United States Patent 10,982,187 (BOS TAURUS VARIETY 'HO840003150607238' AND METHODS OF USE THEREOF) - sequence listing, part 5

SEQ ID NO: 57879 - DNA, 201 bp, Bos taurus; identical to SEQ ID NO: 17205

SEQ ID NO: 57880 - DNA, 201 bp, Bos taurus; identical to SEQ ID NO: 17207

SEQ ID NO: 57881 - DNA, 201 bp, Bos taurus
aagcttctatgtcctttgcatacagtaatacttttatattgtggaaaatagtgaccttttccaaatgggcgagtgccctttatgtgacatctggacctccaggatgtcgtgagaaggcagtttactgcccacgaggaatgcacataatgtgtcacatgtgaaaacaaaacaaaacaaaaaagctgctagtgagaggctgta

SEQ ID NO: 57882 - DNA, 201 bp, Bos taurus; identical to SEQ ID NO: 17208

SEQ ID NO: 57883 - DNA, 201 bp, Bos taurus
gcctactagacattatttttttaataagacagtttactttggcaacttctcctcctccttaaaagtactgttttttttcaatctctatatctctatgaactactcagattttttggcccattaaattttcaaagtttaacaagtgagcaggaaacacacccttccataccctgagttaagctagtacaaggaaccacagaa

SEQ ID NO: 57884 - DNA, 201 bp, Bos taurus
atgacttttactttgaaaactaggataggcctgagcaaaccaatacaatggtcatcttagtatggaggtgcagggattgacatgattaacaggctcccagatgatgttgggccttgcgggtggctcagatggtaaagaatctgcctgcaatgaagaagacctgggttcaattcctgggttgggaagatcccctggagaagg

SEQ ID NO: 57885 - DNA, 201 bp, Bos taurus; identical to SEQ ID NO: 17209

SEQ ID NO: 57886 - DNA, 201 bp, Bos taurus; identical to SEQ ID NO: 17210

SEQ ID NO: 57887 - DNA, 201 bp, Bos taurus; identical to SEQ ID NO: 17211

SEQ ID NO: 57888 - DNA, 201 bp, Bos taurus; identical to SEQ ID NO: 17212

SEQ ID NO: 57889 - DNA, 201 bp, Bos taurus; identical to SEQ ID NO: 17213

SEQ ID NO: 57890 - DNA, 201 bp, Bos taurus; identical to SEQ ID NO: 17214

SEQ ID NO: 57891 - DNA, 201 bp, Bos taurus; identical to SEQ ID NO: 17215

SEQ ID NO: 57892 - DNA, 201 bp, Bos taurus; identical to SEQ ID NO: 17216

SEQ ID NO: 57893 - DNA, 201 bp, Bos taurus; identical to SEQ ID NO: 17217

SEQ ID NO: 57894 - DNA, 201 bp, Bos taurus; identical to SEQ ID NO: 17218

SEQ ID NO: 57895 - DNA, 201 bp, Bos taurus; identical to SEQ ID NO: 17219

SEQ ID NO: 57896 - DNA, 201 bp, Bos taurus; identical to SEQ ID NO: 17220

SEQ ID NO: 57897 - DNA, 201 bp, Bos taurus; identical to SEQ ID NO: 17221

SEQ ID NO: 57898 - DNA, 201 bp, Bos taurus; identical to SEQ ID NO: 17222

SEQ ID NO: 57899 - DNA, 201 bp, Bos taurus; identical to SEQ ID NO: 17223

SEQ ID NO: 57900 - DNA, 201 bp, Bos taurus
atttctttaaaatctagtcaccaggaaggatgggcctatgccttgcagcctctgtcggaagacagaatcctaacttggacaactgtcatccatgagaagcatctggcctatttggtatttgcactgaccaaccttcacttccctcactctactgagacccctgctaaccccttccctactccctcattcttcttttacaat

SEQ ID NO: 57901 - DNA, 201 bp, Bos taurus; identical to SEQ ID NO: 17224

SEQ ID NO: 57902 - DNA, 201 bp, Bos taurus; identical to SEQ ID NO: 17225

SEQ ID NO: 57903 - DNA, 201 bp, Bos taurus; identical to SEQ ID NO: 17226

SEQ ID NO: 57904 - DNA, 201 bp, Bos taurus
caaaaatagttacatgaaaagaaaattacctaatttatatttcccgaagagtatcctgcatatttaaaaactttagcattctcttatgtagggtttccctggttgctcagatggtaaagcatttgcctgcaatgcaggagacccggggttcaatccctgggttgggaagatcccgtggggaagaaaatggcaacccactcc

SEQ ID NO: 57905 - DNA, 201 bp, Bos taurus
tagtacaatatgccaggtaaaaagtttagcagttttacaaatataaatagttctaaatggctcttctagccaaaattatcaccactcagtgagtacaattcctccatctctcataggtgcactaaattttcatgttttattggcaagagtgacagtactctaattcctgtgcactcattatcagcttagtgcaaatcaatc

SEQ ID NO: 57906 - DNA, 201 bp, Bos taurus; identical to SEQ ID NO: 17228

SEQ ID NO: 57907 - DNA, 201 bp, Bos taurus
caaaatccactagagccatatgttacctcttccaaattgaaaacacttcatcatgccagatacaaattgagtgtattgtgcttcccaagtttgcttttatgttttctgaaagtcaagttcatctggtggttatattctgacagcagagcttcttgtattcccatgtggcattgtatagacatcatagatttacagtgtgtt

SEQ ID NO: 57908 - DNA, 201 bp, Bos taurus
aagggaagtcgctcagtcatgtccgactcctagcgaccccatggactgcagcccaccaggctcctctgtccaccggattttctagaaagagtactggagtggggtgccatcattatgcacctattatcataaaaatgacagtaatggatttcagttcagtttagttcagtcactcagttgtgtccaactctttgcgacccc

SEQ ID NO: 57909 - DNA, 201 bp, Bos taurus; identical to SEQ ID NO: 17229

SEQ ID NO: 57910 - DNA, 201 bp, Bos taurus
gtgagatgaaagcaacaatatgcttcatcataagacatggaggtacaacctggctgccaatggaatcaaaagaagttgctttcactgtctctcgggaaaaacctgtagtgagccaagttctgcagaggagctatgggcagggctgttataaaatgaccagaacctgtccctgacaatttagggagaggcaaaatacttgtg

SEQ ID NO: 57911 - DNA, 201 bp, Bos taurus
agaatagcccattaatttccattggaaacattccagtgaatagcaagagtttgtgatgctttctttttttgttttttctgtagtaatgtctgagctccacgaaatcaagaggtgaaatatggaatcgtgtgctttaaaaaaacatgtgctacagaggcaaatctggcctcagtcctgaattccatagacagccccttattg

SEQ ID NO: 57912 - DNA, 201 bp, Bos taurus
tctccagaggatcttcccaagtggttattaaccaattttgcattcctgtgataaactgatcagttattgtgttagctttttaattgttgtaccaaacctaagctaacacagaataactgattggtttatcacaggaatgcaagactgcttaataattcaatagcaatccaggttactcatcatactaaaataaaaagggga

SEQ ID NO: 57913 - DNA, 201 bp, Bos taurus
tgtatcacggaggttgagaaatgaaatgcaggaggaaggtgagatttttgctttaagacatggcttactttacctcactatcaatggagggagaaaggaacgcacatgggatctttgaccatcactttacccgctgctatggtttcagagaatgtttatgccgtcttagagttaagaattcaggactgcccagcacgagaa

SEQ ID NO: 57914 - DNA, 201 bp, Bos taurus
gtaggatgcatacgtagcaaatgttatgagccggttcatttaactcctgtttctaactttcattcctacttaaccaaattttaagataaaatctgcattcgcatttgcttttggaacgtgactttctgaatgagactcacaaaattcttttcaagtgagaatgacaaactttgtgagaagaaaggtttgttcttttatact

SEQ ID NO: 57915 - DNA, 201 bp, Bos taurus
tgtgccagctaataatcttaccctcaccaggtggaaagaaggctactttctctctctggaaataaacactcacctggcccaggagccctgctcatgttcagtcatgagccctgtacactagaaagtcttcctttaacaatggctcgagtcttggccattctgtagggtagggaatggatgaaattccaaatcaaagtgctt

SEQ ID NO: 57916 - DNA, 201 bp, Bos taurus
ttgtcatcccactggaccttaacggtgcaaaaacagttaagagaaatttgaggaatagttaagaatgactaaaggaaattaacatacacatttccattaatagtcccttacatccaccaggtaattgatctttcttgctgaacgtgggttaggtcagcaatagaacagtacattggatgaatagggatctgtacaaattgg

SEQ ID NO: 57917 - DNA, 201 bp, Bos taurus
agacagaatcacaaactttcacagtcaagctaagccagttcaagactttaaactctgagtggtcttcaaaatgcattgaaaaaaactgtttccaaagatacgtgtcaaataaagatgtagggtacaggtaaactcgtaccctattagaatgtaaattggacagatcttcccggaaagcagtctggcaacatacaccaaaaa

SEQ ID NO: 57918 - DNA, 201 bp, Bos taurus
agtaattgccgtgcgagggcttggttgccccacagcatgcagatctcagttccttgaccagggatcaaactcatgtcccactggaccaccagggacgttcccatgctgacagattaaacgcaagttattaaagagaaacatgagtctccctaacgtaggtattttggattatgtatctgagagaaaaagagctgtctttac

SEQ ID NO: 57919 - DNA, 201 bp, Bos taurus
gattctctaggccagagtactggaatgggttgccattgccttctccagccctctgtcttagagaaggtaaaaagagatgagagaaacatgcaactcaagattgacttctgggccacaaagaggaatcagcatgaacttttagaaaggaagatgggttgagaagcatgtgaaactctcaaatacatcacagtatctgtcata

SEQ ID NO: 57920 - DNA, 201 bp, Bos taurus; identical to SEQ ID NO: 17230

SEQ ID NO: 57921 - DNA, 201 bp, Bos taurus
tatggaagaataagccattgcacaagactagaatatttcactctcacccagtaattggttggctctttctaattaaattatcagatgtttttattgagcagactactgaaagcagtgaccactaatgagacacagttccccagaacagatggcagttcagctgtcttgagtgttgcaaaatgcccaagaatcgggccacac

SEQ ID NO: 57922 - DNA, 201 bp, Bos taurus; identical to SEQ ID NO: 17231

SEQ ID NO: 57923 - DNA, 201 bp, Bos taurus; identical to SEQ ID NO: 17233

SEQ ID NO: 57924 - DNA, 201 bp, Bos taurus; identical to SEQ ID NO: 17235

SEQ ID NO: 57925 - DNA, 201 bp, Bos taurus; identical to SEQ ID NO: 17236

SEQ ID NO: 57926 - DNA, 201 bp, Bos taurus
caaaacaaccacagaaacctttccaactccagcacattaatcctaggttcacagtggatacaaactaaccacagaggcttctccaactctggcctagaactcttgatgtatggctgtgtcctcaactgaccttaggtagcagggagcctgttcagttcagttcagtcgttcagttgtgtctgactctttgtgattccatga

SEQ ID NO: 57927 - DNA, 201 bp, Bos taurus
agtctagtcgccatccatcactatactgttgaccctgttcacccacccttcaaatcccttcccctctggtttatgctctttatgagtttttattttaatatctattttgaaatataattttgaaatcatataaatacttgctttgagaggccataatgttgaacagatgtagcttaaggtatagtttaacaataatcttat

SEQ ID NO: 57928 - DNA, 201 bp, Bos taurus
tatatgtgctaaattttaatctttatatccctgatgaaccatgcatgtcatacttttagctttcaaaattgaattaaaccccatatcataagaaaatttctatgacatattgttcacagctttctttctctttatctttagctcctaaaacacaagggttttaatgtttacttttttcactaacaattaatcttgatggaa

SEQ ID NO: 57929 - DNA, 201 bp, Bos taurus
aagattcaaggtctatatgtattctgacttcagaattcaacagaaactgatttttcaaatgccttaatattaatagtactgtccaatgtagcttccttttattatctctttacatatgttttcaccaaaagcctcaagaatgctttcaaaagcacacagaagtgccctgatgaaaaataactttattttcagttcagttac

SEQ ID NO: 57930 - DNA, 201 bp, Bos taurus
ttgttgtaaagagcaaggtttgggtgcatgtaacccatttagttatcgggtcataagcaatcgtttcctgaccagttagtgcctgtctttcccccatgatgagtgccttataaatgctgcactcggtgttttatggctttactgcctacccatttagagaatactgtcattcattcaaatgcacactgcaaacattgtaga

SEQ ID NO: 57931 - DNA, 201 bp, Bos taurus
tgggatgggaatagaaataataaaaaaagtgagtattatagtaaagacaggaatatcatcagcacatgagttttgaaaaatagatgaataaataaaacaagtaatgctcagaagagtaatacgttttatgaaggttaaaagaggatagagtgcaaaaaggaaaataatccaataatatactacagaaaaaaactgtctgca

SEQ ID NO: 57932 - DNA, 201 bp, Bos taurus
atcatatagtaaatgcttacaaaaatatgtttttgggtgaatggttttgtaaatatagaagaaatttctgataaaatttctgattctaaggcttgaaggatataatatttgtgaagttactgctatcatagcaggggttcaataaatggtagcttgcttctccccaggagccctctgaattattttcccaactctgctctg

SEQ ID NO: 57933 - DNA, 201 bp, Bos taurus; identical to SEQ ID NO: 17237

SEQ ID NO: 57934 - DNA, 201 bp, Bos taurus; identical to SEQ ID NO: 17238

SEQ ID NO: 57935 - DNA, 201 bp, Bos taurus; identical to SEQ ID NO: 17239

SEQ ID NO: 57936 - DNA, 201 bp, Bos taurus
accaaatcaaaaggggatactattgatgagatttgggggtgtgattgttatctatggagtggtttataaactgatacatttttaaaaggatcacatcaacgtgcagtgaaaaggaaatagacaatataaattaatattatttttgacccatgcacttctataagcaaacaaaataatgaaaaaaaaaaaaaagaaaaaaca

SEQ ID NO: 57937 - DNA, 201 bp, Bos taurus; identical to SEQ ID NO: 17240

SEQ ID NO: 57938 - DNA, 201 bp, Bos taurus
agaagaaaggttataataaagagtaattcatgtataaatgtaaatgaccattcacattcagataaaatcaaattgattgatttccttggaacaggtaatacattgaaaagaaatagtacaatttgagagttagggatatgtcaggccattgttcactatttgcactaatttaaaattttaaattttactccaaaagttttg

SEQ ID NO: 57939 - DNA, 201 bp, Bos taurus
cctggcgtgccacagtccatggagtcgcaaacagtcggacacgactgaccgactgaactgaactgaactgaatttaacagaagcatgtttttaaaagttattgaaaactgtattatctggccaaagcagttcttcggccctggggtaataaataagttatgacttcctagtgtctcactgaactaccaaagtgtaatcgtg

SEQ ID NO: 57940 - DNA, 201 bp, Bos taurus
caccagagcagtgaactagaacagcagacgtgggaacagaatacagacgtcttccatttgaagtccttaccacgtggatgctttacttgctgtatagcccgttgttacttttgattcacatgccagtgttctctgccttgtcacctgccgcatgtgcatgacctgttctaaggacatcagtgggctccttgtgccctaggg

SEQ ID NO: 57941 - DNA, 201 bp, Bos taurus; identical to SEQ ID NO: 17241

SEQ ID NO: 57942 - DNA, 201 bp, Bos taurus
atattatgttaattaacatcataaaatatagagcttgcaaaatatcactgcttcaatattactttttcttcctggagaccttctaacttaaaaaaattctagtatttatatctcattgatttacctgatttagtctgtcaaaggtatgtgaaatagctggtctcacttttgcccacagaaaactgtgtagcatccataaat

SEQ ID NO: 57943 - DNA, 201 bp, Bos taurus
cattacctccaccgtagtttggtctcaggtcaaacaacagggagggaacacagccctgaccaaaaccagaaaatttaattgaatttaagatttactgaacctggccctgtccatcagaacaggaaccagtttacgcctcagtcagtctctccaatcaggaagctttcgtaagcctcttatcacctccagcagaaggcagac

SEQ ID NO: 57944 - DNA, 201 bp, Bos taurus; identical to SEQ ID NO: 17242

SEQ ID NO: 57945 - DNA, 201 bp, Bos taurus; identical to SEQ ID NO: 17244

SEQ ID NO: 57946 - DNA, 201 bp, Bos taurus; identical to SEQ ID NO: 17245

SEQ ID NO: 57947 - DNA, 201 bp, Bos taurus; identical to SEQ ID NO: 17246

SEQ ID NO: 57948 - DNA, 201 bp, Bos taurus
tttgctttcaaggaccatggactcaaggctgtgtatatgccagacttcagtgaacattcagggcagtcaaagaatttcacagaagtttggcaaagcaacagtctaatgctaaatatttaagaatgtgttcttaaaagtacctcaaacatttcttcctccaaaaagttctccctgatcgtcactttaactcaagtcacaact

SEQ ID NO: 57949 - DNA, 201 bp, Bos taurus
ctggggcctcagcattgctctttatttctagcagactggacttttgacagtaacagtaactgggccagccgtggtaaacaaaggtctattctgtcaggcccatgcctattttcttgccattgctatagtgaacactcctgtctggtgcctactgtattggcactggggtggccagtggtagatgtcatcctacctggtagg

SEQ ID NO: 57950 - DNA, 201 bp, Bos taurus
atgtacgccagattaataaaaatactcaatgtttggtgtccctgatatttcatatctttgcagctcctgaactaaggccagtatgttttctttgaggttttaaattcattccctgcaccccaaccccccaaattttaaagtgatgtgccttgactgtgattcataaattgacagaaatggccttcatcaagtagattgctt

SEQ ID NO: 57951 - DNA, 201 bp, Bos taurus; identical to SEQ ID NO: 17248

SEQ ID NO: 57952 - DNA, 201 bp, Bos taurus; identical to SEQ ID NO: 17249

SEQ ID NO: 57953 - DNA, 201 bp, Bos taurus; identical to SEQ ID NO: 17250

SEQ ID NO: 57954 - DNA, 201 bp, Bos taurus
cactcatttaaataaaaaacactttagagaggacattcaatgtgctttatagtaattaggctataaaacataaaaaaacactctaagggcttaaagtccagtgatatgtagaaatataaacaggtcatttaatgaaatatagaaaatgttaacaccaaggtacttacaaagaactttgaaagcattaagggctacttgatt

SEQ ID NO: 57955 - DNA, 201 bp, Bos taurus; identical to SEQ ID NO: 17251

SEQ ID NO: 57956 - DNA, 201 bp, Bos taurus
gatccaagatcatggattgaagagagaagcaaaggagccaggtactggatttcccatgaagatattttgctgattcctggacttggaaggacatgaggaacaaagccaagtaaaaagtaacaacaacagcaaaaaaaggtaaagcagaattttcagcagtcatttgttgctaaggaaacaaaaactggaattcaggaccct

SEQ ID NO: 57957 - DNA, 201 bp, Bos taurus
aataagtcactgatgactctacctgcaagattttgttatactcagagaagcaaattaacttaagttatatactgtgcaaagccagtgatttttgtaacatcgagattggtatttaatattaactttatacctcagttatttgggtgtactattctcagaagacaatttgtatcaggtgtttcttcttattttaatgcacac

SEQ ID NO: 57958 - DNA, 201 bp, Bos taurus
cttcatagtctcaaagtgaattttattttgaatgaaaatgctcaaaatgaaaacttctctgagtttagtatatattagaatttctggattcagttcaatcctagtcaaccgctttcagtagcaaatagagaagaaagcaacttgtttgctctttcttgttgagtgagaatgttgtcattcaatggaaaaaatgcaaaagcc

SEQ ID NO: 57959 - DNA, 201 bp, Bos taurus
tactcagatatctagattatattttattgtgatatctgattgtaacatatttgctgatttatgaatatttttgaattatgcagtgtcctggttttttttgttcacatcatgtacttattatgtttattagcttctttgttaataaacctattttccttcttcacttagactctcatctgagtgaattgcactttcaatatt

SEQ ID NO: 57960 - DNA, 201 bp, Bos taurus; identical to SEQ ID NO: 17252

SEQ ID NO: 57961 - DNA, 201 bp, Bos taurus; identical to SEQ ID NO: 17253

SEQ ID NO: 57962 - DNA, 201 bp, Bos taurus; identical to SEQ ID NO: 17254

SEQ ID NO: 57963 - DNA, 201 bp, Bos taurus
tgtttaggatcaccatgtgtctataacagttccactaaccttcatgttgtgttctttctaaatgatactcctggatttgtaaaatgtggtggccttgatctacattaactacagaaacttaaattcagactgaaattactgggttcctaattcatgcttaaggttgtttatctctctaccagccctgactaaaatctattc

SEQ ID NO: 57964 - DNA, 201 bp, Bos taurus
tatccacattgaaattctcagaacctatgaatgaggctttatttggagaaaacaaaaattttttggtagatgcatttaagttaagatctcaggatgagattatcctggcctatccactaaacccaagtatccttgtaagagacatacaaagaaagatatacacaaaggagaaggtcatgtcaagaagaaggtcaatttgga

SEQ ID NO: 57965 - DNA, 201 bp, Bos taurus
cttatatcattattccttgtttcccggggtccatataatttggtaacatctttggcaatatcttctcagctgaaatggatgctggtcaaaaaatatcttccaggctaaaaaaagcaggtaggtgggaaagattaaaatgacatctctctttcagcataggcagcctcatttaaaggattcctttaaatagttttatttaat

SEQ ID NO: 57966 - DNA, 201 bp, Bos taurus; identical to SEQ ID NO: 17255

SEQ ID NO: 57967 - DNA, 201 bp, Bos taurus; identical to SEQ ID NO: 17256

SEQ ID NO: 57968 - DNA, 201 bp, Bos taurus; identical to SEQ ID NO: 17257

SEQ ID NO: 57969 - DNA, 201 bp, Bos taurus
gagctataattacaattcaccattcaaataaagaaatttagctcctttgataaacaccttattaatatcaatactgaatttctcactggctttattttcattgttgtcaaaactgacaaatgcaatagtacatgcattcaagaatttagcaaatgtgcagtcagaattttgtctcagagttaagttttatgagtcattttg

SEQ ID NO: 57970 - DNA, 201 bp, Bos taurus; identical to SEQ ID NO: 17258

SEQ ID NO: 57971 - DNA, 201 bp, Bos taurus
gaagtctgggctgtgtagtttcaggtggaggccagcacagatttatagactcatctctcccatgacctttgattggagtgtgtgacacctgcagtctcgtaggggccccacactcagaaggaccatgtgcttgtttcagggctgtactttgtttttcttttaagtacatatatttttgatgtgggccaaattttttttctt

SEQ ID NO: 57972 - DNA, 201 bp, Bos taurus
tggccaccaagttaccctggaatccggtcttcccataataaactgggtgtttcgtgtgtgaccaagtttatgatgggaagctcaggttacatggtaacttaatggcctagagcaagttgtttctcaaaaggagaaaagattcaagttagtgagcatagtaacagtccatcatcaaacagaatttgtatgtattgagattgg

SEQ ID NO: 57973 - DNA, 201 bp, Bos taurus; identical to SEQ ID NO: 17259

SEQ ID NO: 57974 - DNA, 201 bp, Bos taurus; identical to SEQ ID NO: 17260

SEQ ID NO: 57975 - DNA, 201 bp, Bos taurus; identical to SEQ ID NO: 17263

SEQ ID NO: 57976 - DNA, 201 bp, Bos taurus; identical to SEQ ID NO: 17264

SEQ ID NO: 57977 - DNA, 201 bp, Bos taurus; identical to SEQ ID NO: 17265

SEQ ID NO: 57978 - DNA, 201 bp, Bos taurus
ggacgaggtttcattcattcattgttttgggaacacttgttattttgtcttacataggctgggatacccatacattctaaatggatttctttattcaatcgtttattcacttattaaatcaacaaatatttattaaagtagactagggtccagcctgggcttcctgggtggctcagtgagtaaagaatctacctgtgatac

SEQ ID NO: 57979 - DNA, 201 bp, Bos taurus; identical to SEQ ID NO: 17266

SEQ ID NO: 57980 - DNA, 201 bp, Bos taurus; identical to SEQ ID NO: 17267

SEQ ID NO: 57981 - DNA, 201 bp, Bos taurus; identical to SEQ ID NO: 17268

SEQ ID NO: 57982 - DNA, 201 bp, Bos taurus; identical to SEQ ID NO: 17269

SEQ ID NO: 57983 - DNA, 201 bp, Bos taurus
aaagaagcagatgcagaggacattattggagaactatctatgttgagaagcaaggatgactcaggtttttggcttgagcaatggggtagactttagtgtttttttttttttttttaaaacaggtctaggaagagacagacacacttgtacatagtgaagcagaaggagaatgggagggaagactactattttggccatttg

SEQ ID NO: 57984 - DNA, 201 bp, Bos taurus
acaggttttgatgctattaggatatagcttgataggatggtgttccatagggtgcaaagtgatcaatcatctagcagctaagatcactgggtcccatcaagtgatcagaccctcaagggaatggattgcttgtgtctaagaattcaaagtttatatcatacaaataataaaagagcacagatatcaaacacagtaacatgc

SEQ ID NO: 57985 - DNA, 201 bp, Bos taurus
tcacaaactaaaaccagctgtgcataatgtacaaaacatgtcatgaccaagttaggtctatctcaggcatacagtgctggcttacactgaaaaatcaatcgatacaatttgccacattaacattttaaagagaatattgcatcactagctttaatatagaaaaacatctattagaattcaacatccctttatgatttaaaa

SEQ ID NO: 57986 - DNA, 201 bp, Bos taurus; identical to SEQ ID NO: 17270

SEQ ID NO: 57987 - DNA, 201 bp, Bos taurus; identical to SEQ ID NO: 17271

SEQ ID NO: 57988 - DNA, 201 bp, Bos taurus; identical to SEQ ID NO: 17272

SEQ ID NO: 57989 - DNA, 201 bp, Bos taurus
aatcaaatagttctgggtccaaaacataattttttcttttactatttgtgaggctgtgtacagaatgtaatatctccaagagtcttctcatccattacagaaggttgctgatgttatgagggttaaaagaaaacagtgtctgaaaaagtgacagcattaaaatctatgatgactattagcttatagggattacttcatgta

SEQ ID NO: 57990 - DNA, 201 bp, Bos taurus; identical to SEQ ID NO: 17273

SEQ ID NO: 57991 - DNA, 201 bp, Bos taurus; identical to SEQ ID NO: 17274

SEQ ID NO: 57992 - DNA, 201 bp, Bos taurus; identical to SEQ ID NO: 17275

SEQ ID NO: 57993 - DNA, 201 bp, Bos taurus; identical to SEQ ID NO: 17276

SEQ ID NO: 57994 - DNA, 201 bp, Bos taurus; identical to SEQ ID NO: 17277

SEQ ID NO: 57995 - DNA, 201 bp, Bos taurus; identical to SEQ ID NO: 17278

SEQ ID NO: 57996 - DNA, 201 bp, Bos taurus; identical to SEQ ID NO: 17279

SEQ ID NO: 57997 - DNA, 201 bp, Bos taurus; identical to SEQ ID NO: 17280

SEQ ID NO: 57998 - DNA, 201 bp, Bos taurus; identical to SEQ ID NO: 17281

SEQ ID NO: 57999 - DNA, 201 bp, Bos taurus; identical to SEQ ID NO: 17282

SEQ ID NO: 58000 - DNA, 201 bp, Bos taurus; identical to SEQ ID NO: 17283

SEQ ID NO: 58001 - DNA, 201 bp, Bos taurus
ttattgaccatcctgctggcaattggcttgtcctaggtcttcctcttagcatatttccctcaccagggcttgactggcctaataactggtgctgtcttggtttgatgccccctgtgtgcccatagcatggaagctaagctcctacgggtgccctcactggctgccagccatgtctgttgactctctttacactgggcctgg

SEQ ID NO: 58002 - DNA, 201 bp, Bos taurus; identical to SEQ ID NO: 17284

SEQ ID NO: 58003 - DNA, 201 bp, Bos taurus; identical to SEQ ID NO: 17285

SEQ ID NO: 58004 - DNA, 201 bp, Bos taurus; identical to SEQ ID NO: 17286

SEQ ID NO: 58005 - DNA, 201 bp, Bos taurus; identical to SEQ ID NO: 17287

SEQ ID NO: 58006 - DNA, 201 bp, Bos taurus; identical to SEQ ID NO: 17288

SEQ ID NO: 58007 - DNA, 201 bp, Bos taurus; identical to SEQ ID NO: 17289

SEQ ID NO: 58008 - DNA, 201 bp, Bos taurus; identical to SEQ ID NO: 17290

SEQ ID NO: 58009 - DNA, 201 bp, Bos taurus; identical to SEQ ID NO: 17291

SEQ ID NO: 58010 - DNA, 201 bp, Bos taurus
acaacttcgaacaaatttgacaaagtgattatcaggcttctgttttaagtttaaaacagaatagtccaaatagaggccagaattaaaggaagaggattttatttcatctcaccaaacttccctccttatttacagaagattcccgttctattgtcattaaaacaaaagggaaagaattaaaaaagggaagtgttggtgaaa

SEQ ID NO: 58011 - DNA, 201 bp, Bos taurus
aatttcaggctgtgtgtagcccagccaggcccagaaatttgagttatttgagcatgatactaacatctaccacaaagacagaatagtgtaaggcataccctaggcccttaaacatcatccttttgttatttggttgagtaacaatgaagagagtttaaggtgtgagtgaaatgctatccactgtttccgtgataggatttc

SEQ ID NO: 58012 - DNA, 201 bp, Bos taurus
ttcatagtaatttaaaatgaacattaagttctatacaatgagaaattgcccaagaagaaaaaatattgtattaacacaaaaggaaaagatcctatctcctgtatttctacacatatatttagggcacacacacatccctgaaagcataaagtttatgttgcaactgtaatctctggtgtattatgtaatgcctccaatctt

SEQ ID NO: 58013 - DNA, 201 bp, Bos taurus; identical to SEQ ID NO: 17292

SEQ ID NO: 58014 - DNA, 201 bp, Bos taurus; identical to SEQ ID NO: 17293

SEQ ID NO: 58015 - DNA, 201 bp, Bos taurus; identical to SEQ ID NO: 17294

SEQ ID NO: 58016 - DNA, 201 bp, Bos taurus; identical to SEQ ID NO: 17295

SEQ ID NO: 58017 - DNA, 201 bp, Bos taurus; identical to SEQ ID NO: 17296

SEQ ID NO: 58018 - DNA, 201 bp, Bos taurus
cagcaaacaggtagttcagaaagcacacaaaaattttgcgaagaggaccacagaaaaaaacttgtgaggggttgtatcaagagacaaaactcactgcagaagaggtaaaaatgagagaataagataacaggaaaatatggaaacttggatggagaccaaggatatcaggctgtgaatttcacaagtgtccacaggtttgcc

SEQ ID NO: 58019 - DNA, 201 bp, Bos taurus
cattatgttaatttaaagaaaaagtatcattaatatatctatttcagaaacaaattgtggattttcctccttttgtctccccatgcagattattaattctgtataatagaaatataagtgtacacagaattttttacaacacattttacaagcagattttcacatcccaaaagaaaatatgactttaaatttaattcttac

SEQ ID NO: 58020 - DNA, 201 bp, Bos taurus
tccaaccctattctagttaaggttacctccctttcctttattttgcattattaaataagcttctctattgtaatcctcatcacattgcattctaattgcttgtctatatctttctgcagttggtagctattgtatgaggtttgttgagtgtgaaacaaatgcacagagtagaagataatctgagaagctgacatgaggcca

SEQ ID NO: 58021 - DNA, 201 bp, Bos taurus
ggctttcctggaaatataataactggagtttagcaggaaatacttgggcaggatgctgctgtttctgctataggcactgtcactaggagacaagagaggaatccttggcttccacagtgtaagaagaggtatcctgttgcatcgacaccgcatgtggtgggggtgcctcaaacgaggagggaagtagggcgctggcaggca

SEQ ID NO: 58022 - DNA, 201 bp, Bos taurus; identical to SEQ ID NO: 17297

SEQ ID NO: 58023 - DNA, 201 bp, Bos taurus; identical to SEQ ID NO: 17298

SEQ ID NO: 58024 - DNA, 201 bp, Bos taurus
tgcaactgtaattattttgaagactttgttaaatgtcaggccaggtaaaaatatgattataatagtccccccttatccacagagggtatgttccagcacccctagtaaatgcctggaaacataaggattcctatgcatatttttattatacatacattaccatgatataatttaatttgtaaattagacacaataagagat

SEQ ID NO: 58025 - DNA, 201 bp, Bos taurus; identical to SEQ ID NO: 17299

SEQ ID NO: 58026 - DNA, 201 bp, Bos taurus
tgatggacagggaggcctggcgtgctgtggttcatgggatcgcaaagagttggacacgactgagtgactgaactgaactgaaggttatacagcaagaagcagcaaaactgaaacctcaaccagggccttctggcccaagaattcacgttctcacctaatacacagtgctgttctcttggtacactaccaccaccctgcaaa

SEQ ID NO: 58027 - DNA, 201 bp, Bos taurus; identical to SEQ ID NO: 17300

SEQ ID NO: 58028 - DNA, 201 bp, Bos taurus; identical to SEQ ID NO: 17301

SEQ ID NO: 58029 - DNA, 201 bp, Bos taurus; identical to SEQ ID NO: 17302

SEQ ID NO: 58030 - DNA, 201 bp, Bos taurus; identical to SEQ ID NO: 17303

SEQ ID NO: 58031 - DNA, 201 bp, Bos taurus; identical to SEQ ID NO: 17304

SEQ ID NO: 58032 - DNA, 201 bp, Bos taurus; identical to SEQ ID NO: 17305

SEQ ID NO: 58033 - DNA, 201 bp, Bos taurus
gatgaaataaaaattcacattttaaggcaagaaagaaaaatttaagcataaaatatttttctccctatttgggcctcctccctccctgccagtgtgcatcatgaatctgcactaagcattaaccagacctccccaatggcagaaatacctgctcaaccataaagatcattttttcttcttctggcgccagccctgtaactc

SEQ ID NO: 58034 - DNA, 201 bp, Bos taurus; identical to SEQ ID NO: 17306

SEQ ID NO: 58035 - DNA, 201 bp, Bos taurus; identical to SEQ ID NO: 17307

SEQ ID NO: 58036 - DNA, 201 bp, Bos taurus; identical to SEQ ID NO: 17308

SEQ ID NO: 58037 - DNA, 201 bp, Bos taurus; identical to SEQ ID NO: 17309

SEQ ID NO: 58038 - DNA, 201 bp, Bos taurus; identical to SEQ ID NO: 17310

SEQ ID NO: 58039 - DNA, 201 bp, Bos taurus; identical to SEQ ID NO: 17311

SEQ ID NO: 58040 - DNA, 201 bp, Bos taurus; identical to SEQ ID NO: 17312

SEQ ID NO: 58041 - DNA, 201 bp, Bos taurus; identical to SEQ ID NO: 17313

SEQ ID NO: 58042 - DNA, 201 bp, Bos taurus
gggttgcaatttccttctctacctgtattatatttttctaaagattacctaatacctgtgtttctcaaagtatgtcatgttacatagaaagcaatgttgaggacttccatggtggtacaatggataagaattcacctactaatgcagggagcacaggtttgatctctggtctgggaagattccatatgtcacagggcaact

SEQ ID NO: 58043 - DNA, 201 bp, Bos taurus
cataacagatttcaattttatcttttgattttcttcctcttgtggtacttctatatttttcaatcatactatctcttatattggcttcatctttttttgtgtcttttcagtttcacatattcttactttgtcttcatatgcttttgctaaaatttttgccagtgtctattcctcatctgcattcttgagtctctcagtaat

SEQ ID NO: 58044 - DNA, 201 bp, Bos taurus
gagtaaacaaataccttgggtcttcaaagagaggaaaagaggccaggttgaaagagaaggaatggggagagaaaagaggtctaagagcaggggagagaaaaagaaaaaagaatggccttacacatgtctcctgccacctgcagatacccagatgttacaggacttttccctggcttccagaggaggactagaacttggccc

SEQ ID NO: 58045 - DNA, 201 bp, Bos taurus
gaaaccaactggatctaaagctatgctgtttttccttaaaggtgcttttgagtttcataaaaatgtctcaggtttgagaatttcctgtgtcaacattttatgaaatgtttagaaaatgatgatttcagcaacagtccccaaagaaccaaagcaacaatattaggaagggattgaatttgacatgtttgtctttaatcctaa

SEQ ID NO: 58046 - DNA, 201 bp, Bos taurus
taaattgttaaatacagagttcttgcaaatgttccaaccaacgttgtgttcaataagtgttagatattattttatgataaaacaacatattttagattaacgtatttgcttgccagtgtccaaaatacaagaattgtttgtgatattgaatgtaatactgacaacaagtatttatcctctctgctttatttttaattttac

SEQ ID NO: 58047 - DNA, 201 bp, Bos taurus; identical to SEQ ID NO: 17314

SEQ ID NO: 58048 - DNA, 201 bp, Bos taurus
aacatgtactctctcctctaaaattttagtgtcacaaaggactgtatattatgttttgtgaaatgagtgtttcacttccatgcacatatatgccaataaatcatactttaacatggttgtaattcttattagcatataaaaatttaccagcagtatgtatgcagagatgcccataagtacacagtagattacatgaccaaa

SEQ ID NO: 58049 - DNA, 201 bp, Bos taurus
gttatagcaaaactccaaatgtcttttatagtgcattttctcatttttgcttccattttgacttagaagtatacttggtgtactttaatgattgagttctagctgagagatttagttctctaattttgaggtaggagatagatgggcccctgggctgaacacctggtatatgtccagtgtagtaaaattcaagccttgttg

SEQ ID NO: 58050 - DNA, 201 bp, Bos taurus; identical to SEQ ID NO: 17315

SEQ ID NO: 58051 - DNA, 201 bp, Bos taurus; identical to SEQ ID NO: 17316

SEQ ID NO: 58052 - DNA, 201 bp, Bos taurus; identical to SEQ ID NO: 17317

SEQ ID NO: 58053 - DNA, 201 bp, Bos taurus; identical to SEQ ID NO: 17318

SEQ ID NO: 58054 - DNA, 201 bp, Bos taurus; identical to SEQ ID NO: 17319

SEQ ID NO: 58055 - DNA, 201 bp, Bos taurus; identical to SEQ ID NO: 17320

SEQ ID NO: 58056 - DNA, 201 bp, Bos taurus; identical to SEQ ID NO: 17321

SEQ ID NO: 58057 - DNA, 201 bp, Bos taurus; identical to SEQ ID NO: 17322

SEQ ID NO: 58058 - DNA, 201 bp, Bos taurus; identical to SEQ ID NO: 17323

SEQ ID NO: 58059 - DNA, 201 bp, Bos taurus; identical to SEQ ID NO: 17324

SEQ ID NO: 58060 - DNA, 201 bp, Bos taurus; identical to SEQ ID NO: 17325

SEQ ID NO: 58061 - DNA, 201 bp, Bos taurus; identical to SEQ ID NO: 17326

SEQ ID NO: 58062 - DNA, 201 bp, Bos taurus; identical to SEQ ID NO: 17328

SEQ ID NO: 58063 - DNA, 201 bp, Bos taurus; identical to SEQ ID NO: 17329

SEQ ID NO: 58064 - DNA, 201 bp, Bos taurus; identical to SEQ ID NO: 17330

SEQ ID NO: 58065 - DNA, 201 bp, Bos taurus; identical to SEQ ID NO: 17331

SEQ ID NO: 58066 - DNA, 201 bp, Bos taurus; identical to SEQ ID NO: 17332

SEQ ID NO: 58067 - DNA, 201 bp, Bos taurus; identical to SEQ ID NO: 17333

SEQ ID NO: 58068 - DNA, 201 bp, Bos taurus; identical to SEQ ID NO: 17334

SEQ ID NO: 58069 - DNA, 201 bp, Bos taurus; identical to SEQ ID NO: 17335

SEQ ID NO: 58070 - DNA, 201 bp, Bos taurus; identical to SEQ ID NO: 17336

SEQ ID NO: 58071 - DNA, 201 bp, Bos taurus; identical to SEQ ID NO: 17338

SEQ ID NO: 58072 - DNA, 201 bp, Bos taurus
caacatcagcagcaagtgaagataattcccacattaaaatacatacatacagataaggttgaaactttacttcacatggaattttggcctctcaggaaaagtttgtgtattccttcagttcagttcagttccatcgctcagtcatctctgactctttgcgaccccatgaatcacagcacgccaggcctccctgtccatcac

SEQ ID NO: 58073 - DNA, 201 bp, Bos taurus; identical to SEQ ID NO: 17339

SEQ ID NO: 58074 - DNA, 201 bp, Bos taurus; identical to SEQ ID NO: 17341

SEQ ID NO: 58075 - DNA, 201 bp, Bos taurus; identical to SEQ ID NO: 17342

SEQ ID NO: 58076 - DNA, 201 bp, Bos taurus; identical to SEQ ID NO: 17343

SEQ ID NO: 58077 - DNA, 201 bp, Bos taurus; identical to SEQ ID NO: 17345

SEQ ID NO: 58078 - DNA, 201 bp, Bos taurus; identical to SEQ ID NO: 17348

SEQ ID NO: 58079 - DNA, 201 bp, Bos taurus
tccctatttgaagagtgactacaaagagtcatgaattgatacatagctcaagtgtgtccagtagaagtggacaaggggatttaaaagtccacttagaattcttgaaccctgataacctgacagtgatgcagcggtgcagttttacttgcacaaaatcatttgtccaagtggtacatctttttgtaattcatctccccaatt

SEQ ID NO: 58080 - DNA, 201 bp, Bos taurus; identical to SEQ ID NO: 17349

SEQ ID NO: 58081 - DNA, 201 bp, Bos taurus; identical to SEQ ID NO: 17350

SEQ ID NO: 58082 - DNA, 201 bp, Bos taurus; identical to SEQ ID NO: 17351

SEQ ID NO: 58083 - DNA, 201 bp, Bos taurus; identical to SEQ ID NO: 17352

SEQ ID NO: 58084 - DNA, 201 bp, Bos taurus; identical to SEQ ID NO: 17355

SEQ ID NO: 58085 - DNA, 201 bp, Bos taurus; identical to SEQ ID NO: 17357

SEQ ID NO: 58086 - DNA, 201 bp, Bos taurus
ctgaatcttttcattttctcagttatgtaagaagcaaggtcatccactgaaagtgaaggtgagtaagaagtattggagggttaggaaataagaggagtatgaagtctttaaggtgatagaagaatgggaggattggaaagtatagttttattagtttaaagtatcaggagcccatttacagttcctggtcatggtttcaag

SEQ ID NO: 58087 - DNA, 201 bp, Bos taurus
acagtggccattttaaaaagcatgaggtgaaaactaattgtgatttttgacttgcatttccctaaatgtgatacctagtgatgctgagcacctttcatagacttgttggccatttgtacgtcttccttggagaactctttattccaggtctttgtccgcttttaaatcagattatctcttcttgttgctgtgcattatagg

SEQ ID NO: 58088 - DNA, 201 bp, Bos taurus
cacccagtagccctatatatgtcaaatcatgtcacttctctgtccaaaccatacactgagttccttcttgtctgacaataaaatccaaagtctctcacatagccaacatggacctacttgattttgtagtcaacttcctctcaggtctaaggtttcaccacttcattcctggatcactctgtttcagccacagtggcctcc

SEQ ID NO: 58089 - DNA, 201 bp, Bos taurus
gaattaaaagtataaaataaaagacaagatggttatttacctctttcagttccattgtaaattatctatttcccttgtagtagaaaaccaatgtgaggcttattaatctttgttgaactactttgcaggacctccgtctgcaccgagaaatgtgatatctaatataaacgagacctcggttatcctggactggagttggcc

SEQ ID NO: 58090 - DNA, 201 bp, Bos taurus; identical to SEQ ID NO: 17358

SEQ ID NO: 58091 - DNA, 201 bp, Bos taurus
tgaatgaaaagttttgtcttgtatcacattgcccatggcaaattaacacctatttgatttttagaagataaaaccaaatgaaaacttatctcaggcattatatgttaaggaatcttattttacgtaataatttattccatattttttctctgtgattctgccaagttaatgccagaaatattctactaccactttgtctta

SEQ ID NO: 58092 - DNA, 201 bp, Bos taurus
agatactaaataaacaacttatattatactatcacctattcttaagtgatctgatgctagaaaataaagttataagcaagtttaagacataattttccttaaaaaggcttatgatcggtttcaaaagagagaaatgcacaattgataaatattaattagttttattttataatttataatttcatgtgttaaaagctagta

SEQ ID NO: 58093 - DNA, 201 bp, Bos taurus; identical to SEQ ID NO: 17359

SEQ ID NO: 58094 - DNA, 201 bp, Bos taurus; identical to SEQ ID NO: 17360

SEQ ID NO: 58095 - DNA, 201 bp, Bos taurus; identical to SEQ ID NO: 17361

SEQ ID NO: 58096 - DNA, 201 bp, Bos taurus; identical to SEQ ID NO: 17362

SEQ ID NO: 58097 - DNA, 201 bp, Bos taurus
aattaaaccaacacaaacgtctgtaatacagtataaaatacaacaattgggacaagaagagtctaaataaagtgaaaagccaaaggcaataaaagtgcatttagatatcagtccagaaagaaaggccttacatgtagctagttgagacacggacatgataaagtacgtactccatttacttcattgaacattctttagatc

SEQ ID NO: 58098 - DNA, 201 bp, Bos taurus
cacactgtgtatacaacttggcctaagtaaaataactcggctgacccatatttacatttcactgctagtgtcctaaacacaacgaggatgggcccggtggctggtcttggcacacagcacgatgtttgtgtctttcttccctgggtgccccagacgttagcttcatttctgattggcattagcatctgcagctgtttctgc

SEQ ID NO: 58099 - DNA, 201 bp, Bos taurus
ctgatgggggggtcatgctcagtaaatctttaatccaattttctgttgatgggcagggctgcgtccctccctattgtttgacctgaggccaagatatggcggagttaatgaggaaaatggttcttcaaaaggtcccatgcatgcattactgcactgagtgcccccaatcctgcagcaggccaccaccaacccatgcctctg

SEQ ID NO: 58100 - DNA, 201 bp, Bos taurus; identical to SEQ ID NO: 17363

SEQ ID NO: 58101 - DNA, 201 bp, Bos taurus; identical to SEQ ID NO: 17364

SEQ ID NO: 58102 - DNA, 201 bp, Bos taurus
gttatttagggaaatgcacagtctgtcctcatttttgatagacattaaaatacaaattagctaataatcagtaaccatttatactccctttggagtctttgtgtgaaagtattagtcactcagtcatgtctacctctttgagatcctgcggactgtagccctccaggctcctctgtccatggaattctccagggaagaata

SEQ ID NO: 58103 - DNA, 201 bp, Bos taurus; identical to SEQ ID NO: 17367

SEQ ID NO: 58104 - DNA, 201 bp, Bos taurus; identical to SEQ ID NO: 17368

SEQ ID NO: 58105 - DNA, 201 bp, Bos taurus
tggtcactcattggatcaaagcagcccaaagacctatcactttccatttctctgtgccaggttattatagaaaataacccagatgtagttggattgtaaggcaaatagtcaattttgtttccttaaaaaggaggccaaaaaatatttgttcttgtttataaattcaggtgaaaggaaaatggtgtacatctctgaggctca

SEQ ID NO: 58106 - DNA, 201 bp, Bos taurus; identical to SEQ ID NO: 17371

SEQ ID NO: 58107 - DNA, 201 bp, Bos taurus; identical to SEQ ID NO: 17372

SEQ ID NO: 58108 - DNA, 201 bp, Bos taurus
ttcttataaccagatagcagttgaattgtgtaccgaatgctgaggttagaggcagaatttgtattccagtcatagaaatttatacgtatattccatctttataattttaaaagaagattgacattaacttccgtatatagttcacatcctacacagctgagtctgtatgaagccctgtgtaaatttaagaactaagaatat

SEQ ID NO: 58109 - DNA, 201 bp, Bos taurus
tcctgaaaactcagtggaggagtcagatatgtggataaaaacagtctttctgcactttaatgatttaataagccatctgaaaaaaaaaaaaaaaaagaacgtataaagtattatggcagcaaaaaaagggggatgggatttaatctgcctgtttgaaaatggaaaagcttctgagattataatatttaactgtatgttgaa

SEQ ID NO: 58110 - DNA, 201 bp, Bos taurus; identical to SEQ ID NO: 17377

SEQ ID NO: 58111 - DNA, 201 bp, Bos taurus; identical to SEQ ID NO: 17378

SEQ ID NO: 58112 - DNA, 201 bp, Bos taurus; identical to SEQ ID NO: 17379

SEQ ID NO: 58113 - DNA, 201 bp, Bos taurus; identical to SEQ ID NO: 17380

SEQ ID NO: 58114 - DNA, 201 bp, Bos taurus; identical to SEQ ID NO: 17382

SEQ ID NO: 58115 - DNA, 201 bp, Bos taurus; identical to SEQ ID NO: 17385

SEQ ID NO: 58116 - DNA, 201 bp, Bos taurus; identical to SEQ ID NO: 17386

SEQ ID NO: 58117 - DNA, 201 bp, Bos taurus; identical to SEQ ID NO: 17387

SEQ ID NO: 58118 - DNA, 201 bp, Bos taurus
atatttgccctgtgctgtcactgttgatttctcaggactcaagttcctcattattcttcaaagcacagcgtgtgcagggtggctatatatatattttttttcccataaatgtcagtaattgaagatattttaagggaattacatcacaaagaagcaatacttagaatgtgcccatgtaatgaggtcctgacccttcctggc

SEQ ID NO: 58119 - DNA, 201 bp, Bos taurus; identical to SEQ ID NO: 17388

SEQ ID NO: 58120 - DNA, 201 bp, Bos taurus; identical to SEQ ID NO: 17390

SEQ ID NO: 58121 - DNA, 201 bp, Bos taurus; identical to SEQ ID NO: 17391

SEQ ID NO: 58122 - DNA, 201 bp, Bos taurus; identical to SEQ ID NO: 17392

SEQ ID NO: 58123 - DNA, 201 bp, Bos taurus; identical to SEQ ID NO: 17393

SEQ ID NO: 58124 - DNA, 201 bp, Bos taurus; identical to SEQ ID NO: 17394

SEQ ID NO: 58125 - DNA, 201 bp, Bos taurus
ttaaaggaagcatgtagattcttaactgactcaccctggaagtgacaaatgccacagtctactgctcagaactggaaatgtgattctgatcaaatggtgaagtggctgggaaaagtgtggaagagtacacagatatttgataagtactaatgatcttttccacactcttgatgtttgatactttgaaattacctatttaaa

SEQ ID NO: 58126 - DNA, 201 bp, Bos taurus
ctgccactcctggagccattgctagagaagtggcccacgggattctaaagatggttagtgctgttgtgaaatgttacaacaaagggtgaaaggcccaggatacacctaggcatttacatttccaagtagagcctgtttggcttttgtgtgacccaagccatggctcaggctgagctggattcttgccaaggtgggccatcc

SEQ ID NO: 58127 - DNA, 201 bp, Bos taurus; identical to SEQ ID NO: 17398

SEQ ID NO: 58128 - DNA, 201 bp, Bos taurus; identical to SEQ ID NO: 17400

SEQ ID NO: 58129 - DNA, 201 bp, Bos taurus; identical to SEQ ID NO: 17405

SEQ ID NO: 58130 - DNA, 201 bp, Bos taurus; identical to SEQ ID NO: 17407

SEQ ID NO: 58131 - DNA, 201 bp, Bos taurus; identical to SEQ ID NO: 17410

SEQ ID NO: 58132 - DNA, 201 bp, Bos taurus; identical to SEQ ID NO: 17411

SEQ ID NO: 58133 - DNA, 201 bp, Bos taurus; identical to SEQ ID NO: 17412

SEQ ID NO: 58134 - DNA, 201 bp, Bos taurus; identical to SEQ ID NO: 17413

SEQ ID NO: 58135 - DNA, 201 bp, Bos taurus; identical to SEQ ID NO: 17416

SEQ ID NO: 58136 - DNA, 201 bp, Bos taurus; identical to SEQ ID NO: 17418

SEQ ID NO: 58137 - DNA, 201 bp, Bos taurus; identical to SEQ ID NO: 17419

SEQ ID NO: 58138 - DNA, 201 bp, Bos taurus; identical to SEQ ID NO: 17420

SEQ ID NO: 58139 - DNA, 201 bp, Bos taurus; identical to SEQ ID NO: 17424

SEQ ID NO: 58140 - DNA, 201 bp, Bos taurus; identical to SEQ ID NO: 17427

SEQ ID NO: 58141 - DNA, 201 bp, Bos taurus; identical to SEQ ID NO: 17428

SEQ ID NO: 58142 - DNA, 201 bp, Bos taurus; identical to SEQ ID NO: 17433

SEQ ID NO: 58143 - DNA, 201 bp, Bos taurus; identical to SEQ ID NO: 17434

SEQ ID NO: 58144 - DNA, 201 bp, Bos taurus; identical to SEQ ID NO: 17435

SEQ ID NO: 58145 - DNA, 201 bp, Bos taurus; identical to SEQ ID NO: 17437

SEQ ID NO: 58146 - DNA, 201 bp, Bos taurus; identical to SEQ ID NO: 17439

SEQ ID NO: 58147 - DNA, 201 bp, Bos taurus; identical to SEQ ID NO: 17441

SEQ ID NO: 58148 - DNA, 201 bp, Bos taurus; identical to SEQ ID NO: 17443

SEQ ID NO: 58149 - DNA, 201 bp, Bos taurus; identical to SEQ ID NO: 17445

SEQ ID NO: 58150 - DNA, 201 bp, Bos taurus; identical to SEQ ID NO: 17446

SEQ ID NO: 58151 - DNA, 201 bp, Bos taurus; identical to SEQ ID NO: 17448

SEQ ID NO: 58152 - DNA, 201 bp, Bos taurus; identical to SEQ ID NO: 17454

SEQ ID NO: 58153 - DNA, 201 bp, Bos taurus; identical to SEQ ID NO: 17457

SEQ ID NO: 58154 - DNA, 201 bp, Bos taurus; identical to SEQ ID NO: 17458

SEQ ID NO: 58155 - DNA, 201 bp, Bos taurus; identical to SEQ ID NO: 17465

SEQ ID NO: 58156 - DNA, 201 bp, Bos taurus; identical to SEQ ID NO: 17466

SEQ ID NO: 58157 - DNA, 201 bp, Bos taurus; identical to SEQ ID NO: 17467

SEQ ID NO: 58158 - DNA, 201 bp, Bos taurus; identical to SEQ ID NO: 17468

SEQ ID NO: 58159 - DNA, 201 bp, Bos taurus; identical to SEQ ID NO: 17471

SEQ ID NO: 58160 - DNA, 201 bp, Bos taurus; identical to SEQ ID NO: 17474

SEQ ID NO: 58161 - DNA, 201 bp, Bos taurus; identical to SEQ ID NO: 17475

SEQ ID NO: 58162 - DNA, 201 bp, Bos taurus; identical to SEQ ID NO: 17476

SEQ ID NO: 58163 - DNA, 201 bp, Bos taurus; identical to SEQ ID NO: 17478

SEQ ID NO: 58164 - DNA, 201 bp, Bos taurus; identical to SEQ ID NO: 17479

SEQ ID NO: 58165 - DNA, 201 bp, Bos taurus; identical to SEQ ID NO: 17480

SEQ ID NO: 58166 - DNA, 201 bp, Bos taurus; identical to SEQ ID NO: 17481

SEQ ID NO: 58167 - DNA, 201 bp, Bos taurus; identical to SEQ ID NO: 17486

SEQ ID NO: 58168 - DNA, 201 bp, Bos taurus; identical to SEQ ID NO: 17487

SEQ ID NO: 58169 - DNA, 201 bp, Bos taurus; identical to SEQ ID NO: 17491

SEQ ID NO: 58170 - DNA, 201 bp, Bos taurus; identical to SEQ ID NO: 17492

SEQ ID NO: 58171 - DNA, 201 bp, Bos taurus; identical to SEQ ID NO: 17495

SEQ ID NO: 58172 - DNA, 201 bp, Bos taurus; identical to SEQ ID NO: 17496

SEQ ID NO: 58173 - DNA, 201 bp, Bos taurus; identical to SEQ ID NO: 17498

SEQ ID NO: 58174 - DNA, 201 bp, Bos taurus; identical to SEQ ID NO: 17499

SEQ ID NO: 58175 - DNA, 201 bp, Bos taurus; identical to SEQ ID NO: 17503

SEQ ID NO: 58176 - DNA, 201 bp, Bos taurus; identical to SEQ ID NO: 17506

SEQ ID NO: 58177 - DNA, 201 bp, Bos taurus; identical to SEQ ID NO: 17507

SEQ ID NO: 58178 - DNA, 201 bp, Bos taurus; identical to SEQ ID NO: 17510

SEQ ID NO: 58179 - DNA, 201 bp, Bos taurus; identical to SEQ ID NO: 17511

SEQ ID NO: 58180 - DNA, 201 bp, Bos taurus; identical to SEQ ID NO: 17512

SEQ ID NO: 58181 - DNA, 201 bp, Bos taurus; identical to SEQ ID NO: 17513

SEQ ID NO: 58182 - DNA, 201 bp, Bos taurus; identical to SEQ ID NO: 17515

SEQ ID NO: 58183 - DNA, 201 bp, Bos taurus; identical to SEQ ID NO: 17518

SEQ ID NO: 58184 - DNA, 201 bp, Bos taurus; identical to SEQ ID NO: 17520

SEQ ID NO: 58185 - DNA, 201 bp, Bos taurus; identical to SEQ ID NO: 17521

SEQ ID NO: 58186 - DNA, 201 bp, Bos taurus; identical to SEQ ID NO: 17522

SEQ ID NO: 58187 - DNA, 201 bp, Bos taurus; identical to SEQ ID NO: 17524

SEQ ID NO: 58188 - DNA, 201 bp, Bos taurus; identical to SEQ ID NO: 17526

SEQ ID NO: 58189 - DNA, 201 bp, Bos taurus; identical to SEQ ID NO: 17527

SEQ ID NO: 58190 - DNA, 201 bp, Bos taurus; identical to SEQ ID NO: 17529

SEQ ID NO: 58191 - DNA, 201 bp, Bos taurus; identical to SEQ ID NO: 17530

SEQ ID NO: 58192 - DNA, 201 bp, Bos taurus; identical to SEQ ID NO: 17531

SEQ ID NO: 58193 - DNA, 201 bp, Bos taurus; identical to SEQ ID NO: 17534

SEQ ID NO: 58194 - DNA, 201 bp, Bos taurus; identical to SEQ ID NO: 17535

SEQ ID NO: 58195 - DNA, 201 bp, Bos taurus; identical to SEQ ID NO: 17536

SEQ ID NO: 58196 - DNA, 201 bp, Bos taurus; identical to SEQ ID NO: 17539

SEQ ID NO: 58197 - DNA, 201 bp, Bos taurus; identical to SEQ ID NO: 17540

SEQ ID NO: 58198 - DNA, 201 bp, Bos taurus; identical to SEQ ID NO: 17541

SEQ ID NO: 58199 - DNA, 201 bp, Bos taurus; identical to SEQ ID NO: 17542

SEQ ID NO: 58200 - DNA, 201 bp, Bos taurus; identical to SEQ ID NO: 17543

SEQ ID NO: 58201 - DNA, 201 bp, Bos taurus; identical to SEQ ID NO: 17544

SEQ ID NO: 58202 - DNA, 201 bp, Bos taurus; identical to SEQ ID NO: 17545

SEQ ID NO: 58203 - DNA, 201 bp, Bos taurus; identical to SEQ ID NO: 17548

SEQ ID NO: 58204 - DNA, 201 bp, Bos taurus; identical to SEQ ID NO: 17550

SEQ ID NO: 58205 - DNA, 201 bp, Bos taurus; identical to SEQ ID NO: 17551

SEQ ID NO: 58206 - DNA, 201 bp, Bos taurus; identical to SEQ ID NO: 17556

SEQ ID NO: 58207 - DNA, 201 bp, Bos taurus; identical to SEQ ID NO: 17557

SEQ ID NO: 58208 - DNA, 201 bp, Bos taurus
tgatagtaattttcaatccgtgtgccctttggccaggaaattctacttcaaggaatctgtcctacctaaatattcatatatgacagtctttacaacatcaatggttgtaatggcctgaaaagggaagataaacatccattagtagaaagtgattcaatcacttacagtaatccatattaccatatgccactgtgaaaaaga

SEQ ID NO: 58209 - DNA, 201 bp, Bos taurus
gcagggttatttagcttttttgtgaggtaattcaacctcaatgctaattcaaccattgaacccagagatttgcccgcgttggctcacagaaacctaaggttctgttaatggcacttaggaaacgatgtggcataagggagacctaagcaattggctcgacaggtagatgagggttccggaataggaggccgagccccagct

SEQ ID NO: 58210 - DNA, 201 bp, Bos taurus
ggtcacaagtcacctctggggcttttccccctaatatggattggcagccgcctttccctttgctggctaaagtccccagccctcccagggaaacctcctcgttgttgtccagcaggccactctctcctgtctccaggacctgctggaagcctgtccacatccatctcagccaactccaggatccgcaatgcccgggagtct

SEQ ID NO: 58211 - DNA, 201 bp, Bos taurus
atggtgtccactgggcatgcctggtatcagagcagcgggagtcctggtctctctccctcaaaagactccatgcttctggccccatgtctagcccaggcatgcaggggaactcggaaaacaccaccgaagggaactgagccaaacagaatggacccggccacctcctgggccagctactctgacctctgaccttgcccactg

SEQ ID NO: 58212 - DNA, 201 bp, Bos taurus
tgagacaggctggggacattcaagaggaggcccccatcttcacggcaaccacaggaataaatgatggagagcaagatggctgtgttcagactacaaacacatgtgtgggtcacagaggccaagacgggctctaggaagtggtgaggtttgtgtggggaggtgcaagtttcagacagaagtgacagtcctggaaaaatcctg

SEQ ID NO: 58213 - DNA, 201 bp, Bos taurus
aaattgtggtaagtcaagtaaaaatgcactctcctgatttttttttgctgaaatatcaccataagtaactcaaaagaaaagtaggctcttctttattctgagaaagggatatttaaagttcctttcagtgctgcctttcagtgtttgcaaaaggtaaaaattcagttcacttactattgcaatttctttctgcagatatgc

SEQ ID NO: 58214 - DNA, 201 bp, Bos taurus
tttataaggccacaagtcatagtggattacagcccacccaactccagtctgacctcaactaattctaccttcattgacactatttctttaaaaaaaaagttacattctcaggtactggccattaaggttgcaacatacctttttggaagaacagaactcaacccataacagccccctaacatagaattatccagcccaaaa

SEQ ID NO: 58215 - DNA, 201 bp, Bos taurus; identical to SEQ ID NO: 17560

SEQ ID NO: 58216 - DNA, 201 bp, Bos taurus; identical to SEQ ID NO: 17561

SEQ ID NO: 58217 - DNA, 201 bp, Bos taurus; identical to SEQ ID NO: 17562

SEQ ID NO: 58218 - DNA, 201 bp, Bos taurus
tgaccttctcacacgcagggaccacatcagagcatggcaagtgtgaaagggagtctcagatatgccctgtgggagggtgggggagggcctggcacatcgatctctaggaacctgagaaaagctgacaccccacccaacagccttagaggacatgggttgggccacccaaaggcaggctgccttgttcaactcagcttgtcc

SEQ ID NO: 58219 - DNA, 201 bp, Bos taurus
atgtcccaggattcatgattatggcactcagccacactcaccctgttaaggggcagtctagaaagccccaaactcagctttgagactactcaggccctggcgaaagttcacccccaaaggggatgggaagctgcattcccacgcaggtatcacaggaggttcattagccaagactaaggccataagcacagacagagccca

SEQ ID NO: 58220 - DNA, 201 bp, Bos taurus; identical to SEQ ID NO: 17563

SEQ ID NO: 58221 - DNA, 201 bp, Bos taurus; identical to SEQ ID NO: 17564

SEQ ID NO: 58222 - DNA, 201 bp, Bos taurus; identical to SEQ ID NO: 17565

SEQ ID NO: 58223 - DNA, 201 bp, Bos taurus; identical to SEQ ID NO: 17566

SEQ ID NO: 58224 - DNA, 201 bp, Bos taurus; identical to SEQ ID NO: 17567

SEQ ID NO: 58225 - DNA, 201 bp, Bos taurus; identical to SEQ ID NO: 17568

SEQ ID NO: 58226 - DNA, 201 bp, Bos taurus
agcctaagatgaggctggccaccagagcaggtggtctgaagacccccactgcgtcctccccagtcctcaagtcccagtgctccaggcccctcaaccctacactcctgggggcaggaggcagccactcctgagaacagctcaaagaactgccctgtgtggtcagggctgggggagacccaggggcccctcccctgaagaagt

SEQ ID NO: 58227 - DNA, 201 bp, Bos taurus
gggtcaacaatttgatgccaaagtttctaccctgaacccctgtacgaactctgggatctcttcacaccttggaagagcctgctacagagctggtttttcagctccaacacagaggccttcatcattttcagtctgcctggatttcagtgtcttctaattggctcttgtaccaagccaatcttggttttccaacaacttggt

SEQ ID NO: 58228 - DNA, 201 bp, Bos taurus
caggcagattctttaacatctgagccactagttaaaataaaatatcaaacataccgtttgggaacatggttcttcatgacatatacatcttgaatactttgcagtattgtatatatgcaggcctacacatatgttttaatgagtatgtactattccatcacatgacccaatcactattgggtcattcccaatacagttgga

SEQ ID NO: 58229 - DNA, 201 bp, Bos taurus
tctcaaaactgtcaaaggtcatcaaaaccaaagaatatctgagaaactgtcatagccaagaaaagactaagaagagacatgtaatatggtaccctatatacgatcctagactggaaaaatgacattaggtaaaaactaaagaaactggaataatatatgcacttcagttaataaagcataaatattggttcattgattgtg

SEQ ID NO: 58230 - DNA, 201 bp, Bos taurus; identical to SEQ ID NO: 17569

SEQ ID NO: 58231 - DNA, 201 bp, Bos taurus
gagggaggagcaagctgtctggcttcctgagctccttgcctctccagggacatcattttcagattagattaccaattacctctgttcaaaggcctctggcgctctcttacacatcgtcctgtcccattcacttgtgatcctctgcctggaaaggatgagaacagaggcaccacccttgcagtctggcctgtaatggcctac

SEQ ID NO: 58232 - DNA, 201 bp, Bos taurus; identical to SEQ ID NO: 17570

SEQ ID NO: 58233 - DNA, 201 bp, Bos taurus
gcttaacacaccctcctggcctagcgccatcctcctggtggcccctcaattccacctttcctgtctctcctccctttgttacttctcaggcacccagtctgctggctctcaactaatgcaggccagtttcctgagagaatacatgcttcccttaggaagacatcccagaatggggagagtgtgggctaaagagggaaaatt

SEQ ID NO: 58234 - DNA, 201 bp, Bos taurus
tttgccttcaaaagatcatctatttttaagccattaattagtatataaacagatggcacaacaactaagagatcttttttagagtcagaggttttggtgtgtattcaattagaaccccaaatggtatgcttctttgttcacacattaacaaaagttattgcatccaaaatttagttacaataattaaaatatctactgaca

SEQ ID NO: 58235 - DNA, 201 bp, Bos taurus; identical to SEQ ID NO: 17571

SEQ ID NO: 58236 - DNA, 201 bp, Bos taurus
tctttgcgtctcgggcctcccaggcctcctctcaaatgaagatttaacccctactgccctgggagaggtgaggatcaagtgccacctcgtgtactgcaggtagccctgtgctgctgtggccgttgttgtgtgtccggtctcacaacactcttctactctgctgacttctgggaactcagccctggcgggccctgtagccat

SEQ ID NO: 58237 - DNA, 201 bp, Bos taurus
ggatgagttgactgcatctccaggcatttttcagatttcattttctagtggccagaccctctccctgtcacactgttgggcagggaggtggaacgtctgaatgcaatgcagaacatgtatagtggcctccaggcgatgctggagccagtgccaggcccctagacttgctgagggtcctcacttcgtgaccagaccctttaa

SEQ ID NO: 58238 - DNA, 201 bp, Bos taurus
tcctgaaggacctgaatcaaaagtgtgatcagtgtcattcagagtctccctccccacatgactatctaagcgggcttacaagtgggtctctagggcctaagggggagaatgtctgaagaaggttgtattggactcaaaacagagaatcatttcattctaggtattggcaggcctgtctgcttctgggagcaaaactgcccc

SEQ ID NO: 58239 - DNA, 201 bp, Bos taurus; identical to SEQ ID NO: 17572

SEQ ID NO: 58240 - DNA, 201 bp, Bos taurus; identical to SEQ ID NO: 17573

SEQ ID NO: 58241 - DNA, 201 bp, Bos taurus; identical to SEQ ID NO: 17574

SEQ ID NO: 58242 - DNA, 201 bp, Bos taurus; identical to SEQ ID NO: 17576

SEQ ID NO: 58243 - DNA, 201 bp, Bos taurus
ttgggattaagtaataaaacatgagacaaagggactcagaattctgagacgaagggctaggttttctcttccttctgaacaaaatgttatcaatgaggaggattcacttctatggagaacctttgggatttccattccaggcaattcagtggtaagaaaagtaagccaagactctctaagtaaaaatctatctatatcctc

SEQ ID NO: 58244 - DNA, 201 bp, Bos taurus; identical to SEQ ID NO: 17577

SEQ ID NO: 58245 - DNA, 201 bp, Bos taurus; identical to SEQ ID NO: 17578

SEQ ID NO: 58246 - DNA, 201 bp, Bos taurus; identical to SEQ ID NO: 17579

SEQ ID NO: 58247 - DNA, 201 bp, Bos taurus; identical to SEQ ID NO: 17580

SEQ ID NO: 58248 - DNA, 201 bp, Bos taurus; identical to SEQ ID NO: 17581

SEQ ID NO: 58249 - DNA, 201 bp, Bos taurus; identical to SEQ ID NO: 17582

SEQ ID NO: 58250 - DNA, 201 bp, Bos taurus; identical to SEQ ID NO: 17583

SEQ ID NO: 58251 - DNA, 201 bp, Bos taurus
caggacaagattcccgtctgatgctggccgctgccacttattctcacaaacagattcttcccttccccattattgtccatcctccctactttgacacaggctgtgattggcctagagtccatttctttcatattttctttagactgctgacccttgcttcctcattagtattcccttcattctgcctagttctaattccct

SEQ ID NO: 58252 - DNA, 201 bp, Bos taurus
tttagaacaaccaatgccaggcagcccacccatggtactgcctttgtgtaagataaaaacatgctagaaggtgtcttctgcatcacccaaaggcagagaggaaaacagagtaaaaaacagagagtaagggtcacatttcatccccattagtaccaaggcattctgctcatgcatagaccaaatggcttttttctccccaat

SEQ ID NO: 58253 - DNA, 201 bp, Bos taurus
taagaggggcaataggtgaaggcatacgtcctgctgcagatcaactttgggagacaaaatttcctgggaattaaggaagaagagcaattaataagtatgtttctcatgtatgtgtagattgcacatcattggtaggtttccttgaaggatgatagaggattaagaatacagactctggatacaaaaagcttgagttcaaac

SEQ ID NO: 58254 - DNA, 201 bp, Bos taurus; identical to SEQ ID NO: 17584

SEQ ID NO: 58255 - DNA, 201 bp, Bos taurus
caagttttatcctcaacatgttttgtttctttacagttgctttaggtttccttatcactttaacatttgcatcaaatagaatcaagacctacatagaaaatgctgtcataatatctgagaaatgagttcttaaaatttttagtcaaggaaagtatgtctccatctacaatatattcagactttcagaactccgtgggcagc

SEQ ID NO: 58256 - DNA, 201 bp, Bos taurus
gtctctagccattgccaattttcccctggaggaaatatctgctcccagttgagaaccatacatatatagtgtggaactataaagtctatggtcaagaaatagatttggaaatcacctttgaggtaattgttaaatcttaaataatggtggaaattctgcagaagcatgtttaaggtaaaaataaataaataagaagccaaa

SEQ ID NO: 58257 - DNA, 201 bp, Bos taurus; identical to SEQ ID NO: 17586

SEQ ID NO: 58258 - DNA, 201 bp, Bos taurus; identical to SEQ ID NO: 17587

SEQ ID NO: 58259 - DNA, 201 bp, Bos taurus; identical to SEQ ID NO: 17588

SEQ ID NO: 58260 - DNA, 201 bp, Bos taurus; identical to SEQ ID NO: 17597

SEQ ID NO: 58261 - DNA, 201 bp, Bos taurus; identical to SEQ ID NO: 17599

SEQ ID NO: 58262 - DNA, 201 bp, Bos taurus; identical to SEQ ID NO: 17600

SEQ ID NO: 58263 - DNA, 201 bp, Bos taurus; identical to SEQ ID NO: 17602

SEQ ID NO: 58264 - DNA, 201 bp, Bos taurus
ttttgaccaacccagtacttcaggtctgtatctcttcccgcactgatggggagtggggtagcagagagcataccccctctagttacccccatttccaaggcagaagaatttactaattgtccagagccaggacattcaataatcccagtttacttgtggcctggcttaccctgccttatacagcagcatgttgtgatgtgt

SEQ ID NO: 58265 - DNA, 201 bp, Bos taurus; identical to SEQ ID NO: 17606

SEQ ID NO: 58266 - DNA, 201 bp, Bos taurus; identical to SEQ ID NO: 17607

SEQ ID NO: 58267 - DNA, 201 bp, Bos taurus; identical to SEQ ID NO: 17609

SEQ ID NO: 58268 - DNA, 201 bp, Bos taurus
ccacacctgcgagagggcagggccactctaggaggagattgaagaagagcatccttagacagaagagtcccagagagaaagctggtcttcactgacagggtgaaaggaagtgaggccatggattcacatcagggtaggctgcccctcaccccagaatttagaccccaaaaacaagatcttcagctaggctctaggtggagg

SEQ ID NO: 58269 - DNA, 201 bp, Bos taurus; identical to SEQ ID NO: 17611

SEQ ID NO: 58270 - DNA, 201 bp, Bos taurus
ctgttttcagtaagaatccaaatgttccgaacctatatatgtgaagggcacacttaatttttattgctgttcatggagcaagaaggtccactcttagtttattataagtatcttatgtatctcaaatctgaatcaaatgtataataacctttaacctgatcattgttcttttatgcataaaccttcataaatggcctagtt

SEQ ID NO: 58271 - DNA, 201 bp, Bos taurus
ggcctggcaccctctaggcctttaatccacggttcataattcctcagcaaagagaagccactggccctccctctctgcctgaggttaggttagaaagtgtgagtgcatgctccctaccctggtgggttcctgggaagcccagagcttggctccgccagggaaagcagcagagatctgagctgcagagggatgtgccttcag

SEQ ID NO: 58272 - DNA, 201 bp, Bos taurus; identical to SEQ ID NO: 17612

SEQ ID NO: 58273 - DNA, 201 bp, Bos taurus
attttatgattaaatattacaatttaacacttaaaacagtagatttgtggccatttgtgcatgtattttactcatcctaatgggctaaagatcaccttttccaaaagtatagtcctcttgagtgaaataagctatgtcttctctgcttaggcatccatgcttaagcaagtgtgccttatttgaaaactgatccaaagttac

SEQ ID NO: 58274 - DNA, 201 bp, Bos taurus; identical to SEQ ID NO: 17613

SEQ ID NO: 58275 - DNA, 201 bp, Bos taurus
ctggtccaaccacttgcgttctggtaccttccggcagctgagctaataaacctgctgggctggaaggtggcaggtgggcaatgttgtgggtgacatggccaggcaggcagattttctgcgaaaggaaggcgtggctttcaggtggggcatctctcaggcagatgccctctgaagaggcttgggggaaaagaggaggggcct

SEQ ID NO: 58276 - DNA, 201 bp, Bos taurus; identical to SEQ ID NO: 17614

SEQ ID NO: 58277 - DNA, 201 bp, Bos taurus; identical to SEQ ID NO: 17615

SEQ ID NO: 58278 - DNA, 201 bp, Bos taurus; identical to SEQ ID NO: 17616

SEQ ID NO: 58279 - DNA, 201 bp, Bos taurus; identical to SEQ ID NO: 17617

SEQ ID NO: 58280 - DNA, 201 bp, Bos taurus; identical to SEQ ID NO: 17619

SEQ ID NO: 58281 - DNA, 201 bp, Bos taurus; identical to SEQ ID NO: 17620

SEQ ID NO: 58282 - DNA, 201 bp, Bos taurus; identical to SEQ ID NO: 17621

SEQ ID NO: 58283 - DNA, 201 bp, Bos taurus; identical to SEQ ID NO: 17622

SEQ ID NO: 58284 - DNA, 201 bp, Bos taurus; identical to SEQ ID NO: 17623

SEQ ID NO: 58285 - DNA, 201 bp, Bos taurus; identical to SEQ ID NO: 17624

SEQ ID NO: 58286 - DNA, 201 bp, Bos taurus
gacaattaccttctatagagttaatcagttgttcagttctccagtacaaactatctctttattattcattttaaacattgaccaattgttggatgataccgtaagaagcaatgtatatttttctgttctctgtatatgaataatttcctattgattggagtattaatagtgctttaaatattctcatgaataagagaatat

SEQ ID NO: 58287 - DNA, 201 bp, Bos taurus; identical to SEQ ID NO: 17625

SEQ ID NO: 58288 - DNA, 201 bp, Bos taurus; identical to SEQ ID NO: 17626

SEQ ID NO: 58289 - DNA, 201 bp, Bos taurus
acactgcctgaagtaagtgataaagactgaattaaccaaaagaagagggtggaggacctagcagacatccaagttgagctaatggtatcttgtctcaagtgttttcctaacacaggtatttcctttgcactaaaattgtgtaatggcacacatgtggaggatactgcttcctcaaattcctttaataagcctctctcagat

SEQ ID NO: 58290 - DNA, 201 bp, Bos taurus; identical to SEQ ID NO: 17630

SEQ ID NO: 58291 - DNA, 201 bp, Bos taurus
cacctgagcctaatcactcagagcaggtggaagtctctgtctctgggaaccgggctttgcatctcaactctgaagaatctaaagtgagtattttcttggtgataaaggccatggactcccagtaacccagtgagtggctcagggctccacatggctgctcatatttcaaagaacacatgttcattgttatccatttacaac

SEQ ID NO: 58292 - DNA, 201 bp, Bos taurus; identical to SEQ ID NO: 17631

SEQ ID NO: 58293 - DNA, 201 bp, Bos taurus
tatagatttcaccaagtagctgcaagcctaccgccaccaagaattatttataagctctctttaagccctccaaccatgcacaatattcctgtttaaaatctgtctaggggttaaaattgtagtgtaatgtgatttttccattagacctgcttctctctagttctgtggagaaagaatgagtctcaaatgggccatttcttt

SEQ ID NO: 58294 - DNA, 201 bp, Bos taurus; identical to SEQ ID NO: 17632

SEQ ID NO: 58295 - DNA, 201 bp, Bos taurus; identical to SEQ ID NO: 17633

SEQ ID NO: 58296 - DNA, 201 bp, Bos taurus; identical to SEQ ID NO: 17634

SEQ ID NO: 58297 - DNA, 201 bp, Bos taurus; identical to SEQ ID NO: 17635

SEQ ID NO: 58298 - DNA, 201 bp, Bos taurus; identical to SEQ ID NO: 17636

SEQ ID NO: 58299 - DNA, 201 bp, Bos taurus; identical to SEQ ID NO: 17637

SEQ ID NO: 58300 - DNA, 201 bp, Bos taurus; identical to SEQ ID NO: 17638

SEQ ID NO: 58301 - DNA, 201 bp, Bos taurus; identical to SEQ ID NO: 17639

SEQ ID NO: 58302 - DNA, 201 bp, Bos taurus; identical to SEQ ID NO: 17640

SEQ ID NO: 58303 - DNA, 201 bp, Bos taurus; identical to SEQ ID NO: 17641

SEQ ID NO: 58304 - DNA, 201 bp, Bos taurus; identical to SEQ ID NO: 17642

SEQ ID NO: 58305 - DNA, 201 bp, Bos taurus; identical to SEQ ID NO: 17644

SEQ ID NO: 58306 - DNA, 201 bp, Bos taurus; identical to SEQ ID NO: 17645

SEQ ID NO: 58307 - DNA, 201 bp, Bos taurus; identical to SEQ ID NO: 17646

SEQ ID NO: 58308 - DNA, 201 bp, Bos taurus; identical to SEQ ID NO: 17647

SEQ ID NO: 58309 - DNA, 201 bp, Bos taurus; identical to SEQ ID NO: 17648

SEQ ID NO: 58310 - DNA, 201 bp, Bos taurus; identical to SEQ ID NO: 17649

SEQ ID NO: 58311 - DNA, 201 bp, Bos taurus; identical to SEQ ID NO: 17650

SEQ ID NO: 58312 - DNA, 201 bp, Bos taurus; identical to SEQ ID NO: 17651

SEQ ID NO: 58313 - DNA, 201 bp, Bos taurus; identical to SEQ ID NO: 17652

SEQ ID NO: 58314 - DNA, 201 bp, Bos taurus; identical to SEQ ID NO: 17653

SEQ ID NO: 58315 - DNA, 201 bp, Bos taurus; identical to SEQ ID NO: 17654

SEQ ID NO: 58316 - DNA, 201 bp, Bos taurus; identical to SEQ ID NO: 17655

SEQ ID NO: 58317 - DNA, 201 bp, Bos taurus; identical to SEQ ID NO: 17656

SEQ ID NO: 58318 - DNA, 201 bp, Bos taurus; identical to SEQ ID NO: 17657

SEQ ID NO: 58319 - DNA, 201 bp, Bos taurus
tatcaagggcatgagtagaaaatagactagaaggaaagcagacccagaagcaacaccagaactgacaggatccctgggtcagtgagcagtggccacacccctcccattatggagtatctggagtgaaaatgagcttctatgttcccttgagacaatcccgcctacagggatgtctgaatgtatggccactgcagtgacact

SEQ ID NO: 58320 - DNA, 201 bp, Bos taurus; identical to SEQ ID NO: 17658

SEQ ID NO: 58321 - DNA, 201 bp, Bos taurus
tatgggcttggcaatctgagtatcctgtaaaatcatctttcttgatcttaaaaaatatgtgagcactagtcagtgtaaaatagaaatccatatactatgcaaagtttatgctatattataaagaatcgaacaataaaaagtgtttttaatatattaaccacacctttataatttctattggatgaattaatttgacagagt

SEQ ID NO: 58322 - DNA, 201 bp, Bos taurus; identical to SEQ ID NO: 17659

SEQ ID NO: 58323 - DNA, 201 bp, Bos taurus
tgactgattattaaacgaattacaaaatgtatcctgtcttggactggctcctttgttaacacttgtgccatattattccttttagaaaaggtttttaattatcttgatatatgccaacatactcatttccaaatacattggactgtacattggatatccttaaaaatagtttcatcactcagtaaattaatattgaataag

SEQ ID NO: 58324 - DNA, 201 bp, Bos taurus
catttgagttttatttttgaaagtaaaaattttaaagaagtgtatgtatatgctctatttcagctgaccctctgtacctgtggatgtactttgccatttcatataagggattcaagcatcctcagattttggtttgggatgaggatggggaggctgtcatggaacacatccctgcagatacttagggacaactacatatgc

SEQ ID NO: 58325 - DNA, 201 bp, Bos taurus; identical to SEQ ID NO: 17660

SEQ ID NO: 58326 - DNA, 201 bp, Bos taurus; identical to SEQ ID NO: 17661

SEQ ID NO: 58327 - DNA, 201 bp, Bos taurus; identical to SEQ ID NO: 17662

SEQ ID NO: 58328 - DNA, 201 bp, Bos taurus; identical to SEQ ID NO: 17663

SEQ ID NO: 58329 - DNA, 201 bp, Bos taurus; identical to SEQ ID NO: 17664

SEQ ID NO: 58330 - DNA, 201 bp, Bos taurus
gaatagcagaggagtgggagtgggggaaaggtgaagaaaaatcagaattaacctttccttgttgtggtgtacatcggcagatagaagagagcagaacagatattaaacttactgccagaaagaaatatttcaaggagactagagagtcattttgtgctcataaatggattaaagaatcatcacaaatactaggtaaaaagt

SEQ ID NO: 58331 - DNA, 201 bp, Bos taurus
tatatctaatgtgtatatgtacacatacctacttttatctatatatgtagcaatatcatatataatgtatttgattcatttatcttggattacttctcattatgcaaaataaattagttctaacttttgctatgaagaaatgcttttttaactgccatgtcagtgtcttcctttaaaattcatagatgtattaaaatctgc

SEQ ID NO: 58332 - DNA, 201 bp, Bos taurus
attctaaaaataagactgctgttgaccccattctttaagaattcagttttatgagatcattttctttctttcaaatgaacattgtaaaaatatgaactagttttcaacttaaattgaaaacaaaatttaggaacatgcaatatattcatattggaaaattcataaaaaagttctttgctttttatgtttaatataaattta

SEQ ID NO: 58333 - DNA, 201 bp, Bos taurus; identical to SEQ ID NO: 17665

SEQ ID NO: 58334 - DNA, 201 bp, Bos taurus; identical to SEQ ID NO: 17666

SEQ ID NO: 58335 - DNA, 201 bp, Bos taurus; identical to SEQ ID NO: 17667

SEQ ID NO: 58336 - DNA, 201 bp, Bos taurus; identical to SEQ ID NO: 17668

SEQ ID NO: 58337 - DNA, 201 bp, Bos taurus; identical to SEQ ID NO: 17669

SEQ ID NO: 58338 - DNA, 201 bp, Bos taurus; identical to SEQ ID NO: 17670

SEQ ID NO: 58339 - DNA, 201 bp, Bos taurus; identical to SEQ ID NO: 17671

SEQ ID NO: 58340 - DNA, 201 bp, Bos taurus; identical to SEQ ID NO: 17672

SEQ ID NO: 58341 - DNA, 201 bp, Bos taurus
gccttaagactctgatcttgaagactcctctaggtccagcttactcctgatattcattgttatttcacatttatttgggtctgcatgatatgtctcaaatatctccagacttggcctttattaagcaagttctacagccaagggtctccacacccaagtagccagcgccagttagcataaacactgtatcaactttcaaaa

SEQ ID NO: 58342 - DNA, 201 bp, Bos taurus; identical to SEQ ID NO: 17674

SEQ ID NO: 58343 - DNA, 201 bp, Bos taurus; identical to SEQ ID NO: 17676

SEQ ID NO: 58344 - DNA, 201 bp, Bos taurus
gggcccagctggggtctacttgatccaggaggatcggggagaaagtcagtgtgattcaggcacgcacagtcattccagacaatgcattcttcagtgatgacgcagtcttgatattatcaaaagaaatgtttatttccccccatctttagagctattttaccagcactgtattgctttcactgagagattaactacaacact

SEQ ID NO: 58345 - DNA, 201 bp, Bos taurus
gggtctcctaaggttgcactgagatgttggcctgatctgccatcatctgaaaggttgaggttggaccagatatgagagccagatggaggctctcgcctggaagcttggccatgttcaggggatgctccagcatcgtggcccttgggatggcaaacttcttagctggtggtcgtcctttgccagaccaagtgttccaatgga

SEQ ID NO: 58346 - DNA, 201 bp, Bos taurus
acagggaggcccggcgtgctgcgattcatggggtcgcaaagagtccgacacgtctgagtgactgaactgatctaatctgacccattggcctttttttttttaattgagcttgcatgagctgttaatgtattttgaagattaatcccttgtcagttgtttcatttgcaaatatattttctcccattctacaggcctttagtt

SEQ ID NO: 58347 - DNA, 201 bp, Bos taurus
gtgccgttttcttctatcctggatgaatggaagaatcgtggagacatttctagggcacagaggacaacatggggtgaattaataaatttgcttctgaaaacgccgagtttaacataatgcaaggacattgctatagagtgcatgtttgtgtcctcccctcaaatttatatgttgaaattctaatgcccactatgatggtct

SEQ ID NO: 58348 - DNA, 201 bp, Bos taurus
ctatacagtaaaattttttacaccctgatttcctagtgccggtggctcaggaaggctatgaaatcttccataacttaaaaggaccatatgttcattgagaaggaattactagaaatgatgaacgtaatttttcttctttgtcatgactcaaaaaccaagttgggtctggggcagggaggtgaggcctggcttcagataagg

SEQ ID NO: 58349 - DNA, 201 bp, Bos taurus; identical to SEQ ID NO: 17678

SEQ ID NO: 58350 - DNA, 201 bp, Bos taurus
ttaccatctgtcctcatcgttaaattggctggcctgtcctctctattcagaactaattcaagggcgccaaggtttcaggagccatggcattcctgggggcacatctctgcagatatcacgagggaaattttctagacttcgtaattcccctgtgcttctcggccaggctcctagtgtaaagaaaagttagataatgggtgt

SEQ ID NO: 58351 - DNA, 201 bp, Bos taurus
cttataaactcttccacggatgatttgaacttttgcgtgactgtctgggattttttttccaaagctccgagcatggccgcctgtggtatcaaggtgttgcgaaacagtatctgtgttgcgcttcctgttttaacctacctcgtttcgttcgtttcgtttcactgttcatcacagcagtgttatctccaggagacatataga

SEQ ID NO: 58352 - DNA, 201 bp, Bos taurus
ctgaaaggccagagagatcaactccttctagagaagtatttttctctgtgtttataatcacttgtgtagtgccccctgagggaggaactggagctccacatggttaattaacttgatcccaatatggctagcaagaggccaacctggaactcaaacccagaccctaaattgtatggtatctctacaacaccatgttgccat

SEQ ID NO: 58353 - DNA, 201 bp, Bos taurus; identical to SEQ ID NO: 17679

SEQ ID NO: 58354 - DNA, 201 bp, Bos taurus
aagagagtgaatgctacggagaggcagtttctgcctgcagagaatgtccaagctgggtctgtggcagatggaacacaggtgggcccagtggcccctctgattgaaggagatgaagtggggaatctgggatagccaaggtagctggtgttcccgggaaagagtgggagagaggagaaagtcgcacacagagaacttcagaca

SEQ ID NO: 58355 - DNA, 201 bp, Bos taurus; identical to SEQ ID NO: 17680

SEQ ID NO: 58356 - DNA, 201 bp, Bos taurus
cattgcctattgttgcagagagtcaatggttggtggcaatggcaacagaaataagcttgttactgttgggctcaggagccctactggtgggcccagggacgcttaattcagcagaagctattcaacccttgtcaatgctgcactgaatatggctgctcaccaggcccattctccagctgtccccaggagaagctcatgact

SEQ ID NO: 58357 - DNA, 201 bp, Bos taurus; identical to SEQ ID NO: 17681

SEQ ID NO: 58358 - DNA, 201 bp, Bos taurus; identical to SEQ ID NO: 17685

SEQ ID NO: 58359 - DNA, 201 bp, Bos taurus; identical to SEQ ID NO: 17686

SEQ ID NO: 58360 - DNA, 201 bp, Bos taurus; identical to SEQ ID NO: 17687

SEQ ID NO: 58361 - DNA, 201 bp, Bos taurus; identical to SEQ ID NO: 17688

SEQ ID NO: 58362 - DNA, 201 bp, Bos taurus; identical to SEQ ID NO: 17689

SEQ ID NO: 58363 - DNA, 201 bp, Bos taurus; identical to SEQ ID NO: 17690

SEQ ID NO: 58364 - DNA, 201 bp, Bos taurus; identical to SEQ ID NO: 17691

SEQ ID NO: 58365 - DNA, 201 bp, Bos taurus; identical to SEQ ID NO: 17693

SEQ ID NO: 58366 - DNA, 201 bp, Bos taurus
tatttcctgcttctcccagaactccttggcttctgaaaattttccctccaagactctgctcctcctccatcaatttgtgtgccttctcctcccccaccagccatccagggcaatccttttgggtttaaaataccagccagtttctcttgcttggaaccaagaatcctaactgacaaaaagttattagaatttctaaaattc

SEQ ID NO: 58367 - DNA, 201 bp, Bos taurus; identical to SEQ ID NO: 17698

SEQ ID NO: 58368 - DNA, 201 bp, Bos taurus; identical to SEQ ID NO: 17699

SEQ ID NO: 58369 - DNA, 201 bp, Bos taurus; identical to SEQ ID NO: 17700

SEQ ID NO: 58370 - DNA, 201 bp, Bos taurus; identical to SEQ ID NO: 17701

SEQ ID NO: 58371 - DNA, 201 bp, Bos taurus; identical to SEQ ID NO: 17702

SEQ ID NO: 58372 - DNA, 201 bp, Bos taurus
gttaatttctactgtacaataaagtgaatcagctatatgtgtgtatatgtatatcccctccctatggagcctccttccccaccatcccactcctctaggtcatcgcggatcatccagttaaattccctgtgctatacagcagcttctaactatctatttcacacatgatagtgtatatatgtcaatgctactcaatttgtc

SEQ ID NO: 58373 - DNA, 201 bp, Bos taurus; identical to SEQ ID NO: 17703

SEQ ID NO: 58374 - DNA, 201 bp, Bos taurus; identical to SEQ ID NO: 17704

SEQ ID NO: 58375 - DNA, 201 bp, Bos taurus; identical to SEQ ID NO: 17705

SEQ ID NO: 58376 - DNA, 201 bp, Bos taurus; identical to SEQ ID NO: 17706

SEQ ID NO: 58377 - DNA, 201 bp, Bos taurus; identical to SEQ ID NO: 17707

SEQ ID NO: 58378 - DNA, 201 bp, Bos taurus; identical to SEQ ID NO: 17708

SEQ ID NO: 58379 - DNA, 201 bp, Bos taurus; identical to SEQ ID NO: 17709

SEQ ID NO: 58380 - DNA, 201 bp, Bos taurus; identical to SEQ ID NO: 17710

SEQ ID NO: 58381 - DNA, 201 bp, Bos taurus; identical to SEQ ID NO: 17711

SEQ ID NO: 58382 - DNA, 201 bp, Bos taurus; identical to SEQ ID NO: 17712

SEQ ID NO: 58383 - DNA, 201 bp, Bos taurus; identical to SEQ ID NO: 17713

SEQ ID NO: 58384 - DNA, 201 bp, Bos taurus; identical to SEQ ID NO: 17714

SEQ ID NO: 58385 - DNA, 201 bp, Bos taurus; identical to SEQ ID NO: 17715

SEQ ID NO: 58386 - DNA, 201 bp, Bos taurus; identical to SEQ ID NO: 17721

SEQ ID NO: 58387 - DNA, 201 bp, Bos taurus; identical to SEQ ID NO: 17723

SEQ ID NO: 58388 - DNA, 201 bp, Bos taurus; identical to SEQ ID NO: 17724

SEQ ID NO: 58389 - DNA, 201 bp, Bos taurus
agcacttgaactggatattgtatacttagtacaaaagagtgctgcatgtgtctaggtgatggcagaatgtcgagagcattaaagaccaattttgagtaagcgccaacccagtgcagctgtggaactgcgcttctggcccaggcagagccacttctacagctggcctagatatttactaaaatttcattaagcattaccagt

SEQ ID NO: 58390 - DNA, 201 bp, Bos taurus
tctgtgggtcagtaaggatatattgtctttaatcaaaaagaataatgaattgaggcacacacagtagcataggctgaaaatctgcagtgaaatttgtcctgccctcatactattaacctaattaccatacaatttaaagttaataataaataacaggcttaaattagaccagactaaagtatgggcaattataccaagaac

SEQ ID NO: 58391 - DNA, 201 bp, Bos taurus
cactaacctcctatttacaattctttgagtaaggtgctttagttaccagcactttggaaatgacaaaactgtgactcagaaaattaaggaatttgcacaaaagcacatagtggagaggaaatgaagatagaattcacactgagctagaccagacctaaagcctgcaatctaatcactgcaaagtaccagctccatagaaca

SEQ ID NO: 58392 - DNA, 201 bp, Bos taurus; identical to SEQ ID NO: 17728

SEQ ID NO: 58393 - DNA, 201 bp, Bos taurus
ttctctgacaccttagcacaggctgcatcactgtgagtacatttcttgtgaactgtgtcaaaggcagcaagtattactatgatacccacattctaggtgccgataaatataaccagtatgatgactatcacagatgagaatcaagctctagaaaaggaagatcattaggttatactctcacctctcttttcctcatatatt

SEQ ID NO: 58394 - DNA, 201 bp, Bos taurus; identical to SEQ ID NO: 17729

SEQ ID NO: 58395 - DNA, 201 bp, Bos taurus
cttcatctgggctcaggttgtctacactctgaagccctcaaaagcctggaatttctgtttttgctgtaacattcctaacaaaagccatggatgtctgttgatcagatagaaaggaagaatacgtgaattcatagctcaaacattcccatcctaacattaggttcattggccttaccctgagtatacctgggtgagtttatc

SEQ ID NO: 58396 - DNA, 201 bp, Bos taurus
actttttaaaatctacagttattacttatatcacagtagatgatacaaatgtgatatatgtaatgtatgtgtgttcatgtgaccaagaactaacagataacgaaaaaaataaatagttgggtttgagcagatttactttcatcttcaagtttgtttaatgttgtttttatacaacattaaacattacacattactacaatg

SEQ ID NO: 58397 - DNA, 201 bp, Bos taurus
atccctaaatcagcttctccaaggaacctgatggaatctgagccagtgccggccaccacccaggccactgcagtgacagccacagacagctcgataacttcactgacggtctatggcaacattctttccactgctgatgggtgggagacggcttgtcacatatggatcatctaccagaaggacatttatctggactctacc

SEQ ID NO: 58398 - DNA, 201 bp, Bos taurus
tgagcgactgaactgaactgaggactaagtcttcagttcttttatcttccaccccactctaccccaccatagatgtcatcaaggcccatgattttagatgatatctattcactgaagacaatcatattttcattttcagccctgacttctctaactaagctctgggccataaatactattatttaaccaacattcacattt

SEQ ID NO: 58399 - DNA, 201 bp, Bos taurus; identical to SEQ ID NO: 17731

SEQ ID NO: 58400 - DNA, 201 bp, Bos taurus; identical to SEQ ID NO: 17732

SEQ ID NO: 58401 - DNA, 201 bp, Bos taurus; identical to SEQ ID NO: 17734

SEQ ID NO: 58402 - DNA, 201 bp, Bos taurus; identical to SEQ ID NO: 17735

SEQ ID NO: 58403 - DNA, 201 bp, Bos taurus; identical to SEQ ID NO: 17736

SEQ ID NO: 58404 - DNA, 201 bp, Bos taurus
ttatgcatataagatctaaactgccatattttacattattatatataaagatctattaagacagatcttctatctcaatctagggggaaaaaaagtgacacatttgatcaaattaaaaatttaggagcaagttctactgttttaggtcatctgcttctgagggaaagaggtctttctttccaggtcctgatttttcatact

SEQ ID NO: 58405 - DNA, 201 bp, Bos taurus; identical to SEQ ID NO: 17737

SEQ ID NO: 58406 - DNA, 201 bp, Bos taurus; identical to SEQ ID NO: 17738

SEQ ID NO: 58407 - DNA, 201 bp, Bos taurus; identical to SEQ ID NO: 17739

SEQ ID NO: 58408 - DNA, 201 bp, Bos taurus; identical to SEQ ID NO: 17742

SEQ ID NO: 58409 - DNA, 201 bp, Bos taurus; identical to SEQ ID NO: 17748

SEQ ID NO: 58410 - DNA, 201 bp, Bos taurus
attttctgaaaatagactcatttccgcagatggatgaaatgagttctcaccagcaaacaatgaaatgtgtcatgtgaaatttcaaggtcccttctaaagaccctgtgattccatgaaaacaaagtggggaaagaaagcaagttgcatgtatgaaattaggtagatggttaaaactaattcattacccttattatttctgaa

SEQ ID NO: 58411 - DNA, 201 bp, Bos taurus; identical to SEQ ID NO: 17749

SEQ ID NO: 58412 - DNA, 201 bp, Bos taurus; identical to SEQ ID NO: 17753

SEQ ID NO: 58413 - DNA, 201 bp, Bos taurus
ggggtagtgtcaggatgattctcatacattacatttggtgcagactttattctaatctaatgccaccactgatctgacaggtgccggaccttggcccagaggttggggacccctgctataaaacataaaatattcaaatgataaattcttaaactctgcaaataaaattaacataatcttctcctttaattttaatttctt

SEQ ID NO: 58414 - DNA, 201 bp, Bos taurus; identical to SEQ ID NO: 17754

SEQ ID NO: 58415 - DNA, 201 bp, Bos taurus; identical to SEQ ID NO: 17756

SEQ ID NO: 58416 - DNA, 201 bp, Bos taurus; identical to SEQ ID NO: 17757

SEQ ID NO: 58417 - DNA, 201 bp, Bos taurus; identical to SEQ ID NO: 17758

SEQ ID NO: 58418 - DNA, 201 bp, Bos taurus; identical to SEQ ID NO: 17759

SEQ ID NO: 58419 - DNA, 201 bp, Bos taurus; identical to SEQ ID NO: 17760

SEQ ID NO: 58420 - DNA, 201 bp, Bos taurus; identical to SEQ ID NO: 17764

SEQ ID NO: 58421 - DNA, 201 bp, Bos taurus
cacatcatttattatgatacaggtatctcaacactcagtctcatctcctagctgataaatcaggtactggaatgcctctcctttctcagaatgataaaaacatgtaaactatggttaaaatgcactttaaagatatgaagcctttggtactttaacaataaaattccctcaggaaaataaaatgctgttttcttcacagta

SEQ ID NO: 58422 - DNA, 201 bp, Bos taurus
taaagacatacacagtgcaatttaaaaattattttccgtggacacagactatctaaataaattaagtgataagtatttataaatggaatctttttcttggaaactcttgatttcatgagaatttctctatgtatattaaatacagtcattgctctgacatgctcaacttaaactcttaagccacttacttgtaaaaagcac

SEQ ID NO: 58423 - DNA, 201 bp, Bos taurus; identical to SEQ ID NO: 17768

SEQ ID NO: 58424 - DNA, 201 bp, Bos taurus; identical to SEQ ID NO: 17769

SEQ ID NO: 58425 - DNA, 201 bp, Bos taurus
acagaaccaacaagccatcaccaaccagaagaatttgggaaaggtcaaaaggagacaccagtccatatggcctaccaacctcccagaatcctcctcactgtaatccatcttgactgagaaatatatgtgctaccaggaaggaccctgagtcagaatgattggccaaagacaatccagaaactaatcccatcaccattaaac

SEQ ID NO: 58426 - DNA, 201 bp, Bos taurus
aagttcctggttttcatctgttcctgaagacaagcaagaactctgtgtctaacagtctcaacttggagcgtccactgagacattctgaaatggttgttgcgtgactcacaggtgaaaaactacaaacaggtaaggaaacagcctttccatgaaataacttcagtgtgtgtgaaaggggcatgagaatggaaaaggagattt

SEQ ID NO: 58427 - DNA, 201 bp, Bos taurus; identical to SEQ ID NO: 17771

SEQ ID NO: 58428 - DNA, 201 bp, Bos taurus; identical to SEQ ID NO: 17776

SEQ ID NO: 58429 - DNA, 201 bp, Bos taurus
ttcctaattgcttgtccctgataatttgggaattcatcttagaatttgatgtatataataacaaggaaaactaagccaaaaataggggacttatagatttaattatccatagttttctttcaactgcacaaggtcacttcatgtccttggttaagcactctgtatctattagaacccaggaataggacaagactcagtctg

SEQ ID NO: 58430 - DNA, 201 bp, Bos taurus; identical to SEQ ID NO: 17777

SEQ ID NO: 58431 - DNA, 201 bp, Bos taurus; identical to SEQ ID NO: 17778

SEQ ID NO: 58432 - DNA, 201 bp, Bos taurus; identical to SEQ ID NO: 17779

SEQ ID NO: 58433 - DNA, 201 bp, Bos taurus; identical to SEQ ID NO: 17780

SEQ ID NO: 58434 - DNA, 201 bp, Bos taurus; identical to SEQ ID NO: 17781

SEQ ID NO: 58435 - DNA, 201 bp, Bos taurus; identical to SEQ ID NO: 17782

SEQ ID NO: 58436 - DNA, 201 bp, Bos taurus; identical to SEQ ID NO: 17783

SEQ ID NO: 58437 - DNA, 201 bp, Bos taurus; identical to SEQ ID NO: 17784

SEQ ID NO: 58438 - DNA, 201 bp, Bos taurus; identical to SEQ ID NO: 17785

SEQ ID NO: 58439 - DNA, 201 bp, Bos taurus; identical to SEQ ID NO: 17786

SEQ ID NO: 58440 - DNA, 201 bp, Bos taurus; identical to SEQ ID NO: 17787

SEQ ID NO: 58441 - DNA, 201 bp, Bos taurus; identical to SEQ ID NO: 17788

SEQ ID NO: 58442 - DNA, 201 bp, Bos taurus; identical to SEQ ID NO: 17790

SEQ ID NO: 58443 - DNA, 201 bp, Bos taurus; identical to SEQ ID NO: 17792

SEQ ID NO: 58444 - DNA, 201 bp, Bos taurus; identical to SEQ ID NO: 17793

SEQ ID NO: 58445 - DNA, 201 bp, Bos taurus; identical to SEQ ID NO: 17795

SEQ ID NO: 58446 - DNA, 201 bp, Bos taurus
ggctattggactgttatgtctaggtagctctaaatttatatgaagtggaataatcctttaagcaatccttttaaagtataatttttttaaacatttttatggagaggtaatatacatacaggggaaaatgcacctcttgattgtacatattttcagaatcttttgtattgtaatggtatttggtatgtagttcttttagag

SEQ ID NO: 58447 - DNA, 201 bp, Bos taurus; identical to SEQ ID NO: 17800

SEQ ID NO: 58448 - DNA, 201 bp, Bos taurus; identical to SEQ ID NO: 17801

SEQ ID NO: 58449 - DNA, 201 bp, Bos taurus; identical to SEQ ID NO: 17804

SEQ ID NO: 58450 - DNA, 201 bp, Bos taurus; identical to SEQ ID NO: 17805

SEQ ID NO: 58451 - DNA, 201 bp, Bos taurus; identical to SEQ ID NO: 17806

SEQ ID NO: 58452 - DNA, 201 bp, Bos taurus; identical to SEQ ID NO: 17808

SEQ ID NO: 58453 - DNA, 201 bp, Bos taurus; identical to SEQ ID NO: 17811

SEQ ID NO: 58454 - DNA, 201 bp, Bos taurus; identical to SEQ ID NO: 17812

SEQ ID NO: 58455 - DNA, 201 bp, Bos taurus; identical to SEQ ID NO: 17814

SEQ ID NO: 58456 - DNA, 201 bp, Bos taurus; identical to SEQ ID NO: 17815

SEQ ID NO: 58457 - DNA, 201 bp, Bos taurus; identical to SEQ ID NO: 17819

SEQ ID NO: 58458 - DNA, 201 bp, Bos taurus; identical to SEQ ID NO: 17821

SEQ ID NO: 58459 - DNA, 201 bp, Bos taurus; identical to SEQ ID NO: 17822

SEQ ID NO: 58460 - DNA, 201 bp, Bos taurus; identical to SEQ ID NO: 17823

SEQ ID NO: 58461 - DNA, 201 bp, Bos taurus; identical to SEQ ID NO: 17829

SEQ ID NO: 58462 - DNA, 201 bp, Bos taurus; identical to SEQ ID NO: 17830

SEQ ID NO: 58463 - DNA, 201 bp, Bos taurus; identical to SEQ ID NO: 17833

SEQ ID NO: 58464 - DNA, 201 bp, Bos taurus; identical to SEQ ID NO: 17834

SEQ ID NO: 58465 - DNA, 201 bp, Bos taurus; identical to SEQ ID NO: 17836

SEQ ID NO: 58466 - DNA, 201 bp, Bos taurus; identical to SEQ ID NO: 17838

SEQ ID NO: 58467 - DNA, 201 bp, Bos taurus; identical to SEQ ID NO: 17839

SEQ ID NO: 58468 - DNA, 201 bp, Bos taurus; identical to SEQ ID NO: 17840

SEQ ID NO: 58469 - DNA, 201 bp, Bos taurus; identical to SEQ ID NO: 17841

SEQ ID NO: 58470 - DNA, 201 bp, Bos taurus; identical to SEQ ID NO: 17844

SEQ ID NO: 58471 - DNA, 201 bp, Bos taurus; identical to SEQ ID NO: 17845

SEQ ID NO: 58472 - DNA, 201 bp, Bos taurus
tgtaggaaataaaagcagtcttcgggcaatgaatttcccattctttttattatattcatcaatagagagatgaacgcttaagtgaagagacgttattatgtccataaaactgatcgatttccagattaaagaaaaagaagaaacacattaaatatattccaaatctttgccctgtaattattttgttcgttgctgtttggt

SEQ ID NO: 58473 - DNA, 201 bp, Bos taurus; identical to SEQ ID NO: 17846

SEQ ID NO: 58474 - DNA, 201 bp, Bos taurus
taaagaaagaaatgataatatgactcatttctattaaactgggtatcaaaaatcaaattaaaaaaatttctgaaactaactgatgaaaagtacaggtcaagacaacaattctggttattaatgtcaggcttgggtatagtcaaattttcccactgtacatactgtttgaaatgtatacttcttaggctcaatctcaaaatg

SEQ ID NO: 58475 - DNA, 201 bp, Bos taurus; identical to SEQ ID NO: 17850

SEQ ID NO: 58476 - DNA, 201 bp, Bos taurus; identical to SEQ ID NO: 17851

SEQ ID NO: 58477 - DNA, 201 bp, Bos taurus; identical to SEQ ID NO: 17853

SEQ ID NO: 58478 - DNA, 201 bp, Bos taurus; identical to SEQ ID NO: 17855

SEQ ID NO: 58479 - DNA, 201 bp, Bos taurus; identical to SEQ ID NO: 17857

SEQ ID NO: 58480 - DNA, 201 bp, Bos taurus
ctcttgaaccaggttgtctgtactgcgttctctagttccttggtcctgtggtcacccaaggactgggatggaggtagatcgaaggaaccaacctcagaaggcagggcctgtttctattcccactttgagctgctcttgccattcccaaactggaagaggcaacttcccaaagggctgacgaccttaccgaggaagcagctg

SEQ ID NO: 58481 - DNA, 201 bp, Bos taurus
taatggccaggtacacatgtttcgttcattcatcctggcaggtctctggagaacaactttggagaccatcagattcacctgcagtgcttgtcagccatctatccaaagctcagccaggcccactgaccatatctctgggaaggccagcttcaggcaagtgtggggactctgggatggaaaagatgtcagtgtgtccccatt

SEQ ID NO: 58482 - DNA, 201 bp, Bos taurus; identical to SEQ ID NO: 17860

SEQ ID NO: 58483 - DNA, 201 bp, Bos taurus; identical to SEQ ID NO: 17861

SEQ ID NO: 58484 - DNA, 201 bp, Bos taurus; identical to SEQ ID NO: 17865

SEQ ID NO: 58485 - DNA, 201 bp, Bos taurus; identical to SEQ ID NO: 17866

SEQ ID NO: 58486 - DNA, 201 bp, Bos taurus; identical to SEQ ID NO: 17867

SEQ ID NO: 58487 - DNA, 201 bp, Bos taurus; identical to SEQ ID NO: 17873

SEQ ID NO: 58488 - DNA, 201 bp, Bos taurus; identical to SEQ ID NO: 17874

SEQ ID NO: 58489 - DNA, 201 bp, Bos taurus; identical to SEQ ID NO: 17875

SEQ ID NO: 58490 - DNA, 201 bp, Bos taurus; identical to SEQ ID NO: 17879

SEQ ID NO: 58491 - DNA, 201 bp, Bos taurus; identical to SEQ ID NO: 17880

SEQ ID NO: 58492 - DNA, 201 bp, Bos taurus; identical to SEQ ID NO: 17881

SEQ ID NO: 58493 - DNA, 201 bp, Bos taurus; identical to SEQ ID NO: 17882

SEQ ID NO: 58494 - DNA, 201 bp, Bos taurus; identical to SEQ ID NO: 17885

SEQ ID NO: 58495 - DNA, 201 bp, Bos taurus; identical to SEQ ID NO: 17887

SEQ ID NO: 58496 - DNA, 201 bp, Bos taurus; identical to SEQ ID NO: 17889

SEQ ID NO: 58497 - DNA, 201 bp, Bos taurus; identical to SEQ ID NO: 17890

SEQ ID NO: 58498 - DNA, 201 bp, Bos taurus
ccatggagcaaaaggtacaaagctgtcaaccatccagacactgcagaacaggaacaagaagagggctgtcctaagcctggaggggcctcactcacacagccctcctaaactacattctcacggagcctcggagtccccagactgctcgatcattccctcagtgacccatcaacataatgaaaacctccccttctgtggccc

SEQ ID NO: 58499 - DNA, 201 bp, Bos taurus; identical to SEQ ID NO: 17891

SEQ ID NO: 58500 - DNA, 201 bp, Bos taurus; identical to SEQ ID NO: 17892

SEQ ID NO: 58501 - DNA, 201 bp, Bos taurus; identical to SEQ ID NO: 17893

SEQ ID NO: 58502 - DNA, 201 bp, Bos taurus
acatatatctttatacatatctttatacatacacagttcacatatgtattggtttgctctcttttctcaccaaaaagcatggtccatgaaggcaggccctacagtttgttcaagctaagtatcccacctcagtgggcattcagcaaatatttgttgagccaatgatgaaacccaagaacaagaagcacggccaggaaagtc

SEQ ID NO: 58503 - DNA, 201 bp, Bos taurus
ttccattcacagagccccgcctcacccttccctcactgctaaggataaggcctgtccctctcttatctcctgggaaaggttaagcccatcctggcccccaggggtagatgtctctttctgaaaagaccggttctcccccgctgttaacctgtgactcaatacaatctactagaagcctgcaagtcactcttgggcctgcaa

SEQ ID NO: 58504 - DNA, 201 bp, Bos taurus; identical to SEQ ID NO: 17894

SEQ ID NO: 58505 - DNA, 201 bp, Bos taurus; identical to SEQ ID NO: 17895

SEQ ID NO: 58506 - DNA, 201 bp, Bos taurus; identical to SEQ ID NO: 17897

SEQ ID NO: 58507 - DNA, 201 bp, Bos taurus
ttcagtcatttgccctaaaaagatgagttaagtgtgcatctttctttgatcttctgagcattggaatatggctctctgtttaaaaaatgcattcacaaatgaaggtttaattcagccttctcagatagttttctttcattccccaaagataattttcttcactactcctttagtagttcttggcctttcaaatagctgtgc

SEQ ID NO: 58508 - DNA, 201 bp, Bos taurus; identical to SEQ ID NO: 17898

SEQ ID NO: 58509 - DNA, 201 bp, Bos taurus; identical to SEQ ID NO: 17899

SEQ ID NO: 58510 - DNA, 201 bp, Bos taurus
ctggttcaatatgtgctgaacacattcccctcaaagccatatgtggacaccctggccctagcacctgagggtggaactgtgtgttagggcctttgaagagatgattaaggcaaaatgaagcttatggggtaggtcctaacccaatctgaagggtgtccttataagaaaaggagcccaggacacagatgcaaagaaggcccg

SEQ ID NO: 58511 - DNA, 201 bp, Bos taurus
aagagggtttatattcagcagagtcaatggcctgattcttaagtgatggtaagcttgtcagtgatactttatgaaagtgtacatacagttaagcataaccataaattctctggtgacattagttatttaagattttttaaatattttgaagtcatataaatctagcatttgtagatatcagttgtatgaaactgaggcctg

SEQ ID NO: 58512 - DNA, 201 bp, Bos taurus
aatatctgaaaaatatagctaaacaaaatatagttaagaatgtacaagaaattacaaattacctatctcttcagcttttcctgtgtgcacttctattggtctcttttgctatacattctaatttttctccctagcagtagaaacatcttcctctgttgttattacactttactacatttttttttcttttggccgtatctc

SEQ ID NO: 58513 - DNA, 201 bp, Bos taurus
gagtaatcttacccaagtcagaagtaggactagtgagatctccaggttagtgctctgcttcctccacctccctacttcaggccgccctcaccattttccttccccacttctttcaaccaggaattccaagccttcttgcaccaaaaatgtgagtttctcacggccaattatcacctaaaacgattttctaaatgggtactt

SEQ ID NO: 58514 - DNA, 201 bp, Bos taurus; identical to SEQ ID NO: 17902

SEQ ID NO: 58515 - DNA, 201 bp, Bos taurus; identical to SEQ ID NO: 17905

SEQ ID NO: 58516 - DNA, 201 bp, Bos taurus
tgaggcctcaccatcctctggagctcacagtcctccactggaggcttggcacctcacccaccaatccgttgagaccaagagaatgtggaggctttctctgtaccactcaggggccagatctagaaacagcctagatctctgctcccctgccccggcacagccagtcagacgagtgggcccaagtgccagcagtctgggacc

SEQ ID NO: 58517 - DNA, 201 bp, Bos taurus; identical to SEQ ID NO: 17906

SEQ ID NO: 58518 - DNA, 201 bp, Bos taurus
actcagagttttaaatatcaattcactttgtactaataatacagtaagtcccctacatatgaaccttcacgtcacaagctttcaaagatgcaaatgtgaacgctagcctctgtctagcagctgttgtactgtactcctgtgctttccaaggtactgtgctgttcgtgtttgcttgtttcttctgtgtcatgtgtgtgaagt

SEQ ID NO: 58519 - DNA, 201 bp, Bos taurus
gcttgatctgcttgatctcctcccactagaatacaggcacaagtcacccttaacaagaagttaatacaaaccactcaactaacctttctgtccaagggggaaaaaaaaaaaaagaaagaaggaatacaaccctaaagcttgggaaaaggagacctcaagcagaacaagttagagaaaagaagatgaaaaaaaaaacagaaa

SEQ ID NO: 58520 - DNA, 201 bp, Bos taurus
aaatagtgggcagccgggcctggtcctattgatatagtatgggggagggaaagaagcagtggtgaccttaatgaaccagatcgcatctgcgtgggcccttctctcatggagatcagagaagagaagatgctgcttggtatcctttctcagctgaactcagcctccaggtggacaggcatctttcagaatcatgagctgaga

SEQ ID NO: 58521 - DNA, 201 bp, Bos taurus; identical to SEQ ID NO: 17909

SEQ ID NO: 58522 - DNA, 201 bp, Bos taurus; identical to SEQ ID NO: 17910

SEQ ID NO: 58523 - DNA, 201 bp, Bos taurus
ccaggcctgcagctggtctgtgtggccacgtcgcccactctgctgggggtggggaccctcctcagaacttcttaggccacagagcaaggacagtacactgtgatttctttccttgtaacttttctccctgtgcagtgacccctgctccctggagggcccaggacaggcagctgagagtcagagccccgtcccttgtccttc

SEQ ID NO: 58524 - DNA, 201 bp, Bos taurus; identical to SEQ ID NO: 17912

SEQ ID NO: 58525 - DNA, 201 bp, Bos taurus; identical to SEQ ID NO: 17913

SEQ ID NO: 58526 - DNA, 201 bp, Bos taurus; identical to SEQ ID NO: 17914

SEQ ID NO: 58527 - DNA, 201 bp, Bos taurus; identical to SEQ ID NO: 17915

SEQ ID NO: 58528 - DNA, 201 bp, Bos taurus; identical to SEQ ID NO: 17916

SEQ ID NO: 58529 - DNA, 201 bp, Bos taurus
gcatgggaccggccctgccccggacaccatggggtgcagccaacagaccacttgtggtgccgggaagctctcaagtgggaaggaggggagctgaccacaggggccacggctctattttgcccatttatctaacactggcccaagaatgctttcctttgggacggacggagtattctccacttctataagcttcataatacc

SEQ ID NO: 58530 - DNA, 201 bp, Bos taurus
agggtccccttcgccctgtgtgtctaacgcacttcttcagtgctcagcaggcccacagggtttcttctcatgaccatttaaacctctgcctcctgacagcgctgtctgtctatgttttttatgtatcgtcaacatcagagagatacttgtgagctttgcagtatgtggttcataagacaaaatgtccatgtgttcaagggg

SEQ ID NO: 58531 - DNA, 201 bp, Bos taurus
ggtcccttccctggggagtcccgccaggcccccaagtgctgccacgatgaacgtgcacagacttccaaaggcatctaggagacccaagctggggacaagccggccaagaacgcgtgaactccagggacacggagcggggccgcagaccccaggctccctgggccctgccgtaggatctgggggaatggccgggagcagaga

SEQ ID NO: 58532 - DNA, 201 bp, Bos taurus
gcactccagtgggggacagtgcactccactggggggtacattctagtgggagtgcactctggtgggggtgcactctgctggggggaagtgcactccagtggggcctcctacccatggaagagccagcatcctcctcacatggatgaaccagaatagcaccccaaccctcacccaggggactgctggcccctaattgccatt

SEQ ID NO: 58533 - DNA, 201 bp, Bos taurus
tagctcagccagaacctgctggtcaagtcagtgtcagcccagtgcccagcagctgtggccctaggctgggacgcttgtgggagaggccacgccaggcagtactggctccgggaacccagcctgcgccctgcacccctgtcctgcctcagggacgtaaccagggcccatccagggcgccggtgtcaccaaggagaagggctg

SEQ ID NO: 58534 - DNA, 201 bp, Bos taurus
taccacaacatccagcatcctcagaaatcctggcattttgggaaaatggattctgagttgtccccacagcccccgtaaggggcccttgaggctcagggccaatgagaagcgaggtaagtgctcactgccagtggactcttctctaggttcctttccaagacaggtctgaggccacaggcagcaccaacccctgggagctga

SEQ ID NO: 58535 - DNA, 201 bp, Bos taurus; identical to SEQ ID NO: 17920

SEQ ID NO: 58536 - DNA, 201 bp, Bos taurus
tgggacctgctaccaaccaagaaaccctaggcctggattcagcactcctcctgacaccccctcctggggctgagcagacacccacagaccactcagctggcggtggaaggccaacagctcccgctccagaagaccccaaatcgtcctgacatctgaacccaaaggcaagtgcgggtggaagccatggggggccaggggcac

SEQ ID NO: 58537 - DNA, 201 bp, Bos taurus; identical to SEQ ID NO: 17921

SEQ ID NO: 58538 - DNA, 201 bp, Bos taurus
acagctccgctgaggaaagggccttctctgaaccgtgactgactgcatcgtggttttcaagaaaaaaacaaaacttttatagatctcagtatgttttagtgtagcctggagtgtgagcgtgctcctctcagcagctgcgtatagacgtctcagaagaaagcaaaatcttcctcaccatgaaaatcatttctgtaaatgtct

SEQ ID NO: 58539 - DNA, 201 bp, Bos taurus
ctcactcaggtcccctcgtgttccagaggttgggcctgcctccatgatcgttgggaacctggtcgccgggaagagaatcgctcaggcctcagggagggagctgtcgcacctagaggacagtgagcaggctaggaaggtaagggggttggaggggagggtgaagaggtccctgggaagccatcaggcccgaccctccccaac

SEQ ID NO: 58540 - DNA, 201 bp, Bos taurus; identical to SEQ ID NO: 17922

SEQ ID NO: 58541 - DNA, 201 bp, Bos taurus
attggtggctacaaaagcataaaggtcataaaattccctggcttcaccaacagctggaagcagaccctgtctgcacagacagatcaagaatgaccttcactgcacatcagacacatccatcataaccttcattctacagacagaacaggaggtgcaggtgcttgggtatggccatctccagggcagagctgtgacctgccc

SEQ ID NO: 58542 - DNA, 201 bp, Bos taurus
tttgaatccctggttgctgttcttgagccctatgtggggtgcctcatctatgaagtgacctcaatggtggcgaaaaatcgggagaaatagaggggctgtggcaggcaaaaggtgtcaggagtatgaagaccctgaagaggggccgagctggtaaggctcctgtctttttccccactcatgcggcagtttgctgttttcttt

SEQ ID NO: 58543 - DNA, 201 bp, Bos taurus
taaagatctcctcttccatttgcaggctggctgtgatggtgagagtattagaaattgcccattttcttagcgtctctttatgattctctggctaaagggcgttatatttaatgtgacaacaggggacttgaaaaggtaagaccaggtttctgcagtaatgaaataactatccccaattccctatacacacaggcacatgga

SEQ ID NO: 58544 - DNA, 201 bp, Bos taurus; identical to SEQ ID NO: 17923

SEQ ID NO: 58545 - DNA, 201 bp, Bos taurus; identical to SEQ ID NO: 17924

SEQ ID NO: 58546 - DNA, 201 bp, Bos taurus
cagaaaaatctccagtgtcagcatgtcacaagtgatcctagcgcacaggacatactcagcgccccgtaactagaccatgtccaaagtcaatggaacttcaattgcaaagcggaagctgtgaatgccaaactgggcagcacagagtgccagtctcaacttccttgaagtttgtttgtgcaggtttggaaatcacagagaggt

SEQ ID NO: 58547 - DNA, 201 bp, Bos taurus
ttaaaaatctttctatatattgttaggaaggatgatgttgtcagacatgtttcttaaatcaatgcatgataagtctgaagtgaggtcaactcattcaacaattgagatgtggaaatacgaaggatgaagtggaagagcagagagtttagtatttgttatatttctattaatactcttcagctatatgtaactatcccacgt

SEQ ID NO: 58548 - DNA, 201 bp, Bos taurus; identical to SEQ ID NO: 17925

SEQ ID NO: 58549 - DNA, 201 bp, Bos taurus
gctcagcagaggcttggacctctagagctcagaccaggagcttctcccaacagctcccactgcctcactagtgatgcattgtaactaagaagcaacatagatgcaggttttgtctacattctaaagtagacctaaaaagaagcaagaaatagttcaaagtttacacttccccctgatgcactaactaatacaaggaaggac

SEQ ID NO: 58550 - DNA, 201 bp, Bos taurus
ggctgtgcatcagcccccagaaggaacagagtccacacatggcctgatgatagggggtggggagggaagtttgcatcacctgaggtctaattcaagagacatcatagattgtattggctccaatttttaaactagggcttcacaattttttcacagaagaaaaagcacaagcaactcattagatcaaaacattattctaga

SEQ ID NO: 58551 - DNA, 201 bp, Bos taurus
tggtctctggagctagaccagagaataggcctcaacagcttttcctttctccatgcaaatcttctcataggtctccacatctagggactacaggaccatctgtagcaagtcttaattacaaggaggcctagccttgacctcctatgggagagacatagagttagcctgagtataaagatccatccctttaagacagcaacg

SEQ ID NO: 58552 - DNA, 201 bp, Bos taurus
tactggagtgggttgccatttctttctccaggggatctttctgacccagggatcaaaccaaggtctcccacattgcaggcagacacttttccaactgagctgcctgggaagcctcatataggccattacaaagtatcaagcagagttccctgtgctgtacagcaggtccttatcagttacctatgatatatatagtagtgt

SEQ ID NO: 58553 - DNA, 201 bp, Bos taurus; identical to SEQ ID NO: 17926

SEQ ID NO: 58554 - DNA, 201 bp, Bos taurus; identical to SEQ ID NO: 17927

SEQ ID NO: 58555 - DNA, 201 bp, Bos taurus; identical to SEQ ID NO: 17928

SEQ ID NO: 58556 - DNA, 201 bp, Bos taurus
ggctgtctgcaggaggaggaagtggcctgccacagaggagtgtgtgctgatgggaggctgtctgcaggaggaggaagtggcctgccacaccgtcctcctgggagcggaatgaggaagcagagtccactcgcgttgatgatttgaaagtcagttgtgttggccttatcacagggggcccggagcaatcagaaagcgaagagg

SEQ ID NO: 58557 - DNA, 201 bp, Bos taurus
tgagggggagctattttgctaattaaagggtaagaaactctcactcttgaggggctggagcaagtccctgggtcccttcaggactgttaaaaaagaggccttttgctctctggtcaagaaagagtgttcagtttaatccaaggcatggacgtcactcaggagttcatggcccttgcagctcaagaccggtctggcaagggc

SEQ ID NO: 58558 - DNA, 201 bp, Bos taurus
gccaggtgcagtgtcctggcacttctggcctgaaggctggtggggcgggtgagccctcaggcagaaggaagtcagacagagcacacagagggacaacgacaaggccctgacaacacctgtcacactctcatatcatacaagtcacactgatagtgcccaaagagaatttgtgtgtgtgtgagtctgtgtgctcagctgtgt

SEQ ID NO: 58559 - DNA, 201 bp, Bos taurus
gctctgggcccagacagatcaagcttagacctatagggaaatatgattgaggttcttagaagacgtctgtaattctggtgtggctctgccgggcctggtggtgtgtgtctaacatgtctgtccctttccacaattccagagactttctgtaattatatgtagtttggggcctttccccttgatgagtaacctcttcttctc

SEQ ID NO: 58560 - DNA, 201 bp, Bos taurus
gtttgctggagacagaccagctcaggggcagctcggccctgctggctaactcggccagctctttggcactgagagatggggtgctggtctcgtaggtctcgtggaagctgttgtagtcgacttcgtagaacccatcctccagcgtcaggacaggtgtgaatcggtacccccagaggatctcactggtgatgtaggagcttc

SEQ ID NO: 58561 - DNA, 201 bp, Bos taurus
tgagaaatcaaaaagacaggatgctggccccagagagctgagatgcctgtgaaagagatgacctcaataatccgggcctgttgcatcttcccgtacctacgagagcgctaaattccttaatgtgatatccatgaaagtgaaagtcactcagttgtgttctactctttgcaacctcattaactatatggtccatgggattct

SEQ ID NO: 58562 - DNA, 201 bp, Bos taurus; identical to SEQ ID NO: 17929

SEQ ID NO: 58563 - DNA, 201 bp, Bos taurus
tggcctcacaggccacgtacagagcctggatccacttctccaccctcctctctgcctggctgatgcccgctgctgtcctaacgtggaggaaggagacgggcttcagagtgaggtcaggtgcctttgactcgcatctgctgcttgctagcagcgtgccctggacacctcgtctaatttctttcagctgtggtctcttcattt

SEQ ID NO: 58564 - DNA, 201 bp, Bos taurus
taagacgctttcctttccttgggtgttgggtccatggcttggctggtgttggcacagctggaccagtgggaggggatttcacagagaactctaaatctccgtaagttcatctgtcttttacaaggtgtgaatttccccagccatctgaggttcactgggcggcagctgctctgtcttgaagccacagccaaccgtttcttt

SEQ ID NO: 58565 - DNA, 201 bp, Bos taurus; identical to SEQ ID NO: 17930

SEQ ID NO: 58566 - DNA, 201 bp, Bos taurus
acagagaagcctggtgggctacagtccatggggtcgcaaagagtcggacacaactgagagacttaactttcactttcttttcacttaactttccaatactttggccacctgatacaaagaactgactcattggaaaagaccctgatgctgggaaagattgagggcaggaggagaaggggatgacagaggatgagatggctg

SEQ ID NO: 58567 - DNA, 201 bp, Bos taurus
aggcagacacttctggactataaattcaagaattttcatggagctcagtctctcaaaatgcccatctcccaaaaaagattttcaacaggtggtgccagccatgagtgctctgcttaggataaaaattgcacatgtgtattattagtgctgctgaatttaataaatgcacccaggtctgttaatttattcaaattttggata

SEQ ID NO: 58568 - DNA, 201 bp, Bos taurus; identical to SEQ ID NO: 17931

SEQ ID NO: 58569 - DNA, 201 bp, Bos taurus
acgttacaatcccaccttacaggggaggaagcagagctcagggccctggcgcagggtcacgggactgggagggactcaaaggcaggggtgtctgtggccataaagcatcagaaacctcaggggcaatctgacagagtccccagtgaagagaagagctgttccccatgcatttggggtccccgatgcatttgaggccgtccc

SEQ ID NO: 58570 - DNA, 201 bp, Bos taurus
agcagagctttgacatctccagatcaaacgtgttattgcttacctggacattcattcagcacacctgcataaaaacgcctttccagaaaggttgctggccctcctgcttctgttcagagcaccaaatacccatcacgtgtgattttaggaatcagtgaggatcaacaataaaaaataaagggacccaaatgctcctctggg

SEQ ID NO: 58571 - DNA, 201 bp, Bos taurus
agataaataggtagattaattttgagaaattggctcacactattatggaagctagcaagtccaaaatctgcatgataaactagcaagttggagacccagagaagaactggggttttagttagagtctgaaggttcttctctggaggaagcctgtcttttttctattaaggaactagttggatgaatcctaccgactttatg

SEQ ID NO: 58572 - DNA, 201 bp, Bos taurus; identical to SEQ ID NO: 17933

SEQ ID NO: 58573 - DNA, 201 bp, Bos taurus; identical to SEQ ID NO: 17935

SEQ ID NO: 58574 - DNA, 201 bp, Bos taurus
tgctcactttcctcaagggacagatgcctctgacaaatgtgcagaaggggaagtctttgaagcagtcatgagtaggcccagtttacacaagggttgctgagaaaatggagttctgaaaagtaccatcaagtgaagaactttcctgatcctctttggcccatctcccttggccagcccatgctggagaggttggacaccatg

SEQ ID NO: 58575 - DNA, 201 bp, Bos taurus
cagtggctaagattccacgctcccaacgcagggggccagggttggatccccggttagggacctagatcccacatgcagtaaagatcccacatggcacaacgaagacacggcccagccgagtaaaataaacacacaaaatacgacaggaaggagcttacctacacagagaaacagactcaaaggcacggagaacagaggcat

SEQ ID NO: 58576 - DNA, 201 bp, Bos taurus; identical to SEQ ID NO: 17941

SEQ ID NO: 58577 - DNA, 201 bp, Bos taurus
caaaacagccacttgccccagaactctctgggctgctgctttaagatgcaagtcctgagcctcatttgtgtactggaagcaggatctctcaggccagcaccatggagaattctggtgctaatatttgggaatcattgtttaaaaatcttcgtcagagcattaggtcaccaatccaggctacaacagggcccaggacacaaa

SEQ ID NO: 58578 - DNA, 201 bp, Bos taurus; identical to SEQ ID NO: 17943

SEQ ID NO: 58579 - DNA, 201 bp, Bos taurus
ttctgggagggtggcccgatggggctgccaaggtgccactcttgattgtcccagactgtagttctgtacaccttgtcagtgacgggtagaagacagggcatgtgacacaattctggccaacaagaagtcagccagaaagacttctaggaaggtctccctcatttcttaaagaagaagaaatcaacgaggccttctgttttt

SEQ ID NO: 58580 - DNA, 201 bp, Bos taurus; identical to SEQ ID NO: 17946

SEQ ID NO: 58581 - DNA, 201 bp, Bos taurus
cttttcttttttttaagatgcagctatatgctgtctatacttctgattcaaatataaaaatagtttgaaagcaacaggatgggagaaaatgtattatgcaagcagcaactgtaagaaagtggagagctacgctgatactgagcaagcttccctttctcgatcttaacctctcaggagcgtcattgactgttcttatacaga

SEQ ID NO: 58582 - DNA, 201 bp, Bos taurus
tgccacggggctgtagacttcctgcagacagcggctgagtcctttcggttaccggccccagtggcgttcaagggctgcctggagggaacctcacagataatgaatgaaggcctgagcgagcacctgctttgaccttcaaacttcacagtgtttactggcattttcttagaacagtggacgttgataaatgctgtgtgactc

SEQ ID NO: 58583 - DNA, 201 bp, Bos taurus; identical to SEQ ID NO: 17947

SEQ ID NO: 58584 - DNA, 201 bp, Bos taurus; identical to SEQ ID NO: 17948

SEQ ID NO: 58585 - DNA, 201 bp, Bos taurus; identical to SEQ ID NO: 17949

SEQ ID NO: 58586 - DNA, 201 bp, Bos taurus
actcaccctacctgattgtcactggctatccactaacatctttgactgtggacaccgttgctgggtattgttgtcacctttgcttgacatggaaaggacagtatttgcgtccccccttcatcagcttgcaacataattcaggtatctagaacactctcctcatattcttctttcccagaccctattacaggcatcattttt

SEQ ID NO: 58587 - DNA, 201 bp, Bos taurus; identical to SEQ ID NO: 17950

SEQ ID NO: 58588 - DNA, 201 bp, Bos taurus; identical to SEQ ID NO: 17951

SEQ ID NO: 58589 - DNA, 201 bp, Bos taurus; identical to SEQ ID NO: 17952

SEQ ID NO: 58590 - DNA, 201 bp, Bos taurus; identical to SEQ ID NO: 17953

SEQ ID NO: 58591 - DNA, 201 bp, Bos taurus; identical to SEQ ID NO: 17954

SEQ ID NO: 58592 - DNA, 201 bp, Bos taurus; identical to SEQ ID NO: 17956

SEQ ID NO: 58593 - DNA, 201 bp, Bos taurus
taagccaagcaaatgttgagctgccagttaaaaatgtaccacctgccttccccttctctttaatatattctttaaagtagcatggtggaaggtatccagcaagactcagagcatgctttttaatttgaaattttgagcatccagattctagaagcaatcctcgttttggacatgtaaacaatgaaggtatttgaaggcttg

SEQ ID NO: 58594 - DNA, 201 bp, Bos taurus; identical to SEQ ID NO: 17958

SEQ ID NO: 58595 - DNA, 201 bp, Bos taurus; identical to SEQ ID NO: 17959

SEQ ID NO: 58596 - DNA, 201 bp, Bos taurus; identical to SEQ ID NO: 17960

SEQ ID NO: 58597 - DNA, 201 bp, Bos taurus
tcttttctcaatcttgatcctaagaattaactaaaaaagaatatttaaaaggtcatgttgtcccttcctgtgcaaatctgggagataaggctgttactaatgcattttctaatttttaaagtaaatgttaaggggaacatttggttctcttatgaaaagcttttcacaaacaggtcaaatatgttacaggtggtggaaaca

SEQ ID NO: 58598 - DNA, 201 bp, Bos taurus; identical to SEQ ID NO: 17961

SEQ ID NO: 58599 - DNA, 201 bp, Bos taurus; identical to SEQ ID NO: 17962

SEQ ID NO: 58600 - DNA, 201 bp, Bos taurus; identical to SEQ ID NO: 17963

SEQ ID NO: 58601 - DNA, 201 bp, Bos taurus
ggtcaggaaatgctttgttaagaggtgggattgtccacctacttaaaaaaggtaaaaaaagagtagaaggccatttcagggtagtaaagcattatgaggagagccatcataactgaaagtgatggtaaaattaatgacgtgatgtgttttcaggcaaaataccggtcatttctataatcaaatgttttccctgagcctcac

SEQ ID NO: 58602 - DNA, 201 bp, Bos taurus; identical to SEQ ID NO: 17965

SEQ ID NO: 58603 - DNA, 201 bp, Bos taurus; identical to SEQ ID NO: 17966

SEQ ID NO: 58604 - DNA, 201 bp, Bos taurus; identical to SEQ ID NO: 17967

SEQ ID NO: 58605 - DNA, 201 bp, Bos taurus; identical to SEQ ID NO: 17968

SEQ ID NO: 58606 - DNA, 201 bp, Bos taurus; identical to SEQ ID NO: 17969

SEQ ID NO: 58607 - DNA, 201 bp, Bos taurus; identical to SEQ ID NO: 17970

SEQ ID NO: 58608 - DNA, 201 bp, Bos taurus; identical to SEQ ID NO: 17971

SEQ ID NO: 58609 - DNA, 201 bp, Bos taurus; identical to SEQ ID NO: 17972

SEQ ID NO: 58610 - DNA, 201 bp, Bos taurus; identical to SEQ ID NO: 17973

SEQ ID NO: 58611 - DNA, 201 bp, Bos taurus; identical to SEQ ID NO: 17974

SEQ ID NO: 58612 - DNA, 201 bp, Bos taurus; identical to SEQ ID NO: 17975

SEQ ID NO: 58613 - DNA, 201 bp, Bos taurus; identical to SEQ ID NO: 17976

SEQ ID NO: 58614 - DNA, 201 bp, Bos taurus; identical to SEQ ID NO: 17977

SEQ ID NO: 58615 - DNA, 201 bp, Bos taurus; identical to SEQ ID NO: 17981

SEQ ID NO: 58616 - DNA, 201 bp, Bos taurus; identical to SEQ ID NO: 17982

SEQ ID NO: 58617 - DNA, 201 bp, Bos taurus; identical to SEQ ID NO: 17983

SEQ ID NO: 58618 - DNA, 201 bp, Bos taurus; identical to SEQ ID NO: 17984

SEQ ID NO: 58619 - DNA, 201 bp, Bos taurus; identical to SEQ ID NO: 17985

SEQ ID NO: 58620 - DNA, 201 bp, Bos taurus; identical to SEQ ID NO: 17986

SEQ ID NO: 58621 - DNA, 201 bp, Bos taurus; identical to SEQ ID NO: 17991

SEQ ID NO: 58622 - DNA, 201 bp, Bos taurus; identical to SEQ ID NO: 17993

SEQ ID NO: 58623 - DNA, 201 bp, Bos taurus; identical to SEQ ID NO: 17994

SEQ ID NO: 58624 - DNA, 201 bp, Bos taurus; identical to SEQ ID NO: 17995

SEQ ID NO: 58625 - DNA, 201 bp, Bos taurus; identical to SEQ ID NO: 17996

SEQ ID NO: 58626 - DNA, 201 bp, Bos taurus; identical to SEQ ID NO: 17997

SEQ ID NO: 58627 - DNA, 201 bp, Bos taurus; identical to SEQ ID NO: 17998

SEQ ID NO: 58628 - DNA, 201 bp, Bos taurus; identical to SEQ ID NO: 17999

SEQ ID NO: 58629 - DNA, 201 bp, Bos taurus; identical to SEQ ID NO: 18000

SEQ ID NO: 58630 - DNA, 201 bp, Bos taurus; identical to SEQ ID NO: 18001

SEQ ID NO: 58631 - DNA, 201 bp, Bos taurus; identical to SEQ ID NO: 18002

SEQ ID NO: 58632 - DNA, 201 bp, Bos taurus; identical to SEQ ID NO: 18003

SEQ ID NO: 58633 - DNA, 201 bp, Bos taurus; identical to SEQ ID NO: 18004

SEQ ID NO: 58634 - DNA, 201 bp, Bos taurus; identical to SEQ ID NO: 18005

SEQ ID NO: 58635 - DNA, 201 bp, Bos taurus
tccacagaaattgtgattatcccagaaacagtgaccactaccatgctaaattaatagttctcagtcctcatcttacttgacgtctcaaggcttgaccactcgaaaccctttctcctctccaatgcctggacaccacacttcttgccaattccaccctcatttaactggagctcctttgagatctcctttgcatacatttta

SEQ ID NO: 58636 - DNA, 201 bp, Bos taurus
aatgactaaacgaattatagattagatgtatgatagaatattacatagttgctaaaagggctgttcacagacactaggaaaccagtaggacatcaagagattgcatgtaacatgcattcgcaaatgacagaaatttgaaacaaatactgtgttaaaaattattatatcagggtttattaaatgaaatcattttctttgtac

SEQ ID NO: 58637 - DNA, 201 bp, Bos taurus; identical to SEQ ID NO: 18006

SEQ ID NO: 58638 - DNA, 201 bp, Bos taurus; identical to SEQ ID NO: 18008

SEQ ID NO: 58639 - DNA, 201 bp, Bos taurus; identical to SEQ ID NO: 18009

SEQ ID NO: 58640 - DNA, 201 bp, Bos taurus
aaagcactacttgtatcttttgaaacagaagagcaacagttaattgagctgcatgctcagtgcataatagccattcagaccaacttacatttagaatagaaaatagacatcaggtcttggttcccccaaaataaatggtgtcattggtaccaatcttgatagctttgacagcagacaccatgtgagaacagagcagtcatg

SEQ ID NO: 58641 - DNA, 201 bp, Bos taurus; identical to SEQ ID NO: 18010

SEQ ID NO: 58642 - DNA, 201 bp, Bos taurus; identical to SEQ ID NO: 18013

SEQ ID NO: 58643 - DNA, 201 bp, Bos taurus; identical to SEQ ID NO: 18014

SEQ ID NO: 58644 - DNA, 201 bp, Bos taurus; identical to SEQ ID NO: 18015

SEQ ID NO: 58645 - DNA, 201 bp, Bos taurus; identical to SEQ ID NO: 18017

SEQ ID NO: 58646 - DNA, 201 bp, Bos taurus; identical to SEQ ID NO: 18018

SEQ ID NO: 58647 - DNA, 201 bp, Bos taurus; identical to SEQ ID NO: 18019

SEQ ID NO: 58648 - DNA, 201 bp, Bos taurus; identical to SEQ ID NO: 18021

SEQ ID NO: 58649 - DNA, 201 bp, Bos taurus
cagtgtctaatttctaccccgatgcaagggggtgaagttggtcacttatttaggctcacttgtttgttgtattttgaactggcatgtgtggaatgtgtggtgagtgttcgcagtggatggaccacagtggttttgccacagcccaaggttgcatgtgcttcctaggtctacactgctgcatgtccagggtgctctgcaagg

SEQ ID NO: 58650 - DNA, 201 bp, Bos taurus
tgagttgtaagatttgactctgaaaattactctggtaataagaagtgactggataatcaatggattgggtgtcatggagttagggagatttgcttaaaaataggattaaattgagccaagaaacaaccacaacataagaggatttgtagcttggggactcattgaaaactttctaaagaggattaggaaggaggacacttt

SEQ ID NO: 58651 - DNA, 201 bp, Bos taurus; identical to SEQ ID NO: 18022

SEQ ID NO: 58652 - DNA, 201 bp, Bos taurus; identical to SEQ ID NO: 18026

SEQ ID NO: 58653 - DNA, 201 bp, Bos taurus; identical to SEQ ID NO: 18027

SEQ ID NO: 58654 - DNA, 201 bp, Bos taurus; identical to SEQ ID NO: 18029

SEQ ID NO: 58655 - DNA, 201 bp, Bos taurus
acctcattccacttgttacctttggactttctgctgtgttctgatggaacatactttctcagatgaaaatggagtttatttccttggactgacactcatcttccctcttgccaattatttccccaagttagcaggaaaattcagccttctccctcacatccttaaaggatggctcgagtccgtctccaaatgaacaaatta

SEQ ID NO: 58656 - DNA, 201 bp, Bos taurus
atacacacatggccaagaaccaagaaatagctctccaccttgcaggtgcttggcaataaccctcaggactaaaattccctttaacagagatcaatactttggtaacttgcagaatcctgaacttgattttatgccactggcttctccttacccagcactgttactaaaccagcactgaggaaggaattttcccctctattc

SEQ ID NO: 58657 - DNA, 201 bp, Bos taurus
aaagcttatcaagttatctggccctcaaaacttagctcaggaaaccagatttactgagacatattcacatacatcagaagcactaaacaggattttttaatgcagtattaaaaatatggcccatttagaaagaaaatatatatacatatatagttacagcaatgttgttcttgttgttcagtcgctaagtcttgtcccact

SEQ ID NO: 58658 - DNA, 201 bp, Bos taurus; identical to SEQ ID NO: 18030

SEQ ID NO: 58659 - DNA, 201 bp, Bos taurus; identical to SEQ ID NO: 18032

SEQ ID NO: 58660 - DNA, 201 bp, Bos taurus
tggtagcaagtttgaggttctttcctgaccggtacctggggtgcagcctttctgtgctgttggttaagtacagagctttaactttagtggccaactgagccgggcaaaggatagctttgctcgtaaaagctgagggaatgtgaagagactctttgaatagagggccaccccgtctgtatgtatagcttatccctggtggct

SEQ ID NO: 58661 - DNA, 201 bp, Bos taurus
atctgtaactacaaggtttaaatccagaaccctgattgtgacagagaggggctagtgttttcccagtcaaatccccacagcacccaggccgggatgctctgtctgagtctagagtctgcccttccagatgcctggggtcccagcccaggatgagctaggcagtggaggagctgcccacctactgcttcttttgtaggaatt

SEQ ID NO: 58662 - DNA, 201 bp, Bos taurus; identical to SEQ ID NO: 18035

SEQ ID NO: 58663 - DNA, 201 bp, Bos taurus; identical to SEQ ID NO: 18036

SEQ ID NO: 58664 - DNA, 201 bp, Bos taurus; identical to SEQ ID NO: 18037

SEQ ID NO: 58665 - DNA, 201 bp, Bos taurus; identical to SEQ ID NO: 18038

SEQ ID NO: 58666 - DNA, 201 bp, Bos taurus
taagttctttgtatccataatctgtatcagctatgcccatcctcttctatcacctagcttgtaggtcatcaataaatatttcttgtactttttctcataccaccagctaagggcttcaacgtactcgaggtagtatgtgccaggcgattgcaatgccttcattctttcttccacaggagaacagcagattcctatactgtg

SEQ ID NO: 58667 - DNA, 201 bp, Bos taurus
gcaggccttcggggtagctgaagccctcttccctctcgcccccagcaccccctctgaagctctcctaagactgagaaatgagggccagggcacatccccgcgggcacggtgggctaggctgtcggggcaactgctgggagaatggcaacacttggtcgcccgcgcgtgtcctgggacctccaagttggggaccggcccctg

SEQ ID NO: 58668 - DNA, 201 bp, Bos taurus; identical to SEQ ID NO: 18039

SEQ ID NO: 58669 - DNA, 201 bp, Bos taurus; identical to SEQ ID NO: 18041

SEQ ID NO: 58670 - DNA, 201 bp, Bos taurus; identical to SEQ ID NO: 18043

SEQ ID NO: 58671 - DNA, 201 bp, Bos taurus; identical to SEQ ID NO: 18044

SEQ ID NO: 58672 - DNA, 201 bp, Bos taurus; identical to SEQ ID NO: 18045

SEQ ID NO: 58673 - DNA, 201 bp, Bos taurus
gggaccaaagtacaaaattaaccattaacacacattctgaatggtccctgagactgatgacctagagaaatagtatctgttacctgtgagtttagaaaactctttcatagtaaattacaactaataaaagggagttcttgagctgcgagtaaggcatgctccttgtgcacatgtgctcagaagcacacgtgacaatgtata

SEQ ID NO: 58674 - DNA, 201 bp, Bos taurus; identical to SEQ ID NO: 18047

SEQ ID NO: 58675 - DNA, 201 bp, Bos taurus; identical to SEQ ID NO: 18048

SEQ ID NO: 58676 - DNA, 201 bp, Bos taurus
aggaagaggactgggcagagagaactttgaagattttgcccagatatggcaaaatcttggtcagcacactagggcactgcagagcaaacactgcttgtgagaggagccctgcattggcagaaatggccaggctccagtacccctgcagagctagatcactaggtgctacctgggaaagacatggccttccttataagcgca

SEQ ID NO: 58677 - DNA, 201 bp, Bos taurus
tttttaaattaaatatttcagacacagagaagaaaagcataataaatgcctgtttacccatcatccagatttatcaaactagtaacatgtgcagcattttgatgcaccattccttaagtcattacccagatatttcaagcctcctttgtaaccacccctaattccattcctttctcttttccccatgtttgtcacttcttc

SEQ ID NO: 58678 - DNA, 201 bp, Bos taurus; identical to SEQ ID NO: 18049

SEQ ID NO: 58679 - DNA, 201 bp, Bos taurus; identical to SEQ ID NO: 18050

SEQ ID NO: 58680 - DNA, 201 bp, Bos taurus; identical to SEQ ID NO: 18051

SEQ ID NO: 58681 - DNA, 201 bp, Bos taurus; identical to SEQ ID NO: 18052

SEQ ID NO: 58682 - DNA, 201 bp, Bos taurus; identical to SEQ ID NO: 18053

SEQ ID NO: 58683 - DNA, 201 bp, Bos taurus; identical to SEQ ID NO: 18054

SEQ ID NO: 58684 - DNA, 201 bp, Bos taurus
cccttctgaaatttataatctagtagaggaagactggtaacatacaagtaacattaaaaatcaaatatggagcaacaatatagacccagatgccttggagagtctagtatatgcttgctgtcatcaagttccatacaattttacatatttataaatttttatttttgtgtattttcaattttaaccagtttgagaaataat

SEQ ID NO: 58685 - DNA, 201 bp, Bos taurus
tctagctgagcctacattgggtaaacagggtcacccaaaattactcttaggctggaaagtgaatcgaatattggccactgagatgggttctgtggcctcaattcaatctttatcctacgaacatgatcataatgcagcaattgtacctctggaaacctgacactgatggatgcttttggtgaagtgctttggtactaaggc

SEQ ID NO: 58686 - DNA, 201 bp, Bos taurus; identical to SEQ ID NO: 18056

SEQ ID NO: 58687 - DNA, 201 bp, Bos taurus
aaaggaatataagagagtgaagcagtcacaaaatggaaatattcagtctcttaccacatgtaatgttcagctggtagaccaaggattgtacagctgcattgtacacaatgagtatggagagaagacaatgtcagcaagatggctattggatttttagctctgacttggttcatttcatcctcatcacttcacacagctttt

SEQ ID NO: 58688 - DNA, 201 bp, Bos taurus; identical to SEQ ID NO: 18057

SEQ ID NO: 58689 - DNA, 201 bp, Bos taurus; identical to SEQ ID NO: 18058

SEQ ID NO: 58690 - DNA, 201 bp, Bos taurus; identical to SEQ ID NO: 18059

SEQ ID NO: 58691 - DNA, 201 bp, Bos taurus; identical to SEQ ID NO: 18060

SEQ ID NO: 58692 - DNA, 201 bp, Bos taurus; identical to SEQ ID NO: 18061

SEQ ID NO: 58693 - DNA, 201 bp, Bos taurus; identical to SEQ ID NO: 18062

SEQ ID NO: 58694 - DNA, 201 bp, Bos taurus; identical to SEQ ID NO: 18065

SEQ ID NO: 58695 - DNA, 201 bp, Bos taurus
ttatcctgggtgggcctaacttactaacaaacaaagctcaggctctgcaagcagctgcgcctgctctcttctcctggagccccttcagggctatctacatcgtggccttagcatctggttggccaacctccacaagaacatatgcctgtgtgtgtgtctatgtgtctgtctgtctgtgtgtgtttgtatgtgtgtctccct

SEQ ID NO: 58696 - DNA, 201 bp, Bos taurus
gggaagaaaacaagtattgactaaaaggaaatttgaagggtctgcatggattgtctctccatgtattttgttagcacatataattgatagcaatattaaggcattaaaaatattatttacttcctggtttgcattattagctcacatgtatttcattaacacacatgagcaagagtgatacatagcaacaagtgagctttc

SEQ ID NO: 58697 - DNA, 201 bp, Bos taurus; identical to SEQ ID NO: 18068

SEQ ID NO: 58698 - DNA, 201 bp, Bos taurus
cagacagttttcaactaagtggtctggtgatgaattagaagagatgagaaccagggagaggggattatttcagcatcatccactgagttggtgataggagagtgagctgtgtcctcctagctctgagttcccagatcgtttgcaaagtagtgagagttctgccattgtgtgagaccataatccgaggtctaattgggctaa

SEQ ID NO: 58699 - DNA, 201 bp, Bos taurus
tttaaaacttatgtattcatttgctcactgtttactcagcaaataggtattatttgcctaatatgtgttagactctggatatacaatagttcaaaaagtcgcatggagttttcagacaataattttagtctaccgctaatatgaattcagttcattttatcatttttttctttcttttcctagaacaatcttcatagaaga

SEQ ID NO: 58700 - DNA, 201 bp, Bos taurus; identical to SEQ ID NO: 18073

SEQ ID NO: 58701 - DNA, 201 bp, Bos taurus; identical to SEQ ID NO: 18074

SEQ ID NO: 58702 - DNA, 201 bp, Bos taurus; identical to SEQ ID NO: 18075

SEQ ID NO: 58703 - DNA, 201 bp, Bos taurus
taggaaagattctagtagataagacagcagatgctagttaaatcaggccccagacagggggaaaaaaaaatgctaagcaagactgctatagggggtcctgaaactagggaagcttcttcagggccttttctctgtgggtgataatcttttcacttccccacattctttcctccttagcatttattgaggataggaggagga

SEQ ID NO: 58704 - DNA, 201 bp, Bos taurus; identical to SEQ ID NO: 18077

SEQ ID NO: 58705 - DNA, 201 bp, Bos taurus
gctcatattatgcaacagtaccacttttgttagaaaatctgaaagaacagattatttatgcttcgaattaaaagtattatagaatttactgggagttaatgtatgcacaatggatggctccttacgtttaaccctaattctgctgaagacattgctttctgctcacacaggtacacgtgatttgagagcacccatctctgg

SEQ ID NO: 58706 - DNA, 201 bp, Bos taurus; identical to SEQ ID NO: 18078

SEQ ID NO: 58707 - DNA, 201 bp, Bos taurus; identical to SEQ ID NO: 18079

SEQ ID NO: 58708 - DNA, 201 bp, Bos taurus; identical to SEQ ID NO: 18083

SEQ ID NO: 58709 - DNA, 201 bp, Bos taurus; identical to SEQ ID NO: 18084

SEQ ID NO: 58710 - DNA, 201 bp, Bos taurus; identical to SEQ ID NO: 18085

SEQ ID NO: 58711 - DNA, 201 bp, Bos taurus; identical to SEQ ID NO: 18087

SEQ ID NO: 58712 - DNA, 201 bp, Bos taurus
actcactcactgatctgtctagtggctaacactggctgtctgctgggagctcattgttaaccgttgctggaatacctacacttgacaacgtgtgacctgcatgtgaactttccctgcaacagcttggctttgtcactaaatggtgaagatatccaagaacaagcattccaagagagggaggcagaggaaaactccgaagtc

SEQ ID NO: 58713 - DNA, 201 bp, Bos taurus
gagttgatgcttccttcactcactcgtgaggccacccgctgacgggcctccccttcgctcagggctttagagaaaattagagaagatgagacaagaggccaattctccccactccattcgcccccgccccaccaccgttgccttcctctcctaacccgcagtctcaaagcaagttcaacgacaggcctagactaaagagat

SEQ ID NO: 58714 - DNA, 201 bp, Bos taurus; identical to SEQ ID NO: 18088

SEQ ID NO: 58715 - DNA, 201 bp, Bos taurus
agttaagaacaaaacgtgggtgaagcctggaagtcaatgtccgtatcccccagccaggaccagccatcatgcttgggatgcccatctgccctctgtgcagtggggaggccctttgggacatgggaagcagacgatgctgctcattggatcatgctccactgtgcttggcccagccaaggtagacatgtgggtcttctggga

SEQ ID NO: 58716 - DNA, 201 bp, Bos taurus; identical to SEQ ID NO: 18093

SEQ ID NO: 58717 - DNA, 201 bp, Bos taurus
tgacatttcataggtccaaaaaaattaaaaatgaacacatctgaaattggacaccctagtaggtctttgataggggtagcagtagtggtagtctctcaatcgggtccaactctttgactccacaggctgttgcccaccaggctcctctgtccatgggattctccaggcaagaatactggagtagatttccattcctttctc

SEQ ID NO: 58718 - DNA, 201 bp, Bos taurus
tagcatctgtgtgaatctgagtgcagtgtgtgatggtgtctctgactgccccggtgggacagatgagtccccactttgcagtaagtctcctgaccacagtttactggccatgaactcatcctgagcaggggccagctgcgtgtcgtcattgtcacaatcaccatgtagttgttgaggaaggaatctcagttctctgaattt

SEQ ID NO: 58719 - DNA, 201 bp, Bos taurus
atctggagtgcgtttcaaaatggaacagataaaaaactagtaagtacataagtacatatctactggcctttgatctgactagttccccagtctcaggtctatttgctgttaatcaccagtgagagaaggtcctaccctatcttaagtggttctcatgtctccctctgggccatccatacttaaaagccctggatgttccta

SEQ ID NO: 58720 - DNA, 201 bp, Bos taurus; identical to SEQ ID NO: 18095

SEQ ID NO: 58721 - DNA, 201 bp, Bos taurus
gatttggggccacaaagatatgagggagattttgctaccaccagttcagagagccgatataccaatgtgggtgataacccagtacctaaactgaatcatcagtattaaatggtcaaggtgcccaggaaatgactagagttcactgaccactggcttaaatggcaatcagttcatgttatttctctgttatcatttcctggg

SEQ ID NO: 58722 - DNA, 201 bp, Bos taurus; identical to SEQ ID NO: 18097

SEQ ID NO: 58723 - DNA, 201 bp, Bos taurus; identical to SEQ ID NO: 18098

SEQ ID NO: 58724 - DNA, 201 bp, Bos taurus; identical to SEQ ID NO: 18099

SEQ ID NO: 58725 - DNA, 201 bp, Bos taurus; identical to SEQ ID NO: 18100

SEQ ID NO: 58726 - DNA, 201 bp, Bos taurus; identical to SEQ ID NO: 18101

SEQ ID NO: 58727 - DNA, 201 bp, Bos taurus; identical to SEQ ID NO: 18102

SEQ ID NO: 58728 - DNA, 201 bp, Bos taurus; identical to SEQ ID NO: 18103

SEQ ID NO: 58729 - DNA, 201 bp, Bos taurus
cgaagcagtcatttttatctcatggagagtgtaagatctggcatctgaagctctgttacttactagctatatgactataatcaagtcaagtctccacttacggcagatttggtagattagctaactgatttcccattccaatccccctttagcttttcttccaggaaataggtcatctgtaatagaagatgaagtccagac

SEQ ID NO: 58730 - DNA, 201 bp, Bos taurus; identical to SEQ ID NO: 18105

SEQ ID NO: 58731 - DNA, 201 bp, Bos taurus; identical to SEQ ID NO: 18106

SEQ ID NO: 58732 - DNA, 201 bp, Bos taurus; identical to SEQ ID NO: 18107

SEQ ID NO: 58733 - DNA, 201 bp, Bos taurus; identical to SEQ ID NO: 18108

SEQ ID NO: 58734 - DNA, 201 bp, Bos taurus; identical to SEQ ID NO: 18109

SEQ ID NO: 58735 - DNA, 201 bp, Bos taurus; identical to SEQ ID NO: 18110

SEQ ID NO: 58736 - DNA, 201 bp, Bos taurus; identical to SEQ ID NO: 18111

SEQ ID NO: 58737 - DNA, 201 bp, Bos taurus; identical to SEQ ID NO: 18114

SEQ ID NO: 58738 - DNA, 201 bp, Bos taurus; identical to SEQ ID NO: 18115

SEQ ID NO: 58739 - DNA, 201 bp, Bos taurus; identical to SEQ ID NO: 18116

SEQ ID NO: 58740 - DNA, 201 bp, Bos taurus; identical to SEQ ID NO: 18119

SEQ ID NO: 58741 - DNA, 201 bp, Bos taurus; identical to SEQ ID NO: 18120

SEQ ID NO: 58742 - DNA, 201 bp, Bos taurus; identical to SEQ ID NO: 18123

SEQ ID NO: 58743 - DNA, 201 bp, Bos taurus; identical to SEQ ID NO: 18126

SEQ ID NO: 58744 - DNA, 201 bp, Bos taurus
tggtaggcttgcatagctcacatcatctggatctgcctagataactcagctgacttcattgtttcattctcattcccttctttgtcattaatggtttttacttcctttggcccacttatcacactgtattgtaattccagaaggcctagagttcttgatagactttaaacacagctcagaagcataaggaattgcctcatc

SEQ ID NO: 58745 - DNA, 201 bp, Bos taurus
ttgccgaacggaattctttcttaccacccccttggcctacattatgcctcttccttcaggtttcacacattgcctgacacccaccccagatctcttattacagtgctgttggcctgtgccattatttcatagcatttatctcagttttgaaatcatccatgtacttccgtaattacttaaataacatacgctctttcctaa

SEQ ID NO: 58746 - DNA, 201 bp, Bos taurus
ctaaaagatttaacttatttaaaataagggggcacatccatatttctaaagtaataaggttttaattacaatgaacatcctttacataaaggcttggtaattaagattcttacaaatagaaaatgctaatttgtttctatattttactgtttgggataagattcttctagtgatatcatcattgtttaggatcttgaatgg

SEQ ID NO: 58747 - DNA, 201 bp, Bos taurus; identical to SEQ ID NO: 18127

SEQ ID NO: 58748 - DNA, 201 bp, Bos taurus; identical to SEQ ID NO: 18128

SEQ ID NO: 58749 - DNA, 201 bp, Bos taurus; identical to SEQ ID NO: 18129

SEQ ID NO: 58750 - DNA, 201 bp, Bos taurus
atgagcacgacaatttgcacagtaccaaggtaaaagcagacaccgatagtgcagaaagcatagatgaaagtcgccgcctactaacttctggaaatattcagacaagcccacctagggaaaaaggaaagaaaaaaagaaagaaaggaataaaatgtctggtattagaagtgcaaggcttgcaaataaagattaactaattcc

SEQ ID NO: 58751 - DNA, 201 bp, Bos taurus; identical to SEQ ID NO: 18130

SEQ ID NO: 58752 - DNA, 201 bp, Bos taurus; identical to SEQ ID NO: 18131

SEQ ID NO: 58753 - DNA, 201 bp, Bos taurus; identical to SEQ ID NO: 18132

SEQ ID NO: 58754 - DNA, 201 bp, Bos taurus; identical to SEQ ID NO: 18133

SEQ ID NO: 58755 - DNA, 201 bp, Bos taurus; identical to SEQ ID NO: 18134

SEQ ID NO: 58756 - DNA, 201 bp, Bos taurus; identical to SEQ ID NO: 18137

SEQ ID NO: 58757 - DNA, 201 bp, Bos taurus; identical to SEQ ID NO: 18138

SEQ ID NO: 58758 - DNA, 201 bp, Bos taurus; identical to SEQ ID NO: 18141

SEQ ID NO: 58759 - DNA, 201 bp, Bos taurus
aactgactgatgggggccctgtttgttactaagtttgcattttttcaattactctgcattctctaggtaggggagttcatcaaccccattgatttagacgtcagcaacttcatctgctccttttgctcattctctgaaatcttaagactaatgtctaaatatggcttcttgatccctgagcccatcacctttcttatatgc

SEQ ID NO: 58760 - DNA, 201 bp, Bos taurus
aaatggcataaggaaatttatttgttattttagcaacttccacagttatctgaaatctacctaagactggttaacttttttatgtgactaataaagagatatcaagtatttgacttttaaatatttttaaagggttcatgagttctatcataatccattgatcaggattgatcacaatcttcttggtcaagaaggaatgga

SEQ ID NO: 58761 - DNA, 201 bp, Bos taurus; identical to SEQ ID NO: 18142

SEQ ID NO: 58762 - DNA, 201 bp, Bos taurus; identical to SEQ ID NO: 18143

SEQ ID NO: 58763 - DNA, 201 bp, Bos taurus
gggaggggaactgggtgaattcggcttttccccccgaagttgcttcctcttttttgcagataaagtcattctctggctggtgctgggagccccagggagagtgagggtgaggtcccggctctcgggggtctgggtcccgtcctgtgcgcggagtcatgggggtggggaaggtgggaagcggcgaggcagctgtcgagaggg

SEQ ID NO: 58764 - DNA, 201 bp, Bos taurus; identical to SEQ ID NO: 18144

SEQ ID NO: 58765 - DNA, 201 bp, Bos taurus; identical to SEQ ID NO: 18145

SEQ ID NO: 58766 - DNA, 201 bp, Bos taurus; identical to SEQ ID NO: 18146

SEQ ID NO: 58767 - DNA, 201 bp, Bos taurus; identical to SEQ ID NO: 18147

SEQ ID NO: 58768 - DNA, 201 bp, Bos taurus; identical to SEQ ID NO: 18148

SEQ ID NO: 58769 - DNA, 201 bp, Bos taurus; identical to SEQ ID NO: 18149

SEQ ID NO: 58770 - DNA, 201 bp, Bos taurus; identical to SEQ ID NO: 18150

SEQ ID NO: 58771 - DNA, 201 bp, Bos taurus; identical to SEQ ID NO: 18151

SEQ ID NO: 58772 - DNA, 201 bp, Bos taurus; identical to SEQ ID NO: 18152

SEQ ID NO: 58773 - DNA, 201 bp, Bos taurus; identical to SEQ ID NO: 18153

SEQ ID NO: 58774 - DNA, 201 bp, Bos taurus; identical to SEQ ID NO: 18154

SEQ ID NO: 58775 - DNA, 201 bp, Bos taurus; identical to SEQ ID NO: 18155

SEQ ID NO: 58776 - DNA, 201 bp, Bos taurus; identical to SEQ ID NO: 18156

SEQ ID NO: 58777 - DNA, 201 bp, Bos taurus; identical to SEQ ID NO: 18157

SEQ ID NO: 58778 - DNA, 201 bp, Bos taurus; identical to SEQ ID NO: 18158

SEQ ID NO: 58779 - DNA, 201 bp, Bos taurus; identical to SEQ ID NO: 18159

SEQ ID NO: 58780 - DNA, 201 bp, Bos taurus; identical to SEQ ID NO: 18160

SEQ ID NO: 58781 - DNA, 201 bp, Bos taurus; identical to SEQ ID NO: 18161

SEQ ID NO: 58782 - DNA, 201 bp, Bos taurus
ggaggggaggggatttcagaagtggttgaaaattgcctattttttatgtcctttagatcacaacaactaatattttcattacatagattttcacactgttcttcaagtctctaagtgaagctctcatccagactgatattttctatctatactttcagttgaaacctactataatctcccctttaaaaaactaacttccaa

SEQ ID NO: 58783 - DNA, 201 bp, Bos taurus
aaaaatgcactgttgaactttaagtttactgcattctggaggcaatacctattctcattcaagtacaacatgtatctcatctacccacaaagtgggtatcagagcagcatctctcaaatccactaaatcgacctcttcacaccttcacaactggaagtcttacttcacagaggacacatctggaaattattctcggaaagc

SEQ ID NO: 58784 - DNA, 201 bp, Bos taurus; identical to SEQ ID NO: 18164

SEQ ID NO: 58785 - DNA, 201 bp, Bos taurus; identical to SEQ ID NO: 18165

SEQ ID NO: 58786 - DNA, 201 bp, Bos taurus; identical to SEQ ID NO: 18166

SEQ ID NO: 58787 - DNA, 201 bp, Bos taurus; identical to SEQ ID NO: 18167

SEQ ID NO: 58788 - DNA, 201 bp, Bos taurus; identical to SEQ ID NO: 18169

SEQ ID NO: 58789 - DNA, 201 bp, Bos taurus; identical to SEQ ID NO: 18170

SEQ ID NO: 58790 - DNA, 201 bp, Bos taurus; identical to SEQ ID NO: 18171

SEQ ID NO: 58791 - DNA, 201 bp, Bos taurus; identical to SEQ ID NO: 18174

SEQ ID NO: 58792 - DNA, 201 bp, Bos taurus; identical to SEQ ID NO: 18175

SEQ ID NO: 58793 - DNA, 201 bp, Bos taurus; identical to SEQ ID NO: 18176

SEQ ID NO: 58794 - DNA, 201 bp, Bos taurus; identical to SEQ ID NO: 18177

SEQ ID NO: 58795 - DNA, 201 bp, Bos taurus; identical to SEQ ID NO: 18178

SEQ ID NO: 58796 - DNA, 201 bp, Bos taurus; identical to SEQ ID NO: 18179

SEQ ID NO: 58797 - DNA, 201 bp, Bos taurus; identical to SEQ ID NO: 18180

SEQ ID NO: 58798 - DNA, 201 bp, Bos taurus; identical to SEQ ID NO: 18181

SEQ ID NO: 58799 - DNA, 201 bp, Bos taurus; identical to SEQ ID NO: 18182

SEQ ID NO: 58800 - DNA, 201 bp, Bos taurus; identical to SEQ ID NO: 18185

SEQ ID NO: 58801 - DNA, 201 bp, Bos taurus
actacttggggtagtaaagcaattataattggccatgtctttaaaacactctccttcttcccaaggaaaacaccgccctctccttaccagggctctggaaactggttggcctaaaatattttaaaacatacagtttgatttgtaaagatcaacagttggtctgaggaaaacgccatacattttaatctttcaaagtttata

SEQ ID NO: 58802 - DNA, 201 bp, Bos taurus; identical to SEQ ID NO: 18188

SEQ ID NO: 58803 - DNA, 201 bp, Bos taurus; identical to SEQ ID NO: 18190

SEQ ID NO: 58804 - DNA, 201 bp, Bos taurus
gactggatctgatttaaacactggactgggtccatctttaaaaatggtttgggtccagaactaaactgaggtcagactaggtttgacttgagctgaagtgagtccagtaagggccactgctaatgggaatctcagaagctgaaaaaaaaaggggggaggggtgcagaattgatgaaccttggttgagcatttcaaagctgt

SEQ ID NO: 58805 - DNA, 201 bp, Bos taurus; identical to SEQ ID NO: 18191

SEQ ID NO: 58806 - DNA, 201 bp, Bos taurus; identical to SEQ ID NO: 18192

SEQ ID NO: 58807 - DNA, 201 bp, Bos taurus; identical to SEQ ID NO: 18193

SEQ ID NO: 58808 - DNA, 201 bp, Bos taurus; identical to SEQ ID NO: 18194

SEQ ID NO: 58809 - DNA, 201 bp, Bos taurus
ctttgcctttggaaccaagaggaatattccccagaggcaacggaaatacttgtaacactggaagttatggtcacaaggattatttctggggccatgtgtcatctctgcttctattaacttgtcaatatagctctctctctctctgttcctgagtgctgaccagttcctacctgtcggccccaaataggcaataccctaggt

SEQ ID NO: 58810 - DNA, 201 bp, Bos taurus; identical to SEQ ID NO: 18195

SEQ ID NO: 58811 - DNA, 201 bp, Bos taurus; identical to SEQ ID NO: 18197

SEQ ID NO: 58812 - DNA, 201 bp, Bos taurus; identical to SEQ ID NO: 18198

SEQ ID NO: 58813 - DNA, 201 bp, Bos taurus; identical to SEQ ID NO: 18199

SEQ ID NO: 58814 - DNA, 201 bp, Bos taurus; identical to SEQ ID NO: 18200

SEQ ID NO: 58815 - DNA, 201 bp, Bos taurus; identical to SEQ ID NO: 18201

SEQ ID NO: 58816 - DNA, 201 bp, Bos taurus; identical to SEQ ID NO: 18202

SEQ ID NO: 58817 - DNA, 201 bp, Bos taurus; identical to SEQ ID NO: 18203

SEQ ID NO: 58818 - DNA, 201 bp, Bos taurus; identical to SEQ ID NO: 18204

SEQ ID NO: 58819 - DNA, 201 bp, Bos taurus; identical to SEQ ID NO: 18205

SEQ ID NO: 58820 - DNA, 201 bp, Bos taurus; identical to SEQ ID NO: 18206

SEQ ID NO: 58821 - DNA, 201 bp, Bos taurus; identical to SEQ ID NO: 18207

SEQ ID NO: 58822 - DNA, 201 bp, Bos taurus; identical to SEQ ID NO: 18208

SEQ ID NO: 58823 - DNA, 201 bp, Bos taurus; identical to SEQ ID NO: 18209

SEQ ID NO: 58824 - DNA, 201 bp, Bos taurus; identical to SEQ ID NO: 18210

SEQ ID NO: 58825 - DNA, 201 bp, Bos taurus; identical to SEQ ID NO: 18211

SEQ ID NO: 58826 - DNA, 201 bp, Bos taurus; identical to SEQ ID NO: 18212

SEQ ID NO: 58827 - DNA, 201 bp, Bos taurus; identical to SEQ ID NO: 18213

SEQ ID NO: 58828 - DNA, 201 bp, Bos taurus; identical to SEQ ID NO: 18214

SEQ ID NO: 58829 - DNA, 201 bp, Bos taurus; identical to SEQ ID NO: 18215

SEQ ID NO: 58830 - DNA, 201 bp, Bos taurus; identical to SEQ ID NO: 18216

SEQ ID NO: 58831 - DNA, 201 bp, Bos taurus; identical to SEQ ID NO: 18217

SEQ ID NO: 58832 - DNA, 201 bp, Bos taurus; identical to SEQ ID NO: 18218

SEQ ID NO: 58833 - DNA, 201 bp, Bos taurus; identical to SEQ ID NO: 18219

SEQ ID NO: 58834 - DNA, 201 bp, Bos taurus; identical to SEQ ID NO: 18220

SEQ ID NO: 58835 - DNA, 201 bp, Bos taurus; identical to SEQ ID NO: 18221

SEQ ID NO: 58836 - DNA, 201 bp, Bos taurus; identical to SEQ ID NO: 18222

SEQ ID NO: 58837 - DNA, 201 bp, Bos taurus; identical to SEQ ID NO: 18223

SEQ ID NO: 58838 - DNA, 201 bp, Bos taurus; identical to SEQ ID NO: 18224

SEQ ID NO: 58839 - DNA, 201 bp, Bos taurus; identical to SEQ ID NO: 18225

SEQ ID NO: 58840 - DNA, 201 bp, Bos taurus; identical to SEQ ID NO: 18226

SEQ ID NO: 58841 - DNA, 201 bp, Bos taurus; identical to SEQ ID NO: 18227

SEQ ID NO: 58842 - DNA, 201 bp, Bos taurus; identical to SEQ ID NO: 18228

SEQ ID NO: 58843 - DNA, 201 bp, Bos taurus; identical to SEQ ID NO: 18229

SEQ ID NO: 58844 - DNA, 201 bp, Bos taurus; identical to SEQ ID NO: 18230

SEQ ID NO: 58845 - DNA, 201 bp, Bos taurus; identical to SEQ ID NO: 18231

SEQ ID NO: 58846 - DNA, 201 bp, Bos taurus; identical to SEQ ID NO: 18232

SEQ ID NO: 58847 - DNA, 201 bp, Bos taurus; identical to SEQ ID NO: 18233

SEQ ID NO: 58848 - DNA, 201 bp, Bos taurus; identical to SEQ ID NO: 18234

SEQ ID NO: 58849 - DNA, 201 bp, Bos taurus; identical to SEQ ID NO: 18235

SEQ ID NO: 58850 - DNA, 201 bp, Bos taurus; identical to SEQ ID NO: 18236

SEQ ID NO: 58851 - DNA, 201 bp, Bos taurus; identical to SEQ ID NO: 18237

SEQ ID NO: 58852 - DNA, 201 bp, Bos taurus; identical to SEQ ID NO: 18238

SEQ ID NO: 58853 - DNA, 201 bp, Bos taurus; identical to SEQ ID NO: 18239

SEQ ID NO: 58854 - DNA, 201 bp, Bos taurus; identical to SEQ ID NO: 18240

SEQ ID NO: 58855 - DNA, 201 bp, Bos taurus; identical to SEQ ID NO: 18241

SEQ ID NO: 58856 - DNA, 201 bp, Bos taurus; identical to SEQ ID NO: 18242

SEQ ID NO: 58857 - DNA, 201 bp, Bos taurus; identical to SEQ ID NO: 18243

SEQ ID NO: 58858 - DNA, 201 bp, Bos taurus; identical to SEQ ID NO: 18244

SEQ ID NO: 58859 - DNA, 201 bp, Bos taurus; identical to SEQ ID NO: 18246

SEQ ID NO: 58860 - DNA, 201 bp, Bos taurus; identical to SEQ ID NO: 18248

SEQ ID NO: 58861 - DNA, 201 bp, Bos taurus; identical to SEQ ID NO: 18249

SEQ ID NO: 58862 - DNA, 201 bp, Bos taurus; identical to SEQ ID NO: 18250

SEQ ID NO: 58863 - DNA, 201 bp, Bos taurus; identical to SEQ ID NO: 18251

SEQ ID NO: 58864 - DNA, 201 bp, Bos taurus
tgttatgatttgtcagcttcctctcctggaatataattacatatgatttctaaagaacacatttttaggctaaagtttacaaggccatgtttacttctattaaaaatatcctcactcaccttaaatctgtattctctacctctcttgactgtaacccctctgccactactacctgtattatttctctttttctcaggcagc

SEQ ID NO: 58865 - DNA, 201 bp, Bos taurus; identical to SEQ ID NO: 18252

SEQ ID NO: 58866 - DNA, 201 bp, Bos taurus; identical to SEQ ID NO: 18253

SEQ ID NO: 58867 - DNA, 201 bp, Bos taurus; identical to SEQ ID NO: 18254

SEQ ID NO: 58868 - DNA, 201 bp, Bos taurus; identical to SEQ ID NO: 18256

SEQ ID NO: 58869 - DNA, 201 bp, Bos taurus; identical to SEQ ID NO: 18257

SEQ ID NO: 58870 - DNA, 201 bp, Bos taurus; identical to SEQ ID NO: 18259

SEQ ID NO: 58871 - DNA, 201 bp, Bos taurus; identical to SEQ ID NO: 18260

SEQ ID NO: 58872 - DNA, 201 bp, Bos taurus
gttagatacaaatttgtgttatgggttgtgtcatactaacatgggttttaatgtttggagatttcacattagtattcagtttaggacttccctgatggctcagatggtaaagaatctgcccgcaatgccagagacccaggttcgatccctgggtggggaagatcccttggagaagggaatagctacccactccagtattct

SEQ ID NO: 58873 - DNA, 201 bp, Bos taurus; identical to SEQ ID NO: 18261

SEQ ID NO: 58874 - DNA, 201 bp, Bos taurus; identical to SEQ ID NO: 18263

SEQ ID NO: 58875 - DNA, 201 bp, Bos taurus; identical to SEQ ID NO: 18264

SEQ ID NO: 58876 - DNA, 201 bp, Bos taurus; identical to SEQ ID NO: 18265

SEQ ID NO: 58877 - DNA, 201 bp, Bos taurus; identical to SEQ ID NO: 18266

SEQ ID NO: 58878 - DNA, 201 bp, Bos taurus; identical to SEQ ID NO: 18267

SEQ ID NO: 58879 - DNA, 201 bp, Bos taurus; identical to SEQ ID NO: 18268

SEQ ID NO: 58880 - DNA, 201 bp, Bos taurus; identical to SEQ ID NO: 18269

SEQ ID NO: 58881 - DNA, 201 bp, Bos taurus; identical to SEQ ID NO: 18271

SEQ ID NO: 58882 - DNA, 201 bp, Bos taurus; identical to SEQ ID NO: 18272

SEQ ID NO: 58883 - DNA, 201 bp, Bos taurus; identical to SEQ ID NO: 18273

SEQ ID NO: 58884 - DNA, 201 bp, Bos taurus; identical to SEQ ID NO: 18278

SEQ ID NO: 58885 - DNA, 201 bp, Bos taurus; identical to SEQ ID NO: 18279

SEQ ID NO: 58886 - DNA, 201 bp, Bos taurus; identical to SEQ ID NO: 18280

SEQ ID NO: 58887 - DNA, 201 bp, Bos taurus
cttttctgattcttgcattgggaagaagataaaatgagatgaactttaagttctctccctaatctaagactttatggatacaattaaccacagtgattctcaagatttattgcctttctgatcggaaaggcaatttaaatttatatacatgccatataatgtctataagatgataattaccttgataatttcatatatctt

SEQ ID NO: 58888 - DNA, 201 bp, Bos taurus
gtgctgagccttgcatatgccaggtttttgacaagtgatttttgcacatataggattaaattatttcacaggggagaaaaaagaacaaggaatgggaacattgaaggctccagaaaaggggagagcaaggtcacagtagctcttttttctcagatcctacaggaatctctgtaagttttctggcttagggaaatgactctg

SEQ ID NO: 58889 - DNA, 201 bp, Bos taurus
agcttcttatgcttgagtggtcttgcttttacttgtgaatggtggattttaatctgtaacaaggtattaaaagctattaagatgatacaaatgaatggcagctatgggctacagggaatggaatttttagtcaagagtggcagattctttaaggaataactttgcagtggagggacatttggggcaactctcataacctct

SEQ ID NO: 58890 - DNA, 201 bp, Bos taurus; identical to SEQ ID NO: 18281

SEQ ID NO: 58891 - DNA, 201 bp, Bos taurus; identical to SEQ ID NO: 18282

SEQ ID NO: 58892 - DNA, 201 bp, Bos taurus
attgtcgaatgcaatttgagaatgggttacctagtccccccactttacagaaaaagtattgggttggtcaaaaaactcattcatatttttttcagtaaatattatggaaaaacccaaacaaactttttggccaacctgatggttaataatcagcagggttaaatgctttccctgaggctacacaactggatacaaccaaga

SEQ ID NO: 58893 - DNA, 201 bp, Bos taurus
tcccaccccaagagtttctgattcagtaggcctgggtagggccatgaatttccatgtctaacaatttcccaggagatgctgattctggtgctgatggactaggatgtacaccttgaggcccatgaggtttgtcaatattaagttgtcacaaaagaaccacaaggctgagagagaatttctggagaagttgctatatgcttg

SEQ ID NO: 58894 - DNA, 201 bp, Bos taurus; identical to SEQ ID NO: 18283

SEQ ID NO: 58895 - DNA, 201 bp, Bos taurus; identical to SEQ ID NO: 18284

SEQ ID NO: 58896 - DNA, 201 bp, Bos taurus
gccaacatctggacaactcattttgagccagtttctcagcatatgttctggaaattcaatttcagttgacaatgggaagtgaatttggctagtctaaaaacggcctcgttttggcccccaagccagcgggatttctggccagagtcttctgctgcaggcatgtccctaagttttggcagtccatgtcagtcactggcaggt

SEQ ID NO: 58897 - DNA, 201 bp, Bos taurus; identical to SEQ ID NO: 18285

SEQ ID NO: 58898 - DNA, 201 bp, Bos taurus
attacaaaacctataaggccaaataaagtcatgagtctgagaccctgataatctacaactgaatattaactaccaaaggtcagctgagactatgggcctttgagtaacattcagccagaaactgccctacttgatatgtcttcacaaatgttataaactgaatgggactccagcaatttgtcccattagagtcagggccta

SEQ ID NO: 58899 - DNA, 201 bp, Bos taurus
gcatgaactccaatgaaggaatctattctccaggaattaatagtaacagcctgaaggaatatccaccctgcaaacccacagacacaaggagcccctgcacagatccccacaaggcatttgtttatgacacggattctcatgacgaggctgatgaggacgcttcctccttagcctctgtccaagcggttccaaaccagggct

SEQ ID NO: 58900 - DNA, 201 bp, Bos taurus
ccacagacacaaggagcccctgcacggatccccacaaggcatttgtttatgacacggattctcatgacgaggctgatgaggacgcttcctccttagcctcggtccaagcggttccaaaccagggctgcaggctgcacagttgtaaattaacccacagtgtctctgacagcctctttggctgggagctgaatggcaaacact

SEQ ID NO: 58901 - DNA, 201 bp, Bos taurus; identical to SEQ ID NO: 18288

SEQ ID NO: 58902 - DNA, 201 bp, Bos taurus; identical to SEQ ID NO: 18289

SEQ ID NO: 58903 - DNA, 201 bp, Bos taurus
cccagaaatcccaaggggacactgccctgcagagcacagtttgaaaaacagccacctagtggcatctgcaggactaaaggagcctctgcaacattgtttcattaagcagatccttcctgaagctcagtccagctctgatccacatacctccatagccttgtgctctttgtcaaggcaggtttagcagatggtaaatcatgg

SEQ ID NO: 58904 - DNA, 201 bp, Bos taurus
tccaaatgaagcagagctctgcatgcaagtaatcctttctcacatgctgatcctataggctttatattaaaattcttttaatagtccttatggtttccctctaaacatttagcaccattggagtttttggttgccttcacaaatagaagagcaagtttacctgtttattcattcctaaataataatgacaggtcaagttgt

SEQ ID NO: 58905 - DNA, 201 bp, Bos taurus
attctttaaaatttgcacactgaactattgcatttcagcatttcccatttttagtatttcccattcccatgcctcctgagtctgcatcttaacttgtcatcgaagtctttttctactttaaagtctgagaaggattgatgtgatctctatgatttctgaagccaatcttgtgatataggtatgttatgtgaccaaagagtg

SEQ ID NO: 58906 - DNA, 201 bp, Bos taurus
tgagtctgtttctgttttgtaagtaagttcacttgtatcctttctttttcgattccctttataagcagtatcatgtgatattcctttgtctgatttgcttcattgagtatgacaatctctaggttcatccatatagttgcaaatgacattattgcagtcttcttagtggctgagtaatatcacattgcatatatgtgccac

SEQ ID NO: 58907 - DNA, 201 bp, Bos taurus
tagcagtaaagagggtgatttacctcgctccagggaagtcttctcttcacacacatcaagaactggccacgagtcagacattggcctcagcatttgtggagtaaaaacaaagcctctagccccttagagccgacaggagcaataggtatggtgaggactgcgtagatccagtgtgtaattgcagcaaattctatgatagta

SEQ ID NO: 58908 - DNA, 201 bp, Bos taurus; identical to SEQ ID NO: 18291

SEQ ID NO: 58909 - DNA, 201 bp, Bos taurus
taaaaaacttgtacacatcaaatgttcaggtagaatggattctctgtgaatggattttgaatttactctgcatcttaccatatctttggtctgctgccgggatctccaaagtgatgtgtagcaaaatttggggagcatagtcttagtggattacagatataatatatttttggttattgttttaccaaaagattgtttact

SEQ ID NO: 58910 - DNA, 201 bp, Bos taurus
aatcatcaaaataaatgagttccaccaaaaaagagagtgaaagaaagagtgagggctgagaaagagccagacaaagtgagggaaaaaagttaaaatgtgcagactctggagcagaaaaatgcaggatgcagaaggaaggaagaagagatgagagagagtggaggatcaggtcatttaacagtgcttgagccattctgaaga

SEQ ID NO: 58911 - DNA, 201 bp, Bos taurus
catttatcagtagtttcctcttgtattctattttcttcctctaagaattattaaaaaaaagatattcccaggtgtgtggccttcaatcctgcctcgttcagccagaggaagcataattgagctttcagtaaactgtaagatgatagattttcacccgtcaagatgtgttggagaccaaaaataaacaattatagatacttc

SEQ ID NO: 58912 - DNA, 201 bp, Bos taurus
ccaggaagacttggttagcaactggaagcctgcttgcagtttggtagaggatgctgtctttggagccgagattgcccctcgccttccagctctggttatcacctacctgcctctctgcctccagcagggaatgggcccgtccacagccagctagctctcctctggtattcactcagtccttaggtttgtgagcaggctggc

SEQ ID NO: 58913 - DNA, 201 bp, Bos taurus; identical to SEQ ID NO: 18298

SEQ ID NO: 58914 - DNA, 201 bp, Bos taurus
gatacccatgatgcttaaataccagtggactttaatttttcaaagtcaaaatttcctcaactcgtccatagaaataatactgccagtttcataggattacggtaaactataaatatgctaatggttctatagtacctagcaagtacaagagaggagcagacacttagatgataggtagtggtaacaatacctggaatgatg

SEQ ID NO: 58915 - DNA, 201 bp, Bos taurus; identical to SEQ ID NO: 18300

SEQ ID NO: 58916 - DNA, 201 bp, Bos taurus
acagcaatgaaattacactgattggttagacctgggtcacatgctcatccctgaaccagtccctgtgactgaaggaatgcaaagaactggctggtccattgtgagtgatgttctttttatctggaatcaggcgtcacaccagacctacatggactgagccaggtatagacaaaggaactttgaggtgttattcccagaagc

SEQ ID NO: 58917 - DNA, 201 bp, Bos taurus; identical to SEQ ID NO: 18302

SEQ ID NO: 58918 - DNA, 201 bp, Bos taurus
aagctcaagaacctgcaagccaggcctgggatggccacatgcacccttccctggctgcagggcgacaccacacttccatcagggatgcctgggtcctggaaaaagattctttgcaagttgaagagcagagccttttaattgccatgtccccagtgacataaaatctcacaaacaacctccataaatcacaccctgacagct

SEQ ID NO: 58919 - DNA, 201 bp, Bos taurus
tttctggtagaaaatggccctaccccaggagcactgtgctggtggctcctcagcaaagtagaaaatgtcacttacgcatgagccgtgacaacagcatgtacaggcccgcacgtacgctttcctctgccgagcagctgctacagctgcaaactgcagggcaagatcaagaggactaaggaggccaacgaccccacatccaca

SEQ ID NO: 58920 - DNA, 201 bp, Bos taurus
aactgaaaagtttcacagctcagggccccagcttacatccttctggctggcagccccaggagaaagaaggctctcttcctccacagggacagaagtcgctatccatgcagccctaacgccagaatgccacgtgtctgacagtgtttgtgaggggtgctctctgaaggacagctgaggggtggaagccaggagaacaaagat

SEQ ID NO: 58921 - DNA, 201 bp, Bos taurus; identical to SEQ ID NO: 18315

SEQ ID NO: 58922 - DNA, 201 bp, Bos taurus
aatgggttatgccagcatctccctggtgcccacttgaggccttgatagtggtcttgtacagagaagatgccctggaagacagaccaggggtgcggatagtgatgagtgtcagggccacatggggtagggggtggatgagaggctgctccattatcctgtccattctggcctctgtgcctccttctgcagatcgagggctca

SEQ ID NO: 58923 - DNA, 201 bp, Bos taurus
tagcattcaacaactattactgtagggtaaggaaaaaaaaacttgcatacctattgcttttcatttctatcatctattttgatgtatgccaattcagatattacaaagtgttatctctataaaaagatattataaaaactatactaatattatcaaagagtacagcttagaataaaacagactgacagctgacataattct

SEQ ID NO: 58924 - DNA, 201 bp, Bos taurus; identical to SEQ ID NO: 18316

SEQ ID NO: 58925 - DNA, 201 bp, Bos taurus; identical to SEQ ID NO: 18317

SEQ ID NO: 58926 - DNA, 201 bp, Bos taurus; identical to SEQ ID NO: 18318

SEQ ID NO: 58927 - DNA, 201 bp, Bos taurus; identical to SEQ ID NO: 18319

SEQ ID NO: 58928 - DNA, 201 bp, Bos taurus; identical to SEQ ID NO: 18320

SEQ ID NO: 58929 - DNA, 201 bp, Bos taurus
ttggtgacatcatcttgcacattatattttctaacatagatgatttaaagattgaaatcatggccctactctgtttatattcataaataaagtcatggaaaatcatcaaaatggagtttatattaccagtcatttataaatgattgctgtgaaactttaagataacctgtcttctgagttatattaagaacttctcctgta

SEQ ID NO: 58930 - DNA, 201 bp, Bos taurus; identical to SEQ ID NO: 18321

SEQ ID NO: 58931 - DNA, 201 bp, Bos taurus; identical to SEQ ID NO: 18325

SEQ ID NO: 58932 - DNA, 201 bp, Bos taurus; identical to SEQ ID NO: 18326

SEQ ID NO: 58933 - DNA, 201 bp, Bos taurus
cagttctaactgttgggatgtaaatattctacctgatcttcctagattgttttgtgtctgtgtttttgattgttcacattttaggaaacttggccttgagcgtaaactctgaatttaggttatatcctcccggactcatatatggggaagtcctttgcatcttgttggtctgaatcgctgttgtaatatatttaattggtg

SEQ ID NO: 58934 - DNA, 201 bp, Bos taurus
ttctgtcactgtttccattgtgacctccatgaggtcacagagaatcgaacatgactgaataacaccaatattctggaaacatctaccataaataactgtttctttattcatcaaaataaatgcctctcaaaacactctctccagctcatggaaccaaaaggcatgaaggcaatttttttttttaagagttttaaacttcta

SEQ ID NO: 58935 - DNA, 201 bp, Bos taurus; identical to SEQ ID NO: 18331

SEQ ID NO: 58936 - DNA, 201 bp, Bos taurus
aaatatttgttcatcccagcaatgaagaagtgctcaggtgaatcttttgtaattatttgccctaaagtacccaaaatggtacaagtttggcaggagaactctggagtaggaggtcaggacaaaataggtagtccctgtgtcaatcaagcaattctcacagctacctcccacatccagctgtacccttggcctcggccccat

SEQ ID NO: 58937 - DNA, 201 bp, Bos taurus
aattactatagaccatatctcatctgagaggctgcctccaccaagtaattgactttatttagctgtggttctttgctgtggaaagtaattatatgtaataagcattccctcatcttcaagtcacccaagatatgaagccaatagcaagaagtgattgcatataatgggagtagttgtttctaacagttgatgtacagtttc

SEQ ID NO: 58938 - DNA, 201 bp, Bos taurus; identical to SEQ ID NO: 18332

SEQ ID NO: 58939 - DNA, 201 bp, Bos taurus; identical to SEQ ID NO: 18333

SEQ ID NO: 58940 - DNA, 201 bp, Bos taurus; identical to SEQ ID NO: 18334

SEQ ID NO: 58941 - DNA, 201 bp, Bos taurus
cttctcatcatgatcaaataagtcatatttataccatatgacaaatataaggatattgatattaccaataaaatcttggacctcagcttagctacagaaatcttatagttttacactgggctctcaattagtttactcagcactttcccctcctgaatagtaaaaagcctccccttgactcagtgtatgcatgctcagtca

SEQ ID NO: 58942 - DNA, 201 bp, Bos taurus; identical to SEQ ID NO: 18335

SEQ ID NO: 58943 - DNA, 201 bp, Bos taurus; identical to SEQ ID NO: 18336

SEQ ID NO: 58944 - DNA, 201 bp, Bos taurus
tgttttctagttttttgtaaacaaacttaatattatttgtcttctatgagtttctcctttgtttcaaaatcttatctttgagactcactcacattgtgcatgtgaccttggctcactcaggtttagtgttttacagcagtccactattggaaaaaccacaattcatgtgttttttcccactgtcaaaagatatttgtgggc

SEQ ID NO: 58945 - DNA, 201 bp, Bos taurus; identical to SEQ ID NO: 18337

SEQ ID NO: 58946 - DNA, 201 bp, Bos taurus; identical to SEQ ID NO: 18338

SEQ ID NO: 58947 - DNA, 201 bp, Bos taurus
ttggtttctgacgggaggaaagtcacatttttttgatatgatggggctggtcatgtggagaaggataagatgggtgtgggcccatgcctgttcttttcttgtgtggagggaagatgatttctgttcttgctggatgggatctgcactcaggcctccccactggtttcattgcacatggacatggggtggcagcatgagcag

SEQ ID NO: 58948 - DNA, 201 bp, Bos taurus
tgtgtctatatccttcctgtctcagtttacatcactaccccacccccagaaccagatattacaatggagaggacctgctgctccctcccagccaggcccccgctatccaactgggtgcataaacccaaaggcaacaattattgcggaggagttatgtgcagaaatcaatcgccttgcccttgatggggaggatcaggctca

SEQ ID NO: 58949 - DNA, 201 bp, Bos taurus
ggctcaaacacatctttattaatcaaagtaggaaccattacaatcaacacattttttgccaatgaaaaataaatttattcctgtagtgtaaaaatccatgctttgggatttgataaacatttggagagcattttctgcttcctgctggttgtggaagtgttttccctgcaaaaagttaatgagatgcttgaagaagtggta

SEQ ID NO: 58950 - DNA, 201 bp, Bos taurus
agtcgagaagggtgactaaaatgggggagaaagaaacaggaaatgttgacatctaaattgtggaagcagtaccaccagcttggccatttcatctctggcctgtgtcatcacttcagttttttatttcaagagaagtatgtgcacttgtaagatacatttgaaaaagcaaggatctcaagaggttcatgtccccagcccggc

SEQ ID NO: 58951 - DNA, 201 bp, Bos taurus; identical to SEQ ID NO: 18342

SEQ ID NO: 58952 - DNA, 201 bp, Bos taurus
tagcaaccgtatttatgcctgcagaaattcttcacttttgccacataatgtcactcagtcagggaagtgatagttcatcacattcactggagctgccccccctcaagggcagctgccacaatgcagcttataattctgcctatcatacttttgtagccccaagacctctagggcatctgacactgaataggagtttagtac

SEQ ID NO: 58953 - DNA, 201 bp, Bos taurus; identical to SEQ ID NO: 18343

SEQ ID NO: 58954 - DNA, 201 bp, Bos taurus
atgtgttggaaatattacacgtgggagctggtgaacacagcaagaaagcagcatctgtctcacacactcaagctgtgtgttctttcacctccaatctttgaatgttattgtcaactcccagctcccaagactcctcctctaagtagtatcacacctgctgcaaggcttagggactctctgtaaccagcttgtagcagtact

SEQ ID NO: 58955 - DNA, 201 bp, Bos taurus; identical to SEQ ID NO: 18344

SEQ ID NO: 58956 - DNA, 201 bp, Bos taurus; identical to SEQ ID NO: 18347

SEQ ID NO: 58957 - DNA, 201 bp, Bos taurus; identical to SEQ ID NO: 18350

SEQ ID NO: 58958 - DNA, 201 bp, Bos taurus; identical to SEQ ID NO: 18354

SEQ ID NO: 58959 - DNA, 201 bp, Bos taurus; identical to SEQ ID NO: 18355

SEQ ID NO: 58960 - DNA, 201 bp, Bos taurus; identical to SEQ ID NO: 18356

SEQ ID NO: 58961 - DNA, 201 bp, Bos taurus; identical to SEQ ID NO: 18357

SEQ ID NO: 58962 - DNA, 201 bp, Bos taurus; identical to SEQ ID NO: 18358

SEQ ID NO: 58963 - DNA, 201 bp, Bos taurus; identical to SEQ ID NO: 18361

SEQ ID NO: 58964 - DNA, 201 bp, Bos taurus; identical to SEQ ID NO: 18362

SEQ ID NO: 58965 - DNA, 201 bp, Bos taurus; identical to SEQ ID NO: 18363

SEQ ID NO: 58966 - DNA, 201 bp, Bos taurus; identical to SEQ ID NO: 18364

SEQ ID NO: 58967 - DNA, 201 bp, Bos taurus; identical to SEQ ID NO: 18367

SEQ ID NO: 58968 - DNA, 201 bp, Bos taurus; identical to SEQ ID NO: 18368

SEQ ID NO: 58969 - DNA, 201 bp, Bos taurus; identical to SEQ ID NO: 18369

SEQ ID NO: 58970 - DNA, 201 bp, Bos taurus; identical to SEQ ID NO: 18370

SEQ ID NO: 58971 - DNA, 201 bp, Bos taurus; identical to SEQ ID NO: 18371

SEQ ID NO: 58972 - DNA, 201 bp, Bos taurus; identical to SEQ ID NO: 18372

SEQ ID NO: 58973 - DNA, 201 bp, Bos taurus; identical to SEQ ID NO: 18373

SEQ ID NO: 58974 - DNA, 201 bp, Bos taurus; identical to SEQ ID NO: 18374

SEQ ID NO: 58975 - DNA, 201 bp, Bos taurus; identical to SEQ ID NO: 18375

SEQ ID NO: 58976 - DNA, 201 bp, Bos taurus; identical to SEQ ID NO: 18376

SEQ ID NO: 58977 - DNA, 201 bp, Bos taurus; identical to SEQ ID NO: 18377

SEQ ID NO: 58978 - DNA, 201 bp, Bos taurus; identical to SEQ ID NO: 18378

SEQ ID NO: 58979 - DNA, 201 bp, Bos taurus; identical to SEQ ID NO: 18379

SEQ ID NO: 58980 - DNA, 201 bp, Bos taurus; identical to SEQ ID NO: 18380

SEQ ID NO: 58981 - DNA, 201 bp, Bos taurus; identical to SEQ ID NO: 18381

SEQ ID NO: 58982 - DNA, 201 bp, Bos taurus; identical to SEQ ID NO: 18382

SEQ ID NO: 58983 - DNA, 201 bp, Bos taurus; identical to SEQ ID NO: 18383

SEQ ID NO: 58984 - DNA, 201 bp, Bos taurus; identical to SEQ ID NO: 18384

SEQ ID NO: 58985 - DNA, 201 bp, Bos taurus; identical to SEQ ID NO: 18385

SEQ ID NO: 58986 - DNA, 201 bp, Bos taurus; identical to SEQ ID NO: 18386

SEQ ID NO: 58987 - DNA, 201 bp, Bos taurus; identical to SEQ ID NO: 18387

SEQ ID NO: 58988 - DNA, 201 bp, Bos taurus; identical to SEQ ID NO: 18388

SEQ ID NO: 58989 - DNA, 201 bp, Bos taurus; identical to SEQ ID NO: 18390

SEQ ID NO: 58990 - DNA, 201 bp, Bos taurus
agtatggatagaggagaaagaagatattaagtatcaattgtggccctcggaaaaaccacagaggctaatttccaagttttttctcaggaagagagtaaggcgggtacatagaaaaaaggcccagtaaagcccaattatcgttgtaattctcatcccaaactccccactaggttggtttaggagttatgggggctgcatcat

SEQ ID NO: 58991 - DNA, 201 bp, Bos taurus
aggtcactggaataatggccaaatcatttatacctcttaaatatccatacggttgaataaaatggtcctaagtaaatggtcctaagaaacaaggaggcaatttgtgttaaattttaggccaagatgttgaaagttaaaaaaaaaatccttcccatcatggaaaactccaaaatacccctttctacctttcaaaggaacaaa

SEQ ID NO: 58992 - DNA, 201 bp, Bos taurus
agactgtatcttattcatatatgtgttttctccagcaccttgcatatggcatcttgtacatacagaagttcagcaatgtttgtcaaactaaaagatgagagatactactaagaaatatctggcaacactttgaaaactagattagagtaacagaaacaactaggggagcgctgtttgtattaatccatgtatgaagtgatg

SEQ ID NO: 58993 - DNA, 201 bp, Bos taurus; identical to SEQ ID NO: 18391

SEQ ID NO: 58994 - DNA, 201 bp, Bos taurus; identical to SEQ ID NO: 18392

SEQ ID NO: 58995 - DNA, 201 bp, Bos taurus
gataacctctattctactttctacatctttgattttgcatattttaggtaccacaggtcatacaacatttatccatttgtgactgactccatttcgcatagtattttcaaagttcatccaattgcagcacgcaccattacttcactcctttctatgactgaataacattccattgtatggatatgccacattttgtttatc

SEQ ID NO: 58996 - DNA, 201 bp, Bos taurus; identical to SEQ ID NO: 18393

SEQ ID NO: 58997 - DNA, 201 bp, Bos taurus; identical to SEQ ID NO: 18395

SEQ ID NO: 58998 - DNA, 201 bp, Bos taurus; identical to SEQ ID NO: 18396

SEQ ID NO: 58999 - DNA, 201 bp, Bos taurus; identical to SEQ ID NO: 18397

SEQ ID NO: 59000 - DNA, 201 bp, Bos taurus; identical to SEQ ID NO: 18398

SEQ ID NO: 59001 - DNA, 201 bp, Bos taurus; identical to SEQ ID NO: 18402

SEQ ID NO: 59002 - DNA, 201 bp, Bos taurus; identical to SEQ ID NO: 18403

SEQ ID NO: 59003 - DNA, 201 bp, Bos taurus; identical to SEQ ID NO: 18404

SEQ ID NO: 59004 - DNA, 201 bp, Bos taurus; identical to SEQ ID NO: 18406

SEQ ID NO: 59005 - DNA, 201 bp, Bos taurus; identical to SEQ ID NO: 18409

SEQ ID NO: 59006 - DNA, 201 bp, Bos taurus; identical to SEQ ID NO: 18413

SEQ ID NO: 59007 - DNA, 201 bp, Bos taurus
actgctgaccccatcagactttgggactggtcaagccaccacgatcacatgagccagttcaataaactaattctctccctatattgtttctgtttctctggagaaccctggctaatacacatctaagaaaattgttaacatttgttgactctggaattataggcctatggatagtcattatattaccttctctacttttga

SEQ ID NO: 59008 - DNA, 201 bp, Bos taurus; identical to SEQ ID NO: 18421

SEQ ID NO: 59009 - DNA, 201 bp, Bos taurus
ttattttttttgcagatgcagtcctaggagctcagggctcagtggcctatcaagataatgtagtctttgtgggaagaaaaagccttctcctctaaggacatgaagccctttaccagtgagttggcccacagcgcaagaactaacaactactcagctcttacatttgggcacaaatgtacagtcatgtagtgctccacacct

SEQ ID NO: 59010 - DNA, 201 bp, Bos taurus; identical to SEQ ID NO: 18423

SEQ ID NO: 59011 - DNA, 201 bp, Bos taurus; identical to SEQ ID NO: 18424

SEQ ID NO: 59012 - DNA, 201 bp, Bos taurus; identical to SEQ ID NO: 18425

SEQ ID NO: 59013 - DNA, 201 bp, Bos taurus; identical to SEQ ID NO: 18426

SEQ ID NO: 59014 - DNA, 201 bp, Bos taurus
gactgagtgacttccactattggtaaaaataaaagtgatgaaactttggcaagcctcataaggaaaaaaaaaaaaaaaaagagctcaactaataaaatcataaatgaacaacaaaaaattgcaaagaacatcatggaaatatagaggatgatattggattactatcaataaagttaacaaactggacaacctagaataaag

SEQ ID NO: 59015 - DNA, 201 bp, Bos taurus
tgtcttcaagtttccaagtcttatgaacaacatagagtcctgccatgtcagggagtgaacatatctgagagatgagcatgaatttatttgggatattagataggaaaggaggcctggcctaaagagagcagcaaatggataagagttggcaagaaaaggtaattatagcctacaaaaaccaccaaaaaaccctttttttta

SEQ ID NO: 59016 - DNA, 201 bp, Bos taurus
ttcatattactggaatggccaccatggtatggtgttccagctgctaaagaaacaatccgtgataaggcaataacttaccctgagcttcagggtcagtatgcgccatctattctcatgagtttaacatccataaaactctccagccctgacctctccctagaaatttaagttcttatgttcacaggactgctggtaaggtat

SEQ ID NO: 59017 - DNA, 201 bp, Bos taurus; identical to SEQ ID NO: 18427

SEQ ID NO: 59018 - DNA, 201 bp, Bos taurus; identical to SEQ ID NO: 18428

SEQ ID NO: 59019 - DNA, 201 bp, Bos taurus; identical to SEQ ID NO: 18429

SEQ ID NO: 59020 - DNA, 201 bp, Bos taurus; identical to SEQ ID NO: 18430

SEQ ID NO: 59021 - DNA, 201 bp, Bos taurus
ttaatgtgatttttaaataattatttttgtagcctataattcactctgtactcattcggttttttataattatatcaaaaacacagtgtctggccctgggagcaaaagaatactgtagttttagagatagcaattgagaggctagaaagaaagaaggaaggacatggcttgaacagtgatgtctctttgggggccacttga

SEQ ID NO: 59022 - DNA, 201 bp, Bos taurus; identical to SEQ ID NO: 18431

SEQ ID NO: 59023 - DNA, 201 bp, Bos taurus; identical to SEQ ID NO: 18432

SEQ ID NO: 59024 - DNA, 201 bp, Bos taurus
atttccttgaaataagttagtgacagatcacctggcaaatgctaatggtatttgctactaggagagtcattatctatggaccactgtcaccggatatctagggtgcttgtggaaaacaaacatacaatctatggatttatgtggcatggccctagggtaaaatgtaaattttttaaattatccaaatagttccttttgggc

SEQ ID NO: 59025 - DNA, 201 bp, Bos taurus; identical to SEQ ID NO: 18434

SEQ ID NO: 59026 - DNA, 201 bp, Bos taurus; identical to SEQ ID NO: 18435

SEQ ID NO: 59027 - DNA, 201 bp, Bos taurus; identical to SEQ ID NO: 18437

SEQ ID NO: 59028 - DNA, 201 bp, Bos taurus
ggaattccatcacctccactagctttgttcatagtgatgcttaccaccagggaaaaaatcactggccattagtgatttagttccccctacaacccttttcctcttcctggaggtataggggtaggaaggaaagttccaaccctttaattttgagttttctggcgaccagaatgtatctaagggttcccagctactgatacc

SEQ ID NO: 59029 - DNA, 201 bp, Bos taurus; identical to SEQ ID NO: 18438

SEQ ID NO: 59030 - DNA, 201 bp, Bos taurus
tatacaatattaccctcagccatttctttaaatatagaataatctagaaagaaatacacccatcccttgatgtctggaggggtttggttccacatcctcccccataccctgccacccacctaccaactccccactgacaccaaagttcagatgttcaggtcccttatataaagttgttcagtacagagggccatagatact

SEQ ID NO: 59031 - DNA, 201 bp, Bos taurus; identical to SEQ ID NO: 18439

SEQ ID NO: 59032 - DNA, 201 bp, Bos taurus
cttggccagctccctccagccgtctcatttccttttgccccacggccctatggtcactgcctccctccagagcttgctatgttggcttctctacgtgctctatccatcccggccccgagctgccccttcacccattcctccagccctgcagtctgcttttgcctgctgggcttaatcttcacacccgcctctttgagcccc

SEQ ID NO: 59033 - DNA, 201 bp, Bos taurus
acagtgcctgcagtaatcagaaacccaggagaagcagtcaccacctggctgtatgaagtctgcagaaaagcttttccacgggtcgccctcgagtgtgctttgctgaaaacaagcaaatccacacagctcagccgggtctttgctggtctttgctctcccggtcctactgtgtgaccatgggtttcacttcttaatagaccc

SEQ ID NO: 59034 - DNA, 201 bp, Bos taurus; identical to SEQ ID NO: 18440

SEQ ID NO: 59035 - DNA, 201 bp, Bos taurus; identical to SEQ ID NO: 18441

SEQ ID NO: 59036 - DNA, 201 bp, Bos taurus; identical to SEQ ID NO: 18442

SEQ ID NO: 59037 - DNA, 201 bp, Bos taurus; identical to SEQ ID NO: 18443

SEQ ID NO: 59038 - DNA, 201 bp, Bos taurus; identical to SEQ ID NO: 18444

SEQ ID NO: 59039 - DNA, 201 bp, Bos taurus; identical to SEQ ID NO: 18445

SEQ ID NO: 59040 - DNA, 201 bp, Bos taurus; identical to SEQ ID NO: 18446

SEQ ID NO: 59041 - DNA, 201 bp, Bos taurus; identical to SEQ ID NO: 18447

SEQ ID NO: 59042 - DNA, 201 bp, Bos taurus; identical to SEQ ID NO: 18448

SEQ ID NO: 59043 - DNA, 201 bp, Bos taurus; identical to SEQ ID NO: 18449

SEQ ID NO: 59044 - DNA, 201 bp, Bos taurus; identical to SEQ ID NO: 18450

SEQ ID NO: 59045 - DNA, 201 bp, Bos taurus; identical to SEQ ID NO: 18451

SEQ ID NO: 59046 - DNA, 201 bp, Bos taurus; identical to SEQ ID NO: 18452

SEQ ID NO: 59047 - DNA, 201 bp, Bos taurus; identical to SEQ ID NO: 18453

SEQ ID NO: 59048 - DNA, 201 bp, Bos taurus; identical to SEQ ID NO: 18454

SEQ ID NO: 59049 - DNA, 201 bp, Bos taurus; identical to SEQ ID NO: 18455

SEQ ID NO: 59050 - DNA, 201 bp, Bos taurus; identical to SEQ ID NO: 18456

SEQ ID NO: 59051 - DNA, 201 bp, Bos taurus; identical to SEQ ID NO: 18457

SEQ ID NO: 59052 - DNA, 201 bp, Bos taurus; identical to SEQ ID NO: 18458

SEQ ID NO: 59053 - DNA, 201 bp, Bos taurus; identical to SEQ ID NO: 18459

SEQ ID NO: 59054 - DNA, 201 bp, Bos taurus; identical to SEQ ID NO: 18460

SEQ ID NO: 59055 - DNA, 201 bp, Bos taurus; identical to SEQ ID NO: 18461

SEQ ID NO: 59056 - DNA, 201 bp, Bos taurus; identical to SEQ ID NO: 18462

SEQ ID NO: 59057 - DNA, 201 bp, Bos taurus; identical to SEQ ID NO: 18463

SEQ ID NO: 59058 - DNA, 201 bp, Bos taurus; identical to SEQ ID NO: 18464

SEQ ID NO: 59059 - DNA, 201 bp, Bos taurus; identical to SEQ ID NO: 18465

SEQ ID NO: 59060 - DNA, 201 bp, Bos taurus; identical to SEQ ID NO: 18466

SEQ ID NO: 59061 - DNA, 201 bp, Bos taurus; identical to SEQ ID NO: 18467

SEQ ID NO: 59062 - DNA, 201 bp, Bos taurus; identical to SEQ ID NO: 18468

SEQ ID NO: 59063 - DNA, 201 bp, Bos taurus
caccagtccaaggtgacccagccaaaagaggtagagtggtccaactcttccattatttcaaaggtagagatacaggtagcatctccatcagaaagaccaggaggaggcctgacctgtgaatctcaccatgcattattgatctgtcagctgaaataaataaagctctgcataaaacaggaggacaaagtgaaatttcactgg

SEQ ID NO: 59064 - DNA, 201 bp, Bos taurus; identical to SEQ ID NO: 18469

SEQ ID NO: 59065 - DNA, 201 bp, Bos taurus; identical to SEQ ID NO: 18473

SEQ ID NO: 59066 - DNA, 201 bp, Bos taurus
gtgtaggatgagcatgccttcagaatcattagatccatgtatatgttgggcaagggattgaacctcaaagccaatgatttcaaaatccaaggcagggagtaggaagggtgatgaagagtcagaatcacctagtcctcaagtgagtagggacagggaaagagtggagagttaacatggcccagggaaatgtgctaggattgt

SEQ ID NO: 59067 - DNA, 201 bp, Bos taurus
ctcaaagaaaaatttggaatggaaatagaaggatgaggctaggtgggcaggaaaatggaggaaatctgaagaaaaaaataacaaggctcatgacccattagctataggcctgtagaatactcatgcaaaaaaactcattgtttctgaatcagctcacaatactacggtgacttgggtccacttttcttgctaaggttggag

SEQ ID NO: 59068 - DNA, 201 bp, Bos taurus; identical to SEQ ID NO: 18474

SEQ ID NO: 59069 - DNA, 201 bp, Bos taurus; identical to SEQ ID NO: 18475

SEQ ID NO: 59070 - DNA, 201 bp, Bos taurus; identical to SEQ ID NO: 18476

SEQ ID NO: 59071 - DNA, 201 bp, Bos taurus
aaacaaaaacattaactttccctcttgtccttaaattcttgtgctcttaagtatttaagaacataacaaatgagtatcagtcattctgtgggttccatttaacaataacttctcttattgtccatgccacacaggtggtgctcatctagaattactgcatgcacatcacagacagagattccttatcatgattgacgatgc

SEQ ID NO: 59072 - DNA, 201 bp, Bos taurus; identical to SEQ ID NO: 18477

SEQ ID NO: 59073 - DNA, 201 bp, Bos taurus
agaacctggtactattatttagcaacttgatggtgctggccatatttgataacactcatgaagttggagtgtgtgataggaaatcagaatattggttaacgatagcccttagatgactggccgctagcttttcccattggcctcggtcaagtcagtgtcagtgatggctgttaagatgcttactcacatgatctctcgtgt

SEQ ID NO: 59074 - DNA, 201 bp, Bos taurus; identical to SEQ ID NO: 18478

SEQ ID NO: 59075 - DNA, 201 bp, Bos taurus
ggttttgtttttaaggacaaaagcttgaaagaacaatgttttgttgagaccatcaggatgagttatgtggttggatgcagtttaggactataacttgttatttagtccatcagtcatatatgacttttttgtgattccatggacggtagcccaccaggctcctatgtcctgggattttccaggcaagaatactggagtggg

SEQ ID NO: 59076 - DNA, 201 bp, Bos taurus; identical to SEQ ID NO: 18479

SEQ ID NO: 59077 - DNA, 201 bp, Bos taurus
tcacaggttagactgggctaaacaggtgaaagagaagaacgatgtgtgtctgtatgaacaccaccagcagcagccaaaacgacagataactggacagcgagataagagaataggacactgaaccaatctaccaaaaataaactgacagggaggaatccaaccaaacacatcgccaaaagtgtcagctaaaaatacagccag

SEQ ID NO: 59078 - DNA, 201 bp, Bos taurus; identical to SEQ ID NO: 18480

SEQ ID NO: 59079 - DNA, 201 bp, Bos taurus; identical to SEQ ID NO: 18481

SEQ ID NO: 59080 - DNA, 201 bp, Bos taurus; identical to SEQ ID NO: 18482

SEQ ID NO: 59081 - DNA, 201 bp, Bos taurus; identical to SEQ ID NO: 18483

SEQ ID NO: 59082 - DNA, 201 bp, Bos taurus; identical to SEQ ID NO: 18484

SEQ ID NO: 59083 - DNA, 201 bp, Bos taurus
gtctgcatttcagtcaaggtctcttctggatatactgttgcctaatcgctatcttgtaaagttaacctccaataatcctcatatgaaataatatgaagtaggggagagacagaggatgaaagtaagatacacatgtaacaagtgaaaaagaaaatacccatattttctatgaccggtaccaatcatgatgtcataatggat

SEQ ID NO: 59084 - DNA, 201 bp, Bos taurus; identical to SEQ ID NO: 18485

SEQ ID NO: 59085 - DNA, 201 bp, Bos taurus
ctgtccccagactacaggtccagacaggaatgaattttgtggccgtcttgtgaaatccatgtctggtgtgaaccacgtcttgtgtgaaccacacactgcatccagaccaggcagcggtgcctggccagttccagattcctattgcagaatcgatgatgatcacgctcacatgatctggattattaacttgattctttgaga

SEQ ID NO: 59086 - DNA, 201 bp, Bos taurus; identical to SEQ ID NO: 18486

SEQ ID NO: 59087 - DNA, 201 bp, Bos taurus; identical to SEQ ID NO: 18489

SEQ ID NO: 59088 - DNA, 201 bp, Bos taurus
ttcccaagccagggatcgaatccaggtctccctcattgcaggtggtttctttaccatctgagccaccagggaatcccataatgtacatccaggcctgccactgactttggatgatttttgtgcaaagtgtacatggtgcagatttgctactcatgaaagggacagcgggtttggccatgcaacgcttgagtattggtctgt

SEQ ID NO: 59089 - DNA, 201 bp, Bos taurus; identical to SEQ ID NO: 18490

SEQ ID NO: 59090 - DNA, 201 bp, Bos taurus; identical to SEQ ID NO: 18491

SEQ ID NO: 59091 - DNA, 201 bp, Bos taurus; identical to SEQ ID NO: 18492

SEQ ID NO: 59092 - DNA, 201 bp, Bos taurus; identical to SEQ ID NO: 18493

SEQ ID NO: 59093 - DNA, 201 bp, Bos taurus; identical to SEQ ID NO: 18494

SEQ ID NO: 59094 - DNA, 201 bp, Bos taurus
cagggccctcccacagcctgtggctttaccttcctcctggaatctggagcctgtccatccagatggcaggaggagaatgaaggaacgctgcacatttcatcggccaggcttggacaaggaatacatctcttctgcccgcatttcaggggtcaggactcagttatatgggacgcctacctgccaaggagactgggaaaggtc

SEQ ID NO: 59095 - DNA, 201 bp, Bos taurus; identical to SEQ ID NO: 18504

SEQ ID NO: 59096 - DNA, 201 bp, Bos taurus; identical to SEQ ID NO: 18509

SEQ ID NO: 59097 - DNA, 201 bp, Bos taurus
agacctttctctctccttttatcacaacacagacaccctgggggtccttgctgggagctctgggagggcagagagggcctgagcatcttcccagtgtcctgcagagtgggcatggtatacctgaacttgcagaagtcacagggcagggccgacaccctgtctcgagagctccaaggtgccacttcatctaggacaaccccc

SEQ ID NO: 59098 - DNA, 201 bp, Bos taurus; identical to SEQ ID NO: 18511

SEQ ID NO: 59099 - DNA, 201 bp, Bos taurus
aattcacaatctgccgttccagaaaatccttttcacctggacacattaccctttcctgccagttgcatcaagtaggcctggcagcccctctcatcaagttagggctgaggacagtcttcagagtcaaaaaggctagtgtcctgaccacggtcctgccacaccctcgctctataatctacatggtaaaaaaaacatcacctt

SEQ ID NO: 59100 - DNA, 201 bp, Bos taurus
accccctacctcattcctcagcatctcccatcctctctgcactttgccacgctgagaggaatagcaggggccttggcaggccatgcctgccatcctgcaccctgccagggcacagtgttcccattgtcttgagcagcgagaggtgtccaggtcctggcaaggggtgggggatcatgccaggcttctcctgtctccaggggc

SEQ ID NO: 59101 - DNA, 201 bp, Bos taurus
ccttaaatgtgctctgacctagttccctgtgaaaattcaatagtggtagtttacatgtttttgaaacactttgaaattattttatataaagtttggttgtggtgaatttattgaaaatattttctttgaaaaaagttccctaagtagatttttcaatatttttttaaaaaaggtatttctgtaacacaataaaagtaagag

SEQ ID NO: 59102 - DNA, 201 bp, Bos taurus
cagccacatacagccctccgttctgcaggtctgccaggtcggtgacagggtggccataaggggtgtagagagcacgcacggccactggggcccgcacagccgatgtcacctcacagaggaaggtctccagggtggggaagcggcgttgagtcaccaccagctggcggcctggggagaaggggtccccgttctggtacacca

SEQ ID NO: 59103 - DNA, 201 bp, Bos taurus; identical to SEQ ID NO: 18516

SEQ ID NO: 59104 - DNA, 201 bp, Bos taurus; identical to SEQ ID NO: 18517

SEQ ID NO: 59105 - DNA, 201 bp, Bos taurus; identical to SEQ ID NO: 18518

SEQ ID NO: 59106 - DNA, 201 bp, Bos taurus; identical to SEQ ID NO: 18519

SEQ ID NO: 59107 - DNA, 201 bp, Bos taurus; identical to SEQ ID NO: 18520

SEQ ID NO: 59108 - DNA, 201 bp, Bos taurus; identical to SEQ ID NO: 18523

SEQ ID NO: 59109 - DNA, 201 bp, Bos taurus; identical to SEQ ID NO: 18526

SEQ ID NO: 59110 - DNA, 201 bp, Bos taurus; identical to SEQ ID NO: 18527

SEQ ID NO: 59111 - DNA, 201 bp, Bos taurus
aaccatgccatccatgtctgtgactccagcgcccacctcagctgtcggtaagtgacagtgaatcagaaacccagacaggaacagattttggaggagggccatggggtttggtgtcaggatgcctgaacctcagttcccccacctgtcaggtggaaacaataacccccaccctggggaatcatgaagtgaaggggcccagca

SEQ ID NO: 59112 - DNA, 201 bp, Bos taurus
gctgcacttacagtgggaaccagccaggccgctgctgactggcacagggctgtgtcttttggactgtggtcctcatgtccacagttcctaatcaggccagtgtctgttctttctcatctcgtgcagagatactgtcatgccagaatgtgtgccctttccccatgaaggtctgaccgaggcctccctgcccagaatcatcta

SEQ ID NO: 59113 - DNA, 201 bp, Bos taurus; identical to SEQ ID NO: 18529

SEQ ID NO: 59114 - DNA, 201 bp, Bos taurus; identical to SEQ ID NO: 18530

SEQ ID NO: 59115 - DNA, 201 bp, Bos taurus; identical to SEQ ID NO: 18531

SEQ ID NO: 59116 - DNA, 201 bp, Bos taurus; identical to SEQ ID NO: 18532

SEQ ID NO: 59117 - DNA, 201 bp, Bos taurus; identical to SEQ ID NO: 18533

SEQ ID NO: 59118 - DNA, 201 bp, Bos taurus; identical to SEQ ID NO: 18534

SEQ ID NO: 59119 - DNA, 201 bp, Bos taurus; identical to SEQ ID NO: 18537

SEQ ID NO: 59120 - DNA, 201 bp, Bos taurus; identical to SEQ ID NO: 18538

SEQ ID NO: 59121 - DNA, 201 bp, Bos taurus
aaaaaaatggaattagtggccaagggatggagggacgggctagccctggttggggacatctcagggtctttagcaacgtgctgtgctcgggggtaggcctcacctggggagttgcccaggactccagaggaggggatggatttattttggtcagtgagagggcactggttgttaaccccacacatcccagtggccccctca

SEQ ID NO: 59122 - DNA, 201 bp, Bos taurus
gaattcaggcaggaggaaaggatcagctggatcccaggccttcaaaggtggaagcccaaagagtagcttcagggaggctgtggatttaccacacctcccccaaatccaaaccctgtccatggcctctgcatggctctacttaaaataccactagctgcctttggttgactatctgtgtgcgaaggacgtcatgtacttttc

SEQ ID NO: 59123 - DNA, 201 bp, Bos taurus; identical to SEQ ID NO: 18542

SEQ ID NO: 59124 - DNA, 201 bp, Bos taurus; identical to SEQ ID NO: 18543

SEQ ID NO: 59125 - DNA, 201 bp, Bos taurus
tgctcaggaaatgctagtggcctgtaccgtggtcccagtctgaaaacaggttccctgggaagggctggtttccctggattctcccatgcccagtgcccaggacctgggtgcgatgtgggccagctggtgctgttcagtggacatttgctgagtaccatctgcacgccaaacactgtgctgggcactgaggattcaagagcg

SEQ ID NO: 59126 - DNA, 201 bp, Bos taurus; identical to SEQ ID NO: 18544

SEQ ID NO: 59127 - DNA, 201 bp, Bos taurus
aagtgggcagtgcccagggctgccaatactgggtttggccatgcagagaccctcatcttcctggaggggtgtcatggccaggttataacccagcatcttggggttctgggttggaggattcaggcctctggctccctggcccagccttattccagtgagtgcccaagaaaggaaggatgaatttaatgtgctgctcgccct

SEQ ID NO: 59128 - DNA, 201 bp, Bos taurus; identical to SEQ ID NO: 18545

SEQ ID NO: 59129 - DNA, 201 bp, Bos taurus; identical to SEQ ID NO: 18546

SEQ ID NO: 59130 - DNA, 201 bp, Bos taurus; identical to SEQ ID NO: 18550

SEQ ID NO: 59131 - DNA, 201 bp, Bos taurus; identical to SEQ ID NO: 18555

SEQ ID NO: 59132 - DNA, 201 bp, Bos taurus; identical to SEQ ID NO: 18556

SEQ ID NO: 59133 - DNA, 201 bp, Bos taurus; identical to SEQ ID NO: 18557

SEQ ID NO: 59134 - DNA, 201 bp, Bos taurus; identical to SEQ ID NO: 18558

SEQ ID NO: 59135 - DNA, 201 bp, Bos taurus; identical to SEQ ID NO: 18559

SEQ ID NO: 59136 - DNA, 201 bp, Bos taurus
ccatggcctgtggcctgtccctgcccctcttctcccctctacttctccatctgtgcaatgggtgagttaggctaattagttcgtccagcactcaggtcactgagtccagtacagggcccccagcacagcccagtgattcttccctcccttcacccagcaccttctctcaccgcaggtgtgcgccaggttactacggcaacc

SEQ ID NO: 59137 - DNA, 201 bp, Bos taurus; identical to SEQ ID NO: 18560

SEQ ID NO: 59138 - DNA, 201 bp, Bos taurus; identical to SEQ ID NO: 18561

SEQ ID NO: 59139 - DNA, 201 bp, Bos taurus; identical to SEQ ID NO: 18562

SEQ ID NO: 59140 - DNA, 201 bp, Bos taurus; identical to SEQ ID NO: 18564

SEQ ID NO: 59141 - DNA, 201 bp, Bos taurus
cctggatttggtgatggacagggaggcctggagtgctgcagtccatggcgtcgcaaagagtcagacatgactgagcaactgaactgaactgaactgtcccaaaaatccctggccgcgaagcatctggcactaactctcacacaacagtaatcctgctgctaagtcacttcagtcgtgtccgactctgtgcaaccccataga

SEQ ID NO: 59142 - DNA, 201 bp, Bos taurus
aagaaacagatccctcaaataggctgatatttattaaagaaattgagttgataactaataaccttccaaaacaaaaaccacctggcccagatgatttcagcggtgaattctatcaaatatttaaggaagaaattacaccacttttctacaatctcttccagaaaattcttacaaaaactccctaactcattctacaaggcc

SEQ ID NO: 59143 - DNA, 201 bp, Bos taurus
tgaattcatagggaaaatcctgaaagatgaaaaaggagaggcagtctgtgacatcaccagagtccttgaatgcggggacctggacatgataccaggggcccccaggatacacgggggtggggcagtttgcctgccatagagacaacagtattcccaagttgaagtgcttagtaaaaggcgaaggcctagcccatcacctct

SEQ ID NO: 59144 - DNA, 201 bp, Bos taurus
ccactgctgggaaacgaggggtgcccagggagtgtgggtcagggctgggggcgagcgcctcaggcctcgtgtgcagtccctggggccttcagtccatctctgtgccatctcccacctgcggctgctccgtgtgcccagctgaaatctgatcacattacagtgtggccttggagagaggtcgctcagtcgtgtctgactctg

SEQ ID NO: 59145 - DNA, 201 bp, Bos taurus
actgcagcctctatgtaaccgagcactcagcatgcatcaggcatgtgttccagacgctttataggcatgactgtctctggtgtctctgcctggcaatatgttgggtttctcttttaaccctcacacgagccctgtggggtatattgccctccaatttaaaggtgagacagcggagacctggagagagaatagctgctgttg

SEQ ID NO: 59146 - DNA, 201 bp, Bos taurus; identical to SEQ ID NO: 18566

SEQ ID NO: 59147 - DNA, 201 bp, Bos taurus; identical to SEQ ID NO: 18567

SEQ ID NO: 59148 - DNA, 201 bp, Bos taurus; identical to SEQ ID NO: 18568

SEQ ID NO: 59149 - DNA, 201 bp, Bos taurus
gccccggggtgggttgcagccttgattctcgctctgagcctcagtttcctgtctgtaaagtcagaggtttgccttcccctgagggaagggcctgtgcttctcggcaccagggtaattaagagtctggttgctgggatttccttgatggtccagtcagtggttaagaatcaacgcgggttcgatctccggtctgggaaataa

SEQ ID NO: 59150 - DNA, 201 bp, Bos taurus; identical to SEQ ID NO: 18570

SEQ ID NO: 59151 - DNA, 201 bp, Bos taurus
acgggtctggatagatgctagggactcgcacatctgtgcacagcagcatgccctgaccaggtgggagcaaggtctgaacgtttccgttttcctgaaagcccgtcacagaggccttcgctgcctcccagagcttcctcaaactcatgtcccttgggtcagtgacggtgtcgaaccgtctcatcctctgccgccccttctcct

SEQ ID NO: 59152 - DNA, 201 bp, Bos taurus; identical to SEQ ID NO: 18572

SEQ ID NO: 59153 - DNA, 201 bp, Bos taurus
agtcctatctgtgctgcagggccatgcggggcaggggctactgttattcagtttacagaggtccagagcatcacctctcagaaactgcctccagcctgctagagaccggagggtgcgtggcgtggccgtgttggtgatgctgggtggggaaagaggatgacgacttcacatcgtcagccactgaggctgctgaaatgaaag

SEQ ID NO: 59154 - DNA, 201 bp, Bos taurus; identical to SEQ ID NO: 18575

SEQ ID NO: 59155 - DNA, 201 bp, Bos taurus
tctgatgcttccaaactctccaacccaatgggaaacccacctctcacgtcctctgctgccatccctggccccttagagtcctagacagcttccttggcccgcctgcacgtgctccagtctgttccccaacgaacagagcatgctcttcctgtgctcagaagcgctggtcccagccacacgcagcatcgtctcggacggcac

SEQ ID NO: 59156 - DNA, 201 bp, Bos taurus; identical to SEQ ID NO: 18576

SEQ ID NO: 59157 - DNA, 201 bp, Bos taurus; identical to SEQ ID NO: 18578

SEQ ID NO: 59158 - DNA, 201 bp, Bos taurus; identical to SEQ ID NO: 18579

SEQ ID NO: 59159 - DNA, 201 bp, Bos taurus; identical to SEQ ID NO: 18580

SEQ ID NO: 59160 - DNA, 201 bp, Bos taurus; identical to SEQ ID NO: 18581

SEQ ID NO: 59161 - DNA, 201 bp, Bos taurus; identical to SEQ ID NO: 18582

SEQ ID NO: 59162 - DNA, 201 bp, Bos taurus; identical to SEQ ID NO: 18583

SEQ ID NO: 59163 - DNA, 201 bp, Bos taurus; identical to SEQ ID NO: 18584

SEQ ID NO: 59164 - DNA, 201 bp, Bos taurus; identical to SEQ ID NO: 18585

SEQ ID NO: 59165 - DNA, 201 bp, Bos taurus; identical to SEQ ID NO: 18586

SEQ ID NO: 59166 - DNA, 201 bp, Bos taurus; identical to SEQ ID NO: 18587

SEQ ID NO: 59167 - DNA, 201 bp, Bos taurus; identical to SEQ ID NO: 18588

SEQ ID NO: 59168 - DNA, 201 bp, Bos taurus; identical to SEQ ID NO: 18589

SEQ ID NO: 59169 - DNA, 201 bp, Bos taurus; identical to SEQ ID NO: 18590

SEQ ID NO: 59170 - DNA, 201 bp, Bos taurus; identical to SEQ ID NO: 18591

SEQ ID NO: 59171 - DNA, 201 bp, Bos taurus; identical to SEQ ID NO: 18592

SEQ ID NO: 59172 - DNA, 201 bp, Bos taurus; identical to SEQ ID NO: 18593

SEQ ID NO: 59173 - DNA, 201 bp, Bos taurus; identical to SEQ ID NO: 18594

SEQ ID NO: 59174 - DNA, 201 bp, Bos taurus; identical to SEQ ID NO: 18595

SEQ ID NO: 59175 - DNA, 201 bp, Bos taurus; identical to SEQ ID NO: 18596

SEQ ID NO: 59176 - DNA, 201 bp, Bos taurus; identical to SEQ ID NO: 18597

SEQ ID NO: 59177 - DNA, 201 bp, Bos taurus; identical to SEQ ID NO: 18598

SEQ ID NO: 59178 - DNA, 201 bp, Bos taurus; identical to SEQ ID NO: 18599

SEQ ID NO: 59179 - DNA, 201 bp, Bos taurus; identical to SEQ ID NO: 18600

SEQ ID NO: 59180 - DNA, 201 bp, Bos taurus; identical to SEQ ID NO: 18601

SEQ ID NO: 59181 - DNA, 201 bp, Bos taurus; identical to SEQ ID NO: 18602

SEQ ID NO: 59182 - DNA, 201 bp, Bos taurus; identical to SEQ ID NO: 18603

SEQ ID NO: 59183 - DNA, 201 bp, Bos taurus; identical to SEQ ID NO: 18604

SEQ ID NO: 59184 - DNA, 201 bp, Bos taurus; identical to SEQ ID NO: 18605

SEQ ID NO: 59185 - DNA, 201 bp, Bos taurus; identical to SEQ ID NO: 18606

SEQ ID NO: 59186 - DNA, 201 bp, Bos taurus; identical to SEQ ID NO: 18607

SEQ ID NO: 59187 - DNA, 201 bp, Bos taurus; identical to SEQ ID NO: 18608

SEQ ID NO: 59188 - DNA, 201 bp, Bos taurus; identical to SEQ ID NO: 18609

SEQ ID NO: 59189 - DNA, 201 bp, Bos taurus; identical to SEQ ID NO: 18610

SEQ ID NO: 59190 - DNA, 201 bp, Bos taurus; identical to SEQ ID NO: 18611

SEQ ID NO: 59191 - DNA, 201 bp, Bos taurus; identical to SEQ ID NO: 18612

SEQ ID NO: 59192 - DNA, 201 bp, Bos taurus; identical to SEQ ID NO: 18613

SEQ ID NO: 59193 - DNA, 201 bp, Bos taurus; identical to SEQ ID NO: 18614

SEQ ID NO: 59194 - DNA, 201 bp, Bos taurus; identical to SEQ ID NO: 18615

SEQ ID NO: 59195 - DNA, 201 bp, Bos taurus; identical to SEQ ID NO: 18616

SEQ ID NO: 59196 - DNA, 201 bp, Bos taurus; identical to SEQ ID NO: 18618

SEQ ID NO: 59197 - DNA, 201 bp, Bos taurus; identical to SEQ ID NO: 18619

SEQ ID NO: 59198 - DNA, 201 bp, Bos taurus
ctacagtttaaaaagtttgatgtaaaaataaatgatgagattgtcactgctcttctcaataagaaaataaaagtccctaaataaaatgttcatattgttttaaatgagaatttaatgcccagtgacatgctgatgtctttagtctcagacacatcgtggaatcttctattaaactttctggtgaaatttgccaaaattacc

SEQ ID NO: 59199 - DNA, 201 bp, Bos taurus; identical to SEQ ID NO: 18622

SEQ ID NO: 59200 - DNA, 201 bp, Bos taurus
aaggctttgtcttcccaaggtgccggctacagactaggctttaaatttattctcctgaattcctctaggaatgagatctgttttacctattaaagttattcaaatggggtatgttgcaccaaaatgctggacaaagggatagatgcttagccataccagactcagattcacgacctagaattgggaatatttctaactcag

SEQ ID NO: 59201 - DNA, 201 bp, Bos taurus; identical to SEQ ID NO: 18623

SEQ ID NO: 59202 - DNA, 201 bp, Bos taurus
agatcttattataaattctcctgctatgccatggtctagtgagcaatgccctcatcactttcatcatcttactaagtaaatctctctaatctcaacacatatgtagaggcctcttcttcctcttgagcgatatgtggtcagaaacctaataggcaagtctttctgactgtcaacattaccaaacatctgtgaaaatccttt

SEQ ID NO: 59203 - DNA, 201 bp, Bos taurus; identical to SEQ ID NO: 18625

SEQ ID NO: 59204 - DNA, 201 bp, Bos taurus; identical to SEQ ID NO: 18627

SEQ ID NO: 59205 - DNA, 201 bp, Bos taurus; identical to SEQ ID NO: 18628

SEQ ID NO: 59206 - DNA, 201 bp, Bos taurus; identical to SEQ ID NO: 18633

SEQ ID NO: 59207 - DNA, 201 bp, Bos taurus; identical to SEQ ID NO: 18634

SEQ ID NO: 59208 - DNA, 201 bp, Bos taurus; identical to SEQ ID NO: 18635

SEQ ID NO: 59209 - DNA, 201 bp, Bos taurus
ggacagaggtgatgtcaccttcctccaggacgagggcttcggctgggcccgttgctgtaggttgagttactgcctgtggaggggctcagagctggatggcgttgacgggttgacccggagaggcctcctctgaggacagccgctggcgtatctgaggtggtgtggtaccatagctcccgcaagggccaagctccacggacc

SEQ ID NO: 59210 - DNA, 201 bp, Bos taurus; identical to SEQ ID NO: 18639

SEQ ID NO: 59211 - DNA, 201 bp, Bos taurus; identical to SEQ ID NO: 18640

SEQ ID NO: 59212 - DNA, 201 bp, Bos taurus; identical to SEQ ID NO: 18641

SEQ ID NO: 59213 - DNA, 201 bp, Bos taurus; identical to SEQ ID NO: 18642

SEQ ID NO: 59214 - DNA, 201 bp, Bos taurus; identical to SEQ ID NO: 18643

SEQ ID NO: 59215 - DNA, 201 bp, Bos taurus
gaagagaattgctcattctgcagaaaccagagttccacggaagcagccaatcagcgtaagaagagaggaagtgacagagccaggtggagccagagagccagctttatggaaaaacactggcactagcttaaaacaggctgcacctctggcagttcctccccacaaaggagatggtgacgtggctgctgtgggaccagaaga

SEQ ID NO: 59216 - DNA, 201 bp, Bos taurus
ggttccagccttggtcggggaactaagagcccacatgtctcgcaacatggccaaaataaatacataagaaaagcattcctgggaggagtaaaaaggcccagaattctagctctatcagtagcttgctaggcaagtcacttaacctctctgagcctcagttctttcacctttatggtagttttcaaagtatcatatatgggg

SEQ ID NO: 59217 - DNA, 201 bp, Bos taurus; identical to SEQ ID NO: 18645

SEQ ID NO: 59218 - DNA, 201 bp, Bos taurus; identical to SEQ ID NO: 18646

SEQ ID NO: 59219 - DNA, 201 bp, Bos taurus; identical to SEQ ID NO: 18647

SEQ ID NO: 59220 - DNA, 201 bp, Bos taurus; identical to SEQ ID NO: 18648

SEQ ID NO: 59221 - DNA, 201 bp, Bos taurus
tgagtgtaaagaggaagtgaggccaatctcaaggaatttgatctgatctggggaatttattcaaattctcaaccacagaatactctggctctcaaggcagtcagccttctagggcccttgtaagtcaacagaagcagtggtggaagggtgaggtgtgcccgccagctttgaccatgtcttcagtgtgacttagggagggct

SEQ ID NO: 59222 - DNA, 201 bp, Bos taurus; identical to SEQ ID NO: 18650

SEQ ID NO: 59223 - DNA, 201 bp, Bos taurus
aagcgtatttttcatataatttatatttctagtcaattcacttgattcccactaagattatttttgcctcttaacacaaaccttccatatgtgttgtgggtaaggtctattcaaaagaggatgaatagattctgaagcttagagtttctgccctggactcagaatttttgtgattttctgtgatgagaatgtattattgat

SEQ ID NO: 59224 - DNA, 201 bp, Bos taurus; identical to SEQ ID NO: 18652

SEQ ID NO: 59225 - DNA, 201 bp, Bos taurus; identical to SEQ ID NO: 18656

SEQ ID NO: 59226 - DNA, 201 bp, Bos taurus; identical to SEQ ID NO: 18657

SEQ ID NO: 59227 - DNA, 201 bp, Bos taurus; identical to SEQ ID NO: 18658

SEQ ID NO: 59228 - DNA, 201 bp, Bos taurus; identical to SEQ ID NO: 18659

SEQ ID NO: 59229 - DNA, 201 bp, Bos taurus; identical to SEQ ID NO: 18660

SEQ ID NO: 59230 - DNA, 201 bp, Bos taurus; identical to SEQ ID NO: 18661

SEQ ID NO: 59231 - DNA, 201 bp, Bos taurus; identical to SEQ ID NO: 18662

SEQ ID NO: 59232 - DNA, 201 bp, Bos taurus; identical to SEQ ID NO: 18663

SEQ ID NO: 59233 - DNA, 201 bp, Bos taurus; identical to SEQ ID NO: 18664

SEQ ID NO: 59234 - DNA, 201 bp, Bos taurus; identical to SEQ ID NO: 18665

SEQ ID NO: 59235 - DNA, 201 bp, Bos taurus; identical to SEQ ID NO: 18666

SEQ ID NO: 59236 - DNA, 201 bp, Bos taurus; identical to SEQ ID NO: 18667

SEQ ID NO: 59237 - DNA, 201 bp, Bos taurus; identical to SEQ ID NO: 18668

SEQ ID NO: 59238 - DNA, 201 bp, Bos taurus; identical to SEQ ID NO: 18669

SEQ ID NO: 59239 - DNA, 201 bp, Bos taurus; identical to SEQ ID NO: 18670

SEQ ID NO: 59240 - DNA, 201 bp, Bos taurus; identical to SEQ ID NO: 18671

SEQ ID NO: 59241 - DNA, 201 bp, Bos taurus; identical to SEQ ID NO: 18672

SEQ ID NO: 59242 - DNA, 201 bp, Bos taurus; identical to SEQ ID NO: 18673

SEQ ID NO: 59243 - DNA, 201 bp, Bos taurus; identical to SEQ ID NO: 18674

SEQ ID NO: 59244 - DNA, 201 bp, Bos taurus; identical to SEQ ID NO: 18675

SEQ ID NO: 59245 - DNA, 201 bp, Bos taurus; identical to SEQ ID NO: 18676

SEQ ID NO: 59246 - DNA, 201 bp, Bos taurus; identical to SEQ ID NO: 18677

SEQ ID NO: 59247 - DNA, 201 bp, Bos taurus; identical to SEQ ID NO: 18678

SEQ ID NO: 59248 - DNA, 201 bp, Bos taurus; identical to SEQ ID NO: 18679

SEQ ID NO: 59249 - DNA, 201 bp, Bos taurus; identical to SEQ ID NO: 18680

SEQ ID NO: 59250 - DNA, 201 bp, Bos taurus; identical to SEQ ID NO: 18681

SEQ ID NO: 59251 - DNA, 201 bp, Bos taurus; identical to SEQ ID NO: 18682

SEQ ID NO: 59252 - DNA, 201 bp, Bos taurus; identical to SEQ ID NO: 18683

SEQ ID NO: 59253 - DNA, 201 bp, Bos taurus; identical to SEQ ID NO: 18684

SEQ ID NO: 59254 - DNA, 201 bp, Bos taurus; identical to SEQ ID NO: 18685

SEQ ID NO: 59255 - DNA, 201 bp, Bos taurus; identical to SEQ ID NO: 18686

SEQ ID NO: 59256 - DNA, 201 bp, Bos taurus; identical to SEQ ID NO: 18687

SEQ ID NO: 59257 - DNA, 201 bp, Bos taurus; identical to SEQ ID NO: 18688

SEQ ID NO: 59258 - DNA, 201 bp, Bos taurus; identical to SEQ ID NO: 18689

SEQ ID NO: 59259 - DNA, 201 bp, Bos taurus; identical to SEQ ID NO: 18690

SEQ ID NO: 59260 - DNA, 201 bp, Bos taurus; identical to SEQ ID NO: 18691

SEQ ID NO: 59261 - DNA, 201 bp, Bos taurus
aactcccagagttcactcaaactcatgtccattgagtcggtgatgccatccagccatctcatcctctgtcgtccggttctcctcctgcccccattaattttggggccaagtgaggaaagcttattcaaagtcagagctggtgaaaattaattttagtcactcaaaaagagaggatatggggaaaagactttagataaacgg

SEQ ID NO: 59262 - DNA, 201 bp, Bos taurus; identical to SEQ ID NO: 18692

SEQ ID NO: 59263 - DNA, 201 bp, Bos taurus; identical to SEQ ID NO: 18693

SEQ ID NO: 59264 - DNA, 201 bp, Bos taurus
ccattctggggagagaactggaaggccataaaacagtacataaggtagaacaagctaggacgagtactcttaattcatctggcattaccaatacgtgatctgaagacctggcctgtggcacggatatcaacaactctgggcatgggtattctttttctcagtcaaactacacaggcaacccatcaaactgctgaccagaag

SEQ ID NO: 59265 - DNA, 201 bp, Bos taurus
cctgcttgcagtagggcttaagcagagatcccagccagcagttctgcaaaattgcagaaccaagccaatgacccaatcaggtcagggagctcagcttgccatttggcctgatttggatcgccaccaccaggccatgctggccatggagcacatactattccctggtaggagagcagattcacagcccaacttctgattata

SEQ ID NO: 59266 - DNA, 201 bp, Bos taurus
ggcagctgcctttgcttataacacctttctaaaaggacaggccacgtaaggtttgctgctcccagaaacttctttgtcatcgatgtttgtcaacttcttttatttcatagatgtttgcctggcctactggataaaagatattcaaaatttgctttaagaaatttaaaaatttgaggtgaaatatggtcataagttagactg

SEQ ID NO: 59267 - DNA, 201 bp, Bos taurus; identical to SEQ ID NO: 18694

SEQ ID NO: 59268 - DNA, 201 bp, Bos taurus
acaatgtgttcaatccctggccaaccctactctttgaaaagcagttacattaacagttactgcagggcatctaagtggatgctgtgcagtaaatagaagacggatggaccacagcaaacatggccttaaagtgaaactggatcagaacactttgacaagtcacttctaagaatgatgcatcactgtttttataagtctgga

SEQ ID NO: 59269 - DNA, 201 bp, Bos taurus; identical to SEQ ID NO: 18696

SEQ ID NO: 59270 - DNA, 201 bp, Bos taurus
taatgaaaaagtatttacatctcaacttggtctttggcagagtacactcctttagtggaaaaaggagttatgtcaggcctctttctttccaaaatttgttattctatactctgtcattcacattgcaaactctggtttctacttcttcataattcagagagaaaaaaatgaggatgcttactgggggccagaaaagttctt

SEQ ID NO: 59271 - DNA, 201 bp, Bos taurus; identical to SEQ ID NO: 18697

SEQ ID NO: 59272 - DNA, 201 bp, Bos taurus; identical to SEQ ID NO: 18698

SEQ ID NO: 59273 - DNA, 201 bp, Bos taurus; identical to SEQ ID NO: 18699

SEQ ID NO: 59274 - DNA, 201 bp, Bos taurus; identical to SEQ ID NO: 18700

SEQ ID NO: 59275 - DNA, 201 bp, Bos taurus; identical to SEQ ID NO: 18701

SEQ ID NO: 59276 - DNA, 201 bp, Bos taurus; identical to SEQ ID NO: 18702

SEQ ID NO: 59277 - DNA, 201 bp, Bos taurus; identical to SEQ ID NO: 18703

SEQ ID NO: 59278 - DNA, 201 bp, Bos taurus; identical to SEQ ID NO: 18704

SEQ ID NO: 59279 - DNA, 201 bp, Bos taurus; identical to SEQ ID NO: 18705

SEQ ID NO: 59280 - DNA, 201 bp, Bos taurus; identical to SEQ ID NO: 18706

SEQ ID NO: 59281 - DNA, 201 bp, Bos taurus; identical to SEQ ID NO: 18707

SEQ ID NO: 59282 - DNA, 201 bp, Bos taurus; identical to SEQ ID NO: 18708

SEQ ID NO: 59283 - DNA, 201 bp, Bos taurus; identical to SEQ ID NO: 18709

SEQ ID NO: 59284 - DNA, 201 bp, Bos taurus; identical to SEQ ID NO: 18710

SEQ ID NO: 59285 - DNA, 201 bp, Bos taurus; identical to SEQ ID NO: 18711

SEQ ID NO: 59286 - DNA, 201 bp, Bos taurus; identical to SEQ ID NO: 18712

SEQ ID NO: 59287 - DNA, 201 bp, Bos taurus; identical to SEQ ID NO: 18713

SEQ ID NO: 59288 - DNA, 201 bp, Bos taurus; identical to SEQ ID NO: 18714

SEQ ID NO: 59289 - DNA, 201 bp, Bos taurus; identical to SEQ ID NO: 18715

SEQ ID NO: 59290 - DNA, 201 bp, Bos taurus; identical to SEQ ID NO: 18716

SEQ ID NO: 59291 - DNA, 201 bp, Bos taurus; identical to SEQ ID NO: 18717

SEQ ID NO: 59292 - DNA, 201 bp, Bos taurus; identical to SEQ ID NO: 18719

SEQ ID NO: 59293 - DNA, 201 bp, Bos taurus; identical to SEQ ID NO: 18720

SEQ ID NO: 59294 - DNA, 201 bp, Bos taurus; identical to SEQ ID NO: 18721

SEQ ID NO: 59295 - DNA, 201 bp, Bos taurus; identical to SEQ ID NO: 18722

SEQ ID NO: 59296 - DNA, 201 bp, Bos taurus; identical to SEQ ID NO: 18724

SEQ ID NO: 59297 - DNA, 201 bp, Bos taurus; identical to SEQ ID NO: 18725

SEQ ID NO: 59298 - DNA, 201 bp, Bos taurus; identical to SEQ ID NO: 18726

SEQ ID NO: 59299 - DNA, 201 bp, Bos taurus; identical to SEQ ID NO: 18727

SEQ ID NO: 59300 - DNA, 201 bp, Bos taurus; identical to SEQ ID NO: 18728

SEQ ID NO: 59301 - DNA, 201 bp, Bos taurus; identical to SEQ ID NO: 18729

SEQ ID NO: 59302 - DNA, 201 bp, Bos taurus; identical to SEQ ID NO: 18730

SEQ ID NO: 59303 - DNA, 201 bp, Bos taurus; identical to SEQ ID NO: 18731

SEQ ID NO: 59304 - DNA, 201 bp, Bos taurus; identical to SEQ ID NO: 18732

SEQ ID NO: 59305 - DNA, 201 bp, Bos taurus; identical to SEQ ID NO: 18733

SEQ ID NO: 59306 - DNA, 201 bp, Bos taurus; identical to SEQ ID NO: 18734

SEQ ID NO: 59307 - DNA, 201 bp, Bos taurus; identical to SEQ ID NO: 18735

SEQ ID NO: 59308 - DNA, 201 bp, Bos taurus; identical to SEQ ID NO: 18736

SEQ ID NO: 59309 - DNA, 201 bp, Bos taurus; identical to SEQ ID NO: 18737

SEQ ID NO: 59310 - DNA, 201 bp, Bos taurus; identical to SEQ ID NO: 18738

SEQ ID NO: 59311 - DNA, 201 bp, Bos taurus; identical to SEQ ID NO: 18739

SEQ ID NO: 59312 - DNA, 201 bp, Bos taurus; identical to SEQ ID NO: 18740

SEQ ID NO: 59313 - DNA, 201 bp, Bos taurus; identical to SEQ ID NO: 18741

SEQ ID NO: 59314 - DNA, 201 bp, Bos taurus; identical to SEQ ID NO: 18742

SEQ ID NO: 59315 - DNA, 201 bp, Bos taurus; identical to SEQ ID NO: 18743

SEQ ID NO: 59316 - DNA, 201 bp, Bos taurus; identical to SEQ ID NO: 18744

SEQ ID NO: 59317 - DNA, 201 bp, Bos taurus; identical to SEQ ID NO: 18745

SEQ ID NO: 59318 - DNA, 201 bp, Bos taurus; identical to SEQ ID NO: 18746

SEQ ID NO: 59319 - DNA, 201 bp, Bos taurus; identical to SEQ ID NO: 18748

SEQ ID NO: 59320 - DNA, 201 bp, Bos taurus; identical to SEQ ID NO: 18749

SEQ ID NO: 59321 - DNA, 201 bp, Bos taurus; identical to SEQ ID NO: 18750

SEQ ID NO: 59322 - DNA, 201 bp, Bos taurus; identical to SEQ ID NO: 18751

SEQ ID NO: 59323 - DNA, 201 bp, Bos taurus; identical to SEQ ID NO: 18752

SEQ ID NO: 59324 - DNA, 201 bp, Bos taurus; identical to SEQ ID NO: 18753

SEQ ID NO: 59325 - DNA, 201 bp, Bos taurus; identical to SEQ ID NO: 18754

SEQ ID NO: 59326 - DNA, 201 bp, Bos taurus; identical to SEQ ID NO: 18755

SEQ ID NO: 59327 - DNA, 201 bp, Bos taurus; identical to SEQ ID NO: 18756

SEQ ID NO: 59328 - DNA, 201 bp, Bos taurus; identical to SEQ ID NO: 18757

SEQ ID NO: 59329 - DNA, 201 bp, Bos taurus; identical to SEQ ID NO: 18758

SEQ ID NO: 59330 - DNA, 201 bp, Bos taurus; identical to SEQ ID NO: 18759

SEQ ID NO: 59331 - DNA, 201 bp, Bos taurus; identical to SEQ ID NO: 18760

SEQ ID NO: 59332 - DNA, 201 bp, Bos taurus; identical to SEQ ID NO: 18761

SEQ ID NO: 59333 - DNA, 201 bp, Bos taurus; identical to SEQ ID NO: 18762

SEQ ID NO: 59334 - DNA, 201 bp, Bos taurus; identical to SEQ ID NO: 18763

SEQ ID NO: 59335 - DNA, 201 bp, Bos taurus; identical to SEQ ID NO: 18764

SEQ ID NO: 59336 - DNA, 201 bp, Bos taurus; identical to SEQ ID NO: 18765

SEQ ID NO: 59337 - DNA, 201 bp, Bos taurus; identical to SEQ ID NO: 18766

SEQ ID NO: 59338 - DNA, 201 bp, Bos taurus; identical to SEQ ID NO: 18767

SEQ ID NO: 59339 - DNA, 201 bp, Bos taurus; identical to SEQ ID NO: 18768

SEQ ID NO: 59340 - DNA, 201 bp, Bos taurus; identical to SEQ ID NO: 18769

SEQ ID NO: 59341 - DNA, 201 bp, Bos taurus; identical to SEQ ID NO: 18770

SEQ ID NO: 59342 - DNA, 201 bp, Bos taurus; identical to SEQ ID NO: 18771

SEQ ID NO: 59343 - DNA, 201 bp, Bos taurus; identical to SEQ ID NO: 18772

SEQ ID NO: 59344 - DNA, 201 bp, Bos taurus; identical to SEQ ID NO: 18773

SEQ ID NO: 59345 - DNA, 201 bp, Bos taurus; identical to SEQ ID NO: 18774

SEQ ID NO: 59346 - DNA, 201 bp, Bos taurus; identical to SEQ ID NO: 18775

SEQ ID NO: 59347 - DNA, 201 bp, Bos taurus; identical to SEQ ID NO: 18776

SEQ ID NO: 59348 - DNA, 201 bp, Bos taurus; identical to SEQ ID NO: 18777

SEQ ID NO: 59349 - DNA, 201 bp, Bos taurus; identical to SEQ ID NO: 18778

SEQ ID NO: 59350 - DNA, 201 bp, Bos taurus; identical to SEQ ID NO: 18779

SEQ ID NO: 59351 - DNA, 201 bp, Bos taurus; identical to SEQ ID NO: 18780

SEQ ID NO: 59352 - DNA, 201 bp, Bos taurus; identical to SEQ ID NO: 18781

SEQ ID NO: 59353 - DNA, 201 bp, Bos taurus; identical to SEQ ID NO: 18782

SEQ ID NO: 59354 - DNA, 201 bp, Bos taurus; identical to SEQ ID NO: 18783

SEQ ID NO: 59355 - DNA, 201 bp, Bos taurus; identical to SEQ ID NO: 18784

SEQ ID NO: 59356 - DNA, 201 bp, Bos taurus; identical to SEQ ID NO: 18785

SEQ ID NO: 59357 - DNA, 201 bp, Bos taurus; identical to SEQ ID NO: 18786

SEQ ID NO: 59358 - DNA, 201 bp, Bos taurus; identical to SEQ ID NO: 18787

SEQ ID NO: 59359 - DNA, 201 bp, Bos taurus; identical to SEQ ID NO: 18788

SEQ ID NO: 59360 - DNA, 201 bp, Bos taurus; identical to SEQ ID NO: 18789

SEQ ID NO: 59361 - DNA, 201 bp, Bos taurus; identical to SEQ ID NO: 18790

SEQ ID NO: 59362 - DNA, 201 bp, Bos taurus; identical to SEQ ID NO: 18791

SEQ ID NO: 59363 - DNA, 201 bp, Bos taurus; identical to SEQ ID NO: 18792

SEQ ID NO: 59364 - DNA, 201 bp, Bos taurus; identical to SEQ ID NO: 18793

SEQ ID NO: 59365 - DNA, 201 bp, Bos taurus; identical to SEQ ID NO: 18794

SEQ ID NO: 59366 - DNA, 201 bp, Bos taurus; identical to SEQ ID NO: 18795

SEQ ID NO: 59367 - DNA, 201 bp, Bos taurus; identical to SEQ ID NO: 18796

SEQ ID NO: 59368 - DNA, 201 bp, Bos taurus; identical to SEQ ID NO: 18797

SEQ ID NO: 59369 - DNA, 201 bp, Bos taurus; identical to SEQ ID NO: 18798

SEQ ID NO: 59370 - DNA, 201 bp, Bos taurus; identical to SEQ ID NO: 18799

SEQ ID NO: 59371 - DNA, 201 bp, Bos taurus; identical to SEQ ID NO: 18800

SEQ ID NO: 59372 - DNA, 201 bp, Bos taurus; identical to SEQ ID NO: 18801

SEQ ID NO: 59373 - DNA, 201 bp, Bos taurus; identical to SEQ ID NO: 18802

SEQ ID NO: 59374 - DNA, 201 bp, Bos taurus; identical to SEQ ID NO: 18803

SEQ ID NO: 59375 - DNA, 201 bp, Bos taurus; identical to SEQ ID NO: 18804

SEQ ID NO: 59376 - DNA, 201 bp, Bos taurus; identical to SEQ ID NO: 18805

SEQ ID NO: 59377 - DNA, 201 bp, Bos taurus; identical to SEQ ID NO: 18806

SEQ ID NO: 59378 - DNA, 201 bp, Bos taurus; identical to SEQ ID NO: 18807

SEQ ID NO: 59379 - DNA, 201 bp, Bos taurus; identical to SEQ ID NO: 18808

SEQ ID NO: 59380 - DNA, 201 bp, Bos taurus; identical to SEQ ID NO: 18809

SEQ ID NO: 59381 - DNA, 201 bp, Bos taurus; identical to SEQ ID NO: 18810

SEQ ID NO: 59382 - DNA, 201 bp, Bos taurus; identical to SEQ ID NO: 18811

SEQ ID NO: 59383 - DNA, 201 bp, Bos taurus; identical to SEQ ID NO: 18812

SEQ ID NO: 59384 - DNA, 201 bp, Bos taurus; identical to SEQ ID NO: 18813

SEQ ID NO: 59385 - DNA, 201 bp, Bos taurus; identical to SEQ ID NO: 18814

SEQ ID NO: 59386 - DNA, 201 bp, Bos taurus; identical to SEQ ID NO: 18815

SEQ ID NO: 59387 - DNA, 201 bp, Bos taurus; identical to SEQ ID NO: 18816

SEQ ID NO: 59388 - DNA, 201 bp, Bos taurus; identical to SEQ ID NO: 18817

SEQ ID NO: 59389 - DNA, 201 bp, Bos taurus; identical to SEQ ID NO: 18818

SEQ ID NO: 59390 - DNA, 201 bp, Bos taurus; identical to SEQ ID NO: 18819

SEQ ID NO: 59391 - DNA, 201 bp, Bos taurus; identical to SEQ ID NO: 18820

SEQ ID NO: 59392 - DNA, 201 bp, Bos taurus; identical to SEQ ID NO: 18821

SEQ ID NO: 59393 - DNA, 201 bp, Bos taurus; identical to SEQ ID NO: 18822

SEQ ID NO: 59394 - DNA, 201 bp, Bos taurus; identical to SEQ ID NO: 18823

SEQ ID NO: 59395 - DNA, 201 bp, Bos taurus; identical to SEQ ID NO: 18824

SEQ ID NO: 59396 - DNA, 201 bp, Bos taurus; identical to SEQ ID NO: 18825

SEQ ID NO: 59397 - DNA, 201 bp, Bos taurus; identical to SEQ ID NO: 18826

SEQ ID NO: 59398 - DNA, 201 bp, Bos taurus; identical to SEQ ID NO: 18827

SEQ ID NO: 59399 - DNA, 201 bp, Bos taurus; identical to SEQ ID NO: 18828

SEQ ID NO: 59400 - DNA, 201 bp, Bos taurus; identical to SEQ ID NO: 18829

SEQ ID NO: 59401 - DNA, 201 bp, Bos taurus; identical to SEQ ID NO: 18830

SEQ ID NO: 59402 - DNA, 201 bp, Bos taurus; identical to SEQ ID NO: 18831

SEQ ID NO: 59403 - DNA, 201 bp, Bos taurus; identical to SEQ ID NO: 18832

SEQ ID NO: 59404 - DNA, 201 bp, Bos taurus; identical to SEQ ID NO: 18833

SEQ ID NO: 59405 - DNA, 201 bp, Bos taurus; identical to SEQ ID NO: 18834

SEQ ID NO: 59406 - DNA, 201 bp, Bos taurus; identical to SEQ ID NO: 18835

SEQ ID NO: 59407 - DNA, 201 bp, Bos taurus; identical to SEQ ID NO: 18836

SEQ ID NO: 59408 - DNA, 201 bp, Bos taurus; identical to SEQ ID NO: 18837

SEQ ID NO: 59409 - DNA, 201 bp, Bos taurus; identical to SEQ ID NO: 18838

SEQ ID NO: 59410 - DNA, 201 bp, Bos taurus; identical to SEQ ID NO: 18839

SEQ ID NO: 59411 - DNA, 201 bp, Bos taurus; identical to SEQ ID NO: 18840

SEQ ID NO: 59412 - DNA, 201 bp, Bos taurus; identical to SEQ ID NO: 18841

SEQ ID NO: 59413 - DNA, 201 bp, Bos taurus; identical to SEQ ID NO: 18842

SEQ ID NO: 59414 - DNA, 201 bp, Bos taurus; identical to SEQ ID NO: 18843

SEQ ID NO: 59415 - DNA, 201 bp, Bos taurus; identical to SEQ ID NO: 18844

SEQ ID NO: 59416 - DNA, 201 bp, Bos taurus; identical to SEQ ID NO: 18845

SEQ ID NO: 59417 - DNA, 201 bp, Bos taurus; identical to SEQ ID NO: 18846

SEQ ID NO: 59418 - DNA, 201 bp, Bos taurus; identical to SEQ ID NO: 18847

SEQ ID NO: 59419 - DNA, 201 bp, Bos taurus; identical to SEQ ID NO: 18848

SEQ ID NO: 59420 - DNA, 201 bp, Bos taurus; identical to SEQ ID NO: 18849

SEQ ID NO: 59421 - DNA, 201 bp, Bos taurus; identical to SEQ ID NO: 18852

SEQ ID NO: 59422 - DNA, 201 bp, Bos taurus; identical to SEQ ID NO: 18853

SEQ ID NO: 59423 - DNA, 201 bp, Bos taurus; identical to SEQ ID NO: 18854

SEQ ID NO: 59424 - DNA, 201 bp, Bos taurus; identical to SEQ ID NO: 18856

SEQ ID NO: 59425 - DNA, 201 bp, Bos taurus; identical to SEQ ID NO: 18857

SEQ ID NO: 59426 - DNA, 201 bp, Bos taurus; identical to SEQ ID NO: 18858

SEQ ID NO: 59427 - DNA, 201 bp, Bos taurus; identical to SEQ ID NO: 18859

SEQ ID NO: 59428 - DNA, 201 bp, Bos taurus; identical to SEQ ID NO: 18860

SEQ ID NO: 59429 - DNA, 201 bp, Bos taurus; identical to SEQ ID NO: 18861

SEQ ID NO: 59430 - DNA, 201 bp, Bos taurus; identical to SEQ ID NO: 18862

SEQ ID NO: 59431 - DNA, 201 bp, Bos taurus
gcctattaattgtgagactgtacctggtctcagcaataactcaggagtccaactagaaccccattgcctttctggaacatctaaaagaggccctacaaaaatttgccagtgttcacttagattcttatgagggatcagatcagatcagatcagatcagtcgctcagtcgtgtcctactatttgcaaccccatgaatcgcag

SEQ ID NO: 59432 - DNA, 201 bp, Bos taurus; identical to SEQ ID NO: 18863

SEQ ID NO: 59433 - DNA, 201 bp, Bos taurus; identical to SEQ ID NO: 18864

SEQ ID NO: 59434 - DNA, 201 bp, Bos taurus; identical to SEQ ID NO: 18865

SEQ ID NO: 59435 - DNA, 201 bp, Bos taurus; identical to SEQ ID NO: 18866

SEQ ID NO: 59436 - DNA, 201 bp, Bos taurus; identical to SEQ ID NO: 18868

SEQ ID NO: 59437 - DNA, 201 bp, Bos taurus; identical to SEQ ID NO: 18869

SEQ ID NO: 59438 - DNA, 201 bp, Bos taurus; identical to SEQ ID NO: 18870

SEQ ID NO: 59439 - DNA, 201 bp, Bos taurus; identical to SEQ ID NO: 18871

SEQ ID NO: 59440 - DNA, 201 bp, Bos taurus; identical to SEQ ID NO: 18872

SEQ ID NO: 59441 - DNA, 201 bp, Bos taurus; identical to SEQ ID NO: 18873

SEQ ID NO: 59442 - DNA, 201 bp, Bos taurus; identical to SEQ ID NO: 18874

SEQ ID NO: 59443 - DNA, 201 bp, Bos taurus; identical to SEQ ID NO: 18875

SEQ ID NO: 59444 - DNA, 201 bp, Bos taurus; identical to SEQ ID NO: 18876

SEQ ID NO: 59445 - DNA, 201 bp, Bos taurus; identical to SEQ ID NO: 18877

SEQ ID NO: 59446 - DNA, 201 bp, Bos taurus; identical to SEQ ID NO: 18878

SEQ ID NO: 59447 - DNA, 201 bp, Bos taurus; identical to SEQ ID NO: 18879

SEQ ID NO: 59448 - DNA, 201 bp, Bos taurus; identical to SEQ ID NO: 18880

SEQ ID NO: 59449 - DNA, 201 bp, Bos taurus; identical to SEQ ID NO: 18881

SEQ ID NO: 59450 - DNA, 201 bp, Bos taurus; identical to SEQ ID NO: 18882

SEQ ID NO: 59451 - DNA, 201 bp, Bos taurus; identical to SEQ ID NO: 18883

SEQ ID NO: 59452 - DNA, 201 bp, Bos taurus; identical to SEQ ID NO: 18884

SEQ ID NO: 59453 - DNA, 201 bp, Bos taurus; identical to SEQ ID NO: 18885

SEQ ID NO: 59454 - DNA, 201 bp, Bos taurus; identical to SEQ ID NO: 18886

SEQ ID NO: 59455 - DNA, 201 bp, Bos taurus; identical to SEQ ID NO: 18887

SEQ ID NO: 59456 - DNA, 201 bp, Bos taurus; identical to SEQ ID NO: 18888

SEQ ID NO: 59457 - DNA, 201 bp, Bos taurus; identical to SEQ ID NO: 18889

SEQ ID NO: 59458 - DNA, 201 bp, Bos taurus; identical to SEQ ID NO: 18890

SEQ ID NO: 59459 - DNA, 201 bp, Bos taurus; identical to SEQ ID NO: 18891

SEQ ID NO: 59460 - DNA, 201 bp, Bos taurus; identical to SEQ ID NO: 18892

SEQ ID NO: 59461 - DNA, 201 bp, Bos taurus; identical to SEQ ID NO: 18893

SEQ ID NO: 59462 - DNA, 201 bp, Bos taurus; identical to SEQ ID NO: 18894

SEQ ID NO: 59463 - DNA, 201 bp, Bos taurus; identical to SEQ ID NO: 18895

SEQ ID NO: 59464 - DNA, 201 bp, Bos taurus; identical to SEQ ID NO: 18896

SEQ ID NO: 59465 - DNA, 201 bp, Bos taurus; identical to SEQ ID NO: 18897

SEQ ID NO: 59466 - DNA, 201 bp, Bos taurus; identical to SEQ ID NO: 18898

SEQ ID NO: 59467 - DNA, 201 bp, Bos taurus; identical to SEQ ID NO: 18899

SEQ ID NO: 59468 - DNA, 201 bp, Bos taurus; identical to SEQ ID NO: 18900

SEQ ID NO: 59469 - DNA, 201 bp, Bos taurus; identical to SEQ ID NO: 18901

SEQ ID NO: 59470 - DNA, 201 bp, Bos taurus; identical to SEQ ID NO: 18902

SEQ ID NO: 59471 - DNA, 201 bp, Bos taurus; identical to SEQ ID NO: 18903

SEQ ID NO: 59472 - DNA, 201 bp, Bos taurus; identical to SEQ ID NO: 18905

SEQ ID NO: 59473 - DNA, 201 bp, Bos taurus; identical to SEQ ID NO: 18907

SEQ ID NO: 59474 - DNA, 201 bp, Bos taurus; identical to SEQ ID NO: 18908

SEQ ID NO: 59475 - DNA, 201 bp, Bos taurus; identical to SEQ ID NO: 18909

SEQ ID NO: 59476 - DNA, 201 bp, Bos taurus; identical to SEQ ID NO: 18910

SEQ ID NO: 59477 - DNA, 201 bp, Bos taurus; identical to SEQ ID NO: 18911

SEQ ID NO: 59478 - DNA, 201 bp, Bos taurus; identical to SEQ ID NO: 18912

SEQ ID NO: 59479 - DNA, 201 bp, Bos taurus; identical to SEQ ID NO: 18913

SEQ ID NO: 59480 - DNA, 201 bp, Bos taurus; identical to SEQ ID NO: 18914

SEQ ID NO: 59481 - DNA, 201 bp, Bos taurus; identical to SEQ ID NO: 18916

SEQ ID NO: 59482 - DNA, 201 bp, Bos taurus; identical to SEQ ID NO: 18917

SEQ ID NO: 59483 - DNA, 201 bp, Bos taurus; identical to SEQ ID NO: 18918

SEQ ID NO: 59484 - DNA, 201 bp, Bos taurus
atgaatattcaggactgattccctttaggattgacaccctttgggatgtgactgtgcacaaaaccacacacagttttttgcatggttctgtgtgtatatttcataaaatatgttgatttttaaaaataaaatatgtattattaagtaggaagctaatcacactcatacatttcaagcataatatttgctcccaggattcag

SEQ ID NO: 59485 - DNA, 201 bp, Bos taurus; identical to SEQ ID NO: 18919

SEQ ID NO: 59486 - DNA, 201 bp, Bos taurus; identical to SEQ ID NO: 18920

SEQ ID NO: 59487 - DNA, 201 bp, Bos taurus; identical to SEQ ID NO: 18921

SEQ ID NO: 59488 - DNA, 201 bp, Bos taurus; identical to SEQ ID NO: 18922

SEQ ID NO: 59489 - DNA, 201 bp, Bos taurus; identical to SEQ ID NO: 18923

SEQ ID NO: 59490 - DNA, 201 bp, Bos taurus; identical to SEQ ID NO: 18925

SEQ ID NO: 59491 - DNA, 201 bp, Bos taurus; identical to SEQ ID NO: 18926

SEQ ID NO: 59492 - DNA, 201 bp, Bos taurus; identical to SEQ ID NO: 18927

SEQ ID NO: 59493 - DNA, 201 bp, Bos taurus; identical to SEQ ID NO: 18928

SEQ ID NO: 59494 - DNA, 201 bp, Bos taurus
tctatcttcaggacaataatagccagtgagtacttaagtgtaagtgatttttgccttcttgacacagaatgatataagtgaaaaaataatgcaaactaggaatagtataattttctatgtaaaaagtttataatatatatgcactacagaaatgtctcctctcatatctcagcaaatatataaattaaaatgttacgatat

SEQ ID NO: 59495 - DNA, 201 bp, Bos taurus; identical to SEQ ID NO: 18929

SEQ ID NO: 59496 - DNA, 201 bp, Bos taurus
caataacagaagattaagtggataccaacaatagaaatttatttctcatagttttggagtccaagaagtccaagaacaagatataggtagatactcataactgaatcaattcccacaggcctaccacaaatatcatcatagtctgcaggttgtctcagtatatgaatttggggtgaacacaaacattcaatgtatagaaac

SEQ ID NO: 59497 - DNA, 201 bp, Bos taurus; identical to SEQ ID NO: 18930

SEQ ID NO: 59498 - DNA, 201 bp, Bos taurus; identical to SEQ ID NO: 18931

SEQ ID NO: 59499 - DNA, 201 bp, Bos taurus; identical to SEQ ID NO: 18932

SEQ ID NO: 59500 - DNA, 201 bp, Bos taurus; identical to SEQ ID NO: 18933

SEQ ID NO: 59501 - DNA, 201 bp, Bos taurus; identical to SEQ ID NO: 18934

SEQ ID NO: 59502 - DNA, 201 bp, Bos taurus; identical to SEQ ID NO: 18935

SEQ ID NO: 59503 - DNA, 201 bp, Bos taurus; identical to SEQ ID NO: 18936

SEQ ID NO: 59504 - DNA, 201 bp, Bos taurus; identical to SEQ ID NO: 18937

SEQ ID NO: 59505 - DNA, 201 bp, Bos taurus
atgcaaatcattctgaaccattcaaaaatagagaacaaatttttgtgacatcagtgaaatgatcctatccttgctttatgtacagaactctgtgtgcgtgatggggggtgtttgagtgtgtgtgtgttacgtattccagttgaggcagttttagcataaggttaagaataaagttcaagcgtcagactgcatgggttttaa

SEQ ID NO: 59506 - DNA, 201 bp, Bos taurus
gtagttttaattcaaaattttccattttaagggaagataatattatacaataagcaggacctgtatttgactaatggaatggtagtcattcttctggacattcatataccacatttcaggagtccattaagtagaagagaactgtcactcatcatagtctttcaggtttccaagtttgataacattattaaaagcgtccat

SEQ ID NO: 59507 - DNA, 201 bp, Bos taurus; identical to SEQ ID NO: 18939

SEQ ID NO: 59508 - DNA, 201 bp, Bos taurus; identical to SEQ ID NO: 18940

SEQ ID NO: 59509 - DNA, 201 bp, Bos taurus; identical to SEQ ID NO: 18942

SEQ ID NO: 59510 - DNA, 201 bp, Bos taurus; identical to SEQ ID NO: 18943

SEQ ID NO: 59511 - DNA, 201 bp, Bos taurus; identical to SEQ ID NO: 18944

SEQ ID NO: 59512 - DNA, 201 bp, Bos taurus
cctaggttggccatgactaaagtgacttagaacacaggcaccatagttgatttacattacattagtttcagctgtatgcaaagtgattcagttctacatatgtgtgtgtgtctacatacatatattcctcagtttcttttccatacttttttattcttggtttgcaatttaatacagtttccaaagagaattcctttagat

SEQ ID NO: 59513 - DNA, 201 bp, Bos taurus; identical to SEQ ID NO: 18945

SEQ ID NO: 59514 - DNA, 201 bp, Bos taurus; identical to SEQ ID NO: 18947

SEQ ID NO: 59515 - DNA, 201 bp, Bos taurus; identical to SEQ ID NO: 18948

SEQ ID NO: 59516 - DNA, 201 bp, Bos taurus
taaattgcccaccagttgcctggaaggactttgaagggtaaatgtctgatatgaagtagcctcagaaaggtgatagcattatcatcctagtatcttgccaccagtaaaccagcaacatcaatagttgaccatttacttagtgaataaacttagtgggttaaagaaataaaaagctggggacattggagacagatacttatt

SEQ ID NO: 59517 - DNA, 201 bp, Bos taurus; identical to SEQ ID NO: 18949

SEQ ID NO: 59518 - DNA, 201 bp, Bos taurus
atgtaataaacacaatgatagacatatgaagaaagtacaaaagacacacagaagggaagcacctaattttgtcctgagcatgtagcaggtgctgtcattgccccttagccctcatcattcctttatctgctgacaggttcttactgcaagtacttgtgattttctgcctctggtctttctctgatcatctttctttgagca

SEQ ID NO: 59519 - DNA, 201 bp, Bos taurus
ctccaaatagttttgttattggtagcacctctgcttgaactgggaggaagtgttgcattctctaattcagttcaattctctaaatattgattgagcatctaacatgggctcaggcaaggttgacctgacttgaaactggagaaaaggactgcttacgcgcttctttcaagtagagcaaggaaggttactggatcctaaata

SEQ ID NO: 59520 - DNA, 201 bp, Bos taurus
taaaccctttgttgggaggagacaagaaccaagggagagaaataaaccaacctgacatcttgaaaggcgttaagaatatcagtagatattctgggcccatttcttccttttacagggtaaacttgatataatcaggagtcttgatatttttgcttgatggatttacaggcccacttctgactgttaattctagagactgat

SEQ ID NO: 59521 - DNA, 201 bp, Bos taurus
attgaatgtgggaggcaaagaaagggaattgagaaagaatgttcacctttcagacacagataactagagtacctggaggataagcatattttgaagtaaaaataatgagttgatttttgatcatgttagttggccctgactcaactattcaagtgatgtctacagattagttggatggttaagactgactcacagggaatg

SEQ ID NO: 59522 - DNA, 201 bp, Bos taurus
acagagggagcatacggaaatatattacccagtgaatattaggtttattctagaaccaccctgctctaagctcactcttcacattgcctatctactatgtgcttgacatgagatgatgaaatgggcctctaatgctatataatagtttataaagttttttttacttgtgtttctcacattcacaaaatatgcttgagaagt

SEQ ID NO: 59523 - DNA, 201 bp, Bos taurus; identical to SEQ ID NO: 18951

SEQ ID NO: 59524 - DNA, 201 bp, Bos taurus; identical to SEQ ID NO: 18952

SEQ ID NO: 59525 - DNA, 201 bp, Bos taurus
tcagagtgtggacttccatcatgccttctgaatgggcacctgaccacataatcagtccctcagtcatagctgattggattaggatgggcccttgccccaatggggaacaatcagattctgtcttatacgaaattggggttcactatttctaggctcaccttcattggcatttaaactgaaaagtcctgagggctgcctggg

SEQ ID NO: 59526 - DNA, 201 bp, Bos taurus; identical to SEQ ID NO: 18953

SEQ ID NO: 59527 - DNA, 201 bp, Bos taurus; identical to SEQ ID NO: 18954

SEQ ID NO: 59528 - DNA, 201 bp, Bos taurus
gaaaaataggccactcaaacattaaatgtaagtaacagagcatttaaaaatttggtttttagaagcaggacaaagaattcattcattcatttgttgagttcctactaggagtatggtagctcctactaacactgtgctaagtatgtcctagaataaacccagaaaagactaggatcccccaagatagggagggtaggggta

SEQ ID NO: 59529 - DNA, 201 bp, Bos taurus; identical to SEQ ID NO: 18955

SEQ ID NO: 59530 - DNA, 201 bp, Bos taurus
aataactcacccatggatacaaaaaacaactgcgaatttgaatgattcagtaaagtatttttctctgaaaacaaacaacaaaaaaacaattgataaaaagcgctactcagcttatgaatgaatgtaactccaataaaaatttacttttatgtttaataatgatgtatcataatgaatttgtaatacatgcctgttgtttgt

SEQ ID NO: 59531 - DNA, 201 bp, Bos taurus; identical to SEQ ID NO: 18956

SEQ ID NO: 59532 - DNA, 201 bp, Bos taurus; identical to SEQ ID NO: 18957

SEQ ID NO: 59533 - DNA, 201 bp, Bos taurus; identical to SEQ ID NO: 18958

SEQ ID NO: 59534 - DNA, 201 bp, Bos taurus; identical to SEQ ID NO: 18959

SEQ ID NO: 59535 - DNA, 201 bp, Bos taurus; identical to SEQ ID NO: 18960

SEQ ID NO: 59536 - DNA, 201 bp, Bos taurus; identical to SEQ ID NO: 18961

SEQ ID NO: 59537 - DNA, 201 bp, Bos taurus; identical to SEQ ID NO: 18962

SEQ ID NO: 59538 - DNA, 201 bp, Bos taurus
agggttttttaaattttcttgaaattgaactatccgtgtgttcctacaaaacatgaaagttccattctccaagtgataggatttttaaggaaactaaaatatccacttgcaattattaagaaacgatcagtgactcaatcactaatgaatacaatcatctttaattctaaaagaaataaaatgttaaaatgatttacatat

SEQ ID NO: 59539 - DNA, 201 bp, Bos taurus; identical to SEQ ID NO: 18963

SEQ ID NO: 59540 - DNA, 201 bp, Bos taurus; identical to SEQ ID NO: 18964

SEQ ID NO: 59541 - DNA, 201 bp, Bos taurus; identical to SEQ ID NO: 18965

SEQ ID NO: 59542 - DNA, 201 bp, Bos taurus; identical to SEQ ID NO: 18966

SEQ ID NO: 59543 - DNA, 201 bp, Bos taurus; identical to SEQ ID NO: 18967

SEQ ID NO: 59544 - DNA, 201 bp, Bos taurus; identical to SEQ ID NO: 18968

SEQ ID NO: 59545 - DNA, 201 bp, Bos taurus; identical to SEQ ID NO: 18969

SEQ ID NO: 59546 - DNA, 201 bp, Bos taurus; identical to SEQ ID NO: 18970

SEQ ID NO: 59547 - DNA, 201 bp, Bos taurus
ggaatgaggaggccagagctgagacaaaattttctttggaggagtatctggatggcatatcaccatgttcaccatagtacataaataatattaatctacatataaacattttccaggatatatatcaaattttataaaaatatcacccttgcattctattcagggcatgaataaacactttaaattttattttgacaatct

SEQ ID NO: 59548 - DNA, 201 bp, Bos taurus; identical to SEQ ID NO: 18971

SEQ ID NO: 59549 - DNA, 201 bp, Bos taurus
aaccattagcaatcatggacaatctacttcagcaatttgttcttgcaacaaaaaagattcttgtggacatgttttctcttcttcaaaggttaagatgccacctttcatatctgccactggcaggtaatgcagatagtaacccgccgtctttgccttgagctcctcagaggaaaatgtgttatgtgaatgcactgtgctacc

SEQ ID NO: 59550 - DNA, 201 bp, Bos taurus
ctccttttataggggcaataattttaagagacagctgggaatatctgtgatagcattgtgttccctaatagcaataggatctggaaatggcagaggccaggtggcagcacataaccagtagaagggaggtagaagggaggtaaaaaaagtagcaggttcagaatatcagcaaggcctaacccacatgaatatatggaaata

SEQ ID NO: 59551 - DNA, 201 bp, Bos taurus
catgatacaaaatttgcatgatatttttctccaacctctccaagctacaacagctagtacttttgattttatcactttagcaacttacaaacttttcaagctccataattaatcatccgtatcccaaatctacatcaccagattactgctattctcttatctccttcaaaagctttgacaaaataagaatgatctctgtac

SEQ ID NO: 59552 - DNA, 201 bp, Bos taurus
accaagggcccaaacagaacaaaaaggcaaaggaaggaagaattttctttgtcgtcttaagctgggacctccatcttctgttcttggacatcggaactcttggtttttgagccaacaccagtggcctcctcggttttcgggtctttggacatagactaaatgttactactccctttcttgatccaccatcttccagcaggt

SEQ ID NO: 59553 - DNA, 201 bp, Bos taurus
agttccatgagctgcggccttgtctatttggttctctcccggccctgacacactggagagctcaataaacattttggaatgaatgaaagcagtaagtcagggattgaatacatgtgagtgaaggcctagttgaggacaaggtagaatgtgtttgggaaataggtaatcgttactagagtgtacatgataacaggttggaaa

SEQ ID NO: 59554 - DNA, 201 bp, Bos taurus
gggggctaatttttgtgagttaaatatttagagtctggagaaattaacataactggagaagcataggtaaggtactgatagccaagaaactccaaaagctgggaaggcaatcatagagaaccccaggtctatagtgcctaacatcagtcaacactcctgtcaattttttttccctcatcaaggcaatctttcaggaatgat

SEQ ID NO: 59555 - DNA, 201 bp, Bos taurus; identical to SEQ ID NO: 18972

SEQ ID NO: 59556 - DNA, 201 bp, Bos taurus; identical to SEQ ID NO: 18973

SEQ ID NO: 59557 - DNA, 201 bp, Bos taurus; identical to SEQ ID NO: 18974

SEQ ID NO: 59558 - DNA, 201 bp, Bos taurus; identical to SEQ ID NO: 18975

SEQ ID NO: 59559 - DNA, 201 bp, Bos taurus
ttgcaaaatcacatgcgaatgtgggcccagtaggtaatgattgttaggggaatgggttgggtgtgaagcaatagggagtagtggagactgtggtgaagggaagaatacaggccctgtcttcaaagggagctgctctacacaggagctgactattgccagggcaggaggagaatgggacgacagaggatgagatggcatcac

SEQ ID NO: 59560 - DNA, 201 bp, Bos taurus; identical to SEQ ID NO: 18976

SEQ ID NO: 59561 - DNA, 201 bp, Bos taurus
taaggccaccattcttccaagccaggttcctgcttgtaggttcctagagtccagagtcatgcctgagaaggtgaaggctgtctagcagaggccttagcaggaccagaacctggatttggtgctctcttcactttacagcaaaaccttctgttttacttgttcacggtattgtattaaaaacgcaagctttccctggcccat

SEQ ID NO: 59562 - DNA, 201 bp, Bos taurus
agtcattaagctctgccaaatgaacgaaagctatgaaagcatacctttggtgatggggagattaccacctgtcaacactgtcttgcccgttcgtaagtgacttgaatggttagaaaatctttccttgtgtttggtcggctgggacctgctggatggactttcccctgaggcatgccgcaaatgcaacatctaggaagatca

SEQ ID NO: 59563 - DNA, 201 bp, Bos taurus; identical to SEQ ID NO: 18977

SEQ ID NO: 59564 - DNA, 201 bp, Bos taurus
ttgactactctaggtttctcatatgagggcttccctggtagctcagctggtaaagaatatacctgcaatgcaggtatctcatataagtggaaaaatacaaaatattgctttttcaataaatcccgtatttattttcttacttttcccatctttgtctttaaaggttgagtgcagaatacaatgtcagttaattgcagattt

SEQ ID NO: 59565 - DNA, 201 bp, Bos taurus
aaaggccactttaactttcttagccattgcttccagaagggtcttccttcttgttgcccatttctcagcagtgtgagaagagaggttaggacactgcacaatctttttctccaatctcagtatcaaccaatatcatcaataccaagcagaggacttgctaccagctgccaggtgttgatagtctggggaagtggtaaagaa

SEQ ID NO: 59566 - DNA, 201 bp, Bos taurus
aacatcttttgtcaacgactgctttagacattaagtgagaataacacacgttaatatgctcgattatatgttgaaaagtttgaatgcatttgattttgtgctattgtcaaacaaagtctgaggcaatataacacaaattaagcagagcacccccagccactccccaaaaaggtaaacagacactgggaaaaagaactggga

SEQ ID NO: 59567 - DNA, 201 bp, Bos taurus
ctttaacttcaatgtgagttaggagttataaactgagatactgggccttgaggatccaatttcctagatttctgcaggtgcataagaatctaatgataatgacaatgaaaatcaaggtaaggcctctgctaggatatgtgggcccaacccagacttgctgccccttctggtgtgaaagtgacatgttcttgcctttacttt

SEQ ID NO: 59568 - DNA, 201 bp, Bos taurus
aaattcatctatgttaattatacttcaataggaatgataaaagtaaacaataaaaactctaccttatgtatacaaagctttggttccctgtcatggcctcaagcctactctcctcttcctccttttgcgtattagttacagaagaaaggaaagcacctcagagtggacaggtatggcctgccaccttctccactctcacac

SEQ ID NO: 59569 - DNA, 201 bp, Bos taurus
tcctgccaccacacctaactccccctctcactgcaaaaagaaaacaaagtgcctgggtgaggtgggagtgggagcttcctttagttgcccagagcttaaaacacaggttctataagaaaaacgaaacgtctacatggagatatattgatacttatttttgaaagcatatgtgaataacataatgatgtgtgtggaggaggg

SEQ ID NO: 59570 - DNA, 201 bp, Bos taurus
caccttacaaacttactgactggggcatgccagcaagccaggaaatggcaaggtctggctccaagtccaagtctagatgataccaaaacactgtatgctacagacgccccttgggttagacccctcctgactccagatccattgtgcttcccaacacatcactgctgtctagaggaaagggagagatatccttaccttaaa

SEQ ID NO: 59571 - DNA, 201 bp, Bos taurus
cgacccctggactgcagcatgccaggcttccctgtccatcaccaactcccggagcttgctcaaactcatgtccatcgagctggtgatgccatccaatcatttcattcctacattgacccatcatcatcagccaaagtccatggtttacattagggttcactcttggtgtacattctattggtttggacaaatatactgacg

SEQ ID NO: 59572 - DNA, 201 bp, Bos taurus
aactgggaccaaaaaaaaaaaaaaggtggcatggcatgataggcaagatctagaataccatgaacattgttggtggcccacccagcattcctcctccccacctgtcttcctttccagcagaacctgattttgttcaggaatccatctctctatgcactcccaagcacctcaggagaatctggcccatctgcttctaagatg

SEQ ID NO: 59573 - DNA, 201 bp, Bos taurus
ataatcgtgttcaccactactttttctttgtttattgagttttaaaaggtaactggaatagctttaaatggtaatacacaggattataagctgttactgctgtttgttctcttgtcttctcactctttcctacacccagtccattagcaagtgctttaggaccacctctaaaatatattccaagtccagctacttcccttc

SEQ ID NO: 59574 - DNA, 201 bp, Bos taurus; identical to SEQ ID NO: 18978

SEQ ID NO: 59575 - DNA, 201 bp, Bos taurus; identical to SEQ ID NO: 18979

SEQ ID NO: 59576 - DNA, 201 bp, Bos taurus; identical to SEQ ID NO: 18980

SEQ ID NO: 59577 - DNA, 201 bp, Bos taurus; identical to SEQ ID NO: 18981

SEQ ID NO: 59578 - DNA, 201 bp, Bos taurus
aaagtagaggctatatgagaaccacatcctcttcaataataatcagcttttttcccctgacagagattatacagtgttaaatgggaatcactaaagctgagaagtgagaaaaaagttagaattctgtcatattacaacagaaaaataatcttagtctttctcaactttaaaattataacctaaaaaatgtctatgtacata

SEQ ID NO: 59579 - DNA, 201 bp, Bos taurus
agattaaagtacagttagaagagagagtagcctgtaatcaaatcaagaaagttaagaaagtattttactttcatgggaagttttgtttttttcagtttgtatattttgggggagaacaaagataatcattagaatcataaaaatagattttgtaataggattaacaaagcacacgcatttttaaacagttaattgttcaaa

SEQ ID NO: 59580 - DNA, 201 bp, Bos taurus; identical to SEQ ID NO: 18982

SEQ ID NO: 59581 - DNA, 201 bp, Bos taurus
attctccttgttttccctttttgtaattaaaaaaaagaaaaccctccagaatttcaggtggtcatatggctatccagccctgatttggctgtggccctctcccttatgaaaagaatagtatataaaagggggaaggagagaggagtaaagtgtcagagggaaagatgaaagcctggatctagacctaggggctccagcggc

SEQ ID NO: 59582 - DNA, 201 bp, Bos taurus
taggcttggactaatttgccagaggctgacacttcatgtagaacaaggatgagccatcgcaaatttaaagccaacataggccccctagtccctggctgacactgcctctaactgcgcattcgtgagtgagcccagtcaagaccacaggagccccaaccccaaattctgacccacagaacaatgagctaaatatgtggccag

SEQ ID NO: 59583 - DNA, 201 bp, Bos taurus; identical to SEQ ID NO: 18983

SEQ ID NO: 59584 - DNA, 201 bp, Bos taurus; identical to SEQ ID NO: 18984

SEQ ID NO: 59585 - DNA, 201 bp, Bos taurus; identical to SEQ ID NO: 18985

SEQ ID NO: 59586 - DNA, 201 bp, Bos taurus
atgcattcatattgtggatgacccataactttaatgagggcaggacatgatttatttgtgaactgatcaaactgttaagtgttcatctatttatctgttattttcttcttttatttttgattcactcatttgcttgcttacctaacaagtaccagaatggtaactgtgggcctggtagagtcagggctataaacatgaaca

SEQ ID NO: 59587 - DNA, 201 bp, Bos taurus; identical to SEQ ID NO: 18986

SEQ ID NO: 59588 - DNA, 201 bp, Bos taurus
atattgcctccccacagcctcctccatagccaacaattgattaaaatattccttcttgccacatatttcactctttgtgaaagaggttctggaaagtacacttttctcttacctcatttcaccttcattaatgttttgatgtagtatcatggctatctgcctagagggattaagagattttacctggctctgggtgtagtc

SEQ ID NO: 59589 - DNA, 201 bp, Bos taurus
aatagattggagggacttagggccaaaagcagagatatgagttatttgctgataagatattataataatctaaggggtaatggtggcctaaactaggctagagttagtggaaacataaaatattttaaaagtatatggtcaggctcttcaagatggctattctctctctctctctctctctctgtacatcggttgcttcac

SEQ ID NO: 59590 - DNA, 201 bp, Bos taurus; identical to SEQ ID NO: 18987

SEQ ID NO: 59591 - DNA, 201 bp, Bos taurus
gcttaccatagcccttctgttagtcccgctggccttctaaccagccaaggagcttctctttccattgttgaaccccagggctggggcatccaatatgaggttttaattgttgactccccagggacaatctccagtcatgtaatctccctcttcctctcaagtcctttcctagggacataagtcccaacttgattacttctt

SEQ ID NO: 59592 - DNA, 201 bp, Bos taurus; identical to SEQ ID NO: 18988

SEQ ID NO: 59593 - DNA, 201 bp, Bos taurus
agccccaggaactgcagctgaaattccctagggagaaactcacagttgctatcaggaaggattttgaccagcatctggaggcatccttctggctgatccagccacttgtccccctcctccagctctcaagttagatctattcaggtatcctcctttcttatacacagaaactaacacttatcattagctgctataaataat

SEQ ID NO: 59594 - DNA, 201 bp, Bos taurus; identical to SEQ ID NO: 18990

SEQ ID NO: 59595 - DNA, 201 bp, Bos taurus; identical to SEQ ID NO: 18991

SEQ ID NO: 59596 - DNA, 201 bp, Bos taurus; identical to SEQ ID NO: 18992

SEQ ID NO: 59597 - DNA, 201 bp, Bos taurus; identical to SEQ ID NO: 18993

SEQ ID NO: 59598 - DNA, 201 bp, Bos taurus
atacaagtttcttaagacattaaactgcctttgccaaaaaaacaacaaagccccttatatttctatcccattacccactggagtcacctcctgggtaaacctctctcacctaaaacgggtcacttctgatcctgtgctgccctccttaactgacccctctcaggtctctctcactggacctacctccttaaaaatcacccg

SEQ ID NO: 59599 - DNA, 201 bp, Bos taurus; identical to SEQ ID NO: 18994

SEQ ID NO: 59600 - DNA, 201 bp, Bos taurus; identical to SEQ ID NO: 18995

SEQ ID NO: 59601 - DNA, 201 bp, Bos taurus; identical to SEQ ID NO: 18996

SEQ ID NO: 59602 - DNA, 201 bp, Bos taurus; identical to SEQ ID NO: 18997

SEQ ID NO: 59603 - DNA, 201 bp, Bos taurus
aaaagcatggaatgaaggcattgctcaaccctgaaccagctgatgcctctggttaatgcagggaaggaagaagtacaataagcagaatggggcctgtaggcaataaaagttgtaggagtttgtaggtttagaaatacggagtttacttttgggttggacttccaggccttttacataaaacaaagaaaataacaactatgt

SEQ ID NO: 59604 - DNA, 201 bp, Bos taurus
tgagcctgcctgtggtgtctcagggccagccgagcagtgcctctcccgccccatgccccactgccatggagtgttgcacagacacctgggaagctggaaacccctggggctggcctgtcagccagtggcaggtgcccctcatcagtttcttgactttcaacaagttctattaaggttagattttatctgcaatggattagc

SEQ ID NO: 59605 - DNA, 201 bp, Bos taurus
tccatctgtgtcatgatctctggttctgatgagttgagaaggaatcacaggatcttgacatttcaatcagggctcaaattcccaccagcagccagacacccgcagctcccaccatagccaggctcggcaatctttcttcaagatggtttgcttatcacttccgccagtcacttgccctgcactgttacagatccaaaccag

SEQ ID NO: 59606 - DNA, 201 bp, Bos taurus; identical to SEQ ID NO: 18998

SEQ ID NO: 59607 - DNA, 201 bp, Bos taurus
gccaaacaatcagcagacgagacgtctgagggtctgaggctgcagagcaagctaaagagcataaagagtcaagggcaaccagaaactctacccctggccactctgctcctacccatggattgcagaggaagcccagccccttcccccattctcccccacctcctccaccctggcttccgctgcccagccaacattattttc

SEQ ID NO: 59608 - DNA, 201 bp, Bos taurus
ggagcccctgctttgctccacaccaactgaatgatcttggggagatggccccaacttcctgaatctgtctcctgggccacacagggcaccaatggaggcctctggcagggtttgtgggagtccaatgatatcacagatgtaaagtgcccagtaccatgcctagcccataaatgttaagtgttagttgctcagtcatgtcca

SEQ ID NO: 59609 - DNA, 201 bp, Bos taurus
accgtctgtgactcattgtggttaactggtttctagcaaatatttgctgaattgatggataaaatccaatcattcaagacccagactagatgctacatctactaaggagtcatgtctaatgtgtaccagtctccagaagtaatctctctgttccctatatgttcagagcatttcatcattcccctctgatgatagttttta

SEQ ID NO: 59610 - DNA, 201 bp, Bos taurus
cactttctctgcaatggcattcaaatgaataaaaagataaaaagaacagtgaccaccctaccacatgctctccatgacctcccagcttaggctcaacggtgcttatttttatatctatctcaagaaagaatttgggttggtttagcccatcatgactcagttcctttgggacttatgtcccctgctgttccaatcagctct

SEQ ID NO: 59611 - DNA, 201 bp, Bos taurus
ggcccccgcgacctcaacttgcgcgtgggcggacagcccctggtcctggagcagatgctcatctactacctggacgagaagcccccccagttctccatgaggcgcctcaccagcggcctcatcgccgtcgtcgtggtggtcgtggtggcggtggtcgccggcgcggccgtcctggtgatcaccaatcgcagaaagtcggga

SEQ ID NO: 59612 - DNA, 201 bp, Bos taurus; identical to SEQ ID NO: 18999

SEQ ID NO: 59613 - DNA, 201 bp, Bos taurus; identical to SEQ ID NO: 19000

SEQ ID NO: 59614 - DNA, 201 bp, Bos taurus; identical to SEQ ID NO: 19001

SEQ ID NO: 59615 - DNA, 201 bp, Bos taurus; identical to SEQ ID NO: 19002

SEQ ID NO: 59616 - DNA, 201 bp, Bos taurus; identical to SEQ ID NO: 19003

SEQ ID NO: 59617 - DNA, 201 bp, Bos taurus; identical to SEQ ID NO: 19004

SEQ ID NO: 59618 - DNA, 201 bp, Bos taurus; identical to SEQ ID NO: 19005

SEQ ID NO: 59619 - DNA, 201 bp, Bos taurus; identical to SEQ ID NO: 19006

SEQ ID NO: 59620 - DNA, 201 bp, Bos taurus; identical to SEQ ID NO: 19007

SEQ ID NO: 59621 - DNA, 201 bp, Bos taurus
gttgactgtaggcgacagcctggtgaacatgctggagagttcaaagggtgacctagaaagtttgagactgcacagcaggaggccaggatatgttacctgatagtgagttaagaataagtgctttctcatggctactgttttaacatctgaaaaaaagaagggagctgggccagttgatctcttaggttctctccacctctg

SEQ ID NO: 59622 - DNA, 201 bp, Bos taurus; identical to SEQ ID NO: 19008

SEQ ID NO: 59623 - DNA, 201 bp, Bos taurus
cctggaggcttgcgtctgagttgggaggccctaaggagttcaggagcagagttctttaaatgacaggctcacatttgcatatagaatgatggctcgggcggcagtgggatctcaggtctgtctttctctcaagtggcccccatgtcctcactctaacagaggggagctcaagtgttctgtcatgtagcctgaactctgttt

SEQ ID NO: 59624 - DNA, 201 bp, Bos taurus; identical to SEQ ID NO: 19009

SEQ ID NO: 59625 - DNA, 201 bp, Bos taurus
ccaccaaagaagataaattcagtgattgcttgttcaatataataatacaatgctcaaatattattaaagaacaagttactttgaatctaactttcaagttgctgtagggttttttcccctataactagtttattgcccagtagagtagaacggttgtaaatctcttaactggtttgatttgtgtgtatgtattttgtattt

SEQ ID NO: 59626 - DNA, 201 bp, Bos taurus
ctgcttctgctcccctctgccctcttaagacatgtttcttaaatggtgagtgtctggcttcgtccctgacagtaccctcttaaaaatgacctttggtggatttctggtgcctggagccaccctgaaggcaggggaagaatcttaattgaggctgcattatttttgataattcacttaagtcaaacattttgtttttgctgg

SEQ ID NO: 59627 - DNA, 201 bp, Bos taurus
gaggttgttaatttatcaactttgtggccttcagagttttaatcccaggatatgttctgtcagtgtaggtatctttctggatgggtttggtctaagcaaatgatggctgtgaggatggtgctattttatcagtagagagatgtactaccttcagatatcctactacagttttatagcctttgcatttctgatatccctggc

SEQ ID NO: 59628 - DNA, 201 bp, Bos taurus; identical to SEQ ID NO: 19010

SEQ ID NO: 59629 - DNA, 201 bp, Bos taurus
catacaatgtttgtaatagatttgttaaatgaacacctggcagaaataaaacaagcactagtagacctttgtcaggaaaatgaaagaagggccaattatccgagagtaagaattggctcacatacgtttcactaaaggacctgccttgttcttgtgtggctcctaatctgactctgcctaggaatcattggccaagctttg

SEQ ID NO: 59630 - DNA, 201 bp, Bos taurus; identical to SEQ ID NO: 19011

SEQ ID NO: 59631 - DNA, 201 bp, Bos taurus
aaggaagtccaagaaatgactagtatcaaacaggaatgtaaccatatatgccaggtacaaagggtatggatgggaagatgcctccagcaagactgtgtcagtaggagagaaaagagggaaaagatgggatcaagagtggactgggcattcagaactaagagcaggaagtgtttggcatccttttacacaggacctagtcca

SEQ ID NO: 59632 - DNA, 201 bp, Bos taurus; identical to SEQ ID NO: 19012

SEQ ID NO: 59633 - DNA, 201 bp, Bos taurus; identical to SEQ ID NO: 19013

SEQ ID NO: 59634 - DNA, 201 bp, Bos taurus
gcagtcttattaggaccccatgggactctgtggactgcttttaaaggcaacagtgggcagtgtcatggctgaaggaggagaggttttacaggtagcctgcaggagctcaagatgcctcctttttaacatgcagcatatggggttgcaaccagaggaggggcagtcttaccaaagcaccggcttggggtagacacttaccag

SEQ ID NO: 59635 - DNA, 201 bp, Bos taurus; identical to SEQ ID NO: 19014

SEQ ID NO: 59636 - DNA, 201 bp, Bos taurus; identical to SEQ ID NO: 19015

SEQ ID NO: 59637 - DNA, 201 bp, Bos taurus; identical to SEQ ID NO: 19016

SEQ ID NO: 59638 - DNA, 201 bp, Bos taurus; identical to SEQ ID NO: 19017

SEQ ID NO: 59639 - DNA, 201 bp, Bos taurus; identical to SEQ ID NO: 19018

SEQ ID NO: 59640 - DNA, 201 bp, Bos taurus; identical to SEQ ID NO: 19019

SEQ ID NO: 59641 - DNA, 201 bp, Bos taurus
ttagcttccagcctttcactccctctgacagctacagggcctcaaggtttccaatggcaaccatttccctttctctagctgattgctaggtctctgaccacgaaaccagaccaccccctaccaccacagacttgtcagagtggggacttttctgcatagtgttacctcctcctcttggcagtgggaaggtaagctcctggg

SEQ ID NO: 59642 - DNA, 201 bp, Bos taurus; identical to SEQ ID NO: 19020

SEQ ID NO: 59643 - DNA, 201 bp, Bos taurus; identical to SEQ ID NO: 19021

SEQ ID NO: 59644 - DNA, 201 bp, Bos taurus
tatgtttgagtctctttggatttattatactttccattcattaagtttcttgtatttatatatccatgtcattgcaaagattttggacttttgggccatcgtttcttcagatacactctcttccccttcctctctccccttcttctgggactcccattatgcatgttttggcctacttaatggtttcctataagtctctta

SEQ ID NO: 59645 - DNA, 201 bp, Bos taurus; identical to SEQ ID NO: 19022

SEQ ID NO: 59646 - DNA, 201 bp, Bos taurus
tcacccaccaaggggcaggcataagaagcaagaaagctgtaataccataactcaggccagactctgccctgggaccagctggaccctggccttgcccactgacatgccaacacaaaatttgggacactgcaaaccccatacccaactgtggcagaaaccgtccccccacccccactgagcaatgaacaatctgaaatgagc

SEQ ID NO: 59647 - DNA, 201 bp, Bos taurus; identical to SEQ ID NO: 19023

SEQ ID NO: 59648 - DNA, 201 bp, Bos taurus
ttgcagcgttggcttccccttgccttggatcagacctctggtcctaagccctcctcctctttccctgtagcaaacattgaacgaagcaggagagtagtacgttggccatttgctcctcagcacttgctaaggagtatgttttgttgaggtacttgaaagattccattaatgaggaagtccaaggtgatatttttatcttct

SEQ ID NO: 59649 - DNA, 201 bp, Bos taurus
cactcacactcgcaagagttgcccaaagcagctgtgtcagctcctccctcttctcagacgcaccccgcctttgatctggccagctgacaaccagccaacactcacagtgctcctctccaacccccatccccaccccagagattcagggatcaggggaaggcagagcctcttgcacctctttcccttcatctgagtgcttcc

SEQ ID NO: 59650 - DNA, 201 bp, Bos taurus
gctggccccctccttccagctccctcctattccaatccatgcacccaagttcctgccacctggggtcctgtacacctgctgctccctccacctggagagctctctgtccccattcagggccctcatttcacaaccccctttgagacccatgccaaataccacatcctcgaagaagcctttctgctgctaccacccacacct

SEQ ID NO: 59651 - DNA, 201 bp, Bos taurus
cttgaggttgtggactgcctccaccaccagcagcccatccacactcttcagacccttcaccatggagggcaggagggcctgcaccttggcagcctgcagagaaggagtatttgggatgggggctcctatctgatctaacaggtgaggggcccagcctctgagtcacagagatgaacttggtcaagcaagtcctacctccag

SEQ ID NO: 59652 - DNA, 201 bp, Bos taurus; identical to SEQ ID NO: 19024

SEQ ID NO: 59653 - DNA, 201 bp, Bos taurus; identical to SEQ ID NO: 19025

SEQ ID NO: 59654 - DNA, 201 bp, Bos taurus; identical to SEQ ID NO: 19026

SEQ ID NO: 59655 - DNA, 201 bp, Bos taurus; identical to SEQ ID NO: 19027

SEQ ID NO: 59656 - DNA, 201 bp, Bos taurus; identical to SEQ ID NO: 19028

SEQ ID NO: 59657 - DNA, 201 bp, Bos taurus; identical to SEQ ID NO: 19029

SEQ ID NO: 59658 - DNA, 201 bp, Bos taurus
agaaacaggatttgcttctcagtttggggccccaggtctcttaaatgcttagattgtagtcttcccacaggattaagtagtgatttctgttttcataggcagtttcataggcctcttgacactgtgaggggcctcttgaatctctcgttgctctaccacgtctggctgtgtggtgtctttgtcctgatgacttggtacgtc

SEQ ID NO: 59659 - DNA, 201 bp, Bos taurus
gctaaatctgaccttgactgctatgaggctatttgtagacttcatttactccttgtactatgaccgtgtttccattcactgtggtgtgatgatgtaggtgctgtcccagaccctatgggagtgttatgtaatatgcatctttattacctttctaaagtcctttaatcaaagcttcgggccttaggagtttaagacaaagca

SEQ ID NO: 59660 - DNA, 201 bp, Bos taurus; identical to SEQ ID NO: 19030

SEQ ID NO: 59661 - DNA, 201 bp, Bos taurus; identical to SEQ ID NO: 19031

SEQ ID NO: 59662 - DNA, 201 bp, Bos taurus; identical to SEQ ID NO: 19032

SEQ ID NO: 59663 - DNA, 201 bp, Bos taurus; identical to SEQ ID NO: 19033

SEQ ID NO: 59664 - DNA, 201 bp, Bos taurus
cacagttgtttgcaactcagcaaagcagtagtaaaccatcaggttctattcacccagcacttagaaaaaacagaattgatcacacccatttaaaaacaaatctcatgctatttcccaatgtatagtttcaatctaagttctgacaatgaaatatatggatatatatctatatatctcatcttgattttcaaaggaggcaaa

SEQ ID NO: 59665 - DNA, 201 bp, Bos taurus; identical to SEQ ID NO: 19034

SEQ ID NO: 59666 - DNA, 201 bp, Bos taurus; identical to SEQ ID NO: 19035

SEQ ID NO: 59667 - DNA, 201 bp, Bos taurus
tccatggacttcccatctatgggacttaggacactaaaacagaaacaaaggagagagatggaagcagctcttagaagaactacttctctcttatcatacattgggtgccttgctgaaaagacctatgcaaaacatcacaaagaagaagccactgccccaaaatgtacacgaacagagctctcagggaggggcctgtgcact

SEQ ID NO: 59668 - DNA, 201 bp, Bos taurus; identical to SEQ ID NO: 19036

SEQ ID NO: 59669 - DNA, 201 bp, Bos taurus; identical to SEQ ID NO: 19037

SEQ ID NO: 59670 - DNA, 201 bp, Bos taurus; identical to SEQ ID NO: 19038

SEQ ID NO: 59671 - DNA, 201 bp, Bos taurus; identical to SEQ ID NO: 19039

SEQ ID NO: 59672 - DNA, 201 bp, Bos taurus
ttacactgtgtgttttttttttttttttgcattgtatttttaaaaaagaaaaacattacttagtgattattttgggataatgtagtaagatattttgccacggttgactgaatatttgaggaaattaaatacttagggttttgaaatatgataaaatatattaggttatgttaaaaaatgttcttatcctttagaactata

SEQ ID NO: 59673 - DNA, 201 bp, Bos taurus
attgactgaatggtgtttatcaactattttatgttgtgatccacacatatgtactgtatgtgtctttgtttattaatttattgaggaagcctagagaagaaaggtttgttttcacatcttgagcattattataaataactttcagaataggtagatactgaagttttctaatttagaaaatgtccatttgggctaattagt

SEQ ID NO: 59674 - DNA, 201 bp, Bos taurus
gcaaaacatcttcaaaatgtttgtgaaacatctttaagattgtttgcttttagtagatggacattgaataaatcaggcagatttggatttgaacctggaacctgaaactgactatataagccaaaattttctctgaaatggagattaaagtaccttggcaattaacccaccttggaataatgaatccttaccttcacagta

SEQ ID NO: 59675 - DNA, 201 bp, Bos taurus
aggatcagagtagtgggagcctgggaagggaaaccaggtacttgttttgaagtacacaagacgacaggtttatgggagttagaactaagatgacagtggtagagatgaggagacagaatcaggaagaagcacaaatcgctgagatttggtgattgtctaactatgtcaggatagggatgataggaagaaggagttgtcaaa

SEQ ID NO: 59676 - DNA, 201 bp, Bos taurus
ccaaggtgacaaccttaccattttgtttcctcacatttatttattgagccaatgtttattgaacacatgtcatgtggtgctggtgctggggtggtctacagccccaccctcagtgtggaaaagcacctccacatccacaggcccccctccacctcggaccagccccacccagcagctgcccaattggaagatggggaacag

SEQ ID NO: 59677 - DNA, 201 bp, Bos taurus; identical to SEQ ID NO: 19041

SEQ ID NO: 59678 - DNA, 201 bp, Bos taurus; identical to SEQ ID NO: 19043

SEQ ID NO: 59679 - DNA, 201 bp, Bos taurus; identical to SEQ ID NO: 19044

SEQ ID NO: 59680 - DNA, 201 bp, Bos taurus; identical to SEQ ID NO: 19046

SEQ ID NO: 59681 - DNA, 201 bp, Bos taurus; identical to SEQ ID NO: 19052

SEQ ID NO: 59682 - DNA, 201 bp, Bos taurus; identical to SEQ ID NO: 19054

SEQ ID NO: 59683 - DNA, 201 bp, Bos taurus; identical to SEQ ID NO: 19056

SEQ ID NO: 59684 - DNA, 201 bp, Bos taurus; identical to SEQ ID NO: 19065

SEQ ID NO: 59685 - DNA, 201 bp, Bos taurus; identical to SEQ ID NO: 19066

SEQ ID NO: 59686 - DNA, 201 bp, Bos taurus; identical to SEQ ID NO: 19067

SEQ ID NO: 59687 - DNA, 201 bp, Bos taurus; identical to SEQ ID NO: 19069

SEQ ID NO: 59688 - DNA, 201 bp, Bos taurus; identical to SEQ ID NO: 19070

SEQ ID NO: 59689 - DNA, 201 bp, Bos taurus; identical to SEQ ID NO: 19071

SEQ ID NO: 59690 - DNA, 201 bp, Bos taurus; identical to SEQ ID NO: 19082

SEQ ID NO: 59691 - DNA, 201 bp, Bos taurus; identical to SEQ ID NO: 19083

SEQ ID NO: 59692 - DNA, 201 bp, Bos taurus; identical to SEQ ID NO: 19084

SEQ ID NO: 59693 - DNA, 201 bp, Bos taurus; identical to SEQ ID NO: 19085

SEQ ID NO: 59694 - DNA, 201 bp, Bos taurus; identical to SEQ ID NO: 19089

SEQ ID NO: 59695 - DNA, 201 bp, Bos taurus; identical to SEQ ID NO: 19090

SEQ ID NO: 59696 - DNA, 201 bp, Bos taurus; identical to SEQ ID NO: 19093

SEQ ID NO: 59697 - DNA, 201 bp, Bos taurus
tcttaggatttgggaggagagtcatctctcctctcaatcacctctcatggttggccacaagaaagaaagggtcgagtaacctgagctgcccttcctgaaatgaggtgttctattatctactgagcattgagttgggcatgggcagtagtactctgtcctcaaaccgaaatgctatggaaaatactgagcaagctgcatgag

SEQ ID NO: 59698 - DNA, 201 bp, Bos taurus; identical to SEQ ID NO: 19094

SEQ ID NO: 59699 - DNA, 201 bp, Bos taurus
ttattcccttgaacagaaattacaaaaatctgtggccttctgcttccagttttgctgcctgtcttttggacatgtgggcctttttaagttcttgtaagacggctgttactctccagagctgagcccatcacttcttacctcctcagctgcaacctgtttctttgcctttgacaaggccacctctacttcacagctaccaag

SEQ ID NO: 59700 - DNA, 201 bp, Bos taurus; identical to SEQ ID NO: 19095

SEQ ID NO: 59701 - DNA, 201 bp, Bos taurus; identical to SEQ ID NO: 19096

SEQ ID NO: 59702 - DNA, 201 bp, Bos taurus; identical to SEQ ID NO: 19097

SEQ ID NO: 59703 - DNA, 201 bp, Bos taurus; identical to SEQ ID NO: 19098

SEQ ID NO: 59704 - DNA, 201 bp, Bos taurus; identical to SEQ ID NO: 19099

SEQ ID NO: 59705 - DNA, 201 bp, Bos taurus
cagctgaaagggagcttatttacacagagcagctcaatctttctccccccatcgagactcctgacttcttttcaagggatctcatgttttgaaaggtattgtatccaaataactaataactcattaatttcctactatttattaatcaatatctatagtccagtcagagtttctgattagcatgagatgtttatattcacc

SEQ ID NO: 59706 - DNA, 201 bp, Bos taurus; identical to SEQ ID NO: 19100

SEQ ID NO: 59707 - DNA, 201 bp, Bos taurus; identical to SEQ ID NO: 19101

SEQ ID NO: 59708 - DNA, 201 bp, Bos taurus; identical to SEQ ID NO: 19102

SEQ ID NO: 59709 - DNA, 201 bp, Bos taurus
attagtgcatttccaaatatgagggtgaaagtgactaccagaagatgtgaaataaatgtaaaggataacaaactcacacctatttggttcatactgccatgatttcatcttcaaagaagaagatttatattgaagttaacagataaccctccatgaaataatcaagaggagctcagacttttcactctttctttatttttg

SEQ ID NO: 59710 - DNA, 201 bp, Bos taurus; identical to SEQ ID NO: 19103

SEQ ID NO: 59711 - DNA, 201 bp, Bos taurus; identical to SEQ ID NO: 19104

SEQ ID NO: 59712 - DNA, 201 bp, Bos taurus; identical to SEQ ID NO: 19105

SEQ ID NO: 59713 - DNA, 201 bp, Bos taurus; identical to SEQ ID NO: 19106

SEQ ID NO: 59714 - DNA, 201 bp, Bos taurus; identical to SEQ ID NO: 19107

SEQ ID NO: 59715 - DNA, 201 bp, Bos taurus; identical to SEQ ID NO: 19108

SEQ ID NO: 59716 - DNA, 201 bp, Bos taurus; identical to SEQ ID NO: 19109

SEQ ID NO: 59717 - DNA, 201 bp, Bos taurus; identical to SEQ ID NO: 19110

SEQ ID NO: 59718 - DNA, 201 bp, Bos taurus; identical to SEQ ID NO: 19111

SEQ ID NO: 59719 - DNA, 201 bp, Bos taurus; identical to SEQ ID NO: 19112

SEQ ID NO: 59720 - DNA, 201 bp, Bos taurus; identical to SEQ ID NO: 19113

SEQ ID NO: 59721 - DNA, 201 bp, Bos taurus; identical to SEQ ID NO: 19114

SEQ ID NO: 59722 - DNA, 201 bp, Bos taurus; identical to SEQ ID NO: 19115

SEQ ID NO: 59723 - DNA, 201 bp, Bos taurus; identical to SEQ ID NO: 19116

SEQ ID NO: 59724 - DNA, 201 bp, Bos taurus
tgacttccagcgtttgattggttttttcccctcttggtgtgtgtgccattttttacagaggaggcgagaagcacggcagcagcgatctagaaaagtcggcgtacgctactatgaaacacacaatgtgaagaataggaacaggaacaaaaagaagaccaccgactcagaagggcagaaacacagacacaagaaagccaaaca

SEQ ID NO: 59725 - DNA, 201 bp, Bos taurus; identical to SEQ ID NO: 19117

SEQ ID NO: 59726 - DNA, 201 bp, Bos taurus; identical to SEQ ID NO: 19119

SEQ ID NO: 59727 - DNA, 201 bp, Bos taurus; identical to SEQ ID NO: 19120

SEQ ID NO: 59728 - DNA, 201 bp, Bos taurus; identical to SEQ ID NO: 19124

SEQ ID NO: 59729 - DNA, 201 bp, Bos taurus; identical to SEQ ID NO: 19126

SEQ ID NO: 59730 - DNA, 201 bp, Bos taurus; identical to SEQ ID NO: 19127

SEQ ID NO: 59731 - DNA, 201 bp, Bos taurus; identical to SEQ ID NO: 19130

SEQ ID NO: 59732 - DNA, 201 bp, Bos taurus; identical to SEQ ID NO: 19131

SEQ ID NO: 59733 - DNA, 201 bp, Bos taurus; identical to SEQ ID NO: 19132

SEQ ID NO: 59734 - DNA, 201 bp, Bos taurus; identical to SEQ ID NO: 19133

SEQ ID NO: 59735 - DNA, 201 bp, Bos taurus; identical to SEQ ID NO: 19134

SEQ ID NO: 59736 - DNA, 201 bp, Bos taurus; identical to SEQ ID NO: 19135

SEQ ID NO: 59737 - DNA, 201 bp, Bos taurus; identical to SEQ ID NO: 19136

SEQ ID NO: 59738 - DNA, 201 bp, Bos taurus; identical to SEQ ID NO: 19138

SEQ ID NO: 59739 - DNA, 201 bp, Bos taurus; identical to SEQ ID NO: 19139

SEQ ID NO: 59740 - DNA, 201 bp, Bos taurus; identical to SEQ ID NO: 19140

SEQ ID NO: 59741 - DNA, 201 bp, Bos taurus; identical to SEQ ID NO: 19141

SEQ ID NO: 59742 - DNA, 201 bp, Bos taurus; identical to SEQ ID NO: 19145

SEQ ID NO: 59743 - DNA, 201 bp, Bos taurus; identical to SEQ ID NO: 19147

SEQ ID NO: 59744 - DNA, 201 bp, Bos taurus; identical to SEQ ID NO: 19148

SEQ ID NO: 59745 - DNA, 201 bp, Bos taurus; identical to SEQ ID NO: 19152

SEQ ID NO: 59746 - DNA, 201 bp, Bos taurus
ctttcccctcttatgtggtggtcagggatgctggatcccaccccccagacaagagggcgcacccagaggggccctgcccacaagggaagggccagggaaagcatacggagggactgaactcaggctgggtcctggaggagagatgaagcgaggagagcagaggcggggggacaactaccccgttaggggggccagggtggg

SEQ ID NO: 59747 - DNA, 201 bp, Bos taurus; identical to SEQ ID NO: 19157

SEQ ID NO: 59748 - DNA, 201 bp, Bos taurus; identical to SEQ ID NO: 19158

SEQ ID NO: 59749 - DNA, 201 bp, Bos taurus; identical to SEQ ID NO: 19161

SEQ ID NO: 59750 - DNA, 201 bp, Bos taurus; identical to SEQ ID NO: 19162

SEQ ID NO: 59751 - DNA, 201 bp, Bos taurus; identical to SEQ ID NO: 19163

SEQ ID NO: 59752 - DNA, 201 bp, Bos taurus; identical to SEQ ID NO: 19164

SEQ ID NO: 59753 - DNA, 201 bp, Bos taurus
gtatttaatgggttgtctttctgctcttgctaaaatataggctctttgagaccaaggaaagattattttccccccactgatggactcaagaacacttgatcggggcctgggaccaagaggaaagctgataaatatttggtgatttatggataggagtggcggcaggccaggaaatgttagttttcatgaacttccactccc

SEQ ID NO: 59754 - DNA, 201 bp, Bos taurus; identical to SEQ ID NO: 19169

SEQ ID NO: 59755 - DNA, 201 bp, Bos taurus; identical to SEQ ID NO: 19170

SEQ ID NO: 59756 - DNA, 201 bp, Bos taurus; identical to SEQ ID NO: 19171

SEQ ID NO: 59757 - DNA, 201 bp, Bos taurus
gttcagacagactaaatggaaacctgccattaggcagggtgggaggcttgttctgtggagagagagggctttgggctgtggggacctcaggtgcctctgctgtcaaatacagccatgtcaaccctggtgatcagtgttttgcgtcctggtttatatagtgagagaacagagagcttgattccgattgcagtcttcagaatt

SEQ ID NO: 59758 - DNA, 201 bp, Bos taurus; identical to SEQ ID NO: 19176

SEQ ID NO: 59759 - DNA, 201 bp, Bos taurus; identical to SEQ ID NO: 19177

SEQ ID NO: 59760 - DNA, 201 bp, Bos taurus; identical to SEQ ID NO: 19178

SEQ ID NO: 59761 - DNA, 201 bp, Bos taurus; identical to SEQ ID NO: 19179

SEQ ID NO: 59762 - DNA, 201 bp, Bos taurus
agaagaggagctgatggaaacaggcagtggccctgaccaccaggaacaaggaagctcagagcttcagcagagtcacagaggggcacttgcacctccccagcttttggccctctctgagaaagtgatgtctaagcttaaaaaaaaattagggtaaagaaggaggaaactgtccccaaacagaagtaacaccatgaatttttt

SEQ ID NO: 59763 - DNA, 201 bp, Bos taurus; identical to SEQ ID NO: 19182

SEQ ID NO: 59764 - DNA, 201 bp, Bos taurus
ctctttttgagagctgctggaggctggagacctccatcagccagggcagtggcccgacgcccacccacactgccgcagcccatctcccaggcccccagataaatgtggttccacctgtttctgtttcaagccaaactggggtctgagtccctccacagactcctgggccagtgggagggctggctcagcacacagtccacc

SEQ ID NO: 59765 - DNA, 201 bp, Bos taurus
ccacggtgggcccgccgcacagcccctgctcccctccgcacggcctcctctaaaccaggctcttacggccatcaaggactcttcactaaagccagtgacgcctcacttatcagcacaaagagccaaccccaaggtgaacatgaaccgattgagctctgagcctcacctttaggaaatttcctgattaagttctgatgcaaa

SEQ ID NO: 59766 - DNA, 201 bp, Bos taurus
ttccgttcctggtcaaggaactaaggtcccacgtgcctggcacacaatacagccaaagcaaagtgggaggggggcagagaactgagaacaccacgtgcctgtctgggaccaggcactgggctctcaacagctttgtaagcaaagtcatattggcggtggacagggcgcacaaggtgtccctcgagtcttcaggtgagagcc

SEQ ID NO: 59767 - DNA, 201 bp, Bos taurus
ggcctctgtgatcaccgtgcctcagcctcatatgtgcccacaggcagtggacatcctcccaccaaagagccacgcaggcaaacccagaggacagcccaggtagtctgggccctcggctggccgcggggagaactcagcaaagaagggaagggcagagctggttctgaagccgtaccctgcagaactcctggtgcaggcacc

SEQ ID NO: 59768 - DNA, 201 bp, Bos taurus; identical to SEQ ID NO: 19183

SEQ ID NO: 59769 - DNA, 201 bp, Bos taurus; identical to SEQ ID NO: 19185

SEQ ID NO: 59770 - DNA, 201 bp, Bos taurus; identical to SEQ ID NO: 19186

SEQ ID NO: 59771 - DNA, 201 bp, Bos taurus; identical to SEQ ID NO: 19188

SEQ ID NO: 59772 - DNA, 201 bp, Bos taurus; identical to SEQ ID NO: 19189

SEQ ID NO: 59773 - DNA, 201 bp, Bos taurus
ctcagaaggagtgtcgcttttggacttccagcctgcagatggtgagggaatgtgctcagaggaggtaggcctccgctggggcccttgctacctcagcccttgggaactaaagcaaaaatatccctccacggggagtgctcccgtcagaaggagtgtgatgtccagatgggcgtgtgtgcgcggcaatggggagccggggag

SEQ ID NO: 59774 - DNA, 201 bp, Bos taurus
agccttcttaaggaaagacataaatgatccctgttacacgtgtggtcagggctgtccctggctccatcatgtcctcccatttcctgcagtttcctctcccaccgtctagctgctccgagagccggtctcgtccctgctcacagatggccgcactagccccgctgaaacagaaccgctggggcagcaggggccagggagatc

SEQ ID NO: 59775 - DNA, 201 bp, Bos taurus
accatggccatggggaaacaaggctcagatttttcacgtgaaaatctgaggttcacggtgaaaaattcaggaactcacgaagacacacgggtcctcagacactgaggccacgactcttcccaagggacgtcaacaagagaaacagtgagcccatttgggtgcaggctagagactcggaattattaagatggactgttagag

SEQ ID NO: 59776 - DNA, 201 bp, Bos taurus; identical to SEQ ID NO: 19190

SEQ ID NO: 59777 - DNA, 201 bp, Bos taurus; identical to SEQ ID NO: 19192

SEQ ID NO: 59778 - DNA, 201 bp, Bos taurus
tgtcaggtcccaggccgggcgagtcctcacctaggttttcccggaggagccacgtcagcaccgagtctctgtagggaatgaagtctgtcttcttcttcttcttgttctgtgggggacgggcgtccaaggtcagccccgagcccacctgaggtggggtcaggggggcacagacggggagcgcgggctggctgcccagggctc

SEQ ID NO: 59779 - DNA, 201 bp, Bos taurus; identical to SEQ ID NO: 19196

SEQ ID NO: 59780 - DNA, 201 bp, Bos taurus; identical to SEQ ID NO: 19197

SEQ ID NO: 59781 - DNA, 201 bp, Bos taurus; identical to SEQ ID NO: 19198

SEQ ID NO: 59782 - DNA, 201 bp, Bos taurus
gtcggacacgactgacgtgacttagcagcagcagcagcgagggtcggtagctgtcattctagctgtctggtgactccaccagctgctgtgggcggtgcttaccggggccccgcccaccgtctgctccgaaagagcgtagccccccaggggcgtccctagggccctctgaaagggcgcctcctccttgtccaattcggcagc

SEQ ID NO: 59783 - DNA, 201 bp, Bos taurus; identical to SEQ ID NO: 19199

SEQ ID NO: 59784 - DNA, 201 bp, Bos taurus; identical to SEQ ID NO: 19200

SEQ ID NO: 59785 - DNA, 201 bp, Bos taurus; identical to SEQ ID NO: 19201

SEQ ID NO: 59786 - DNA, 201 bp, Bos taurus; identical to SEQ ID NO: 19203

SEQ ID NO: 59787 - DNA, 201 bp, Bos taurus; identical to SEQ ID NO: 19204

SEQ ID NO: 59788 - DNA, 201 bp, Bos taurus; identical to SEQ ID NO: 19205

SEQ ID NO: 59789 - DNA, 201 bp, Bos taurus; identical to SEQ ID NO: 19207

SEQ ID NO: 59790 - DNA, 201 bp, Bos taurus; identical to SEQ ID NO: 19209

SEQ ID NO: 59791 - DNA, 201 bp, Bos taurus; identical to SEQ ID NO: 19210

SEQ ID NO: 59792 - DNA, 201 bp, Bos taurus; identical to SEQ ID NO: 19212

SEQ ID NO: 59793 - DNA, 201 bp, Bos taurus; identical to SEQ ID NO: 19213

SEQ ID NO: 59794 - DNA, 201 bp, Bos taurus; identical to SEQ ID NO: 19215

SEQ ID NO: 59795 - DNA, 201 bp, Bos taurus
gtaaataaaagcacacaggtaaaggaatataagatttacttgatttttcaaaatatatcaacttactttccagacttggagaaatcacgatgtcattgccaagctgagaggggaaaagtcccatttgttactgcttcaaggttaagagatcccctctgtggctagcgctgaacagaacgcaccactcagtagttcaccaag

SEQ ID NO: 59796 - DNA, 201 bp, Bos taurus; identical to SEQ ID NO: 19219

SEQ ID NO: 59797 - DNA, 201 bp, Bos taurus; identical to SEQ ID NO: 19220

SEQ ID NO: 59798 - DNA, 201 bp, Bos taurus; identical to SEQ ID NO: 19221

SEQ ID NO: 59799 - DNA, 201 bp, Bos taurus; identical to SEQ ID NO: 19223

SEQ ID NO: 59800 - DNA, 201 bp, Bos taurus; identical to SEQ ID NO: 19225

SEQ ID NO: 59801 - DNA, 201 bp, Bos taurus; identical to SEQ ID NO: 19226

SEQ ID NO: 59802 - DNA, 201 bp, Bos taurus; identical to SEQ ID NO: 19227

SEQ ID NO: 59803 - DNA, 201 bp, Bos taurus; identical to SEQ ID NO: 19228

SEQ ID NO: 59804 - DNA, 201 bp, Bos taurus; identical to SEQ ID NO: 19231

SEQ ID NO: 59805 - DNA, 201 bp, Bos taurus; identical to SEQ ID NO: 19232

SEQ ID NO: 59806 - DNA, 201 bp, Bos taurus; identical to SEQ ID NO: 19233

SEQ ID NO: 59807 - DNA, 201 bp, Bos taurus; identical to SEQ ID NO: 19234

SEQ ID NO: 59808 - DNA, 201 bp, Bos taurus; identical to SEQ ID NO: 19238

SEQ ID NO: 59809 - DNA, 201 bp, Bos taurus; identical to SEQ ID NO: 19239

SEQ ID NO: 59810 - DNA, 201 bp, Bos taurus; identical to SEQ ID NO: 19241

SEQ ID NO: 59811 - DNA, 201 bp, Bos taurus; identical to SEQ ID NO: 19242

SEQ ID NO: 59812 - DNA, 201 bp, Bos taurus; identical to SEQ ID NO: 19243

SEQ ID NO: 59813 - DNA, 201 bp, Bos taurus; identical to SEQ ID NO: 19244

SEQ ID NO: 59814 - DNA, 201 bp, Bos taurus
gctcagctgttacactgttaacctggagccttactggtggcagctgaaaaagccctgggtggaccacatgcactcctgtgcccaaaccctacagcctgattgctgcgctcaccggaggggcagggctctgcctgtcaggcatggcgttcacctaagtgagaaggtggtaaggtgttcttttgattttatgcccagccaagg

SEQ ID NO: 59815 - DNA, 201 bp, Bos taurus; identical to SEQ ID NO: 19245

SEQ ID NO: 59816 - DNA, 201 bp, Bos taurus; identical to SEQ ID NO: 19248

SEQ ID NO: 59817 - DNA, 201 bp, Bos taurus
acatatgtcccctacttcctggccctccccctcacctctgatcccatcccacccctctaggttgtcacagagcaccagcttgagctccctgagtcgcacatcgaactcccccggctacctgttttccatatggtagtgtacatgcttccatgctacgatattacttagtagcactcagtttcatttgttgaccattttatt

SEQ ID NO: 59818 - DNA, 201 bp, Bos taurus
cccaagtgaaatcagaggatgggttgtatgattcgatggcttgcatctcttccagcttcagggcccaaggattaccatgttagtattttgctaatatttcccttgtactctcgtagtacagtgcttgggacctggccagtcctttgcagtgttagtgcccagtgaaaagtggctgagtataaatctcaatgcctctctttt

SEQ ID NO: 59819 - DNA, 201 bp, Bos taurus; identical to SEQ ID NO: 19251

SEQ ID NO: 59820 - DNA, 201 bp, Bos taurus
tgacatttgccacgatagtaaatcttaagcgttttcaccacacacatacatcaaaggctatgaggtggtggatatctcagctaacatgactgtagatgtcatttcacaaaggaaacataaatcaaatcatcgcattacacagtttaaatatatacacttttatttgtcaattataccccaacaaaggtaattcttccattt

SEQ ID NO: 59821 - DNA, 201 bp, Bos taurus; identical to SEQ ID NO: 19255

SEQ ID NO: 59822 - DNA, 201 bp, Bos taurus
cggagttgtgctttcaaagttggacttcttttgaagtgtctcattgaatttataagtatacatatttagttatgcttacaaattatgaactaatatttagtattaaaaattataaacattatctatttaacagtgttttagtgcctgttttttctaagtactagaaatgttacagtaaacaaaacagacaaaaatccctgc

SEQ ID NO: 59823 - DNA, 201 bp, Bos taurus; identical to SEQ ID NO: 19256

SEQ ID NO: 59824 - DNA, 201 bp, Bos taurus
ctatatatacttttgtttccatggaaaatcttcatgggaacaggagtcgaaatttacagcaattaatttgtccaaagttactaacaagttagcttggcctcacactagccctggctcccttagggtctccatgagggtgggggaggaggtggacattcccctgagagccatccagcaggggcctttggagatgtgcaaaga

SEQ ID NO: 59825 - DNA, 201 bp, Bos taurus
ctactgcatcttgtagtaggtttgagctactttcatttatttattcactcaacaaaattactgaggatttgctgtgtattgattagcctacaacacaatacttctgaaaaataaccaaaaaaataaaaataaaaaatgaagagacagagccaaagccaaaaaataacacccaactgtggatgtgactggccatagaagaaa

SEQ ID NO: 59826 - DNA, 201 bp, Bos taurus; identical to SEQ ID NO: 19257

SEQ ID NO: 59827 - DNA, 201 bp, Bos taurus; identical to SEQ ID NO: 19258

SEQ ID NO: 59828 - DNA, 201 bp, Bos taurus; identical to SEQ ID NO: 19259

SEQ ID NO: 59829 - DNA, 201 bp, Bos taurus
agggagattcttgctaaagtgacctgacagagttcttgccaaagagaggccaaggacttctatatcacaggtggggcctgaggaatttgatcagatattagtgtgatcagtcatcaatggtgggggaatcctctctacactgactttgccagattcctgctaaaactaggccatacatgtctgacaaagatagaatgatac

SEQ ID NO: 59830 - DNA, 201 bp, Bos taurus; identical to SEQ ID NO: 19260

SEQ ID NO: 59831 - DNA, 201 bp, Bos taurus; identical to SEQ ID NO: 19261

SEQ ID NO: 59832 - DNA, 201 bp, Bos taurus; identical to SEQ ID NO: 19266

SEQ ID NO: 59833 - DNA, 201 bp, Bos taurus; identical to SEQ ID NO: 19267

SEQ ID NO: 59834 - DNA, 201 bp, Bos taurus; identical to SEQ ID NO: 19268

SEQ ID NO: 59835 - DNA, 201 bp, Bos taurus; identical to SEQ ID NO: 19270

SEQ ID NO: 59836 - DNA, 201 bp, Bos taurus; identical to SEQ ID NO: 19271

SEQ ID NO: 59837 - DNA, 201 bp, Bos taurus
gttaagtggcagcaactactctctttcacttctttctccaaatcaatttttatgtgatttctgagcaaagcccttgttattttgtgtattactccaattttcacataggaaaagttgtttgcatcacttttcaacattgtaaagcttttaattttaaacatccaaagagttttttttttttttttctttaatacactttgg

SEQ ID NO: 59838 - DNA, 201 bp, Bos taurus
acccagctgtctccatttccttcaccttgccctgcacactggcatcttgaaaacaccaaatatactcttcaatcacttctttttttttttttggccttttctctcccactgtctgagttaacactctcaagatggcaccatggcttgctcactcatttctgtcaggtttctatggaaaaattaggtaattcacagggcctc

SEQ ID NO: 59839 - DNA, 201 bp, Bos taurus; identical to SEQ ID NO: 19274

SEQ ID NO: 59840 - DNA, 201 bp, Bos taurus
gcagttaattcattaaggaaaactgagctggataaaatattaggtaatatttgaaattttttcagggaattaaggtcatgcctaaatactgttctacttttatgtttaaacagacatcagtattagtagtcaggacatatataagtatatatatgtataaatttatatatgtataaacatatataagtatgtatatgtata

SEQ ID NO: 59841 - DNA, 201 bp, Bos taurus
gtgaaatcttagaaaattaccttacttcttctttaatgaatgataatgaatattttacttgggagattcttggtggggaattgaaataatagcaaaaaattgaataactcagaggtacctaaatgattggagctataaaataatgaagaaagaaagaaaagaaacatggatcctctacttgattacatggatcttcaggaa

SEQ ID NO: 59842 - DNA, 201 bp, Bos taurus
tggatacaatatctctagagtcagtactttccctcagatgtaccagcatattttaaattttattagctgatggataacaggtgagctaaaagaggcttaacatgttactgatctgtgtggatgagtttgatgctacttttgaagtgaagtaattgttttagagaaggatgattggtgaacattatctgcaagagtgctttg

SEQ ID NO: 59843 - DNA, 201 bp, Bos taurus; identical to SEQ ID NO: 19276

SEQ ID NO: 59844 - DNA, 201 bp, Bos taurus; identical to SEQ ID NO: 19277

SEQ ID NO: 59845 - DNA, 201 bp, Bos taurus; identical to SEQ ID NO: 19278

SEQ ID NO: 59846 - DNA, 201 bp, Bos taurus; identical to SEQ ID NO: 19279

SEQ ID NO: 59847 - DNA, 201 bp, Bos taurus
aaaggggacacaataacatcctccccactgcttacctctacatgtcagagatcttccaaactgagcaaaggattttggaaaaggggacagatggagagaccgattaaatccacccttacctgcaagacaggcagcctctccccagagaagagctctctgtaattctgccaggggatatggagggtcaggtgcaacccacct

SEQ ID NO: 59848 - DNA, 201 bp, Bos taurus; identical to SEQ ID NO: 19281

SEQ ID NO: 59849 - DNA, 201 bp, Bos taurus; identical to SEQ ID NO: 19282

SEQ ID NO: 59850 - DNA, 201 bp, Bos taurus; identical to SEQ ID NO: 19283

SEQ ID NO: 59851 - DNA, 201 bp, Bos taurus
actttgcttcacaccaatgttgggtggttcttttagtttgggctgactggcaatcagatgcatctgtctagtttctgctggaaagtcattgataaaactggagaaaaacttcctaagggttggagacatgagaggacagtgcctgggacccaaagttagcctaagatagtggcagccagactggagcaatttttgagagaa

SEQ ID NO: 59852 - DNA, 201 bp, Bos taurus; identical to SEQ ID NO: 19288

SEQ ID NO: 59853 - DNA, 201 bp, Bos taurus
ttcttcctgaattatacttaaataaaatactgaaaggtaaataaatattctctcacctgggaaatacttttttccccctcttttctttaacatttaatcaatttctcagtggtctcaagaacctgctgcctgttttgttttggtccagttttcactctgatacctgtgtcttcctgatttcttagccccctggctttaagc

SEQ ID NO: 59854 - DNA, 201 bp, Bos taurus; identical to SEQ ID NO: 19290

SEQ ID NO: 59855 - DNA, 201 bp, Bos taurus; identical to SEQ ID NO: 19291

SEQ ID NO: 59856 - DNA, 201 bp, Bos taurus; identical to SEQ ID NO: 19292

SEQ ID NO: 59857 - DNA, 201 bp, Bos taurus; identical to SEQ ID NO: 19293

SEQ ID NO: 59858 - DNA, 201 bp, Bos taurus; identical to SEQ ID NO: 19294

SEQ ID NO: 59859 - DNA, 201 bp, Bos taurus; identical to SEQ ID NO: 19295

SEQ ID NO: 59860 - DNA, 201 bp, Bos taurus; identical to SEQ ID NO: 19296

SEQ ID NO: 59861 - DNA, 201 bp, Bos taurus; identical to SEQ ID NO: 19297

SEQ ID NO: 59862 - DNA, 201 bp, Bos taurus; identical to SEQ ID NO: 19298

SEQ ID NO: 59863 - DNA, 201 bp, Bos taurus; identical to SEQ ID NO: 19299

SEQ ID NO: 59864 - DNA, 201 bp, Bos taurus; identical to SEQ ID NO: 19300

SEQ ID NO: 59865 - DNA, 201 bp, Bos taurus; identical to SEQ ID NO: 19301

SEQ ID NO: 59866 - DNA, 201 bp, Bos taurus; identical to SEQ ID NO: 19302

SEQ ID NO: 59867 - DNA, 201 bp, Bos taurus; identical to SEQ ID NO: 19303

SEQ ID NO: 59868 - DNA, 201 bp, Bos taurus; identical to SEQ ID NO: 19304

SEQ ID NO: 59869 - DNA, 201 bp, Bos taurus; identical to SEQ ID NO: 19305

SEQ ID NO: 59870 - DNA, 201 bp, Bos taurus; identical to SEQ ID NO: 19306

SEQ ID NO: 59871 - DNA, 201 bp, Bos taurus; identical to SEQ ID NO: 19307

SEQ ID NO: 59872 - DNA, 201 bp, Bos taurus; identical to SEQ ID NO: 19308

SEQ ID NO: 59873 - DNA, 201 bp, Bos taurus; identical to SEQ ID NO: 19309

SEQ ID NO: 59874 - DNA, 201 bp, Bos taurus; identical to SEQ ID NO: 19310

SEQ ID NO: 59875 - DNA, 201 bp, Bos taurus; identical to SEQ ID NO: 19311

SEQ ID NO: 59876 - DNA, 201 bp, Bos taurus; identical to SEQ ID NO: 19313

SEQ ID NO: 59877 - DNA, 201 bp, Bos taurus; identical to SEQ ID NO: 19314

SEQ ID NO: 59878 - DNA, 201 bp, Bos taurus; identical to SEQ ID NO: 19315

SEQ ID NO: 59879 - DNA, 201 bp, Bos taurus; identical to SEQ ID NO: 19316

SEQ ID NO: 59880 - DNA, 201 bp, Bos taurus; identical to SEQ ID NO: 19317

SEQ ID NO: 59881 - DNA, 201 bp, Bos taurus; identical to SEQ ID NO: 19318

SEQ ID NO: 59882 - DNA, 201 bp, Bos taurus; identical to SEQ ID NO: 19319

SEQ ID NO: 59883 - DNA, 201 bp, Bos taurus; identical to SEQ ID NO: 19320

SEQ ID NO: 59884 - DNA, 201 bp, Bos taurus; identical to SEQ ID NO: 19322

SEQ ID NO: 59885 - DNA, 201 bp, Bos taurus; identical to SEQ ID NO: 19323

SEQ ID NO: 59886 - DNA, 201 bp, Bos taurus; identical to SEQ ID NO: 19324

SEQ ID NO: 59887 - DNA, 201 bp, Bos taurus; identical to SEQ ID NO: 19325

SEQ ID NO: 59888 - DNA, 201 bp, Bos taurus; identical to SEQ ID NO: 19326

SEQ ID NO: 59889 - DNA, 201 bp, Bos taurus; identical to SEQ ID NO: 19327

SEQ ID NO: 59890 - DNA, 201 bp, Bos taurus; identical to SEQ ID NO: 19328

SEQ ID NO: 59891 - DNA, 201 bp, Bos taurus; identical to SEQ ID NO: 19329

SEQ ID NO: 59892 - DNA, 201 bp, Bos taurus; identical to SEQ ID NO: 19330

SEQ ID NO: 59893 - DNA, 201 bp, Bos taurus; identical to SEQ ID NO: 19332

SEQ ID NO: 59894 - DNA, 201 bp, Bos taurus; identical to SEQ ID NO: 19333

SEQ ID NO: 59895 - DNA, 201 bp, Bos taurus
tgctgtggtcaggaagatggcgatcagttttctgagttttcttcctgaggtcaggaaggtggtggttaggcctctgagtccttattgctgctgctaagtcgcgtcagttgtgtcggactgtgtgcgacctcatagatggcagcccaccaggctcccctccctgggattctccaggcaagaacaacggagtgggttgccatt

SEQ ID NO: 59896 - DNA, 201 bp, Bos taurus; identical to SEQ ID NO: 19334

SEQ ID NO: 59897 - DNA, 201 bp, Bos taurus
gagaattatgtaactccagcattctgaaatctacacatttattttagaggccattttcttttcctgcttttactttcaaaatttactacttatctagcttagcaaagacatttcttttttttcctcccttttgttctttttaaattgcttcttcatgaatcattcaaattcattctctacatgaaaacagcagaaaatttg

SEQ ID NO: 59898 - DNA, 201 bp, Bos taurus
ttatttgaattcctctttgtaacttaaatcagtgaagaaaatggcttccttggagtcaatttttctgatatacaattggttagtgtagagattaaattataagtgtcacatttaatttaaaaccaaagagagaaatagcattatcacggagagtgtgctcttttgtgaatgtcaagtgcaacttgttgaaggtcttttgaa

SEQ ID NO: 59899 - DNA, 201 bp, Bos taurus
tccatatataattcttcaggataaagaggtccagttatttgaaggccacaatgtaatatctcttaatgctgaggacagcgcatactggaaaatgaagaggtacagttttataattaaatagtatggccaaggaatctgtgataaagtaaaaaaaataatgtattaagcaaaaaaaaaaaaaaaccctcaatttgaggtaaa

SEQ ID NO: 59900 - DNA, 201 bp, Bos taurus; identical to SEQ ID NO: 19339

SEQ ID NO: 59901 - DNA, 201 bp, Bos taurus; identical to SEQ ID NO: 19340

SEQ ID NO: 59902 - DNA, 201 bp, Bos taurus
atgcacaaaaaaatagtagggaaaatcttatccaaagatatttttgagtttcctccaaaattaagtttgtgttttaactgtttttagcaaaacaagcatccgttgttaatacatatggaagagtaagtattttcagcaaaggaattttattttcagatgctgtttttgaatgactcctgttttaaatttttcttttattga

SEQ ID NO: 59903 - DNA, 201 bp, Bos taurus; identical to SEQ ID NO: 19341

SEQ ID NO: 59904 - DNA, 201 bp, Bos taurus
ggtcaacatttatattcaaacagtaaattatttaaatgaagaagtcagtttactatgctttaaacttattatctattttgccttccatattatgtcatacactccttgaggatggggagaatctgagcagatttcaatttttaaaatatccttcttacattttgcacagcaaggtactcaataaacatttgtcaaatggaa

SEQ ID NO: 59905 - DNA, 201 bp, Bos taurus; identical to SEQ ID NO: 19344

SEQ ID NO: 59906 - DNA, 201 bp, Bos taurus; identical to SEQ ID NO: 19345

SEQ ID NO: 59907 - DNA, 201 bp, Bos taurus; identical to SEQ ID NO: 19346

SEQ ID NO: 59908 - DNA, 201 bp, Bos taurus; identical to SEQ ID NO: 19347

SEQ ID NO: 59909 - DNA, 201 bp, Bos taurus
ctggcaaagcttttccctgatggggagaaattacctagaaagcaagcagttgtgagcccctcagagatggagtggatactgtggttccacccaggtccccactgtagggccagtcactccatcctcagccaagagtaatcattcccttaggcagctgtcctcagttgcaggacaccacccagctaaggcagcccagcccag

SEQ ID NO: 59910 - DNA, 201 bp, Bos taurus; identical to SEQ ID NO: 19348

SEQ ID NO: 59911 - DNA, 201 bp, Bos taurus; identical to SEQ ID NO: 19350

SEQ ID NO: 59912 - DNA, 201 bp, Bos taurus; identical to SEQ ID NO: 19352

SEQ ID NO: 59913 - DNA, 201 bp, Bos taurus; identical to SEQ ID NO: 19353

SEQ ID NO: 59914 - DNA, 201 bp, Bos taurus; identical to SEQ ID NO: 19354

SEQ ID NO: 59915 - DNA, 201 bp, Bos taurus; identical to SEQ ID NO: 19355

SEQ ID NO: 59916 - DNA, 201 bp, Bos taurus; identical to SEQ ID NO: 19356

SEQ ID NO: 59917 - DNA, 201 bp, Bos taurus
aagtattcacagtaaaataccaaggtaaggtaaattcatccactccatattcccaaacaaggtgaggttaagtttttgcctttggaaggacaggtggaaacggaagagaggacgagatgtaagtctacacatagggcgttgacaggcaaccctaaaacacaaaatgtttgtcctccaacctgttctccttggaccatccca

SEQ ID NO: 59918 - DNA, 201 bp, Bos taurus
aaaaggcaaaggccaatttgtcactatagttttagcatcacattttctgccactgtaaatagatctctgacttaaatttgccattgtatattaaagccaccatatgtatgaaaacactgggtgtaattctgaatatctaaatcaatgttagactcaaatacactgtcacaagtgcaaatatttcactgtgactttgaatat

SEQ ID NO: 59919 - DNA, 201 bp, Bos taurus; identical to SEQ ID NO: 19357

SEQ ID NO: 59920 - DNA, 201 bp, Bos taurus
ctctgaaaggatattttaaatttcagattgcatggaagagaatagctatgaaatcttgagttttactcagataaacaattaaatcatggattggagtcttttatagtatgcacgactattccaaaatggttattgctatagtttgtagtatctgtaattggcctaaaaacaataaatttgttccagcaaagtaactccaaa

SEQ ID NO: 59921 - DNA, 201 bp, Bos taurus
attagctttgcaagactatctctcagttggccccttagagagcagactggaggctgatcaagatgaacatggttagatgtggctaccaagtccaccaagttactgatggcccagagaataacggtggcatggaggaggaaatgctgaagaatttgtgagcacgaatataagttagtcttttcactgcattttaccttatgt

SEQ ID NO: 59922 - DNA, 201 bp, Bos taurus
ttttaaacagcactagcaatatttctcagagaagcagagggctgtgtgtgcaattgcataatacacttccttgacagttcaaaaaatcataggccttctcggataacttagaagctgtctgcatctgtgtatcatattacgttggggaagagcaattagtcaaggggaggcccaggcccagggcaccactgacattcctct

SEQ ID NO: 59923 - DNA, 201 bp, Bos taurus; identical to SEQ ID NO: 19358

SEQ ID NO: 59924 - DNA, 201 bp, Bos taurus; identical to SEQ ID NO: 19359

SEQ ID NO: 59925 - DNA, 201 bp, Bos taurus
caaagcaatttatcttataattctacaattaaacagacccttctcttttaaaccagttaactacttagactcagctaatcacagacgaactaaagaaaaagcattttaattaagcaggttgctaactgattcccacgtctatatcagcaggtcacctttctggttcataaagaaaaagtagccctttcacttcactaatac

SEQ ID NO: 59926 - DNA, 201 bp, Bos taurus; identical to SEQ ID NO: 19360

SEQ ID NO: 59927 - DNA, 201 bp, Bos taurus
gtgtgtcagtggccctcaggcacaccgccagctttcagcgtttcagactccacaagaaggatcaagcttcctttcaccatagtttaagacaatcgtgagcgtaggccagtcaccctgagttggccatcaggagagacagctggccactggggaccaaaggtcactactgaagctgatcttcctctgcctcttctttgtgta

SEQ ID NO: 59928 - DNA, 201 bp, Bos taurus
actctaaaagtggctattttcagagttagcgaagggagaggccaatgccatggcattaagggagggagttgaggggtgcaaaagaccttagtgtgcttaccgaccccctctccaaggccaaacatactgtcttggcccaaggctggctctggtttgaactactttgcagcttgaagctccacgaagtgagaaatgggcctg

SEQ ID NO: 59929 - DNA, 201 bp, Bos taurus
ccagtgggttcctgtgtagatttcccgccccccccccccccacccccgtccctccaatggctaatgggcttgagggaaaagcgcaggccttccgagttccttccaacacctgccctacttagcatcctgcacattgccttctgggaaatgtagtttcttagttgcccgagcccttcaacatctggccaccattggaactac

SEQ ID NO: 59930 - DNA, 201 bp, Bos taurus
cactttaccaacaaaacttagtctttcaaagggaataaatgtgagattagttaaaaggcatatttataccttattgagatggatggatttggcaaaaacacgtgaaagtaggttttaaaaactgctttttagcttcacacttaccagaataatttgctatttttaaggattcattttcctcctaagattagggctggggag

SEQ ID NO: 59931 - DNA, 201 bp, Bos taurus
ctgttgagcagcagcatcttgccagtccactgtgcgatagatcatcaaagtagggagtaaatgcctttagctccaggatgcttttaccacttatttgattccctgggtcttattcactaaactgtagtatttctaagttattgctagatcatgcatcaacaaacattttctaaaaaggggcaaaaaagtatatattttgac

SEQ ID NO: 59932 - DNA, 201 bp, Bos taurus; identical to SEQ ID NO: 19361

SEQ ID NO: 59933 - DNA, 201 bp, Bos taurus; identical to SEQ ID NO: 19362

SEQ ID NO: 59934 - DNA, 201 bp, Bos taurus; identical to SEQ ID NO: 19364

SEQ ID NO: 59935 - DNA, 201 bp, Bos taurus; identical to SEQ ID NO: 19365

SEQ ID NO: 59936 - DNA, 201 bp, Bos taurus; identical to SEQ ID NO: 19366

SEQ ID NO: 59937 - DNA, 201 bp, Bos taurus
aggagcctggtggcctacagtccatttggtcacaaagagtcggacacgactgaagcgacttagcatacagcatgcacaatgcttagcataaaatccaaaatttctctattgctctatgaggccctaacataatctagttccttgcctgcctcgggacctttgatcttgctgttctttctacctgtcatggtttgcttgcac

SEQ ID NO: 59938 - DNA, 201 bp, Bos taurus; identical to SEQ ID NO: 19367

SEQ ID NO: 59939 - DNA, 201 bp, Bos taurus; identical to SEQ ID NO: 19368

SEQ ID NO: 59940 - DNA, 201 bp, Bos taurus
gagggggattctttccttataatttgtatcatgaatgcgcctcaaggatctagtgcatccttccacatgcgcctatggatcctggctttgtagaggccttaccttcagtacaaacagatgaaccctgctattgaactaattgttatgccagctgcattgtcctgtggaccctcccacccctttcacacctatgacactttt

SEQ ID NO: 59941 - DNA, 201 bp, Bos taurus; identical to SEQ ID NO: 19369

SEQ ID NO: 59942 - DNA, 201 bp, Bos taurus; identical to SEQ ID NO: 19370

SEQ ID NO: 59943 - DNA, 201 bp, Bos taurus
gaactctggaaagaggccccgctgaggaggacacgcctctcctagctctgctctctccgaggattccgttttctgcctgcaatttggtaaggcccatggcgtctatctctagggtggaatccagggggatccttgaatacacaagtgcagtgtcctcgaaatcatcagactgagatccaatataggagaaaaatgttgcca

SEQ ID NO: 59944 - DNA, 201 bp, Bos taurus
cttgttaaaatgcacactcctgtgctctaggccgagtgcttctgattcagtgtcactgcaacctgggatgctaagttaagtacctaggtggtttcaacactgggtccccgaaatggccacactggaaaactgaaactgactcagccttgaaaactcatagccaggaacatgggtccaactcttcttgtgtttattcctggc

SEQ ID NO: 59945 - DNA, 201 bp, Bos taurus; identical to SEQ ID NO: 19371

SEQ ID NO: 59946 - DNA, 201 bp, Bos taurus; identical to SEQ ID NO: 19372

SEQ ID NO: 59947 - DNA, 201 bp, Bos taurus; identical to SEQ ID NO: 19373

SEQ ID NO: 59948 - DNA, 201 bp, Bos taurus; identical to SEQ ID NO: 19374

SEQ ID NO: 59949 - DNA, 201 bp, Bos taurus
agattttttttttttttttcatgtggatcatttttaaagtctttattaaacttgctacaatatcgtttctgttgtttctattctgggttttgggccctgaagcacatgagatcttaactctccaaccagggatttaaccgccccctacttcccccaaatatgaaggcaaagtcttaaccactggactgccaagaaagttcc

SEQ ID NO: 59950 - DNA, 201 bp, Bos taurus; identical to SEQ ID NO: 19375

SEQ ID NO: 59951 - DNA, 201 bp, Bos taurus
attggttcatggcacttgtggaaaagaggctttgagttcaaggctctgttgggactgagaggccatgggaaggaggtggttgcccgtgggcctgatggctattggaaaaagcaagatcaagaacaatagtataagagacatcagaacatctcaagaacccctcaactatagggataatttgagggctgaggttgcagctgc

SEQ ID NO: 59952 - DNA, 201 bp, Bos taurus; identical to SEQ ID NO: 19376

SEQ ID NO: 59953 - DNA, 201 bp, Bos taurus; identical to SEQ ID NO: 19377

SEQ ID NO: 59954 - DNA, 201 bp, Bos taurus
gtagacatgagcacttgagtacctcgggaaaacaattctagacacaattaaaaataattcagctaaaattgttaataaattcctaaaggctgagtgtgtgtcagcaagaaaacacagaacccatgaaggccacaacccgttcacgggttcttcagagcctctccaggtttgcatcaaagaaaataaaaggccaggtgcaga

SEQ ID NO: 59955 - DNA, 201 bp, Bos taurus
ccaccctcgaccggctccttcctctcccctttcccctccccaccccgggtcactgccgggcgcctcccatttaggggagtgtcggaccccggaaacctccgggccggaaacctcgcggcccaagggcctctccttaaaccgaattttctttgacaggcaactgagtgaaataagtgtttatctatttaggtgtgaagaaaa

SEQ ID NO: 59956 - DNA, 201 bp, Bos taurus; identical to SEQ ID NO: 19378

SEQ ID NO: 59957 - DNA, 201 bp, Bos taurus; identical to SEQ ID NO: 19379

SEQ ID NO: 59958 - DNA, 201 bp, Bos taurus; identical to SEQ ID NO: 19380

SEQ ID NO: 59959 - DNA, 201 bp, Bos taurus; identical to SEQ ID NO: 19381

SEQ ID NO: 59960 - DNA, 201 bp, Bos taurus; identical to SEQ ID NO: 19382

SEQ ID NO: 59961 - DNA, 201 bp, Bos taurus
catttcctactccagggtatcttcccaacacagggatcagtcctgtgtctcttgtgtctcctgcacccagttacatatgacttattaataagaattcactgatttcatttgatcaacagtatattgtaggcaactgcagtgtttttttttgaattgtggaatgacatatgacataatattagtttcaagtgtactacataa

SEQ ID NO: 59962 - DNA, 201 bp, Bos taurus; identical to SEQ ID NO: 19383

SEQ ID NO: 59963 - DNA, 201 bp, Bos taurus; identical to SEQ ID NO: 19384

SEQ ID NO: 59964 - DNA, 201 bp, Bos taurus
caacactaatcaaagaaaatgaactgtaatcgtttcgaggaagctgaattgcatcaacatttgagtatccattattcctttcatcatttcagcattgtacactatcattatctattctttcagggttctgaaaaggctttagaatctgctgattgtcagtcactagctaccggatgccacaaagctctgcaattctactgg

SEQ ID NO: 59965 - DNA, 201 bp, Bos taurus; identical to SEQ ID NO: 19385

SEQ ID NO: 59966 - DNA, 201 bp, Bos taurus; identical to SEQ ID NO: 19386

SEQ ID NO: 59967 - DNA, 201 bp, Bos taurus
aggcctagtaacactgttcttaacaacttgatacactgaaataaaaacaaattgactctctaaaggtgtgtgtgcttaatcactcagtcatgtctgactgcgtgcgaccctttgggccaaagcctgccaggttcctctgtccacaggatttttcaggcaagagtactggagtggattaccattttcctcctccatgggatt

SEQ ID NO: 59968 - DNA, 201 bp, Bos taurus; identical to SEQ ID NO: 19387

SEQ ID NO: 59969 - DNA, 201 bp, Bos taurus; identical to SEQ ID NO: 19388

SEQ ID NO: 59970 - DNA, 201 bp, Bos taurus; identical to SEQ ID NO: 19389

SEQ ID NO: 59971 - DNA, 201 bp, Bos taurus
tgactaaggtcttgctgagttaagtgtttttagtgtctgttatcctcacattctctctcagagtagaacatacattgtcttgctgtggccggaagtaatatagagaagaaggctgggaccctgggttgagagacttgatttgactgccaccactaggtgcccagaggccctttccttttctcccaggagactgtgggactt

SEQ ID NO: 59972 - DNA, 201 bp, Bos taurus; identical to SEQ ID NO: 19390

SEQ ID NO: 59973 - DNA, 201 bp, Bos taurus; identical to SEQ ID NO: 19391

SEQ ID NO: 59974 - DNA, 201 bp, Bos taurus; identical to SEQ ID NO: 19392

SEQ ID NO: 59975 - DNA, 201 bp, Bos taurus
ataaatcaaatttaaaaattgtgatcaattaattttcttattaaaggagaccttgaaaaatatttctttgtaaccaccctacactgccattttaatatatctctcagcagtttacctaaaaataaaatcaaatatctggatcattggttttcaaagttatttattttgaccaattattttcataattatttcagaatcacc

SEQ ID NO: 59976 - DNA, 201 bp, Bos taurus
cctggggggccaggacaggggccacacgctgcacactaagtcttccctattttctctgacttctggcattctgggacatgtctcttcctggtcacaacagcttgttagaggagcggaggggccaggtcactgtttccacccccctcaacatttcctctttctagagcagatgactagagagaaaaagtgtctcaaatgagc

SEQ ID NO: 59977 - DNA, 201 bp, Bos taurus
tcatttaggttacctgtttacaaatctttatacaggatatagacaaaacataagtggggaagaagaaaagaagaagaaaattcaatatactgatttaacattggaaagggaaaaggaaggacagagaaggcaagaaaagaagtacattgcagacagaagttgtaaaccatcagcaactgcctcctttgctgcgtccagatt

SEQ ID NO: 59978 - DNA, 201 bp, Bos taurus; identical to SEQ ID NO: 19393

SEQ ID NO: 59979 - DNA, 201 bp, Bos taurus; identical to SEQ ID NO: 19394

SEQ ID NO: 59980 - DNA, 201 bp, Bos taurus; identical to SEQ ID NO: 19395

SEQ ID NO: 59981 - DNA, 201 bp, Bos taurus
ttatttgttgacctttttggatgaaaatttctaaaatccagaggaacaaagccagataatgatgacaaaggaataatttatcttttcctaggagacttcacgtaatggtggcaatattatcctcttattacacattgaaatttgtgcttacttctcagttttatattaatcacttctaacttttatttgtatgtagagcat

SEQ ID NO: 59982 - DNA, 201 bp, Bos taurus; identical to SEQ ID NO: 19396

SEQ ID NO: 59983 - DNA, 201 bp, Bos taurus; identical to SEQ ID NO: 19397

SEQ ID NO: 59984 - DNA, 201 bp, Bos taurus
ctttttattattttttcctaaattttgaagcatataaatgcatttagtcaataatttaagacatgtggtatgtttatattaaaagtttattggcccagctctctctattttcattctcttcattcacccatagtactgtcggcagtcttggttttcaaatccctttggccagtgacagtccttactttcctgtttgaagac

SEQ ID NO: 59985 - DNA, 201 bp, Bos taurus
agtgattaaaaataacacaggtataacataggtatgatcagataagagaatgggctaaactcagtggtgattcaaacaagaagtaaatttagtattctccagtaaatccctatgatcatgctgttaaattccctttctgcactaatgacttacaccttgaacagacatcatagacttctcttacctataaaggaccagtct

SEQ ID NO: 59986 - DNA, 201 bp, Bos taurus
ctaatttaaatctctaatatataggatggataaagaccttttcaaaagcctataatttcttagaaaataatataggaagctatgttgtgaacttggagtgataagtctcatagacacaaaaggcaaaaagaaaaatagtcacacatatgactatacctcccaataaaaataccatacaagtagcagatgagacagaatatt

SEQ ID NO: 59987 - DNA, 201 bp, Bos taurus; identical to SEQ ID NO: 19398

SEQ ID NO: 59988 - DNA, 201 bp, Bos taurus
tttcaattatctgcacatctcccccaaactcttggatttctcaatctttaggagacaactactatttatttgtatgaattttccccttcaaaataggaacgtggattagtttccctgagcaaactgtttattacttattcttttattttcttctaattggttcctatatccatttgatagatgtctaccaccttccatttt

SEQ ID NO: 59989 - DNA, 201 bp, Bos taurus
caaacttcagtggttggaaatatctttttaatttaaatttcataagaaacagagctacaatgcacattccctgaccagattgtgtgtggcctatttattcgaaatgtttgattccatatggatttctgctctttatttataacttcaagaaaggattctaataagttagcaactcaaggacaactgacttgaaatccaggc

SEQ ID NO: 59990 - DNA, 201 bp, Bos taurus
tttgcacctacagtggaaaaaatgacattccaatagcatgaatgtgtatgtttgaaataatataaactaaaatccacatgtaacattcaattgcgggcatgtagcacccgcgtaccgatggagggaattactgtcagggtgtgtttcttattcctctaaagatccagggagtcgactcaactggcctggaggagaggggtc

SEQ ID NO: 59991 - DNA, 201 bp, Bos taurus; identical to SEQ ID NO: 19399

SEQ ID NO: 59992 - DNA, 201 bp, Bos taurus; identical to SEQ ID NO: 19400

SEQ ID NO: 59993 - DNA, 201 bp, Bos taurus
cagtgcttttaggtggaaagttttgagatcaatattatttcaatggacccacaggtctgtgctcaggtacgtgtttagtactattctctttctgttcacataatgaaaaggtttgtgggtccaagaaaatagaaaaattaatatagcgatgtagtggttaattacagtatagaaagttaatattgcaaagcctgaataagt

SEQ ID NO: 59994 - DNA, 201 bp, Bos taurus
agccactaggctggacgttcctgcaactctgctcaatcctctttataagtctcattagagactaaagatctgtccaaaatggtacagggggttacacccactgttctgccacccttcctcaaaaacacacatggtgaaggttctgatgatgatcagtgtggcctccaaaactgggcctacattattggctattaaaattgt

SEQ ID NO: 59995 - DNA, 201 bp, Bos taurus; identical to SEQ ID NO: 19401

SEQ ID NO: 59996 - DNA, 201 bp, Bos taurus
tcctaacagcattcactattataatcatgtaacaacaaataagggactatagggctatgcaaaacagaatcatttgttatatcaaagtaaaaattttctcatgaaacatcaaaatcattttcaactgccaggtttagagagttatttagacacaggctcttactaaagattctgcaatcaactctgaatacttgccatgta

SEQ ID NO: 59997 - DNA, 201 bp, Bos taurus
tagtggtcaagggcttttaaaatcagtttaagttaacctctgctttcagaaaatttgtaatgaaaaataatttacagatggctggattgtctcctaaaagagataaaaattgagacaaaatacatttggcattcagagatattaacttcgattatctttcaccctcatcactgaagagacatttggtttgactgatacaga

SEQ ID NO: 59998 - DNA, 201 bp, Bos taurus; identical to SEQ ID NO: 19403

SEQ ID NO: 59999 - DNA, 201 bp, Bos taurus
atataattgagtcattatttgtagtacttatatcaacattaaaattccccaacaacctatgaaaggtatgaacaatttttagagctacactttttttttcgccttaagagttatcttttttaaaaatgtgctttggaatttactattgtgtagttttgtcttttatattctccattacctcatgtaaaatgcagaagaatg

SEQ ID NO: 60000 - DNA, 201 bp, Bos taurus
caagacagaagccttgatcagatttcttcctcccaacgctcagaaaaaacagatcctgctgacaactggatttcagaagtctagcctcccaaacttgagacgataagtactgttgtttaagtcactcagtttgcagtactctgttacagcagccctagcaaactaatacagtctcttaggccaaaaggtgataatgaaatc

SEQ ID NO: 60001 - DNA, 201 bp, Bos taurus; identical to SEQ ID NO: 19404

SEQ ID NO: 60002 - DNA, 201 bp, Bos taurus; identical to SEQ ID NO: 19405

SEQ ID NO: 60003 - DNA, 201 bp, Bos taurus
cagagaaaattactccatatgtagttgtagattcactgtgtatgtgggaagaggagagttcaacatcttcctatgctaccatcttgaacccctttctcttgtggtgtgattttaaccagacagtatagaacttagcaggaaatcatacagagggttttctgttataagaatattcttctaatattttatgatcctttatgt

SEQ ID NO: 60004 - DNA, 201 bp, Bos taurus; identical to SEQ ID NO: 19406

SEQ ID NO: 60005 - DNA, 201 bp, Bos taurus; identical to SEQ ID NO: 19407

SEQ ID NO: 60006 - DNA, 201 bp, Bos taurus; identical to SEQ ID NO: 19408

SEQ ID NO: 60007 - DNA, 201 bp, Bos taurus; identical to SEQ ID NO: 19409

SEQ ID NO: 60008 - DNA, 201 bp, Bos taurus; identical to SEQ ID NO: 19410

SEQ ID NO: 60009 - DNA, 201 bp, Bos taurus; identical to SEQ ID NO: 19411

SEQ ID NO: 60010 - DNA, 201 bp, Bos taurus
ggtgctaaaatgtcaaactgttcccaagtgtgggccacgactgaggaggctagatagagaaaacacccttcagataaaggatctgctgagcttgtttattactcagccactggcttcatcgcttggatgcttgaatgagcatttattaagtaatctttggttgatagtgagctacttatatttggggagggagcaaagtaa

SEQ ID NO: 60011 - DNA, 201 bp, Bos taurus
gccctgtcttcctctgactttttttctcctctgcttttctgcaatggtttccacttcttgtcttgaagtggatattcctgtctcctgtactggggccttgatggactgacattaactccttgtctgttgtctatggatgtttctatattggaatggttggaaacaggcagctaataagagtgactagctctggccccaacc

SEQ ID NO: 60012 - DNA, 201 bp, Bos taurus; identical to SEQ ID NO: 19412

SEQ ID NO: 60013 - DNA, 201 bp, Bos taurus; identical to SEQ ID NO: 19413

SEQ ID NO: 60014 - DNA, 201 bp, Bos taurus; identical to SEQ ID NO: 19414

SEQ ID NO: 60015 - DNA, 201 bp, Bos taurus; identical to SEQ ID NO: 19415

SEQ ID NO: 60016 - DNA, 201 bp, Bos taurus
ctctccatggaaggatctaggtgtgaaagggttaagaccgatctctgtgacctttatagaaaggatgcataaaatgtatttttagggattgtgcttacttcgctttcttccaaattgagaatttgcccacttaacttcgttatacagtttttaaaatactctgtaacatgtgttcactaacatttggagggaacacggttg

SEQ ID NO: 60017 - DNA, 201 bp, Bos taurus
acccacaataaaagtcttggccaagaattcacacttattttgcagaattattctagagacaaatttgagtgttatagaattattttttaaaagtatcccagctagtcctagtttcagttcaatctcctgcagcacaggttgtagctatgagtaactgtcctaggcagtacctatgtgacaatacctatttcatgcaaagcg

SEQ ID NO: 60018 - DNA, 201 bp, Bos taurus
ctcatgacctgtaatatgaaaaatgctgttttactgcaagagggaggattgaaaaggtgaagctgctcaaactgagctattagctaagggcatggaacacgttagcccttgattctgaaattttaaaggtgggcttgtcataagaacttcaagcagtaaatgtaacacacaaaggataaggaggcccatgatctgagaaag

SEQ ID NO: 60019 - DNA, 201 bp, Bos taurus
aaacatgcagattgtgttaaaacataagagaaagtgatagcttacagtgaaccatgtcagatttgtcatctccaaagacttagcttcgggaccagagaccgggcttgatcacttaaaggtttctgtgtagcagcattttattaaagtataaaaagggacaagagggctggagggctgcagtctgtggggtcccaaacagtg

SEQ ID NO: 60020 - DNA, 201 bp, Bos taurus; identical to SEQ ID NO: 19416

SEQ ID NO: 60021 - DNA, 201 bp, Bos taurus
gccgtaccagtgtcctacaatgaatattttggttgaggtttagtcctgttgaaggctgctgttgtttcatgtctgatctaaggcttcttggcgataacttgtgtaatgaaatgttttcattaagagtgtgttcacagatctccctttctctgcttccttcagagatctgtctatagctgctatctgttactaccagatttc

SEQ ID NO: 60022 - DNA, 201 bp, Bos taurus; identical to SEQ ID NO: 19417

SEQ ID NO: 60023 - DNA, 201 bp, Bos taurus; identical to SEQ ID NO: 19418

SEQ ID NO: 60024 - DNA, 201 bp, Bos taurus
tagacatgacttagccactaaacagcaaaacaaactagttggaaattttcactctttgccttcagctccttcccctgatgcttccctatgccacacaagcatcccagtcagaattcccactcaaggaaaagacttaggaaaaagtccttttcaaacaacagtgaatgaaacctatattagcaactccactttctgacccaa

SEQ ID NO: 60025 - DNA, 201 bp, Bos taurus
gtcagctgtgtctaggcaggtaatttacctggttctcatgctgcagttatgaggaacctcttggaatgagcttgtatagcagatgccctgaagcctcccacattctggcagtgagattaggagtcactttccttggcattgcccttcacaatctcatttttgattagactatacctgctctccatggtatttgctctgacc

SEQ ID NO: 60026 - DNA, 201 bp, Bos taurus
aagaaaaatgtaggtgacatatcctcccttttttgctacagtagacataccaaatattttctctactatcatcagcgagtgtaaaaaagtatttagcccacgtaaaaagtaaattcttaagcagcagtttcagagagggcttaaacacagaagacttttcctgtgtgtgtgtgtgtgtgggcgtgggtgtgtgtgcgtggg

SEQ ID NO: 60027 - DNA, 201 bp, Bos taurus
ttttaattctcatagaaacacatatgtatgtaactggatatgtatttctttaatccagaactttggttttctgtaactccatattttcaatctgagatgcatcataaactttatattatcacaaatctaactcatttgtaatctatacacagcatttgtcagtttaaatgcattgtaatttctaagccatttatttattgt

SEQ ID NO: 60028 - DNA, 201 bp, Bos taurus
tggtggcttattagttctgtgttccttaccaggacctcctgtggtaaaacaactcatgcaaatgattactatggtgcctggccagggtgggcagtttgtcggtgtgcttcccctaacagtcccatggaaatcttattttgctgataccagtgtagagaaaggagttgttgttcccagtttctgcagggtgcgaataggcca

SEQ ID NO: 60029 - DNA, 201 bp, Bos taurus; identical to SEQ ID NO: 19419

SEQ ID NO: 60030 - DNA, 201 bp, Bos taurus
ttctatcaaacatcaacaaaaatcaaccataggtttacccatgcccctgccctcttgaacatcactccccatcccaccaacaacactaggttattcccgaaccctagtttgagttctctgagtcatacagcaaattcccaatggctatctattttacatatgataatatatgtttccatgttactctgtccatacatccca

SEQ ID NO: 60031 - DNA, 201 bp, Bos taurus
tctcaccatctggcaggaaagacagagtttaccatggccgagagtggctgcatctaccatggcagcagggctggcagtagctattgaaaccttcttgtcccgaatcctctcctaccaatggccctctaggttgtctcagtgctgtctgcccaatggtctaagcatggtttaaaacaatgtcaacaacagtaaagactttta

SEQ ID NO: 60032 - DNA, 201 bp, Bos taurus
ccactgtctttgatattctgcatagctcataccacatttatatcacactcatactacatgccaaatgtaaggctctattccacacagtcattcagggatcctggctggggaagtttctattatattgaaagtatttcatttacagtcttgctgcgcaatgtatgatctgcaaaccagcatcactggtatcattaggaattt

SEQ ID NO: 60033 - DNA, 201 bp, Bos taurus
atatatgaaactacagccgaccatggaaaacatcactcacccttagacggacactgctataagcactctgaggcctgagattaggaagagaggggaggcctaagcccctcgccatcccagttcagcaggaagtagccagaatgacctcgacacccctattcccaaagaattgggcctcatatctcttgagaagggaatgtc

SEQ ID NO: 60034 - DNA, 201 bp, Bos taurus; identical to SEQ ID NO: 19420

SEQ ID NO: 60035 - DNA, 201 bp, Bos taurus
ctgaagtaaaaatgggttttgtttttaatttagaaaatataaattcagtacaattaaaggttttttccatcaatttcattgtacttttaatctctaagattaatctctaaattttgtgttagagtcagataaaacaaactactaactctgtccattcctcttttcttagatatgtggtaacacactgtacatactattttc

SEQ ID NO: 60036 - DNA, 201 bp, Bos taurus
gttcctattatcagagaatcttgaaaatacagtttgcaatgctcaactctggagtcaaagagcaaagtatataaagttgcctttcagtatataatcagtctgccataaaattttttatttttttcagataattctgtttcccagtcatatagataaagaggctatatttaaaaactctgtatctctgatcatttataataa

SEQ ID NO: 60037 - DNA, 201 bp, Bos taurus; identical to SEQ ID NO: 19421

SEQ ID NO: 60038 - DNA, 201 bp, Bos taurus; identical to SEQ ID NO: 19422

SEQ ID NO: 60039 - DNA, 201 bp, Bos taurus
atttctaggctagctatgctattgtacaattttttactgtgaaattttcacataaagtatttctggatgaataattcttatatgtcaaattagcattatcactcattttctggaaaagtaaggtataagggagtcaattgataaataataaataagaaagggaactttggatcactttggtttgttttgtaatccttacaa

SEQ ID NO: 60040 - DNA, 201 bp, Bos taurus; identical to SEQ ID NO: 19423

SEQ ID NO: 60041 - DNA, 201 bp, Bos taurus; identical to SEQ ID NO: 19424

SEQ ID NO: 60042 - DNA, 201 bp, Bos taurus; identical to SEQ ID NO: 19425

SEQ ID NO: 60043 - DNA, 201 bp, Bos taurus
tactgaagatatgaaaagagtcatttttcagaatactattacagatttgcttcttagcttgagccaagttataaagggaccaggtaagcaatgggagaaggaagggtatataagcaggaagggagaggaaaactctcggaagatgttctgcagctttctaagatagacaaagaatttagggggattctagatgacagaaca

SEQ ID NO: 60044 - DNA, 201 bp, Bos taurus
tcttgagctcaagcactggaagacatccatataaattctgcaagatgatagctatgatgtcacccaaaagtgttccttctcatgtctccccacttcatctggctcatcggaagctttgaggcctcagtagtcttgtgatgctgttttgaggagggtgaaaaattcttttctggttggaataaagaagcatccgggttgggg

SEQ ID NO: 60045 - DNA, 201 bp, Bos taurus
cctgcctttcccatggttcccaattaaaaaaaaaaaaaagcagtgtgtgaataatatggggtagtataagaacacgtctttagattctgaccagtcttgagtcttcttttttgaagttatatgatttggtggaagtttttctataaaattcatgtaatcatacttatagtttaccaggtatctacaaggtactgaactgta

SEQ ID NO: 60046 - DNA, 201 bp, Bos taurus
aaatgcccaggtgacaaagctgtcagtagtgatgccgaggtttggatcagtcccatctgataccagtgttagggtggctcacatcacagcaggttgtgttcgagatgccagacaccacactgtctctttgaaaccagcagcaagctcagttactcttccttttctggtgtttccatcccattttattcagtagctctcctc

SEQ ID NO: 60047 - DNA, 201 bp, Bos taurus
aggacgttgtctgtggcccagctgcttatcccagtgatcttgtccagttctgcttgtactcatccctctaaagctctctcactcccgtctctccttgtgcggaactcctggcctatcacgctcacgcctccttgtgttttccagctttggagacatgctgtccttcaccctgacggcctttgtggagctgatggaccatgg

SEQ ID NO: 60048 - DNA, 201 bp, Bos taurus; identical to SEQ ID NO: 19426

SEQ ID NO: 60049 - DNA, 201 bp, Bos taurus
aaataacaaagagaaatggaaatctcttaagacttttctgacttcttgagaagagtctcaggattctgtctagtactgctctgttcaatctaatgctgtagatacaataagataaacagagaagtgtgggagagatggggagggagatgaaatgtcttcttgcatttcataacagattagtgaaacaccagctaccagagc

SEQ ID NO: 60050 - DNA, 201 bp, Bos taurus
aattcccattcctagtaagtggtcaagagggagttcacccaaatctttaaaacttgcgtttatgcagtatactttcctgcttctagtttggacaagtttagtttatagacattccggctctttgcttcttatcattttctctatttattcactggccacagaagccatttttctcatattcattttaatgttcagtgttta

SEQ ID NO: 60051 - DNA, 201 bp, Bos taurus
tctgtgtttttgccttttattaccaatatttcagagcatacattattcattgtcatgggtattagagaagagctaaagcacagctggatcccccgaaatgtaagtggccccatagtcatttcattgaagcctttacttttgagttgggggttaagaaggaggatgcaagtgacttggatatttcaggtatgggaatctcat

SEQ ID NO: 60052 - DNA, 201 bp, Bos taurus
gaaaaaagcatgcagaaacattcttgagaataatcactcagtaaatcatgttggcctttcctgtgcctgggaagacagttttttcgaattgtgcaaaatatttctgaccttcagtttcacccactgcttttgcctctggctctcattagtaaacaccttggaagaatctcagaattgttaatggaaaaatgattaatagaa

SEQ ID NO: 60053 - DNA, 201 bp, Bos taurus
ccatataggccaagtaaaatgtcagagagaaaatcattctgttgagtggcgagtaggaataagcaaagttgggctggtactcaattttatctttactttttaaatttttatttaggcccttaattttatttttagaatggggttttgttaagtaaactcagcacagtcatatctaaacatgtctgtatttattttcacaaa

SEQ ID NO: 60054 - DNA, 201 bp, Bos taurus
ataatcccccttttccttttcctttgggttcttgcttgcaggtggttttacagctgttggcagatcacttctggaagaagatgcagcaccagtggccccatgtcctgggaaaggagaatccattcaatccgcagattgagcaggtgtttggagaccaaggggggcactgaggccccaaggacatgtgcttctggggaggca

SEQ ID NO: 60055 - DNA, 201 bp, Bos taurus
atttcaaatcattttattttgatagtgattttcaaaacttgcatgtgtgcaaagattgtgtgcacactttccaggaaggagacgctcccacaggtaaagaatggaggtagtgagtaatacttagatattgttggtagccagtgtgttggatacctgagatttggaggatatggccatgggtgttattttaacttttaaccc

SEQ ID NO: 60056 - DNA, 201 bp, Bos taurus
catacccacccttgacaactgccttctggaggtaactacagctactagctttcagcgatatttgatgtctttcttgtatttatacacatacatagagcatgttaatagagaaggtaattttcaggctctcgtgatgagtaagaagaggctccatcattcaaaagcacatattttggaagtacattaaatttgtataattta

SEQ ID NO: 60057 - DNA, 201 bp, Bos taurus
ccttgatcattgacagcaaaagaagcatttcacatttatctcctgcaatactgaaggacattttcacaactggaaccagtagttacaatgtcttactacaaagcaaagaggagaaaaagcatcattcacaaaaacagccttcctccaccggctccaaaagatgtagaaaacccagcaaatctcctagctcttcgcgtagta

SEQ ID NO: 60058 - DNA, 201 bp, Bos taurus
ctggatgtggacacccaaaagagcacctagagatgtgaagcaaacctttaaaagggtagaaaggtacaagacgctggatttaacttcaagggcctgttttggcgcctgcccctgcgtgttggtcctgcaacacaggagcctctttgtttctgttgtacaatggcacagatggggccccaggctggggtttcaagagttcta

SEQ ID NO: 60059 - DNA, 201 bp, Bos taurus
ttgcaaagagcacaggtctaaagtcagaaggttctgggtcctagtcccagctgacatactaatgagctgtgggatacaggcaagtcacttaacttcttcggttttagtttccttactcaaaggtggagactcaataataaaagcatgcattacctacttcccagagttactgagaaagctgtgaaaatacaaaggcacatt

SEQ ID NO: 60060 - DNA, 201 bp, Bos taurus
ttgaagatacacttcatgaggctgcctaataaatcacagttttaacttcctctttgatccagaagttctaggcgaggtgtgcatataagtaagtacatgcatgctcagtcatgtccaactctttgtgaccccatggactatagcctgccaggctcctctgtctatgggatttcccaggcaagaacactggaacaagctgcc

SEQ ID NO: 60061 - DNA, 201 bp, Bos taurus
ggatactctggagaatataaatctgtgaggaataatgagttgattaatgttgactttcccagtccagattcacctaaaagaaacaaagggggaaatctctcaaaactcagtcaacttatcaagcttaaatattcaaccagtgttataatcaaacttgctttcatccaattacttcttggaggacaagcaagtgacattaca

SEQ ID NO: 60062 - DNA, 201 bp, Bos taurus; identical to SEQ ID NO: 19427

SEQ ID NO: 60063 - DNA, 201 bp, Bos taurus
cataactgtttaacactgaactctgggttcacaggggcaaaaatgttgtgaaacattctgagcctttaatattctctttgaacatataagaggcacttttggaagagaatgacgagtaataatttacattcaccatttcccaaagggataacacagatccagcttcctcaacttcattgtctactcctcaggaatttcaaa

SEQ ID NO: 60064 - DNA, 201 bp, Bos taurus; identical to SEQ ID NO: 19428

SEQ ID NO: 60065 - DNA, 201 bp, Bos taurus
tagtttattggtacaacggaaactgaaacagagccctgtagatcttaggctggtttctttccactacactaagcatgaactgtggcatttgggttggcaccacactccatgggcctactttccaaggacaaccgccacagtattccatctcactgctcttctccaatgtgaccttggttaattaccctcctcttgcatctg

SEQ ID NO: 60066 - DNA, 201 bp, Bos taurus; identical to SEQ ID NO: 19429

SEQ ID NO: 60067 - DNA, 201 bp, Bos taurus
cacattttgcattctcagatattcagaaacttctgaaaagatttaatttgggttcatgtatttatgtttcgatctctaactatatttttgccaagttggaagtagatttagatctttatagatactatgctttggaagtttgttatgtatctggaaagaaatcagatttggttgagaagtatttagttggttcatcaaaaa

SEQ ID NO: 60068 - DNA, 201 bp, Bos taurus; identical to SEQ ID NO: 19430

SEQ ID NO: 60069 - DNA, 201 bp, Bos taurus; identical to SEQ ID NO: 19431

SEQ ID NO: 60070 - DNA, 201 bp, Bos taurus; identical to SEQ ID NO: 19432

SEQ ID NO: 60071 - DNA, 201 bp, Bos taurus; identical to SEQ ID NO: 19433

SEQ ID NO: 60072 - DNA, 201 bp, Bos taurus; identical to SEQ ID NO: 19434

SEQ ID NO: 60073 - DNA, 201 bp, Bos taurus; identical to SEQ ID NO: 19435

SEQ ID NO: 60074 - DNA, 201 bp, Bos taurus
caaaataagaactacaattttaaaaacattgccaaggtgcctcattagcacagtaggtagggtgacaattacataaaaatattgctaagtaaccaaagtggatatcaacagaaaaaatatgaatatggcatctctaaggctttttaaactaagacaactgtacagaaatgcttaaaagcacaaatgcaacattgctgaatg

SEQ ID NO: 60075 - DNA, 201 bp, Bos taurus; identical to SEQ ID NO: 19436

SEQ ID NO: 60076 - DNA, 201 bp, Bos taurus; identical to SEQ ID NO: 19437

SEQ ID NO: 60077 - DNA, 201 bp, Bos taurus; identical to SEQ ID NO: 19440

SEQ ID NO: 60078 - DNA, 201 bp, Bos taurus; identical to SEQ ID NO: 19441

SEQ ID NO: 60079 - DNA, 201 bp, Bos taurus; identical to SEQ ID NO: 19442

SEQ ID NO: 60080 - DNA, 201 bp, Bos taurus; identical to SEQ ID NO: 19443

SEQ ID NO: 60081 - DNA, 201 bp, Bos taurus; identical to SEQ ID NO: 19445

SEQ ID NO: 60082 - DNA, 201 bp, Bos taurus; identical to SEQ ID NO: 19448

SEQ ID NO: 60083 - DNA, 201 bp, Bos taurus; identical to SEQ ID NO: 19449

SEQ ID NO: 60084 - DNA, 201 bp, Bos taurus; identical to SEQ ID NO: 19451

SEQ ID NO: 60085 - DNA, 201 bp, Bos taurus; identical to SEQ ID NO: 19452

SEQ ID NO: 60086 - DNA, 201 bp, Bos taurus; identical to SEQ ID NO: 19453

SEQ ID NO: 60087 - DNA, 201 bp, Bos taurus; identical to SEQ ID NO: 19456

SEQ ID NO: 60088 - DNA, 201 bp, Bos taurus; identical to SEQ ID NO: 19459

SEQ ID NO: 60089 - DNA, 201 bp, Bos taurus; identical to SEQ ID NO: 19464

SEQ ID NO: 60090 - DNA, 201 bp, Bos taurus; identical to SEQ ID NO: 19467

SEQ ID NO: 60091 - DNA, 201 bp, Bos taurus; identical to SEQ ID NO: 19476

SEQ ID NO: 60092 - DNA, 201 bp, Bos taurus; identical to SEQ ID NO: 19477

SEQ ID NO: 60093 - DNA, 201 bp, Bos taurus; identical to SEQ ID NO: 19479

SEQ ID NO: 60094 - DNA, 201 bp, Bos taurus; identical to SEQ ID NO: 19480

SEQ ID NO: 60095 - DNA, 201 bp, Bos taurus; identical to SEQ ID NO: 19482

SEQ ID NO: 60096 - DNA, 201 bp, Bos taurus; identical to SEQ ID NO: 19485

SEQ ID NO: 60097 - DNA, 201 bp, Bos taurus; identical to SEQ ID NO: 19486

SEQ ID NO: 60098 - DNA, 201 bp, Bos taurus; identical to SEQ ID NO: 19487

SEQ ID NO: 60099 - DNA, 201 bp, Bos taurus; identical to SEQ ID NO: 19490

SEQ ID NO: 60100 - DNA, 201 bp, Bos taurus; identical to SEQ ID NO: 19491

SEQ ID NO: 60101 - DNA, 201 bp, Bos taurus; identical to SEQ ID NO: 19494

SEQ ID NO: 60102 - DNA, 201 bp, Bos taurus; identical to SEQ ID NO: 19495

SEQ ID NO: 60103 - DNA, 201 bp, Bos taurus; identical to SEQ ID NO: 19498

SEQ ID NO: 60104 - DNA, 201 bp, Bos taurus; identical to SEQ ID NO: 19499

SEQ ID NO: 60105 - DNA, 201 bp, Bos taurus; identical to SEQ ID NO: 19500

SEQ ID NO: 60106 - DNA, 201 bp, Bos taurus; identical to SEQ ID NO: 19502

SEQ ID NO: 60107 - DNA, 201 bp, Bos taurus; identical to SEQ ID NO: 19503

SEQ ID NO: 60108 - DNA, 201 bp, Bos taurus; identical to SEQ ID NO: 19504

SEQ ID NO: 60109 - DNA, 201 bp, Bos taurus; identical to SEQ ID NO: 19509

SEQ ID NO: 60110 - DNA, 201 bp, Bos taurus; identical to SEQ ID NO: 19511

SEQ ID NO: 60111 - DNA, 201 bp, Bos taurus; identical to SEQ ID NO: 19514

SEQ ID NO: 60112 - DNA, 201 bp, Bos taurus; identical to SEQ ID NO: 19515

SEQ ID NO: 60113 - DNA, 201 bp, Bos taurus; identical to SEQ ID NO: 19517

SEQ ID NO: 60114 - DNA, 201 bp, Bos taurus; identical to SEQ ID NO: 19518

SEQ ID NO: 60115 - DNA, 201 bp, Bos taurus; identical to SEQ ID NO: 19519

SEQ ID NO: 60116 - DNA, 201 bp, Bos taurus; identical to SEQ ID NO: 19521

SEQ ID NO: 60117 - DNA, 201 bp, Bos taurus; identical to SEQ ID NO: 19523

SEQ ID NO: 60118 - DNA, 201 bp, Bos taurus; identical to SEQ ID NO: 19524

SEQ ID NO: 60119 - DNA, 201 bp, Bos taurus; identical to SEQ ID NO: 19525

SEQ ID NO: 60120 - DNA, 201 bp, Bos taurus; identical to SEQ ID NO: 19526

SEQ ID NO: 60121 - DNA, 201 bp, Bos taurus; identical to SEQ ID NO: 19527

SEQ ID NO: 60122 - DNA, 201 bp, Bos taurus; identical to SEQ ID NO: 19528

SEQ ID NO: 60123 - DNA, 201 bp, Bos taurus; identical to SEQ ID NO: 19529

SEQ ID NO: 60124 - DNA, 201 bp, Bos taurus; identical to SEQ ID NO: 19531

SEQ ID NO: 60125 - DNA, 201 bp, Bos taurus
tatagtaatctttgatggcaatcactgtactgttcagtaacgttctggatctggcaattttcgtcagtggcatttttaggcctctgtcatatcccatgtgtgtgatacccctgtttttacagtaagagccagcagtgcttctagatggcaaccaactttcccatcacattttcactctcaagtaaagtgtgtgtgcatgtg

SEQ ID NO: 60126 - DNA, 201 bp, Bos taurus; identical to SEQ ID NO: 19535

SEQ ID NO: 60127 - DNA, 201 bp, Bos taurus
aaaaatctttcttctaaggtagaatgatgacagctgaagctgtgatgaacacgaggggttctttcaatttttatgtatatttgaaaatttgcataacacacaggtgaacaaattagaagaatacaatagtaaaatatcctttgaatatatcatattttgttttatttttttaaatatccagtttatgctgaagatttctaa

SEQ ID NO: 60128 - DNA, 201 bp, Bos taurus; identical to SEQ ID NO: 19538

SEQ ID NO: 60129 - DNA, 201 bp, Bos taurus; identical to SEQ ID NO: 19539

SEQ ID NO: 60130 - DNA, 201 bp, Bos taurus; identical to SEQ ID NO: 19540

SEQ ID NO: 60131 - DNA, 201 bp, Bos taurus
aacaaaaaatattaaagaattcaggaaaaaaaatattaaattgagttaaaaagaataatttaaaaaagaaaaagaaaaaattggagaatatcattatatatcccaagaaatgaattagaattaactagaaataatgaagcattttggtgacattgccaattatgagccatatataacataaggagttaccattggggaaac

SEQ ID NO: 60132 - DNA, 201 bp, Bos taurus
agcaagatgtaagaggacaagaaagaaaatacaagttaagggattatggcttaaaaatcccatctctcagtgaagtcttccctaactcattcagaagaggtcatttcccctctatctctgtccattagtagcatggaaggttgtggaaggaaagaacttgtccaatttgttcagtgctctctccctaggagctggaacatt

SEQ ID NO: 60133 - DNA, 201 bp, Bos taurus
tactactagactacatcctcttttaaggagcaaacaccaaatgtaattcatttcagtgtccttccatagcccttagcaaaacacacaggtagtggccttttattaaataaacaagcacaccatacctttataggcatttttcatttgacttgctctttatattaaccaaggcacagagaaagcagatggaagatgaagagg

SEQ ID NO: 60134 - DNA, 201 bp, Bos taurus; identical to SEQ ID NO: 19541

SEQ ID NO: 60135 - DNA, 201 bp, Bos taurus; identical to SEQ ID NO: 19542

SEQ ID NO: 60136 - DNA, 201 bp, Bos taurus; identical to SEQ ID NO: 19543

SEQ ID NO: 60137 - DNA, 201 bp, Bos taurus; identical to SEQ ID NO: 19544

SEQ ID NO: 60138 - DNA, 201 bp, Bos taurus
tgagaaagctaaaaacgcaagatatatttccccttaatttcaaaacatgaatagatgtcatgtaacttctgtgacattctctcttataacttagattttcattaattcatcaagaagaagagagaaagtttacttaacagagttaatttttttgcttcaaatttattcatacatgtagacaccccatatgtacttttaaaa

SEQ ID NO: 60139 - DNA, 201 bp, Bos taurus; identical to SEQ ID NO: 19546

SEQ ID NO: 60140 - DNA, 201 bp, Bos taurus; identical to SEQ ID NO: 19547

SEQ ID NO: 60141 - DNA, 201 bp, Bos taurus; identical to SEQ ID NO: 19548

SEQ ID NO: 60142 - DNA, 201 bp, Bos taurus; identical to SEQ ID NO: 19549

SEQ ID NO: 60143 - DNA, 201 bp, Bos taurus; identical to SEQ ID NO: 19550

SEQ ID NO: 60144 - DNA, 201 bp, Bos taurus; identical to SEQ ID NO: 19551

SEQ ID NO: 60145 - DNA, 201 bp, Bos taurus; identical to SEQ ID NO: 19552

SEQ ID NO: 60146 - DNA, 201 bp, Bos taurus; identical to SEQ ID NO: 19553

SEQ ID NO: 60147 - DNA, 201 bp, Bos taurus
ttttataggtatgtgtctgtaatttctatgtatatatataaataattataactaaaaaatttggttgcttgattcaaggcctatatctatgtgtgtgtgtatatatgtgtgtgtgttcatatgggaaacaactggcaaataaaattataaatcaatttcatttatcagttcagtcacttagttgtgtccaactctttgcgg

SEQ ID NO: 60148 - DNA, 201 bp, Bos taurus; identical to SEQ ID NO: 19555

SEQ ID NO: 60149 - DNA, 201 bp, Bos taurus; identical to SEQ ID NO: 19556

SEQ ID NO: 60150 - DNA, 201 bp, Bos taurus; identical to SEQ ID NO: 19557

SEQ ID NO: 60151 - DNA, 201 bp, Bos taurus
acattgaaataggtgttttgttttgtctctggactaaaatagcctcagctcaataatctcattttgtagtttgctctatttttgtttataaagagtgtgagtctaaaatcaccatctgtataatttggacctaatacttacctgaaatatatgtaataaatattcagtcatcaaatttatgatgcaggttgcccctcattt

SEQ ID NO: 60152 - DNA, 201 bp, Bos taurus; identical to SEQ ID NO: 19558

SEQ ID NO: 60153 - DNA, 201 bp, Bos taurus; identical to SEQ ID NO: 19561

SEQ ID NO: 60154 - DNA, 201 bp, Bos taurus
aatgcaagggcccaagtcttcttgttggcaaaggtgaatgaagaaaaactgagactgtgagaaactgtgtgcctggtatgagcctggaaggctgtatggacaagcagggccagtgaagcaagatcttgtggagtgggagtgggtgtgtctggctggggctgagtggagttcagtggctacgtttgcagtttgaaggcgaaa

SEQ ID NO: 60155 - DNA, 201 bp, Bos taurus
ataattttaaaaaaatctggacttccctggcagtgcagttgataagaatctgcctgccaatgcaggggacatgggttcgattcctggtctgggaagattttacttactgcgtagctactgaagcccgagcacctagagcctatgttctgcaacaaaagaagtcattgcaatgaaaagtctgagcactacaacaaagagaac

SEQ ID NO: 60156 - DNA, 201 bp, Bos taurus
aggaaatactaatagaccttgaatttcattaaaagagttttgattgtgggcattgaactgggtgggcttcctggtggcttgcatggtaaagaacatacctacaatgcaggtgatctggatttaatccctggatcaggaagatcccctggagaagggaatggcaacccactctggtattcttgcctggaggattccgtgggc

SEQ ID NO: 60157 - DNA, 201 bp, Bos taurus; identical to SEQ ID NO: 19562

SEQ ID NO: 60158 - DNA, 201 bp, Bos taurus; identical to SEQ ID NO: 19564

SEQ ID NO: 60159 - DNA, 201 bp, Bos taurus; identical to SEQ ID NO: 19565

SEQ ID NO: 60160 - DNA, 201 bp, Bos taurus
atttcaagaccactctaaactcctcagggcaaaggagttcagaaagaaatggtctttgaaattacagatagcatgctcaaaaagcaaaaccaattattggaagtagcaaatgtatacctcgtgttttaatattttcattgcaaagcagtattaaaggaaatcaactcaattagagatgggatagatggatgaccgcacatc

SEQ ID NO: 60161 - DNA, 201 bp, Bos taurus; identical to SEQ ID NO: 19566

SEQ ID NO: 60162 - DNA, 201 bp, Bos taurus; identical to SEQ ID NO: 19568

SEQ ID NO: 60163 - DNA, 201 bp, Bos taurus; identical to SEQ ID NO: 19569

SEQ ID NO: 60164 - DNA, 201 bp, Bos taurus
tacctaaattgtattatttacttctcacaagaactcaatgtgctaaaaaattatttccattcgatagactagaataataaaactgggaaacattaaaaaaattttttaagttatccttggtcacaaagctaggaagaggatttcattcagtactcatgttctctttatttcaacattatgttctgatggcacagaggagat

SEQ ID NO: 60165 - DNA, 201 bp, Bos taurus
ctccaggggatcttcccaaccaagggatcaaattcacctctcgtatgtctcctgcattggcaggtgggttcttaaccattagcaccacctgggaagccccaaaaataggatacttggggttatatggagccattataaatagctctgtcaaagatggaactggtctttaataatttatagtatttatcttagcacaaacca

SEQ ID NO: 60166 - DNA, 201 bp, Bos taurus; identical to SEQ ID NO: 19570

SEQ ID NO: 60167 - DNA, 201 bp, Bos taurus; identical to SEQ ID NO: 19571

SEQ ID NO: 60168 - DNA, 201 bp, Bos taurus; identical to SEQ ID NO: 19572

SEQ ID NO: 60169 - DNA, 201 bp, Bos taurus
atcttggttcctttgtgtctgatgacacagtggtcagaggagtgaatcccggctgccatttcggaatatactttggccaagctactgaactgcttggacttccccatagttagaaagcccactaactcaattggagcatcacctctcttggccacaccaaaacctggctcacaccaccaccaccttttggagaaacgagtt

SEQ ID NO: 60170 - DNA, 201 bp, Bos taurus; identical to SEQ ID NO: 19573

SEQ ID NO: 60171 - DNA, 201 bp, Bos taurus; identical to SEQ ID NO: 19574

SEQ ID NO: 60172 - DNA, 201 bp, Bos taurus
atgtatatattatctaacttaacccttaaaatagcttatagccttgtgaggttgtctttattattgttattgtgagaaagagtatttaatatctctgaaaccttagatgattctatgatggtcaaaatattactaggagacagagctagggtataaatttaagattttaaattccgaaatccatgcctttggggaaacatt

SEQ ID NO: 60173 - DNA, 201 bp, Bos taurus; identical to SEQ ID NO: 19575

SEQ ID NO: 60174 - DNA, 201 bp, Bos taurus; identical to SEQ ID NO: 19576

SEQ ID NO: 60175 - DNA, 201 bp, Bos taurus; identical to SEQ ID NO: 19579

SEQ ID NO: 60176 - DNA, 201 bp, Bos taurus
tagaaagtatgatctttgtaatgggccttattacatgttatcaggacaccaagacatagggcaaacagcataggatttggaatgaaaagatccagatttgtgtcttgagtttctggtttactaactagattattattaaacttctcaaaaccatgctcttgtcagtatgatggtactgtaaagtggtctcctataagggtt

SEQ ID NO: 60177 - DNA, 201 bp, Bos taurus; identical to SEQ ID NO: 19589

SEQ ID NO: 60178 - DNA, 201 bp, Bos taurus; identical to SEQ ID NO: 19590

SEQ ID NO: 60179 - DNA, 201 bp, Bos taurus
tagttagtgaaggctcttttactgttttaggatacttagcagtgtgatacccaccatagcgaaggagactctagctccttttgtttcacgtataaaagacgaggggacttttgcaagtcttccctcagggtggcagctgaccctgtagtttgttcagctgccggtttactcctgatggggtctgattgaaggtggggagag

SEQ ID NO: 60180 - DNA, 201 bp, Bos taurus
aggctcaccttgggtggtctgttgtccacccccttgcggtgctgtgtgtaggcatccggagcttttgcacctccagtggtggcaagtctgtggcctctttgtatcttgtccatacatgcagttacttggagtcccttatagtttctttgtattctattgtttagaggccgtttgtccacctgcgagcactcagatagaggg

SEQ ID NO: 60181 - DNA, 201 bp, Bos taurus; identical to SEQ ID NO: 19591

SEQ ID NO: 60182 - DNA, 201 bp, Bos taurus
tcacggccatcttcctagcctgttggcattttccaccagccctatagtagtgatggtggccagcagcagtgcccaggactgggctgcccaccactctccccgccctgagagggagcgttctctatttggccagcctaagagtaggaaatgacaggaccttggatgcaggagagggagtgtaaatggtgtggtaatttgaaa

SEQ ID NO: 60183 - DNA, 201 bp, Bos taurus
ctcttgctttcctccccttcccttcctccctcccctcgcactcactcagcccaggtcatttttccagactgactcccagatcaccagccttctccagctctctggggcctgcccagccccctcttcctcctcagcctcaagtcagggcactgctcttagatctgtagtttcttagatctgtgggtggatgttttttcacca

SEQ ID NO: 60184 - DNA, 201 bp, Bos taurus; identical to SEQ ID NO: 19592

SEQ ID NO: 60185 - DNA, 201 bp, Bos taurus; identical to SEQ ID NO: 19595

SEQ ID NO: 60186 - DNA, 201 bp, Bos taurus; identical to SEQ ID NO: 19596

SEQ ID NO: 60187 - DNA, 201 bp, Bos taurus; identical to SEQ ID NO: 19597

SEQ ID NO: 60188 - DNA, 201 bp, Bos taurus; identical to SEQ ID NO: 19598

SEQ ID NO: 60189 - DNA, 201 bp, Bos taurus; identical to SEQ ID NO: 19599

SEQ ID NO: 60190 - DNA, 201 bp, Bos taurus; identical to SEQ ID NO: 19601

SEQ ID NO: 60191 - DNA, 201 bp, Bos taurus; identical to SEQ ID NO: 19602

SEQ ID NO: 60192 - DNA, 201 bp, Bos taurus
cttctccaggccaagttcaaacccacgtggggactatggaaagacggaaggtggggtaacagcatagaagcacccccatccatggctcctcattcgtatccgggccctgctgctgctgctcagggtcagctgggaaagagggcccctctgctgtcttcaggtcaggccccttggcggggtgaggacaggccatcctggact

SEQ ID NO: 60193 - DNA, 201 bp, Bos taurus; identical to SEQ ID NO: 19605

SEQ ID NO: 60194 - DNA, 201 bp, Bos taurus; identical to SEQ ID NO: 19607

SEQ ID NO: 60195 - DNA, 201 bp, Bos taurus
ttttttgttttttttcagtgcagattgagtgacacaatgcgtggttaaaaaaaaaaaagaaagagaaaggacaaatagcaaatgtaggccatctctgaccaggcacattgttgttcagtacacaggcacccaggaagccagccagccagaaaaactgttgagagtctctgtggtgtaattgaaaagttccaggccttgggc

SEQ ID NO: 60196 - DNA, 201 bp, Bos taurus; identical to SEQ ID NO: 19608

SEQ ID NO: 60197 - DNA, 201 bp, Bos taurus; identical to SEQ ID NO: 19609

SEQ ID NO: 60198 - DNA, 201 bp, Bos taurus; identical to SEQ ID NO: 19610

SEQ ID NO: 60199 - DNA, 201 bp, Bos taurus; identical to SEQ ID NO: 19611

SEQ ID NO: 60200 - DNA, 201 bp, Bos taurus; identical to SEQ ID NO: 19612

SEQ ID NO: 60201 - DNA, 201 bp, Bos taurus; identical to SEQ ID NO: 19613

SEQ ID NO: 60202 - DNA, 201 bp, Bos taurus; identical to SEQ ID NO: 19614

SEQ ID NO: 60203 - DNA, 201 bp, Bos taurus
gatggacccagaagagaacccccctccctcccctccgctgggttgctcacctctccagccaaatgtcccacttctgtctcaggctctctgcctcggtgggtggcggtcccctccctgcagttccacagtttctctttgcctttgtgcttttgcacaggtggctctctccttcttgcaagcattcctttgtactgtctggct

SEQ ID NO: 60204 - DNA, 201 bp, Bos taurus; identical to SEQ ID NO: 19621

SEQ ID NO: 60205 - DNA, 201 bp, Bos taurus
atatcaataaggcactgtttctatgggccagctgcatgagacatggaaatagctttgtttcataacactctctttgtattttttggttgttgttataatggaattttgttgtatatggccctgaattctactaagtgcttcagacttgaagagtttggttgcaagacttattcctttactttccctgtgctatgacaatag

SEQ ID NO: 60206 - DNA, 201 bp, Bos taurus
cccaaagagtcggacacaactgagcgactgaactgaactgactgacaggcattttaccacaaaactagtctggcacgttcctaaagggtcacgggcctccggcaggaggaactgtgtgaacccaactgcatgcattctctccaggttcctgacaactgacaacacataatcacgaaacattgggtagggaaaggaggacag

SEQ ID NO: 60207 - DNA, 201 bp, Bos taurus; identical to SEQ ID NO: 19625

SEQ ID NO: 60208 - DNA, 201 bp, Bos taurus; identical to SEQ ID NO: 19626

SEQ ID NO: 60209 - DNA, 201 bp, Bos taurus
gaccagagtgggctgcaggacagccagtggggtcactaggtaaagactgggtgattcaggtatctcccacccctctcccttcccatgtcacacccaggccaagtcagaagggctagcagccccagcttcaccccaggaagctgaagaactgctccctgaggaagatgagctcctggtctgagagggcccaagacctgttgt

SEQ ID NO: 60210 - DNA, 201 bp, Bos taurus; identical to SEQ ID NO: 19627

SEQ ID NO: 60211 - DNA, 201 bp, Bos taurus
tccccacctggtctacagctgaggtcttggccccagggccctctgcacctatgatcccacaaaaccactccagccagttggtcccgtcgctttgggggcctcctagtgtgacactggcacctggagggaccccagcctgtccccaccctaaggttaagtcccccttgagaagcctcactgctgtgcagggggaaaggcagt

SEQ ID NO: 60212 - DNA, 201 bp, Bos taurus
gaaattctctcagccaaaggtcaccaagaggctaaataaccaaaatgggcttcatccacagatgcttcttaaactacaactaggccactcatccaaactcggcacagtcctgcacaaaggaggaggggaggctttctcagaaggcagcagacacaggcctgtgcaatccggcagcccggcggggtcagtggctggtcagcc

SEQ ID NO: 60213 - DNA, 201 bp, Bos taurus; identical to SEQ ID NO: 19632

SEQ ID NO: 60214 - DNA, 201 bp, Bos taurus
attcctgaccatgctccaggtggggctggtcatccagggaagcagatactgtgtgtgaatcaagagcaagcatttatgtttacagaggtcaccgttacacaccttggtcctgccttcctgctcgaaggtggagtttgcaaggagggactctagaggggtctggaggacccatctgtgtcagcgagtcttgttagcaccaac

SEQ ID NO: 60215 - DNA, 201 bp, Bos taurus; identical to SEQ ID NO: 19633

SEQ ID NO: 60216 - DNA, 201 bp, Bos taurus
tggcccctctgtgattcctatatcacttacagttggagggctgggaacctaagacctggttctgaacaatgggaggcgtgtaagccaattatgtaagtcactttccagccttggcccttataattttctatggcattgtgatgggattccccaagtatcctcccatttggagatttcctataaaggctcgtcagatatgac

SEQ ID NO: 60217 - DNA, 201 bp, Bos taurus; identical to SEQ ID NO: 19634

SEQ ID NO: 60218 - DNA, 201 bp, Bos taurus; identical to SEQ ID NO: 19635

SEQ ID NO: 60219 - DNA, 201 bp, Bos taurus; identical to SEQ ID NO: 19638

SEQ ID NO: 60220 - DNA, 201 bp, Bos taurus
ttctacaaacatccactcaggccccagggtctaggtatcaggtaatgcatcctgaaagccaagacacagaccagcccatactcctttggtgctgatcatcttgagggccttttactgacttctcttcctagaactcagcatttccttacatggttatgacgactgaagcatgccaaccccaggtgttccagaacttattta

SEQ ID NO: 60221 - DNA, 201 bp, Bos taurus; identical to SEQ ID NO: 19640

SEQ ID NO: 60222 - DNA, 201 bp, Bos taurus
ctcacacacacacacaaacacaaatttacttaagacgcacaaattcaaagtgttttccccaaaatttatttaatctattaggcaggccatactcttgaaaccagtgaaaacagcactttataaaatgccgcacaaacctaaaactcagtattggagattctagcaggcctttattccttacttctgctttgttcaccttcc

SEQ ID NO: 60223 - DNA, 201 bp, Bos taurus; identical to SEQ ID NO: 19642

SEQ ID NO: 60224 - DNA, 201 bp, Bos taurus; identical to SEQ ID NO: 19643

SEQ ID NO: 60225 - DNA, 201 bp, Bos taurus; identical to SEQ ID NO: 19645

SEQ ID NO: 60226 - DNA, 201 bp, Bos taurus
ctagggtgataatgaagaagcttttgaggttattagatatcagcatagttgaaccattataataaccacatgccaaatgctaccaacctatggggtgtgcctgctatgttgacagatgttctctgtcacacaaaactaacaaaaatggatatgaaattctatttttagaaacataacaaatcaagaacatctttctaattc

SEQ ID NO: 60227 - DNA, 201 bp, Bos taurus; identical to SEQ ID NO: 19646

SEQ ID NO: 60228 - DNA, 201 bp, Bos taurus
aaataggaatgaaatgacttcagatcattaagcaacttatttgaaattgatttctgatgcttattcagcatgtttaacaaataaatgatactaaatagaaaacacatttcaggcagcaacccaagagccaaatattaacacgcacaatcttcatttgctgtgggcgcttccaacttcaggtgttcttttaatattccatat

SEQ ID NO: 60229 - DNA, 201 bp, Bos taurus; identical to SEQ ID NO: 19647

SEQ ID NO: 60230 - DNA, 201 bp, Bos taurus; identical to SEQ ID NO: 19648

SEQ ID NO: 60231 - DNA, 201 bp, Bos taurus; identical to SEQ ID NO: 19649

SEQ ID NO: 60232 - DNA, 201 bp, Bos taurus
ctcctatttctgcaagatgtcgaggttgttgaacaccccaggtaggctgaaaatggagtgttacttttaattactatctcggctggtgtttggaattaccgaaacaatccaacaggtgtggcttattatctgaacagtccagtcttcaaagtgcaggcagctgtgaaagaataaacccacttggtttgttttctggagaag

SEQ ID NO: 60233 - DNA, 201 bp, Bos taurus; identical to SEQ ID NO: 19650

SEQ ID NO: 60234 - DNA, 201 bp, Bos taurus; identical to SEQ ID NO: 19651

SEQ ID NO: 60235 - DNA, 201 bp, Bos taurus
tcacatatgacacaaattttaaaatcaataaaaagatgttaacacaaaatataatcatataattaaatatgtatcaggaaccagaaaaagtgaagagggagaaatcagataatattttacttgtgtttaactaaaaagccatgtacttaaagtctatgagataaaaacagtcataaatctatctgaatcctctagcaacta

SEQ ID NO: 60236 - DNA, 201 bp, Bos taurus
caaaaaagaaaagaacacctttttagttaaaccatttattaaagcattctttattaaataacctaacaccttggaattggatatgtgaagagaacatgtccgaagaattaaagcagacaagatactctgatcattttatttcttgacttatgtgtttttattttttacttctgtatttcaagaaaacataatctctgcctt

SEQ ID NO: 60237 - DNA, 201 bp, Bos taurus; identical to SEQ ID NO: 19652

SEQ ID NO: 60238 - DNA, 201 bp, Bos taurus
agagttctctggcccccagagcatgtccactaggtgctcctggattttacttgggttcaccttaaagggcacaagcaagagattacatatgaaaaagcagagacatcatttttatgacaatggtctgtatagtcaaggctatggtttttctagtagtcatatatgcatgtgatagttggaccataaaaaaaattgagtgct

SEQ ID NO: 60239 - DNA, 201 bp, Bos taurus
taaatgagagaatcttcgtggtttctcctattcctaactcgcattccattcttgctctcttaccagatgtggggttcggctgtggcttcccaggcaacaccgattctgctgactgctttgggtgccctcaactccagtcggcctcgatcatctcaaacagctggctgagccttttcttaacgtcaggctctctgcggacac

SEQ ID NO: 60240 - DNA, 201 bp, Bos taurus; identical to SEQ ID NO: 19653

SEQ ID NO: 60241 - DNA, 201 bp, Bos taurus; identical to SEQ ID NO: 19655

SEQ ID NO: 60242 - DNA, 201 bp, Bos taurus
ggcgccattgtgggtgaaccagggagaacctcatcaaggagagttccgtcttcccatcctcagcgcgctgagacagtgaggcctcggtctgtccctcggagagccactaaaaggaacgatggtccttcacgtgctgccaagatcgtgcagtacagcttgcaggatctcagatccccggccagggattgaaccgggggccct

SEQ ID NO: 60243 - DNA, 201 bp, Bos taurus; identical to SEQ ID NO: 19658

SEQ ID NO: 60244 - DNA, 201 bp, Bos taurus; identical to SEQ ID NO: 19659

SEQ ID NO: 60245 - DNA, 201 bp, Bos taurus
ctggtctgcagtcactcacgggcattttctgaggcctgaagatgggatggaggacccggaggagacccaccaggcacagacagcccttaacctgttcctccggggcctgagctgctggatgtatcagactaggagccatgtgatctggactaggggacaccagcccctcctcccctctgagctggaggctggggtctcagg

SEQ ID NO: 60246 - DNA, 201 bp, Bos taurus; identical to SEQ ID NO: 19663

SEQ ID NO: 60247 - DNA, 201 bp, Bos taurus; identical to SEQ ID NO: 19664

SEQ ID NO: 60248 - DNA, 201 bp, Bos taurus; identical to SEQ ID NO: 19665

SEQ ID NO: 60249 - DNA, 201 bp, Bos taurus; identical to SEQ ID NO: 19666

SEQ ID NO: 60250 - DNA, 201 bp, Bos taurus; identical to SEQ ID NO: 19671

SEQ ID NO: 60251 - DNA, 201 bp, Bos taurus
gctttccccacgcgggcagccttcccaggcgcccacctggctccgccctgcacacccttcagctctcaaatgtctcttcctcggagagcccttgcctgccacctggccctgcctcccgtcattaggccactcatagcccttggctttctgtccgtcgtctgtgtccccagggtcatttccttggcctgatgtcccttccta

SEQ ID NO: 60252 - DNA, 201 bp, Bos taurus
ccatctccatggaataaccatgactttttctttctctaaaccactgtgatattgtcagccccacttagcgtagcagttaatcagcctcctcctttcattgctcatctgtttcacttttgagtaactttatttcccagaccaaacataagctgttcaaggacagagtgtttttcatctcactttgattttccccggcccacg

SEQ ID NO: 60253 - DNA, 201 bp, Bos taurus; identical to SEQ ID NO: 19674

SEQ ID NO: 60254 - DNA, 201 bp, Bos taurus; identical to SEQ ID NO: 19675

SEQ ID NO: 60255 - DNA, 201 bp, Bos taurus; identical to SEQ ID NO: 19676

SEQ ID NO: 60256 - DNA, 201 bp, Bos taurus; identical to SEQ ID NO: 19677

SEQ ID NO: 60257 - DNA, 201 bp, Bos taurus; identical to SEQ ID NO: 19678

SEQ ID NO: 60258 - DNA, 201 bp, Bos taurus; identical to SEQ ID NO: 19679

SEQ ID NO: 60259 - DNA, 201 bp, Bos taurus; identical to SEQ ID NO: 19681

SEQ ID NO: 60260 - DNA, 201 bp, Bos taurus; identical to SEQ ID NO: 19682

SEQ ID NO: 60261 - DNA, 201 bp, Bos taurus; identical to SEQ ID NO: 19685

SEQ ID NO: 60262 - DNA, 201 bp, Bos taurus; identical to SEQ ID NO: 19686

SEQ ID NO: 60263 - DNA, 201 bp, Bos taurus; identical to SEQ ID NO: 19687

SEQ ID NO: 60264 - DNA, 201 bp, Bos taurus; identical to SEQ ID NO: 19688

SEQ ID NO: 60265 - DNA, 201 bp, Bos taurus; identical to SEQ ID NO: 19689

SEQ ID NO: 60266 - DNA, 201 bp, Bos taurus
cggtctctgctgcagggcaactgtctcggctttcaggcctgttggccgagttgcgcttgtggaatgcagtgccctccggcttctcatctatcagataaaacgaccagagctggacaggcccgcacgcctggaggatcacagaaaattatttcacctctctgggcctcgtcaacagagcaagggacttggctctgctgggtt

SEQ ID NO: 60267 - DNA, 201 bp, Bos taurus
tatctatcattcatcttctatgctgcaaattattgtaattttcaagcattataatcatttcatcttatgtattatgactgtttgtcttccctgtggcttagtgatactgaatttgcctaccaaggcaaaagacatgagttaagtccctgaattgagaagattccctggagaaggaaataacaaccgaccccagtattcctg

SEQ ID NO: 60268 - DNA, 201 bp, Bos taurus
caaggtgagaccggcctccttttgaggggcaatggcagggtggggattcctttcccgaagaagcaggggaaccgaccctcatcttgaatagaggagggggaaaacggggcccttcttgagttgtggcatgaaactcggcattcctctctagtggggacgtgtatctcggggaccttcctgagttgcataaagggtgtcaag

SEQ ID NO: 60269 - DNA, 201 bp, Bos taurus
ctggggctgagggagctggggacatgtggcaggcagtgtgactccacgatgaacctggagggcctgttgccctccagacacaggctggataattgaaggggttggaattaacatatacacattaatatatatcaaatagatgatcaaaaagtacttactgaataacatagggaagtttattgaacaccatagaaaagaaat

SEQ ID NO: 60270 - DNA, 201 bp, Bos taurus
agaaaaggacaagttatcaagaatgtcaatgatagtaagaatctactttgaagatactctttgggaggtagtgttttagctgatgtgaagaaataaggagccagtcatacaaagagttgacggggggattattcaggaaaaggaaaggtattttacttctttcacaagatagctacatataaagcactcagcacaagactg

SEQ ID NO: 60271 - DNA, 201 bp, Bos taurus
acaggatagatcaaataattttttttgagaaatgtttcattgtgggctacagttaggcaataagaatccagccagtcacccacattcattggcatgcgctgtgccctttccaaagccatttgtttgcttttatgaaagcagactgaaaattaaacacaaggaatattaaattattattaatgaggacatttgcgggacact

SEQ ID NO: 60272 - DNA, 201 bp, Bos taurus
tttacaactttctaacattattattaaatggtagaaactttttgagacctcttgttgacactttaatttttcattcaagggtgttttcatcaagtctgaactcacatatggcattttcttcctaaataattttgaaaatgacatgtttaccttctcttttgacttgtagtaaaggcctaaaatgtccataaatgagggata

SEQ ID NO: 60273 - DNA, 201 bp, Bos taurus
tttgcttggaagatcaaactatattgtaaacccacctttgattttggctgaaatgataatcaatcttgaagctttcaaattacccggtaaagggcaaatgcagtatattctcttttagaacagctgtgcaaatagccttcatgtttggagttaggcttttactttattgaagatggcctttaagagtcatatttgtttcta

SEQ ID NO: 60274 - DNA, 201 bp, Bos taurus; identical to SEQ ID NO: 19691

SEQ ID NO: 60275 - DNA, 201 bp, Bos taurus; identical to SEQ ID NO: 19692

SEQ ID NO: 60276 - DNA, 201 bp, Bos taurus
ttcctcttccaggggatcttcccgacccaggggtcaaacctatgtctcttacatctcttgcactggcattctttactgctgagccaccaggggaggcccgatgtgttgttaccttgcattaaactctcgcattgtcatatgagttttcttattctatctctgtgtcgtgctctgtattttctccctttttctcttctggcc

SEQ ID NO: 60277 - DNA, 201 bp, Bos taurus; identical to SEQ ID NO: 19693

SEQ ID NO: 60278 - DNA, 201 bp, Bos taurus
ctttaagattcctggcattcagagcaacttgaacccacaattcctacttctctcattcctttatgaaatatgtgccttgcatataaaaagcctgctttttaatggacaatgcaggatccattttagtgatatttttgtaagcttgacaatttacgttgattgatttgttgtgtcatgaaacaaatatcgtttctatatttt

SEQ ID NO: 60279 - DNA, 201 bp, Bos taurus
gatatctttacatgaacaaatcagaatacatggctttttgcccctctatagagggctctgcactgaaaaatctaggagaaccatttgtttctgtgaaaactttttgtatgattccttagcggacttgtttagctcactgttttcctgtcaaggcacacacagccgtgtgggcaatctgagtccagtgttggattttggtta

SEQ ID NO: 60280 - DNA, 201 bp, Bos taurus
tgggagagcaggttgatgtttttcattaacaccaggtactatgccataataaggaatgccaactctcagctgacaacaaaattatgtttaaaatagagacgtaactgtatctttccacaaacttgttggcatgtaagcaaaggcatttagctcaggtttacttagagtcctatgactatacagttctatgagggggtcaaa

SEQ ID NO: 60281 - DNA, 201 bp, Bos taurus
atctgtaacatgaacataaccaaaaaggaaaactgggaaccaagaggacaaccaaagactaattcattaattttccaattattaatcatccttaaccaggccactatatgcattaaaagacattagaacacaacttatttctaaaccaggaatgactgtttcagtccataacactttatgggactttttttttttttttcc

SEQ ID NO: 60282 - DNA, 201 bp, Bos taurus
tctgcaagcttccccagctcttcctcttttaaatagatccctcttttcagcctccactttctctgtttactgtctactacatacaggctatcaaatgaatgtagcattgctattttgtcctcttcggcacatttgtgcatactggatggtttctggtgtgggatatgtattgattcactagcacttgcagtcatttctgta

SEQ ID NO: 60283 - DNA, 201 bp, Bos taurus
ttaattcaccactttaacccagagccctggagcctctcttcagttgccttcagcgcactgtgttctgaggatcttagttcacctcatgctcagcctctattactgcaagaatcactgaatctttctgaaatgctcacatctttaagttcctagttttcttaaagtttaagtacacatagtaatttgtacccatttgtacaa

SEQ ID NO: 60284 - DNA, 201 bp, Bos taurus
aagaggccttcactattttggatgtgagcaaacatcagattaggaaacttgacttgttgtaactgtgccaaagcctctttaatgttctttaaagatatgagtacaggccaactcagaagctaagaagtagcaccgggccctgtggaatcagaccacatttgaatcacagattgcgttctgccttcctagactgaatggcct

SEQ ID NO: 60285 - DNA, 201 bp, Bos taurus; identical to SEQ ID NO: 19696

SEQ ID NO: 60286 - DNA, 201 bp, Bos taurus; identical to SEQ ID NO: 19697

SEQ ID NO: 60287 - DNA, 201 bp, Bos taurus; identical to SEQ ID NO: 19698

SEQ ID NO: 60288 - DNA, 201 bp, Bos taurus
atcattgttagtaaggtattgaaatagacactactcctgtaaacagtgttcaaacctgacgccatgctctggaatgcagctcctgccacgtaaatcatagatgccataaaaatcaatagacaggagaggtgacattgataggtgattactattgaaagagtgattgacagtaagacaatacaaaacatctctgacggggaa

SEQ ID NO: 60289 - DNA, 201 bp, Bos taurus; identical to SEQ ID NO: 19701

SEQ ID NO: 60290 - DNA, 201 bp, Bos taurus; identical to SEQ ID NO: 19702

SEQ ID NO: 60291 - DNA, 201 bp, Bos taurus
gctgtttagaaagctctcaggttactaagtttctattttggggggcataaactaatttataaattaaaatataatgatgctatataatgcacatttgaaaatatgtggttttcattttcttttggccaacgcgtctccacttacaaattaacttcctattaaatctgcttttgctaatggtttattttattaatcagtatt

SEQ ID NO: 60292 - DNA, 201 bp, Bos taurus; identical to SEQ ID NO: 19704

SEQ ID NO: 60293 - DNA, 201 bp, Bos taurus; identical to SEQ ID NO: 19705

SEQ ID NO: 60294 - DNA, 201 bp, Bos taurus
tcctttcacatcaccatgtactttcacttataaagaaaaagacaatgaagctggttgaagaggcagaaaacaaatgtgatttgttacctgtgtgatcatgaagttagcagttttctgttgttgagaattagtcaatattagcagaaaccattgtttaaaggatgactcatctgaaaaaataaatcacaaagatgatgattt

SEQ ID NO: 60295 - DNA, 201 bp, Bos taurus; identical to SEQ ID NO: 19706

SEQ ID NO: 60296 - DNA, 201 bp, Bos taurus; identical to SEQ ID NO: 19709

SEQ ID NO: 60297 - DNA, 201 bp, Bos taurus; identical to SEQ ID NO: 19710

SEQ ID NO: 60298 - DNA, 201 bp, Bos taurus; identical to SEQ ID NO: 19711

SEQ ID NO: 60299 - DNA, 201 bp, Bos taurus; identical to SEQ ID NO: 19712

SEQ ID NO: 60300 - DNA, 201 bp, Bos taurus; identical to SEQ ID NO: 19714

SEQ ID NO: 60301 - DNA, 201 bp, Bos taurus
agtaggtgcggccttggggaggtgcttccgtcctaaaggaaggctcagaaggggattactgccccaccataacagacccacagagatcccttgccccttctggcgtgtgaaggcccggtaagaaggcaccagcttcaaaccaggaagaggaccttcagaaagtcactctatgcagcagcttgatctttgacttcccagctc

SEQ ID NO: 60302 - DNA, 201 bp, Bos taurus; identical to SEQ ID NO: 19719

SEQ ID NO: 60303 - DNA, 201 bp, Bos taurus; identical to SEQ ID NO: 19720

SEQ ID NO: 60304 - DNA, 201 bp, Bos taurus
gcaaagagtcggacacaactgagcgacttcacttcactttgcactcatttgttaaaattataacatgcctttggtgagtagtaagttggatgatagagttactatatatgctaaagtgggttttttatttaaaagaataggaatacaatgaaattctaaagttggaaagtatatagaataaaattctaattcttgatgaat

SEQ ID NO: 60305 - DNA, 201 bp, Bos taurus; identical to SEQ ID NO: 19722

SEQ ID NO: 60306 - DNA, 201 bp, Bos taurus; identical to SEQ ID NO: 19724

SEQ ID NO: 60307 - DNA, 201 bp, Bos taurus
tgtagtttatgcatgccatgctcacttaactgtcagatttatttttaaactttcaatttcctctcctatctccaggaagcatgtatttttatttttccacacagtgtgttgtcctatttattattctggacatgggaataaaggcattcttggaaatgtctcgattatctttgccattctcttgttacatcctgtgatatc

SEQ ID NO: 60308 - DNA, 201 bp, Bos taurus
ttctaaaactgtcaaatcatttattcacgatttgcttttgaacaagatttctttatccatctctaccactgaatctgcagatctctcaaaatgcaagcaacgtggcctccttttattttctaatacccggaaacactagctgcctttctccccagctgctttcctgcccatgtcccttttatgagaacaaacgttgccatt

SEQ ID NO: 60309 - DNA, 201 bp, Bos taurus; identical to SEQ ID NO: 19725

SEQ ID NO: 60310 - DNA, 201 bp, Bos taurus; identical to SEQ ID NO: 19726

SEQ ID NO: 60311 - DNA, 201 bp, Bos taurus; identical to SEQ ID NO: 19727

SEQ ID NO: 60312 - DNA, 201 bp, Bos taurus; identical to SEQ ID NO: 19728

SEQ ID NO: 60313 - DNA, 201 bp, Bos taurus
cctggccttgtcctgggttatacggaaaattagcactggctgaatccaggtggtcctagtgccaggggttggtggcggacgacatgggtgacagggtgagcggggaggccctgcagttggattccaccagctcgccctggatgcgcacgtgagctgaggcactggtctgcctcaaggccgccttgagaggagcaatttggt

SEQ ID NO: 60314 - DNA, 201 bp, Bos taurus
cttataaaagtacatggcacatctcatgttcagtaagtattaataaccactgctgtgatggtggtcagcgttgttactactgagtcatgctgccatctcttggaccagtttctcatgatgcataaagttacacttagcagctttaagaatgtgtaagtaactgttagacaatctattttgacagatggacatctgaaataa

SEQ ID NO: 60315 - DNA, 201 bp, Bos taurus; identical to SEQ ID NO: 19729

SEQ ID NO: 60316 - DNA, 201 bp, Bos taurus
ccccattctcactgttcaaatactatgtcatctctgctaatcccgattctcttcaaaactgaacttaagctgatctaacatgcaaaacttagaaatgcatccagagcctactcatgacacctactcaggaaaagtcatgaagaatcacaagcaaattcacctattgtacctatttatatgttttactccctcatgccagga

SEQ ID NO: 60317 - DNA, 201 bp, Bos taurus; identical to SEQ ID NO: 19733

SEQ ID NO: 60318 - DNA, 201 bp, Bos taurus; identical to SEQ ID NO: 19734

SEQ ID NO: 60319 - DNA, 201 bp, Bos taurus; identical to SEQ ID NO: 19737

SEQ ID NO: 60320 - DNA, 201 bp, Bos taurus
gaggttgatacaactgcaaactaatcaaatatgaggcccttccagagtgcctagttcccccagttaacatataggtcttctgtccagactaggaagcacactgactccctgaggcctccagaatgtgcagagccacctacaaattaccacatgcagaccatcaggtgagccttgcaataagaccaggagacaaatctgctg

SEQ ID NO: 60321 - DNA, 201 bp, Bos taurus
agaaaaccagaaccttctagctgtaaaggcccttagaaaccacctcatttgtctccttgcatcttaatacatatgaaaataaagacttaagagtggccgttacctggtccattttataaatttgttagttgcaatgctggattagaactcattatctttgatgacagctcttttaacaatctcattctgcttttcaagatt

SEQ ID NO: 60322 - DNA, 201 bp, Bos taurus; identical to SEQ ID NO: 19738

SEQ ID NO: 60323 - DNA, 201 bp, Bos taurus; identical to SEQ ID NO: 19742

SEQ ID NO: 60324 - DNA, 201 bp, Bos taurus; identical to SEQ ID NO: 19743

SEQ ID NO: 60325 - DNA, 201 bp, Bos taurus; identical to SEQ ID NO: 19746

SEQ ID NO: 60326 - DNA, 201 bp, Bos taurus
ttttaaaactaacagtttacttatcataattttgaaaaagaacttaaagaatggttaacttctagaaaattagtactggagaaatactttttttcccctctcaagtttagtttgtaacataaatcagagtatgtgcattttcataatttagttttaaacaaatttattaccacttcctggaagatcccctggagaaggaaa

SEQ ID NO: 60327 - DNA, 201 bp, Bos taurus
tattttcctgtactaattattttcccatcacagttggtttaatgttttctcatacagggaaaggagacaatagcagtctgctatcctcctgcttcatatataggtgttatggacacaatgttcgtgtcccactaaaactatatgttcaagtcccaacccacaatgtgattagtacagtctttggggggtgattaggtcttg

SEQ ID NO: 60328 - DNA, 201 bp, Bos taurus; identical to SEQ ID NO: 19750

SEQ ID NO: 60329 - DNA, 201 bp, Bos taurus; identical to SEQ ID NO: 19751

SEQ ID NO: 60330 - DNA, 201 bp, Bos taurus
ttaccaactgagctatgagagaagctacttaagccctaattcctggcttctgtttctctataaaccagaaagagaaagaaaactaataagtgagaactctctacagggactctggtgtggaatgttgaacaagaggcttgcctgttgatttgatagtagttagcaggttagagtcaaggttaaaatgttttatgaaaggat

SEQ ID NO: 60331 - DNA, 201 bp, Bos taurus; identical to SEQ ID NO: 19753

SEQ ID NO: 60332 - DNA, 201 bp, Bos taurus; identical to SEQ ID NO: 19755

SEQ ID NO: 60333 - DNA, 201 bp, Bos taurus; identical to SEQ ID NO: 19756

SEQ ID NO: 60334 - DNA, 201 bp, Bos taurus; identical to SEQ ID NO: 19757

SEQ ID NO: 60335 - DNA, 201 bp, Bos taurus; identical to SEQ ID NO: 19758

SEQ ID NO: 60336 - DNA, 201 bp, Bos taurus; identical to SEQ ID NO: 19760

SEQ ID NO: 60337 - DNA, 201 bp, Bos taurus; identical to SEQ ID NO: 19761

SEQ ID NO: 60338 - DNA, 201 bp, Bos taurus; identical to SEQ ID NO: 19762

SEQ ID NO: 60339 - DNA, 201 bp, Bos taurus; identical to SEQ ID NO: 19764

SEQ ID NO: 60340 - DNA, 201 bp, Bos taurus; identical to SEQ ID NO: 19766

SEQ ID NO: 60341 - DNA, 201 bp, Bos taurus
ggtgaggactaagcatatatgatggagaatttttaaaagaattttatcagttacaaatgccattctttctttttcctactataagctagttaatatgtgaaaacttgaactatattaaattttgtaacatttaatcatgaatcatcattggctcatttatgttaaatatttctcaaatatgcatcagttatttgatcatct

SEQ ID NO: 60342 - DNA, 201 bp, Bos taurus
gctccagccttgtccctttctgtttctgtccaaagaggaacccagaactaacacactcagtagtgcatatccaacccttgggcccagactctacctctaaccaaggtacacaaacccaaaagaagaaccaactcaatcgtacagctccaaaaccagaggccctggccatgctccaaccaaggcagaaactaccatcatgct

SEQ ID NO: 60343 - DNA, 201 bp, Bos taurus
gttacctgtgtcaggggagtttgtaattccctcggttctgtgtcctagcaacaaaaatttgaattgacagatggaccagtattaaaggcctcagacagactggtgttacagctctgtattacagctcagtttcatttagaaagtaaaggaaaatacatccttgaggtgtgagggcatgtggacccaaaggatgtgaaaaga

SEQ ID NO: 60344 - DNA, 201 bp, Bos taurus; identical to SEQ ID NO: 19768

SEQ ID NO: 60345 - DNA, 201 bp, Bos taurus; identical to SEQ ID NO: 19770

SEQ ID NO: 60346 - DNA, 201 bp, Bos taurus; identical to SEQ ID NO: 19771

SEQ ID NO: 60347 - DNA, 201 bp, Bos taurus; identical to SEQ ID NO: 19772

SEQ ID NO: 60348 - DNA, 201 bp, Bos taurus
aggtttcatgcatttgaaaacagacagttaaggcctgtgattcctgagtaaacatttcggagtctgaatactttcttgcaaatttacctggtaatgaaaatttaaagttccttaggaaggtcctggccatagttttcatggctgttttagctgccctgctaattccgttctgaggatgctatctgagacatttatgtgaca

SEQ ID NO: 60349 - DNA, 201 bp, Bos taurus
attctttcattcatttttggtgaaattgtccattctaaaggcctttattactagacagtttggtaatatgaaacaaaatgtatactatgtatattatagcgttctaacttctagttaaacttaggagctagtatttagaaagataaaagatatgccaaggtttcatcatagcagcatttttaatattaattaattggaaac

SEQ ID NO: 60350 - DNA, 201 bp, Bos taurus
aggggtgaggtcattggaaaaaagtacaatagtatgcactggttatttgaattaaggaaagagtgaagcaggagatagatggtccctgggccgaacagtttctcccctgtggacggaaattccttaagagcagaaactccattaaagcaggatgatgaggggaggctgggccctgcccagataagagataaaagaccacac

SEQ ID NO: 60351 - DNA, 201 bp, Bos taurus; identical to SEQ ID NO: 19773

SEQ ID NO: 60352 - DNA, 201 bp, Bos taurus; identical to SEQ ID NO: 19775

SEQ ID NO: 60353 - DNA, 201 bp, Bos taurus; identical to SEQ ID NO: 19777

SEQ ID NO: 60354 - DNA, 201 bp, Bos taurus; identical to SEQ ID NO: 19778

SEQ ID NO: 60355 - DNA, 201 bp, Bos taurus; identical to SEQ ID NO: 19779

SEQ ID NO: 60356 - DNA, 201 bp, Bos taurus; identical to SEQ ID NO: 19780

SEQ ID NO: 60357 - DNA, 201 bp, Bos taurus; identical to SEQ ID NO: 19781

SEQ ID NO: 60358 - DNA, 201 bp, Bos taurus; identical to SEQ ID NO: 19782

SEQ ID NO: 60359 - DNA, 201 bp, Bos taurus; identical to SEQ ID NO: 19783

SEQ ID NO: 60360 - DNA, 201 bp, Bos taurus; identical to SEQ ID NO: 19785

SEQ ID NO: 60361 - DNA, 201 bp, Bos taurus; identical to SEQ ID NO: 19787

SEQ ID NO: 60362 - DNA, 201 bp, Bos taurus; identical to SEQ ID NO: 19788

SEQ ID NO: 60363 - DNA, 201 bp, Bos taurus; identical to SEQ ID NO: 19789

SEQ ID NO: 60364 - DNA, 201 bp, Bos taurus; identical to SEQ ID NO: 19793

SEQ ID NO: 60365 - DNA, 201 bp, Bos taurus; identical to SEQ ID NO: 19794

SEQ ID NO: 60366 - DNA, 201 bp, Bos taurus; identical to SEQ ID NO: 19798

SEQ ID NO: 60367 - DNA, 201 bp, Bos taurus; identical to SEQ ID NO: 19800

SEQ ID NO: 60368 - DNA, 201 bp, Bos taurus; identical to SEQ ID NO: 19801

SEQ ID NO: 60369 - DNA, 201 bp, Bos taurus; identical to SEQ ID NO: 19802

SEQ ID NO: 60370 - DNA, 201 bp, Bos taurus; identical to SEQ ID NO: 19803

SEQ ID NO: 60371 - DNA, 201 bp, Bos taurus; identical to SEQ ID NO: 19807

SEQ ID NO: 60372 - DNA, 201 bp, Bos taurus; identical to SEQ ID NO: 19810

SEQ ID NO: 60373 - DNA, 201 bp, Bos taurus; identical to SEQ ID NO: 19812

SEQ ID NO: 60374 - DNA, 201 bp, Bos taurus; identical to SEQ ID NO: 19813

SEQ ID NO: 60375 - DNA, 201 bp, Bos taurus; identical to SEQ ID NO: 19814

SEQ ID NO: 60376 - DNA, 201 bp, Bos taurus; identical to SEQ ID NO: 19816

SEQ ID NO: 60377 - DNA, 201 bp, Bos taurus; identical to SEQ ID NO: 19817

SEQ ID NO: 60378 - DNA, 201 bp, Bos taurus; identical to SEQ ID NO: 19820

SEQ ID NO: 60379 - DNA, 201 bp, Bos taurus; identical to SEQ ID NO: 19821

SEQ ID NO: 60380 - DNA, 201 bp, Bos taurus; identical to SEQ ID NO: 19822

SEQ ID NO: 60381 - DNA, 201 bp, Bos taurus; identical to SEQ ID NO: 19824

SEQ ID NO: 60382 - DNA, 201 bp, Bos taurus; identical to SEQ ID NO: 19825

SEQ ID NO: 60383 - DNA, 201 bp, Bos taurus; identical to SEQ ID NO: 19827

SEQ ID NO: 60384 - DNA, 201 bp, Bos taurus; identical to SEQ ID NO: 19828

SEQ ID NO: 60385 - DNA, 201 bp, Bos taurus; identical to SEQ ID NO: 19829

SEQ ID NO: 60386 - DNA, 201 bp, Bos taurus; identical to SEQ ID NO: 19830

SEQ ID NO: 60387 - DNA, 201 bp, Bos taurus; identical to SEQ ID NO: 19831

SEQ ID NO: 60388 - DNA, 201 bp, Bos taurus; identical to SEQ ID NO: 19832

SEQ ID NO: 60389 - DNA, 201 bp, Bos taurus; identical to SEQ ID NO: 19833

SEQ ID NO: 60390 - DNA, 201 bp, Bos taurus; identical to SEQ ID NO: 19837

SEQ ID NO: 60391 - DNA, 201 bp, Bos taurus; identical to SEQ ID NO: 19838

SEQ ID NO: 60392 - DNA, 201 bp, Bos taurus; identical to SEQ ID NO: 19842

SEQ ID NO: 60393 - DNA, 201 bp, Bos taurus; identical to SEQ ID NO: 19843

SEQ ID NO: 60394 - DNA, 201 bp, Bos taurus; identical to SEQ ID NO: 19846

SEQ ID NO: 60395 - DNA, 201 bp, Bos taurus
atgtctctagtctttccaaccctgttgttttcctctatttctttggattgttcacttaagaaggcattctcatttctccttattattctctggaactctctattcagttatgtatctttcactgtcttctttgcctttttcttcttttttcagttccttttctcagaccttttgtaagatctcatcagacaaccctttgtc

SEQ ID NO: 60396 - DNA, 201 bp, Bos taurus
tggttgtcacacagctactgctagagctgtgcaaatgtggcagccatcttagagctgaatgagcatctccaggaaggttttagcatcttcaaggcccctccccaagaatcatggggcatccccttcaagaagccaggggctgaatacattctgtgagtctttgggctcctgcccctttgtagctcctctggccctcaaacc

SEQ ID NO: 60397 - DNA, 201 bp, Bos taurus; identical to SEQ ID NO: 19847

SEQ ID NO: 60398 - DNA, 201 bp, Bos taurus
agagaaaaaacaggacatattatacacagagggacctagataaggagttcagaagatttctcactggcaacaatgcaaagaagaaaacagttgataaataccttgaaagaactaagagcaagcaactgccaacctagcattgtgtatcttgtgaaaatgtctttcaaacatgaaggttaaataatgtctctgtcagacatc

SEQ ID NO: 60399 - DNA, 201 bp, Bos taurus
gcattaatggctccacaacctaattcaagcagcatatgcgtccccacacgcccccccatacatgcgcacgtgctgagggtgtttgttgcaacagtggaacaatcccagaaatgggccattataaacatcttgttcatggctttccagctaagaagtttccatcaaaatgatacatggtactggctatgcaagaatttccag

SEQ ID NO: 60400 - DNA, 201 bp, Bos taurus
tctgctagcctcccatgagttagggaagggaagcttacctaaccctaaccctaaccctgccaactttggattcctaaattcacctgatcccccatccaccaggggccaggataggcacagctgcaggaaggcacttcttcccactttctctctctcatccatcagatctcagtatcaatgaatttgtccttcatcattgga

SEQ ID NO: 60401 - DNA, 201 bp, Bos taurus
actttgaaaactatgttttaatgatgttgtggattaaaaccagcaccacaaagccacatccaaagaataatttcacctaatatgacaaaagagaagttcaatttcacttgagcaagatatcttaaccaagagaggtcagatccccaaaatgacatctatccctttagaacttttcatgaaagagatctgggatttacttat

SEQ ID NO: 60402 - DNA, 201 bp, Bos taurus; identical to SEQ ID NO: 19848

SEQ ID NO: 60403 - DNA, 201 bp, Bos taurus; identical to SEQ ID NO: 19849

SEQ ID NO: 60404 - DNA, 201 bp, Bos taurus
tacatgtatttggaaaatatgttgacactgttatttagatctcaagcaaggaagtaaaatagtttattcattatggcctctggagaagagtctatggctttgaatgaaaggatttatctggtttgtgttaatcaataaaaagtagctgaaagtcacctttagtacttctcttcaaagtaactaatcttttggttccatggg

SEQ ID NO: 60405 - DNA, 201 bp, Bos taurus; identical to SEQ ID NO: 19850

SEQ ID NO: 60406 - DNA, 201 bp, Bos taurus; identical to SEQ ID NO: 19851

SEQ ID NO: 60407 - DNA, 201 bp, Bos taurus; identical to SEQ ID NO: 19852

SEQ ID NO: 60408 - DNA, 201 bp, Bos taurus; identical to SEQ ID NO: 19853

SEQ ID NO: 60409 - DNA, 201 bp, Bos taurus; identical to SEQ ID NO: 19861

SEQ ID NO: 60410 - DNA, 201 bp, Bos taurus; identical to SEQ ID NO: 19863

SEQ ID NO: 60411 - DNA, 201 bp, Bos taurus; identical to SEQ ID NO: 19864

SEQ ID NO: 60412 - DNA, 201 bp, Bos taurus; identical to SEQ ID NO: 19865

SEQ ID NO: 60413 - DNA, 201 bp, Bos taurus; identical to SEQ ID NO: 19866

SEQ ID NO: 60414 - DNA, 201 bp, Bos taurus; identical to SEQ ID NO: 19867

SEQ ID NO: 60415 - DNA, 201 bp, Bos taurus; identical to SEQ ID NO: 19871

SEQ ID NO: 60416 - DNA, 201 bp, Bos taurus; identical to SEQ ID NO: 19872

SEQ ID NO: 60417 - DNA, 201 bp, Bos taurus; identical to SEQ ID NO: 19873

SEQ ID NO: 60418 - DNA, 201 bp, Bos taurus; identical to SEQ ID NO: 19874

SEQ ID NO: 60419 - DNA, 201 bp, Bos taurus; identical to SEQ ID NO: 19875

SEQ ID NO: 60420 - DNA, 201 bp, Bos taurus; identical to SEQ ID NO: 19876

SEQ ID NO: 60421 - DNA, 201 bp, Bos taurus; identical to SEQ ID NO: 19877

SEQ ID NO: 60422 - DNA, 201 bp, Bos taurus; identical to SEQ ID NO: 19878

SEQ ID NO: 60423 - DNA, 201 bp, Bos taurus; identical to SEQ ID NO: 19879

SEQ ID NO: 60424 - DNA, 201 bp, Bos taurus; identical to SEQ ID NO: 19881

SEQ ID NO: 60425 - DNA, 201 bp, Bos taurus; identical to SEQ ID NO: 19882

SEQ ID NO: 60426 - DNA, 201 bp, Bos taurus; identical to SEQ ID NO: 19884

SEQ ID NO: 60427 - DNA, 201 bp, Bos taurus; identical to SEQ ID NO: 19885

SEQ ID NO: 60428 - DNA, 201 bp, Bos taurus; identical to SEQ ID NO: 19886

SEQ ID NO: 60429 - DNA, 201 bp, Bos taurus; identical to SEQ ID NO: 19888

SEQ ID NO: 60430 - DNA, 201 bp, Bos taurus; identical to SEQ ID NO: 19889

SEQ ID NO: 60431 - DNA, 201 bp, Bos taurus; identical to SEQ ID NO: 19890

SEQ ID NO: 60432 - DNA, 201 bp, Bos taurus; identical to SEQ ID NO: 19891

SEQ ID NO: 60433 - DNA, 201 bp, Bos taurus; identical to SEQ ID NO: 19892

SEQ ID NO: 60434 - DNA, 201 bp, Bos taurus; identical to SEQ ID NO: 19894

SEQ ID NO: 60435 - DNA, 201 bp, Bos taurus; identical to SEQ ID NO: 19896

SEQ ID NO: 60436 - DNA, 201 bp, Bos taurus
gggtatcgctactttattgtgagagctagctaacgtaaataatatggaactttgtaaatatgagaaaggaaatatcatttttctgcttgaggagaaaacttattggtgctgataaggtttttctgaataatttagaagaactgttgtttggaaacatatcaatcctccaaaactcagaaatttgggagaattgggggaaaa

SEQ ID NO: 60437 - DNA, 201 bp, Bos taurus; identical to SEQ ID NO: 19897

SEQ ID NO: 60438 - DNA, 201 bp, Bos taurus; identical to SEQ ID NO: 19898

SEQ ID NO: 60439 - DNA, 201 bp, Bos taurus
agtaccatttatgaactttttgtatactatacaatttatttactttttatgtctgttggttctcccctcattaggaatgttaacttcataaagatgggcatctctgttttgggctctgatgaagatgtgtaagagtaacactgttttcatacctactaacacagtatccattctgcagtccatggattcagttggataatt

SEQ ID NO: 60440 - DNA, 201 bp, Bos taurus
aagaaacaccaaactaacctctgcccccaaaagtcaaaggccattttctgatcgacctcttcaactgaagtttccagcagttaaatgctatgataacgacattgctctagggccctccactaacccaccacccaagggggaaaaaaatccaccctagtgagcttcttgaaatcaggcgttttaagcaatggatttcacacg

SEQ ID NO: 60441 - DNA, 201 bp, Bos taurus
cttatcttattcagatgtatggcaaggtctgggttatggctgagagccatctgagagggagagtagcctactggaaagagtgtagtttgttggttagaccgtttggatttgaactctgcctctgcctcttacttactgtaaagctctaaacaaattattagcccactctgaagctcaagtgaccctctgcgagcagagggc

SEQ ID NO: 60442 - DNA, 201 bp, Bos taurus
tcaaactacagtatgatacagtatgctgtagtatgtattgactctgaaatatcacctaattgtatgaaaatatgtaagtcttccaaatacctacctttaaatagtttttaaaaactttagcatcaggctgctgaagcgcttgacaaaactcctgaggggccaggaggggaggagagagaaaagaatgagtcatttgtatta

SEQ ID NO: 60443 - DNA, 201 bp, Bos taurus; identical to SEQ ID NO: 19901

SEQ ID NO: 60444 - DNA, 201 bp, Bos taurus; identical to SEQ ID NO: 19902

SEQ ID NO: 60445 - DNA, 201 bp, Bos taurus
caaggcaactgaacaactggtatcaagagatgtagagctgagctttgggatagaaagaaagatatgaaggatcacctttaccttgcactgcaaatgaacctaggctggacttggctcggttaagctcagtttgaagtggatattgaagttgcagctaaacatgatggacattcaagattaaatggtgaaatgtgtttgatt

SEQ ID NO: 60446 - DNA, 201 bp, Bos taurus; identical to SEQ ID NO: 19903

SEQ ID NO: 60447 - DNA, 201 bp, Bos taurus; identical to SEQ ID NO: 19904

SEQ ID NO: 60448 - DNA, 201 bp, Bos taurus; identical to SEQ ID NO: 19905

SEQ ID NO: 60449 - DNA, 201 bp, Bos taurus; identical to SEQ ID NO: 19906

SEQ ID NO: 60450 - DNA, 201 bp, Bos taurus; identical to SEQ ID NO: 19907

SEQ ID NO: 60451 - DNA, 201 bp, Bos taurus; identical to SEQ ID NO: 19909

SEQ ID NO: 60452 - DNA, 201 bp, Bos taurus; identical to SEQ ID NO: 19911

SEQ ID NO: 60453 - DNA, 201 bp, Bos taurus; identical to SEQ ID NO: 19912

SEQ ID NO: 60454 - DNA, 201 bp, Bos taurus; identical to SEQ ID NO: 19913

SEQ ID NO: 60455 - DNA, 201 bp, Bos taurus; identical to SEQ ID NO: 19914

SEQ ID NO: 60456 - DNA, 201 bp, Bos taurus; identical to SEQ ID NO: 19915

SEQ ID NO: 60457 - DNA, 201 bp, Bos taurus; identical to SEQ ID NO: 19916

SEQ ID NO: 60458 - DNA, 201 bp, Bos taurus; identical to SEQ ID NO: 19917

SEQ ID NO: 60459 - DNA, 201 bp, Bos taurus; identical to SEQ ID NO: 19919

SEQ ID NO: 60460 - DNA, 201 bp, Bos taurus
ggctgtcccctgttatgcagtgccatgacacttcctttggcatgccatcaaaagtcctcatggtttaaggatgtcactagcatacaattttacaacatttggggggagctaacttgtagtgatcaggatagactattgaactatagatttacagctcaactcagagagtagcaatctatgagtttcaagtttggagtttgg

SEQ ID NO: 60461 - DNA, 201 bp, Bos taurus; identical to SEQ ID NO: 19921

SEQ ID NO: 60462 - DNA, 201 bp, Bos taurus; identical to SEQ ID NO: 19922

SEQ ID NO: 60463 - DNA, 201 bp, Bos taurus; identical to SEQ ID NO: 19923

SEQ ID NO: 60464 - DNA, 201 bp, Bos taurus; identical to SEQ ID NO: 19925

SEQ ID NO: 60465 - DNA, 201 bp, Bos taurus; identical to SEQ ID NO: 19926

SEQ ID NO: 60466 - DNA, 201 bp, Bos taurus
tgtgaagtgatgtcttatcagtgtctcaggataagaaatggcaatcattccatcaggtgctggaaactggttagcctcgagacaagggtttctagggccataggtcaggatgtgtatttagttacagggtcccagaaacccgtctcctggctaccacaagcaatggcttcttttctgggctaaggagccagacctggactg

SEQ ID NO: 60467 - DNA, 201 bp, Bos taurus; identical to SEQ ID NO: 19933

SEQ ID NO: 60468 - DNA, 201 bp, Bos taurus; identical to SEQ ID NO: 19934

SEQ ID NO: 60469 - DNA, 201 bp, Bos taurus; identical to SEQ ID NO: 19935

SEQ ID NO: 60470 - DNA, 201 bp, Bos taurus; identical to SEQ ID NO: 19936

SEQ ID NO: 60471 - DNA, 201 bp, Bos taurus; identical to SEQ ID NO: 19937

SEQ ID NO: 60472 - DNA, 201 bp, Bos taurus; identical to SEQ ID NO: 19938

SEQ ID NO: 60473 - DNA, 201 bp, Bos taurus; identical to SEQ ID NO: 19939

SEQ ID NO: 60474 - DNA, 201 bp, Bos taurus; identical to SEQ ID NO: 19940

SEQ ID NO: 60475 - DNA, 201 bp, Bos taurus; identical to SEQ ID NO: 19942

SEQ ID NO: 60476 - DNA, 201 bp, Bos taurus; identical to SEQ ID NO: 19943

SEQ ID NO: 60477 - DNA, 201 bp, Bos taurus
tggtttgggcactggtattccagaggataagctatacctacagggaactaggtgcacgcccctagggaaagactggaatcaggccttgactcttctaggcatctactttagaaccatttgcagattttaagccagctaattttaacatctcatgagaacagttcctggaggggcccagaggctggcattaaataactccca

SEQ ID NO: 60478 - DNA, 201 bp, Bos taurus
aaagcatgaacagctcactctctatctggttacttgtggttttatctttacctttccaagaaggtgggaaagaagaaatgggggccatttccttaaaaaccgtgaagtgtagtgaagtaaaggtcgctcagttgtgtccgactctttgtgaccccatggactatacaggccagaatactggagtgggtagcctttctcttc

SEQ ID NO: 60479 - DNA, 201 bp, Bos taurus; identical to SEQ ID NO: 19947

SEQ ID NO: 60480 - DNA, 201 bp, Bos taurus; identical to SEQ ID NO: 19948

SEQ ID NO: 60481 - DNA, 201 bp, Bos taurus; identical to SEQ ID NO: 19949

SEQ ID NO: 60482 - DNA, 201 bp, Bos taurus; identical to SEQ ID NO: 19950

SEQ ID NO: 60483 - DNA, 201 bp, Bos taurus; identical to SEQ ID NO: 19951

SEQ ID NO: 60484 - DNA, 201 bp, Bos taurus; identical to SEQ ID NO: 19952

SEQ ID NO: 60485 - DNA, 201 bp, Bos taurus; identical to SEQ ID NO: 19953

SEQ ID NO: 60486 - DNA, 201 bp, Bos taurus; identical to SEQ ID NO: 19954

SEQ ID NO: 60487 - DNA, 201 bp, Bos taurus; identical to SEQ ID NO: 19955

SEQ ID NO: 60488 - DNA, 201 bp, Bos taurus; identical to SEQ ID NO: 19957

SEQ ID NO: 60489 - DNA, 201 bp, Bos taurus; identical to SEQ ID NO: 19958

SEQ ID NO: 60490 - DNA, 201 bp, Bos taurus; identical to SEQ ID NO: 19959

SEQ ID NO: 60491 - DNA, 201 bp, Bos taurus
tggccactggtgatccattcattctccagcccctctccctccctgaggagtagggggactagaagacataagtgctaaatctccaatcacagggctaggtacccctggcaaccaggcccccctccttggttgcctaggagtactccaaaagtcacctaattaatataacaaaggatacctttatccatctgtatacttagg

SEQ ID NO: 60492 - DNA, 201 bp, Bos taurus; identical to SEQ ID NO: 19960

SEQ ID NO: 60493 - DNA, 201 bp, Bos taurus
tggggcggcttgtcttgttggggaggataggttctaggcgctgggctcagtagttgcagctcctgggccctagagcacacgggcttcagcagttgcggccgactggcaaagttgctctttggcacatgggatcttcctagatcagggctccaacccctgttgcctgcattggcagacagattcttaaccagtggtccaccc

SEQ ID NO: 60494 - DNA, 201 bp, Bos taurus
gcctgtaccttttcctttttaatctcaccttttgagatctatccatattattgcatttaagtcttgtgctttgtttaccaattgcacaatccctgattgccaaaatgaataaaggaagagtctaacatgaagtggattacatacagaaggcccttcctgactgttttcagggagccattgaacatcagataaggctctgcg

SEQ ID NO: 60495 - DNA, 201 bp, Bos taurus; identical to SEQ ID NO: 19962

SEQ ID NO: 60496 - DNA, 201 bp, Bos taurus; identical to SEQ ID NO: 19963

SEQ ID NO: 60497 - DNA, 201 bp, Bos taurus; identical to SEQ ID NO: 19964

SEQ ID NO: 60498 - DNA, 201 bp, Bos taurus; identical to SEQ ID NO: 19965

SEQ ID NO: 60499 - DNA, 201 bp, Bos taurus; identical to SEQ ID NO: 19966

SEQ ID NO: 60500 - DNA, 201 bp, Bos taurus; identical to SEQ ID NO: 19970

SEQ ID NO: 60501 - DNA, 201 bp, Bos taurus; identical to SEQ ID NO: 19971

SEQ ID NO: 60502 - DNA, 201 bp, Bos taurus; identical to SEQ ID NO: 19972

SEQ ID NO: 60503 - DNA, 201 bp, Bos taurus; identical to SEQ ID NO: 19973

SEQ ID NO: 60504 - DNA, 201 bp, Bos taurus; identical to SEQ ID NO: 19974

SEQ ID NO: 60505 - DNA, 201 bp, Bos taurus; identical to SEQ ID NO: 19977

SEQ ID NO: 60506 - DNA, 201 bp, Bos taurus; identical to SEQ ID NO: 19979

SEQ ID NO: 60507 - DNA, 201 bp, Bos taurus; identical to SEQ ID NO: 19981

SEQ ID NO: 60508 - DNA, 201 bp, Bos taurus; identical to SEQ ID NO: 19985

SEQ ID NO: 60509 - DNA, 201 bp, Bos taurus; identical to SEQ ID NO: 19986

SEQ ID NO: 60510 - DNA, 201 bp, Bos taurus; identical to SEQ ID NO: 19987

SEQ ID NO: 60511 - DNA, 201 bp, Bos taurus; identical to SEQ ID NO: 19989

SEQ ID NO: 60512 - DNA, 201 bp, Bos taurus; identical to SEQ ID NO: 19990

SEQ ID NO: 60513 - DNA, 201 bp, Bos taurus; identical to SEQ ID NO: 19991

SEQ ID NO: 60514 - DNA, 201 bp, Bos taurus; identical to SEQ ID NO: 19992

SEQ ID NO: 60515 - DNA, 201 bp, Bos taurus; identical to SEQ ID NO: 19993

SEQ ID NO: 60516 - DNA, 201 bp, Bos taurus; identical to SEQ ID NO: 19994

SEQ ID NO: 60517 - DNA, 201 bp, Bos taurus; identical to SEQ ID NO: 19995

SEQ ID NO: 60518 - DNA, 201 bp, Bos taurus; identical to SEQ ID NO: 19996

SEQ ID NO: 60519 - DNA, 201 bp, Bos taurus; identical to SEQ ID NO: 19997

SEQ ID NO: 60520 - DNA, 201 bp, Bos taurus; identical to SEQ ID NO: 19998

SEQ ID NO: 60521 - DNA, 201 bp, Bos taurus; identical to SEQ ID NO: 19999

SEQ ID NO: 60522 - DNA, 201 bp, Bos taurus; identical to SEQ ID NO: 20000

SEQ ID NO: 60523 - DNA, 201 bp, Bos taurus; identical to SEQ ID NO: 20003

SEQ ID NO: 60524 - DNA, 201 bp, Bos taurus; identical to SEQ ID NO: 20004

SEQ ID NO: 60525 - DNA, 201 bp, Bos taurus
ggccaccacatggtctgcccaaggtaacatggtgagtcagagaaagaataggaacgaaagcaaaagaatctgtcagtggtttgcccagaaggccttccaatttttaactcaggctacactggttcctttcaggctgccctactctgaggggtttgtccagtagttttggagtcaggcatcgagccaggtctcaaaggtcta

SEQ ID NO: 60526 - DNA, 201 bp, Bos taurus
aaaaaagcacaggtgatcttccccaaggtgattgaagccgagataacatcactgagcaccattgacccgttctgtgcagaggaaggtccatggaagttcccgaacctttgtcgttgttcagttgctcagtcatatctgactgtttgtgagcccatgggctgctgcagaccaggcctctctgtccctcactatctcctggag

SEQ ID NO: 60527 - DNA, 201 bp, Bos taurus
tcatgcttgacttgcagggggtcaggggaggctgtgcagggctctcggcctgcagaccctcaatttcgtgaatttcaatctaggggggacttgccctggtctcctagcaagccagacacggcctgtcacccagatcagtctctcacacccagtgctttcctggctgcgggaacaactcggccctccctccctccgtcctgg

SEQ ID NO: 60528 - DNA, 201 bp, Bos taurus
cacaggggccatcaggaaacggatctgaagaaatcccagaaaacagctgcttcctgtgagctgaggggcagctgccctcggggctggtgagggtccaggtaccacactgggcccagggagcccttccttgaatgcatgcaaatgaatggcataaatttctacttacttaacttcacaaatgctaacaagctcataaaaaat

SEQ ID NO: 60529 - DNA, 201 bp, Bos taurus
tggggttcaatcccagtatagcacatgcttgtgattctaggcaagtcacaatctaacttttctctacgcttcatctgaggggccttaatgcacatgctcaattgaattcatctaacaatgactcttcctctcccactgtccaggatccccctagggtcgctctgtgcagaaggccagaggggccctgcttccctgagacct

SEQ ID NO: 60530 - DNA, 201 bp, Bos taurus; identical to SEQ ID NO: 20010

SEQ ID NO: 60531 - DNA, 201 bp, Bos taurus
atgttgtaacactaccaccttgtgggaaatttgagcatgtgagtcaaatatttgagaactattttcaaacagccaaacaataaggcagaatttcttgatagttagagtcacaatatatgaacagatgatatatgaaaaaaacatttatggtcaggtcattttagaaagctcaggataaaacaaataagtatttttttttaa

SEQ ID NO: 60532 - DNA, 201 bp, Bos taurus
aggaggctcccattggccaaaggtgagatgatttgatgattcaaaaacactattgttccaagtgattaaaatgaatgaaaaatataaaatgagaaaggaagaatataagccttcatggccataattaaaggttgttgggcaccaactcattatttttaaaactgctaactaaagcgaaagaactgagattttatattgttt

SEQ ID NO: 60533 - DNA, 201 bp, Bos taurus; identical to SEQ ID NO: 20013

SEQ ID NO: 60534 - DNA, 201 bp, Bos taurus; identical to SEQ ID NO: 20016

SEQ ID NO: 60535 - DNA, 201 bp, Bos taurus; identical to SEQ ID NO: 20017

SEQ ID NO: 60536 - DNA, 201 bp, Bos taurus; identical to SEQ ID NO: 20018

SEQ ID NO: 60537 - DNA, 201 bp, Bos taurus
aaacatgtattgtattaactttaaaaaaaaaaaaagttaaggtagcctatgacttagaattgaaaaaagagagactaggaaaatgcacttttctcatatattcagaaagataatgcctttactaacatattgacttaaattcgatttacccttaaagaaaagtagagaaatcaaagattatttagggaaaaactaccaaaa

SEQ ID NO: 60538 - DNA, 201 bp, Bos taurus; identical to SEQ ID NO: 20019

SEQ ID NO: 60539 - DNA, 201 bp, Bos taurus; identical to SEQ ID NO: 20020

SEQ ID NO: 60540 - DNA, 201 bp, Bos taurus; identical to SEQ ID NO: 20021

SEQ ID NO: 60541 - DNA, 201 bp, Bos taurus; identical to SEQ ID NO: 20022

SEQ ID NO: 60542 - DNA, 201 bp, Bos taurus
tagcactcagccttctttatgatccaactctcacatccgtggatgactactgaaaaaaacattgctttgactatccggccttttatcagcaaaatgatgttgctgctttttaatacgctgtctaggtttgtcatagctttccttccaaggagcaagtgtctaaatttcatggatgcaggccctgtctacagtgattctgga

SEQ ID NO: 60543 - DNA, 201 bp, Bos taurus; identical to SEQ ID NO: 20024

SEQ ID NO: 60544 - DNA, 201 bp, Bos taurus
tttaattaatcatcccataatagacttgcagggtatgttgaaaagcagagccttaactgaaaaaagagtgtcctgtgattcaaggaggtgccatttatggaaactaatccttaaaaattacttgcaaaagcaagaaaatatatggatttttgaggtatagtttataattgattataaaaccacaaatatctaacaaaataa

SEQ ID NO: 60545 - DNA, 201 bp, Bos taurus; identical to SEQ ID NO: 20025

SEQ ID NO: 60546 - DNA, 201 bp, Bos taurus; identical to SEQ ID NO: 20026

SEQ ID NO: 60547 - DNA, 201 bp, Bos taurus; identical to SEQ ID NO: 20027

SEQ ID NO: 60548 - DNA, 201 bp, Bos taurus; identical to SEQ ID NO: 20028

SEQ ID NO: 60549 - DNA, 201 bp, Bos taurus
tgaaactctgccatgacattagttataaagaaagccaaagaaagaaatcttggccacaagatgggaattgacgcaattcttatgtctgccacattcagactatgccttttgcagacgtttctgcgtttatttatagcaaggttgactttagtaacaagaccatgttccactaatgatactttttaaaaatataccaaaaca

SEQ ID NO: 60550 - DNA, 201 bp, Bos taurus
gatatatgcccaggagtggaattgctccttcttctactttaaagatgattgtgatttctcattcattggtgttccaccatcctttgcttcttaacccagtcgttatctctgtaaacagtccctttattatactgttaggcttaagccctttgaagtggatacttgcagtgttcctgatactggaggagggagccctatcat

SEQ ID NO: 60551 - DNA, 201 bp, Bos taurus
gacgcaagcaccctagtgatcctgtctgtccttaagagatcaggaggccggttcagaccctgaaaataggatcagggccatttgggcagggaatccctagcactgagtatttggagtctgtctagaaaagggtccagtcaactgcttgctccaaggaggtcacagctgggggaagatagaggtgagaggccctcgaaagtg

SEQ ID NO: 60552 - DNA, 201 bp, Bos taurus; identical to SEQ ID NO: 20032

SEQ ID NO: 60553 - DNA, 201 bp, Bos taurus
tacttttttgcacagaatattctaacagttctgaggatgagtcactatcaacgaagacttgaggagtttagggtatcaaaaacatatggggttattaagcggtggacttgaaaatgtccaatggtcttgtcagtaaaaaaaaaagagaagaaacaatggatgaagtgttaaaatggtggaagtgtaacagggaaaccttgt

SEQ ID NO: 60554 - DNA, 201 bp, Bos taurus; identical to SEQ ID NO: 20033

SEQ ID NO: 60555 - DNA, 201 bp, Bos taurus; identical to SEQ ID NO: 20034

SEQ ID NO: 60556 - DNA, 201 bp, Bos taurus
ataatcagtggaggaaatggttcggttattaaaagcaaatgaaagatatttctacccctgacagctcaatattagtaccagtccttatagttctgcagattttctcaacaaggctgggttacacctaggtattactaataataataaccagcattttcgattgtttagtatgtactgctgctgctgctgctgctaagtcac

SEQ ID NO: 60557 - DNA, 201 bp, Bos taurus
ataagccagaattaatgaaaataattgcatataatgtgttagagggaataaatagaagtgatagagatggaactaagtctcctaagatcttcccaggtggcgctagtggtaaagaactgcctgccaatgtaggagactcagaagacgctggttcaatccccaggtcctgaagatcgttggtcaggaaggtcccctggagga

SEQ ID NO: 60558 - DNA, 201 bp, Bos taurus
gtattccctcccgatcaacggacactggctgcagctgcccagcaaggattcctccttcctccaggcttcagctataaggctggatgtagtaagtaccgtttatttttcatttgggagtgggtggagggcatgtctttaggcaatttaatattcctgccacaccaagaaatgagatcacccgtatagcatttttattttaaa

SEQ ID NO: 60559 - DNA, 201 bp, Bos taurus; identical to SEQ ID NO: 20035

SEQ ID NO: 60560 - DNA, 201 bp, Bos taurus
caaggatcccagcatacatccttgcggcttagcagacccaaatgccaagactgtataaggggattctgcgaatcagagttccttcaaaattcctactgattgttggcttcggttacctcagtataacgtgctaagtgtgcaaaggtgaataaatcaacgtctcatcccttcctgaagcaaatgtacccaaagggggggaaa

SEQ ID NO: 60561 - DNA, 201 bp, Bos taurus
aattagaacaatagggtaaaattaatgccaatgttaagtacagatgtgccagatatgatgggtagttgatacacaattcaaattgacaaccacgtgcaatatggaaagtatccaggcataacctcagatccagttggccaatggatgtcatgattgcctcacagagaacatatttaaaagagatttatttggcagtaagaa

SEQ ID NO: 60562 - DNA, 201 bp, Bos taurus; identical to SEQ ID NO: 20038

SEQ ID NO: 60563 - DNA, 201 bp, Bos taurus
gacacctcaatgctgtttctctgaagcatccatgcaaggatatcatggacaaactgcctctatcctgggctaaaatgactcaccccaaatagacacttttgggaaatgctagcactgctgtccaccaaggagtgcattccaggcttcccataaccctcttaacagcagttcagttttactcaaaagtttcagcatgagtat

SEQ ID NO: 60564 - DNA, 201 bp, Bos taurus
aattaatatgtttaattaataactgatggccggaacataacttatttaaataaatgtaaaaaaccagaataagttaataaataataaactaaagaagtgtagagtttcaacttggaagtttcaattaaactaattttccttaaagaaaatacgctgttattgttcagtcactaagttgtgttggactctgcaacccatgga

SEQ ID NO: 60565 - DNA, 201 bp, Bos taurus; identical to SEQ ID NO: 20039

SEQ ID NO: 60566 - DNA, 201 bp, Bos taurus; identical to SEQ ID NO: 20042

SEQ ID NO: 60567 - DNA, 201 bp, Bos taurus; identical to SEQ ID NO: 20043

SEQ ID NO: 60568 - DNA, 201 bp, Bos taurus; identical to SEQ ID NO: 20044

SEQ ID NO: 60569 - DNA, 201 bp, Bos taurus; identical to SEQ ID NO: 20045

SEQ ID NO: 60570 - DNA, 201 bp, Bos taurus; identical to SEQ ID NO: 20046

SEQ ID NO: 60571 - DNA, 201 bp, Bos taurus; identical to SEQ ID NO: 20047

SEQ ID NO: 60572 - DNA, 201 bp, Bos taurus; identical to SEQ ID NO: 20048

SEQ ID NO: 60573 - DNA, 201 bp, Bos taurus; identical to SEQ ID NO: 20049

SEQ ID NO: 60574 - DNA, 201 bp, Bos taurus
atgtggctcactgggagcaggagtgatctgtagagttggatcaggtgtgggttagtatgcccaaggacatactgagctgctctctgaggctattttaggctgtgactttggccaaccctctcctctgtcctggatctcaggcttcattataatttgcctatcatccttaccccatcacataaattaacttccctatctaag

SEQ ID NO: 60575 - DNA, 201 bp, Bos taurus
ctgctatacgtcaaatttataaaattaatattcttcagagaaatctcaaaattgaattacttcccctggtcaaaatcgaaaggtttacctgaggggcgcttgtggcaaccaggaaagcattagtccttcccgggtgatcatagtcatgcatggctgcagccacatacaaggccatcaactccaaggcagggatatttccag

SEQ ID NO: 60576 - DNA, 201 bp, Bos taurus
tagcaattattagagtacagaaaagaaagtattctcccagtgttcaagaagaacataaaaataatttccctgaatacaggccattaagctttaattttgatcctctttaaaatattaatatggattataaattgttttctagctctcataaaggtaatgcctcgaatccagcatagattcacttagagtaggccatgccac

SEQ ID NO: 60577 - DNA, 201 bp, Bos taurus
gtgccccatccttaggttagaacacggacatggtggtgggggtgagccagcctccaccatgcctaccaggaccacatcctaggatgacagggccccagccagcatgacttcaatgccactcacccccatggattaacatctcagactatcttgtaaaagagaaataaatcttttatctagtttgtcatttctaaactggcc

SEQ ID NO: 60578 - DNA, 201 bp, Bos taurus; identical to SEQ ID NO: 20054

SEQ ID NO: 60579 - DNA, 201 bp, Bos taurus; identical to SEQ ID NO: 20055

SEQ ID NO: 60580 - DNA, 201 bp, Bos taurus; identical to SEQ ID NO: 20056

SEQ ID NO: 60581 - DNA, 201 bp, Bos taurus; identical to SEQ ID NO: 20058

SEQ ID NO: 60582 - DNA, 201 bp, Bos taurus; identical to SEQ ID NO: 20059

SEQ ID NO: 60583 - DNA, 201 bp, Bos taurus
atatattaaggacttaaagtactgggcttggtgaaatatgggaaaatgtttattgcacctgattttgcaatgagaaaagacttgtagtaacaggaaataaacaatgacaatatataggtgattaaaatgccttaattaggatgttttgtttgcatttttatggaaataagggagtaagagtacatgactttattctagtgt

SEQ ID NO: 60584 - DNA, 201 bp, Bos taurus; identical to SEQ ID NO: 20061

SEQ ID NO: 60585 - DNA, 201 bp, Bos taurus
tttagaaataataatttcttcccttcatgggattgttcctacagactattctaattttttcccctgccactctttctcccagctagctttgctgtagtaatatcagcctgatgtaagtttattgaacaccccaggtttcttcccagtttagacttattcactatctttgaaaagctcttccctaacaatgacatgagtcac

SEQ ID NO: 60586 - DNA, 201 bp, Bos taurus; identical to SEQ ID NO: 20063

SEQ ID NO: 60587 - DNA, 201 bp, Bos taurus; identical to SEQ ID NO: 20064

SEQ ID NO: 60588 - DNA, 201 bp, Bos taurus; identical to SEQ ID NO: 20065

SEQ ID NO: 60589 - DNA, 201 bp, Bos taurus; identical to SEQ ID NO: 20066

SEQ ID NO: 60590 - DNA, 201 bp, Bos taurus; identical to SEQ ID NO: 20067

SEQ ID NO: 60591 - DNA, 201 bp, Bos taurus
ccgaggggccaaatgagactggacaaaagtctctttccagagcctggtgcctggttttgtattcccttgcagtagcattactgaactatatagaaacatacgaatcgcttaattgttccttaaacgttcttgtctggctgcatccctctttcctgcccacaggttgaaaagtaatgaatatgaaacgaagtgaaggtcaag

SEQ ID NO: 60592 - DNA, 201 bp, Bos taurus; identical to SEQ ID NO: 20069

SEQ ID NO: 60593 - DNA, 201 bp, Bos taurus; identical to SEQ ID NO: 20070

SEQ ID NO: 60594 - DNA, 201 bp, Bos taurus; identical to SEQ ID NO: 20071

SEQ ID NO: 60595 - DNA, 201 bp, Bos taurus; identical to SEQ ID NO: 20072

SEQ ID NO: 60596 - DNA, 201 bp, Bos taurus
cacatgttttccttaaaaaggaagcaaatccggagtgtttggtggcttcgccctcactcagctccctttgctggattgacaggccacaaactcagaagaaaagaaaagagtggaggaggactcccctggtggtcggtccagtggttaagactccgagctcccactgcaggggccacagattccaaccctggtcagggaagt

SEQ ID NO: 60597 - DNA, 201 bp, Bos taurus; identical to SEQ ID NO: 20074

SEQ ID NO: 60598 - DNA, 201 bp, Bos taurus; identical to SEQ ID NO: 20075

SEQ ID NO: 60599 - DNA, 201 bp, Bos taurus; identical to SEQ ID NO: 20077

SEQ ID NO: 60600 - DNA, 201 bp, Bos taurus; identical to SEQ ID NO: 20078

SEQ ID NO: 60601 - DNA, 201 bp, Bos taurus; identical to SEQ ID NO: 20079

SEQ ID NO: 60602 - DNA, 201 bp, Bos taurus; identical to SEQ ID NO: 20080

SEQ ID NO: 60603 - DNA, 201 bp, Bos taurus; identical to SEQ ID NO: 20081

SEQ ID NO: 60604 - DNA, 201 bp, Bos taurus; identical to SEQ ID NO: 20082

SEQ ID NO: 60605 - DNA, 201 bp, Bos taurus; identical to SEQ ID NO: 20084

SEQ ID NO: 60606 - DNA, 201 bp, Bos taurus; identical to SEQ ID NO: 20085

SEQ ID NO: 60607 - DNA, 201 bp, Bos taurus
gttctgaatttgtattaagttctgaataatcatttcttcaagtttgtttgccaatctttcactttgtcactgggcatttcacttctgggccaacatgcccgtgagtatccagattcaactctgtttcttccagtcagatttatttacttcattgctctagttatgaattttagaatcttcttgccctgtctcttcgattca

SEQ ID NO: 60608 - DNA, 201 bp, Bos taurus; identical to SEQ ID NO: 20086

SEQ ID NO: 60609 - DNA, 201 bp, Bos taurus; identical to SEQ ID NO: 20087

SEQ ID NO: 60610 - DNA, 201 bp, Bos taurus
tggccatcttctcctctgtgtcttcacatggtcttccctctggcatttgcctatctgtgcccagattttttcttcttatgaggagatcagccatattggaatagggccccctgtaaagacttctttttaacttaaccaacattttaaaacacttcatctcctaagataattgcattctgagctatgagtattgaggtcctc

SEQ ID NO: 60611 - DNA, 201 bp, Bos taurus
ccctgtctgcatgtatacaggaagactctttgggggtcaaaatggagggtgcaccatcccataataagtgtggacgtgtacccacaggcctctgctgtgcaatccatctcagcaaaatgtttttgtgcacccacgttggggagggtccaggactagtcaagtgtgggaaaagaactgagataattggccaaaggtaaacaa

SEQ ID NO: 60612 - DNA, 201 bp, Bos taurus
tcccagaccaggaatcaaaccaatgcccctactttgtgaggcagattcttaaaccattggcctatgagggaataatctttttaccatcacctttgcctttgccagactatcatatagctggagttatactatacgacttttcaaatggccatctttcccttagcaataaatattaatatttaaagttccttcatatctttt

SEQ ID NO: 60613 - DNA, 201 bp, Bos taurus; identical to SEQ ID NO: 20088

SEQ ID NO: 60614 - DNA, 201 bp, Bos taurus
acaaagtcagaggaattcctctcctctagaagcctcccccgcccaaattcccaagatccttggcctgccaggaaacaattttctttgtgtatgagcctggcaccctatatgtcatacaccatgtcagtttcctttgaggactttgtaaatattgactccacccatatttctctattgtgagcttgtcatgactgattaaat

SEQ ID NO: 60615 - DNA, 201 bp, Bos taurus
tactttgagagcttttaacccaatttaaggaccctgttagttgacaaaaagtttttccccaaaagaggtgaatacttaaactcactcaaagaagagagacggaagctccctggagggtcatttaattcctttttgctttataggtgacaaatgagaccctgaccttgaccttcacagttctgcaagacatcccagtaaggg

SEQ ID NO: 60616 - DNA, 201 bp, Bos taurus
catcactatgatatacattaggtctcaagaacttactcatcttataactgaaagtttatacccttgatcaatatttcccattttcctccacccaccaatctctggtaacctttctaccctgtgtaactatgagttcaacctttttagtttcaaatagtgagatcatgtgagattggtctttctgcagacagttttacttag

SEQ ID NO: 60617 - DNA, 201 bp, Bos taurus
agataagaccgttaaaaattacgctgtatagacttattctctgcgccaacttctaaagtacatgtttggaagttaagggatgggtgtgcaggcaccatctcatctagagccggggcctgccgacacacctgaggtcttctctcatctgttcctccagttgggaggctctgccaagaatctcccttctcaagattttttttg

SEQ ID NO: 60618 - DNA, 201 bp, Bos taurus; identical to SEQ ID NO: 20091

SEQ ID NO: 60619 - DNA, 201 bp, Bos taurus
tcttgccaaccacattggctgtttttggtctttgcattttgtataaacttgtgagtcagcttatcatttttcaccaaaaaagcataaggtattttgactgagatttgatttaatctaaatataaatttgaggatgattgactgtagtaattttgagttttccaactcactgacatcatacattcctctattcaatttggtc

SEQ ID NO: 60620 - DNA, 201 bp, Bos taurus; identical to SEQ ID NO: 20092

SEQ ID NO: 60621 - DNA, 201 bp, Bos taurus
aggcagcgctggtaccggcacaggctgaaatggccttatcactgtggaaatatcgaaggacttccatgctggtgagcaaacggttcctgcccgagcctcacgccttccttcgccaagggccagcagctgagagagaacatctggcacatcagggggccgctaagaccacacccccaagctctactctgattggttgattcc

SEQ ID NO: 60622 - DNA, 201 bp, Bos taurus; identical to SEQ ID NO: 20094

SEQ ID NO: 60623 - DNA, 201 bp, Bos taurus; identical to SEQ ID NO: 20097

SEQ ID NO: 60624 - DNA, 201 bp, Bos taurus; identical to SEQ ID NO: 20098

SEQ ID NO: 60625 - DNA, 201 bp, Bos taurus; identical to SEQ ID NO: 20099

SEQ ID NO: 60626 - DNA, 201 bp, Bos taurus; identical to SEQ ID NO: 20100

SEQ ID NO: 60627 - DNA, 201 bp, Bos taurus; identical to SEQ ID NO: 20101

SEQ ID NO: 60628 - DNA, 201 bp, Bos taurus
gaagacacagagccatgccttatgtacctctgtgtcagagaatctcatgatggcccttgcatggttgatggatggcaaatatatacagacacagagtcgcagaagcagtcacggtagacccaggcctcctgtgggtccacagctccaccctggtgttctgctggagtgcagagggtccacctaagtctgaggtgtgaggac

SEQ ID NO: 60629 - DNA, 201 bp, Bos taurus
cattgcctggagcctggaccctgtgaacccatccctgcctccctccctctcccagtggggaggtgctgcccccacaaaaacctgctcaaaagacccctggacttccctggactgacctctgtgaccgttctttcagtcgtcctaggaatttttggctgtcactggtgtcgattcctaatccagcccaccttgccctgcagg

SEQ ID NO: 60630 - DNA, 201 bp, Bos taurus
gtgccccctagtggccacttccttcatcacggaggttgagatccgcgggatgtcaataggagtggcgacttggacgctaattttatgaatagactgcagttcttgcctagaaagagctcacggccctgagtggaggagccacctgcccaaccgatgctgcttcaatcagaacgcgtccgagggtgcccaggaaaaggtgac

SEQ ID NO: 60631 - DNA, 201 bp, Bos taurus
caaggccagaaggcaagataacagtgggttggataagggaaagaaaagcaggcacctaagaagtaaaggtgagtgagaaggaaaagattagaaaacgaaggaaaaaaaagaaccacaaaggaaaaatccaaacacaccagaaaccagagtcaacatggattaaaccactctcaccagttaacaaaaagactgctttttttt

SEQ ID NO: 60632 - DNA, 201 bp, Bos taurus; identical to SEQ ID NO: 20104

SEQ ID NO: 60633 - DNA, 201 bp, Bos taurus
agccgggaccacctcagggagcctatgtgggcagcttctgcacactttcggccaccccatggagccccctcaccctcacctttgaagcaggccagccgactgccacacctcctgtgtctccccacttcactcttgtcccaggaattcgagcagcgtccacagtctgccccaatcgtagcagcctagctccttccatcaaca

SEQ ID NO: 60634 - DNA, 201 bp, Bos taurus
ttccttccagacctgccccggcctctcacaagcatgctctttccaacagctcacacctgccccacaagtgttcacagcactcacaccagaccctgactggtaggccaggcggaagccagcgtgcagatgaagccagccccagagtctcaacaaggagaacgccgagcctggggggtgggcttcccagacgagaggcacagc

SEQ ID NO: 60635 - DNA, 201 bp, Bos taurus
ctctgcgggcagtggaaggagctgtcttttcactgcttccctacatgttccagagatgagagtgtgtgcccaacaccagccttgatcccctggagtgtgaggtttgtgcaggcctgcttggggcaggccctttggtatggacgccttggcagcacccaagggcagctggctcgatgggtcctcaccttgtagccccggagc

SEQ ID NO: 60636 - DNA, 201 bp, Bos taurus; identical to SEQ ID NO: 20106

SEQ ID NO: 60637 - DNA, 201 bp, Bos taurus; identical to SEQ ID NO: 20107

SEQ ID NO: 60638 - DNA, 201 bp, Bos taurus
gtgtcatgggccaggctggagtagaaacatctgaacgtggccccctcctccttgccagttgcctgccgtccagaggaggaactgggccctctccctgaagggcacagctcaacaacccagagcaagacccagagttgtgtgtctccttcctcttgctgtactagggtctctgctgcagggacctcatctgctgagctggcc

SEQ ID NO: 60639 - DNA, 201 bp, Bos taurus; identical to SEQ ID NO: 20108

SEQ ID NO: 60640 - DNA, 201 bp, Bos taurus; identical to SEQ ID NO: 20109

SEQ ID NO: 60641 - DNA, 201 bp, Bos taurus; identical to SEQ ID NO: 20110

SEQ ID NO: 60642 - DNA, 201 bp, Bos taurus; identical to SEQ ID NO: 20111

SEQ ID NO: 60643 - DNA, 201 bp, Bos taurus; identical to SEQ ID NO: 20113

SEQ ID NO: 60644 - DNA, 201 bp, Bos taurus; identical to SEQ ID NO: 20114

SEQ ID NO: 60645 - DNA, 201 bp, Bos taurus; identical to SEQ ID NO: 20115

SEQ ID NO: 60646 - DNA, 201 bp, Bos taurus
ggggcaggcgcgccagtcaaggcacagtggacgctgccggctgtggggtgtggaccgggctaagggggatggacgtgacctggcagcagtgaggaggggcatggacaccaggcctgtggggtttcctggaggtttctaaccaaagactgagccagccctgcctggagggggagagagggtgggtgcagaagcacagagaga

SEQ ID NO: 60647 - DNA, 201 bp, Bos taurus; identical to SEQ ID NO: 20117

SEQ ID NO: 60648 - DNA, 201 bp, Bos taurus; identical to SEQ ID NO: 20118

SEQ ID NO: 60649 - DNA, 201 bp, Bos taurus; identical to SEQ ID NO: 20120

SEQ ID NO: 60650 - DNA, 201 bp, Bos taurus; identical to SEQ ID NO: 20121

SEQ ID NO: 60651 - DNA, 201 bp, Bos taurus; identical to SEQ ID NO: 20122

SEQ ID NO: 60652 - DNA, 201 bp, Bos taurus; identical to SEQ ID NO: 20123

SEQ ID NO: 60653 - DNA, 201 bp, Bos taurus; identical to SEQ ID NO: 20124

SEQ ID NO: 60654 - DNA, 201 bp, Bos taurus; identical to SEQ ID NO: 20126

SEQ ID NO: 60655 - DNA, 201 bp, Bos taurus; identical to SEQ ID NO: 20127

SEQ ID NO: 60656 - DNA, 201 bp, Bos taurus; identical to SEQ ID NO: 20128

SEQ ID NO: 60657 - DNA, 201 bp, Bos taurus
cactgggccattctgaggctcgaaggacagacacagcttggagagtgctcggcaacagcagagtcctcacaagtatctgctgtcaggacagtccttcccagctcaggatggaaagacagcgtctggtcccggctgtttgggatcctcagtcactggacgtgtgtgtggtcaccctgtgtctcatgccgtgaccctgcagag

SEQ ID NO: 60658 - DNA, 201 bp, Bos taurus
ctagtcctgttggtctcaactcctctctcagcccccacctcacgtggcccagccaccatcacctcttccctgcatcaccacacctttggcctccccagccggttagggatgtactaggtccagcaggtgttcagtcattcactcggtaaacatgcactgattagcgtagcgctgattgggtaccaggcaaaggccctgccc

SEQ ID NO: 60659 - DNA, 201 bp, Bos taurus
acattgtaggcagacactttaatctctgagccaccagggacgctcaaatgacccagaggtcatttgagccagaaacatagggagaggccacagaaaggaatattttaagggaaaggacggtgcgcccccgccctgccacacacacacagggagatctgtggaagggaaatgaaaacaccagtttctgtcccggcccctcct

SEQ ID NO: 60660 - DNA, 201 bp, Bos taurus; identical to SEQ ID NO: 20130

SEQ ID NO: 60661 - DNA, 201 bp, Bos taurus
gtggagagaaactgaggcccagcggacacagcaagcatcagttacccgacaagtgagtggatgagccatcagatgattcctgtccccagcctctgtgttcgcgagctgaggcccagacatacgtcatggagcagagaccagtcgcccccgctgtgccctgtcctaatttccgacccagagaatccgtgagcagaataaatg

SEQ ID NO: 60662 - DNA, 201 bp, Bos taurus; identical to SEQ ID NO: 20132

SEQ ID NO: 60663 - DNA, 201 bp, Bos taurus
accccgttctggcggccgtgcgcccaccacccctgccccgccatgtgtccgcagagctgtcgctcatcacgctgcactggttcctcacggccttcgccagcgtggtgcacatccgcctgctgctgcgactctgggacctgtttttctacgagggctccctggtgctgttccaggccacgttgggcatgctgcgcctcaagg

SEQ ID NO: 60664 - DNA, 201 bp, Bos taurus; identical to SEQ ID NO: 20133

SEQ ID NO: 60665 - DNA, 201 bp, Bos taurus; identical to SEQ ID NO: 20134

SEQ ID NO: 60666 - DNA, 201 bp, Bos taurus; identical to SEQ ID NO: 20135

SEQ ID NO: 60667 - DNA, 201 bp, Bos taurus; identical to SEQ ID NO: 20136

SEQ ID NO: 60668 - DNA, 201 bp, Bos taurus; identical to SEQ ID NO: 20139

SEQ ID NO: 60669 - DNA, 201 bp, Bos taurus; identical to SEQ ID NO: 20140

SEQ ID NO: 60670 - DNA, 201 bp, Bos taurus; identical to SEQ ID NO: 20141

SEQ ID NO: 60671 - DNA, 201 bp, Bos taurus; identical to SEQ ID NO: 20142

SEQ ID NO: 60672 - DNA, 201 bp, Bos taurus; identical to SEQ ID NO: 20143

SEQ ID NO: 60673 - DNA, 201 bp, Bos taurus; identical to SEQ ID NO: 20145

SEQ ID NO: 60674 - DNA, 201 bp, Bos taurus; identical to SEQ ID NO: 20146

SEQ ID NO: 60675 - DNA, 201 bp, Bos taurus; identical to SEQ ID NO: 20147

SEQ ID NO: 60676 - DNA, 201 bp, Bos taurus; identical to SEQ ID NO: 20148

SEQ ID NO: 60677 - DNA, 201 bp, Bos taurus; identical to SEQ ID NO: 20150

SEQ ID NO: 60678 - DNA, 201 bp, Bos taurus
acaccaggcccaaaggggtgacaagcccatcacctggtgaatgaatctgtaaagtgtgtctctctgagcaacggactgtgactcagccgtaagaaggagcgaggccccggcatgtgccacaatgtgggtgaaccttgaaaacatcatgctaagggagagaagaaggaaatggcagcccacccccgtgttcttgcatggaga

SEQ ID NO: 60679 - DNA, 201 bp, Bos taurus
ttctatgcctcagtgtcttcttctggaaaagggagatcctgatccatattgtctgccctgtggagttgcaagggataagagaaatagtccctctactatacggcctgttgagcactcaggcggttgtcgttcagtcgctcagttgtgtccgactctttgcgaccccatggactgcagcacgccaggcttccctgtccttca

SEQ ID NO: 60680 - DNA, 201 bp, Bos taurus; identical to SEQ ID NO: 20152

SEQ ID NO: 60681 - DNA, 201 bp, Bos taurus
catggagttcaaggggccattgagaggtgtcgagtctgcagactggcagtcacagtgtgggggaacctcgtgggaacgagggtgtggagaaagagggccaagtcctcactgcggtggatgggactccaagatgagactccggacggggatggtattggcaacgacagggtgagagcaggggttcccaaagcaggccgtctg

SEQ ID NO: 60682 - DNA, 201 bp, Bos taurus
tgtaaatggaccactgccctttccaaatggctgatgccctggttgctcccaaccagcggtcagttcctaggtcatcaccttcttggccacccacagaatgttccagcttgtcagcgaactcatgataaacgcctgcggttttcctctgggaggacagtggtggggggtggccccccacagaggaggctgtcccagggtgtc

SEQ ID NO: 60683 - DNA, 201 bp, Bos taurus; identical to SEQ ID NO: 20153

SEQ ID NO: 60684 - DNA, 201 bp, Bos taurus; identical to SEQ ID NO: 20154

SEQ ID NO: 60685 - DNA, 201 bp, Bos taurus; identical to SEQ ID NO: 20155

SEQ ID NO: 60686 - DNA, 201 bp, Bos taurus
tgagtcagtttcgttccagcagcaggagacccggccccctcgttcgccatcctttgacgtaacccctcagttccagcatatctgcagagccgggtcagccgtgtcccgggccctggggagtggcttcaagggctggagtgctgtgtgcatgcagctcccgctcgtcccggtccttgctgttcggcacggaacacttgccgc

SEQ ID NO: 60687 - DNA, 201 bp, Bos taurus; identical to SEQ ID NO: 20156

SEQ ID NO: 60688 - DNA, 201 bp, Bos taurus
agaggaaggcccccctgcggtgtccctgcgccccctctgtgggcccccagggccgcccccaggactgcacagctgagcctgcggccctgaggagcggccaattcatctggaaggcatgaggctcggctgtctcatggacggatgaccctgagcttctaaggagactgagaggcgatggtcacactgggcatgtgagctgag

SEQ ID NO: 60689 - DNA, 201 bp, Bos taurus; identical to SEQ ID NO: 20158

SEQ ID NO: 60690 - DNA, 201 bp, Bos taurus; identical to SEQ ID NO: 20160

SEQ ID NO: 60691 - DNA, 201 bp, Bos taurus; identical to SEQ ID NO: 20161

SEQ ID NO: 60692 - DNA, 201 bp, Bos taurus; identical to SEQ ID NO: 20162

SEQ ID NO: 60693 - DNA, 201 bp, Bos taurus
ccttctgtgtccccagaaaaggaagagccaggtccaccacagtccagccctttagctgcctgctacccggacccacgtgtcttctccgtgaaagagggccgcctttccataacagagtccctcccggatgtctcctggagacattccctgcagctcccctacatcccactcggttcaggcgctctgggacctcctggccag

SEQ ID NO: 60694 - DNA, 201 bp, Bos taurus
cggtgggcaccgtgcccacctggggcgctccatgtcggtgttcctgaactcacgtcttcatatttactcttgccgcgccaattgaattagaaaaggccattgtgcactttagaagcaagagtcctcgtaaatactttattggaacaagctcaggatttacttgctcataaagataccctggacggctctgctccgtgatga

SEQ ID NO: 60695 - DNA, 201 bp, Bos taurus; identical to SEQ ID NO: 20163

SEQ ID NO: 60696 - DNA, 201 bp, Bos taurus; identical to SEQ ID NO: 20164

SEQ ID NO: 60697 - DNA, 201 bp, Bos taurus; identical to SEQ ID NO: 20165

SEQ ID NO: 60698 - DNA, 201 bp, Bos taurus; identical to SEQ ID NO: 20166

SEQ ID NO: 60699 - DNA, 201 bp, Bos taurus; identical to SEQ ID NO: 20167

SEQ ID NO: 60700 - DNA, 201 bp, Bos taurus; identical to SEQ ID NO: 20169

SEQ ID NO: 60701 - DNA, 201 bp, Bos taurus; identical to SEQ ID NO: 20170

SEQ ID NO: 60702 - DNA, 201 bp, Bos taurus; identical to SEQ ID NO: 20171

SEQ ID NO: 60703 - DNA, 201 bp, Bos taurus; identical to SEQ ID NO: 20174

SEQ ID NO: 60704 - DNA, 201 bp, Bos taurus
atatgtgtacatacctatgtttttttcatcctaagccctgcacactgtctcatttgtttgttctactttggacagccactgatttaaatggaacactttttcaaaattatccccaaatgtcaccaactgcagaagaaagtaatttgcactctgaagattgaagcaatagttttaagatgacagtcactaaatttttctaaa

SEQ ID NO: 60705 - DNA, 201 bp, Bos taurus
taaaactgtttatggggttttcatggcaagaagctggaatgggttgccattttatcctccagtggaccacactttgtcagaactctccactgtgaccggtccatcctgagtggccctgcttggcatgcctcatagcttcattgaattgtgcaaacccttcaccaagacaaggcagcgacccatgaaaggggtttggatgtt

SEQ ID NO: 60706 - DNA, 201 bp, Bos taurus
tctcttcctgagccccatctgggcccacaatgttgcctctacaatcttgtggtgagacaaccaggagacagatgatccttggaagggaaatactgtataatttccaattcctctagatatccaggccttcatcttccatgtttcctacaacatgtgcaacaacatcatctcttagtgaacatgctagggtgggtgacaggc

SEQ ID NO: 60707 - DNA, 201 bp, Bos taurus; identical to SEQ ID NO: 20175

SEQ ID NO: 60708 - DNA, 201 bp, Bos taurus; identical to SEQ ID NO: 20177

SEQ ID NO: 60709 - DNA, 201 bp, Bos taurus; identical to SEQ ID NO: 20178

SEQ ID NO: 60710 - DNA, 201 bp, Bos taurus; identical to SEQ ID NO: 20179

SEQ ID NO: 60711 - DNA, 201 bp, Bos taurus; identical to SEQ ID NO: 20182

SEQ ID NO: 60712 - DNA, 201 bp, Bos taurus
ttgatgttacacaagaaaaaatttatatcccaaaacttaataagagattttaaacaaaatgatttatctataaaataaaaattctcaagctatattccaaatacatttggtagaacatcaaaatcatggatattttgaacagcatgcctagtgtccacaaagggatgtgtgtacagaatgttgctgacactaataaaagaa

SEQ ID NO: 60713 - DNA, 201 bp, Bos taurus
tcctacattcaggaaacttgatcaactttagctttattattttcattataaatacgatggcagtgctttatccatatggctatatctcttgggacattgatgtgttcttttgcagataaaacatgagacattaattaaatgccatctttctccaaagcataagtaaactgcacatgataactcgattatctcagttaagca

SEQ ID NO: 60714 - DNA, 201 bp, Bos taurus
gagcccagcttttccaggaagcctgggccacggctgtctctgggagcaggcaaggacaggaggcaggctactgggccctggggcgcagctgagcaggcagggcaggtccgcagtcactccctcactcatggagggtgactttttgagagacaggaagtaaggagcgtgggtgggcagggccttcgacagaattttgaggag

SEQ ID NO: 60715 - DNA, 201 bp, Bos taurus
aggtagagatccaccttgtgggactgaaaggaggcgcttctttctttatcattcctgtgaatatttacgagggctctggcacaacatgactggtgctgctaagaccatgcctctcacagaatgctcatctttcccaactagaaacaaatgcaggaatacccctggtatgcacagggcttcattcatgactaatggagacag

SEQ ID NO: 60716 - DNA, 201 bp, Bos taurus; identical to SEQ ID NO: 20185

SEQ ID NO: 60717 - DNA, 201 bp, Bos taurus; identical to SEQ ID NO: 20186

SEQ ID NO: 60718 - DNA, 201 bp, Bos taurus
agagttgctggccaaaatccctctcagtaagggactggtctctgctgcccacggtggctcagcccagttctaaccctagcccactcatatactgaacacagtagaagtggccacatgtgcctgctatctcctctcaaacctgggacaggccagcagtgtttcccttacacacctttgatacaattaatgccagttgagatc

SEQ ID NO: 60719 - DNA, 201 bp, Bos taurus
tgaaaagcctcatgtttgaagaagtaatatacatagcttgagaatagctgagttagaattccagccctggcctactttactatacaatctagcttctttttaggatgcaacactgccttcattttttttggacagtaaaaataacatgactaaacaataaaaacttctggtcctatttagaagctatatattttcaccctc

SEQ ID NO: 60720 - DNA, 201 bp, Bos taurus; identical to SEQ ID NO: 20188

SEQ ID NO: 60721 - DNA, 201 bp, Bos taurus
cagggaagccatagcaagctctcttatcgtttcagtggccctcactgcagagctgagatgtgcagcaggtcattcaccctctgctctcccgcaggcagaaagtggtggggccatgctcactgcatagcacaagtctctccagaaatcttcctcacaaattctccttcattgccggaaacttgatcattttatcatggtggt

SEQ ID NO: 60722 - DNA, 201 bp, Bos taurus; identical to SEQ ID NO: 20190

SEQ ID NO: 60723 - DNA, 201 bp, Bos taurus; identical to SEQ ID NO: 20192

SEQ ID NO: 60724 - DNA, 201 bp, Bos taurus; identical to SEQ ID NO: 20193

SEQ ID NO: 60725 - DNA, 201 bp, Bos taurus; identical to SEQ ID NO: 20194

SEQ ID NO: 60726 - DNA, 201 bp, Bos taurus
gggtgttatagtgccccagataatttagattgtaatagaacccaacattgagctttggtaaaattgtttctcctgagggttggcctaataaagaggaacataatgctccagaatatttcaaaatggttccttttcgcctctgcctgccagatgcatgagatttgtctccagtatttgctacaagggcctgtaaaactcctg

SEQ ID NO: 60727 - DNA, 201 bp, Bos taurus
aaaaagtgatacaaaaaaattactaataagtttcttgatgtctgaaatgagcagcttcaactttaacttatttagtatggagactgaattcaccttctactgatgaattaggagcatttacaaatgcatggctagacacaggatgctaaattaaaatgactagactgcaaaaaacaaagctggcaaagccaacgctatttt

SEQ ID NO: 60728 - DNA, 201 bp, Bos taurus
ttaatgaactctgggaattggtgatggacagggaggccttctgtgctgcgatccatggagtcacaaagagtcagacatgactgagcgactgaactgaactgacacttcatagggtgtggcccattgcagagggaaagtgcccaggccatagaatgtggtgtggttagttttcatgatctgggtgatttcatatgctaatga

SEQ ID NO: 60729 - DNA, 201 bp, Bos taurus; identical to SEQ ID NO: 20200

SEQ ID NO: 60730 - DNA, 201 bp, Bos taurus; identical to SEQ ID NO: 20202

SEQ ID NO: 60731 - DNA, 201 bp, Bos taurus; identical to SEQ ID NO: 20203

SEQ ID NO: 60732 - DNA, 201 bp, Bos taurus; identical to SEQ ID NO: 20205

SEQ ID NO: 60733 - DNA, 201 bp, Bos taurus; identical to SEQ ID NO: 20212

SEQ ID NO: 60734 - DNA, 201 bp, Bos taurus; identical to SEQ ID NO: 20214

SEQ ID NO: 60735 - DNA, 201 bp, Bos taurus; identical to SEQ ID NO: 20217

SEQ ID NO: 60736 - DNA, 201 bp, Bos taurus; identical to SEQ ID NO: 20224

SEQ ID NO: 60737 - DNA, 201 bp, Bos taurus; identical to SEQ ID NO: 20227

SEQ ID NO: 60738 - DNA, 201 bp, Bos taurus; identical to SEQ ID NO: 20228

SEQ ID NO: 60739 - DNA, 201 bp, Bos taurus; identical to SEQ ID NO: 20229

SEQ ID NO: 60740 - DNA, 201 bp, Bos taurus; identical to SEQ ID NO: 20230

SEQ ID NO: 60741 - DNA, 201 bp, Bos taurus; identical to SEQ ID NO: 20231

SEQ ID NO: 60742 - DNA, 201 bp, Bos taurus; identical to SEQ ID NO: 20233

SEQ ID NO: 60743 - DNA, 201 bp, Bos taurus; identical to SEQ ID NO: 20235

SEQ ID NO: 60744 - DNA, 201 bp, Bos taurus; identical to SEQ ID NO: 20241

SEQ ID NO: 60745 - DNA, 201 bp, Bos taurus; identical to SEQ ID NO: 20242

SEQ ID NO: 60746 - DNA, 201 bp, Bos taurus; identical to SEQ ID NO: 20243

SEQ ID NO: 60747 - DNA, 201 bp, Bos taurus; identical to SEQ ID NO: 20244

SEQ ID NO: 60748 - DNA, 201 bp, Bos taurus; identical to SEQ ID NO: 20245

SEQ ID NO: 60749 - DNA, 201 bp, Bos taurus; identical to SEQ ID NO: 20247

SEQ ID NO: 60750 - DNA, 201 bp, Bos taurus; identical to SEQ ID NO: 20249

SEQ ID NO: 60751 - DNA, 201 bp, Bos taurus; identical to SEQ ID NO: 20250

SEQ ID NO: 60752 - DNA, 201 bp, Bos taurus; identical to SEQ ID NO: 20251

SEQ ID NO: 60753 - DNA, 201 bp, Bos taurus; identical to SEQ ID NO: 20252

SEQ ID NO: 60754 - DNA, 201 bp, Bos taurus; identical to SEQ ID NO: 20253

SEQ ID NO: 60755 - DNA, 201 bp, Bos taurus; identical to SEQ ID NO: 20254

SEQ ID NO: 60756 - DNA, 201 bp, Bos taurus; identical to SEQ ID NO: 20256

SEQ ID NO: 60757 - DNA, 201 bp, Bos taurus; identical to SEQ ID NO: 20259

SEQ ID NO: 60758 - DNA, 201 bp, Bos taurus; identical to SEQ ID NO: 20260

SEQ ID NO: 60759 - DNA, 201 bp, Bos taurus; identical to SEQ ID NO: 20261

SEQ ID NO: 60760 - DNA, 201 bp, Bos taurus; identical to SEQ ID NO: 20262

SEQ ID NO: 60761 - DNA, 201 bp, Bos taurus; identical to SEQ ID NO: 20263

SEQ ID NO: 60762 - DNA, 201 bp, Bos taurus; identical to SEQ ID NO: 20264

SEQ ID NO: 60763 - DNA, 201 bp, Bos taurus; identical to SEQ ID NO: 20265

SEQ ID NO: 60764 - DNA, 201 bp, Bos taurus; identical to SEQ ID NO: 20266

SEQ ID NO: 60765 - DNA, 201 bp, Bos taurus; identical to SEQ ID NO: 20267

SEQ ID NO: 60766 - DNA, 201 bp, Bos taurus; identical to SEQ ID NO: 20268

SEQ ID NO: 60767 - DNA, 201 bp, Bos taurus; identical to SEQ ID NO: 20269

SEQ ID NO: 60768 - DNA, 201 bp, Bos taurus; identical to SEQ ID NO: 20270

SEQ ID NO: 60769 - DNA, 201 bp, Bos taurus; identical to SEQ ID NO: 20271

SEQ ID NO: 60770 - DNA, 201 bp, Bos taurus; identical to SEQ ID NO: 20272

SEQ ID NO: 60771 - DNA, 201 bp, Bos taurus; identical to SEQ ID NO: 20273

SEQ ID NO: 60772 - DNA, 201 bp, Bos taurus; identical to SEQ ID NO: 20274

SEQ ID NO: 60773 - DNA, 201 bp, Bos taurus; identical to SEQ ID NO: 20275

SEQ ID NO: 60774 - DNA, 201 bp, Bos taurus; identical to SEQ ID NO: 20276

SEQ ID NO: 60775 - DNA, 201 bp, Bos taurus; identical to SEQ ID NO: 20277

SEQ ID NO: 60776 - DNA, 201 bp, Bos taurus; identical to SEQ ID NO: 20278

SEQ ID NO: 60777 - DNA, 201 bp, Bos taurus; identical to SEQ ID NO: 20279

SEQ ID NO: 60778 - DNA, 201 bp, Bos taurus; identical to SEQ ID NO: 20280

SEQ ID NO: 60779 - DNA, 201 bp, Bos taurus; identical to SEQ ID NO: 20281

SEQ ID NO: 60780 - DNA, 201 bp, Bos taurus; identical to SEQ ID NO: 20282

SEQ ID NO: 60781 - DNA, 201 bp, Bos taurus; identical to SEQ ID NO: 20283

SEQ ID NO: 60782 - DNA, 201 bp, Bos taurus; identical to SEQ ID NO: 20284

SEQ ID NO: 60783 - DNA, 201 bp, Bos taurus; identical to SEQ ID NO: 20285

SEQ ID NO: 60784 - DNA, 201 bp, Bos taurus; identical to SEQ ID NO: 20286

SEQ ID NO: 60785 - DNA, 201 bp, Bos taurus; identical to SEQ ID NO: 20287

SEQ ID NO: 60786 - DNA, 201 bp, Bos taurus; identical to SEQ ID NO: 20288

SEQ ID NO: 60787 - DNA, 201 bp, Bos taurus; identical to SEQ ID NO: 20289

SEQ ID NO: 60788 - DNA, 201 bp, Bos taurus; identical to SEQ ID NO: 20290

SEQ ID NO: 60789 - DNA, 201 bp, Bos taurus; identical to SEQ ID NO: 20291

SEQ ID NO: 60790 - DNA, 201 bp, Bos taurus; identical to SEQ ID NO: 20292

SEQ ID NO: 60791 - DNA, 201 bp, Bos taurus; identical to SEQ ID NO: 20293

SEQ ID NO: 60792 - DNA, 201 bp, Bos taurus; identical to SEQ ID NO: 20294

SEQ ID NO: 60793 - DNA, 201 bp, Bos taurus; identical to SEQ ID NO: 20296

SEQ ID NO: 60794 - DNA, 201 bp, Bos taurus; identical to SEQ ID NO: 20297

SEQ ID NO: 60795 - DNA, 201 bp, Bos taurus; identical to SEQ ID NO: 20298

SEQ ID NO: 60796 - DNA, 201 bp, Bos taurus; identical to SEQ ID NO: 20299

SEQ ID NO: 60797 - DNA, 201 bp, Bos taurus; identical to SEQ ID NO: 20300

SEQ ID NO: 60798 - DNA, 201 bp, Bos taurus; identical to SEQ ID NO: 20301

SEQ ID NO: 60799 - DNA, 201 bp, Bos taurus; identical to SEQ ID NO: 20302

SEQ ID NO: 60800 - DNA, 201 bp, Bos taurus; identical to SEQ ID NO: 20303

SEQ ID NO: 60801 - DNA, 201 bp, Bos taurus; identical to SEQ ID NO: 20304

SEQ ID NO: 60802 - DNA, 201 bp, Bos taurus; identical to SEQ ID NO: 20305

SEQ ID NO: 60803 - DNA, 201 bp, Bos taurus; identical to SEQ ID NO: 20306

SEQ ID NO: 60804 - DNA, 201 bp, Bos taurus; identical to SEQ ID NO: 20307

SEQ ID NO: 60805 - DNA, 201 bp, Bos taurus; identical to SEQ ID NO: 20308

SEQ ID NO: 60806 - DNA, 201 bp, Bos taurus; identical to SEQ ID NO: 20309

SEQ ID NO: 60807 - DNA, 201 bp, Bos taurus; identical to SEQ ID NO: 20310

SEQ ID NO: 60808 - DNA, 201 bp, Bos taurus; identical to SEQ ID NO: 20311

SEQ ID NO: 60809 - DNA, 201 bp, Bos taurus; identical to SEQ ID NO: 20312

SEQ ID NO: 60810 - DNA, 201 bp, Bos taurus; identical to SEQ ID NO: 20313

SEQ ID NO: 60811 - DNA, 201 bp, Bos taurus; identical to SEQ ID NO: 20314

SEQ ID NO: 60812 - DNA, 201 bp, Bos taurus; identical to SEQ ID NO: 20315

SEQ ID NO: 60813 - DNA, 201 bp, Bos taurus; identical to SEQ ID NO: 20316

SEQ ID NO: 60814 - DNA, 201 bp, Bos taurus; identical to SEQ ID NO: 20317

SEQ ID NO: 60815 - DNA, 201 bp, Bos taurus; identical to SEQ ID NO: 20318

SEQ ID NO: 60816 - DNA, 201 bp, Bos taurus; identical to SEQ ID NO: 20319

SEQ ID NO: 60817 - DNA, 201 bp, Bos taurus; identical to SEQ ID NO: 20320

SEQ ID NO: 60818 - DNA, 201 bp, Bos taurus; identical to SEQ ID NO: 20321

SEQ ID NO: 60819 - DNA, 201 bp, Bos taurus; identical to SEQ ID NO: 20322

SEQ ID NO: 60820 - DNA, 201 bp, Bos taurus; identical to SEQ ID NO: 20323

SEQ ID NO: 60821 - DNA, 201 bp, Bos taurus; identical to SEQ ID NO: 20324

SEQ ID NO: 60822 - DNA, 201 bp, Bos taurus; identical to SEQ ID NO: 20325

SEQ ID NO: 60823 - DNA, 201 bp, Bos taurus; identical to SEQ ID NO: 20326

SEQ ID NO: 60824 - DNA, 201 bp, Bos taurus; identical to SEQ ID NO: 20327

SEQ ID NO: 60825 - DNA, 201 bp, Bos taurus; identical to SEQ ID NO: 20328

SEQ ID NO: 60826 - DNA, 201 bp, Bos taurus; identical to SEQ ID NO: 20329

SEQ ID NO: 60827 - DNA, 201 bp, Bos taurus; identical to SEQ ID NO: 20330

SEQ ID NO: 60828 - DNA, 201 bp, Bos taurus; identical to SEQ ID NO: 20331

SEQ ID NO: 60829 - DNA, 201 bp, Bos taurus; identical to SEQ ID NO: 20332

SEQ ID NO: 60830 - DNA, 201 bp, Bos taurus; identical to SEQ ID NO: 20333

SEQ ID NO: 60831 - DNA, 201 bp, Bos taurus; identical to SEQ ID NO: 20334

SEQ ID NO: 60832 - DNA, 201 bp, Bos taurus; identical to SEQ ID NO: 20335

SEQ ID NO: 60833 - DNA, 201 bp, Bos taurus; identical to SEQ ID NO: 20337

SEQ ID NO: 60834 - DNA, 201 bp, Bos taurus; identical to SEQ ID NO: 20338

SEQ ID NO: 60835 - DNA, 201 bp, Bos taurus; identical to SEQ ID NO: 20339

SEQ ID NO: 60836 - DNA, 201 bp, Bos taurus; identical to SEQ ID NO: 20340

SEQ ID NO: 60837 - DNA, 201 bp, Bos taurus; identical to SEQ ID NO: 20341

SEQ ID NO: 60838 - DNA, 201 bp, Bos taurus; identical to SEQ ID NO: 20342

SEQ ID NO: 60839 - DNA, 201 bp, Bos taurus; identical to SEQ ID NO: 20343

SEQ ID NO: 60840 - DNA, 201 bp, Bos taurus; identical to SEQ ID NO: 20344

SEQ ID NO: 60841 - DNA, 201 bp, Bos taurus; identical to SEQ ID NO: 20345

SEQ ID NO: 60842 - DNA, 201 bp, Bos taurus; identical to SEQ ID NO: 20346

SEQ ID NO: 60843 - DNA, 201 bp, Bos taurus; identical to SEQ ID NO: 20347

SEQ ID NO: 60844 - DNA, 201 bp, Bos taurus; identical to SEQ ID NO: 20348

SEQ ID NO: 60845 - DNA, 201 bp, Bos taurus; identical to SEQ ID NO: 20349

SEQ ID NO: 60846 - DNA, 201 bp, Bos taurus; identical to SEQ ID NO: 20350

SEQ ID NO: 60847 - DNA, 201 bp, Bos taurus; identical to SEQ ID NO: 20351

SEQ ID NO: 60848 - DNA, 201 bp, Bos taurus; identical to SEQ ID NO: 20352

SEQ ID NO: 60849 - DNA, 201 bp, Bos taurus; identical to SEQ ID NO: 20353

SEQ ID NO: 60850 - DNA, 201 bp, Bos taurus; identical to SEQ ID NO: 20354

SEQ ID NO: 60851 - DNA, 201 bp, Bos taurus; identical to SEQ ID NO: 20355

SEQ ID NO: 60852 - DNA, 201 bp, Bos taurus; identical to SEQ ID NO: 20356

SEQ ID NO: 60853 - DNA, 201 bp, Bos taurus; identical to SEQ ID NO: 20357

SEQ ID NO: 60854 - DNA, 201 bp, Bos taurus; identical to SEQ ID NO: 20358

SEQ ID NO: 60855 - DNA, 201 bp, Bos taurus; identical to SEQ ID NO: 20359

SEQ ID NO: 60856 - DNA, 201 bp, Bos taurus; identical to SEQ ID NO: 20360

SEQ ID NO: 60857 - DNA, 201 bp, Bos taurus; identical to SEQ ID NO: 20361

SEQ ID NO: 60858 - DNA, 201 bp, Bos taurus; identical to SEQ ID NO: 20362

SEQ ID NO: 60859 - DNA, 201 bp, Bos taurus; identical to SEQ ID NO: 20363

SEQ ID NO: 60860 - DNA, 201 bp, Bos taurus; identical to SEQ ID NO: 20364

SEQ ID NO: 60861 - DNA, 201 bp, Bos taurus; identical to SEQ ID NO: 20365

SEQ ID NO: 60862 - DNA, 201 bp, Bos taurus; identical to SEQ ID NO: 20366

SEQ ID NO: 60863 - DNA, 201 bp, Bos taurus; identical to SEQ ID NO: 20367

SEQ ID NO: 60864 - DNA, 201 bp, Bos taurus; identical to SEQ ID NO: 20368

SEQ ID NO: 60865 - DNA, 201 bp, Bos taurus; identical to SEQ ID NO: 20369

SEQ ID NO: 60866 - DNA, 201 bp, Bos taurus; identical to SEQ ID NO: 20370

SEQ ID NO: 60867 - DNA, 201 bp, Bos taurus; identical to SEQ ID NO: 20372

SEQ ID NO: 60868 - DNA, 201 bp, Bos taurus; identical to SEQ ID NO: 20373

SEQ ID NO: 60869 - DNA, 201 bp, Bos taurus; identical to SEQ ID NO: 20374

SEQ ID NO: 60870 - DNA, 201 bp, Bos taurus; identical to SEQ ID NO: 20375

SEQ ID NO: 60871 - DNA, 201 bp, Bos taurus; identical to SEQ ID NO: 20376

SEQ ID NO: 60872 - DNA, 201 bp, Bos taurus; identical to SEQ ID NO: 20377

SEQ ID NO: 60873 - DNA, 201 bp, Bos taurus; identical to SEQ ID NO: 20379

SEQ ID NO: 60874 - DNA, 201 bp, Bos taurus; identical to SEQ ID NO: 20380

SEQ ID NO: 60875 - DNA, 201 bp, Bos taurus
taatagtacaagaaatttttaactccggtgaagtctgcttatgcatctaacggatggtagtacttctgataaccacaggagggcgtatgtcagccagttcccgaagagagcagcttgtttcgtccgtctctaaatcggttttccttgatgatgagtatcaaacagctctctccccccagagtgtatcaattttactatcaa

SEQ ID NO: 60876 - DNA, 201 bp, Bos taurus; identical to SEQ ID NO: 20382

SEQ ID NO: 60877 - DNA, 201 bp, Bos taurus
cccagatgtaggaatggagaatctcaacagtaaactggatgtagcactggcaggatatacaatgaatgtggtaaaagcaaatggacgcaaggacattacagctatggaaagaaagaatgtcaactaatgaaagcaaaactatattaggaagttgaaagggacaaaaactttaggaaaaagaggaaagttcagggacctggg

SEQ ID NO: 60878 - DNA, 201 bp, Bos taurus
gagaaagaaaatataacgtctcagcccgatacactgcgggatgttgactcactttgcaacaatagtccttcatgaatgtagaaaggaagctagtcttttatgcaatgagttcagttcaaacaaatctctcctaaccctgcgttgctacaggaatagatgtcgccaatgttaatatctgtattggacactctgtgtaattat

SEQ ID NO: 60879 - DNA, 201 bp, Bos taurus; identical to SEQ ID NO: 20383

SEQ ID NO: 60880 - DNA, 201 bp, Bos taurus; identical to SEQ ID NO: 20386

SEQ ID NO: 60881 - DNA, 201 bp, Bos taurus; identical to SEQ ID NO: 20389

SEQ ID NO: 60882 - DNA, 201 bp, Bos taurus; identical to SEQ ID NO: 20390

SEQ ID NO: 60883 - DNA, 201 bp, Bos taurus; identical to SEQ ID NO: 20391

SEQ ID NO: 60884 - DNA, 201 bp, Bos taurus; identical to SEQ ID NO: 20392

SEQ ID NO: 60885 - DNA, 201 bp, Bos taurus; identical to SEQ ID NO: 20393

SEQ ID NO: 60886 - DNA, 201 bp, Bos taurus; identical to SEQ ID NO: 20394

SEQ ID NO: 60887 - DNA, 201 bp, Bos taurus; identical to SEQ ID NO: 20395

SEQ ID NO: 60888 - DNA, 201 bp, Bos taurus; identical to SEQ ID NO: 20396

SEQ ID NO: 60889 - DNA, 201 bp, Bos taurus
cgggtacctatgatagactcatgtcttcactaatagctgttgttgcattggggccaacccatggaccactgctggcttcttggtccacacctttactgagacactgccaggttctcctcttatttttcagcgatttttcttggttacattgtgagatgacacactgagtttcctggcccagaatagtcatttcagtagcgc

SEQ ID NO: 60890 - DNA, 201 bp, Bos taurus
gatacagacaaagagggagcaagatatcagagggaatgggattaataacacagggaaaatagaacatccttttcttttgtactggaaagaataaaccaatgaataaatctgaatcaagtgccaatggttctctacaccctgagctaggaattaaggatgggtggtgattgataaagacagacaaaatacctcagttcatag

SEQ ID NO: 60891 - DNA, 201 bp, Bos taurus; identical to SEQ ID NO: 20399

SEQ ID NO: 60892 - DNA, 201 bp, Bos taurus
cagtgactcagacacactttgaagctgtattttagtgcatccttacaggactgaagataaatgggaagaactgtaaatagtagcaatattatccaggacttgcaagagagaacagaaaactgttatacatatatattaactggcagtgcttaaagtttagactgcatcagaattaccttgagatcttcttcaaagtgaatc

SEQ ID NO: 60893 - DNA, 201 bp, Bos taurus; identical to SEQ ID NO: 20401

SEQ ID NO: 60894 - DNA, 201 bp, Bos taurus
gacttgcaatttcttggctgactacagtttatttctcaaacaatttaacttgtataatctcctgagaaatatctgagggtgtagaatacatgggaaaatggtctgttttgcttagaaatatgtttttaaattttaagtggttaggtaatgtacatacagaaaacttctgaagttttattcattctcataaacttacaggtt

SEQ ID NO: 60895 - DNA, 201 bp, Bos taurus; identical to SEQ ID NO: 20402

SEQ ID NO: 60896 - DNA, 201 bp, Bos taurus; identical to SEQ ID NO: 20403

SEQ ID NO: 60897 - DNA, 201 bp, Bos taurus; identical to SEQ ID NO: 20404

SEQ ID NO: 60898 - DNA, 201 bp, Bos taurus; identical to SEQ ID NO: 20405

SEQ ID NO: 60899 - DNA, 201 bp, Bos taurus; identical to SEQ ID NO: 20406

SEQ ID NO: 60900 - DNA, 201 bp, Bos taurus; identical to SEQ ID NO: 20408

SEQ ID NO: 60901 - DNA, 201 bp, Bos taurus; identical to SEQ ID NO: 20410

SEQ ID NO: 60902 - DNA, 201 bp, Bos taurus; identical to SEQ ID NO: 20412

SEQ ID NO: 60903 - DNA, 201 bp, Bos taurus; identical to SEQ ID NO: 20413

SEQ ID NO: 60904 - DNA, 201 bp, Bos taurus
ggagttcagaatcagaagggtcacctcagattcaagtttaacaaagttactgtggagggtataaaatctcagagaggaaattgaatgagcaaatcagttccaagcattagagtaaaattcccaactgaacagctccacggcagttacaatcacgagcagtgaaatcacctttcaaaacacgatcatggcaagcaccaccta

SEQ ID NO: 60905 - DNA, 201 bp, Bos taurus; identical to SEQ ID NO: 20414

SEQ ID NO: 60906 - DNA, 201 bp, Bos taurus
cagtcactgatgacaccagtggtggcttaggcagccaagataaatacccacttggaggatccaggaggtgagagtaagccatgggactcccaccacgaccatgggaactgcacatctaggttctttcatgttgtggagaatcggagcccgtgtttatttggtgcaaaggacttatttggatattgctggccaaatggctgt

SEQ ID NO: 60907 - DNA, 201 bp, Bos taurus; identical to SEQ ID NO: 20415

SEQ ID NO: 60908 - DNA, 201 bp, Bos taurus; identical to SEQ ID NO: 20416

SEQ ID NO: 60909 - DNA, 201 bp, Bos taurus; identical to SEQ ID NO: 20417

SEQ ID NO: 60910 - DNA, 201 bp, Bos taurus; identical to SEQ ID NO: 20418

SEQ ID NO: 60911 - DNA, 201 bp, Bos taurus; identical to SEQ ID NO: 20419

SEQ ID NO: 60912 - DNA, 201 bp, Bos taurus; identical to SEQ ID NO: 20421

SEQ ID NO: 60913 - DNA, 201 bp, Bos taurus
atagcttgttttatgtgactgtttactataagtttctaatgttgtataaataaaaaacttgaaaatcttactttttaaagccaactatacatggcagaggggtctagtctgatagataagcttataatgtccactgaaacaagaaaaagaaatttaattgaaaatctattccaacccatctctatatctccaaaagaaaag

SEQ ID NO: 60914 - DNA, 201 bp, Bos taurus
tgttaagtctggagagcttaagtttggacagctgttcctctctttgtctcctttcctgtttcctgtgttctaagggatgccttatagtaaacctattccagcttggtggggcctggatttccatcagcgacgtttagaatcaccataaaaggaattccctgggagcctagtgaactaaggtcccgcaagctgtgtcagttc

SEQ ID NO: 60915 - DNA, 201 bp, Bos taurus; identical to SEQ ID NO: 20422

SEQ ID NO: 60916 - DNA, 201 bp, Bos taurus; identical to SEQ ID NO: 20424

SEQ ID NO: 60917 - DNA, 201 bp, Bos taurus
tgcagggtacgggccactctgggcagcaccaacacagactcagacacccagaccttcctctcactttcccttctcttctctctcttctgctccaggagtgcggagtctggggaaatcctgaacgagctcatcaggatgcagctgctgggcggctcaatcctacttaatgtctatgtcagcacatccctcgcctcttttaag

SEQ ID NO: 60918 - DNA, 201 bp, Bos taurus; identical to SEQ ID NO: 20427

SEQ ID NO: 60919 - DNA, 201 bp, Bos taurus; identical to SEQ ID NO: 20428

SEQ ID NO: 60920 - DNA, 201 bp, Bos taurus
cccactataattgtcaccctgccatttaatttctgtcatatgagttttctaaaatttaaatatagtcatcttgcttactgatccagattttccagtggctcttagaaccttatgataaaattatgtgccttttgcatgatagatgaagccttcataattggacacctgcccacctccattacatcattcctttttacacat

SEQ ID NO: 60921 - DNA, 201 bp, Bos taurus; identical to SEQ ID NO: 20430

SEQ ID NO: 60922 - DNA, 201 bp, Bos taurus
gcctgcttacccctaccaaatgaatcagagactgaatattcatctgaagttgttgttcctaaaacactttgccaagtccaggaatcttttcagttgacagcgatattttcctctacaaagcagagtaagtctggctgcctattccaccattttgtcaggttcattgtggtgatatatttcttccttttatagatgaagcta

SEQ ID NO: 60923 - DNA, 201 bp, Bos taurus; identical to SEQ ID NO: 20431

SEQ ID NO: 60924 - DNA, 201 bp, Bos taurus; identical to SEQ ID NO: 20433

SEQ ID NO: 60925 - DNA, 201 bp, Bos taurus; identical to SEQ ID NO: 20434

SEQ ID NO: 60926 - DNA, 201 bp, Bos taurus; identical to SEQ ID NO: 20435

SEQ ID NO: 60927 - DNA, 201 bp, Bos taurus; identical to SEQ ID NO: 20436

SEQ ID NO: 60928 - DNA, 201 bp, Bos taurus
aaatactaaaaactactgagaaaaagacagcattagtcatggtctgccatttagcaactaaacacagaagcctcatgtgtgttgcatgggttgatatttacattggcttgtttttacagctcagagcatccttatataaaagacttgaatatttttgtataattctaataactatgtttattattaatatatcctgtgagt

SEQ ID NO: 60929 - DNA, 201 bp, Bos taurus; identical to SEQ ID NO: 20437

SEQ ID NO: 60930 - DNA, 201 bp, Bos taurus; identical to SEQ ID NO: 20438

SEQ ID NO: 60931 - DNA, 201 bp, Bos taurus; identical to SEQ ID NO: 20439

SEQ ID NO: 60932 - DNA, 201 bp, Bos taurus; identical to SEQ ID NO: 20440

SEQ ID NO: 60933 - DNA, 201 bp, Bos taurus; identical to SEQ ID NO: 20441

SEQ ID NO: 60934 - DNA, 201 bp, Bos taurus; identical to SEQ ID NO: 20442

SEQ ID NO: 60935 - DNA, 201 bp, Bos taurus; identical to SEQ ID NO: 20443

SEQ ID NO: 60936 - DNA, 201 bp, Bos taurus; identical to SEQ ID NO: 20444

SEQ ID NO: 60937 - DNA, 201 bp, Bos taurus; identical to SEQ ID NO: 20445

SEQ ID NO: 60938 - DNA, 201 bp, Bos taurus; identical to SEQ ID NO: 20446

SEQ ID NO: 60939 - DNA, 201 bp, Bos taurus; identical to SEQ ID NO: 20447

SEQ ID NO: 60940 - DNA, 201 bp, Bos taurus
gctgattaacagatgaccagaatacttaatatgttagaaaaagaacatctctcttagttggaaaaaaaaattgaaattgcacagttactggacagagatacaaataaactaggaaagtaggggagtgtagagtcctaaggtgtgacaataccaataaacagagaaccaaaatgaataaggaatactagtctgaattaaaag

SEQ ID NO: 60941 - DNA, 201 bp, Bos taurus; identical to SEQ ID NO: 20448

SEQ ID NO: 60942 - DNA, 201 bp, Bos taurus
aaaagtatcttagataatgtctatctattttgtccatcactgtaattaagtaaatatagcgatatctgatgtgtaagacaggctaaatccatatttgtaaattaattttcaagggaataaaaaataattgagctgtgaatagcaattttagctgcatattgctgagaggtaatagacataattgctacataagaaaatggc

SEQ ID NO: 60943 - DNA, 201 bp, Bos taurus; identical to SEQ ID NO: 20449

SEQ ID NO: 60944 - DNA, 201 bp, Bos taurus
gtgtaatgtgtccagatataatgccacttgataacattctaaattttatctttaattgttctgtttcacacactcatcttgtgaaacaggtgatgagctttgtgagaacagaggagtatttgtagcaatagattgtttagtgctaaagagaatgtactttagaactgaatcttggtttttcaacttaaaaactatgtaact

SEQ ID NO: 60945 - DNA, 201 bp, Bos taurus; identical to SEQ ID NO: 20455

SEQ ID NO: 60946 - DNA, 201 bp, Bos taurus; identical to SEQ ID NO: 20456

SEQ ID NO: 60947 - DNA, 201 bp, Bos taurus
taaatttatatttcagttgagtttggaattatatctctccactgagaagagagagttttagtgtgtggatttaaaataaacttttctttaccaaaaatatgtagtgaacttcactggtagaaatgagaaacaatagagagcttagttataatatatagcatgctagaggcaggctcagatcatagaattatagacggttag

SEQ ID NO: 60948 - DNA, 201 bp, Bos taurus
gtgtattatgggagtgggtctggtaagatctttctattgttagctctaatcctgccattttaaaatgtaaattgtggaagtggtgctagtaagacctttaaaaccttgagatattcttttgattaactgtaataaccaactgcagtgtaatataattatataatggttactgtaataaccatgaaaagtatgaaaatacaa

SEQ ID NO: 60949 - DNA, 201 bp, Bos taurus; identical to SEQ ID NO: 20457

SEQ ID NO: 60950 - DNA, 201 bp, Bos taurus; identical to SEQ ID NO: 20458

SEQ ID NO: 60951 - DNA, 201 bp, Bos taurus
cagggagtctagtaaaatcccacacaatcttgactacaaggattgttatgaaaatataactctaattcagtttattaaacataaaagttatcttatgtggaattaaatttggcactgcctttccataaaccatgccagatacagatagaacttccttaggtttgttcatttctcatcagctaagaagttaaactaatctta

SEQ ID NO: 60952 - DNA, 201 bp, Bos taurus
ttcttgcctgggaaatcccatggacagaggatactggtgggctacagtccatagggtcataaagaaatggacacagctaaagcgacagcatacacgtacatatggcccacacacaggaaaaaaaaaagaagccaaagctgcctgatggaggaccaagatgttgggtttaacagacaaaaacatcaaaggaaccattataaa

SEQ ID NO: 60953 - DNA, 201 bp, Bos taurus
agattatagataagaatattttaaaatttgagtttcttctaacctcaggagtctatagattaaaatatttgcttgacctttaatacaagcaggaacccaataattccagcaataattacaaaaatattactacctcccgtttattaagcatttattttcctgtttatcttacttgagaccttttcaattgttttcttttgt

SEQ ID NO: 60954 - DNA, 201 bp, Bos taurus; identical to SEQ ID NO: 20459

SEQ ID NO: 60955 - DNA, 201 bp, Bos taurus; identical to SEQ ID NO: 20462

SEQ ID NO: 60956 - DNA, 201 bp, Bos taurus; identical to SEQ ID NO: 20465

SEQ ID NO: 60957 - DNA, 201 bp, Bos taurus
gtaagagttccaatagtgtagcttatggctgttctaatcttgagctctttttagatttttacatgattagtcagaaaaccagattctttcacctcttcccgttgttaattgtggattgatatttgagaaaatgataaagtaatgataaagctgaaaatataatattttgaaattaaagcattcttcttttagtaacatgaa

SEQ ID NO: 60958 - DNA, 201 bp, Bos taurus; identical to SEQ ID NO: 20466

SEQ ID NO: 60959 - DNA, 201 bp, Bos taurus; identical to SEQ ID NO: 20468

SEQ ID NO: 60960 - DNA, 201 bp, Bos taurus
tcctcccttgtgttacgacttaagcacaaaatctgggtcttcctttgctctaattatggcttcagttatccctactgtataaacaataattcccatagacctcatctctttctctaatttggctttcatcagctcctggatttccaaatgtatctaaggcatttctgggacaaccttccaaacctataatatcctgaatta

SEQ ID NO: 60961 - DNA, 201 bp, Bos taurus
agttttaagctctggaaaatgtcatttctttaagcatggataaaaagaaacactggaaaatagaagtaaaatatttcatcatttttgaggttttgcacttctactctctgcttcttggaccctacttattattggctcatctttctctttgaaccatgtttatctgctttgttactaacctccactaacataaaaaggcga

SEQ ID NO: 60962 - DNA, 201 bp, Bos taurus; identical to SEQ ID NO: 20469

SEQ ID NO: 60963 - DNA, 201 bp, Bos taurus; identical to SEQ ID NO: 20470

SEQ ID NO: 60964 - DNA, 201 bp, Bos taurus; identical to SEQ ID NO: 20471

SEQ ID NO: 60965 - DNA, 201 bp, Bos taurus; identical to SEQ ID NO: 20472

SEQ ID NO: 60966 - DNA, 201 bp, Bos taurus; identical to SEQ ID NO: 20473

SEQ ID NO: 60967 - DNA, 201 bp, Bos taurus
ccggttagatgaaggagacaaaggaaggattggtctgatacccacccaaggtggaccggagtgagaagagctgggcctggttaggagggaatagcagaactgtaggaaagagggcttgttctgggcagtacatgaagccctgccaggaaacgcacggacacctctagcacacagggagcccctccttgctctgggcctggc

SEQ ID NO: 60968 - DNA, 201 bp, Bos taurus
ccaattgttttaaaatgaggtggtttctagtatctgctaataggagcaataaatttttaaaaatcattatcattatgaactcatgaattgtagtttattgaaataaaagtccttactgaggctcaaattttcccatctttggcaagtgagatccttttcagattgggtcttgtgtctgttcacaatatgacccttgtaatc

SEQ ID NO: 60969 - DNA, 201 bp, Bos taurus
gctccagcaaagggcagccgccactccttacctctgacgcggggtagcttgtctcagccactgcccccaacctctggcccggggtagctcctctcagccacgctcctgccctgagcacaagtatctctttaagtatctctcttcagttcagttcagtcgctcagacatgtccgactctttgcaaccccatgaatcgcagca

SEQ ID NO: 60970 - DNA, 201 bp, Bos taurus; identical to SEQ ID NO: 20474

SEQ ID NO: 60971 - DNA, 201 bp, Bos taurus; identical to SEQ ID NO: 20475

SEQ ID NO: 60972 - DNA, 201 bp, Bos taurus; identical to SEQ ID NO: 20476

SEQ ID NO: 60973 - DNA, 201 bp, Bos taurus
gggagagcaagacaccactgttccaacctgctggaggatcgcatggaacagagctgtgccagacccagccccagggctcgtgcacatgggggcctccagaacagagaactctgcccatagagcttgggcagaggtggtgtcattccctaggcattaccattcctcctttcacaggaccctatgacaccaaagcacgagacc

SEQ ID NO: 60974 - DNA, 201 bp, Bos taurus; identical to SEQ ID NO: 20478

SEQ ID NO: 60975 - DNA, 201 bp, Bos taurus; identical to SEQ ID NO: 20479

SEQ ID NO: 60976 - DNA, 201 bp, Bos taurus; identical to SEQ ID NO: 20480

SEQ ID NO: 60977 - DNA, 201 bp, Bos taurus; identical to SEQ ID NO: 20481

SEQ ID NO: 60978 - DNA, 201 bp, Bos taurus; identical to SEQ ID NO: 20482

SEQ ID NO: 60979 - DNA, 201 bp, Bos taurus; identical to SEQ ID NO: 20483

SEQ ID NO: 60980 - DNA, 201 bp, Bos taurus; identical to SEQ ID NO: 20484

SEQ ID NO: 60981 - DNA, 201 bp, Bos taurus; identical to SEQ ID NO: 20485

SEQ ID NO: 60982 - DNA, 201 bp, Bos taurus; identical to SEQ ID NO: 20486

SEQ ID NO: 60983 - DNA, 201 bp, Bos taurus; identical to SEQ ID NO: 20488

SEQ ID NO: 60984 - DNA, 201 bp, Bos taurus; identical to SEQ ID NO: 20489

SEQ ID NO: 60985 - DNA, 201 bp, Bos taurus; identical to SEQ ID NO: 20490

SEQ ID NO: 60986 - DNA, 201 bp, Bos taurus
caggtatttttgtataacacgacaaatgttagatatattgtttactgtcattattactttgaaaccggtagctattagactccccactaaatctgactatataatgcattaagcagcacatacaccatgacatcacatgtgtatttaactttttgacaattatatttcagtacagttggtctcttttgtaaccctttgtgt

SEQ ID NO: 60987 - DNA, 201 bp, Bos taurus; identical to SEQ ID NO: 20491

SEQ ID NO: 60988 - DNA, 201 bp, Bos taurus; identical to SEQ ID NO: 20492

SEQ ID NO: 60989 - DNA, 201 bp, Bos taurus; identical to SEQ ID NO: 20493

SEQ ID NO: 60990 - DNA, 201 bp, Bos taurus; identical to SEQ ID NO: 20494

SEQ ID NO: 60991 - DNA, 201 bp, Bos taurus; identical to SEQ ID NO: 20495

SEQ ID NO: 60992 - DNA, 201 bp, Bos taurus; identical to SEQ ID NO: 20496

SEQ ID NO: 60993 - DNA, 201 bp, Bos taurus; identical to SEQ ID NO: 20497

SEQ ID NO: 60994 - DNA, 201 bp, Bos taurus; identical to SEQ ID NO: 20498

SEQ ID NO: 60995 - DNA, 201 bp, Bos taurus; identical to SEQ ID NO: 20499

SEQ ID NO: 60996 - DNA, 201 bp, Bos taurus; identical to SEQ ID NO: 20500

SEQ ID NO: 60997 - DNA, 201 bp, Bos taurus; identical to SEQ ID NO: 20501

SEQ ID NO: 60998 - DNA, 201 bp, Bos taurus; identical to SEQ ID NO: 20502

SEQ ID NO: 60999 - DNA, 201 bp, Bos taurus; identical to SEQ ID NO: 20503

SEQ ID NO: 61000 - DNA, 201 bp, Bos taurus; identical to SEQ ID NO: 20504

SEQ ID NO: 61001 - DNA, 201 bp, Bos taurus; identical to SEQ ID NO: 20505

SEQ ID NO: 61002 - DNA, 201 bp, Bos taurus; identical to SEQ ID NO: 20507

SEQ ID NO: 61003 - DNA, 201 bp, Bos taurus; identical to SEQ ID NO: 20508

SEQ ID NO: 61004 - DNA, 201 bp, Bos taurus; identical to SEQ ID NO: 20509

SEQ ID NO: 61005 - DNA, 201 bp, Bos taurus; identical to SEQ ID NO: 20510

SEQ ID NO: 61006 - DNA, 201 bp, Bos taurus; identical to SEQ ID NO: 20511

SEQ ID NO: 61007 - DNA, 201 bp, Bos taurus; identical to SEQ ID NO: 20513

SEQ ID NO: 61008 - DNA, 201 bp, Bos taurus; identical to SEQ ID NO: 20514

SEQ ID NO: 61009 - DNA, 201 bp, Bos taurus; identical to SEQ ID NO: 20515

SEQ ID NO: 61010 - DNA, 201 bp, Bos taurus; identical to SEQ ID NO: 20516

SEQ ID NO: 61011 - DNA, 201 bp, Bos taurus; identical to SEQ ID NO: 20517

SEQ ID NO: 61012 - DNA, 201 bp, Bos taurus
gctccatctcagaggcaaaaatgtttcaacctttaactattttctgtaacagttttccctcttattccagcaaaatgtacatattcttattttccagttactttatttcaaatgttatctacagatttcctgctctgagggtataggtctcttacaactcaaccctactgtctatctcatcagtcctatttaattttatca

SEQ ID NO: 61013 - DNA, 201 bp, Bos taurus; identical to SEQ ID NO: 20518

SEQ ID NO: 61014 - DNA, 201 bp, Bos taurus; identical to SEQ ID NO: 20519

SEQ ID NO: 61015 - DNA, 201 bp, Bos taurus; identical to SEQ ID NO: 20520

SEQ ID NO: 61016 - DNA, 201 bp, Bos taurus; identical to SEQ ID NO: 20521

SEQ ID NO: 61017 - DNA, 201 bp, Bos taurus
cgtgctgcgattcatgggtcgcaaagagttggacacgactgagtgactgatctgatctgatttgatctgatttatactgtgctcacaactgtgactacgttctggcccccagtcacctatctgctctgatacatacccctacattttactcacctgttgagttttttcactccattgctttacctttactcctgctgttac

SEQ ID NO: 61018 - DNA, 201 bp, Bos taurus
gcagggactgttggtattactgttacaggttagaatataggctaaaaagaaaagacaagcagtatcacatgcggtattggacttaagtgatacttttcatgatgttactgggagaagtctgttggaaatgtcacatataggtaaacagtataggtgagcatctttgaaatcactgtcatgttacctttatttctatagttc

SEQ ID NO: 61019 - DNA, 201 bp, Bos taurus
agagactgaacaaccactcacacaaatctaaatattaaaaatttaatagaaatattctcccaagagtaaagaattgccttagtcagattaggcagccatatcagaataacatagattgtgtaaagaatctgcatacaatgcaggagacccgggtttcatctctggatcccctggagaagggaatagcttacccactccaga

SEQ ID NO: 61020 - DNA, 201 bp, Bos taurus
cttaggaaacaaaaaaatacattttgcatattcttgtcctaaggaacctatgtgtatattagcaccagtacatcttttttgttaaatcaagagcataagagagtaaatttgtgatttggattccacagtctcttgctgtctcaagggcatctttctttcagttatcctttccctccactctaatattaagttattctctcc

SEQ ID NO: 61021 - DNA, 201 bp, Bos taurus; identical to SEQ ID NO: 20524

SEQ ID NO: 61022 - DNA, 201 bp, Bos taurus; identical to SEQ ID NO: 20525

SEQ ID NO: 61023 - DNA, 201 bp, Bos taurus
tcaccatcactatctattttcagaacatttttttcaccccagttagaacccttgtaagtcattggcagtcactgcctattctcctcacttcccaggccctagcaactactattctactttctgcctctgtggatttacctattctgggcatttcataaaaacagaatcatacaatatgtggcctgttatgtctggtctctt

SEQ ID NO: 61024 - DNA, 201 bp, Bos taurus
ataagtatagcttacaacagtaagactaaatttttaatgtagagattatacaaacatttgattgtatgagaagccaccttgggaattgataacatttttttaaatgatgtatctattgcataaaaccagattggattgataatgccccttttggcagaatcacagaatcctgattgagtaataaaatgatggtcttgtatg

SEQ ID NO: 61025 - DNA, 201 bp, Bos taurus; identical to SEQ ID NO: 20528

SEQ ID NO: 61026 - DNA, 201 bp, Bos taurus; identical to SEQ ID NO: 20529

SEQ ID NO: 61027 - DNA, 201 bp, Bos taurus
gtaattttgaatacttacagggaaccaaaacccgtaactacagttaaaggcaggtgtgactttgtatattcactggcaactggttaaccttgaaaacaattccaagcaagagaaaactctaaattcttagaaaactctaaagcatacctatatcccagctttgactcaggcttttcacaattataactcaaccagatttct

SEQ ID NO: 61028 - DNA, 201 bp, Bos taurus
ggtcttagaagacagagaaaccgagaagaaaggcatcaccttttcagtgcaccaagcaacattaatgccactcgacaggagggagcagggggcctgtctccgcgtggagaaggaagagaggaaatggaaacccaccaggagccacccaccacgtttaactggtcctgcgccagtatctttgcagctgtcactccgggaagg

SEQ ID NO: 61029 - DNA, 201 bp, Bos taurus
gagaactgtatggagcacaacttctacatcagctttggtcctgatgaacatctgccttgttcaaggtcctgttactgtggccctgtttctggcacagaactcctaaaactcttgatgagtacaataaaaagtgtcttttgttatgctaatgacatgacttttggaaagtacaggataggggccggttgccagaggacccaa

SEQ ID NO: 61030 - DNA, 201 bp, Bos taurus; identical to SEQ ID NO: 20530

SEQ ID NO: 61031 - DNA, 201 bp, Bos taurus; identical to SEQ ID NO: 20532

SEQ ID NO: 61032 - DNA, 201 bp, Bos taurus; identical to SEQ ID NO: 20533

SEQ ID NO: 61033 - DNA, 201 bp, Bos taurus; identical to SEQ ID NO: 20537

SEQ ID NO: 61034 - DNA, 201 bp, Bos taurus
tgtcagtatgctgagattttcaagtaggaagagctatttttcccccaaatcagagaaatggcatcacaatatgggccctccccttctaggcttcttcagagttgacaacttccaacaagctttagtgagagttgctcagtcatgtccaactttttgtgaccccatggatatatagtccatggaattctccaggccagaata

SEQ ID NO: 61035 - DNA, 201 bp, Bos taurus; identical to SEQ ID NO: 20540

SEQ ID NO: 61036 - DNA, 201 bp, Bos taurus; identical to SEQ ID NO: 20542

SEQ ID NO: 61037 - DNA, 201 bp, Bos taurus; identical to SEQ ID NO: 20543

SEQ ID NO: 61038 - DNA, 201 bp, Bos taurus; identical to SEQ ID NO: 20544

SEQ ID NO: 61039 - DNA, 201 bp, Bos taurus; identical to SEQ ID NO: 20545

SEQ ID NO: 61040 - DNA, 201 bp, Bos taurus
tccagttgaatagcaagtgtatatcaattgtttgattagaaaagatattctgagtactgccgtctgtctatgctggcctggatgggagacatggagatgtaagatattgcttctataattagagagtgtagagtctacttgaaatgcaatcttaagttgctcagttgtgtccgattctttgtggcctcgtggactatggtg

SEQ ID NO: 61041 - DNA, 201 bp, Bos taurus
tataaactcaaaagataaactaaaacctccactacttaacaatttttagtagttctgaacaagtgctataaatactagatgtttgttaacaaatttttgttccaaagaatatgtatcagggtagaaataaaagtaaatctctaccatatatacattaacaattactaacatgatttatttggtacaaaggatcttttctaa

SEQ ID NO: 61042 - DNA, 201 bp, Bos taurus; identical to SEQ ID NO: 20549

SEQ ID NO: 61043 - DNA, 201 bp, Bos taurus; identical to SEQ ID NO: 20550

SEQ ID NO: 61044 - DNA, 201 bp, Bos taurus; identical to SEQ ID NO: 20551

SEQ ID NO: 61045 - DNA, 201 bp, Bos taurus
ggccaaagactcaggctgtacaccaagccagagggagaatgctggcagtttagaggtgcatgcagtgggtacactaagacatagtccagcagggtcctccatacccaggcctgcaggcagcaccagcatatcaaacagtctgaaagctatgggcagaaaggggaaattggtagggctagttgggcttcacattgttgaaca

SEQ ID NO: 61046 - DNA, 201 bp, Bos taurus; identical to SEQ ID NO: 20553

SEQ ID NO: 61047 - DNA, 201 bp, Bos taurus; identical to SEQ ID NO: 20554

SEQ ID NO: 61048 - DNA, 201 bp, Bos taurus
tatcatgaggttggaaaaagagtagtgtaacgatgtcacagaattcagctggtggctaaaattcagctagtgggaaaagggacaaaagtagttttttctacaagactagttcagtttataacttaacaactctttgggtaaataaaaattcttgctctggctgttttgtttggttgtgatgagcaaaatccaatcgacgag

SEQ ID NO: 61049 - DNA, 201 bp, Bos taurus
tataaacaggaagaaactaagaatgtagaagagggctcctcactgaggctaagatttagaactcagaccagaatgaatcatacagtttgtaggccccatgcaaaatgtccattcaggtatgacctaaatcaaaacacttatgattatatagtgggggtgacaaatagattcaagtgattagatctgttagacagaggcctg

SEQ ID NO: 61050 - DNA, 201 bp, Bos taurus; identical to SEQ ID NO: 20555

SEQ ID NO: 61051 - DNA, 201 bp, Bos taurus; identical to SEQ ID NO: 20557

SEQ ID NO: 61052 - DNA, 201 bp, Bos taurus; identical to SEQ ID NO: 20558

SEQ ID NO: 61053 - DNA, 201 bp, Bos taurus; identical to SEQ ID NO: 20559

SEQ ID NO: 61054 - DNA, 201 bp, Bos taurus; identical to SEQ ID NO: 20560

SEQ ID NO: 61055 - DNA, 201 bp, Bos taurus; identical to SEQ ID NO: 20562

SEQ ID NO: 61056 - DNA, 201 bp, Bos taurus; identical to SEQ ID NO: 20564

SEQ ID NO: 61057 - DNA, 201 bp, Bos taurus; identical to SEQ ID NO: 20565

SEQ ID NO: 61058 - DNA, 201 bp, Bos taurus; identical to SEQ ID NO: 20567

SEQ ID NO: 61059 - DNA, 201 bp, Bos taurus; identical to SEQ ID NO: 20568

SEQ ID NO: 61060 - DNA, 201 bp, Bos taurus; identical to SEQ ID NO: 20569

SEQ ID NO: 61061 - DNA, 201 bp, Bos taurus; identical to SEQ ID NO: 20570

SEQ ID NO: 61062 - DNA, 201 bp, Bos taurus; identical to SEQ ID NO: 20571

SEQ ID NO: 61063 - DNA, 201 bp, Bos taurus; identical to SEQ ID NO: 20572

SEQ ID NO: 61064 - DNA, 201 bp, Bos taurus; identical to SEQ ID NO: 20574

SEQ ID NO: 61065 - DNA, 201 bp, Bos taurus; identical to SEQ ID NO: 20575

SEQ ID NO: 61066 - DNA, 201 bp, Bos taurus; identical to SEQ ID NO: 20576

SEQ ID NO: 61067 - DNA, 201 bp, Bos taurus; identical to SEQ ID NO: 20577

SEQ ID NO: 61068 - DNA, 201 bp, Bos taurus; identical to SEQ ID NO: 20578

SEQ ID NO: 61069 - DNA, 201 bp, Bos taurus; identical to SEQ ID NO: 20579

SEQ ID NO: 61070 - DNA, 201 bp, Bos taurus; identical to SEQ ID NO: 20580

SEQ ID NO: 61071 - DNA, 201 bp, Bos taurus; identical to SEQ ID NO: 20581

SEQ ID NO: 61072 - DNA, 201 bp, Bos taurus; identical to SEQ ID NO: 20582

SEQ ID NO: 61073 - DNA, 201 bp, Bos taurus; identical to SEQ ID NO: 20583

SEQ ID NO: 61074 - DNA, 201 bp, Bos taurus; identical to SEQ ID NO: 20585

SEQ ID NO: 61075 - DNA, 201 bp, Bos taurus; identical to SEQ ID NO: 20586

SEQ ID NO: 61076 - DNA, 201 bp, Bos taurus; identical to SEQ ID NO: 20587

SEQ ID NO: 61077 - DNA, 201 bp, Bos taurus; identical to SEQ ID NO: 20588

SEQ ID NO: 61078 - DNA, 201 bp, Bos taurus; identical to SEQ ID NO: 20589

SEQ ID NO: 61079 - DNA, 201 bp, Bos taurus; identical to SEQ ID NO: 20590

SEQ ID NO: 61080 - DNA, 201 bp, Bos taurus; identical to SEQ ID NO: 20591

SEQ ID NO: 61081 - DNA, 201 bp, Bos taurus; identical to SEQ ID NO: 20592

SEQ ID NO: 61082 - DNA, 201 bp, Bos taurus; identical to SEQ ID NO: 20593

SEQ ID NO: 61083 - DNA, 201 bp, Bos taurus; identical to SEQ ID NO: 20594

SEQ ID NO: 61084 - DNA, 201 bp, Bos taurus; identical to SEQ ID NO: 20595

SEQ ID NO: 61085 - DNA, 201 bp, Bos taurus; identical to SEQ ID NO: 20596

SEQ ID NO: 61086 - DNA, 201 bp, Bos taurus; identical to SEQ ID NO: 20598

SEQ ID NO: 61087 - DNA, 201 bp, Bos taurus; identical to SEQ ID NO: 20599

SEQ ID NO: 61088 - DNA, 201 bp, Bos taurus; identical to SEQ ID NO: 20601

SEQ ID NO: 61089 - DNA, 201 bp, Bos taurus; identical to SEQ ID NO: 20602

SEQ ID NO: 61090 - DNA, 201 bp, Bos taurus; identical to SEQ ID NO: 20603

SEQ ID NO: 61091 - DNA, 201 bp, Bos taurus; identical to SEQ ID NO: 20604

SEQ ID NO: 61092 - DNA, 201 bp, Bos taurus; identical to SEQ ID NO: 20605

SEQ ID NO: 61093 - DNA, 201 bp, Bos taurus; identical to SEQ ID NO: 20606

SEQ ID NO: 61094 - DNA, 201 bp, Bos taurus; identical to SEQ ID NO: 20607

SEQ ID NO: 61095 - DNA, 201 bp, Bos taurus; identical to SEQ ID NO: 20608

SEQ ID NO: 61096 - DNA, 201 bp, Bos taurus; identical to SEQ ID NO: 20609

SEQ ID NO: 61097 - DNA, 201 bp, Bos taurus; identical to SEQ ID NO: 20610

SEQ ID NO: 61098 - DNA, 201 bp, Bos taurus; identical to SEQ ID NO: 20611

SEQ ID NO: 61099 - DNA, 201 bp, Bos taurus; identical to SEQ ID NO: 20612

SEQ ID NO: 61100 - DNA, 201 bp, Bos taurus; identical to SEQ ID NO: 20613

SEQ ID NO: 61101 - DNA, 201 bp, Bos taurus; identical to SEQ ID NO: 20614

SEQ ID NO: 61102 - DNA, 201 bp, Bos taurus; identical to SEQ ID NO: 20615

SEQ ID NO: 61103 - DNA, 201 bp, Bos taurus; identical to SEQ ID NO: 20616

SEQ ID NO: 61104 - DNA, 201 bp, Bos taurus; identical to SEQ ID NO: 20617

SEQ ID NO: 61105 - DNA, 201 bp, Bos taurus; identical to SEQ ID NO: 20618

SEQ ID NO: 61106 - DNA, 201 bp, Bos taurus; identical to SEQ ID NO: 20619

SEQ ID NO: 61107 - DNA, 201 bp, Bos taurus; identical to SEQ ID NO: 20620

SEQ ID NO: 61108 - DNA, 201 bp, Bos taurus; identical to SEQ ID NO: 20621

SEQ ID NO: 61109 - DNA, 201 bp, Bos taurus; identical to SEQ ID NO: 20622

SEQ ID NO: 61110 - DNA, 201 bp, Bos taurus; identical to SEQ ID NO: 20623

SEQ ID NO: 61111 - DNA, 201 bp, Bos taurus; identical to SEQ ID NO: 20624

SEQ ID NO: 61112 - DNA, 201 bp, Bos taurus; identical to SEQ ID NO: 20625

SEQ ID NO: 61113 - DNA, 201 bp, Bos taurus; identical to SEQ ID NO: 20626

SEQ ID NO: 61114 - DNA, 201 bp, Bos taurus; identical to SEQ ID NO: 20627

SEQ ID NO: 61115 - DNA, 201 bp, Bos taurus; identical to SEQ ID NO: 20628

SEQ ID NO: 61116 - DNA, 201 bp, Bos taurus; identical to SEQ ID NO: 20629

SEQ ID NO: 61117 - DNA, 201 bp, Bos taurus; identical to SEQ ID NO: 20630

SEQ ID NO: 61118 - DNA, 201 bp, Bos taurus; identical to SEQ ID NO: 20631

SEQ ID NO: 61119 - DNA, 201 bp, Bos taurus; identical to SEQ ID NO: 20632

SEQ ID NO: 61120 - DNA, 201 bp, Bos taurus; identical to SEQ ID NO: 20633

SEQ ID NO: 61121 - DNA, 201 bp, Bos taurus; identical to SEQ ID NO: 20634

SEQ ID NO: 61122 - DNA, 201 bp, Bos taurus; identical to SEQ ID NO: 20635

SEQ ID NO: 61123 - DNA, 201 bp, Bos taurus; identical to SEQ ID NO: 20636

SEQ ID NO: 61124 - DNA, 201 bp, Bos taurus; identical to SEQ ID NO: 20637

SEQ ID NO: 61125 - DNA, 201 bp, Bos taurus; identical to SEQ ID NO: 20638

SEQ ID NO: 61126 - DNA, 201 bp, Bos taurus; identical to SEQ ID NO: 20639

SEQ ID NO: 61127 - DNA, 201 bp, Bos taurus; identical to SEQ ID NO: 20640

SEQ ID NO: 61128 - DNA, 201 bp, Bos taurus; identical to SEQ ID NO: 20641

SEQ ID NO: 61129 - DNA, 201 bp, Bos taurus; identical to SEQ ID NO: 20642

SEQ ID NO: 61130 - DNA, 201 bp, Bos taurus; identical to SEQ ID NO: 20643

SEQ ID NO: 61131 - DNA, 201 bp, Bos taurus; identical to SEQ ID NO: 20644

SEQ ID NO: 61132 - DNA, 201 bp, Bos taurus; identical to SEQ ID NO: 20645

SEQ ID NO: 61133 - DNA, 201 bp, Bos taurus; identical to SEQ ID NO: 20646

SEQ ID NO: 61134 - DNA, 201 bp, Bos taurus; identical to SEQ ID NO: 20647

SEQ ID NO: 61135 - DNA, 201 bp, Bos taurus; identical to SEQ ID NO: 20648

SEQ ID NO: 61136 - DNA, 201 bp, Bos taurus; identical to SEQ ID NO: 20649

SEQ ID NO: 61137 - DNA, 201 bp, Bos taurus; identical to SEQ ID NO: 20650

SEQ ID NO: 61138 - DNA, 201 bp, Bos taurus; identical to SEQ ID NO: 20651

SEQ ID NO: 61139 - DNA, 201 bp, Bos taurus; identical to SEQ ID NO: 20652

SEQ ID NO: 61140 - DNA, 201 bp, Bos taurus; identical to SEQ ID NO: 20654

SEQ ID NO: 61141 - DNA, 201 bp, Bos taurus; identical to SEQ ID NO: 20655

SEQ ID NO: 61142 - DNA, 201 bp, Bos taurus; identical to SEQ ID NO: 20656

SEQ ID NO: 61143 - DNA, 201 bp, Bos taurus; identical to SEQ ID NO: 20657

SEQ ID NO: 61144 - DNA, 201 bp, Bos taurus; identical to SEQ ID NO: 20658

SEQ ID NO: 61145 - DNA, 201 bp, Bos taurus; identical to SEQ ID NO: 20659

SEQ ID NO: 61146 - DNA, 201 bp, Bos taurus; identical to SEQ ID NO: 20660

SEQ ID NO: 61147 - DNA, 201 bp, Bos taurus; identical to SEQ ID NO: 20661

SEQ ID NO: 61148 - DNA, 201 bp, Bos taurus; identical to SEQ ID NO: 20662

SEQ ID NO: 61149 - DNA, 201 bp, Bos taurus; identical to SEQ ID NO: 20663

SEQ ID NO: 61150 - DNA, 201 bp, Bos taurus; identical to SEQ ID NO: 20664

SEQ ID NO: 61151 - DNA, 201 bp, Bos taurus; identical to SEQ ID NO: 20665

SEQ ID NO: 61152 - DNA, 201 bp, Bos taurus; identical to SEQ ID NO: 20666

SEQ ID NO: 61153 - DNA, 201 bp, Bos taurus; identical to SEQ ID NO: 20667

SEQ ID NO: 61154 - DNA, 201 bp, Bos taurus; identical to SEQ ID NO: 20668

SEQ ID NO: 61155 - DNA, 201 bp, Bos taurus; identical to SEQ ID NO: 20669

SEQ ID NO: 61156 - DNA, 201 bp, Bos taurus; identical to SEQ ID NO: 20670

SEQ ID NO: 61157 - DNA, 201 bp, Bos taurus; identical to SEQ ID NO: 20671

SEQ ID NO: 61158 - DNA, 201 bp, Bos taurus; identical to SEQ ID NO: 20672

SEQ ID NO: 61159 - DNA, 201 bp, Bos taurus; identical to SEQ ID NO: 20673

SEQ ID NO: 61160 - DNA, 201 bp, Bos taurus; identical to SEQ ID NO: 20674

SEQ ID NO: 61161 - DNA, 201 bp, Bos taurus; identical to SEQ ID NO: 20675

SEQ ID NO: 61162 - DNA, 201 bp, Bos taurus; identical to SEQ ID NO: 20676

SEQ ID NO: 61163 - DNA, 201 bp, Bos taurus; identical to SEQ ID NO: 20677

SEQ ID NO: 61164 - DNA, 201 bp, Bos taurus; identical to SEQ ID NO: 20678

SEQ ID NO: 61165 - DNA, 201 bp, Bos taurus; identical to SEQ ID NO: 20679

SEQ ID NO: 61166 - DNA, 201 bp, Bos taurus; identical to SEQ ID NO: 20680

SEQ ID NO: 61167 - DNA, 201 bp, Bos taurus; identical to SEQ ID NO: 20681

SEQ ID NO: 61168 - DNA, 201 bp, Bos taurus; identical to SEQ ID NO: 20684

SEQ ID NO: 61169 - DNA, 201 bp, Bos taurus; identical to SEQ ID NO: 20685

SEQ ID NO: 61170 - DNA, 201 bp, Bos taurus; identical to SEQ ID NO: 20686

SEQ ID NO: 61171 - DNA, 201 bp, Bos taurus; identical to SEQ ID NO: 20687

SEQ ID NO: 61172 - DNA, 201 bp, Bos taurus; identical to SEQ ID NO: 20688

SEQ ID NO: 61173 - DNA, 201 bp, Bos taurus; identical to SEQ ID NO: 20689

SEQ ID NO: 61174 - DNA, 201 bp, Bos taurus; identical to SEQ ID NO: 20690

SEQ ID NO: 61175 - DNA, 201 bp, Bos taurus; identical to SEQ ID NO: 20691

SEQ ID NO: 61176 - DNA, 201 bp, Bos taurus; identical to SEQ ID NO: 20692

SEQ ID NO: 61177 - DNA, 201 bp, Bos taurus; identical to SEQ ID NO: 20693

SEQ ID NO: 61178 - DNA, 201 bp, Bos taurus; identical to SEQ ID NO: 20695

SEQ ID NO: 61179 - DNA, 201 bp, Bos taurus; identical to SEQ ID NO: 20696

SEQ ID NO: 61180 - DNA, 201 bp, Bos taurus; identical to SEQ ID NO: 20697

SEQ ID NO: 61181 - DNA, 201 bp, Bos taurus; identical to SEQ ID NO: 20698

SEQ ID NO: 61182 - DNA, 201 bp, Bos taurus; identical to SEQ ID NO: 20699

SEQ ID NO: 61183 - DNA, 201 bp, Bos taurus; identical to SEQ ID NO: 20700

SEQ ID NO: 61184 - DNA, 201 bp, Bos taurus; identical to SEQ ID NO: 20701

SEQ ID NO: 61185 - DNA, 201 bp, Bos taurus; identical to SEQ ID NO: 20702

SEQ ID NO: 61186 - DNA, 201 bp, Bos taurus; identical to SEQ ID NO: 20703

SEQ ID NO: 61187 - DNA, 201 bp, Bos taurus; identical to SEQ ID NO: 20704

SEQ ID NO: 61188 - DNA, 201 bp, Bos taurus; identical to SEQ ID NO: 20705

SEQ ID NO: 61189 - DNA, 201 bp, Bos taurus; identical to SEQ ID NO: 20706

SEQ ID NO: 61190 - DNA, 201 bp, Bos taurus; identical to SEQ ID NO: 20707

SEQ ID NO: 61191 - DNA, 201 bp, Bos taurus; identical to SEQ ID NO: 20708

SEQ ID NO: 61192 - DNA, 201 bp, Bos taurus; identical to SEQ ID NO: 20709

SEQ ID NO: 61193 - DNA, 201 bp, Bos taurus; identical to SEQ ID NO: 20710

SEQ ID NO: 61194 - DNA, 201 bp, Bos taurus; identical to SEQ ID NO: 20711

SEQ ID NO: 61195 - DNA, 201 bp, Bos taurus; identical to SEQ ID NO: 20712

SEQ ID NO: 61196 - DNA, 201 bp, Bos taurus; identical to SEQ ID NO: 20713

SEQ ID NO: 61197 - DNA, 201 bp, Bos taurus; identical to SEQ ID NO: 20714

SEQ ID NO: 61198 - DNA, 201 bp, Bos taurus; identical to SEQ ID NO: 20715

SEQ ID NO: 61199 - DNA, 201 bp, Bos taurus; identical to SEQ ID NO: 20716

SEQ ID NO: 61200 - DNA, 201 bp, Bos taurus; identical to SEQ ID NO: 20717

SEQ ID NO: 61201 - DNA, 201 bp, Bos taurus; identical to SEQ ID NO: 20718

SEQ ID NO: 61202 - DNA, 201 bp, Bos taurus; identical to SEQ ID NO: 20719

SEQ ID NO: 61203 - DNA, 201 bp, Bos taurus; identical to SEQ ID NO: 20720

SEQ ID NO: 61204 - DNA, 201 bp, Bos taurus; identical to SEQ ID NO: 20721

SEQ ID NO: 61205 - DNA, 201 bp, Bos taurus; identical to SEQ ID NO: 20722

SEQ ID NO: 61206 - DNA, 201 bp, Bos taurus; identical to SEQ ID NO: 20723

SEQ ID NO: 61207 - DNA, 201 bp, Bos taurus; identical to SEQ ID NO: 20724

SEQ ID NO: 61208 - DNA, 201 bp, Bos taurus; identical to SEQ ID NO: 20725

SEQ ID NO: 61209 - DNA, 201 bp, Bos taurus; identical to SEQ ID NO: 20726

SEQ ID NO: 61210 - DNA, 201 bp, Bos taurus; identical to SEQ ID NO: 20727

SEQ ID NO: 61211 - DNA, 201 bp, Bos taurus; identical to SEQ ID NO: 20728

SEQ ID NO: 61212 - DNA, 201 bp, Bos taurus; identical to SEQ ID NO: 20729

SEQ ID NO: 61213 - DNA, 201 bp, Bos taurus; identical to SEQ ID NO: 20730

SEQ ID NO: 61214 - DNA, 201 bp, Bos taurus; identical to SEQ ID NO: 20731

SEQ ID NO: 61215 - DNA, 201 bp, Bos taurus; identical to SEQ ID NO: 20732

SEQ ID NO: 61216 - DNA, 201 bp, Bos taurus; identical to SEQ ID NO: 20733

SEQ ID NO: 61217 - DNA, 201 bp, Bos taurus; identical to SEQ ID NO: 20734

SEQ ID NO: 61218 - DNA, 201 bp, Bos taurus; identical to SEQ ID NO: 20735

SEQ ID NO: 61219 - DNA, 201 bp, Bos taurus; identical to SEQ ID NO: 20736

SEQ ID NO: 61220 - DNA, 201 bp, Bos taurus; identical to SEQ ID NO: 20737

SEQ ID NO: 61221 - DNA, 201 bp, Bos taurus; identical to SEQ ID NO: 20738

SEQ ID NO: 61222 - DNA, 201 bp, Bos taurus; identical to SEQ ID NO: 20739

SEQ ID NO: 61223 - DNA, 201 bp, Bos taurus; identical to SEQ ID NO: 20740

SEQ ID NO: 61224 - DNA, 201 bp, Bos taurus; identical to SEQ ID NO: 20741

SEQ ID NO: 61225 - DNA, 201 bp, Bos taurus; identical to SEQ ID NO: 20742

SEQ ID NO: 61226 - DNA, 201 bp, Bos taurus; identical to SEQ ID NO: 20743

SEQ ID NO: 61227 - DNA, 201 bp, Bos taurus; identical to SEQ ID NO: 20744

SEQ ID NO: 61228 - DNA, 201 bp, Bos taurus; identical to SEQ ID NO: 20745

SEQ ID NO: 61229 - DNA, 201 bp, Bos taurus; identical to SEQ ID NO: 20746

SEQ ID NO: 61230 - DNA, 201 bp, Bos taurus; identical to SEQ ID NO: 20747

SEQ ID NO: 61231 - DNA, 201 bp, Bos taurus; identical to SEQ ID NO: 20753

SEQ ID NO: 61232 - DNA, 201 bp, Bos taurus; identical to SEQ ID NO: 20755

SEQ ID NO: 61233 - DNA, 201 bp, Bos taurus; identical to SEQ ID NO: 20756

SEQ ID NO: 61234 - DNA, 201 bp, Bos taurus; identical to SEQ ID NO: 20757

SEQ ID NO: 61235 - DNA, 201 bp, Bos taurus; identical to SEQ ID NO: 20761

SEQ ID NO: 61236 - DNA, 201 bp, Bos taurus; identical to SEQ ID NO: 20762

SEQ ID NO: 61237 - DNA, 201 bp, Bos taurus; identical to SEQ ID NO: 20763

SEQ ID NO: 61238 - DNA, 201 bp, Bos taurus; identical to SEQ ID NO: 20764

SEQ ID NO: 61239 - DNA, 201 bp, Bos taurus; identical to SEQ ID NO: 20765

SEQ ID NO: 61240 - DNA, 201 bp, Bos taurus; identical to SEQ ID NO: 20766

SEQ ID NO: 61241 - DNA, 201 bp, Bos taurus; identical to SEQ ID NO: 20767

SEQ ID NO: 61242 - DNA, 201 bp, Bos taurus; identical to SEQ ID NO: 20768

SEQ ID NO: 61243 - DNA, 201 bp, Bos taurus; identical to SEQ ID NO: 20774

SEQ ID NO: 61244 - DNA, 201 bp, Bos taurus; identical to SEQ ID NO: 20777

SEQ ID NO: 61245 - DNA, 201 bp, Bos taurus; identical to SEQ ID NO: 20778

SEQ ID NO: 61246 - DNA, 201 bp, Bos taurus; identical to SEQ ID NO: 20779

SEQ ID NO: 61247 - DNA, 201 bp, Bos taurus; identical to SEQ ID NO: 20780

SEQ ID NO: 61248 - DNA, 201 bp, Bos taurus; identical to SEQ ID NO: 20783

SEQ ID NO: 61249 - DNA, 201 bp, Bos taurus; identical to SEQ ID NO: 20787

SEQ ID NO: 61250 - DNA, 201 bp, Bos taurus; identical to SEQ ID NO: 20788

SEQ ID NO: 61251 - DNA, 201 bp, Bos taurus; identical to SEQ ID NO: 20790

SEQ ID NO: 61252 - DNA, 201 bp, Bos taurus; identical to SEQ ID NO: 20793

SEQ ID NO: 61253 - DNA, 201 bp, Bos taurus; identical to SEQ ID NO: 20794

SEQ ID NO: 61254 - DNA, 201 bp, Bos taurus; identical to SEQ ID NO: 20796

SEQ ID NO: 61255 - DNA, 201 bp, Bos taurus; identical to SEQ ID NO: 20805

SEQ ID NO: 61256 - DNA, 201 bp, Bos taurus; identical to SEQ ID NO: 20809

SEQ ID NO: 61257 - DNA, 201 bp, Bos taurus; identical to SEQ ID NO: 20811

SEQ ID NO: 61258 - DNA, 201 bp, Bos taurus; identical to SEQ ID NO: 20812

SEQ ID NO: 61259 - DNA, 201 bp, Bos taurus; identical to SEQ ID NO: 20814

SEQ ID NO: 61260 - DNA, 201 bp, Bos taurus; identical to SEQ ID NO: 20818

SEQ ID NO: 61261 - DNA, 201 bp, Bos taurus; identical to SEQ ID NO: 20819

SEQ ID NO: 61262 - DNA, 201 bp, Bos taurus; identical to SEQ ID NO: 20820

SEQ ID NO: 61263 - DNA, 201 bp, Bos taurus; identical to SEQ ID NO: 20821

SEQ ID NO: 61264 - DNA, 201 bp, Bos taurus; identical to SEQ ID NO: 20822

SEQ ID NO: 61265 - DNA, 201 bp, Bos taurus; identical to SEQ ID NO: 20823

SEQ ID NO: 61266 - DNA, 201 bp, Bos taurus; identical to SEQ ID NO: 20824

SEQ ID NO: 61267 - DNA, 201 bp, Bos taurus; identical to SEQ ID NO: 20825

SEQ ID NO: 61268 - DNA, 201 bp, Bos taurus; identical to SEQ ID NO: 20826

SEQ ID NO: 61269 - DNA, 201 bp, Bos taurus; identical to SEQ ID NO: 20827

SEQ ID NO: 61270 - DNA, 201 bp, Bos taurus; identical to SEQ ID NO: 20828

SEQ ID NO: 61271 - DNA, 201 bp, Bos taurus; identical to SEQ ID NO: 20829

SEQ ID NO: 61272 - DNA, 201 bp, Bos taurus; identical to SEQ ID NO: 20830

SEQ ID NO: 61273 - DNA, 201 bp, Bos taurus; identical to SEQ ID NO: 20831

SEQ ID NO: 61274 - DNA, 201 bp, Bos taurus; identical to SEQ ID NO: 20832

SEQ ID NO: 61275 - DNA, 201 bp, Bos taurus; identical to SEQ ID NO: 20833

SEQ ID NO: 61276 - DNA, 201 bp, Bos taurus
ctcgcgtcaaatcgttctgtacgcaccgagctgcgtgggcttttcccgtgtgcgcaggttagacgtggactctcagaggaacacgtcctgtgagggccattctgaaaggagaatccaggaacagcccgcgaaggaatgatcttccagggacacgcaagatactcacaaaggccaagtttgtttcaaagagtagaagtacag

SEQ ID NO: 61277 - DNA, 201 bp, Bos taurus; identical to SEQ ID NO: 20835

SEQ ID NO: 61278 - DNA, 201 bp, Bos taurus; identical to SEQ ID NO: 20836

SEQ ID NO: 61279 - DNA, 201 bp, Bos taurus
ctgcacgtcctcgatggtgacctgcatggacggggggcctggggtgggggaaggagctggtgggcagaagccaggctgtgttcgccacagcctactctgcgctgaaatcttctcatgcctggcctccgtgcacagacacccagacctgggtggactggcagcaaccccatgtgtgtcttgctgcccgagctgggcaggaag

SEQ ID NO: 61280 - DNA, 201 bp, Bos taurus; identical to SEQ ID NO: 20837

SEQ ID NO: 61281 - DNA, 201 bp, Bos taurus; identical to SEQ ID NO: 20838

SEQ ID NO: 61282 - DNA, 201 bp, Bos taurus
ggtgggcatctagggtgcagccacgtttctgaaggtcactattgggaaacagcccagctctgtttagggtccaggtgttggggtctacacgttctctccatacaccactagggaagggaacagcagtcctggcgcttctgggccccagggacagtgtagccaattggtgcccaggctctgggaccacagtctgcccagggc

SEQ ID NO: 61283 - DNA, 201 bp, Bos taurus; identical to SEQ ID NO: 20839

SEQ ID NO: 61284 - DNA, 201 bp, Bos taurus; identical to SEQ ID NO: 20840

SEQ ID NO: 61285 - DNA, 201 bp, Bos taurus
tgcagagcagagggctagggcagtcagcatgcccgcctcggcgctgcacagtcaagaagacgggcttgaacggagcgtcccgttgcccagggaggccctcagtgcccccaagtggaggagtcaaggtggggcttcctgcctgtaacagggtgagccgtctgtctttcagggccgagatggtggtgcctgacttctcggagc

SEQ ID NO: 61286 - DNA, 201 bp, Bos taurus
aacaacaataaaaagagctcatccttctcccattcctgaccataatgccatgtctggctctgtgtatatcagcctggggcctcttgaggcctcttgtccaccgcttaccatggacagggggagtgaatgtgaagccctctccccctctctcatcccttcagtggtgtttctctggaggcaggagggtctcccctccccatc

SEQ ID NO: 61287 - DNA, 201 bp, Bos taurus; identical to SEQ ID NO: 20841

SEQ ID NO: 61288 - DNA, 201 bp, Bos taurus
ggaagcgtttggacgtcggcgtacacgattcattctctggtttcagggtcctggagcaggtcaggcccacgtgggtttcgagggctggcctcacagcatcacactgccctctctgggtgtcgctgccccagtttttaagatgctgtgtacctccctggaaggtcccaaggacactgcctccacgcctggctccaaggaggg

SEQ ID NO: 61289 - DNA, 201 bp, Bos taurus
caaggaacctgaggttcaaagaactgcagcgagtcaggagttatcctcaggtcagctccctgggaaggagcctcagatggaggtgaagggccccctctcttctcagactccagaagagtcttcacttggcactcagggccccttccccagtgaaaccctgagagagacaggtaatgtgactagatattacttttctctgaa

SEQ ID NO: 61290 - DNA, 201 bp, Bos taurus; identical to SEQ ID NO: 20842

SEQ ID NO: 61291 - DNA, 201 bp, Bos taurus; identical to SEQ ID NO: 20844

SEQ ID NO: 61292 - DNA, 201 bp, Bos taurus
tgtcctcctttccatcacccttaagcccagctccaatgtcctctcctccaggaagccccgcctgaatccctcagctcccctccctgcttctggccttcccatggctttgtggtgctgggagtgtctgtgtcagactctgtgactgtgggcttctcagggattgcccagtatggcccaggcttagagcaggcaccaaggagg

SEQ ID NO: 61293 - DNA, 201 bp, Bos taurus; identical to SEQ ID NO: 20845

SEQ ID NO: 61294 - DNA, 201 bp, Bos taurus; identical to SEQ ID NO: 20846

SEQ ID NO: 61295 - DNA, 201 bp, Bos taurus
gtgtcggggattcagagtggactcagctcctaccctgtgccagggaagaaaggcctgggcatggatagcccctgccccatggagcagagctggggcctaggcaagtccaaggaaggaggcagggaaaggtccatcagccaaaaaatatatcctgtgcacttcctgggtgccaccctgatgggaagaggccagggccacagt

SEQ ID NO: 61296 - DNA, 201 bp, Bos taurus
ttgaaacttatggggcttggtggttaactcagagcccctcaggggtctgagcccttcagaccctcaggggtctcccgaggtcctggccccatccctgtcccgcaaaactggaaaataaattccatgtcattatctccatgtcacttgagccacaaccaaatgtgcctcatggccaagttaggtctaggatgaagggtgcac

SEQ ID NO: 61297 - DNA, 201 bp, Bos taurus; identical to SEQ ID NO: 20847

SEQ ID NO: 61298 - DNA, 201 bp, Bos taurus; identical to SEQ ID NO: 20848

SEQ ID NO: 61299 - DNA, 201 bp, Bos taurus; identical to SEQ ID NO: 20849

SEQ ID NO: 61300 - DNA, 201 bp, Bos taurus; identical to SEQ ID NO: 20850

SEQ ID NO: 61301 - DNA, 201 bp, Bos taurus; identical to SEQ ID NO: 20851

SEQ ID NO: 61302 - DNA, 201 bp, Bos taurus
tggttggccctccagaggctcggtagctttgttacctgggaagggaagagtagactgggggacagcaggcaaggatgctcggagtcaagagaaccccttgtggagggactgtttgttcaggcccaggcgagggtggaagcgggtggctttgggcttctgggctaatggaccgtgggcaaggccagatggtgttagctggag

SEQ ID NO: 61303 - DNA, 201 bp, Bos taurus
ctggccagcgtcctgtagggagactcctctgaaggggccattgactcagatgctgtgggactgggagatttttcaaaatcttctgagtaagtcgagttcaccgcgctggccataggttccggagacgttggccccaggcaacaaatgccctggggcccaggggatgaggccgacggctcactcaggcgctcggagatctcg

SEQ ID NO: 61304 - DNA, 201 bp, Bos taurus
tcagatccctcaccttccacgtctccttttcccttttctgtcctaaaagcagtgtgtgttaactggagaactcagaaagccaggggaggcccccgttcacagggaaggatcattgcacacgtgtgtgtccgtcccaccaggtgcagatcccgtgcacgtggctgctgtgtgctcgccagctgggtcatcaccggccttctg

SEQ ID NO: 61305 - DNA, 201 bp, Bos taurus
caggaccctggtggtcctggtggggggctgctggcttccagacagtgttacttagtcccctgttgtggctggagttcactgccgtggccctgagtcctggtgtgtgtggtttctggctcactcggactaatgagggcgtctctgtgctgctgcgggagccagggggacacagctggtctctagtttccttgtgcgctgccc

SEQ ID NO: 61306 - DNA, 201 bp, Bos taurus
atgcccacttcccagacagaagcaggccagctgggcctgaggccctgggcctggtctgggtctcagaactcaaggggacagaggcagaagtccttagggaaccctgggaaccctgagaaatgtggccttaggaagcagcgtcagagagtgtggttttggagctgggcctggaggtggacgtgtgggcaggtggcgtggcag

SEQ ID NO: 61307 - DNA, 201 bp, Bos taurus; identical to SEQ ID NO: 20852

SEQ ID NO: 61308 - DNA, 201 bp, Bos taurus
tggtgggctggagtccgtagggtagcaaagaactggacacgactaaagcaacggagcacgcactgtttcctgggacaggaccggggagggttatggggactgaaacaccaaggcccggagaggtgaagctgtttgccctgggtcgctcagccagccagtggtgcactgagattgaatggggcgggggagtcgcacacgggc

SEQ ID NO: 61309 - DNA, 201 bp, Bos taurus
ctgtgaccaaatgaaggctctggtttcatgttaatgctgtttgttttgttgtgtaaaacttgggatgctgccaagcctggggcttggttggccaggccctttccaagggctcaacaaccttgagatttcttcctcgccttatctaaggtgtgcaagtcttgcactcacagcaggctcatcatcatcatcatcatcaccatc

SEQ ID NO: 61310 - DNA, 201 bp, Bos taurus
ctatggcccatggggctacagagagtcggatatggctgagcacacagaatacagtatagccccaccacaaaagatgatccatcagcccccaatctcaacatggccaaggtcaagaaaacttgagctacataaactaacatgaatatcactccaaaatactgagtaagaaagcaaattacagaaagatatctacaaaacaat

SEQ ID NO: 61311 - DNA, 201 bp, Bos taurus
acaggctcacaaagagttggacgtactgagcacacatgcacagggacggtgtattcagtaaataacttcaatttaatgagatttcaatgtgcctttataaataacaactatttttgagtgattttttttaaaggcattttcaagtttaaactgcagtgaaccactaatctgctttctgtttctatagatttgcctgtgcct

SEQ ID NO: 61312 - DNA, 201 bp, Bos taurus
cccagagaaggagtgtgacctggctctgtggcacttggaggaactcacagaggggccagtccccacccaaaactcaggggtcaaaccctcctatggccaaatcctatctacacatatcatggcagcagagttttccaactttagcatcagggactttcagttcagtcactcagtcgtgtctgactctttgcaaccccatgg

SEQ ID NO: 61313 - DNA, 201 bp, Bos taurus
aaaggatgaacaagagtccttgagcacagtgtaggcagggcattccagatggaggaaccaggatgagggaaaatgtacagaaaggcccagaacagggttatcggagactaggagttcagaccaggaccaaattgtgaaggggcttgaaggcaccttagaaccgtcactctaaggccaaaggaaatgatgggctggaagcaa

SEQ ID NO: 61314 - DNA, 201 bp, Bos taurus
ttatggtctacatgcaggtcacccgtaacactacgtcagcctcgtttggctaatcctagtttctcacttctcagacattttcctcatttcagtactttcttggtgttgtgaaatgaacaccatctctcattcttgctgccttgcagattattcaattctgcattgttccctatgcttcctttctactgggaaactctcatc

SEQ ID NO: 61315 - DNA, 201 bp, Bos taurus
acctctcctgtgaccctctgccctctgctccctctccacaacctctttattcctggctacatctctcacctgctatgaggataactctgtcttccatgacttacgatgtcatctgctgtaacccatgctgtatgcctgtgaccctcacctgtcccatagacatctatctgctctgacctctgactccactcctgtcccttc

SEQ ID NO: 61316 - DNA, 201 bp, Bos taurus
cgtgaagtgggggagcagttgggcaccaagggcacccactatactggactcatttctgcgcggttttacctggggtataggtgcccacagggtctggaggtggggttttcaggccctgtgtgcgcggagtggggactcgggagatgttcacccaagagtggcggcctgcctgctccagaaccttgtccagtggctggttca

SEQ ID NO: 61317 - DNA, 201 bp, Bos taurus; identical to SEQ ID NO: 20854

SEQ ID NO: 61318 - DNA, 201 bp, Bos taurus; identical to SEQ ID NO: 20855

SEQ ID NO: 61319 - DNA, 201 bp, Bos taurus; identical to SEQ ID NO: 20861

SEQ ID NO: 61320 - DNA, 201 bp, Bos taurus; identical to SEQ ID NO: 20863

SEQ ID NO: 61321 - DNA, 201 bp, Bos taurus; identical to SEQ ID NO: 20864

SEQ ID NO: 61322 - DNA, 201 bp, Bos taurus; identical to SEQ ID NO: 20865

SEQ ID NO: 61323 - DNA, 201 bp, Bos taurus
aacagaattcacagttgccctgggattggtgagcttggtaatggacgggatatgagcatccagtgagatgaggacagggtgagggtgaggaggacagagcgtgaggcccacaagtcaagtatcctgtactattcttgatgtgactctcatgtcggtaattttatatttatttgtgggtcagaggtcgtgaccatttttgct

SEQ ID NO: 61324 - DNA, 201 bp, Bos taurus; identical to SEQ ID NO: 20867

SEQ ID NO: 61325 - DNA, 201 bp, Bos taurus; identical to SEQ ID NO: 20868

SEQ ID NO: 61326 - DNA, 201 bp, Bos taurus; identical to SEQ ID NO: 20869

SEQ ID NO: 61327 - DNA, 201 bp, Bos taurus
atatggccaaagagagaaggaagaacagaagttttgttttgttttgtttttttatagcaaagtctagagactgggcagcttaaatgtactgtatttatttgctgggactcctggcaatagcctttaagttcctttcccacttgtgactctcagatgctgcaatgaataaagagttgttttgcctccttcacaaccacttgg

SEQ ID NO: 61328 - DNA, 201 bp, Bos taurus
aggcttttgtcttcctggagtggggtggaaagggggcatggtcactgggggctgtagatcctacccttacccatcccacatggcccaggtaaaaaagacaattgtggttattatggatatggcagcacattgtcacagtgacaaggcagtccaagatccccagtgagtccttcttgttttcccagcactggaggccaaggc

SEQ ID NO: 61329 - DNA, 201 bp, Bos taurus; identical to SEQ ID NO: 20870

SEQ ID NO: 61330 - DNA, 201 bp, Bos taurus; identical to SEQ ID NO: 20871

SEQ ID NO: 61331 - DNA, 201 bp, Bos taurus
atggagaaggaaaggggaaagtgggaggggctgagggcagggaggggacaggacagagtgggcacagccttgtgggccatggggaggacttgggctttggctcagagtgaggtgggacccatagagggttcagggcagaggagggacataccctgaatcaggtgatcactgcctccactgggccctaccggggaaatagac

SEQ ID NO: 61332 - DNA, 201 bp, Bos taurus
tgacatgggcacgtcagagcatcgggcagggacacctgaccagtaacagggcaggtggtgcgaggagagagggtggcccagagaagtctcagaaggtgccggtctttccaagccctcagggagccttgaggttccttggagagcagacccagcctccagcctgagatgcagcacccagaggggagcctgtgggtgcgtggg

SEQ ID NO: 61333 - DNA, 201 bp, Bos taurus
tggggttttatggaggcttcattgtataggtacggttaatttaaccattggtctttggcggctgaggagggcggactgaaagttgcaacggtctaattgctaagctggtcccgacatggctttctaaagtcatataccccagggtgcttgaagggggcgtcacgtgaatcacagaagacacctttattgctctttaattta

SEQ ID NO: 61334 - DNA, 201 bp, Bos taurus
tcagcgtcagccgcttggggcagacgcagaaacctcaagggtctgtcgtggaaggcgtcctttttccttgtagctaacgttaggcctgtgtacccccttcggtatttgtagatgctcctcccgcccctcctactctgatggcattctggtcccaccccagcctgggaaggggccttgcagggacctctccaaaaaaaaagg

SEQ ID NO: 61335 - DNA, 201 bp, Bos taurus; identical to SEQ ID NO: 20874

SEQ ID NO: 61336 - DNA, 201 bp, Bos taurus; identical to SEQ ID NO: 20875

SEQ ID NO: 61337 - DNA, 201 bp, Bos taurus
gggcccgtgtgctccaactactgagcctgtgcgctagagcccacaagccgcatctactgaagtctaagcgccctagggcctgtgttctacagcaagagaaaccactgtagcgagaggcccaagcgctgcaagtaagaaaagccctcacagcaatgaagacccagcaaagccaaaaataactaaataagcaaataaaaatat

SEQ ID NO: 61338 - DNA, 201 bp, Bos taurus
cagctccttgttagacccttgcctgggggtggggagatttcgtcagggctcaaggatcaagggctgttggtcggggtctgctgaagttagcaagatggggaagggagtttccctgtttggggtgggggcaccttgtcagcatttcaacgctttggtttgtttacagggtgctggatgtctgggttgtcgccttggcccacc

SEQ ID NO: 61339 - DNA, 201 bp, Bos taurus
ttatggtcagaattcctaggagtgttgttatttgactgtttatgcctccatgctttttcaaacatggccaagagcacagaataaaagactaacttcaaacaataacattagaggagaaaaactgcattcccaactcaagaaaccactagagttcatctcaaaacccagtgctgagtttcctggtggccaaagcaaggaggc

SEQ ID NO: 61340 - DNA, 201 bp, Bos taurus; identical to SEQ ID NO: 20879

SEQ ID NO: 61341 - DNA, 201 bp, Bos taurus
tcctttgcttggctctgtgtcaaagggaactgcatttcccaggtgcctttgcacccttcctcccagctagttctaaccaatgggaggcccaggcaggagaccagagggtggaaggaagagagaagccagggtatttctccttctcttgttctgcctctccagcagcaaatacacctcctccatggcctcagctccctgaag

SEQ ID NO: 61342 - DNA, 201 bp, Bos taurus
tttttagggtgcaaggtgggttcttgcaaaccagtccgctccttctgtgcagcagggtgcaggtccccactgcatctggctgggtgaagaaacttggacgacttccttggtctccatcaggggtccccagatgcttgggtatccagcgtgagaagggggcttgtgctttcaagggtcaggctccaggcgctgtgagaggac

SEQ ID NO: 61343 - DNA, 201 bp, Bos taurus
ctttcccctgtctctctctccctctccctctgtatgattaagtttgttgctctgagcgtgtgccttttgctacatctcagtgatggggagtctggcttcctcggccagcagtgggggaagggggactctgtgtgtccatgtgtgtgtgtgactaattgtgtgggatttatgtcagtgtgaggatgaagctcagcgtgagga

SEQ ID NO: 61344 - DNA, 201 bp, Bos taurus
tttaatcatggccggacttggtttccgatgtgttagtcacatgggttagatcataccagaggttaagaccaccaaggctttcttattacccagtttgtcaccaggccacagattaatttggcattggcttcgtgggttggatctctacttttgagacccctgtgagggactttagttcagtaaaaccttcctccccacttt

SEQ ID NO: 61345 - DNA, 201 bp, Bos taurus; identical to SEQ ID NO: 20883

SEQ ID NO: 61346 - DNA, 201 bp, Bos taurus; identical to SEQ ID NO: 20884

SEQ ID NO: 61347 - DNA, 201 bp, Bos taurus
ctgtctctttccctccctcccaattcagttctttttttttttaaacttgttattttgtgttagaatatagccgatgaacagtgttgcgacagtttcaggggaacagtgaccaactcaggtcttgtagttcttctgcgggcaactttcaaaatctgttcaaactctgacctcttcttttccagggtctgagtcccatcactg

SEQ ID NO: 61348 - DNA, 201 bp, Bos taurus
ggcacagggcagcacatgctcacctgtagagaggcggagggaaatccacttccagggtcccccgggggacacagggccaggcagcctgccgcctcagggtttgcatgtctgcctctgcgtgcctgggggctcctgcctccaagtcctgtggggccattgttgacagcaacaaaggccaccccagtgtcctggcaacagctg

SEQ ID NO: 61349 - DNA, 201 bp, Bos taurus
acctcagtgttcacagcagcactatttacaacagccagtacagggaaaccgccgaagtgtccacagacagatgagtgggtaaagaccatgtcgggtatatgcacaaggcaataccatctggccatgaaaagaatgaagcaaatgccacgtgcagcagcctggatggacctagagatcatcacaccaagtgaagtcagacac

SEQ ID NO: 61350 - DNA, 201 bp, Bos taurus
cctgggccttctggattggaaatgtagaatcttagcctttggaccaccagggaagtccctagcattctgttctttctacccccaaagctcctccagacagtgggcctgggccagcctgggcctctcctgaaccttcgtttaggtatccgctgtggtctcctggcttcctgacttgcctatatccattcccactaccggcaa

SEQ ID NO: 61351 - DNA, 201 bp, Bos taurus; identical to SEQ ID NO: 20886

SEQ ID NO: 61352 - DNA, 201 bp, Bos taurus; identical to SEQ ID NO: 20887

SEQ ID NO: 61353 - DNA, 201 bp, Bos taurus
tccaggttccagcctcgatctggcctgtcctcccaggtcctacccttcagctgttgccactctcgccttctaacttctttgggttgttgagtatcaatctggctataaaaggcaattctggcctaaggaaaagtggaaaagaggaaaggggtggccagctgcctgagtcgagaccaacttctgcttgcagcctggcgtctg

SEQ ID NO: 61354 - DNA, 201 bp, Bos taurus; identical to SEQ ID NO: 20888

SEQ ID NO: 61355 - DNA, 201 bp, Bos taurus; identical to SEQ ID NO: 20889

SEQ ID NO: 61356 - DNA, 201 bp, Bos taurus
agcaggaacagtttcagaagcctcctttgtctgtgagctgagtgtccataaatcctgccgtgtcctgcgggcgtgtgccgtgtgaggtctcccgccaccattctgggccgctcctgactcaggtggacggtggaacatggttcattggttggggggggcttcctcccaggggtcactgtgcctcgaaaaggcgtgtccgcg

SEQ ID NO: 61357 - DNA, 201 bp, Bos taurus
cccacctgtttggggtcactgtcctccttcataagtggtccccttaggatttcaaggagaggctgagagctagcttctcagaagtgtttccaccttggacactggctgatttaggccaagtagaagcaagaagcatcagctaacagctgacctcgtggtatgggcaaggaaaatgttttcctctaccttttttttttttta

SEQ ID NO: 61358 - DNA, 201 bp, Bos taurus
aattgtgattaaacagttacatgtcgtgtagtctggtttagaagcaaagttgctatgacactttgcaccataaagagtggatttttcagtttcttgttaaccatttctctttgattatttactgtgtggaaaggatacacgaatgaaagatatcacagattgctttctatgttgtccaaaattttgttgcttattgataat

SEQ ID NO: 61359 - DNA, 201 bp, Bos taurus
ctctttggaatgctggcagctctgatgtgggtctggccacatggttcttctttttttatgaacctggaagagggaatatgtctcggccgggtcaggcctggtgtgtcctctcattctcctgtaggacagagtcatggagcctggatggtgtgtcttaagcttgagcccaatccaactcagataaacctgtcttcagcctct

SEQ ID NO: 61360 - DNA, 201 bp, Bos taurus; identical to SEQ ID NO: 20890

SEQ ID NO: 61361 - DNA, 201 bp, Bos taurus; identical to SEQ ID NO: 20891

SEQ ID NO: 61362 - DNA, 201 bp, Bos taurus; identical to SEQ ID NO: 20892

SEQ ID NO: 61363 - DNA, 201 bp, Bos taurus; identical to SEQ ID NO: 20893

SEQ ID NO: 61364 - DNA, 201 bp, Bos taurus
tttaagaggtggtagtttttgataaaagcttgtagaagtgactttttaaaatgtatactataatttgatataaatgtaatttaaaaatgcatttacatttattacttgtgacaccaggagcaaccttctattattatagtcaggaacatttgtttattcttttctctgccaagttacccagggggtgagtacagggctttc

SEQ ID NO: 61365 - DNA, 201 bp, Bos taurus
taaggtgtggtaaggagttggtggagccagggcactctcactgggagacgaaccaccacctattcctgagtgtgctgacaatggcctccacagctccactcggatcacattccagccactctcagctgtctctgaatagctagatgaagtcctttcccagggcctttgtgttcaaggttcagcacttagccactacacact

SEQ ID NO: 61366 - DNA, 201 bp, Bos taurus; identical to SEQ ID NO: 20895

SEQ ID NO: 61367 - DNA, 201 bp, Bos taurus; identical to SEQ ID NO: 20896

SEQ ID NO: 61368 - DNA, 201 bp, Bos taurus; identical to SEQ ID NO: 20899

SEQ ID NO: 61369 - DNA, 201 bp, Bos taurus; identical to SEQ ID NO: 20900

SEQ ID NO: 61370 - DNA, 201 bp, Bos taurus; identical to SEQ ID NO: 20901

SEQ ID NO: 61371 - DNA, 201 bp, Bos taurus; identical to SEQ ID NO: 20902

SEQ ID NO: 61372 - DNA, 201 bp, Bos taurus
tgtggagggatactctgcaaacaaagattttcaccttttaacttctctggatctcagctgcattatatgaaaaaggggcaaatggtattatcattaggtagcaatatgtgaaaaactttggaggttttgggaagatttttctgtgttctgaagtactattactttatataaaaagtcgttaaaactgccattagcaaatat

SEQ ID NO: 61373 - DNA, 201 bp, Bos taurus
ctggaggctgcagctttgagatcagggtgccagcattgttgagttctgctgacagctctctgtaaggtggcagaaggccattatcctcacatgacaaagagtgtaagagagatttctgggatctcttttttaagatcaacaatctcattcacgagggctccaccctcaggacctaatcacattctggaggtctcatctcct

SEQ ID NO: 61374 - DNA, 201 bp, Bos taurus
tcaaaaaattcttaacaaattctcaactgaggcattgtcctaaaaacaaaaggttgaaatgaactctgaatagccaggaagtccatctcatggaccagccacggtgtgcaattccttcttccaccataaagatggatgagcttccaccacagctcaaaaactgtagtaagctcaaattttagcaagagactgaccatggac

SEQ ID NO: 61375 - DNA, 201 bp, Bos taurus; identical to SEQ ID NO: 20903

SEQ ID NO: 61376 - DNA, 201 bp, Bos taurus
catataatccacctaaagaaatccctaaatgatttcttatatatagtatctaggagactggcatcccgagtgatttaacagattaatactgtttctgtcttcttcaattatacactgtgcacttagatccaaatgggaaaacgatggcaatggtattggtgttttcccacatgataaaaatcagatgacttcaagagctgg

SEQ ID NO: 61377 - DNA, 201 bp, Bos taurus; identical to SEQ ID NO: 20906

SEQ ID NO: 61378 - DNA, 201 bp, Bos taurus
actgagacagagagagtccaagaaagagggcaaagcagaaatcgggacagtgtgggacgggaacgaaagacaagcctgcagtcatgtcagaagaagcaagggagtatgtctgtaccccgtgaccaggttattatattatctcattttaatcaccatgacaactctatgaaataagaaacattatccccattttgcacactg

SEQ ID NO: 61379 - DNA, 201 bp, Bos taurus; identical to SEQ ID NO: 20907

SEQ ID NO: 61380 - DNA, 201 bp, Bos taurus; identical to SEQ ID NO: 20908

SEQ ID NO: 61381 - DNA, 201 bp, Bos taurus; identical to SEQ ID NO: 20909

SEQ ID NO: 61382 - DNA, 201 bp, Bos taurus; identical to SEQ ID NO: 20910

SEQ ID NO: 61383 - DNA, 201 bp, Bos taurus; identical to SEQ ID NO: 20911

SEQ ID NO: 61384 - DNA, 201 bp, Bos taurus; identical to SEQ ID NO: 20912

SEQ ID NO: 61385 - DNA, 201 bp, Bos taurus; identical to SEQ ID NO: 20913

SEQ ID NO: 61386 - DNA, 201 bp, Bos taurus; identical to SEQ ID NO: 20914

SEQ ID NO: 61387 - DNA, 201 bp, Bos taurus; identical to SEQ ID NO: 20915

SEQ ID NO: 61388 - DNA, 201 bp, Bos taurus; identical to SEQ ID NO: 20916

SEQ ID NO: 61389 - DNA, 201 bp, Bos taurus; identical to SEQ ID NO: 20917

SEQ ID NO: 61390 - DNA, 201 bp, Bos taurus; identical to SEQ ID NO: 20918

SEQ ID NO: 61391 - DNA, 201 bp, Bos taurus; identical to SEQ ID NO: 20919

SEQ ID NO: 61392 - DNA, 201 bp, Bos taurus; identical to SEQ ID NO: 20920

SEQ ID NO: 61393 - DNA, 201 bp, Bos taurus; identical to SEQ ID NO: 20921

SEQ ID NO: 61394 - DNA, 201 bp, Bos taurus; identical to SEQ ID NO: 20922

SEQ ID NO: 61395 - DNA, 201 bp, Bos taurus; identical to SEQ ID NO: 20923

SEQ ID NO: 61396 - DNA, 201 bp, Bos taurus; identical to SEQ ID NO: 20924

SEQ ID NO: 61397 - DNA, 201 bp, Bos taurus; identical to SEQ ID NO: 20925

SEQ ID NO: 61398 - DNA, 201 bp, Bos taurus; identical to SEQ ID NO: 20926

SEQ ID NO: 61399 - DNA, 201 bp, Bos taurus; identical to SEQ ID NO: 20927

SEQ ID NO: 61400 - DNA, 201 bp, Bos taurus; identical to SEQ ID NO: 20928

SEQ ID NO: 61401 - DNA, 201 bp, Bos taurus; identical to SEQ ID NO: 20929

SEQ ID NO: 61402 - DNA, 201 bp, Bos taurus
cttgtttatcatcctggccttagcaattctgtaatagaaaatagtattcaaaattttcaagatttttgccaagtgctttttgtgacagtgacactcttgatcagttaacagtagtctcaggctattcaggagattttcaggagcagtggtatatttcagtggtcagtataacctgtgcctgaagaaaacatttataagata

SEQ ID NO: 61403 - DNA, 201 bp, Bos taurus
acactgctttcccctcttcagcttgtcatttatgcttctgactgtctcacaaggacacttctcaaggcatttaaggcccattttgataaccagaaaaatctcttcatttcaacatccttaacataatcacatctgcaaaaactttaccagctaacattcattggtgccaggaattagaatctgatatcattgatggccatt

SEQ ID NO: 61404 - DNA, 201 bp, Bos taurus; identical to SEQ ID NO: 20930

SEQ ID NO: 61405 - DNA, 201 bp, Bos taurus; identical to SEQ ID NO: 20931

SEQ ID NO: 61406 - DNA, 201 bp, Bos taurus; identical to SEQ ID NO: 20932

SEQ ID NO: 61407 - DNA, 201 bp, Bos taurus
gagagagtggaatgtgggtgtggccatggaagaatctctaaaagggatggctggaaagttgtccagtctttcaagcaatgggttaaatcttgccggtagctctgtaaaatgtgtttacaggtggcagaaattaattcctgtgaacagcaatctgtaaataagcagctctgaagagtaagggtaatgaagcaagtgaaaaat

SEQ ID NO: 61408 - DNA, 201 bp, Bos taurus
atgtggcggatcttttcctcagggcaccaggtcctctttgtaccacaggcaaatcttgttcccctgcatgagctgaatgtttcctaaccaaattattactcaagtctgattatcaaagtcatctcaggcaaagtcaagtaggcagttctcttcctgctaaggcccaggtactgcctgacagtgatgtgatcctgagtctga

SEQ ID NO: 61409 - DNA, 201 bp, Bos taurus
ttggagggcacaaacgaaaccttgctcacaccagaggaaaggagcagtgaccccacaagagactgaaccaaatctacctgctggtgttcgagggcctcttatggagatgtgggtcagcaggggctcaccacagggatggggcactgccagaaaagtcccctttggcataaaccctcttggagttcaatatcaaccctgcca

SEQ ID NO: 61410 - DNA, 201 bp, Bos taurus; identical to SEQ ID NO: 20936

SEQ ID NO: 61411 - DNA, 201 bp, Bos taurus; identical to SEQ ID NO: 20937

SEQ ID NO: 61412 - DNA, 201 bp, Bos taurus; identical to SEQ ID NO: 20938

SEQ ID NO: 61413 - DNA, 201 bp, Bos taurus
agactccaagctcgtttcaattgctggtgcaagggtgtaatatattttagtaatttggcatttgtttattattattgtcactgaatctgcacatgtgaaatttatttttggttaatgaatgctgttgtacataagtgggtctctcagacaccaacagggtacatcaagacccctgtgtcaattaaaagttgagtaatggtt

SEQ ID NO: 61414 - DNA, 201 bp, Bos taurus
ggcaagcgaggcatgggcagcatcagtcagtgagtggggaaggcatgcggcccaaagagccagtctccttctttgctccttctccttggcccttcttcccgcctgtattcagaaatagccttcaaagtcattctatttcatgaccatccaccaccttcttgaccctggagaaggtaaagacttggggaaactggaccttgg

SEQ ID NO: 61415 - DNA, 201 bp, Bos taurus; identical to SEQ ID NO: 20940

SEQ ID NO: 61416 - DNA, 201 bp, Bos taurus; identical to SEQ ID NO: 20941

SEQ ID NO: 61417 - DNA, 201 bp, Bos taurus; identical to SEQ ID NO: 20942

SEQ ID NO: 61418 - DNA, 201 bp, Bos taurus; identical to SEQ ID NO: 20943

SEQ ID NO: 61419 - DNA, 201 bp, Bos taurus; identical to SEQ ID NO: 20944

SEQ ID NO: 61420 - DNA, 201 bp, Bos taurus; identical to SEQ ID NO: 20945

SEQ ID NO: 61421 - DNA, 201 bp, Bos taurus; identical to SEQ ID NO: 20946

SEQ ID NO: 61422 - DNA, 201 bp, Bos taurus; identical to SEQ ID NO: 20947

SEQ ID NO: 61423 - DNA, 201 bp, Bos taurus; identical to SEQ ID NO: 20948

SEQ ID NO: 61424 - DNA, 201 bp, Bos taurus; identical to SEQ ID NO: 20949

SEQ ID NO: 61425 - DNA, 201 bp, Bos taurus
cagcctttgttaaaatattttctagctgagtctactctagagcttaaatctacccagcagcatctgcctcagtaatacaaatgcctgggcttcattttgtccagcaggtacctttcttttactacattatagcttagtatttgctctatgctctccattctcttaagggttaaagaaagtccctttcagttttcccgtctt

SEQ ID NO: 61426 - DNA, 201 bp, Bos taurus
ataaggctgtcctcaggagaaaaatatcagacaaaactcattttcaaaagcagacagagttgcaagtttagactgaatttaaaggagtgaactgaagtatgtgattttccttttttgttaccaaaggaattttttcaaaccaatagaaagaactaggtaagttattcactacagtactccatattttttaatgaatatggc

SEQ ID NO: 61427 - DNA, 201 bp, Bos taurus
tatgtatattagttgaaatgttaccgtttactgcactatgcagcatttcaaatggcttagctaatgtataggatattacatggccagctttaccatgaacgaatgaaaagacaaggacttatgggaagttgtattttagagagtactatgaaataatgacccacaaggagatccaaccagtccattctgaaggagatcggc

SEQ ID NO: 61428 - DNA, 201 bp, Bos taurus
aaaacaaaaagctaaatggtgttactttgttcattcacccaacttaaaacctgtgaactcctaccctctgcaattaactgtaatgaagctactgtatattttttcatcaatagcaataggaattgtggttaaaaagagagtaatacttgttctacttgaacaagtagataatactacataatgcttgttcttacatagaac

SEQ ID NO: 61429 - DNA, 201 bp, Bos taurus; identical to SEQ ID NO: 20953

SEQ ID NO: 61430 - DNA, 201 bp, Bos taurus; identical to SEQ ID NO: 20957

SEQ ID NO: 61431 - DNA, 201 bp, Bos taurus; identical to SEQ ID NO: 20958

SEQ ID NO: 61432 - DNA, 201 bp, Bos taurus; identical to SEQ ID NO: 20959

SEQ ID NO: 61433 - DNA, 201 bp, Bos taurus
agtcttttttatacatggtccattgaaatcaaaatttaaacaaggtccacatgttgcaattggctgatgtgtctgttagtctacaacagctctccctccttttttggcactgatttattaaagaaactaagtaatttatcctgtagaattttccacagaagtctattgactatattcctgtgatgttatttaagatgctcc

SEQ ID NO: 61434 - DNA, 201 bp, Bos taurus; identical to SEQ ID NO: 20961

SEQ ID NO: 61435 - DNA, 201 bp, Bos taurus
gcatttaatcctttaagtggcatctttacctcctaagaggaaatggcttttttcagctttatgttatccacggggagaacactgaggccatgtaaggtggttctgtgtataaattcattgtgggcagggggtggtaggtgatggggtggactgaacccaagaaatgaaagaaaggaaagtatacaggcccacttgggctaa

SEQ ID NO: 61436 - DNA, 201 bp, Bos taurus; identical to SEQ ID NO: 20962

SEQ ID NO: 61437 - DNA, 201 bp, Bos taurus; identical to SEQ ID NO: 20964

SEQ ID NO: 61438 - DNA, 201 bp, Bos taurus; identical to SEQ ID NO: 20965

SEQ ID NO: 61439 - DNA, 201 bp, Bos taurus
tcaaaatgtcaaatcaaaatccagagtaattattatgcatgtggatatagaaacagacttttgtggttaacaggaaacatactcacaactgacttttgtaggatattacaaagtgtcaaaataagtttgcccttgggagagcaaaagtctgagagtgcttttctaaaacatacaccatttgatacattagaaatctttatt

SEQ ID NO: 61440 - DNA, 201 bp, Bos taurus
ggaaggtggaggagtagtttgtctctgagcttttaatataggaggattaaaagaaaatgtttcttagggttcatcacttgctataatatcaaaatgtatcccatagtgccctcacctattacataatccccatccatcttgcaacaaactcatctgttctgtggatgtctttaagctctactccccttcagagtcctcatt

SEQ ID NO: 61441 - DNA, 201 bp, Bos taurus; identical to SEQ ID NO: 20967

SEQ ID NO: 61442 - DNA, 201 bp, Bos taurus
caattctaacagaaaggtcacccagaaaactccgtggtcggagcctccctccaaacaacaaatgtgacaattaaaacaaagcacccttcatttgacgggcacggaagcaactgggctggcccaggcccgtggcatttgttacctgagggaaacaatagcagctctgtaggcacgtctggccgaaagggcaggagctgctgc

SEQ ID NO: 61443 - DNA, 201 bp, Bos taurus; identical to SEQ ID NO: 20968

SEQ ID NO: 61444 - DNA, 201 bp, Bos taurus; identical to SEQ ID NO: 20969

SEQ ID NO: 61445 - DNA, 201 bp, Bos taurus; identical to SEQ ID NO: 20970

SEQ ID NO: 61446 - DNA, 201 bp, Bos taurus; identical to SEQ ID NO: 20971

SEQ ID NO: 61447 - DNA, 201 bp, Bos taurus; identical to SEQ ID NO: 20972

SEQ ID NO: 61448 - DNA, 201 bp, Bos taurus; identical to SEQ ID NO: 20973

SEQ ID NO: 61449 - DNA, 201 bp, Bos taurus; identical to SEQ ID NO: 20974

SEQ ID NO: 61450 - DNA, 201 bp, Bos taurus; identical to SEQ ID NO: 20975

SEQ ID NO: 61451 - DNA, 201 bp, Bos taurus; identical to SEQ ID NO: 20976

SEQ ID NO: 61452 - DNA, 201 bp, Bos taurus; identical to SEQ ID NO: 20977

SEQ ID NO: 61453 - DNA, 201 bp, Bos taurus; identical to SEQ ID NO: 20978

SEQ ID NO: 61454 - DNA, 201 bp, Bos taurus; identical to SEQ ID NO: 20979

SEQ ID NO: 61455 - DNA, 201 bp, Bos taurus
actgaatccgcagcgttcactcacttgcatagtcattgaggccctcctaccaactgggcctgaaggtggctaccagtgaaagacaagggcctcacacctggtttccatagccctggttcctccactgccccaacctgcccatgctaggagtgggagtgcccatctatggtaggggccatgatgaggccccaaattcccctg

SEQ ID NO: 61456 - DNA, 201 bp, Bos taurus; identical to SEQ ID NO: 20980

SEQ ID NO: 61457 - DNA, 201 bp, Bos taurus; identical to SEQ ID NO: 20981

SEQ ID NO: 61458 - DNA, 201 bp, Bos taurus; identical to SEQ ID NO: 20982

SEQ ID NO: 61459 - DNA, 201 bp, Bos taurus; identical to SEQ ID NO: 20983

SEQ ID NO: 61460 - DNA, 201 bp, Bos taurus; identical to SEQ ID NO: 20984

SEQ ID NO: 61461 - DNA, 201 bp, Bos taurus; identical to SEQ ID NO: 20985

SEQ ID NO: 61462 - DNA, 201 bp, Bos taurus; identical to SEQ ID NO: 20986

SEQ ID NO: 61463 - DNA, 201 bp, Bos taurus; identical to SEQ ID NO: 20987

SEQ ID NO: 61464 - DNA, 201 bp, Bos taurus
agtatatagctcccttgctaagattagcaagtggtacactctctgtcccccttttgatgtctatatcagaagcgttctctgtcccttactttaataaaaccctgctatacaaaagctcttgagtgatcaagcctgattcctggtccagaagctaaatcttcttcggaaatcttgaatccaacatccttaaccataagctat

SEQ ID NO: 61465 - DNA, 201 bp, Bos taurus; identical to SEQ ID NO: 20988

SEQ ID NO: 61466 - DNA, 201 bp, Bos taurus
ctcattttatggttaagtaatcagccatgaaaaggaactcattagaagtcagttctaatgtgtgaatgaacctagagcctgtataacaatacagagtggagtaaatgaggaaaaaaacaaacattgtgtattaatatttatatatggaatctggaaagagagtattgatgaacctgtttgcagggcagcagaggagatgca

SEQ ID NO: 61467 - DNA, 201 bp, Bos taurus; identical to SEQ ID NO: 20989

SEQ ID NO: 61468 - DNA, 201 bp, Bos taurus; identical to SEQ ID NO: 20990

SEQ ID NO: 61469 - DNA, 201 bp, Bos taurus
tctcttctccctttgggcattgcctcactgtcttgcttagcaaccagcctctaattaagtaatttctacttactaatggagtctctccaaagcaatttttactttgaatgtatctttacagcccctataactgtctagaatgtagaacaaaatagaaatctaaagaatgtgtacttagttaaatatatcttttttccccct

SEQ ID NO: 61470 - DNA, 201 bp, Bos taurus
aggatgtgtcagagtatttcaattttgtagttacaagactgggatagagttcataaaaatcaagaagagggccatgtgtggatttgacccctagttatgacattacaagtccatgttctcagcctcatgcttttgattaagcgatgttcaaatagatagcagagccatatatgtttgagacatctctaatttgagggaagg

SEQ ID NO: 61471 - DNA, 201 bp, Bos taurus
acccagggatcgaacctgagtctccagcattgcagatagattcttttaccttctgagccaccagggaagcccaaatcaggaaaagaacaacactcttactctagcaactcttatagcaaaggtggcgtggatcatgctggagggcagataaaaactaatcagaataagtcagtcttctctgtctctctttgaaagacactg

SEQ ID NO: 61472 - DNA, 201 bp, Bos taurus; identical to SEQ ID NO: 20991

SEQ ID NO: 61473 - DNA, 201 bp, Bos taurus; identical to SEQ ID NO: 20992

SEQ ID NO: 61474 - DNA, 201 bp, Bos taurus; identical to SEQ ID NO: 20993

SEQ ID NO: 61475 - DNA, 201 bp, Bos taurus; identical to SEQ ID NO: 20994

SEQ ID NO: 61476 - DNA, 201 bp, Bos taurus; identical to SEQ ID NO: 20995

SEQ ID NO: 61477 - DNA, 201 bp, Bos taurus; identical to SEQ ID NO: 20996

SEQ ID NO: 61478 - DNA, 201 bp, Bos taurus; identical to SEQ ID NO: 20997

SEQ ID NO: 61479 - DNA, 201 bp, Bos taurus; identical to SEQ ID NO: 20998

SEQ ID NO: 61480 - DNA, 201 bp, Bos taurus; identical to SEQ ID NO: 20999

SEQ ID NO: 61481 - DNA, 201 bp, Bos taurus; identical to SEQ ID NO: 21000

SEQ ID NO: 61482 - DNA, 201 bp, Bos taurus; identical to SEQ ID NO: 21001

SEQ ID NO: 61483 - DNA, 201 bp, Bos taurus
agataaaataaatgttttacaagatggttttatgggttaaccaagtacttacattgacctttctaacagaaagattttaaaaggccagcaatactgttctttaattcaacatcagctcacgagcttttctcatgtgacagaatctacactggctccttcatgctcatgaagaagcagggccagggctctgacatacagagt

SEQ ID NO: 61484 - DNA, 201 bp, Bos taurus
cactcagtgccctcactataactaaatatttggccatttctgaggaccccagtcttctcctgtggatgcatggctccctccacataaacacagagcctcacagcaaggccagaacctataggcaaagggagttcaaacatttagtatagattttccccaaattatgtttcagctattttcttttttttttttttaatttta

SEQ ID NO: 61485 - DNA, 201 bp, Bos taurus; identical to SEQ ID NO: 21002

SEQ ID NO: 61486 - DNA, 201 bp, Bos taurus
acaccatctcccgggcagcattgtgcatgctcacagcccgctcatatcgcagtgctgccttctgtgtctcctgctgggcctgggagggggcgtggggaaggaccatcaggagactgagctgcaaaagacccctggctgcccatggagaccctccctgggcaaggacaagagaaggaaaaaggcccactgtaatgctggctt

SEQ ID NO: 61487 - DNA, 201 bp, Bos taurus
aggactgcatacaataaaaactctaccaccaagactaactttccagaatcctcaactaaggctttaaatccaaaaaaaaggggggaggattgtaaaagtattagttaaaaataaagatgaattatttcatctgctctaagtgcagaaggtctttctaaacatagtattaaccaaacattatggaaaccaaagtgaaaaaca

SEQ ID NO: 61488 - DNA, 201 bp, Bos taurus
ggatctccttgcagtccaagggactctcaaaagttttctccaacaccacagttcaaaagcatcaattctcctacccacatccaaatctctggcctgctccgggtcccccagcagacacatccttactgtggagacacttctccgcccaaccaggactcaggactctcctagcctctcaggccttgggggccaaacaagagc

SEQ ID NO: 61489 - DNA, 201 bp, Bos taurus
gaccactctggggtcagggctgccagggtcagggccaccccagggtcaggactactccaaggtcaagaccagtggaccctaacacaaggacagagttcatcggatatggccacagggtccagcccatgaggctgccacctgccgcactctgctgcagcatcagaaagcatccacaactatgtcaacagactggtaaatact

SEQ ID NO: 61490 - DNA, 201 bp, Bos taurus
ggagcccaggaggaaagtggtggcccaggatgagtgagtgctacagtgggaagagcaatgccgagtacagtgaggcaccttcctccactgtccgcgccagtacaggggcccaggacagcaagctgaccggctcaggtgtcctgctgacaggctgacctggtactgtggtttcactctccacatgtccttgccacgcttagg

SEQ ID NO: 61491 - DNA, 201 bp, Bos taurus
cctgggcctcacacccccaccctgcgtagaccatatgaagggagactttccttctactcggttgtgactagaggacatgggcagcgttctggacatcaggtagtgaccatgggctccctgccctgatggccggcacatccagactccccagctggctgggtgtcccttccgtgggcccctggggagccgaccctccatggt

SEQ ID NO: 61492 - DNA, 201 bp, Bos taurus
aatcatctctcctcctccatcgaaacatttttcccaggaagcaacggtctctggcagcaccttctgtgctcatccaagggtgttctgagcaggaaaggccactggtcaggcagcccagaaggtgagtttgcccatcacaaggcaatagcttttctcttctggtgatgcggcagaatttcctgtcttctgagcactgtgagt

SEQ ID NO: 61493 - DNA, 201 bp, Bos taurus
gggagggggtggtgtctggagcctacaaccctgccctgcagatgggccacagggcacaatcctgggagccagggctccaggagagatagaaactgcaccctgccccccaactcctgactgaaggctggatcgccctactttctttccacactggggggcccccggacgtctgctgttcctaaaaaggtgaggggctggggg

SEQ ID NO: 61494 - DNA, 201 bp, Bos taurus
gaggctgcccagggctgggagactcatctgaaacccagctggggatgtgtcctcttccagggttgctcactggcagttggctgcattcagttcctggccgtgtgggtcttcctgaattttcaccttggcttctagcaagacggaagtcaaaactgtttacagtctggtcacaaaaggacatccccacaccctggccatgtc

SEQ ID NO: 61495 - DNA, 201 bp, Bos taurus; identical to SEQ ID NO: 21003

SEQ ID NO: 61496 - DNA, 201 bp, Bos taurus
gggactggaacctgccctcatgggggagcctcaaagcgggtggaaccctgcagctttctgttcacgggaccccatcctgccctgacctgagagcagcctcgggtggagccctcagtggccaaacagaaccctgctcaccacccccacttcagctgtgatagtcactgccccccccaccactaagacccctagaggtggcag

SEQ ID NO: 61497 - DNA, 201 bp, Bos taurus
tgtgaccatggcagccaatgagagtcagccctgagacttcagctctgagcttacagaggactccactcctggctggggctgggtggctgcagggaggtgaatctggggccaaggttaaagcacctgtagacatttcagtgcctaggatccccacaaaatgatttaatgtctggggcggggaggggggggtggagaaaaacg

SEQ ID NO: 61498 - DNA, 201 bp, Bos taurus; identical to SEQ ID NO: 21004

SEQ ID NO: 61499 - DNA, 201 bp, Bos taurus
gcacgggtcgacgtcaacgcgcgctcgcacggcggctatacgccgctgcatttggcggcgctgcacggccacgaggatgcggccgtgctcttggtagtccacttgggtgcgcaggtgcacgtgcgcgaccacagcggacggcgcgcttaccagtacctgcagtcgggcgcctcgtatgctctgcgtcgcctacttggcgac

SEQ ID NO: 61500 - DNA, 201 bp, Bos taurus
aggccaagagagtggaggtagacagggattttgtagcagacatcagactttcctcccagcgaaaaagacccagaaagaatagaatggctcttggggatataaggtggccatcaaattgaactcatgagctctaaactattagttcaaatacttaataaaaatagcttattttgatacagagtgatttataattcttcattt

SEQ ID NO: 61501 - DNA, 201 bp, Bos taurus; identical to SEQ ID NO: 21005

SEQ ID NO: 61502 - DNA, 201 bp, Bos taurus; identical to SEQ ID NO: 21006

SEQ ID NO: 61503 - DNA, 201 bp, Bos taurus; identical to SEQ ID NO: 21007

SEQ ID NO: 61504 - DNA, 201 bp, Bos taurus
tgacttagcagcagcagcggctttcctctgacatggacgcaccatccacctttaaaactcagacaaagggaggggcaggtgccacctcctaaggcctcactgctgagatcactccaagggggtgttcaggtgtggtgcaggtgtgcaccctcagatcaccaccccgcaagccacaaaggccttccatgaaggttcagcctc

SEQ ID NO: 61505 - DNA, 201 bp, Bos taurus
tcaagagcacagtgatgcaactgaggagggaggccaagatgatgtaaagctgcctttatgacagagatgcagacgtttcaggaaggaggcactgcacaaagtgagatagaggtacagggccccaggcccccagagtccccacagggacatggagctgtgggggaaactggtagtgggcttgactttattgcacagtaacca

SEQ ID NO: 61506 - DNA, 201 bp, Bos taurus; identical to SEQ ID NO: 21008

SEQ ID NO: 61507 - DNA, 201 bp, Bos taurus
cagagagggttaagcaccctgccaaggccatgcggcaaataaatgacagagctgggactccaaaccagccaggtggacacggatctatattcagaccttgtccactgaggcctcttgatacttagcaatatttcatttggatgaatgggagtttttagtacgatggggaaacatctacgtagaacaagattggaggccctg

SEQ ID NO: 61508 - DNA, 201 bp, Bos taurus
ggctggacaccgctgacccttcctgggttcctcttctaaatacacattctcagggtgggaagtgacagccactcaggcctagccctccctgcaagtgggtggagcagatgagagccccgaaggaaagactgagcatgggaagggaggctcctggaggccactgcgcaccccaggaggcttctcctcctcgaatcgtcttca

SEQ ID NO: 61509 - DNA, 201 bp, Bos taurus
aggtttgcgccaggagtagtaagtgaagcagggcaaaccttcaccccacaggcatatgttctccaacctcagggaaataaaaggtgattgttatggccctgcctgattccagcagccctgggtcagatgcttcccataaacagctaccagaagaactcagctgtggccccatcaagtcggtgatcccttcctggaaatgtt

SEQ ID NO: 61510 - DNA, 201 bp, Bos taurus; identical to SEQ ID NO: 21009

SEQ ID NO: 61511 - DNA, 201 bp, Bos taurus; identical to SEQ ID NO: 21010

SEQ ID NO: 61512 - DNA, 201 bp, Bos taurus; identical to SEQ ID NO: 21011

SEQ ID NO: 61513 - DNA, 201 bp, Bos taurus; identical to SEQ ID NO: 21012

SEQ ID NO: 61514 - DNA, 201 bp, Bos taurus; identical to SEQ ID NO: 21013

SEQ ID NO: 61515 - DNA, 201 bp, Bos taurus
gtactgtctgtagattctctgaccatcatcatgactcaatgtcctgtctattgtatcacttactggcttattgtggaaaaaaattttttttattgtaacactcttgagttttcttgctttatttcacaagctcgtccaagatttactgaaaactttgccgcaaatgttcaccaagaccttggagactcagagtgccttggg

SEQ ID NO: 61516 - DNA, 201 bp, Bos taurus
tgccgggtttcttcacctccgagtgaacggcaacggggcccggtggcaggggaggagcattgaggaccagcccaggtgggaggaattagagcggccaaggatgccctcactcaagatggcggcgcaaatctcgcgcttggtcccgacaagcagcgcgcccgtttacgctgcatatgcggccctgcgctctggggggcgggt

SEQ ID NO: 61517 - DNA, 201 bp, Bos taurus
ccagcatatttgatatttgatcacagaattttttttttttaatatactgcattaaaccttggctcagagcacaacttaagaatttaggaatttaatctttaaggaaatgaccacactgtctgttaagcacagtcaggaaccaatgtctcctattaattctaggcctttttttttttttttttttactagtataccatattg

SEQ ID NO: 61518 - DNA, 201 bp, Bos taurus
tgtttgcatttccagttgtattctcttggggtagattctttggatctgaggatatgaatacaactaatgtttttcagaaaaattggtcagtttacattcccctggaagtttatgagaatgctccatcatattgtgctcttgccagcattaaatattatcaagtttaagtcttctctaatttcataagcaaagttaatggtt

SEQ ID NO: 61519 - DNA, 201 bp, Bos taurus
accctggttctgccaacacctctctccaactcccatcacactgatggggggcgggttgagccgacctctgggaaggggcaccttgccatgggctggcctcagtagttgaccccatcatggaatccatcccgtggcatcagaactgaaaagacttcagagactgccttgtacaagtcacgccagactctagtgaggcccggg

SEQ ID NO: 61520 - DNA, 201 bp, Bos taurus
ccgcagtcactttattgcatgtggcacgtctagatggaaaggctttgcaggaattttgctttatgggtaataaaggcctttatgtgcctataatgtggacgtgggtccaaagaggattctgccctgctttctaccaaggggcttggcggagactcctgtgggggctggagctgctggccctgctttgagtagactagaccc

SEQ ID NO: 61521 - DNA, 201 bp, Bos taurus
actaatcagtttcagcaaatagggaatggtatacatggagtctgtaaactgtgagcatcagctgtgtatggcagcgaacccacacttctggcccagcccagctgacggggattgctcaaggatgggaggtggcagcagagcccttgagccacaggcaactcagatgaccccagggccagctgccggcccggcccgagcaca

SEQ ID NO: 61522 - DNA, 201 bp, Bos taurus; identical to SEQ ID NO: 21014

SEQ ID NO: 61523 - DNA, 201 bp, Bos taurus; identical to SEQ ID NO: 21015

SEQ ID NO: 61524 - DNA, 201 bp, Bos taurus; identical to SEQ ID NO: 21016

SEQ ID NO: 61525 - DNA, 201 bp, Bos taurus
ctgctgagtggaaggtggctggccacgttccagagcctttcctctcagcctgtaggtctgcctcgtccagaccaccagccagctgcatgtctctgaaccacggcctcctccccatggttcctcacacacactgccttcccgtcttggtgatgctcaggtatttcttcccgccagcagagatgggctccaggaagaaacctg

SEQ ID NO: 61526 - DNA, 201 bp, Bos taurus
ctgtgtggtagggacagttggcacttggaagggagctcagtgccaggccctgagcataggcatagtgttgttgcttgactgacatgttctaggaggccctaagtcacagcttgtttggggattgtcatgccctcactggaggacctggctcagatttgggagaagattcctacaagggggccgtcccctcacatccatcag

SEQ ID NO: 61527 - DNA, 201 bp, Bos taurus; identical to SEQ ID NO: 21017

SEQ ID NO: 61528 - DNA, 201 bp, Bos taurus; identical to SEQ ID NO: 21018

SEQ ID NO: 61529 - DNA, 201 bp, Bos taurus
ggacgcccctctctccagcaacgctgccttcaggccccagttcctccttcatgcttcaggatttgtgccttactacagaagccccgaggaggggctgcacctaagccctgggccccctgcctctccactgtggggccaggagtccacaggaaagctgcccaggcccagggcagccacactgtgagggagcaggagctggtg

SEQ ID NO: 61530 - DNA, 201 bp, Bos taurus
gctaaggattttcaggagaaactgatgtgttaagaaatggtgttgtgtccacctccaacccccaccggcaaacagaggagatctggtgtccctgaggcctgggctctccttacttcaagtggatctgtgactagtcactgtgcttcacctgactttcctgtctccaaggccatgacccactgaagacactgaacagcactg

SEQ ID NO: 61531 - DNA, 201 bp, Bos taurus; identical to SEQ ID NO: 21019

SEQ ID NO: 61532 - DNA, 201 bp, Bos taurus; identical to SEQ ID NO: 21020

SEQ ID NO: 61533 - DNA, 201 bp, Bos taurus; identical to SEQ ID NO: 21021

SEQ ID NO: 61534 - DNA, 201 bp, Bos taurus; identical to SEQ ID NO: 21022

SEQ ID NO: 61535 - DNA, 201 bp, Bos taurus; identical to SEQ ID NO: 21023

SEQ ID NO: 61536 - DNA, 201 bp, Bos taurus
ctggctgagaaggggtagaatgcagaaaaaagttgattttcaaatggccaggctactatcaacatctgctttcccacctgtctgcacactcccttacattagacctggctccagacctggccctggctccctcacatcggacctgactgtagaaactggacagaaagcccttcatctcttattctctgccctttgctgctt

SEQ ID NO: 61537 - DNA, 201 bp, Bos taurus
atctcctatgggagaaaagtgcttgccttttaaggtgcctcttatagcccccgaaaaaggcaggagaggaggattaatgctccagaaataggggccctgatgggtgcctcccatacacttggttccttccttgggaaaagacacttctgtgtggagaaaaccataaaaccacatttaaatcacactctgcccagaggtggg

SEQ ID NO: 61538 - DNA, 201 bp, Bos taurus; identical to SEQ ID NO: 21024

SEQ ID NO: 61539 - DNA, 201 bp, Bos taurus
aataaggattccacgtctgttttcaggggccaagctgaataaaggtcctctaatttgcataacaaagccagtggaaggtcctgggcaggaaaccccaaagtaaaggggccaagtttcctgagggggcctgagaaaaacatggccctctccccaggacctccttcaagctggaatcaaaccagcaatctaaagataagctca

SEQ ID NO: 61540 - DNA, 201 bp, Bos taurus; identical to SEQ ID NO: 21025

SEQ ID NO: 61541 - DNA, 201 bp, Bos taurus
ggaccacggccaaagtactcattcgaggccaggtggaaggagtaggacagggctctgcgaggtggaggcgagtgcccgcctaggacctggcatggtgagcgcagctctcctactgaggcctggaggagccactggaggtctcatagtttctgtgcacacaggtggcatctgggttatacccatccctggtttaggtgtcac

SEQ ID NO: 61542 - DNA, 201 bp, Bos taurus
catgggtctcaaagaatcagatgagacttagtaactgaacaacagaagataacagaagagccactctgttcccagaggcattccttgagaggacaggccttggggcaagccccctgctcattcaagaacaaatctcctacaggctggtctagaaacttctgctgttttccttttaaacagcatatgtttcaaagtggatac

SEQ ID NO: 61543 - DNA, 201 bp, Bos taurus; identical to SEQ ID NO: 21026

SEQ ID NO: 61544 - DNA, 201 bp, Bos taurus
ttggtcctgccttgtccatcccatccagccaaaacagcccatctgcaagatgcactgcatttcctaggaaggagggcctttgagttacaacccattactcatacttggaggagtcaagaggaagagcttttaccataactgggtttcacagagagtgcagagggtgagcactgtggtggccaggaaccctcagcacagcac

SEQ ID NO: 61545 - DNA, 201 bp, Bos taurus; identical to SEQ ID NO: 21027

SEQ ID NO: 61546 - DNA, 201 bp, Bos taurus
aatggaatctactccaattcatgtaaggcttctcagaggaagagagccaggctgagacccaaaaggatgacgagtagttaaccaggtaacaggccaggccaggaaagaggtccagacacaggcaagggaataggaaggctgtaggtgggtcagcagaccctgcaggtggcaggctccctaaatggaggggtggaggcagga

SEQ ID NO: 61547 - DNA, 201 bp, Bos taurus; identical to SEQ ID NO: 21028

SEQ ID NO: 61548 - DNA, 201 bp, Bos taurus; identical to SEQ ID NO: 21029

SEQ ID NO: 61549 - DNA, 201 bp, Bos taurus
cttttaaaatattggctataccttaaaaataaataaaaatgctccaactgtgatcaggtgtgcagacttgaggtggcaaaaggagcacatgatattggcactgcaattcctcatatgtcattggctaacttgccaaaggtgagattacgaagggatcttcattcaagagaacaaatatgtaactttaagatttctgagtgg

SEQ ID NO: 61550 - DNA, 201 bp, Bos taurus
tatacaagtgtaattactctgttttccaattcatgttgtatttgtgtttgtacacacttatatttgcatgaaataaaaatgagggaaagagtcagtgttcatagcccctgagggaatttcaactgtcataaaatcccaacgacagagaagctgagagatcacactgagctatgcctcatgtgaagtgtgtgtgtgtgtgtg

SEQ ID NO: 61551 - DNA, 201 bp, Bos taurus; identical to SEQ ID NO: 21030

SEQ ID NO: 61552 - DNA, 201 bp, Bos taurus; identical to SEQ ID NO: 21031

SEQ ID NO: 61553 - DNA, 201 bp, Bos taurus; identical to SEQ ID NO: 21032

SEQ ID NO: 61554 - DNA, 201 bp, Bos taurus
tgtgaatcattttgtaaagcaaataatcaatctaaccaaccaatgtctgccagcttatctatctcagagaattttcacataaaagttttgcttaaagttaactatttctgcctgtggaagggatcacaatgtgtttctgaaatgattacctttcaggggcagaggagccaggccaggtttctacaggatgagtacaaatta

SEQ ID NO: 61555 - DNA, 201 bp, Bos taurus
ttctaaacccacccagagggagggagcctgggcaaagatgacatgcatgcacacacacaagcctatgcacaccctgaaaaatatacacatacatgagcaggaaaaaacaacaacaatatcaatgtattggccagagttccctttgaataatgggattattctattcttctcattatactcctgtgtattttctacaatgaa

SEQ ID NO: 61556 - DNA, 201 bp, Bos taurus
gtacatattccaataagtaagtgggaaggattaattcacaggaaacaagtaagacaaaaatccccatttcacacacatccttccaaactcaaaatttggagggaaattacttttacttttggcgtaaattatactaacaacacctcagatcctgaaaagaaagttccaagaacaagtgtcaaagactacacaggggaaaat

SEQ ID NO: 61557 - DNA, 201 bp, Bos taurus
gttttatcccagtttttatagtttgtgataggagggtaaggccaatcccagctactgctcaatggctaagactgaattcttagaattaaaaaaaaattaacattgatattaggcctttaagagtggattattattattttatttatttatttttggttgctctgggtcttcagtgctgcacgggctttttctctagttgag

SEQ ID NO: 61558 - DNA, 201 bp, Bos taurus; identical to SEQ ID NO: 21033

SEQ ID NO: 61559 - DNA, 201 bp, Bos taurus; identical to SEQ ID NO: 21034

SEQ ID NO: 61560 - DNA, 201 bp, Bos taurus; identical to SEQ ID NO: 21035

SEQ ID NO: 61561 - DNA, 201 bp, Bos taurus
aacctggagtgaatgcagttctgattggaggaatgtggggtatgggtgctattgcctgggctctgatccctatgactggactgggttcactcacaacccaacctttccacagagggggccccggtgctataggagatagaacagatcagaggcttgaatcctgcctctgccacttattgactctgggaccttgggttctgc

SEQ ID NO: 61562 - DNA, 201 bp, Bos taurus; identical to SEQ ID NO: 21036

SEQ ID NO: 61563 - DNA, 201 bp, Bos taurus; identical to SEQ ID NO: 21037

SEQ ID NO: 61564 - DNA, 201 bp, Bos taurus; identical to SEQ ID NO: 21038

SEQ ID NO: 61565 - DNA, 201 bp, Bos taurus; identical to SEQ ID NO: 21039

SEQ ID NO: 61566 - DNA, 201 bp, Bos taurus; identical to SEQ ID NO: 21040

SEQ ID NO: 61567 - DNA, 201 bp, Bos taurus; identical to SEQ ID NO: 21041

SEQ ID NO: 61568 - DNA, 201 bp, Bos taurus; identical to SEQ ID NO: 21042

SEQ ID NO: 61569 - DNA, 201 bp, Bos taurus; identical to SEQ ID NO: 21043

SEQ ID NO: 61570 - DNA, 201 bp, Bos taurus; identical to SEQ ID NO: 21044

SEQ ID NO: 61571 - DNA, 201 bp, Bos taurus
gaatccagctctgtagcttgtagggtaggagacaggtcagtgtacacagaatccaaggctgtgccccccttgttctctgactgtgaccatgaatgggccacgattcttctctgtctctttgctcaggcttccatgaaggcttctttcctcttctttgaaatcttaaggaaaccatcctctagctaaatctggccctcattc

SEQ ID NO: 61572 - DNA, 201 bp, Bos taurus
cccatgctgctcagcggtggagctcctcctccacgtgccagctggaggaaaggagaaagttaacacagggagaagagccatcctgggtgtgcttgtgcctggggctgtctgttttatctgtgggcctcttgttcatgaagcccaaataagtgctgctaaaggtgtattaaaatgtaaagcctttttttaatggtctttctc

SEQ ID NO: 61573 - DNA, 201 bp, Bos taurus; identical to SEQ ID NO: 21045

SEQ ID NO: 61574 - DNA, 201 bp, Bos taurus; identical to SEQ ID NO: 21046

SEQ ID NO: 61575 - DNA, 201 bp, Bos taurus
acaactgagtgcatgcacgcatacacccacacacccacacatattactttattctcctccaggcacttccatacctatcatttcattgtatcttcatgtgcgactgagagaagaaatggcctgaaccctattacagagaaagaaaactaaggcacagagaagtggcttatacatagtcacatgactcctgaggtccaatcc

SEQ ID NO: 61576 - DNA, 201 bp, Bos taurus
caactagagtgtaaacagtaaagttagggaaccctgtttgtcttgttctctgctagtacggtagcaggcacatactaggagtgcggtacttgatgttcccttgtaatccgttttcctctgtttgaaaccgcccctctctcctcccagcgctggcttcttcatgctcctaaaacaaagtctatcttatggcttttaagatgc

SEQ ID NO: 61577 - DNA, 201 bp, Bos taurus; identical to SEQ ID NO: 21047

SEQ ID NO: 61578 - DNA, 201 bp, Bos taurus
ttattttattatatgttatttacttctctggacctgctaacctggctatggatttgtatacaggcaggagttttgttcaggttgtcttttaatttctagagcttagcacagataccctattgatacaataaacatttgagaaagggaagagaaataaaggagtacttagatgacttttatattaactagataaaaagacat

SEQ ID NO: 61579 - DNA, 201 bp, Bos taurus; identical to SEQ ID NO: 21048

SEQ ID NO: 61580 - DNA, 201 bp, Bos taurus
aaaaagagccacaaacgagtgctccttttagacagctgctatatttaaaccagagtttattaatccttatatagtctgtttctcaagtgcttcagaaaaggggtataaattgtatggagcatacagtggactctgattttgcacattttggcaagaagagaaggtcttagcttctgtacatatctctcctgcaagaaagaa

SEQ ID NO: 61581 - DNA, 201 bp, Bos taurus
tagaaatgagtccagcagttctgaaaggctttccaggaaagacgtacaagaaagaattaaccctccttagggaaagttgggccattaaccttaccgtcaggacttctccaatactctcaggcttctaatggaccttctactagaacctatccccattctgagacagggcttaaagttctagttactatataataaacacag

SEQ ID NO: 61582 - DNA, 201 bp, Bos taurus; identical to SEQ ID NO: 21050

SEQ ID NO: 61583 - DNA, 201 bp, Bos taurus
tggaactgtcacggcgcctaaggtggtgggtgtgtcgcttagctaacgtattacagtgaacacataatgaggcttacagtctactggcaaatttcccaccgtcttgggcctagtttgttctgtcgcatcctgtttttctcagtggctctgtcctcctcttaatttcgttagtcattgtgccctgctcccttcttccttctc

SEQ ID NO: 61584 - DNA, 201 bp, Bos taurus
ggcacgcagagcgagaggaaatgatgtctcgtgtttgtcagcttggctgtggcagatgcattttatccggagccaaaggaccagctactatgccaggctacggcacctatctgctgtgtggcctcaggcaagttatttcacttctctggatctcaaactgctcatctctaaaatgagagagatttaattaaatcagggatg

SEQ ID NO: 61585 - DNA, 201 bp, Bos taurus
gccagtgtgtgatactgctagatgttgggctctgtcccttgaccgtttctttgctttgcctgtctgcttggcttcttcatgcatgaactcccctccagctggtaaggaaaatggccagtgaactcacatcttcctactttggcacatccctaatcataagggatagtacttgtaagttcccgcagaacagtcccagtgtgg

SEQ ID NO: 61586 - DNA, 201 bp, Bos taurus; identical to SEQ ID NO: 21051

SEQ ID NO: 61587 - DNA, 201 bp, Bos taurus
cagggatcgaaccccagtctcctgcattgaaggtggattctctaccaactgagctccctgtaccttggatcaaatactggctcaaagcaaccgtatgcaagcttaatattagcctttttcttagtttcacagtaactattttattattttaggaagtataaataccaatgaacctagtgaaataggtcacttatattctaa

SEQ ID NO: 61588 - DNA, 201 bp, Bos taurus; identical to SEQ ID NO: 21052

SEQ ID NO: 61589 - DNA, 201 bp, Bos taurus; identical to SEQ ID NO: 21053

SEQ ID NO: 61590 - DNA, 201 bp, Bos taurus; identical to SEQ ID NO: 21054

SEQ ID NO: 61591 - DNA, 201 bp, Bos taurus; identical to SEQ ID NO: 21055

SEQ ID NO: 61592 - DNA, 201 bp, Bos taurus; identical to SEQ ID NO: 21056

SEQ ID NO: 61593 - DNA, 201 bp, Bos taurus
tcccaaagtatgttgtgagtcaaagacattatcatgaagataataagatgaaaggcacataaaagacaccaagtttagacatttgttggttactgagaaatgaaaatgaagcagtcttaaacagtataaaggaagacaggggagaatgttttcccagactttattggctccattccttctcccaaagcagaactgagaaca

SEQ ID NO: 61594 - DNA, 201 bp, Bos taurus; identical to SEQ ID NO: 21057

SEQ ID NO: 61595 - DNA, 201 bp, Bos taurus; identical to SEQ ID NO: 21058

SEQ ID NO: 61596 - DNA, 201 bp, Bos taurus; identical to SEQ ID NO: 21059

SEQ ID NO: 61597 - DNA, 201 bp, Bos taurus; identical to SEQ ID NO: 21060

SEQ ID NO: 61598 - DNA, 201 bp, Bos taurus; identical to SEQ ID NO: 21061

SEQ ID NO: 61599 - DNA, 201 bp, Bos taurus; identical to SEQ ID NO: 21062

SEQ ID NO: 61600 - DNA, 201 bp, Bos taurus
aataacaatagcaattagtgacatgcattttaaaagaatccatttaagatatctcctgtctgggaagaccagttttaaaacgctgatctcacaccagacaaaagaccagaaattatggaagggcatctgtgtcataacaaagagaacaataatagtaaaacgaaagacatacagagagaatttcaaaagaagtgtaactta

SEQ ID NO: 61601 - DNA, 201 bp, Bos taurus; identical to SEQ ID NO: 21063

SEQ ID NO: 61602 - DNA, 201 bp, Bos taurus; identical to SEQ ID NO: 21064

SEQ ID NO: 61603 - DNA, 201 bp, Bos taurus; identical to SEQ ID NO: 21065

SEQ ID NO: 61604 - DNA, 201 bp, Bos taurus; identical to SEQ ID NO: 21066

SEQ ID NO: 61605 - DNA, 201 bp, Bos taurus
aagaagcagccatgggatcaaggagatccaactcaagaaaaactaaggaaatcctaagtaacagtggaggaacatcccagatgacattcgtgcatgcctacagtaagcaaccagtctggatgactgcaacaggctggaaggctctgggagaactttctctaagatgtaaacaatagcacactgatgtgtttcaaagtatag

SEQ ID NO: 61606 - DNA, 201 bp, Bos taurus
ccaggcactcccagcagcagacaccggttttccgcggcgggcggcggcgtggttaaaaaaaaaaaaaaaaaagtgtcgcggcccctttaagagccacagcgccttctctaagataccatcttgcaccaggagttcacgtaagctctctacctaccttgctaaatccctcctcatttactgggtacgaccggcgggcgggcc

SEQ ID NO: 61607 - DNA, 201 bp, Bos taurus; identical to SEQ ID NO: 21067

SEQ ID NO: 61608 - DNA, 201 bp, Bos taurus; identical to SEQ ID NO: 21068

SEQ ID NO: 61609 - DNA, 201 bp, Bos taurus; identical to SEQ ID NO: 21069

SEQ ID NO: 61610 - DNA, 201 bp, Bos taurus; identical to SEQ ID NO: 21070

SEQ ID NO: 61611 - DNA, 201 bp, Bos taurus
ccctcctgaccccaggaacagttttctgagcctgttgtgttagatttctgcccggagcacttggccataacaaagtggagagggaaaaatcaatacaaccggaaccgaatgcacacttaaaacatcagccttcaactgtgcaatcatgtccttgtcactaacatccaagtgcttttgctccatgatctgctcagagtctta

SEQ ID NO: 61612 - DNA, 201 bp, Bos taurus
tacaagaaatttatagtctttctccccacccccatacacacacttaaatctgatgatagctggtgattcagagattgtttgctttgacatgaataaaatgaggtttccattttgatggaattaatcagttaaatttgacataaaaaacagttcaagaaagttctcatggtggtggtgttctgtctgcccaaggtacggtct

SEQ ID NO: 61613 - DNA, 201 bp, Bos taurus; identical to SEQ ID NO: 21071

SEQ ID NO: 61614 - DNA, 201 bp, Bos taurus; identical to SEQ ID NO: 21072

SEQ ID NO: 61615 - DNA, 201 bp, Bos taurus; identical to SEQ ID NO: 21073

SEQ ID NO: 61616 - DNA, 201 bp, Bos taurus
aaattgaaactcagattaagactttaattagctaaaatatagcctatcttcagagtaaaaaaaatcatctctattgtgtctccttctaaatacagaatttctccaataagaaataatttgtctcctatcacctgaaattttttttccttttaaagaatgtatttttctactattaaaaatttatacattatcaatgaaaac

SEQ ID NO: 61617 - DNA, 201 bp, Bos taurus
cagtctaatgcatgggactgagctatttagtcagcaaccactgaaaccaccttcagtgaagtaccttcttgggagcctgcaacagcttctagatcatcctggacaaaaatgacttaggtaattgctaaaaggaaagaagcataagtcatttcattttaaggtagctatctttatatgtaatttaagttagtctttggttta

SEQ ID NO: 61618 - DNA, 201 bp, Bos taurus; identical to SEQ ID NO: 21074

SEQ ID NO: 61619 - DNA, 201 bp, Bos taurus; identical to SEQ ID NO: 21075

SEQ ID NO: 61620 - DNA, 201 bp, Bos taurus; identical to SEQ ID NO: 21076

SEQ ID NO: 61621 - DNA, 201 bp, Bos taurus; identical to SEQ ID NO: 21077

SEQ ID NO: 61622 - DNA, 201 bp, Bos taurus; identical to SEQ ID NO: 21078

SEQ ID NO: 61623 - DNA, 201 bp, Bos taurus
gtgagaaacaaataagtactccgaagtctatcttataattctagaaaatgtaagctaatctgtagtatcaaaaagcaaatcagcagttcaccgtggccagcataaggggtagtgaaagggaggaatgaattacaaatggattcatgttgatatatggcaaaaccaatacaatattgtaaagtaattggcctccaattaaaa

SEQ ID NO: 61624 - DNA, 201 bp, Bos taurus; identical to SEQ ID NO: 21079

SEQ ID NO: 61625 - DNA, 201 bp, Bos taurus; identical to SEQ ID NO: 21080

SEQ ID NO: 61626 - DNA, 201 bp, Bos taurus
gggacctaccccaaggcttctcagctcagtccccatagaacagcccttgttccaaaaaaaaaaaaaaaaaagatggctcaaaggccaaaccagtccaactagaacaatctggcttcaaatcagatcaaaatgccatgacctcttccacatagaagagggccttcctgtaaaagatgaaacttgaaaatagatctaaaaagg

SEQ ID NO: 61627 - DNA, 201 bp, Bos taurus
tctactgaattggaatacctaggtttggggccaaaatttttgaatttttaataagctgcctaagtgactcttccatattcagttcaagggactaaccattaaaaaccaatgggccacatgacttttgacagataaggtctgtttccatgataccaataaacaatatggcaaagtaggtaactgggaatgctgcagaggtgg

SEQ ID NO: 61628 - DNA, 201 bp, Bos taurus; identical to SEQ ID NO: 21081

SEQ ID NO: 61629 - DNA, 201 bp, Bos taurus; identical to SEQ ID NO: 21082

SEQ ID NO: 61630 - DNA, 201 bp, Bos taurus; identical to SEQ ID NO: 21083

SEQ ID NO: 61631 - DNA, 201 bp, Bos taurus
gaaaaatgtggaatgtatatctgagtttaccattgcataagtaaatcccttcctattagattaaggggtacatctatcacataaggttctaatgttgtagactggccttttggtctctcacaaggataaatttgaatactttgataggcttcttgtattttggtttgagaaactcctgtaatttggcaagaaattttttgt

SEQ ID NO: 61632 - DNA, 201 bp, Bos taurus
gtgggagacccacagcgagatggaaaatggccagcctgagaagagttagggatgagaggtacttggtggtgccgtgagaacatgtcataggggatggggctgaggtgagtgtgtcagggtagcatgactgaggaggtgagggagatgagagctgaaagatgggtaagggttaaacaggcaaagaggaggaagatgttggct

SEQ ID NO: 61633 - DNA, 201 bp, Bos taurus; identical to SEQ ID NO: 21084

SEQ ID NO: 61634 - DNA, 201 bp, Bos taurus
ttcctaaatcagtatttatgtaattactggttaactgacagtctcccaaataaaacgtaagttctgtgaaggcaagagcttggtccttactcatactctcacactttttcccatggcagggggacagagacatttaagagaaaaaaatgaaagaaaaatcagttgtggttttaatcacaattgcactaagtttttaaagga

SEQ ID NO: 61635 - DNA, 201 bp, Bos taurus
gattttcctttgtggaacccctcccctgcctcaagcccactgatgagcacatgaccaggactggccaatcagaacagttcattctctggcccccaaggattcattaattcactggctagactgtaaagccagccctgagatatttgctagagtctgtctgtctttctcctggtgttgctaaactttcaatttaaagctgct

SEQ ID NO: 61636 - DNA, 201 bp, Bos taurus
aagtgttcagcatagatgatggccctagaaatgtgagcttttattattatctgcttgatatggctagataatgaagtacatattaaaaggtggttaaaacctgagactgaaaagacagatggccagagaccagatcacaaaaggtagtagagactatgctagagagttcaggctttcatcaaagagttggaatgcactgga

SEQ ID NO: 61637 - DNA, 201 bp, Bos taurus; identical to SEQ ID NO: 21085

SEQ ID NO: 61638 - DNA, 201 bp, Bos taurus
ggagaggcagagttgctcatcaaagagcaactagtggatatgcaataaacgttgaatgaatgaatgacagctacgactaggggcaattatatgtgccatacacaaggatggaaaaggtaatcaaagaaatcttcatagtagagatgatacttgaacgagaccttggggttgggtataattttaatagcacaggaagatgct

SEQ ID NO: 61639 - DNA, 201 bp, Bos taurus; identical to SEQ ID NO: 21086

SEQ ID NO: 61640 - DNA, 201 bp, Bos taurus; identical to SEQ ID NO: 21087

SEQ ID NO: 61641 - DNA, 201 bp, Bos taurus; identical to SEQ ID NO: 21088

SEQ ID NO: 61642 - DNA, 201 bp, Bos taurus; identical to SEQ ID NO: 21089

SEQ ID NO: 61643 - DNA, 201 bp, Bos taurus
gctggggagagtgaagacaagtggctgaggaaggtggagtcaagagtcaagctaacttgacttgtgatgttaacttgtgcagttaaaagtaaagaatgcacgctttctagaactgtgtgttcctagaagttgtgggctacatctagggactcactgcagcagttggtgcagaatgtggcccacaatgggcgctgagccacc

SEQ ID NO: 61644 - DNA, 201 bp, Bos taurus
gcactaccctcgaagctcccaagctctggaggggctctggggaagggggaatcactctctgtgatgtgtctttcatgtactaagccgaatgaccttggcccgaatcgctgagggttatgtaagattaggtagccacttagtcaaaaatagctttcatgctgactccagcccgcagaacatcatccaagcaaagggggcaca

SEQ ID NO: 61645 - DNA, 201 bp, Bos taurus; identical to SEQ ID NO: 21090

SEQ ID NO: 61646 - DNA, 201 bp, Bos taurus; identical to SEQ ID NO: 21091

SEQ ID NO: 61647 - DNA, 201 bp, Bos taurus; identical to SEQ ID NO: 21092

SEQ ID NO: 61648 - DNA, 201 bp, Bos taurus; identical to SEQ ID NO: 21093

SEQ ID NO: 61649 - DNA, 201 bp, Bos taurus; identical to SEQ ID NO: 21094

SEQ ID NO: 61650 - DNA, 201 bp, Bos taurus
gaagagaccttagtgaacggctcatcagacctcaccactggaagcctgactgtgccccacccccaggtgggggagagtatgtctgtagtaacagtcatgagggtaagtgacaggtactgtgattgtgctttacctgagagagttaaaaaggcagctagacccatgcagtgtgattctggagtagtggtaattaggaattgg

SEQ ID NO: 61651 - DNA, 201 bp, Bos taurus
aggtcaccagggcctgggatctgggctgtagtgaatgcctcttatgagccacaccagcttggaactgggtcacaggttgcagggagggtggctggcttaagggccaaagccaaagcacatggcggggcagtgcgggggtggcagtggggctcagggcccccacccagaaccaagcactacggcaccagaagagccttcttc

SEQ ID NO: 61652 - DNA, 201 bp, Bos taurus
gacctctccatgctttctgcttcctttcctcatccagcaaatgaggccagtttgtcccaccagtccccagggctcaggaaagaacaggtccaagaaggggggacagaaagatgggtagaggcctctccaggagatgtctgtggaggggtaggcacctcctgcctccaccctgggagaggatggcaatgaagggggccacgg

SEQ ID NO: 61653 - DNA, 201 bp, Bos taurus; identical to SEQ ID NO: 21095

SEQ ID NO: 61654 - DNA, 201 bp, Bos taurus; identical to SEQ ID NO: 21096

SEQ ID NO: 61655 - DNA, 201 bp, Bos taurus; identical to SEQ ID NO: 21097

SEQ ID NO: 61656 - DNA, 201 bp, Bos taurus; identical to SEQ ID NO: 21098

SEQ ID NO: 61657 - DNA, 201 bp, Bos taurus
aacatgagagcaactgaggatgcagacataggacagttaatctcaggtctggctagagcagccttcaggtacccaggatgaagtggagccagcatggccacggcaggcatttgtgaaatatactaaaaatgtttaaaatggctatagaaagagctacaagcctggccttgtcatggagggcacttctagtatgtcaccagg

SEQ ID NO: 61658 - DNA, 201 bp, Bos taurus; identical to SEQ ID NO: 21102

SEQ ID NO: 61659 - DNA, 201 bp, Bos taurus; identical to SEQ ID NO: 21103

SEQ ID NO: 61660 - DNA, 201 bp, Bos taurus; identical to SEQ ID NO: 21104

SEQ ID NO: 61661 - DNA, 201 bp, Bos taurus; identical to SEQ ID NO: 21105

SEQ ID NO: 61662 - DNA, 201 bp, Bos taurus; identical to SEQ ID NO: 21106

SEQ ID NO: 61663 - DNA, 201 bp, Bos taurus; identical to SEQ ID NO: 21108

SEQ ID NO: 61664 - DNA, 201 bp, Bos taurus; identical to SEQ ID NO: 21110

SEQ ID NO: 61665 - DNA, 201 bp, Bos taurus; identical to SEQ ID NO: 21112

SEQ ID NO: 61666 - DNA, 201 bp, Bos taurus; identical to SEQ ID NO: 21113

SEQ ID NO: 61667 - DNA, 201 bp, Bos taurus; identical to SEQ ID NO: 21114

SEQ ID NO: 61668 - DNA, 201 bp, Bos taurus; identical to SEQ ID NO: 21117

SEQ ID NO: 61669 - DNA, 201 bp, Bos taurus; identical to SEQ ID NO: 21118

SEQ ID NO: 61670 - DNA, 201 bp, Bos taurus; identical to SEQ ID NO: 21120

SEQ ID NO: 61671 - DNA, 201 bp, Bos taurus; identical to SEQ ID NO: 21128

SEQ ID NO: 61672 - DNA, 201 bp, Bos taurus; identical to SEQ ID NO: 21130

SEQ ID NO: 61673 - DNA, 201 bp, Bos taurus; identical to SEQ ID NO: 21131

SEQ ID NO: 61674 - DNA, 201 bp, Bos taurus; identical to SEQ ID NO: 21132

SEQ ID NO: 61675 - DNA, 201 bp, Bos taurus; identical to SEQ ID NO: 21133

SEQ ID NO: 61676 - DNA, 201 bp, Bos taurus; identical to SEQ ID NO: 21134

SEQ ID NO: 61677 - DNA, 201 bp, Bos taurus; identical to SEQ ID NO: 21135

SEQ ID NO: 61678 - DNA, 201 bp, Bos taurus; identical to SEQ ID NO: 21136

SEQ ID NO: 61679 - DNA, 201 bp, Bos taurus; identical to SEQ ID NO: 21137

SEQ ID NO: 61680 - DNA, 201 bp, Bos taurus; identical to SEQ ID NO: 21138

SEQ ID NO: 61681 - DNA, 201 bp, Bos taurus; identical to SEQ ID NO: 21139

SEQ ID NO: 61682 - DNA, 201 bp, Bos taurus; identical to SEQ ID NO: 21140

SEQ ID NO: 61683 - DNA, 201 bp, Bos taurus; identical to SEQ ID NO: 21142

SEQ ID NO: 61684 - DNA, 201 bp, Bos taurus; identical to SEQ ID NO: 21143

SEQ ID NO: 61685 - DNA, 201 bp, Bos taurus; identical to SEQ ID NO: 21144

SEQ ID NO: 61686 - DNA, 201 bp, Bos taurus; identical to SEQ ID NO: 21145

SEQ ID NO: 61687 - DNA, 201 bp, Bos taurus; identical to SEQ ID NO: 21148

SEQ ID NO: 61688 - DNA, 201 bp, Bos taurus; identical to SEQ ID NO: 21151

SEQ ID NO: 61689 - DNA, 201 bp, Bos taurus; identical to SEQ ID NO: 21154

SEQ ID NO: 61690 - DNA, 201 bp, Bos taurus; identical to SEQ ID NO: 21157

SEQ ID NO: 61691 - DNA, 201 bp, Bos taurus; identical to SEQ ID NO: 21159

SEQ ID NO: 61692 - DNA, 201 bp, Bos taurus; identical to SEQ ID NO: 21161

SEQ ID NO: 61693 - DNA, 201 bp, Bos taurus; identical to SEQ ID NO: 21162

SEQ ID NO: 61694 - DNA, 201 bp, Bos taurus; identical to SEQ ID NO: 21163

SEQ ID NO: 61695 - DNA, 201 bp, Bos taurus; identical to SEQ ID NO: 21164

SEQ ID NO: 61696 - DNA, 201 bp, Bos taurus; identical to SEQ ID NO: 21165

SEQ ID NO: 61697 - DNA, 201 bp, Bos taurus; identical to SEQ ID NO: 21166

SEQ ID NO: 61698 - DNA, 201 bp, Bos taurus; identical to SEQ ID NO: 21169

SEQ ID NO: 61699 - DNA, 201 bp, Bos taurus; identical to SEQ ID NO: 21173

SEQ ID NO: 61700 - DNA, 201 bp, Bos taurus; identical to SEQ ID NO: 21174

SEQ ID NO: 61701 - DNA, 201 bp, Bos taurus; identical to SEQ ID NO: 21175

SEQ ID NO: 61702 - DNA, 201 bp, Bos taurus; identical to SEQ ID NO: 21176

SEQ ID NO: 61703 - DNA, 201 bp, Bos taurus; identical to SEQ ID NO: 21177

SEQ ID NO: 61704 - DNA, 201 bp, Bos taurus; identical to SEQ ID NO: 21178

SEQ ID NO: 61705 - DNA, 201 bp, Bos taurus; identical to SEQ ID NO: 21179

SEQ ID NO: 61706 - DNA, 201 bp, Bos taurus
gaagaatggtaaatgtaatgtggtaaggaaaaaggcagtcctggtgggaaagctggcttgggcaaagaataggtggccctcaagaccagtgttctagtgcatgtgatgagattagagacaaagtctgagctggtgagtgtgactgagagggctcacccaggggccagaagctgcaggaacagctgcacagaattcaggcat

SEQ ID NO: 61707 - DNA, 201 bp, Bos taurus; identical to SEQ ID NO: 21185

SEQ ID NO: 61708 - DNA, 201 bp, Bos taurus; identical to SEQ ID NO: 21186

SEQ ID NO: 61709 - DNA, 201 bp, Bos taurus; identical to SEQ ID NO: 21187

SEQ ID NO: 61710 - DNA, 201 bp, Bos taurus
agtttttaaaagtactgatatgttatagcaactttaaataattacataaacaacaatgaaaattttgttttatgcctgggaatttttatcttttatgatacttgttatctgtttatttgactatattgcttatcttggttgaaatatatacatttgacctcctcattgggtagccatttaaaattggtagatacatagagc

SEQ ID NO: 61711 - DNA, 201 bp, Bos taurus; identical to SEQ ID NO: 21189

SEQ ID NO: 61712 - DNA, 201 bp, Bos taurus
aacccaggttggtacagtgaagagtggtgtctatggcaaattggagaatgccctctctgtttaaagttgtttaaattcaaataaaaaataaaaatccattgtactggctaaatagaagatctaactagccactgcatctactatggtaggcctgttcccatacaggatttttattttatgattaaactcagcactacatta

SEQ ID NO: 61713 - DNA, 201 bp, Bos taurus; identical to SEQ ID NO: 21192

SEQ ID NO: 61714 - DNA, 201 bp, Bos taurus; identical to SEQ ID NO: 21194

SEQ ID NO: 61715 - DNA, 201 bp, Bos taurus
aaagcccaactcagtgaaagctcccgcagtggaagctgaaggcaaagaaaatccaactaagtggaagtgacaagaagcccagcatactggaaactgggacggcaaaaacaaactcggccaaaagcccatgcgactcaatctcagattccagaagacctctggttggggtaagaagtcctcatccctacggctggaaggaca

SEQ ID NO: 61716 - DNA, 201 bp, Bos taurus; identical to SEQ ID NO: 21195

SEQ ID NO: 61717 - DNA, 201 bp, Bos taurus; identical to SEQ ID NO: 21196

SEQ ID NO: 61718 - DNA, 201 bp, Bos taurus; identical to SEQ ID NO: 21197

SEQ ID NO: 61719 - DNA, 201 bp, Bos taurus
taagagctgttttgatatctcatggacttttcatttacatgattagaaatagagactcactacatatgccaacagttaaccactgtgacttttaaaatagtcatatttagtgacaggaagcatgagatgaatttttgtcagattttttagaaaaagatctactctacagcatgtttttagtttacatttttgggggtaaca

SEQ ID NO: 61720 - DNA, 201 bp, Bos taurus; identical to SEQ ID NO: 21199

SEQ ID NO: 61721 - DNA, 201 bp, Bos taurus; identical to SEQ ID NO: 21200

SEQ ID NO: 61722 - DNA, 201 bp, Bos taurus; identical to SEQ ID NO: 21201

SEQ ID NO: 61723 - DNA, 201 bp, Bos taurus; identical to SEQ ID NO: 21202

SEQ ID NO: 61724 - DNA, 201 bp, Bos taurus; identical to SEQ ID NO: 21203

SEQ ID NO: 61725 - DNA, 201 bp, Bos taurus; identical to SEQ ID NO: 21204

SEQ ID NO: 61726 - DNA, 201 bp, Bos taurus; identical to SEQ ID NO: 21205

SEQ ID NO: 61727 - DNA, 201 bp, Bos taurus; identical to SEQ ID NO: 21206

SEQ ID NO: 61728 - DNA, 201 bp, Bos taurus; identical to SEQ ID NO: 21207

SEQ ID NO: 61729 - DNA, 201 bp, Bos taurus
tggccaacttttcaaagatactttagataaccagaaagaaaacttattttacaaatttgtggggaagttccctaaatttgttgaataattttccatctgctaaggccaaacaccattttgatgttggcataaccatgtcatattttattacttcttttctttttactgtaaagatggacttttgttgtcactgttatcatt

SEQ ID NO: 61730 - DNA, 201 bp, Bos taurus
ctgctctctgttgaactaatttaggcaagtttatgctatccagtttgcactccacacagctgctgaaaaatggccaagttctggggcccaccttggcttcgtaaaggatggagcatacctcactgacctcataaacttcacgtatgagatgtttcactttgaataagggactcaaactgactttggaccatagttcagtga

SEQ ID NO: 61731 - DNA, 201 bp, Bos taurus
ctttagaatcaaactgctttgaccatctaaaaagggatgcacttttgttttagtttgacagaacatagttttcttccacagtcaacccaactgtgaggaacatatcagaaattaaactagactaagttaaactaaattaatggaatgcctctactgagttttttaagtgaattgatgaaagaagtttgttccttaacataa

SEQ ID NO: 61732 - DNA, 201 bp, Bos taurus
atcatcatcatcgtatctgtttgccatttgtaatagtgttgatgatagtttgacaattagaacagttattctgttccatttgaatgttacctaatatcctggcttttttaaaaaaaagtatggctagcattttcacaatattcaaaatactttagaagcccacaatatgcagttcgacaaaacgatttctcatttccaacc

SEQ ID NO: 61733 - DNA, 201 bp, Bos taurus
ccaataactaatattatcaacgttgtatttaaaatgcaagctgtgtgatagctgtattcagccagggggaaaagacccggatgcatttggttcagatgggcaacctgggctttgggcactcagtgatgccaagtgactcacccgggggaccgtctcttgtagcaggtttctctccagggatgtgtatccccaaccctgaga

SEQ ID NO: 61734 - DNA, 201 bp, Bos taurus
aatttggtgttgctgtattttaattcagcaatttggctactcaaagtctacgctgccatctattagtaaatgaattggactaatctctctgttagttgtgttgaaatggtttgccaataggtatggagagtaagaatatccaagacacagatttttaaagccccaattttatcatagattagccctttcccccctctggag

SEQ ID NO: 61735 - DNA, 201 bp, Bos taurus; identical to SEQ ID NO: 21208

SEQ ID NO: 61736 - DNA, 201 bp, Bos taurus
aatgcagagggtgaatgagggtagtgagcagcttggccagtgaatggaaggatgtgatggaagagccgtggaaaatagtaggagaggtgcagcaggaacacttgatggatggcctagaaatctggcaggaggtttaatttgattaatttggcaacagggaggtgctttaagttcataagctggagtataatacaataaaat

SEQ ID NO: 61737 - DNA, 201 bp, Bos taurus
cgtgcaaaggccctgaggctgggatgagcttggcctattccaggaacagagaggagagcggtatggctgaaacacaagagagagaagttaggaggtggacagaggagattatgggccgggtatagtcattgcccagcaaaggcatgccaggcctctcttggcatcttttttcatcatctccagtgggacatcttcctgtcc

SEQ ID NO: 61738 - DNA, 201 bp, Bos taurus; identical to SEQ ID NO: 21209

SEQ ID NO: 61739 - DNA, 201 bp, Bos taurus
caggtcatatcacagctcttctcagactttcccagggcatctcctctcccatagaatggtgtccaggtgcaacattggccattcatttgcaaaagcaaattcctgcttccatctgatctcctttcttccttaccctctccttccactggcccagtgtccaccttcttgttctccccatagctcacaaaatacaccccatcc

SEQ ID NO: 61740 - DNA, 201 bp, Bos taurus; identical to SEQ ID NO: 21210

SEQ ID NO: 61741 - DNA, 201 bp, Bos taurus
gggagcacaagcttggctcccaggtcagctgtgagtacctcccaccaccagtacccccaccaacatgacctcaaggaagaggaaatggccacactgactcttgcatgtattgcctctcgatgcttctcagatctacctgtgttctttcctctccactccttgcgcaaaccaccacccttttcctgctcctgcttgtgcttt

SEQ ID NO: 61742 - DNA, 201 bp, Bos taurus; identical to SEQ ID NO: 21211

SEQ ID NO: 61743 - DNA, 201 bp, Bos taurus
gtaaattttcttgcatgactgtttggcactctgtgctttggagggatccaggtcgtcttctgtccatgtgctctagtagtttagggctgaagatagacacggtgataggcatgtatgcaaacagtgttcagatagcagaataaaacatttacgtcaacacatacgtggataacaaagggttttacaaatttcctctagatt

SEQ ID NO: 61744 - DNA, 201 bp, Bos taurus
ggcaagggtccttctcgctctgcatggtggggaaggggggtcattgtggtctctagataatctctgatttattctctgtctccctcttggttggggctgaggtagcctcaccagctgaaatcagactgggtttttctcacttccatttgttgccatctttaagatgctgtctgtgagatggtgtctacctccttctctgga

SEQ ID NO: 61745 - DNA, 201 bp, Bos taurus; identical to SEQ ID NO: 21212

SEQ ID NO: 61746 - DNA, 201 bp, Bos taurus; identical to SEQ ID NO: 21213

SEQ ID NO: 61747 - DNA, 201 bp, Bos taurus
tttagacttttacttgcacatgaattgttctacagtggtcaccaagttccctagttctggtcttccaggcccaagcccagagtgcatgtgatggtcccattccgcatcataacatctgtttggcctactgtctcatgtagaggtgtaatcactggcaggaatcagtggcttttccccaagagtaatgaggtggaaaaagtt

SEQ ID NO: 61748 - DNA, 201 bp, Bos taurus; identical to SEQ ID NO: 21214

SEQ ID NO: 61749 - DNA, 201 bp, Bos taurus; identical to SEQ ID NO: 21215

SEQ ID NO: 61750 - DNA, 201 bp, Bos taurus; identical to SEQ ID NO: 21216

SEQ ID NO: 61751 - DNA, 201 bp, Bos taurus; identical to SEQ ID NO: 21217

SEQ ID NO: 61752 - DNA, 201 bp, Bos taurus
tcctggtcatcagtagaccctcataccaataggataaggaccagatacctaaacgtggcaaacgcaccctgcacagatttggcaatggcttcatcatacaataaaaagctgaacaaatgcaaaatcaactaaccttacatctgtaagagaggtgaggtcactgagcaaaccactgccctcaacactggagaggcagatagg

SEQ ID NO: 61753 - DNA, 201 bp, Bos taurus; identical to SEQ ID NO: 21218

SEQ ID NO: 61754 - DNA, 201 bp, Bos taurus
gcccaaaaatagagtaggaacccattttattagaagtaaagcagaagggttcagccacccaaaggtcacacaccagtgatttaattggaaagatttttccctataaaaaagattagttccaattaatggaaaattcaaattatgtttatcaatataaacactaacaaaatgctatcattccatagcatattacttgcacag

SEQ ID NO: 61755 - DNA, 201 bp, Bos taurus; identical to SEQ ID NO: 21219

SEQ ID NO: 61756 - DNA, 201 bp, Bos taurus; identical to SEQ ID NO: 21221

SEQ ID NO: 61757 - DNA, 201 bp, Bos taurus
ggtatcttaactccatccaagcttgttcatcttaacttctcagggctgtgtgagctagatgctggaggaggtgcttgtctgttcctctaggccttcatcctctgactcctccacatttctgcacaccccgctggagtacagcttcctgctggcagagccacgccctcttacatattcctaggactgagtcctggggtgaaa

SEQ ID NO: 61758 - DNA, 201 bp, Bos taurus; identical to SEQ ID NO: 21222

SEQ ID NO: 61759 - DNA, 201 bp, Bos taurus; identical to SEQ ID NO: 21223

SEQ ID NO: 61760 - DNA, 201 bp, Bos taurus
tggaaacagattccaagtaattctaacagtctgcagtcatgtgaaacttcaagagtttaaagcaacaggagaaatgagactgctatttgttaggcctgctcgaccacatggcttcatttacatcattccattgggctatgatgttgggctggggttaaaagtttagtcttcagacaaaacaggtgattcagttggtgtcac

SEQ ID NO: 61761 - DNA, 201 bp, Bos taurus; identical to SEQ ID NO: 21224

SEQ ID NO: 61762 - DNA, 201 bp, Bos taurus; identical to SEQ ID NO: 21225

SEQ ID NO: 61763 - DNA, 201 bp, Bos taurus; identical to SEQ ID NO: 21226

SEQ ID NO: 61764 - DNA, 201 bp, Bos taurus; identical to SEQ ID NO: 21227

SEQ ID NO: 61765 - DNA, 201 bp, Bos taurus
tgttctgaatcagcctttcagcagtcccatttagtagttgtgtagctgcaatattttaggtgattggtgggttgtaaatcacgtgtgtgtgtgcacattcatggcaaatacatgcacacccctaggttaagttcatgatttaattatccatggttgcaccatgttatcatagtccatgtggctacacagagcaggaaatga

SEQ ID NO: 61766 - DNA, 201 bp, Bos taurus
agatattcgcactggcgtgttcatgttaactttaaatatacaaagtaaaaatctgagctttcaccatatgtgactgtgtaggccctccctggttattgtttatcattttaaccaaccatttggatcagacttcaggtttctgctccttctgtgggccaccaatcattcctttatctccctagaatgagttccttaagctgc

SEQ ID NO: 61767 - DNA, 201 bp, Bos taurus; identical to SEQ ID NO: 21229

SEQ ID NO: 61768 - DNA, 201 bp, Bos taurus; identical to SEQ ID NO: 21230

SEQ ID NO: 61769 - DNA, 201 bp, Bos taurus
tcccttggcaaccatgtagcttgaccctgcacaaagcagttctcactgtaatgttagcatttcaaaactgaatcccttgtcaatataattgtgtgttgtcgggaatctagattgtccttacagcagccttcaggagacaatatgtctatttgtcgtctaatacttttgtgaccctgatggtaaaaggaacaggccagcaag

SEQ ID NO: 61770 - DNA, 201 bp, Bos taurus; identical to SEQ ID NO: 21232

SEQ ID NO: 61771 - DNA, 201 bp, Bos taurus; identical to SEQ ID NO: 21233

SEQ ID NO: 61772 - DNA, 201 bp, Bos taurus
tggccagtaaatgatatgcatgtaacttagaaaacaataacataactttcaagtaagaattaaaatagttttttatccagtgctttttgaaagtgcaatgcaaggacagcctatgtacaaacctgcatctttttataaaggtaaagatttaatgaactggcatgtacttcagtagtcagaatttgattggttgttgactta

SEQ ID NO: 61773 - DNA, 201 bp, Bos taurus
tcagtgtaggttgcagcagatgagaaacacaggacctgagataagtgtgaaaagagggacaggttctggggatataaaagggaaaggaaagtatgccctcgacagaaagccatgaactaaagctttgaagtgagacagagcgcagcatgtgtgacttggaagagcagtgactatttgtctcctagggagaagaaacacggg

SEQ ID NO: 61774 - DNA, 201 bp, Bos taurus
ggaagtatgcagagaagtatttagaggaaggttttggtttataaagtctttgttttattgtttgttgatttgcttgtttttggccaatggcccaatgaggaagtgcctcaggacttaaagttgttattaccaactccttctttgtgaaagtatgaagagaagtgttaatctctcctggccaaagacttcaggcagcatact

SEQ ID NO: 61775 - DNA, 201 bp, Bos taurus; identical to SEQ ID NO: 21235

SEQ ID NO: 61776 - DNA, 201 bp, Bos taurus; identical to SEQ ID NO: 21236

SEQ ID NO: 61777 - DNA, 201 bp, Bos taurus; identical to SEQ ID NO: 21238

SEQ ID NO: 61778 - DNA, 201 bp, Bos taurus
aggcggccactggcatggcaaggacaccattaagccaaactatagatgccaccagggcatcctggactcctggtgaaaaaaggagccaccatctcggccaaagtaatagatgcacctaagcatgaggtggaagagctgcttttatacagctggggcaggtaaaatatttatgaatcctgggtgatctatatgtgcttcttg

SEQ ID NO: 61779 - DNA, 201 bp, Bos taurus
tttaatcttagcttaatacattaaatgtggattttaagattatttcaaatattatttcatccagagtcctcagtgcctaagtccaaatgaacatctcaaataagaatatcagatacacaggcatatctttgtagagtaggaaggcaatttttttcaaacatactctgcttacagagagacgggaatcccaaaatctttgaa

SEQ ID NO: 61780 - DNA, 201 bp, Bos taurus; identical to SEQ ID NO: 21240

SEQ ID NO: 61781 - DNA, 201 bp, Bos taurus
tgatgttttcaaaaaacatcttgcattttacttggaaatttgattggtaggttaggggtataactatatttgtgttttataaataaactttttggtattagcttcattaaaaaatctataagtgtgtcttccaagatttcataataggtattctttcttttctagtgagaaaaattatttttttccttccatgtataccaa

SEQ ID NO: 61782 - DNA, 201 bp, Bos taurus; identical to SEQ ID NO: 21242

SEQ ID NO: 61783 - DNA, 201 bp, Bos taurus
gtagaaatagaactcaaaacatttccccttctcttaaatggagttacttatcccttaaagaagtacaggtttctgagtcaacagataatcaaaactactagataaacacgggttatctttctgaggagtatcagtattgcttagagtttagaagaagaaagtatctaaattttatgctatcataagatttcatcagtcaca

SEQ ID NO: 61784 - DNA, 201 bp, Bos taurus; identical to SEQ ID NO: 21244

SEQ ID NO: 61785 - DNA, 201 bp, Bos taurus
agggcccctggcaatgaatgtgggtgattctaagacctgaaggccacccctgactatagccaaaggaaatagccaaagcttgtcctacaaccgcaattctgcaaccataagtaactgaattgggccatcacttgaatgaggttggaaatggattcttactcagagtctctagaaaggagtacaatcaaaaccttttttcaa

SEQ ID NO: 61786 - DNA, 201 bp, Bos taurus; identical to SEQ ID NO: 21246

SEQ ID NO: 61787 - DNA, 201 bp, Bos taurus; identical to SEQ ID NO: 21247

SEQ ID NO: 61788 - DNA, 201 bp, Bos taurus; identical to SEQ ID NO: 21248

SEQ ID NO: 61789 - DNA, 201 bp, Bos taurus; identical to SEQ ID NO: 21249

SEQ ID NO: 61790 - DNA, 201 bp, Bos taurus
aaagaatagtcagaagtattttcatccatgagggacaaatgtgactaaaaattgattgtatcaacaattaaatcctgctctaagttacctttagtagtttggaacatatatattcgtactggcttttaaaattagcactgaagatgttagagtattaattacccatttcatccttaaaaataaacttatgaatctatattc

SEQ ID NO: 61791 - DNA, 201 bp, Bos taurus; identical to SEQ ID NO: 21250

SEQ ID NO: 61792 - DNA, 201 bp, Bos taurus
acagtattggagcttcggcttcagcatcagtccttccactgagtattcagggttgatttcctatagaattgactggtttgatttccttgcagaccaaggggatttcagtgttatgagggcctacggaaaagaatcttttgtctacagcccaaactcagaggaaatgatttgctgactactttaagagaaggtgagctggtg

SEQ ID NO: 61793 - DNA, 201 bp, Bos taurus; identical to SEQ ID NO: 21252

SEQ ID NO: 61794 - DNA, 201 bp, Bos taurus; identical to SEQ ID NO: 21253

SEQ ID NO: 61795 - DNA, 201 bp, Bos taurus; identical to SEQ ID NO: 21254

SEQ ID NO: 61796 - DNA, 201 bp, Bos taurus; identical to SEQ ID NO: 21259

SEQ ID NO: 61797 - DNA, 201 bp, Bos taurus
atgttacacgtaagtcctatttgtccactctatgtcatcagtgttctgagcaaaagccttcacaaactctgtggaggaagccactgttttaaaggcctttgaattcctttactctgaattttctcctcgtaaatgttattaccttaaagtgggatcctgttgataaattcacctggagtagagctcttcacagctctgacg

SEQ ID NO: 61798 - DNA, 201 bp, Bos taurus
gaacgttcttcaaattcctgtagttcggctggctggaagctttggggcagtaaaggtttattggaaagcaacagtggacagtgctggcctggaagactttgagccgtctcatgggattcttgaatttgcagatagacaggtatgttagtcacagacatattagcagtttttggttgtacttcagacattttataggcatct

SEQ ID NO: 61799 - DNA, 201 bp, Bos taurus
ccaggagcacaggccctgctgaggggagcttacattccagttattaaagacgctgcactggtcaaacagagcacgcagtcaggctgaaggtcactctcccgtgtgtcccgcctgctgtcaggccaagttcagctgtctcagcagtttagtctgggggagcccatcagatttctcaagtgtgtgtcagcatttgaggggctc

SEQ ID NO: 61800 - DNA, 201 bp, Bos taurus; identical to SEQ ID NO: 21264

SEQ ID NO: 61801 - DNA, 201 bp, Bos taurus; identical to SEQ ID NO: 21265

SEQ ID NO: 61802 - DNA, 201 bp, Bos taurus; identical to SEQ ID NO: 21266

SEQ ID NO: 61803 - DNA, 201 bp, Bos taurus; identical to SEQ ID NO: 21267

SEQ ID NO: 61804 - DNA, 201 bp, Bos taurus
tatacatagaaaaataaggaagctgaacaatccacaattaaagaggtattcactgaaacatatggaaaagtctttgataatttctcttcactccaacaagtagcagtaaatggattaatggcccttagctggaagcgcatgtctgtgatcagaactgaaggtataaactgttgcatacaacacactcagaggattatactc

SEQ ID NO: 61805 - DNA, 201 bp, Bos taurus; identical to SEQ ID NO: 21271

SEQ ID NO: 61806 - DNA, 201 bp, Bos taurus; identical to SEQ ID NO: 21272

SEQ ID NO: 61807 - DNA, 201 bp, Bos taurus; identical to SEQ ID NO: 21273

SEQ ID NO: 61808 - DNA, 201 bp, Bos taurus; identical to SEQ ID NO: 21274

SEQ ID NO: 61809 - DNA, 201 bp, Bos taurus; identical to SEQ ID NO: 21278

SEQ ID NO: 61810 - DNA, 201 bp, Bos taurus; identical to SEQ ID NO: 21279

SEQ ID NO: 61811 - DNA, 201 bp, Bos taurus
tactacctggctttgttaactttcccttctttatttgggcctctgaagtcaggctttcacttgcccacctctgaagtcgcctcgtaaaaagtcactggttcgcaggttgccagatctagtggcctctctttggcttcatcgtacgtgaccttcctaagacattcaacaccagccacttccttcttcatgaactcttccttt

SEQ ID NO: 61812 - DNA, 201 bp, Bos taurus; identical to SEQ ID NO: 21280

SEQ ID NO: 61813 - DNA, 201 bp, Bos taurus; identical to SEQ ID NO: 21281

SEQ ID NO: 61814 - DNA, 201 bp, Bos taurus; identical to SEQ ID NO: 21282

SEQ ID NO: 61815 - DNA, 201 bp, Bos taurus; identical to SEQ ID NO: 21283

SEQ ID NO: 61816 - DNA, 201 bp, Bos taurus; identical to SEQ ID NO: 21284

SEQ ID NO: 61817 - DNA, 201 bp, Bos taurus
ggaaagactttgtgtatataagtttgcatagggaatgtgtgtgttggatatttgttgttttctttgccttttttgcccccttgggaatggcctttcctcaccccctgtagctcagtagagaccaccagtgacaaggtctctctagcatggttatatgggtgggcctgggacttagagtggaaacttaatgtcccatcccct

SEQ ID NO: 61818 - DNA, 201 bp, Bos taurus; identical to SEQ ID NO: 21285

SEQ ID NO: 61819 - DNA, 201 bp, Bos taurus; identical to SEQ ID NO: 21286

SEQ ID NO: 61820 - DNA, 201 bp, Bos taurus; identical to SEQ ID NO: 21289

SEQ ID NO: 61821 - DNA, 201 bp, Bos taurus; identical to SEQ ID NO: 21290

SEQ ID NO: 61822 - DNA, 201 bp, Bos taurus
tggagatcagctgtggccaaaagatctaaatctgcacacttcttcatctccatttctgtggtcttattgctgctaagactattgccacagcctcctaatccgttttcctatcttccttgtcaggccatcatctacactaagatcagaatcaatttttaaaatgtgtaattcaacataaaaattctcctgttacatctaaga

SEQ ID NO: 61823 - DNA, 201 bp, Bos taurus; identical to SEQ ID NO: 21293

SEQ ID NO: 61824 - DNA, 201 bp, Bos taurus; identical to SEQ ID NO: 21294

SEQ ID NO: 61825 - DNA, 201 bp, Bos taurus; identical to SEQ ID NO: 21295

SEQ ID NO: 61826 - DNA, 201 bp, Bos taurus; identical to SEQ ID NO: 21297

SEQ ID NO: 61827 - DNA, 201 bp, Bos taurus
ggggtgccattgccttctccgtctttctgggtctagacctttccattctctggcttggcaagctgcaaggttgctgtcctcatctgggtaaccagagcttgattgcaaacatgccgttgtttcctttcacaagaagaggaaaggagaacactaatacagaagtgggcagtgttttgagttggagatgattcagaagttaag

SEQ ID NO: 61828 - DNA, 201 bp, Bos taurus
attttagtacattataatgacaatttcgtgtgtttatatttccactcctttgaacagtttgttggtggagtgtccttttaattttcatttgttaagagctcttacattatttggcaaacaataggtttttaataaatatttgtagttagttggataaacagcatccatgtggtctaagattctcagctttttctcttaaac

SEQ ID NO: 61829 - DNA, 201 bp, Bos taurus; identical to SEQ ID NO: 21298

SEQ ID NO: 61830 - DNA, 201 bp, Bos taurus; identical to SEQ ID NO: 21299

SEQ ID NO: 61831 - DNA, 201 bp, Bos taurus; identical to SEQ ID NO: 21300

SEQ ID NO: 61832 - DNA, 201 bp, Bos taurus; identical to SEQ ID NO: 21301

SEQ ID NO: 61833 - DNA, 201 bp, Bos taurus; identical to SEQ ID NO: 21302

SEQ ID NO: 61834 - DNA, 201 bp, Bos taurus
gaagaagtgatagttggaaatcaagcaaggtcatgaggaagagagagattattttctttaatgttttttcacacatttcaaaatcaacttaagtaagatgtctgtggacacataagccgacaaaataacacaatcagaaaacatggcaaaaatatccctcctctagatttttcctgaaaaaatagctttctttttctatca

SEQ ID NO: 61835 - DNA, 201 bp, Bos taurus
aatatatactacatgggtcctaatttgagtataaatagctcctaatgttcaaactgcttttatcactattaagtaatttgttttacatttattggattgaataacagcttcattggctgtgactttgaagacccatgaaagttaaaccctggcatgtactctgacactgactgtggcaataaagaaattaagaagacctca

SEQ ID NO: 61836 - DNA, 201 bp, Bos taurus
cacagactgttccaattcttgggcatgtgccccaaggtcacagcggataggaactaaccactggggggcttccccaagtccaccccatgggcccttgatgtagagttgtgtcttccaagtaacctcaggcagccaggagcccattcagttcagttcagttcagtcgctcagtcgtgtccgactctttgcgaccccatgaat

SEQ ID NO: 61837 - DNA, 201 bp, Bos taurus
ataccaggtggtgagtgtagacacggaggaccttgtcagcctaaggaccaggtggcaccccaaaaggatgcagcaaggaggtactgaaactcaggcagccgggccctgggggaggactcacgtagacaggaagagacagccctgagggcctggggtgcagctggggtggaccacaaggaccatggtcagggttcttgggag

SEQ ID NO: 61838 - DNA, 201 bp, Bos taurus
atttattactctcaatatctttaatactaaatattgatgagggatgataagtaactttttttccccccaaatcacacatttagatttgctactctaaatcgaatcatccttcttactaattagtggagcactttggactgtaaggaaaaaatcagctaaaatagtatcatatccatgggggctttacatttgacaaaatag

SEQ ID NO: 61839 - DNA, 201 bp, Bos taurus; identical to SEQ ID NO: 21303

SEQ ID NO: 61840 - DNA, 201 bp, Bos taurus
cttggaaattttttttacaaataaaaaggtagaaaatctccaaaattaatatggcagcattttaaaatattcttgtaatgaggaacatttggaaaaaacacttaaatgaaaccataaaagtaaaaggattaaatctaacagaacttttaattaaaaagaaatcattcaagagaaaagtcgtttattctacatagaacctaa

SEQ ID NO: 61841 - DNA, 201 bp, Bos taurus; identical to SEQ ID NO: 21304

SEQ ID NO: 61842 - DNA, 201 bp, Bos taurus; identical to SEQ ID NO: 21305

SEQ ID NO: 61843 - DNA, 201 bp, Bos taurus; identical to SEQ ID NO: 21306

SEQ ID NO: 61844 - DNA, 201 bp, Bos taurus; identical to SEQ ID NO: 21307

SEQ ID NO: 61845 - DNA, 201 bp, Bos taurus; identical to SEQ ID NO: 21308

SEQ ID NO: 61846 - DNA, 201 bp, Bos taurus; identical to SEQ ID NO: 21309

SEQ ID NO: 61847 - DNA, 201 bp, Bos taurus; identical to SEQ ID NO: 21310

SEQ ID NO: 61848 - DNA, 201 bp, Bos taurus
cccactaggctcccaaagtataaatcacccccatcctcctcccttgatcgccatcatcacccagggatagccccagggccctagggccactgggataatcctcatggtgtagtgacaaaataccgaatacgggttcaccaaaattttgtgtgagtttttccttaccaccttatggagaaactcaaactttttggccaaccc

SEQ ID NO: 61849 - DNA, 201 bp, Bos taurus
agactcctctgtccatgggattcttcaggcaagaatactggagtgggttgccctgccctcctgcaggggatcttcccgacccagggattgaactcgcttcttgtatgtcccctgcactggcaaacagtttgtttaccagtagctacacagcgaagcaaagacagcctggcatgctgtaaagtttgtccctttcagttgcta

SEQ ID NO: 61850 - DNA, 201 bp, Bos taurus; identical to SEQ ID NO: 21311

SEQ ID NO: 61851 - DNA, 201 bp, Bos taurus; identical to SEQ ID NO: 21312

SEQ ID NO: 61852 - DNA, 201 bp, Bos taurus
gtctaacacaggcacttctgccctagtggagaacagtgctggggcaaatggaactgcagtggacacccagggcaggccaggttcatgctggaacagtccccgcaagccagtcagaacccgggctgtttccagtctactgcatctgtgtgctcactgtcaacagctatcctcactttgttcagaggcaggcccagatccaag

SEQ ID NO: 61853 - DNA, 201 bp, Bos taurus; identical to SEQ ID NO: 21313

SEQ ID NO: 61854 - DNA, 201 bp, Bos taurus; identical to SEQ ID NO: 21314

SEQ ID NO: 61855 - DNA, 201 bp, Bos taurus
atggctatcattgaagagcctacagataacaaatgctggagaggatgtagagaaaaaggaaccctcctacgctgttggcagaaatgtaaattagcgcagctgctatagaaaactgtatactcctaagtcgcttcatttgtgtccaactctgtgcgaccccatagaaagcacagcccaacaggctcctctgtccctgggatt

SEQ ID NO: 61856 - DNA, 201 bp, Bos taurus
cacagagtggacttgctggatcactgttgttgttcagtcactcagacgtgtccaactccttgcaaccccatggattgcagtcaggctttcatccttcactatctccaggagtttgcacaaaccctcaacatgtccattgagtcagtgatgccatccaaccatctcatcctctgtcgtccccttcccctcctgctctcaata

SEQ ID NO: 61857 - DNA, 201 bp, Bos taurus
gcttgaacattttaaactcccctctgcatactcatagtgacacagtcttgaaaacctcagctcaaggcacgacaaactttaaagcgcttcccagtttttatagggtgtcactctctatccaactctaaaagatctaacgacacagaaatgcttccacatcaagatgtttcacaagatactttataaatgaatctggattcc

SEQ ID NO: 61858 - DNA, 201 bp, Bos taurus
catggctggcctcacctctgacctcctcgtgtgtatggatgcagtatggacacacgcacaccataaataccctctgtagtgctgtagtgtccagtggagcgccaagggtaatttccaggccaaaatgtatgaactactttgggcatcttctggtttcttcctgaagtactccctctcttgctaagtgttcactgatcccct

SEQ ID NO: 61859 - DNA, 201 bp, Bos taurus; identical to SEQ ID NO: 21316

SEQ ID NO: 61860 - DNA, 201 bp, Bos taurus; identical to SEQ ID NO: 21317

SEQ ID NO: 61861 - DNA, 201 bp, Bos taurus; identical to SEQ ID NO: 21318

SEQ ID NO: 61862 - DNA, 201 bp, Bos taurus; identical to SEQ ID NO: 21319

SEQ ID NO: 61863 - DNA, 201 bp, Bos taurus; identical to SEQ ID NO: 21321

SEQ ID NO: 61864 - DNA, 201 bp, Bos taurus; identical to SEQ ID NO: 21322

SEQ ID NO: 61865 - DNA, 201 bp, Bos taurus; identical to SEQ ID NO: 21324

SEQ ID NO: 61866 - DNA, 201 bp, Bos taurus; identical to SEQ ID NO: 21325

SEQ ID NO: 61867 - DNA, 201 bp, Bos taurus; identical to SEQ ID NO: 21326

SEQ ID NO: 61868 - DNA, 201 bp, Bos taurus; identical to SEQ ID NO: 21327

SEQ ID NO: 61869 - DNA, 201 bp, Bos taurus; identical to SEQ ID NO: 21328

SEQ ID NO: 61870 - DNA, 201 bp, Bos taurus; identical to SEQ ID NO: 21331

SEQ ID NO: 61871 - DNA, 201 bp, Bos taurus; identical to SEQ ID NO: 21332

SEQ ID NO: 61872 - DNA, 201 bp, Bos taurus; identical to SEQ ID NO: 21333

SEQ ID NO: 61873 - DNA, 201 bp, Bos taurus; identical to SEQ ID NO: 21334

SEQ ID NO: 61874 - DNA, 201 bp, Bos taurus; identical to SEQ ID NO: 21335

SEQ ID NO: 61875 - DNA, 201 bp, Bos taurus; identical to SEQ ID NO: 21336

SEQ ID NO: 61876 - DNA, 201 bp, Bos taurus; identical to SEQ ID NO: 21338

SEQ ID NO: 61877 - DNA, 201 bp, Bos taurus; identical to SEQ ID NO: 21339

SEQ ID NO: 61878 - DNA, 201 bp, Bos taurus; identical to SEQ ID NO: 21340

SEQ ID NO: 61879 - DNA, 201 bp, Bos taurus; identical to SEQ ID NO: 21341

SEQ ID NO: 61880 - DNA, 201 bp, Bos taurus; identical to SEQ ID NO: 21342

SEQ ID NO: 61881 - DNA, 201 bp, Bos taurus; identical to SEQ ID NO: 21343

SEQ ID NO: 61882 - DNA, 201 bp, Bos taurus; identical to SEQ ID NO: 21344

SEQ ID NO: 61883 - DNA, 201 bp, Bos taurus; identical to SEQ ID NO: 21345

SEQ ID NO: 61884 - DNA, 201 bp, Bos taurus; identical to SEQ ID NO: 21346

SEQ ID NO: 61885 - DNA, 201 bp, Bos taurus; identical to SEQ ID NO: 21347

SEQ ID NO: 61886 - DNA, 201 bp, Bos taurus; identical to SEQ ID NO: 21348

SEQ ID NO: 61887 - DNA, 201 bp, Bos taurus
atgagctagatgccacccagatgtagaccaggcctcagacctagagctggatttgggtggaactctgtgtctgagggcgtccaggcagacaacaggcatcgcggacaggccccatctgggtgtatttggggaagccatcccaccaggctggctctgtgtggtgggtttgggtgggagattggcctgagctgaatggccttt

SEQ ID NO: 61888 - DNA, 201 bp, Bos taurus; identical to SEQ ID NO: 21349

SEQ ID NO: 61889 - DNA, 201 bp, Bos taurus
atgaggcaatgtcctttgccaggttctggccacactcctgggtggacagtcctggtggctggtccacgctgaccctgcgggcctctgagggaggggtctccgctctccagggagggcgctatgattatgaaactccgcacctgaagccagcctggggtctcttctgtctgaggtttttatgaggccatgatcactgaggcc

SEQ ID NO: 61890 - DNA, 201 bp, Bos taurus
cggtacaactcagcgagaaagaggaaggatttgctgatggagatcatggagtcctgactgttgacggaccttccacacacacgtactgttcactccagagatagacggcctggagtgtgggctctagagctaacagtttgtgctgttccttctgccctggcctgctctgtctccttggccaggttacctggcctctctgtg

SEQ ID NO: 61891 - DNA, 201 bp, Bos taurus
agagtaacctccaagaagggaggaagatgaaactgtcacctctgaacagatccactctgttaagcctgtgtctgtggatgaagcataaacagaggtccccgtgctggtacacaagcctcactgcctaagaagcgacatattcaaatgtccgcgttaactatctctgtcaaaatttgtgtattgctcagtcaatcctaaagg

SEQ ID NO: 61892 - DNA, 201 bp, Bos taurus; identical to SEQ ID NO: 21351

SEQ ID NO: 61893 - DNA, 201 bp, Bos taurus
aaaattctgcatgtcttacaataaacaaaactaaaagcatagaaactgggaaagtgtataaatatttaatgtaaccagaaaagtgaaataaatccaaaccgctttttaaggtatcaaatttggaggtgacctttaagctgggacttgagagataagtaggtgttggtcaagcaaaagtaagggaagagtccttcaaggaga

SEQ ID NO: 61894 - DNA, 201 bp, Bos taurus; identical to SEQ ID NO: 21353

SEQ ID NO: 61895 - DNA, 201 bp, Bos taurus
tgttttaaaatgtcccgttctgtctaaattgaaacattgtttccttattcaactgaaagtttccccacccctctttcacctaaggaagctgggcctactgtgttttgataaactcctggttcacattcctgggtgccgcccctcactctggctcctccaggtgggctggggagaggagagacaagggaagatgtggccacg

SEQ ID NO: 61896 - DNA, 201 bp, Bos taurus
agggtcttctccagtttaatcccctttaggctaggttttgagaaccagaggttctctaattctctgatctcctagcctcaagcatcctaccagggcctataaaatcctcttcctcctcaggcacactcatctgcgcgccgtccatgcagcaggcatgtacacctttgggccgtggcattggcttcggacagagctctgcaa

SEQ ID NO: 61897 - DNA, 201 bp, Bos taurus
tataaagaattatgtgctttgaaccagactacatattaatctcagatacaattcaaacatcaacatttattgtacagagggttaataatttcacagccaaatggtatttgctgttgtcactgaggcattaaggtaatgctgaattactgtatttcatcactacactgatcttcattttggtatattcctaattcatgccag

SEQ ID NO: 61898 - DNA, 201 bp, Bos taurus
tctttaaagaggtaattaagttaaaatgtggtgtcatgttggatttcccctgtgcgtcagcctttaaagaattccttggccaatgcaggaggtgggtcccctctctgggtcaggaccatcctgtggagtaggaaatggcaacccactccactattcttgcttggagaattccatggccagaagagcctggaatgctacagt

SEQ ID NO: 61899 - DNA, 201 bp, Bos taurus; identical to SEQ ID NO: 21354

SEQ ID NO: 61900 - DNA, 201 bp, Bos taurus; identical to SEQ ID NO: 21355

SEQ ID NO: 61901 - DNA, 201 bp, Bos taurus
tgtgtttctctgagtcatcccacagtggaattgagttccttttcataaactgagttctgctagatgacctgctttagatgtggagaaggccctcaaggaaggtgtgagatgcagggaatttctcctttctctgatcctcctctacatagagtccaaaccagacagtgaacatttgcatttgaaagtaaaggaagtatgtgg

SEQ ID NO: 61902 - DNA, 201 bp, Bos taurus; identical to SEQ ID NO: 21356

SEQ ID NO: 61903 - DNA, 201 bp, Bos taurus
ggacagaagagcctggtaggctacagtccatggggtctcaaagagtcgggcacgactgaacgatttcacttttcactttcagacatggccatgaggataattgcacaataaaaattcaaccatggggcaaagcttatgcaatagacagactgaacaagaaagttgtattcacaacacagagtactaaccactatactatca

SEQ ID NO: 61904 - DNA, 201 bp, Bos taurus; identical to SEQ ID NO: 21357

SEQ ID NO: 61905 - DNA, 201 bp, Bos taurus
acctgttggtgagactggccaggaggtttgactccagagtgcatgctcttttcattattttactctaactcacatggcttgtagggtgttgctccacccttccctgggccacacagatatctctaagtcctggcatctaatttaagtaacagagatttttaaatcttgcattgtctgaatctttttctggcaataaaaata

SEQ ID NO: 61906 - DNA, 201 bp, Bos taurus; identical to SEQ ID NO: 21358

SEQ ID NO: 61907 - DNA, 201 bp, Bos taurus; identical to SEQ ID NO: 21359

SEQ ID NO: 61908 - DNA, 201 bp, Bos taurus; identical to SEQ ID NO: 21360

SEQ ID NO: 61909 - DNA, 201 bp, Bos taurus
aaatgaaattgaaattgagcgatgcccccttttcctccttttttgtaggcaagaccctagcctccatgaccttccctgagtccccaaaggcagatgcaaacagttgcttaaacaagggccaagaaaccacctgaggcgagattaaagggaccagagaatctcaagattaggagaccacattaagccttggagataccataa

SEQ ID NO: 61910 - DNA, 201 bp, Bos taurus; identical to SEQ ID NO: 21361

SEQ ID NO: 61911 - DNA, 201 bp, Bos taurus
tggtaaacctttcagatattagatagttaagaaagtagtaacataaatatgctttgattcagatttgtcaggggtacttgaactagtagaatatatttccaaaaaattattggatcctaacaccaaaaaactgaatatatagtcttaaatgttcttgaaaagatttattttctccattaattaatggctaattttttcata

SEQ ID NO: 61912 - DNA, 201 bp, Bos taurus
ctccttgaagtaaatccacaataaaaactggctaacaggaaaaagcccacagaagactcttacgtgaagcactgaaatgccagatctcaaacgctatatccaagaaggaataagacagatgttaaaatcgtggaggacataatgatgaagagttatgtagcaatcaatttactgtgaacatgcaaatgggcactttaagtt

SEQ ID NO: 61913 - DNA, 201 bp, Bos taurus; identical to SEQ ID NO: 21362

SEQ ID NO: 61914 - DNA, 201 bp, Bos taurus
tgctcgtaacagtacaaatacacattcctattttcctaataataaaaaaccgcgtcctctgactgtgaaaaggagaggacagatgaaaggttttgttacacctggtggaccttggctgctggtttcaaatgcacttattccctcctgtgactggagttaagaccccttgaaggtcacctccgccaagcccagactctgtct

SEQ ID NO: 61915 - DNA, 201 bp, Bos taurus; identical to SEQ ID NO: 21363

SEQ ID NO: 61916 - DNA, 201 bp, Bos taurus; identical to SEQ ID NO: 21364

SEQ ID NO: 61917 - DNA, 201 bp, Bos taurus; identical to SEQ ID NO: 21365

SEQ ID NO: 61918 - DNA, 201 bp, Bos taurus; identical to SEQ ID NO: 21366

SEQ ID NO: 61919 - DNA, 201 bp, Bos taurus; identical to SEQ ID NO: 21367

SEQ ID NO: 61920 - DNA, 201 bp, Bos taurus; identical to SEQ ID NO: 21369

SEQ ID NO: 61921 - DNA, 201 bp, Bos taurus; identical to SEQ ID NO: 21370

SEQ ID NO: 61922 - DNA, 201 bp, Bos taurus; identical to SEQ ID NO: 21371

SEQ ID NO: 61923 - DNA, 201 bp, Bos taurus; identical to SEQ ID NO: 21372

SEQ ID NO: 61924 - DNA, 201 bp, Bos taurus
gggcctctctgatgagacaatttacagagagctaactgaagcaaggtggggagccctgtaagctcctgggggtgcattccaggcaagagaaacagtgagtgcaaaggccctaaggcagaaaggaatgggaattaccactggggctggccaatgagaagacgtgacatagctatggtttctcatgaaaaggaagtgaaagtg

SEQ ID NO: 61925 - DNA, 201 bp, Bos taurus; identical to SEQ ID NO: 21375

SEQ ID NO: 61926 - DNA, 201 bp, Bos taurus; identical to SEQ ID NO: 21376

SEQ ID NO: 61927 - DNA, 201 bp, Bos taurus; identical to SEQ ID NO: 21377

SEQ ID NO: 61928 - DNA, 201 bp, Bos taurus; identical to SEQ ID NO: 21379

SEQ ID NO: 61929 - DNA, 201 bp, Bos taurus
cgccatgaaagtagcctcacttcaattttctgagtggaatttccttctgggaccttcttgaatttttctgctcaaggttatcttcctaaacacccgggcctgaggttttggagccatccctttgcttacccctcagcgggctaaaaggaaattcagaaagtcacagcagggttcatcagatggtcaggccatgggttcaca

SEQ ID NO: 61930 - DNA, 201 bp, Bos taurus; identical to SEQ ID NO: 21380

SEQ ID NO: 61931 - DNA, 201 bp, Bos taurus; identical to SEQ ID NO: 21381

SEQ ID NO: 61932 - DNA, 201 bp, Bos taurus; identical to SEQ ID NO: 21382

SEQ ID NO: 61933 - DNA, 201 bp, Bos taurus
tcaggcctgattggcaggagagtatttccaggggttgtactgaaaagaggacctttatggttcagaacatccactttttgagacaggtttgaaaccgtgcgtggcctgctcctcaccgcagctctctgtcgggaggacgtcacgcctcccgcgcacgcttctgaaagccttggtccttgtgcttcggtccccacggtgacg

SEQ ID NO: 61934 - DNA, 201 bp, Bos taurus; identical to SEQ ID NO: 21384

SEQ ID NO: 61935 - DNA, 201 bp, Bos taurus
aatggctcaggatgactctgcttgttctttgacacatggcatggggtttggggcctgagccttcacagcgcctgctccttcccttcttccttggcctccacaacctccttccacagaaacagagtcttctattcctcacctgtcttcagtctccatccttcacctggcccgccacctatttgaaccattcaacttttgctc

SEQ ID NO: 61936 - DNA, 201 bp, Bos taurus
taggcattttaataatggccaccctgaacccgtgtgaaggtggaacctcattgtagctttgattttcatttctctaatagtgctgtccatcatctttccacgtgcctgttggccacttgtattgatttggagaaatgtcggtctgtttaggtcttctgatcatttttctattgggtttgtttttgttattgttgagttgta

SEQ ID NO: 61937 - DNA, 201 bp, Bos taurus; identical to SEQ ID NO: 21385

SEQ ID NO: 61938 - DNA, 201 bp, Bos taurus; identical to SEQ ID NO: 21386

SEQ ID NO: 61939 - DNA, 201 bp, Bos taurus
tcagccagggactcctcggcatcttaaaggatgcccctaacaaatcctcatatagattctatggaaaagatatggttgtaattctaattcttaagtttgagcatgaggcctgttcttcttttcacagcatgtaaggaggttgctcatagttgaataaaataaaaatgaaataaaattatgtgtcatcttagttcgcaacgc

SEQ ID NO: 61940 - DNA, 201 bp, Bos taurus; identical to SEQ ID NO: 21388

SEQ ID NO: 61941 - DNA, 201 bp, Bos taurus
ctgcagtttctagattctttcctcctttccttataatttgctgcatttatattactttctagaatttctatactttctgcatttatataaccacctagaattgaggttttgttcactttaaattagagcatgtaaattacatcacttattatgcatatgctataattatattatgaatacagtcttgcaaatgatataaaa

SEQ ID NO: 61942 - DNA, 201 bp, Bos taurus; identical to SEQ ID NO: 21389

SEQ ID NO: 61943 - DNA, 201 bp, Bos taurus
aattttttaaatataaaggttaggtgctttccaacttctgtttaggatgttagcaagcaagaaagagcattactcccacatctataacaacaaccacagcgttcaactcactatataatctaaaatgtcacagcttttccagaactcattagattcatggttacaggacaaccaactcaaccaaaatccaaggatgacaag

SEQ ID NO: 61944 - DNA, 201 bp, Bos taurus; identical to SEQ ID NO: 21390

SEQ ID NO: 61945 - DNA, 201 bp, Bos taurus
ctgcattggcaggagaatattttcaccactgtgccacctgggaagccccaaagactgcagcaaaagtgttggctggcctgagctcttaatctggaggctcagttggggtagatctacatctatgctcactcagttggctgacagagtcattttcttgtagttgttggactgagggccctggctttttgctggctgtaactg

SEQ ID NO: 61946 - DNA, 201 bp, Bos taurus; identical to SEQ ID NO: 21391

SEQ ID NO: 61947 - DNA, 201 bp, Bos taurus
gcgagaatgttcagaaatgactcaaaccttaagtaaaagcctctactagatggtttttaaaattttgttggccattatgaatccatatcaagtttttttagatgtattttagggtttttgccttcttattggagcatagcatttttatgcacatataccttcacatccaattagtagctctaatcagaacagacaggtaaa

SEQ ID NO: 61948 - DNA, 201 bp, Bos taurus; identical to SEQ ID NO: 21392

SEQ ID NO: 61949 - DNA, 201 bp, Bos taurus; identical to SEQ ID NO: 21393

SEQ ID NO: 61950 - DNA, 201 bp, Bos taurus; identical to SEQ ID NO: 21394

SEQ ID NO: 61951 - DNA, 201 bp, Bos taurus
ttgcagcctagagaagtaggtgtatccagcttccaacctcattttaaagcaaagcatctcccctttcatcaggctaatgcacaacatggtgcttcagaacggttcccaggactggtgcagtttgacaatcactgattcagagttacatttgtgtattttctctgggtttgacttattcacgatatcccatcactcataaat

SEQ ID NO: 61952 - DNA, 201 bp, Bos taurus
ctcacaatctcccacagtaacacaccataggaccatctgcagaagggatgaaagagaaaacagtaatcagcgcacgcgttggccagtcagcgttctgcccgcaaagctggggcaactgactctaggtcagaagagggcaagttccatgtctttttcctaggattgggtcttacacagagcatgtgtttatctcccctttgg

SEQ ID NO: 61953 - DNA, 201 bp, Bos taurus
gcctcagtgggggacagtgggccatagagttcttagtgaagaggcacagtggaggcaaggatccaatcaaaccgtgcgtttctgatctccacgtgcaggcgagggagcaaaggcatgggcctgagagcctcatcacgaaaggattgcaggctggagctacagctggggctgaggcaaagcgttattagaggaaaagagaac

SEQ ID NO: 61954 - DNA, 201 bp, Bos taurus; identical to SEQ ID NO: 21396

SEQ ID NO: 61955 - DNA, 201 bp, Bos taurus
gatgggtggtcactgctcccttaacttgaccgtgggagagctcaactgcactgcccggataccataactgctcatgcctaagtgtcatacagccttcagtacattgtattcaacttttaagtataacatatctcaccattttttaatggattgggaaagtgaggtttggttaatagaaagagaattgatgactgtaattct

SEQ ID NO: 61956 - DNA, 201 bp, Bos taurus; identical to SEQ ID NO: 21397

SEQ ID NO: 61957 - DNA, 201 bp, Bos taurus; identical to SEQ ID NO: 21399

SEQ ID NO: 61958 - DNA, 201 bp, Bos taurus; identical to SEQ ID NO: 21400

SEQ ID NO: 61959 - DNA, 201 bp, Bos taurus; identical to SEQ ID NO: 21401

SEQ ID NO: 61960 - DNA, 201 bp, Bos taurus; identical to SEQ ID NO: 21404

SEQ ID NO: 61961 - DNA, 201 bp, Bos taurus
ctgacacaatactctcaaatcccttagaaaaaagaggctcccatcaattttacttgctgcattgcttattgatttgagtatctcaaactccccctttttactgctgtatacttagcctagcttatgcagtatgcatatataatttggtacccttacatttttcactaataatacttgatggattttttttcttatggattg

SEQ ID NO: 61962 - DNA, 201 bp, Bos taurus; identical to SEQ ID NO: 21405

SEQ ID NO: 61963 - DNA, 201 bp, Bos taurus
agtggtcttagggaactgatctgaaggggaggcactatgctacccttcttttctcctccaactgtacaggttttcactttccttcagtctcacctcctctcagcatgaaactttactaaaggctctgaggtcttcacacaatagttttctaccagcctcaccccaagtatctgccaggcgtaataggcaagtctaattttt

SEQ ID NO: 61964 - DNA, 201 bp, Bos taurus
caattgctgtagtaaaggaagccttaagcatcttcctgctgcacctttgggtgacagatgctgatgtaggttgaatgtagaggcaggtgttctgtggcctgtttccacctttacattatttcagattctgtgttactgagtagagcagtcttcctttaaaattttaggtcccatttcttggcctcttgccttgtctattgg

SEQ ID NO: 61965 - DNA, 201 bp, Bos taurus; identical to SEQ ID NO: 21407

SEQ ID NO: 61966 - DNA, 201 bp, Bos taurus
ctggtgcgaactgcactgccctgggatcaggaggcctgagcatctggcctcattctgttgtgtacaagctctgtgtcctctctagtttcagtgcatgtgaataccaagcgttgccacatggccgaggctaaggagatgctacctattagtactagtatttctgttattgctgctttacttgtattaatattttcgagatcg

SEQ ID NO: 61967 - DNA, 201 bp, Bos taurus
tgagcttgttcctgatccaaagcccaccagttaaaaaggagggtaggccacttaaggaaagactgcaatgtcactgcaagttgacatagtaatgattgcctatttctttcccaaaggactatggccatttatcagagtaattgtatactatagagaaaaggatatccaaatcacttaggggatgtaggatataatacgtga

SEQ ID NO: 61968 - DNA, 201 bp, Bos taurus; identical to SEQ ID NO: 21410

SEQ ID NO: 61969 - DNA, 201 bp, Bos taurus; identical to SEQ ID NO: 21413

SEQ ID NO: 61970 - DNA, 201 bp, Bos taurus
gccacaatgcacacactgcaggctccacctgttccctgttagcttccctggaaaactcaacactctacccaccgggtcccacctggccccggctctccggcgtatttaaaagaggagaacatttcctcacagggacttgggtgaagagaacagctcccccatcgcaggctgccggccttgggcggaatcagagaaagcaat

SEQ ID NO: 61971 - DNA, 201 bp, Bos taurus; identical to SEQ ID NO: 21414

SEQ ID NO: 61972 - DNA, 201 bp, Bos taurus; identical to SEQ ID NO: 21415

SEQ ID NO: 61973 - DNA, 201 bp, Bos taurus; identical to SEQ ID NO: 21416

SEQ ID NO: 61974 - DNA, 201 bp, Bos taurus; identical to SEQ ID NO: 21417

SEQ ID NO: 61975 - DNA, 201 bp, Bos taurus; identical to SEQ ID NO: 21418

SEQ ID NO: 61976 - DNA, 201 bp, Bos taurus; identical to SEQ ID NO: 21419

SEQ ID NO: 61977 - DNA, 201 bp, Bos taurus; identical to SEQ ID NO: 21420

SEQ ID NO: 61978 - DNA, 201 bp, Bos taurus; identical to SEQ ID NO: 21421

SEQ ID NO: 61979 - DNA, 201 bp, Bos taurus
agtatgggttcttttctgtcttctgaaaggtaagatatggataaaagtatattactggccaactaacttattgctgtaagaattgggaggcatgaaaaaagtctaaccctggggaaaatgctatctctgcaccctcttccttttcactatatatttatttttaggcataattgtgggcccggtgcccagtgttttccagaa

SEQ ID NO: 61980 - DNA, 201 bp, Bos taurus; identical to SEQ ID NO: 21422

SEQ ID NO: 61981 - DNA, 201 bp, Bos taurus; identical to SEQ ID NO: 21423

SEQ ID NO: 61982 - DNA, 201 bp, Bos taurus
gttgggccagcatctccattccccgtgccccaccgatccagctgccctggatccgctggtcgatgtgttgggcaaactgctcgctcacgtggccagctctaaggaaaggcagcttcagcagggcaccggcacagccattctgcagcgccagcaagaaggctgcccgtggcccaaacagctcagagctcgccttctgcagat

SEQ ID NO: 61983 - DNA, 201 bp, Bos taurus; identical to SEQ ID NO: 21424

SEQ ID NO: 61984 - DNA, 201 bp, Bos taurus; identical to SEQ ID NO: 21425

SEQ ID NO: 61985 - DNA, 201 bp, Bos taurus
attcatgatagattggcaggtggtcagtggatgatgggctgaagccactctgagtccttttgcttttttcattttttattagagaaacttgtaaggtcagatgagatgcctcattcatcatttacttctgatgtcagtttggggaaattttcccaaagtgggctacaggagatagcctaatgttaaaatcctgtcttcagt

SEQ ID NO: 61986 - DNA, 201 bp, Bos taurus; identical to SEQ ID NO: 21426

SEQ ID NO: 61987 - DNA, 201 bp, Bos taurus; identical to SEQ ID NO: 21427

SEQ ID NO: 61988 - DNA, 201 bp, Bos taurus; identical to SEQ ID NO: 21429

SEQ ID NO: 61989 - DNA, 201 bp, Bos taurus; identical to SEQ ID NO: 21430

SEQ ID NO: 61990 - DNA, 201 bp, Bos taurus
gtctgtgtacacacagtgctgaggaggcacagggtgacagtgtgattggtctaaatattactcctctgatgtctaagtcttgtggtgcaaagcagaacacctgcctacctgcctgtgcccaaatgcaaaaagtgatggagctggaagccatagaaggaataggtatctcctgtggtcaccaactccctctgagcttctgtg

SEQ ID NO: 61991 - DNA, 201 bp, Bos taurus
aagagcataaaaacacacatactgaaaaccactgcagtgaatagtggtcttaatagtcttggtactcttaatagtccatcctctcgagacaaacatagaattgtatttattctgtggatcacatttgaaattaataacagaacaattactttataggtaaaactactagcttattgccttgtttacataagacaccagaaa

SEQ ID NO: 61992 - DNA, 201 bp, Bos taurus; identical to SEQ ID NO: 21432

SEQ ID NO: 61993 - DNA, 201 bp, Bos taurus; identical to SEQ ID NO: 21433

SEQ ID NO: 61994 - DNA, 201 bp, Bos taurus
tgcaccccaaagctgcattttgaaaacaattttaaactgaagagggggtaatgaaatctcaccctgaaaaacagtgccataaattgagtcctcgatgtgagagtgtttctttggcataggtaatgtatttttgtaaccttagttttacaattcaacacttctgctctatgctaatctttcattataaaaacattctgaagg

SEQ ID NO: 61995 - DNA, 201 bp, Bos taurus
gctgggagacataagactgaatacttaatcaattacagtggccatccagaaaaaacatagagaaaagtttagttgactagtaaaggcagaagactggataccttcagagtatctgttttgttttattttgtttcttcatatcaggctcagaaaggttctaatttctatcttgtacaaaatgtgcatggttcctattttcaa

SEQ ID NO: 61996 - DNA, 201 bp, Bos taurus; identical to SEQ ID NO: 21434

SEQ ID NO: 61997 - DNA, 201 bp, Bos taurus
gtgcttcatgtacataattccattgtattcctcacatcttcacaggtgatgaaagagactctggtaatcactaaacccaggccactcatcagtgccagagatgggattttaaattcagttatatcggattcctaaacttatattccttttactctgtccagcagcctcttgatagagtcatgctgagctcaggtactccag

SEQ ID NO: 61998 - DNA, 201 bp, Bos taurus; identical to SEQ ID NO: 21435

SEQ ID NO: 61999 - DNA, 201 bp, Bos taurus; identical to SEQ ID NO: 21437

SEQ ID NO: 62000 - DNA, 201 bp, Bos taurus; identical to SEQ ID NO: 21438

SEQ ID NO: 62001 - DNA, 201 bp, Bos taurus; identical to SEQ ID NO: 21439

SEQ ID NO: 62002 - DNA, 201 bp, Bos taurus; identical to SEQ ID NO: 21445

SEQ ID NO: 62003 - DNA, 201 bp, Bos taurus; identical to SEQ ID NO: 21447

SEQ ID NO: 62004 - DNA, 201 bp, Bos taurus; identical to SEQ ID NO: 21450

SEQ ID NO: 62005 - DNA, 201 bp, Bos taurus; identical to SEQ ID NO: 21451

SEQ ID NO: 62006 - DNA, 201 bp, Bos taurus; identical to SEQ ID NO: 21452

SEQ ID NO: 62007 - DNA, 201 bp, Bos taurus; identical to SEQ ID NO: 21453

SEQ ID NO: 62008 - DNA, 201 bp, Bos taurus
atgggagatgcaagacaaatgttgcctccatggctttgggtgctgtgtctcagcttcaagctttgatccatcaggacaaacattcccaccaggcgggccaattaataagatggctttacacccagcctctcacaacatagaggagttctttgccctcagcttctccagggctgctatttaacaattctctaggccaaagga

SEQ ID NO: 62009 - DNA, 201 bp, Bos taurus; identical to SEQ ID NO: 21455

SEQ ID NO: 62010 - DNA, 201 bp, Bos taurus; identical to SEQ ID NO: 21456

SEQ ID NO: 62011 - DNA, 201 bp, Bos taurus
tgtatatttaatggtctctaggattcatgtcaactgctccttattccacagacaaatcagctaggtggtgattctgccccagggcccattcagtcatcaacgggagattttctctctctgggtcaagtccatcgtaaccttccagcaatgttttgctggaaggaataaggatttgctggtaggaataaggattcaggccat

SEQ ID NO: 62012 - DNA, 201 bp, Bos taurus; identical to SEQ ID NO: 21457

SEQ ID NO: 62013 - DNA, 201 bp, Bos taurus; identical to SEQ ID NO: 21458

SEQ ID NO: 62014 - DNA, 201 bp, Bos taurus; identical to SEQ ID NO: 21463

SEQ ID NO: 62015 - DNA, 201 bp, Bos taurus; identical to SEQ ID NO: 21464

SEQ ID NO: 62016 - DNA, 201 bp, Bos taurus; identical to SEQ ID NO: 21465

SEQ ID NO: 62017 - DNA, 201 bp, Bos taurus; identical to SEQ ID NO: 21466

SEQ ID NO: 62018 - DNA, 201 bp, Bos taurus; identical to SEQ ID NO: 21468

SEQ ID NO: 62019 - DNA, 201 bp, Bos taurus; identical to SEQ ID NO: 21470

SEQ ID NO: 62020 - DNA, 201 bp, Bos taurus; identical to SEQ ID NO: 21471

SEQ ID NO: 62021 - DNA, 201 bp, Bos taurus; identical to SEQ ID NO: 21472

SEQ ID NO: 62022 - DNA, 201 bp, Bos taurus; identical to SEQ ID NO: 21473

SEQ ID NO: 62023 - DNA, 201 bp, Bos taurus; identical to SEQ ID NO: 21474

SEQ ID NO: 62024 - DNA, 201 bp, Bos taurus; identical to SEQ ID NO: 21479

SEQ ID NO: 62025 - DNA, 201 bp, Bos taurus; identical to SEQ ID NO: 21480

SEQ ID NO: 62026 - DNA, 201 bp, Bos taurus; identical to SEQ ID NO: 21481

SEQ ID NO: 62027 - DNA, 201 bp, Bos taurus; identical to SEQ ID NO: 21482

SEQ ID NO: 62028 - DNA, 201 bp, Bos taurus; identical to SEQ ID NO: 21485

SEQ ID NO: 62029 - DNA, 201 bp, Bos taurus; identical to SEQ ID NO: 21486

SEQ ID NO: 62030 - DNA, 201 bp, Bos taurus; identical to SEQ ID NO: 21487

SEQ ID NO: 62031 - DNA, 201 bp, Bos taurus; identical to SEQ ID NO: 21488

SEQ ID NO: 62032 - DNA, 201 bp, Bos taurus; identical to SEQ ID NO: 21491

SEQ ID NO: 62033 - DNA, 201 bp, Bos taurus; identical to SEQ ID NO: 21492

SEQ ID NO: 62034 - DNA, 201 bp, Bos taurus; identical to SEQ ID NO: 21496

SEQ ID NO: 62035 - DNA, 201 bp, Bos taurus; identical to SEQ ID NO: 21498

SEQ ID NO: 62036 - DNA, 201 bp, Bos taurus; identical to SEQ ID NO: 21499

SEQ ID NO: 62037 - DNA, 201 bp, Bos taurus; identical to SEQ ID NO: 21500

SEQ ID NO: 62038 - DNA, 201 bp, Bos taurus; identical to SEQ ID NO: 21501

SEQ ID NO: 62039 - DNA, 201 bp, Bos taurus; identical to SEQ ID NO: 21502

SEQ ID NO: 62040 - DNA, 201 bp, Bos taurus; identical to SEQ ID NO: 21504

SEQ ID NO: 62041 - DNA, 201 bp, Bos taurus; identical to SEQ ID NO: 21505

SEQ ID NO: 62042 - DNA, 201 bp, Bos taurus; identical to SEQ ID NO: 21506

SEQ ID NO: 62043 - DNA, 201 bp, Bos taurus; identical to SEQ ID NO: 21510

SEQ ID NO: 62044 - DNA, 201 bp, Bos taurus; identical to SEQ ID NO: 21511

SEQ ID NO: 62045 - DNA, 201 bp, Bos taurus; identical to SEQ ID NO: 21512

SEQ ID NO: 62046 - DNA, 201 bp, Bos taurus; identical to SEQ ID NO: 21513

SEQ ID NO: 62047 - DNA, 201 bp, Bos taurus; identical to SEQ ID NO: 21514

SEQ ID NO: 62048 - DNA, 201 bp, Bos taurus; identical to SEQ ID NO: 21520

SEQ ID NO: 62049 - DNA, 201 bp, Bos taurus; identical to SEQ ID NO: 21521

SEQ ID NO: 62050 - DNA, 201 bp, Bos taurus; identical to SEQ ID NO: 21523

SEQ ID NO: 62051 - DNA, 201 bp, Bos taurus; identical to SEQ ID NO: 21527

SEQ ID NO: 62052 - DNA, 201 bp, Bos taurus; identical to SEQ ID NO: 21531

SEQ ID NO: 62053 - DNA, 201 bp, Bos taurus; identical to SEQ ID NO: 21532

SEQ ID NO: 62054 - DNA, 201 bp, Bos taurus; identical to SEQ ID NO: 21533

SEQ ID NO: 62055 - DNA, 201 bp, Bos taurus
gctacaaaaaagtgtgaagtactaatacatgccatagcatggatgaaccttgaaaactttaagctcagtgaaagaatccagacacaaaaggccacatactgtatgactccattcacatgaaaggtccagaataagcaagagacagaaagcagattagtggctgccaaaggatggggtgagtgatagggactgactgataat

SEQ ID NO: 62056 - DNA, 201 bp, Bos taurus; identical to SEQ ID NO: 21534

SEQ ID NO: 62057 - DNA, 201 bp, Bos taurus; identical to SEQ ID NO: 21535

SEQ ID NO: 62058 - DNA, 201 bp, Bos taurus; identical to SEQ ID NO: 21536

SEQ ID NO: 62059 - DNA, 201 bp, Bos taurus; identical to SEQ ID NO: 21538

SEQ ID NO: 62060 - DNA, 201 bp, Bos taurus; identical to SEQ ID NO: 21539

SEQ ID NO: 62061 - DNA, 201 bp, Bos taurus; identical to SEQ ID NO: 21543

SEQ ID NO: 62062 - DNA, 201 bp, Bos taurus; identical to SEQ ID NO: 21545

SEQ ID NO: 62063 - DNA, 201 bp, Bos taurus; identical to SEQ ID NO: 21546

SEQ ID NO: 62064 - DNA, 201 bp, Bos taurus; identical to SEQ ID NO: 21547

SEQ ID NO: 62065 - DNA, 201 bp, Bos taurus; identical to SEQ ID NO: 21549

SEQ ID NO: 62066 - DNA, 201 bp, Bos taurus; identical to SEQ ID NO: 21551

SEQ ID NO: 62067 - DNA, 201 bp, Bos taurus; identical to SEQ ID NO: 21553

SEQ ID NO: 62068 - DNA, 201 bp, Bos taurus; identical to SEQ ID NO: 21554

SEQ ID NO: 62069 - DNA, 201 bp, Bos taurus; identical to SEQ ID NO: 21555

SEQ ID NO: 62070 - DNA, 201 bp, Bos taurus; identical to SEQ ID NO: 21559

SEQ ID NO: 62071 - DNA, 201 bp, Bos taurus; identical to SEQ ID NO: 21560

SEQ ID NO: 62072 - DNA, 201 bp, Bos taurus; identical to SEQ ID NO: 21561

SEQ ID NO: 62073 - DNA, 201 bp, Bos taurus; identical to SEQ ID NO: 21562

SEQ ID NO: 62074 - DNA, 201 bp, Bos taurus; identical to SEQ ID NO: 21563

SEQ ID NO: 62075 - DNA, 201 bp, Bos taurus; identical to SEQ ID NO: 21564

SEQ ID NO: 62076 - DNA, 201 bp, Bos taurus; identical to SEQ ID NO: 21567

SEQ ID NO: 62077 - DNA, 201 bp, Bos taurus; identical to SEQ ID NO: 21569

SEQ ID NO: 62078 - DNA, 201 bp, Bos taurus; identical to SEQ ID NO: 21573

SEQ ID NO: 62079 - DNA, 201 bp, Bos taurus; identical to SEQ ID NO: 21575

SEQ ID NO: 62080 - DNA, 201 bp, Bos taurus; identical to SEQ ID NO: 21577

SEQ ID NO: 62081 - DNA, 201 bp, Bos taurus; identical to SEQ ID NO: 21578

SEQ ID NO: 62082 - DNA, 201 bp, Bos taurus; identical to SEQ ID NO: 21579

SEQ ID NO: 62083 - DNA, 201 bp, Bos taurus; identical to SEQ ID NO: 21583

SEQ ID NO: 62084 - DNA, 201 bp, Bos taurus; identical to SEQ ID NO: 21584

SEQ ID NO: 62085 - DNA, 201 bp, Bos taurus; identical to SEQ ID NO: 21585

SEQ ID NO: 62086 - DNA, 201 bp, Bos taurus; identical to SEQ ID NO: 21586

SEQ ID NO: 62087 - DNA, 201 bp, Bos taurus; identical to SEQ ID NO: 21588

SEQ ID NO: 62088 - DNA, 201 bp, Bos taurus; identical to SEQ ID NO: 21592

SEQ ID NO: 62089 - DNA, 201 bp, Bos taurus; identical to SEQ ID NO: 21593

SEQ ID NO: 62090 - DNA, 201 bp, Bos taurus; identical to SEQ ID NO: 21595

SEQ ID NO: 62091 - DNA, 201 bp, Bos taurus; identical to SEQ ID NO: 21598

SEQ ID NO: 62092 - DNA, 201 bp, Bos taurus; identical to SEQ ID NO: 21599

SEQ ID NO: 62093 - DNA, 201 bp, Bos taurus; identical to SEQ ID NO: 21600

SEQ ID NO: 62094 - DNA, 201 bp, Bos taurus; identical to SEQ ID NO: 21601

SEQ ID NO: 62095 - DNA, 201 bp, Bos taurus; identical to SEQ ID NO: 21602

SEQ ID NO: 62096 - DNA, 201 bp, Bos taurus; identical to SEQ ID NO: 21603

SEQ ID NO: 62097 - DNA, 201 bp, Bos taurus; identical to SEQ ID NO: 21604

SEQ ID NO: 62098 - DNA, 201 bp, Bos taurus; identical to SEQ ID NO: 21605

SEQ ID NO: 62099 - DNA, 201 bp, Bos taurus; identical to SEQ ID NO: 21606

SEQ ID NO: 62100 - DNA, 201 bp, Bos taurus; identical to SEQ ID NO: 21607

SEQ ID NO: 62101 - DNA, 201 bp, Bos taurus; identical to SEQ ID NO: 21608

SEQ ID NO: 62102 - DNA, 201 bp, Bos taurus; identical to SEQ ID NO: 21609

SEQ ID NO: 62103 - DNA, 201 bp, Bos taurus; identical to SEQ ID NO: 21610

SEQ ID NO: 62104 - DNA, 201 bp, Bos taurus; identical to SEQ ID NO: 21611

SEQ ID NO: 62105 - DNA, 201 bp, Bos taurus; identical to SEQ ID NO: 21612

SEQ ID NO: 62106 - DNA, 201 bp, Bos taurus; identical to SEQ ID NO: 21613

SEQ ID NO: 62107 - DNA, 201 bp, Bos taurus; identical to SEQ ID NO: 21617

SEQ ID NO: 62108 - DNA, 201 bp, Bos taurus; identical to SEQ ID NO: 21618

SEQ ID NO: 62109 - DNA, 201 bp, Bos taurus
ctctaggcacatgacagtaaaactgctaaaattcacagaggaaaaagtatgtatcagagaaaaagaaatatattcctgtcaaaggaactacaataaaactgagccctaatctcatctaaaatgatgaaagtcaaaagacactgaaattccagtttcaaagtgctgatataaaaaaaaatgccgatattgaattcttccctg

SEQ ID NO: 62110 - DNA, 201 bp, Bos taurus
tggtatctctttaagaggaaagaatgactaacttgtgcattttcagttttgcctctcattggtaaataatgggtccaataaatgtcttgataaactggatgtgagtgtattggcattagtttaatgtagagacaattaagcttttatttttaagtgttagaagtaagagtgaaaaaagaataaaatacagagaatgtagaa

SEQ ID NO: 62111 - DNA, 201 bp, Bos taurus; identical to SEQ ID NO: 21620

SEQ ID NO: 62112 - DNA, 201 bp, Bos taurus; identical to SEQ ID NO: 21621

SEQ ID NO: 62113 - DNA, 201 bp, Bos taurus; identical to SEQ ID NO: 21622

SEQ ID NO: 62114 - DNA, 201 bp, Bos taurus; identical to SEQ ID NO: 21623

SEQ ID NO: 62115 - DNA, 201 bp, Bos taurus; identical to SEQ ID NO: 21624

SEQ ID NO: 62116 - DNA, 201 bp, Bos taurus
ctaagtaagtgtaattgcaagggtccttataagtgtaatacaagggtaaagaaagaagaaggcaatgttatgatggaagcaggtggaaaaaagtctatgaaatgcaaggccacaagccaaggaatgaagataccctttagaatttggcagaagcaagacagtaagttctctcctagagtctgcagaagaaaccagctgtac

SEQ ID NO: 62117 - DNA, 201 bp, Bos taurus; identical to SEQ ID NO: 21625

SEQ ID NO: 62118 - DNA, 201 bp, Bos taurus
gttgacctgaacagatggcttcttcactcaatagtgaggtatctgggttgagataactgaaggatgaaatcagatgtgattattaattacaggcccaattcagtctctccagcatggtggtttaagagtagtcagactctatatagtgactcagggatcaaagaacaagaaagcaaggcagaagttacatggccttttatg

SEQ ID NO: 62119 - DNA, 201 bp, Bos taurus; identical to SEQ ID NO: 21627

SEQ ID NO: 62120 - DNA, 201 bp, Bos taurus
caaacggtaatactgtgctaagaaataaaggtttacccagccagatctacatactaaatctagttctagccatatggtctattggaaattacataaatgccgtaaggcctattttttttttttttttttctgatctgaaaatgatagttataatacactcatcttaaaagggttggatgagcttatatatttaaagcactt

SEQ ID NO: 62121 - DNA, 201 bp, Bos taurus
actttcacatttttctaaagtcatctttgctaggaggaaagaagaaaaagagagaggtgaagaatgagagcaaaagaaagagagggaaatagcatagtcatagtcatcatttgggatttgagctgagctgtcatggcaggagtgactcagctacaagaaggacctacccaggaccagggtacctcattttccaactgagga

SEQ ID NO: 62122 - DNA, 201 bp, Bos taurus
tgctttgattggatgaccacagagacagctttgattggatgaccacagagacagctttgattggatgaccacagagacagcttgatctccctgagtactctcttgaactttcaactttaagtttcaataggcaccagtgggattctaatcaaggcgggggagactattgattgtttggctctatcatgaatgcacaattct

SEQ ID NO: 62123 - DNA, 201 bp, Bos taurus
acctcggagtaatttgctgactttaaaaaacgcgttgttgacaactgggattatatggtatctcttatatcccagacgttttcctgatactagttttattaggttttaatcagacatgatcttagtgaaatgctttgaaatctgattaaaaagcaacatgaataaaggtgaaggggaaacaacagcagtgttgcagaccta

SEQ ID NO: 62124 - DNA, 201 bp, Bos taurus
gagtaatttgttatgtaaactataggtaattgaggaaccttttcaagtgcagattctctaacaatcctctcctgaaggcctgggattcacggcactttaataagatccaggtgatgttagcttcctgctagtggtccacgtggtccacaatgaggaggtggatttggccccgccccccgctacagtgagccaatgagctca

SEQ ID NO: 62125 - DNA, 201 bp, Bos taurus; identical to SEQ ID NO: 21628

SEQ ID NO: 62126 - DNA, 201 bp, Bos taurus
agacccaggaaaatcattgagttacctggatgttattattcaggttttctattgtcttgtctttttatactacggttttctaaatactaaaataaaataatacagatagtaaaatccaaactttagtgcttcatccccaaatctcgtattttgaaagcatattgattgtttctgcttattcctgaccttaactcatttcct

SEQ ID NO: 62127 - DNA, 201 bp, Bos taurus
agagcaacaggtgttgtcaagggaagaaagaaataaaaggtttacagattttcaagttttcttatgttagatcaaaagctggcaaacttctcctgtaaatggccagagagtaaaaatttagactatgtggaacagttatacagtcttcatctcaactactcaactttgatattgaagcacaaaagaagccataaacctagg

SEQ ID NO: 62128 - DNA, 201 bp, Bos taurus; identical to SEQ ID NO: 21629

SEQ ID NO: 62129 - DNA, 201 bp, Bos taurus; identical to SEQ ID NO: 21630

SEQ ID NO: 62130 - DNA, 201 bp, Bos taurus
cttctgaggtatctctccttggcttgacaggtgccttctcactgtgtcctcatatggtcttttccctgtatccttatctctttttcttttaaggccactagtcatgttggattagggcccactcatatgacctcatttaccttagttacctctttcaaggccctgtctctaaatacatgagtcacattctcatacactgag

SEQ ID NO: 62131 - DNA, 201 bp, Bos taurus; identical to SEQ ID NO: 21633

SEQ ID NO: 62132 - DNA, 201 bp, Bos taurus; identical to SEQ ID NO: 21634

SEQ ID NO: 62133 - DNA, 201 bp, Bos taurus; identical to SEQ ID NO: 21635

SEQ ID NO: 62134 - DNA, 201 bp, Bos taurus
aatgttgttctgctaatgtgtacctcctgcccagtatttcttattaataaggcactaaataaggggcaatcggtgtttccattgccaaaagaaaacgtctcttttaattaatcaatgtaaatgggcttttactggaaaatagaagggaagtgtttctagaactcaggatataatgttacatcagggaataccatgccctct

SEQ ID NO: 62135 - DNA, 201 bp, Bos taurus
ctcgcccaggtctttgcaaaagcccatttttacatggaaataattcatttagtataattagaaagccataagttttcacttattcattcagaaatgatttctagttcctataaacactgtgctagaaaataacatggaaaaatgaatgaaatacctctcttgctcctaaggaactcacaggctaaagacaccaaggtgagc

SEQ ID NO: 62136 - DNA, 201 bp, Bos taurus; identical to SEQ ID NO: 21636

SEQ ID NO: 62137 - DNA, 201 bp, Bos taurus; identical to SEQ ID NO: 21637

SEQ ID NO: 62138 - DNA, 201 bp, Bos taurus; identical to SEQ ID NO: 21638

SEQ ID NO: 62139 - DNA, 201 bp, Bos taurus; identical to SEQ ID NO: 21639

SEQ ID NO: 62140 - DNA, 201 bp, Bos taurus; identical to SEQ ID NO: 21640

SEQ ID NO: 62141 - DNA, 201 bp, Bos taurus; identical to SEQ ID NO: 21642

SEQ ID NO: 62142 - DNA, 201 bp, Bos taurus; identical to SEQ ID NO: 21643

SEQ ID NO: 62143 - DNA, 201 bp, Bos taurus
ccagaagatgcaggagggagtgctcacttgagcatcattaaaagttcaagtggcttcctccctccaccctgcaccccatggggtgcattaaaccccaggattcattaaaccctctgcccccagagcccaatttggttgaagggaatgtttgatcttttcatccagaggaggtctgaactaagggtttggggcctccctgag

SEQ ID NO: 62144 - DNA, 201 bp, Bos taurus; identical to SEQ ID NO: 21646

SEQ ID NO: 62145 - DNA, 201 bp, Bos taurus; identical to SEQ ID NO: 21647

SEQ ID NO: 62146 - DNA, 201 bp, Bos taurus
gaattgttcacttccgagacaaagcagagctaaaattctgccgttgcaaattctggtgcatatatctttttcttctcattctggcctgatgagatgattagacttagcaatataaatgaaataatcatctgaaaaagagagaaagatgggaattccctggcagtccagtgcttaggactcagtgctttcactgcggtggcc

SEQ ID NO: 62147 - DNA, 201 bp, Bos taurus; identical to SEQ ID NO: 21649

SEQ ID NO: 62148 - DNA, 201 bp, Bos taurus
gggtgggtgggtgtggcctcagacatgtcatgccctctgcctgggtgatattttgggctttacagctagtgctgcaaagcacaggatgtgttagatctcaacaactagctgtgagctggcctgaacgccaaagctttcatggcattgtgggtatgaggtcgctaggggaactgatttagtatctaaggaggttaaagaaaa

SEQ ID NO: 62149 - DNA, 201 bp, Bos taurus; identical to SEQ ID NO: 21651

SEQ ID NO: 62150 - DNA, 201 bp, Bos taurus; identical to SEQ ID NO: 21652

SEQ ID NO: 62151 - DNA, 201 bp, Bos taurus; identical to SEQ ID NO: 21653

SEQ ID NO: 62152 - DNA, 201 bp, Bos taurus
gggagggggccagttcaggctctaaatttagtaagaaaacattaggaaaaaattagagtgaagtataaagaaaagtctaaccaggacatgtataagactaaggttgaaatttgctggtgatggccagagaatagtaagaaagaaaccaaattgtttgtatttttctttaaaacagacaaacctgaccatgaaatgcatgct

SEQ ID NO: 62153 - DNA, 201 bp, Bos taurus
tggccaagatcttccagcatcgattcccttatatatgaaatgggtattactacacttaccttccatgattattatgagaattaagaatgatgactcttgaggacttccccggccattcagtggttaagactccaccttccaatacaggggtgcagattcaattcctgcttgcggaattatgatctcacatgccaagcagtg

SEQ ID NO: 62154 - DNA, 201 bp, Bos taurus
gaccattaactagccaagggaaatacagcagttttgtttaaatgaattctcagtcagtcacaacacattttaaactccctagtcattaagaattacataatggatttgaaatatcataggctacaaatctgaaaggtctatacttaaatcctcccttaatcaacattaaacatgaaaagcaggaggaacccatgattccta

SEQ ID NO: 62155 - DNA, 201 bp, Bos taurus
gtgttgacacaccttctgaccccacaattcagctcgtgggcatttgtcctcaagaaacgccagctgggttcatagggaacatgtccgaggacactcactacgtgtggagccagggagttgaaggtgatctaggtggtgtcatcaggggagtggaggctatgtcctgtgagggccatggcctagatgtatactcggccatgt

SEQ ID NO: 62156 - DNA, 201 bp, Bos taurus
ctcattttcatttgaggaaactgaggcccagggatagtgagggtctagctgaggtggcagatggaggcactaaatctcctgattactagacttatgctgtcctgttctgccacttaataacaggcccactaagacatcacaaaaagggccaacttggatgtgctctgctcctaggcatgtcccaagttgagaggaagagca

SEQ ID NO: 62157 - DNA, 201 bp, Bos taurus; identical to SEQ ID NO: 21655

SEQ ID NO: 62158 - DNA, 201 bp, Bos taurus
ggcgctttgccgcgcaagaaataacgggaccgaattgctctgatacctaacttagccctgagttacctggagaaccccatccatcgtgggcagtgactctgtggatgatgggaagagctatagactgggaaccaggggatctggtactttctgttcctgggtctttgtttccccaccaagacccagaggcggttgtatgaa

SEQ ID NO: 62159 - DNA, 201 bp, Bos taurus
gaaagctcgttctattgaggcctcttgtgactgcccttgggcgtagtccccagaggcacagtggctggagggtgatgagaccataaggcctcttccttcatgtgccatgatgttcagacatataagaagaggaagatgggcttaagatatttttctttcctggagacttgggcccaggtcctgcaccagctctgtgcttcc

SEQ ID NO: 62160 - DNA, 201 bp, Bos taurus
tctttgtccgatttacttcatgtagtacaatcatcgctaggtccattctcgctgcaatttgccaacacatcttcatagaaagctgactttcagaacagaccggtggcaaaagatctgagggtcaatttctcacaggtgagaagcacggcacaggccttgtttacaaacccagaaagacctgctgggatttttctctgctct

SEQ ID NO: 62161 - DNA, 201 bp, Bos taurus; identical to SEQ ID NO: 21656

SEQ ID NO: 62162 - DNA, 201 bp, Bos taurus
aagattattattatccttacatcaaagatgagggcactgagacttagagaaataaagtaagttgctccaggacacacagctagtaagtggtagagacagcgatcaagtccaagtctctctgacattggaatctttgtcctcaactacacaacttccactacaatgtcgcattctacagcagctcatgggtatggtaaagaa

SEQ ID NO: 62163 - DNA, 201 bp, Bos taurus; identical to SEQ ID NO: 21657

SEQ ID NO: 62164 - DNA, 201 bp, Bos taurus; identical to SEQ ID NO: 21658

SEQ ID NO: 62165 - DNA, 201 bp, Bos taurus; identical to SEQ ID NO: 21659

SEQ ID NO: 62166 - DNA, 201 bp, Bos taurus
tacaaatctttcttaaacttattaaaaaacagaaaagggataacttccaaacttatattatgaggctagcatcaccctgttaccaaaaaagagaaggacaagagaagaaaaaatacaaaccagtatcactgataaacatagaagtaaaacttctcaacaagatagtcacaaaacaaattcacaatacatttaaaggctcat

SEQ ID NO: 62167 - DNA, 201 bp, Bos taurus
gccaaagccaactccaggaaccctagaactctgcaaccagagaccccagtacccagctccacccacccctgggggaacaccagccctagggctatcccaacccctttagccagccaagaccaggccccaccagctagcaagtcaacaccagcctcaggacaccttcagcccctcacctaaatgcgcctctcctaccagtgg

SEQ ID NO: 62168 - DNA, 201 bp, Bos taurus; identical to SEQ ID NO: 21660

SEQ ID NO: 62169 - DNA, 201 bp, Bos taurus
tggagccagggtgtccaggacactgtagcacatacggccatctgtgtcacaatggagggaggtgcagagaaaagcgcagagggatcacgtgtgactgcaccgtctctgcatatgacgggccattctgcgagaacggtgagtgtgcccaaggaacagggaaaggctggagcatgagaagtccatgaagatgcctctggtatt

SEQ ID NO: 62170 - DNA, 201 bp, Bos taurus; identical to SEQ ID NO: 21661

SEQ ID NO: 62171 - DNA, 201 bp, Bos taurus
cctgtacaccacaccctcaactccaataaaggcaaagagctgggtccttgccccttctctccactcaagatctggctgggtggcccctgatgtgctctgtaccctctagtacctagaagcagtaaactttgtgttttcaaagttccctaataattattgttgatcctaatgatcatccttcagtcataataaggaccacaa

SEQ ID NO: 62172 - DNA, 201 bp, Bos taurus; identical to SEQ ID NO: 21662

SEQ ID NO: 62173 - DNA, 201 bp, Bos taurus
atctacatccatgtctatattcatatttgcctatatgtttaccagatgccaggtgcagagtaaggagaagacagaagagggaggtagggtagggtgttctgaggaggcctctttctgatactgtgatattcaagagttgacaacagtaaggaaataagccaagagaaacatcttgaggaccacagcattctaagcttttgt

SEQ ID NO: 62174 - DNA, 201 bp, Bos taurus
gctctgcataaaagattgggctgtgtcacacagtgaaagaaatgcttttcagtaaaaggtcaccatttgtttgatatagaaaccttctctgaattttcatagataccccaactatctaattttcactcctggggggtttgttgttctatgagggtgagatttaaagtagaaagtatggctctggtatctattaccagaatt

SEQ ID NO: 62175 - DNA, 201 bp, Bos taurus
tctgttgtaataccctggaggaactgcgctacaggaggtggtggtctctgggcgggtaccacttctcgctttttagagagtaattcattatgaaatcatagaaacataactttgaaagctaacaatgactggcctgagactctttatgcctatttatagaaggtataaaaagaggcctgaccctgaaacccttttcagcct

SEQ ID NO: 62176 - DNA, 201 bp, Bos taurus; identical to SEQ ID NO: 21663

SEQ ID NO: 62177 - DNA, 201 bp, Bos taurus
aaatgtgctgggcctatccaggcactgatgagcagactggtccagaggaggtgagggctgtgggtgagcagagagaaaagtcagggtggagagttagacttcgtcaagccaagggggcctcagatgctggctgaggcattcggacctgaataagcgggagccattgaaggataatgaacagaggttattaaaacaaaatat

SEQ ID NO: 62178 - DNA, 201 bp, Bos taurus
tattcttttctatattatcaaagaagtctgctgagatatgaacattggccttcaaactctatttcacccagatttaagtcaacattgaactttgtgtttcacaaatggaaggccatatcactattaatccatttggtcatttctttcttcttattttgagctttcttcagttatttatgcttgaaaaagtctaaaatatac

SEQ ID NO: 62179 - DNA, 201 bp, Bos taurus
gttgccagctttgctaagaggctgtgaacaccagcagcagagcttggagaagcgaactgacagaggataaaatgtctgaggtggatccgggtggtccacaggacagcgaccttggaggaggccaatatcacattttatactgttcaaagcctgtcccctctgctgggaaatagcagtgggaaaaggatgcaaggtctggac

SEQ ID NO: 62180 - DNA, 201 bp, Bos taurus
gtaagagccagtatgcttacaatggcctgcagggaccaacactctgacctcattatctctctgaatttaccttctatgactttcctctcattctgctctagccccactggcctcttcattgttgtgcctcaaatagtccccacctctggacatttgagggcttcccaggtggcactaatggtaaagaacatgcctgccaat

SEQ ID NO: 62181 - DNA, 201 bp, Bos taurus; identical to SEQ ID NO: 21664

SEQ ID NO: 62182 - DNA, 201 bp, Bos taurus
cctgaacacacccctcctcaagcaacaaaatacaaagaagctgtatggtactaaaaataactgtgtgcctgccttccgtagggtaaattctggacaaaaggtacaaagataccaaaaaacccaactgctacttttgaaatgcctgaagcaaggtcagagggtcaggagcaaaagctgggttctgtacatgcaatcaacacc

SEQ ID NO: 62183 - DNA, 201 bp, Bos taurus
gcatgtccgttggcagggctagcaacgttataaaaattggataaataggtctgtagtacgtcaaaggtcacagttatgaagacaacagtgtatcaagtctgatggcccatcaaaatcagcactgagagcttggtaatcctagttgggaataccatcagaagagtggcttgctgccaggggcaagttgagataaacggttca

SEQ ID NO: 62184 - DNA, 201 bp, Bos taurus
cccttctttccttctcccttcttcctccctccctcctctgtcctcacttccttctgcactttcatcttttcacattttcccctgttggcttcctttccctcccttttcttcatttttccttcccttcttctgccacatgccttctaaactccagtctaaggagcagcatcaggttgatggataagaatggccagagcttag

SEQ ID NO: 62185 - DNA, 201 bp, Bos taurus
tgtataatcccctccccttgagtgtgggtgggatatgtgaccttcttctaccaaaagaatatggccaaagtatgtgatgtcacttttatatggaaaaggtcatatgttgtcattgttataattatattagatcacattgtattaatataagatgccagagaagactcttgagagtcccttggacatcagggagatcaaacc

SEQ ID NO: 62186 - DNA, 201 bp, Bos taurus
gactggttagatctacttgcagtcttgccatgtaccttttcttctctcttcctcccagaagcctggaaaagtcctacaggaaggcctactgtctccagttctttgtaggacattggtctataccccctccaatcccatccctgtcatcttctccacaaaaccctgctattccctagtccatgaacctttgctggcctggct

SEQ ID NO: 62187 - DNA, 201 bp, Bos taurus
tggggtagttccctgcagtctgggagtgctaacagtcctgtgcaccttcccatgagaaaacctgtctgccatttctctttcaagaaggcacagacacctgcattcaggaaatcacagattttgttgttttttcagcctcccaagagaagccaggatgaaccactacactggtttccaagctgtttctttgtttgagcagca

SEQ ID NO: 62188 - DNA, 201 bp, Bos taurus
gtgggctacagtccacggggcctcaaagagtcggacatggctgagcaactaacacttttgctttcatttgtacagaaaacttgctgtgcccccagtgcacctgccctctgcctctggctggccctacactgctatccctctgccaacaatatctgcctggctggccatgaaaacatcacatgagttgctagcagactcccc

SEQ ID NO: 62189 - DNA, 201 bp, Bos taurus; identical to SEQ ID NO: 21665

SEQ ID NO: 62190 - DNA, 201 bp, Bos taurus
cggttgacaggaaactagccttgtatttgccctgggagcagcagttctgtactcactaattcaatgttcacagcgatagacactgcctaccttctcagcaagaaccaactgtacacccatacataacagcacaaaaacagggttaccctgtccagttctagtttcaaaaagaaaggaaggcttgaaccctcctataaataa

SEQ ID NO: 62191 - DNA, 201 bp, Bos taurus
gaaattttgaaggcttctgaagatgtcccagtttctttttagatctgccggagataagtgtttctgatttaccatctctgcagtcttagctggacccagcgaggcctctttcctgcttcatcctggccaccctcgtgactgggaaccagctctgaggctggcactaggatgcttggggtttatttctctgaaataaattaa

SEQ ID NO: 62192 - DNA, 201 bp, Bos taurus
atggccccagcaaaacaatcaaatcagatctatgcttgtaagccctctgaaaggaagtgcctaggagaccctttcaatgagacaaaaggacttgtgagaaacttgagggtattggcccacagcgaatgacatgctcaaaaaaatatatggacaaaattctgaagacatagggtgaatcccaccaaaattcctaggaaatgc

SEQ ID NO: 62193 - DNA, 201 bp, Bos taurus
tagcttctgaggtttgttggccatcactgacatcccatggcacatagaaacatcatcccaatctctgccttcattttcacatggagctctccctatatgtgtgggcctgtgtccaaatgtccctttggttaggactcatcctaatgaccccatttcaacttaattatctctgcaaagaccttgtatccaaatgtcacattc

SEQ ID NO: 62194 - DNA, 201 bp, Bos taurus; identical to SEQ ID NO: 21666

SEQ ID NO: 62195 - DNA, 201 bp, Bos taurus
tttcatgggagaagagaaggacaaggaggaatccaaagtcagactgaaacctacaaattggggaccaaacacagaatgtaggcctggctgccctggttctacctctgccccaccttgtaagtcaggaggggaagaggagggtgggagagaggaaagacaggatgaagagggaccacatgccgtcctctgcctggccaggtt

SEQ ID NO: 62196 - DNA, 201 bp, Bos taurus; identical to SEQ ID NO: 21667

SEQ ID NO: 62197 - DNA, 201 bp, Bos taurus
gtgaaagtggccacgagccgctggcagaccagactgcagggaagctcttggggaaggaggagagggtgcctggctcgctggcgatactgggcagcgaggtggaccagatgaagaatgtcctgggcccgcagtggggtaggcagtgaggttcgtgggtaccagccagcctgtagggactctgcatctgcttccttggaagtc

SEQ ID NO: 62198 - DNA, 201 bp, Bos taurus; identical to SEQ ID NO: 21668

SEQ ID NO: 62199 - DNA, 201 bp, Bos taurus; identical to SEQ ID NO: 21669

SEQ ID NO: 62200 - DNA, 201 bp, Bos taurus; identical to SEQ ID NO: 21670

SEQ ID NO: 62201 - DNA, 201 bp, Bos taurus; identical to SEQ ID NO: 21671

SEQ ID NO: 62202 - DNA, 201 bp, Bos taurus; identical to SEQ ID NO: 21672

SEQ ID NO: 62203 - DNA, 201 bp, Bos taurus; identical to SEQ ID NO: 21673

SEQ ID NO: 62204 - DNA, 201 bp, Bos taurus
ctgataccttcgggtaaggtctgaactagctttttttttttttttctcaaaggttcattgaggcaaggatttgattgattgattgagtttttggccaccctagccatgtgggatcctagttgcctgaccagggatcgaacccacgccccctgcacttgaagtacggagtcacttggccactagggaagtccctgaaactag

SEQ ID NO: 62205 - DNA, 201 bp, Bos taurus
gtccctggagaagacggccagcagagctgcccaagatgggggtggcatgcacagtgctgtactgggaggaaggggggccttggggttgagctgcactgaataacccagctgggaccccagggcaatctgcattcattcctttggggaacaggccggcaggctggagtgtatggggctctgattggaaccagagccagggca

SEQ ID NO: 62206 - DNA, 201 bp, Bos taurus
atcccccttcaaaagccagaagatgactctggtccacccgcagttgaggaggaggttttcagaagccctctgaacaagccacccatgtgttgcctggccttgggcaccccatcctgctgtggagcaggactgatggcagccttcccactcccaggactagtcgaagacctgtgccaggctggggactctggtggggccagc

SEQ ID NO: 62207 - DNA, 201 bp, Bos taurus
ggaagaccagataacttcccaagagtagcccagggcggatgatctaacttggagagaggtagttccatgtttgttgggatggcctggtcctgtcatgggtactagggtggagatgccagggcttggcagacagtcaggaccaaggacttaggaaggccctctggttcactggaggtccagcgtcctcatcctgtgactcac

SEQ ID NO: 62208 - DNA, 201 bp, Bos taurus; identical to SEQ ID NO: 21674

SEQ ID NO: 62209 - DNA, 201 bp, Bos taurus
gctgcagttcacggtgtcgcaaagagtcagacacaactgagcaactgaactgaactgaagagttctaactcctaagaactgcttaggagtaaggaactccttgagtggggctgctggccagtcatgtagattacgtgttaatttcttaatagtcatcaggtctgcaaagtaggagaggctagtgctagaactttctgccct

SEQ ID NO: 62210 - DNA, 201 bp, Bos taurus
aagaaaaaaagaaaggctcacctttggcccactgaagtcctaatttcagatccaatttcctgggccctagggtttcaggcaattaagctgggcctgtgacgggaggaagcaaaagctactgatgtctgcatgggaaggaagcaggtctgactgagaccagcttatgaggacggccccagagggactaactcagaaagcgct

SEQ ID NO: 62211 - DNA, 201 bp, Bos taurus
agggggtgaggcatctgggacgtacagggggcctgaggactcagagcacaaagcgggctgggaatgcaagaggtaagagcgagcagagagcaggtgtatcagggccaggcaggggctctgtatataagtggtttctcaactctgttgcatgctggaaccactgcagtggctgaaaaatgtccccagaggtagtaggcccta

SEQ ID NO: 62212 - DNA, 201 bp, Bos taurus
gcacgcatctcttagtcaagatggatgttactgaaaagctgtctggtagaacatcccttgtcataactctcctttggcctccaaggaacctttctatacatgtgtggtcagggaggtctcctgactttgataatgagaaatatggggtctgggtggggcccagcctcattgccttaattgtcctgctgttctcatctcgga

SEQ ID NO: 62213 - DNA, 201 bp, Bos taurus; identical to SEQ ID NO: 21675

SEQ ID NO: 62214 - DNA, 201 bp, Bos taurus; identical to SEQ ID NO: 21676

SEQ ID NO: 62215 - DNA, 201 bp, Bos taurus
atcattccttgttccctccagatgcattaagtaaacaaccctttcattgttatttccccagctttaatttatagactgatactcaactctctaacaaacaacatcagtatcttgggcagatagtgcagtttataaacttctttcactgaacattcatattttcaaacatctgttatcttcatggtactgtgctcctgaagg

SEQ ID NO: 62216 - DNA, 201 bp, Bos taurus; identical to SEQ ID NO: 21677

SEQ ID NO: 62217 - DNA, 201 bp, Bos taurus; identical to SEQ ID NO: 21678

SEQ ID NO: 62218 - DNA, 201 bp, Bos taurus
acagtgaatgtagttcattgcaagaaaaaaaaacaactgataggccccctttaggtaaactggagacacaagaaaaacagcattatatattttatgagcacataccaattcagggccatgtatcaaagtccttggagcatgtgtccatggggagaaaatgagagcaagaatttaatgataaagaagagaaaaatctaaaga

SEQ ID NO: 62219 - DNA, 201 bp, Bos taurus
gcgtggtgacattagaatatgtacctttagtgctactcccaggtggagagtacacgtgaggccacgattgaggcatccttggtgttgtcagtaacaccctgagtcctcagttgaatcactgcagaaatgcttggaaagggcagcaagaagatggttaaaatcctaagctagtcccagactctctggctgtttcttagggga

SEQ ID NO: 62220 - DNA, 201 bp, Bos taurus; identical to SEQ ID NO: 21679

SEQ ID NO: 62221 - DNA, 201 bp, Bos taurus; identical to SEQ ID NO: 21680

SEQ ID NO: 62222 - DNA, 201 bp, Bos taurus
tttatgagaacatcattaaggccatgaggcctcagcccgagtactttgctgttggctactacggacagggcttcccttctttcctgcgggtaagaagcgctagggtggtctccctggccattgagccatgcagttggaggagggaatgtcttcatctcttttccagatgagtctagtgtgttagcagctggagccctgtgt

SEQ ID NO: 62223 - DNA, 201 bp, Bos taurus
atgtcttcgactagagcataatgtattgaatttttctaaacaaggcttcatgtcccctattaatcaggacttctagtcaggagaattgcaaaccaaatacgaaaattccacgataatccacagcttttgagaagagggtaaaactcagaacctatcatatctgatgaatgttctggagattggctttggaataactgtcag

SEQ ID NO: 62224 - DNA, 201 bp, Bos taurus
tgaagaagaccatgaaagggcggcagctgagtccatgagatagagcaagatttggagtcacatagatttgggtttgattctcggctctgctgctcattacccagatttcttactctgtcagaatggtgttctacaagatgagacgaatgatacctccgtcttagagttataatgaaacttgatattgtcataattgttatc

SEQ ID NO: 62225 - DNA, 201 bp, Bos taurus
aggaagcaactaataaatgctggctactattatcttattccataggagtgccttgggtttcacatagtacagcttgtatttacttaatacaagatggacagattagctgtcattattcttctattttttgtgcgaaatttcatgagtttttttcttcaaaataaattgaagaatgattttatatttcccacaagaaatata

SEQ ID NO: 62226 - DNA, 201 bp, Bos taurus
acaacaaaaaatctttaaaaaaaaaaattagcctcatatataatccaaatcttctcctgtatccttctccctccttcccccatgcagaggcttgtggcctagggactgagggtgggaacaagactgatcttcactgtccctctgcacttaccaaggtgtgttttctctgacattggggccaacggaagaagaaagagggag

SEQ ID NO: 62227 - DNA, 201 bp, Bos taurus; identical to SEQ ID NO: 21681

SEQ ID NO: 62228 - DNA, 201 bp, Bos taurus
caccagttttgaagcccaaattattatagaatatattcttctttacccttttacccttctcgttcagtttttccaggaagtgagatgctgttttcagagcatcagtttgaaacagggtgattcttttctatttacaaacagtgcttttttttcagaaagattttctcagtgtcatccttgatctttggttctgtttcttaa

SEQ ID NO: 62229 - DNA, 201 bp, Bos taurus; identical to SEQ ID NO: 21682

SEQ ID NO: 62230 - DNA, 201 bp, Bos taurus; identical to SEQ ID NO: 21683

SEQ ID NO: 62231 - DNA, 201 bp, Bos taurus; identical to SEQ ID NO: 21684

SEQ ID NO: 62232 - DNA, 201 bp, Bos taurus; identical to SEQ ID NO: 21685

SEQ ID NO: 62233 - DNA, 201 bp, Bos taurus
cccatcccccctctcccatcattcattgttcttgtcacaaattaaaacgaaaagcaggcagtgctgagggaaagctgtggccccactcttgacacctccctcgcagaaaagcatgtgacaaccggttcccatggcaacgggctttctttgaaataatttctccttcggtgtaccagtcccccgcctgtctcttcttgggag

SEQ ID NO: 62234 - DNA, 201 bp, Bos taurus; identical to SEQ ID NO: 21686

SEQ ID NO: 62235 - DNA, 201 bp, Bos taurus
ataaaaatgatacaacaaccaaaaagtaggggataaaagcaccaattactgttcaaataacaagcaacaacaacaatacaagaaatcctcttcagttcctataagactaaagagctacaaacagagggaaaaaaaaactggatgagagcactgcctagcaaaacataaggcaagaaactcaagctgcagggaagaaaatga

SEQ ID NO: 62236 - DNA, 201 bp, Bos taurus
ctatgagataggcccaaatgtttctatgcttaccataaatcacattgtatacttttttgataccttttatcttccagtccatacagatgtagaaggacttgcctggaaggccaatggttaagactcaatgatttcactgcagggggagtgggtttgatccctggttgagaactaagatcctgcatgactatgtgatacggt

SEQ ID NO: 62237 - DNA, 201 bp, Bos taurus; identical to SEQ ID NO: 21687

SEQ ID NO: 62238 - DNA, 201 bp, Bos taurus
agccttatactcataatactccattttgtctctacatacatgacagttccataaaataaccacagagaaaaagaagtaagaaaacttaaatgcacattgccatgactgtgcaaatactttcactgaattttagaagataaagaaagcagattaatatcctgtgtgagatattcaagacttctgacacaacacgactgaaat

SEQ ID NO: 62239 - DNA, 201 bp, Bos taurus
ctgggctgttctgtgtggggaatggcccacactgcccatgtgaccagttccaggtagtgagaactgtcctttcactctgccccaggatgagtggatgaccatcctgtggcccttaggagagctgatgctcattctgctttgtttctgaagaaggaaagaaaggaggcagcagcttttcatcccaaaactactctctacttc

SEQ ID NO: 62240 - DNA, 201 bp, Bos taurus; identical to SEQ ID NO: 21688

SEQ ID NO: 62241 - DNA, 201 bp, Bos taurus
tgttctgtcacgaatattttccccttcacggtttcttaaaagcaaaagttaaggtttttccagtctctagtcgctaagcaatcctctgggtatatgctaatgtagagaagttgttaacaagaatggaaatgcagataaaaagtagcagataaaaatccagctgctctactgactttttaggcaactcccaaagccccttcc

SEQ ID NO: 62242 - DNA, 201 bp, Bos taurus; identical to SEQ ID NO: 21689

SEQ ID NO: 62243 - DNA, 201 bp, Bos taurus; identical to SEQ ID NO: 21690

SEQ ID NO: 62244 - DNA, 201 bp, Bos taurus
agtcacggcctccgccaccgattgctcatcacagacagacagacaagtaaggattctttagctgcttcccaaagggccatgtctgttcggagatgccaccaaggagtaaattgccctgggctgcactagtcattggcacctcattgggtctggccttggggtgttgcattcagatatatgatgtttgactgagatgctgga

SEQ ID NO: 62245 - DNA, 201 bp, Bos taurus
aactattctgtggttaagagaattccggggtaggggcccaggtttaaaccctggtcagggaactaagatcccacaaactgtgcaaaatgatacctcccccaaaaaaactattctattattaaaattaaaaaaggaatgagatgagagtgaggatttgttactatcctagccactccagccactaagcccagatatccaccc

SEQ ID NO: 62246 - DNA, 201 bp, Bos taurus; identical to SEQ ID NO: 21691

SEQ ID NO: 62247 - DNA, 201 bp, Bos taurus; identical to SEQ ID NO: 21692

SEQ ID NO: 62248 - DNA, 201 bp, Bos taurus; identical to SEQ ID NO: 21693

SEQ ID NO: 62249 - DNA, 201 bp, Bos taurus; identical to SEQ ID NO: 21694

SEQ ID NO: 62250 - DNA, 201 bp, Bos taurus; identical to SEQ ID NO: 21695

SEQ ID NO: 62251 - DNA, 201 bp, Bos taurus
atatctccatggcttccagtccccttcagcaaccccaggctctggaatcctccaggaaaggggaaaggcactctctcttggggcctcatccccttctctttgccctgcagttgccctaggggacacatcctgggaatgaggcaagaacctgggacaaaagaacccactgattcaaaggcctgggaaactctacaggcctca

SEQ ID NO: 62252 - DNA, 201 bp, Bos taurus; identical to SEQ ID NO: 21696

SEQ ID NO: 62253 - DNA, 201 bp, Bos taurus
tttatactaacaggcaaagggccaaatgggccttactttgattccttttatagtctattagcataaggccctgagcacaggaatggggatggggcaatgcacaggaaaataagcctttgctcacatcttgatcctcggtccataccacattttttcatttatggacatcacattatcaatgtgcttatatatgcagacagt

SEQ ID NO: 62254 - DNA, 201 bp, Bos taurus; identical to SEQ ID NO: 21697

SEQ ID NO: 62255 - DNA, 201 bp, Bos taurus; identical to SEQ ID NO: 21698

SEQ ID NO: 62256 - DNA, 201 bp, Bos taurus; identical to SEQ ID NO: 21699

SEQ ID NO: 62257 - DNA, 201 bp, Bos taurus; identical to SEQ ID NO: 21700

SEQ ID NO: 62258 - DNA, 201 bp, Bos taurus
agtaaaacatgacacaatgaagcacttcaaagttagtaaagtgaaaggaaatggtttatgatattaacaaagcattcaaaatcctaaaaatcctcaaaagtaaaaaccaaatggtcctttcctcagaatttatattcttaaaaatagaagcaaaaggtcagcagtgaaatggggctcagttaaaaatcaagctgaattctc

SEQ ID NO: 62259 - DNA, 201 bp, Bos taurus
aagatgtctccagggtttaatctaaggcagaatttctagaacacacagtccacccatcatcttcaactgtaaaagttaatgccacattgttctccaaaattgctacaccaagtgacattactactagtaatctcttcttgttcttctacatcctcaccacactgcctattgtctgatttccatcactagtcttcaccttcc

SEQ ID NO: 62260 - DNA, 201 bp, Bos taurus
ctctcaatactatacactacaattatatgtgtgtctctcacttcactccttctactaaattcaatagcttggaccatgtctctatctttgtactgcatgcctagcaatttttgactattcaaaaaaatatttggtgagtgagtgacaggatagaaaatgccatcccacactttagctattatgaaaacctttaggctaaaa

SEQ ID NO: 62261 - DNA, 201 bp, Bos taurus
ctaagtaaaacaccaaaaacataaaatttccctactcttaaaatgctggccatgtaactatttaaggcatagcattaaaaatctagctgtcccttcacattccaaacacaacttgtcatctggcctcttgagaattagacccttaatgactgtccccatctggtgccattcaatcttctttctggttcatcttttgttctg

SEQ ID NO: 62262 - DNA, 201 bp, Bos taurus; identical to SEQ ID NO: 21701

SEQ ID NO: 62263 - DNA, 201 bp, Bos taurus; identical to SEQ ID NO: 21702

SEQ ID NO: 62264 - DNA, 201 bp, Bos taurus; identical to SEQ ID NO: 21703

SEQ ID NO: 62265 - DNA, 201 bp, Bos taurus; identical to SEQ ID NO: 21704

SEQ ID NO: 62266 - DNA, 201 bp, Bos taurus
cacaaaagaaaatctggtgatttccatctggtataggtgtttacaatattaaataacttataaaacttgctagactaagaagaataccctctttgtgtgataaaaaggctacatctgataagatcaccatcagacttaatggtgaaatttcaatagttttcccattaaaatctgaagcaacacaagaatctgtgcaccatc

SEQ ID NO: 62267 - DNA, 201 bp, Bos taurus
caggtggtaggagagaggacagtgggagcttgtacacagtttgactcatctaatgtgaaaggaagaaaagaagctgcatttaattgaggtctagctgcttaaaggagaactaattcccttctattcccatgttctaggctatgtccctattttaaaatggtgctttccccaaactgtagaataataaattcaaatgtactc

SEQ ID NO: 62268 - DNA, 201 bp, Bos taurus
gagcagacctttccaaacaggctggaaaggacaaatggcaaagccaaacactccactttctgtaacccattcttgttttctctaatctaatgcagattttatgcctgtgtgctttttacacactgaggtctaaattatttttttcaatgagtaattccttaaaatatgtgggatgtgattgcatgtgtgcatttgtgtgta

SEQ ID NO: 62269 - DNA, 201 bp, Bos taurus
caatacactaagcagagattccccatgtcaccaaggggcatacagacatgtagggcacagggtgaagtccaagaaagcaggccttgatgaagattccttggtcacattgggcagcagtaggtagtgacagtttctacccaaacccttgttgtgtgggcccgcctgggagcacgcttcctgtcacctcagcgaagccttcct

SEQ ID NO: 62270 - DNA, 201 bp, Bos taurus
gtagacagctttggccaacacagtatcaaccaggagaccaaagcagaggaggactcacaccataccaagaccagctggaagtttctccaaggcctttgccaggaggatgggtgtcagaggttaacacccagagccccgtcacaccctctttctgaacctctgcatgttccacaaaggccagcggtgcctagcaaatacttc

SEQ ID NO: 62271 - DNA, 201 bp, Bos taurus
ctaaccgcatcatgaaacatatctcattaatacaacagttaatgcaatcttggaaaatgggttaaaggaagccagtattcacttgtaaacaaaagtctgagtttgctggggagccagagatctaattacaatgctattatgaacagcattattattatcctcattattattacagtctgataggaattagcagaagcaggc

SEQ ID NO: 62272 - DNA, 201 bp, Bos taurus
caggtgttctggggggaaagcctgaataagcaattgaaataaagtgtgatctgtaagcagatttaccattgtaaacagaaccttgtaaacagaaccttcagtatctctcataaaacacatcccatgaaagcattttccctaaggaaaaacaagaagagtgggactgaatgacatctcttgttctgaagcctctttgtccta

SEQ ID NO: 62273 - DNA, 201 bp, Bos taurus
tgactgggatgaaattctagatggttctcctgggcatcaatttagaagttttctttaaaatcttgtgagaagagatgcctcacggcaactttataagggtggttggtgtctggcgaatgtctctcaaggattttccaaaccagctcagatttcagaaaggacagactgaagggataggaaattttgtaaccactgttaact

SEQ ID NO: 62274 - DNA, 201 bp, Bos taurus
caggaaagagccaatcttcagagtaaaaaccaaacacagtgaaagaggagcaaaagaaagaggctgaaatgggtcaggaagacatgaaagaagatgtaactgcagaaaacaagagagtccagcctctgaagaaacagaagcaaaagaagccacatctgatgtgatgaacatcctctcctgaattttttccatggtctccat

SEQ ID NO: 62275 - DNA, 201 bp, Bos taurus; identical to SEQ ID NO: 21705

SEQ ID NO: 62276 - DNA, 201 bp, Bos taurus; identical to SEQ ID NO: 21706

SEQ ID NO: 62277 - DNA, 201 bp, Bos taurus
actagactattccaaagagaataatgcctcaattcaaatcaactgatagagctttataaaaactgcttttacaaaagttcaaattacactacatctaaatattttgcaatgcggctaattacaagggtagctctaggtctacgcctttcatttcagtgttcagagtgagaatgaagttccaaatatgtgttgaagcaactt

SEQ ID NO: 62278 - DNA, 201 bp, Bos taurus
gatcttttgtttaaaaagcatgtctggaaaagtcagctccagtcctatacccctgcactaactgcctgaagaggaaacaaagcccaggcctgtgtgccgtgcggctttattctactaatcagaccattacagctgaccttgaacaaggtgtgacacacaggcccccgcagtagtgccggcctactggcagctgttacaccc

SEQ ID NO: 62279 - DNA, 201 bp, Bos taurus
gctacattttaggatagtttttttatatagcaatagatgactaaaacaattcccctccccttttctaggtattgcatgaactctttggaaaattgtactctgaaggagggaaagggcaccccaataatggttgaggttgactgtccctttaggctaatttaattgatttaaaaaaagattggcatgtgattgttcctgtct

SEQ ID NO: 62280 - DNA, 201 bp, Bos taurus; identical to SEQ ID NO: 21707

SEQ ID NO: 62281 - DNA, 201 bp, Bos taurus
taagctgcatttcttgaactatattgatttcttagcttgagagtaggggacaggatctgttatttaaacatgtagttttaaaatggaaaatgtattcaagcccctataattaaacccctcacatagttttttgcaaatgacatatcaatgggtctataacattatttctgtaatttaattacaaaatgctgttatcgcaaa

SEQ ID NO: 62282 - DNA, 201 bp, Bos taurus; identical to SEQ ID NO: 21709

SEQ ID NO: 62283 - DNA, 201 bp, Bos taurus; identical to SEQ ID NO: 21712

SEQ ID NO: 62284 - DNA, 201 bp, Bos taurus
gacatagggcccaggaggtgagggctgtgtctggctgcatcagtaagtaaaatcccagagaaagattctgactgctccagcctgggtcatgctctgtcccggtgcttcaaatgattggcctggccccgggaaccctgggacagttttgggaaaggagcatttcccccaagaagggagtcctgtcagcaggagaaagggaca

SEQ ID NO: 62285 - DNA, 201 bp, Bos taurus; identical to SEQ ID NO: 21714

SEQ ID NO: 62286 - DNA, 201 bp, Bos taurus; identical to SEQ ID NO: 21716

SEQ ID NO: 62287 - DNA, 201 bp, Bos taurus; identical to SEQ ID NO: 21717

SEQ ID NO: 62288 - DNA, 201 bp, Bos taurus; identical to SEQ ID NO: 21718

SEQ ID NO: 62289 - DNA, 201 bp, Bos taurus
cggggatatgtattcaatattttgtgataaaccataatggaaaagaatatacatatatgtataaccttgctgttcagcagattgacacaatagccaagatatacttaaattttttaaaaaaggaatgattctgctgtataaaaaaaagctaactatctaaaatgtatttctttttttttattgttattaaagatatataac

SEQ ID NO: 62290 - DNA, 201 bp, Bos taurus; identical to SEQ ID NO: 21720

SEQ ID NO: 62291 - DNA, 201 bp, Bos taurus; identical to SEQ ID NO: 21723

SEQ ID NO: 62292 - DNA, 201 bp, Bos taurus; identical to SEQ ID NO: 21724

SEQ ID NO: 62293 - DNA, 201 bp, Bos taurus; identical to SEQ ID NO: 21725

SEQ ID NO: 62294 - DNA, 201 bp, Bos taurus; identical to SEQ ID NO: 21726

SEQ ID NO: 62295 - DNA, 201 bp, Bos taurus
tttctccctgagatgggtgtgtgggttcttctgttatgggggctatatgtacagtcttgtaggctttattggcccctagcccatttggctttcagaccccgcattgtccaaatgctactggttgctgtttagcaagacagcacaaggtctggtcacaaggcagctggctacagaaccctagggagcctcatggctagtgct

SEQ ID NO: 62296 - DNA, 201 bp, Bos taurus
ggctcagtgatattggcttgttagcccaaaatgtaccatgaattatttgtagctgcttttccatctcctaccactaatcaagcaaggtgtgtacactttctaggaggtcaggccttccagatgcagaggcaagaagaggaggcatggagcctgccttcactcacaactatttgacaggaggagagcacttccacgcatgat

SEQ ID NO: 62297 - DNA, 201 bp, Bos taurus; identical to SEQ ID NO: 21728

SEQ ID NO: 62298 - DNA, 201 bp, Bos taurus; identical to SEQ ID NO: 21729

SEQ ID NO: 62299 - DNA, 201 bp, Bos taurus; identical to SEQ ID NO: 21730

SEQ ID NO: 62300 - DNA, 201 bp, Bos taurus
gatgacgagagactagacactgtgtacaacatcccgccactggcctgctgaactgtgagggaattaagaccctcagcctctgtttaggccacaataccccatcagctcatgtttgaggacttcctaatcctggagacagccaccatgtctctcagcactgaagtaccagagtgctttcatttgcatctctgtcagacatgg

SEQ ID NO: 62301 - DNA, 201 bp, Bos taurus
gcctcctggaccagggaggaggcctgcatcagcctccagggaaggggatgcagtaagcagggaaggaggttggctttgtcacttactcagctgatgctcattgcgctctgcatgtgctggccctgggcacccagcacccctgccctgatgcagctggcagttctaaggtcctgtccacctcttagcctgagtcctgtccac

SEQ ID NO: 62302 - DNA, 201 bp, Bos taurus; identical to SEQ ID NO: 21733

SEQ ID NO: 62303 - DNA, 201 bp, Bos taurus; identical to SEQ ID NO: 21734

SEQ ID NO: 62304 - DNA, 201 bp, Bos taurus
tgcaccacctgggagccctgctcagtagtgtgcttgccagcatcatgccgagagcatccttggactcaggagaggtaccagccctaatgatccacagaacggaaaagaaaatgcaacttctgggtgcttctgtcttgcacttgagcaaaatttaggcacgtgagacttccactcatgcagtgaaagcaaaatcagtatgga

SEQ ID NO: 62305 - DNA, 201 bp, Bos taurus; identical to SEQ ID NO: 21736

SEQ ID NO: 62306 - DNA, 201 bp, Bos taurus
caaacaggtataatgatggcttcagtagataccactaatacatataaaacacgtgtatcaatttgtccacagtgttaccaaaccaaacttggttctattagcctgtacacagtgaagccaatctactgacatttggttgtggtgaaagaaagtgtaactatgactgtaagcaccaagaaaggaattgttgttcagatgtat

SEQ ID NO: 62307 - DNA, 201 bp, Bos taurus; identical to SEQ ID NO: 21737

SEQ ID NO: 62308 - DNA, 201 bp, Bos taurus; identical to SEQ ID NO: 21739

SEQ ID NO: 62309 - DNA, 201 bp, Bos taurus; identical to SEQ ID NO: 21746

SEQ ID NO: 62310 - DNA, 201 bp, Bos taurus; identical to SEQ ID NO: 21747

SEQ ID NO: 62311 - DNA, 201 bp, Bos taurus; identical to SEQ ID NO: 21748

SEQ ID NO: 62312 - DNA, 201 bp, Bos taurus; identical to SEQ ID NO: 21749

SEQ ID NO: 62313 - DNA, 201 bp, Bos taurus; identical to SEQ ID NO: 21750

SEQ ID NO: 62314 - DNA, 201 bp, Bos taurus
aagcatcgggcaatatctatcaagacaaaatacagcaaatcatttgcccttgcactcccttttgatcatctctactatggaacaaaagaacaagtacttacggatatgtgaataaggatatttaatgttgtttgtagtaggaaataaacaatctgggaacaatcagaatgaacattaatgggagactggtagaataaatta

SEQ ID NO: 62315 - DNA, 201 bp, Bos taurus
tcatcctttgacttgcctgatgggtgtcggattcttttaggccacaaagtggcagcaagctcaggttaccatagtgatccatgtcatcaaaacagggaccacagacctcaccaacgatgccagtctctgtcctaaagccaggctgcttctacctcctggtcctctgagcattctaatgcccctcacccctgatggattcac

SEQ ID NO: 62316 - DNA, 201 bp, Bos taurus
tcgcttcacgtgaacagcagactggccaggcatgtcggaggcgtatgaattcatctgcccctgagtggtgccacctgctgctgctccatggcatcagcatctggccacctccacagtctgacgtgcaactgaagctcaaagttcaggaaagcaagagtgatgcttactggatcttatagaaccagcaactcctgagcaaca

SEQ ID NO: 62317 - DNA, 201 bp, Bos taurus; identical to SEQ ID NO: 21752

SEQ ID NO: 62318 - DNA, 201 bp, Bos taurus; identical to SEQ ID NO: 21754

SEQ ID NO: 62319 - DNA, 201 bp, Bos taurus
cagatacacttctcttcagctttctttatctgcactaaggtcactttgaaaaatattcactcatacacttccatttcctctcatttctattttccaatcatggacattttcagagccaatgttagatttcttcagcttacctctgacctcagctacggttatagtgaacaattctgagtaccttgacagcatgccatctca

SEQ ID NO: 62320 - DNA, 201 bp, Bos taurus; identical to SEQ ID NO: 21755

SEQ ID NO: 62321 - DNA, 201 bp, Bos taurus; identical to SEQ ID NO: 21756

SEQ ID NO: 62322 - DNA, 201 bp, Bos taurus; identical to SEQ ID NO: 21757

SEQ ID NO: 62323 - DNA, 201 bp, Bos taurus
acatcaaagtgaaaacagcttttaaactaagccaagttctttgaaactttgaaatgcttagtcatgatgttactcagttttatttcaaatcaaaagtcaccagtatttacagttcggcctgtagaccatcagactaaaaggctatccagctttaaaaggctaatcagctaaaaggctgattatgaattagaattttacttt

SEQ ID NO: 62324 - DNA, 201 bp, Bos taurus
aaccacaattacctcacctttttttaatcttcaattgactttccccaggtacctgatgcctcagaggaccctaccaaccggtaaatacctccagcccctcacctttgtggtggcagacttgagatttgttgtcccgtctctctgcttgtctgccttgtgaatctaacttttctctgctgagaacctcagagttttaatgtt

SEQ ID NO: 62325 - DNA, 201 bp, Bos taurus; identical to SEQ ID NO: 21758

SEQ ID NO: 62326 - DNA, 201 bp, Bos taurus; identical to SEQ ID NO: 21760

SEQ ID NO: 62327 - DNA, 201 bp, Bos taurus; identical to SEQ ID NO: 21761

SEQ ID NO: 62328 - DNA, 201 bp, Bos taurus
gaaggatgctgaagtgaaaaggctagaaccatataaaactgaccaagcgaaaaacaaaactaaaagtgttgcctctatagcaacttgaaaaggttataatcgtattaccaagaaaaagaaatcagacacatttagggcatattggaaaaaaacaagttttctcagagtggctgagctgttttgtgatttgaagcagtggaa

SEQ ID NO: 62329 - DNA, 201 bp, Bos taurus; identical to SEQ ID NO: 21762

SEQ ID NO: 62330 - DNA, 201 bp, Bos taurus
aaatggacaagatggattagtgctataagtgctgatatgaggaaaattccatttgtgagctctcagaagacagccaactgacatgacagcactttctgctggtaacatctgttgctgaggtagacctgtttattctctgctctttctttccttctgctttgtttcggtgggcaaggacactgcaagggtgtttgccacccc

SEQ ID NO: 62331 - DNA, 201 bp, Bos taurus; identical to SEQ ID NO: 21763

SEQ ID NO: 62332 - DNA, 201 bp, Bos taurus; identical to SEQ ID NO: 21764

SEQ ID NO: 62333 - DNA, 201 bp, Bos taurus
ataattagtaagtttaataaatatggctttatgaaatataaactattcaagataaatatgtcaaataattatggtgttaaattgtttccagctcccctcccacccaatccttggtaattagaaaatagaatgagcataaaaatggcaaagtatgcattactactgaaagctagggaaactttccactcaaattttagaaaa

SEQ ID NO: 62334 - DNA, 201 bp, Bos taurus
attagataccacaattcagggatggccagcctgcctacatgctctgggagcagctgcacttccctctcaggaaagtaaataatttacttttggagcacccactgtcattcgttcaccacctgactttaaggacttactttctcacaaatccatgacccttctatttccttcccacatccaactaattcatgtcacccttct

SEQ ID NO: 62335 - DNA, 201 bp, Bos taurus
cagatgacaactatccatatgatagattaggctgcaatcagtataccaagaaagccagttcatcaaaaattagtcaaatgttgctaaagtcttaatatatcccatgacttacttgcatactgaggtcttctgaactaaggcaaatgcaattcacttccaaattgctctccattgttttcttttgtactctggaacagattg

SEQ ID NO: 62336 - DNA, 201 bp, Bos taurus
attttgaatcaacagagaatttggggtctgcaaacatggcaagctacatacaagcccctgcactgcaagggaaggagagcacttttatggaaggaagagggaattgtgagggctgcagtccacaaagagcccttggtttttcattggcccagttcttgcaaaagaaaaggagtctgtcttcttcctcttgggctctgcttt

SEQ ID NO: 62337 - DNA, 201 bp, Bos taurus; identical to SEQ ID NO: 21767

SEQ ID NO: 62338 - DNA, 201 bp, Bos taurus; identical to SEQ ID NO: 21768

SEQ ID NO: 62339 - DNA, 201 bp, Bos taurus
aagaactgacagcctgtgacctgctggagcatccaagtcaaactccctatttaaaagcaggggaagcatctatctgcctacaaactaaaattcatggagttccttcaacatggcccctcatcaccctctgagactcagaaggagagaagtccaacaagtaggaatgtagatcccaaggagatgaccaagacgcctgagacc

SEQ ID NO: 62340 - DNA, 201 bp, Bos taurus; identical to SEQ ID NO: 21769

SEQ ID NO: 62341 - DNA, 201 bp, Bos taurus
aatgcaatcattctgttgagtgaggggactggtccactgtggaaagtgaatgcaatctcctgttgcttgatttttatatccactgtgagtcagaacacttgtatacccttggtcatatcagcagtgcttctgctttttttccccctgcagtctcagttttggtgtatctggatgtcttgtcacatcatagaagaacaatct

SEQ ID NO: 62342 - DNA, 201 bp, Bos taurus; identical to SEQ ID NO: 21770

SEQ ID NO: 62343 - DNA, 201 bp, Bos taurus
ctagggatatttgggagacatttattatttattgaaataaaggatttcagaggcaaaaacttgaaatttaaatcctggttcagagtcttcattagccatgcgccttgagcatattaactgaacctctcttggtctcataggttttaaaaaaaaaggattataacacctaccttattgacttattagaatttagaagtatac

SEQ ID NO: 62344 - DNA, 201 bp, Bos taurus; identical to SEQ ID NO: 21774

SEQ ID NO: 62345 - DNA, 201 bp, Bos taurus
tacccacagtttggcaaggcctggggaaactaggttatgcttagaaatatgttcatgtccgtaaaaataaaatgaagatggcctgtcaaagtaagtgctggtgcacatcataaacatacaattagaaattacgggtatcatgttattcttttctgtgtaccatctcttgttttggccacagcacgcagcatgtggatctta

SEQ ID NO: 62346 - DNA, 201 bp, Bos taurus; identical to SEQ ID NO: 21775

SEQ ID NO: 62347 - DNA, 201 bp, Bos taurus
gtcagtctctcccatcaggaagcttccataggcctcttatccttacccatcagagggcagacagaatgaaaaccacaataacagaaaactgaccaaactccacctgaggacttactcaaaagagactctgaaatcacttcccctttattgctggatttctttttagaaaaaaatcagttcagttcagcccagttactcagt

SEQ ID NO: 62348 - DNA, 201 bp, Bos taurus; identical to SEQ ID NO: 21777

SEQ ID NO: 62349 - DNA, 201 bp, Bos taurus
agcttcaaagaaaaggtgattcttgaaccaaaccttaaaagagaagctggcacttgccaggcagatgacagctgggactaattcccaagagaggatactgagagcaaatgctttagtgttccaggggaattgaaaatgatctgactatgagaggaaaggggacagtattagagaaaggtaaagggacaggtaagaatcatc

SEQ ID NO: 62350 - DNA, 201 bp, Bos taurus
aagcccatgccagttctcaagggcatctgtaggccttaaaagaaagcaaagaaggcattgttccctgacacctccctgcaagatgcataatgaggacttgctgtgggccaggcactatgctttatgcacatcaaatcacttaagcctcacaacaagctagaaaagctgctattattgtccccactctagagaaaagaactg

SEQ ID NO: 62351 - DNA, 201 bp, Bos taurus
accagttaattccccctgcagaagtctggagaagacaagagctagggagaggaacaggggtgacaggggttgaagaggtactggcaagggtgagaatgaccatctccctaacgcttttagctcaggctgtagaagagtcactcatggccaaggatcttgatttcaaagaaagcatgggaggaaaaataagtttttgttaaa

SEQ ID NO: 62352 - DNA, 201 bp, Bos taurus
tacccctactgctgagtgagacatcatgaagtgtccatgacaaatctgtggtcggcatcttcaatgcaacctgtgtcattcgatggggaatccacttcattagctatttgaatattggtttcacaatctgaagaatagacctgtggttgccaagtttaaatcttaggcatcatctggttatgaaatcagtttggaaacatt

SEQ ID NO: 62353 - DNA, 201 bp, Bos taurus; identical to SEQ ID NO: 21778

SEQ ID NO: 62354 - DNA, 201 bp, Bos taurus; identical to SEQ ID NO: 21779

SEQ ID NO: 62355 - DNA, 201 bp, Bos taurus
gggagcagggcctgagctccctgggcaggtgggagcctccccaaagcaggtgttcagaacacaagccctcagatgcaaggggagtctgtggccacatcaatgggacctctaagctgccaggaagcaaaggtgattggtggggaagggctccaaggatgaggaccccactccttacccaggcattaggtagcgtacagctca

SEQ ID NO: 62356 - DNA, 201 bp, Bos taurus; identical to SEQ ID NO: 21780

SEQ ID NO: 62357 - DNA, 201 bp, Bos taurus
ctctcatgatgttagagaccagaagtccaaaatcaaggtgttgtcaatgctctgctctctctctctgatgtctttgggggtagatccttcctggcctctcgcggcttctggtaccccaggtctttcttggtttgtagctgcatcactctagcctctgtctccatcttcatgtggccttcttctctgtgtatatgtctctct

SEQ ID NO: 62358 - DNA, 201 bp, Bos taurus
agtagcatcgtgtggcccagggacacagaggctgctcggatgcctggagagcaaagtgttctatgcttcgtgatttctggactaactctggatctggtcatggccatagactagatacagatggactccccatctttcgaaagaggaaacaatcctcaggacttgcctgaagtgtttggttctgttttgaaggaaaatgtg

SEQ ID NO: 62359 - DNA, 201 bp, Bos taurus; identical to SEQ ID NO: 21782

SEQ ID NO: 62360 - DNA, 201 bp, Bos taurus; identical to SEQ ID NO: 21783

SEQ ID NO: 62361 - DNA, 201 bp, Bos taurus
tggggcaactattgatcaggagaaaaataagaagggtaatttactctatgagagaaagaaaatgtatcaagtttagaagtagacagagagttgaactgataaagtgttttatatatcagaaggtgaaatgaggagaaaacgcaatgacttatattgcttctttgggagtaggatgatggttaccatgacttgggtagattt

SEQ ID NO: 62362 - DNA, 201 bp, Bos taurus; identical to SEQ ID NO: 21784

SEQ ID NO: 62363 - DNA, 201 bp, Bos taurus; identical to SEQ ID NO: 21785

SEQ ID NO: 62364 - DNA, 201 bp, Bos taurus; identical to SEQ ID NO: 21786

SEQ ID NO: 62365 - DNA, 201 bp, Bos taurus; identical to SEQ ID NO: 21787

SEQ ID NO: 62366 - DNA, 201 bp, Bos taurus
ccagggaagtccctaaccttcacttctaatatccttaacctcctcaattttgattccattcccagcaggttcttcttggggtggggacctctctgagaagatcatcatagagggtgagtctcaaaagttcatagaagcaagaatgctccagttcttctagtccccatcatcaaccccttgtactcagccaattaaaacagg

SEQ ID NO: 62367 - DNA, 201 bp, Bos taurus
tacctttcgtgctcaaattttctgtaatgattacctgcctcaaatatcactagtttatgtccaaaaactacaaataataagcttgcacctatcgaagtccatattctctgcctgcctgacttgggattatcatcctgagaacctttttcttaaaccttttatacagtttttcttcagtgaattgttagtaattttactagg

SEQ ID NO: 62368 - DNA, 201 bp, Bos taurus; identical to SEQ ID NO: 21789

SEQ ID NO: 62369 - DNA, 201 bp, Bos taurus; identical to SEQ ID NO: 21790

SEQ ID NO: 62370 - DNA, 201 bp, Bos taurus
tctggctgtaagacttctcctagctgtgacaccaaggtgcatgccacatatcatctccactgcagcacccagaggtggggccttggagatgccagggtccatgtgagcactgtaggaaggagcaggggcaggtcttggagtcaggcagccctggcctgagtcgacagcgaagctaactccagttctgtctggttccacaga

SEQ ID NO: 62371 - DNA, 201 bp, Bos taurus
ttgaccttggaccctctcggatctgtttcctcgttagtaaaatacggagatcataacagtactaacctccagaatgaatgcgtgctggccaaaaccgctacggtaagcaagggttctgtaccatatattgggggagggtctccttttatggacgcgccggagtggcctgaagtgttagtcctgtctgactctttgcgaccc

SEQ ID NO: 62372 - DNA, 201 bp, Bos taurus
tgggggtggtggcgggggggttaagtaaaccaagtgatttcatgagtcagtgcccgaggcaggcagtgaggtgtgccgtgggagccctgagtatgttgacgtggtcctttaaattagagagaacatcagctgttccaaactgcttcatccttttgaaaactgtaatgcctctccaaaaggtgggccttaaagagacggagt

SEQ ID NO: 62373 - DNA, 201 bp, Bos taurus; identical to SEQ ID NO: 21791

SEQ ID NO: 62374 - DNA, 201 bp, Bos taurus; identical to SEQ ID NO: 21793

SEQ ID NO: 62375 - DNA, 201 bp, Bos taurus; identical to SEQ ID NO: 21794

SEQ ID NO: 62376 - DNA, 201 bp, Bos taurus; identical to SEQ ID NO: 21795

SEQ ID NO: 62377 - DNA, 201 bp, Bos taurus; identical to SEQ ID NO: 21797

SEQ ID NO: 62378 - DNA, 201 bp, Bos taurus; identical to SEQ ID NO: 21798

SEQ ID NO: 62379 - DNA, 201 bp, Bos taurus; identical to SEQ ID NO: 21799

SEQ ID NO: 62380 - DNA, 201 bp, Bos taurus; identical to SEQ ID NO: 21801

SEQ ID NO: 62381 - DNA, 201 bp, Bos taurus; identical to SEQ ID NO: 21802

SEQ ID NO: 62382 - DNA, 201 bp, Bos taurus
tggaacaggaagcaggaaatgtactcaggaagtaaatcataaaagacatgagtcccaggctaagtaaattagactttccccataaattatgagagagccatgagagacaggtggctagaacatcaccatacaccatccccaaactattgttgaccactcagatttctccttcatttagatttgctgactacatagagctat

SEQ ID NO: 62383 - DNA, 201 bp, Bos taurus; identical to SEQ ID NO: 21803

SEQ ID NO: 62384 - DNA, 201 bp, Bos taurus; identical to SEQ ID NO: 21804

SEQ ID NO: 62385 - DNA, 201 bp, Bos taurus; identical to SEQ ID NO: 21807

SEQ ID NO: 62386 - DNA, 201 bp, Bos taurus; identical to SEQ ID NO: 21810

SEQ ID NO: 62387 - DNA, 201 bp, Bos taurus; identical to SEQ ID NO: 21812

SEQ ID NO: 62388 - DNA, 201 bp, Bos taurus; identical to SEQ ID NO: 21814

SEQ ID NO: 62389 - DNA, 201 bp, Bos taurus; identical to SEQ ID NO: 21815

SEQ ID NO: 62390 - DNA, 201 bp, Bos taurus
gtttttattttattcagttgtatgaattctttagatattttgaatagaagggccttatcagatatatcatttgcaaatatcttctccattcagtaagctggttgttttgttttgttgatggtttccttcaccatgcaaaagcttttcagttgtagtacaagacttttttgatacatttttatttcattgctgcaggatggg

SEQ ID NO: 62391 - DNA, 201 bp, Bos taurus; identical to SEQ ID NO: 21816

SEQ ID NO: 62392 - DNA, 201 bp, Bos taurus; identical to SEQ ID NO: 21817

SEQ ID NO: 62393 - DNA, 201 bp, Bos taurus; identical to SEQ ID NO: 21818

SEQ ID NO: 62394 - DNA, 201 bp, Bos taurus; identical to SEQ ID NO: 21820

SEQ ID NO: 62395 - DNA, 201 bp, Bos taurus; identical to SEQ ID NO: 21821

SEQ ID NO: 62396 - DNA, 201 bp, Bos taurus; identical to SEQ ID NO: 21822

SEQ ID NO: 62397 - DNA, 201 bp, Bos taurus; identical to SEQ ID NO: 21825

SEQ ID NO: 62398 - DNA, 201 bp, Bos taurus; identical to SEQ ID NO: 21826

SEQ ID NO: 62399 - DNA, 201 bp, Bos taurus; identical to SEQ ID NO: 21827

SEQ ID NO: 62400 - DNA, 201 bp, Bos taurus; identical to SEQ ID NO: 21828

SEQ ID NO: 62401 - DNA, 201 bp, Bos taurus; identical to SEQ ID NO: 21834

SEQ ID NO: 62402 - DNA, 201 bp, Bos taurus; identical to SEQ ID NO: 21836

SEQ ID NO: 62403 - DNA, 201 bp, Bos taurus; identical to SEQ ID NO: 21837

SEQ ID NO: 62404 - DNA, 201 bp, Bos taurus; identical to SEQ ID NO: 21840

SEQ ID NO: 62405 - DNA, 201 bp, Bos taurus; identical to SEQ ID NO: 21842

SEQ ID NO: 62406 - DNA, 201 bp, Bos taurus; identical to SEQ ID NO: 21843

SEQ ID NO: 62407 - DNA, 201 bp, Bos taurus; identical to SEQ ID NO: 21844

SEQ ID NO: 62408 - DNA, 201 bp, Bos taurus; identical to SEQ ID NO: 21846

SEQ ID NO: 62409 - DNA, 201 bp, Bos taurus; identical to SEQ ID NO: 21847

SEQ ID NO: 62410 - DNA, 201 bp, Bos taurus
cttacctttaaagtaccattttcaacaaataattgaataaaataatccatctactgaatctgagtcttgcttgaggtagagtaggagtccatatgcattgcgggcctgaaattccagggagatgttattttgtggatttaaaaacacattctggaattctagataggaatctccataataacaaacacaactgatatctgt

SEQ ID NO: 62411 - DNA, 201 bp, Bos taurus
aagtataaatagaaacaactcaaacatccttacatatcatattttctctacttatactcttatagaaacaattagatacaattttactctaacgtatttaaggatctaagacccattggaaattcattttaaattataaaataggcagatagacatttttataaaagtagcataaaatcgatgaaagagtgcataattaaa

SEQ ID NO: 62412 - DNA, 201 bp, Bos taurus; identical to SEQ ID NO: 21849

SEQ ID NO: 62413 - DNA, 201 bp, Bos taurus; identical to SEQ ID NO: 21850

SEQ ID NO: 62414 - DNA, 201 bp, Bos taurus
aggtgtcttaggttagggcttttctcatggtagctatcccacagtctggtttcctagcccaagttaatttgctcagattatcctcggggcattcaggctcggtccttactctaggtaatgcagcccgtgcctccctgcccagcccccgcttgctagtggtggatgcaggagtctgtgctgcttctgtgctaggggagttac

SEQ ID NO: 62415 - DNA, 201 bp, Bos taurus; identical to SEQ ID NO: 21851

SEQ ID NO: 62416 - DNA, 201 bp, Bos taurus
gatccccatgtgaagggaacatggtgttagctgcaccaattgaaacactggcagaaaaagaaaactgctctcagcatcaattccaggcaaggctggcactcttccagacccgtgtccacatctgatcaattacaattcccaaagacataaggtttgctatgtgtctcagcttggattctttcaaaataagaattgaagtaa

SEQ ID NO: 62417 - DNA, 201 bp, Bos taurus
acttaaataattatgatgaatttgtcatcttagtattttcagcctgctatgtaattagtaatttcatggagataagcttggtttcagttttatgatgaatgtcaggtatttattatattaaaagagtgttcattatttcttcacatatgcttaacagtaaggcatcctacttcctataaagtgattcagaggttctctttt

SEQ ID NO: 62418 - DNA, 201 bp, Bos taurus
ttgttgagtatggcagaatagaaggatgtgcgctcatcttctcctgtgagaacagaaaatttgcaaccagctgctgaagaatcatctataggaggatgtcacaaaccaccaaaaattgatactccatgtccaaggacaaagaagaagccccaataagccagtaggaaaggtgccagagactcttggaggacacacaaataa

SEQ ID NO: 62419 - DNA, 201 bp, Bos taurus; identical to SEQ ID NO: 21852

SEQ ID NO: 62420 - DNA, 201 bp, Bos taurus
ttaactatatgcacataacacaggctctacaaggcaggtgtcccaaatgagatgtgattgaaaagacaataacttgagaagccaactgaatgagggtacgtgatctccagaaaagtaccaagcagacatgtgtgtttgtgtcacttgtcacaagcactgacagaacttaaggcatatgggcctgattattttctacaggtt

SEQ ID NO: 62421 - DNA, 201 bp, Bos taurus
tttgggaaaataatgtgcatatgaaaataaacaactttaaataatgatgaccatcatttcatagaatatcttgtatgtctctataatttttttgtcatctatacattaaataaagtcagtcagaaaagagatcttatggggaaaaagcctaaagcttaatatttgactcatattttatcattttttgcccttgttatctaa

SEQ ID NO: 62422 - DNA, 201 bp, Bos taurus; identical to SEQ ID NO: 21855

SEQ ID NO: 62423 - DNA, 201 bp, Bos taurus; identical to SEQ ID NO: 21858

SEQ ID NO: 62424 - DNA, 201 bp, Bos taurus; identical to SEQ ID NO: 21860

SEQ ID NO: 62425 - DNA, 201 bp, Bos taurus; identical to SEQ ID NO: 21861

SEQ ID NO: 62426 - DNA, 201 bp, Bos taurus; identical to SEQ ID NO: 21862

SEQ ID NO: 62427 - DNA, 201 bp, Bos taurus; identical to SEQ ID NO: 21864

SEQ ID NO: 62428 - DNA, 201 bp, Bos taurus
atccttctagagcactctatttcctgctaccctagccaccaactcccctgagtacatggtgatgtctggtcccctgagactcaagtagctgcaccacctttactcctggccctcacaggggcaagcccaaaccttccagggcagcctcaggagcgaacccctgtggacaacccacatgcaaaggtggaaataaaaccacga

SEQ ID NO: 62429 - DNA, 201 bp, Bos taurus; identical to SEQ ID NO: 21865

SEQ ID NO: 62430 - DNA, 201 bp, Bos taurus; identical to SEQ ID NO: 21866

SEQ ID NO: 62431 - DNA, 201 bp, Bos taurus; identical to SEQ ID NO: 21867

SEQ ID NO: 62432 - DNA, 201 bp, Bos taurus; identical to SEQ ID NO: 21868

SEQ ID NO: 62433 - DNA, 201 bp, Bos taurus; identical to SEQ ID NO: 21869

SEQ ID NO: 62434 - DNA, 201 bp, Bos taurus; identical to SEQ ID NO: 21871

SEQ ID NO: 62435 - DNA, 201 bp, Bos taurus; identical to SEQ ID NO: 21872

SEQ ID NO: 62436 - DNA, 201 bp, Bos taurus
gtaaaaaatgtgtctcagaatcagcagtgcttgctcagaatagaactttctaagcagcactacaaatccactaaattgacattttgggggcttggggccacgactataaactttaataaacaacagagatgatgcagctgagccatagaccacttagagaaatcctgcttcctgttgatgctaggaaagaacgtcctggaa

SEQ ID NO: 62437 - DNA, 201 bp, Bos taurus; identical to SEQ ID NO: 21874

SEQ ID NO: 62438 - DNA, 201 bp, Bos taurus; identical to SEQ ID NO: 21876

SEQ ID NO: 62439 - DNA, 201 bp, Bos taurus; identical to SEQ ID NO: 21877

SEQ ID NO: 62440 - DNA, 201 bp, Bos taurus; identical to SEQ ID NO: 21882

SEQ ID NO: 62441 - DNA, 201 bp, Bos taurus; identical to SEQ ID NO: 21883

SEQ ID NO: 62442 - DNA, 201 bp, Bos taurus; identical to SEQ ID NO: 21884

SEQ ID NO: 62443 - DNA, 201 bp, Bos taurus; identical to SEQ ID NO: 21885

SEQ ID NO: 62444 - DNA, 201 bp, Bos taurus; identical to SEQ ID NO: 21887

SEQ ID NO: 62445 - DNA, 201 bp, Bos taurus; identical to SEQ ID NO: 21888

SEQ ID NO: 62446 - DNA, 201 bp, Bos taurus; identical to SEQ ID NO: 21890

SEQ ID NO: 62447 - DNA, 201 bp, Bos taurus; identical to SEQ ID NO: 21891

SEQ ID NO: 62448 - DNA, 201 bp, Bos taurus; identical to SEQ ID NO: 21892

SEQ ID NO: 62449 - DNA, 201 bp, Bos taurus; identical to SEQ ID NO: 21893

SEQ ID NO: 62450 - DNA, 201 bp, Bos taurus; identical to SEQ ID NO: 21895

SEQ ID NO: 62451 - DNA, 201 bp, Bos taurus; identical to SEQ ID NO: 21896

SEQ ID NO: 62452 - DNA, 201 bp, Bos taurus; identical to SEQ ID NO: 21897

SEQ ID NO: 62453 - DNA, 201 bp, Bos taurus; identical to SEQ ID NO: 21900

SEQ ID NO: 62454 - DNA, 201 bp, Bos taurus; identical to SEQ ID NO: 21901

SEQ ID NO: 62455 - DNA, 201 bp, Bos taurus; identical to SEQ ID NO: 21902

SEQ ID NO: 62456 - DNA, 201 bp, Bos taurus; identical to SEQ ID NO: 21903

SEQ ID NO: 62457 - DNA, 201 bp, Bos taurus; identical to SEQ ID NO: 21904

SEQ ID NO: 62458 - DNA, 201 bp, Bos taurus; identical to SEQ ID NO: 21905

SEQ ID NO: 62459 - DNA, 201 bp, Bos taurus; identical to SEQ ID NO: 21906

SEQ ID NO: 62460 - DNA, 201 bp, Bos taurus; identical to SEQ ID NO: 21907

SEQ ID NO: 62461 - DNA, 201 bp, Bos taurus; identical to SEQ ID NO: 21911

SEQ ID NO: 62462 - DNA, 201 bp, Bos taurus; identical to SEQ ID NO: 21912

SEQ ID NO: 62463 - DNA, 201 bp, Bos taurus; identical to SEQ ID NO: 21915

SEQ ID NO: 62464 - DNA, 201 bp, Bos taurus; identical to SEQ ID NO: 21916

SEQ ID NO: 62465 - DNA, 201 bp, Bos taurus; identical to SEQ ID NO: 21918

SEQ ID NO: 62466 - DNA, 201 bp, Bos taurus; identical to SEQ ID NO: 21919

SEQ ID NO: 62467 - DNA, 201 bp, Bos taurus; identical to SEQ ID NO: 21921

SEQ ID NO: 62468 - DNA, 201 bp, Bos taurus; identical to SEQ ID NO: 21928

SEQ ID NO: 62469 - DNA, 201 bp, Bos taurus; identical to SEQ ID NO: 21929

SEQ ID NO: 62470 - DNA, 201 bp, Bos taurus; identical to SEQ ID NO: 21930

SEQ ID NO: 62471 - DNA, 201 bp, Bos taurus; identical to SEQ ID NO: 21931

SEQ ID NO: 62472 - DNA, 201 bp, Bos taurus; identical to SEQ ID NO: 21932

SEQ ID NO: 62473 - DNA, 201 bp, Bos taurus; identical to SEQ ID NO: 21934

SEQ ID NO: 62474 - DNA, 201 bp, Bos taurus; identical to SEQ ID NO: 21936

SEQ ID NO: 62475 - DNA, 201 bp, Bos taurus; identical to SEQ ID NO: 21939

SEQ ID NO: 62476 - DNA, 201 bp, Bos taurus; identical to SEQ ID NO: 21940

SEQ ID NO: 62477 - DNA, 201 bp, Bos taurus; identical to SEQ ID NO: 21941

SEQ ID NO: 62478 - DNA, 201 bp, Bos taurus; identical to SEQ ID NO: 21942

SEQ ID NO: 62479 - DNA, 201 bp, Bos taurus
atggggttctcgtggcaggaatactgaagtggtttgccatttcttcctccagtgtaccacattttgtgaactgttcactgtgacccctctgtcttaggtggccctacaagacatgtctggtagcttcactgagttatgcaagctcctttgatgcaattcttattggagatttgcatctcaaatttgcatattaaggtgatt

SEQ ID NO: 62480 - DNA, 201 bp, Bos taurus
agatcctaaattagaaggaatttattttagtgttgaattcctgggaacaactctgaagatctgtataaatcccatgacatcagcccatcctctttcttccataataattagaagaggttggtaaatacataagcaacagcagtggccctttgcccactgcagtcagccaacatgattgttacaggcaagaaccaaaatctg

SEQ ID NO: 62481 - DNA, 201 bp, Bos taurus
gtgaggtcaaacacggcctacaaaaatagcagatcaaacttggttattgacaactttcttttttctggtgcagtcacttccatattaaacttttccaggtacacattttcttaataagtattttatgacaaagacaaccattgtgtaggttatttttactccagagaggatcactgccaatgtcctgtggaggtatttttt

SEQ ID NO: 62482 - DNA, 201 bp, Bos taurus
gtggagtgaatgaagtagcttgaagaactcacaggacaacgtgtgtggaacagatagttttgggggtatggagatgggtggtcttggcaggaactggatcgtgaatgtcctcagatacaagatcaatgagtctggacctggagacgtttctgacagcattgtttggtataacaggtccatgtgctcttaatatggccttaa

SEQ ID NO: 62483 - DNA, 201 bp, Bos taurus; identical to SEQ ID NO: 21943

SEQ ID NO: 62484 - DNA, 201 bp, Bos taurus; identical to SEQ ID NO: 21944

SEQ ID NO: 62485 - DNA, 201 bp, Bos taurus; identical to SEQ ID NO: 21945

SEQ ID NO: 62486 - DNA, 201 bp, Bos taurus
cgtcccaccttgagatcttagaaaagcatctcatcccagcttcccaggcagctcctcagcctctggcaaggttaaattccatggcctcgcaccctcaaagtgtacccaaccttagcaaaaccccacaagccatgcctccaaggctctattatttcagcatctggacaagcacaccttgtaactgcattaacgaggaggccc

SEQ ID NO: 62487 - DNA, 201 bp, Bos taurus; identical to SEQ ID NO: 21946

SEQ ID NO: 62488 - DNA, 201 bp, Bos taurus; identical to SEQ ID NO: 21949

SEQ ID NO: 62489 - DNA, 201 bp, Bos taurus; identical to SEQ ID NO: 21950

SEQ ID NO: 62490 - DNA, 201 bp, Bos taurus; identical to SEQ ID NO: 21951

SEQ ID NO: 62491 - DNA, 201 bp, Bos taurus; identical to SEQ ID NO: 21953

SEQ ID NO: 62492 - DNA, 201 bp, Bos taurus; identical to SEQ ID NO: 21955

SEQ ID NO: 62493 - DNA, 201 bp, Bos taurus; identical to SEQ ID NO: 21957

SEQ ID NO: 62494 - DNA, 201 bp, Bos taurus; identical to SEQ ID NO: 21959

SEQ ID NO: 62495 - DNA, 201 bp, Bos taurus; identical to SEQ ID NO: 21960

SEQ ID NO: 62496 - DNA, 201 bp, Bos taurus; identical to SEQ ID NO: 21961

SEQ ID NO: 62497 - DNA, 201 bp, Bos taurus; identical to SEQ ID NO: 21964

SEQ ID NO: 62498 - DNA, 201 bp, Bos taurus; identical to SEQ ID NO: 21965

SEQ ID NO: 62499 - DNA, 201 bp, Bos taurus; identical to SEQ ID NO: 21968

SEQ ID NO: 62500 - DNA, 201 bp, Bos taurus; identical to SEQ ID NO: 21969

SEQ ID NO: 62501 - DNA, 201 bp, Bos taurus; identical to SEQ ID NO: 21970

SEQ ID NO: 62502 - DNA, 201 bp, Bos taurus; identical to SEQ ID NO: 21975

SEQ ID NO: 62503 - DNA, 201 bp, Bos taurus; identical to SEQ ID NO: 21980

SEQ ID NO: 62504 - DNA, 201 bp, Bos taurus; identical to SEQ ID NO: 21981

SEQ ID NO: 62505 - DNA, 201 bp, Bos taurus; identical to SEQ ID NO: 21982

SEQ ID NO: 62506 - DNA, 201 bp, Bos taurus; identical to SEQ ID NO: 21983

SEQ ID NO: 62507 - DNA, 201 bp, Bos taurus; identical to SEQ ID NO: 21986

SEQ ID NO: 62508 - DNA, 201 bp, Bos taurus; identical to SEQ ID NO: 21987

SEQ ID NO: 62509 - DNA, 201 bp, Bos taurus; identical to SEQ ID NO: 21988

SEQ ID NO: 62510 - DNA, 201 bp, Bos taurus; identical to SEQ ID NO: 21989

SEQ ID NO: 62511 - DNA, 201 bp, Bos taurus; identical to SEQ ID NO: 21993

SEQ ID NO: 62512 - DNA, 201 bp, Bos taurus; identical to SEQ ID NO: 21994

SEQ ID NO: 62513 - DNA, 201 bp, Bos taurus; identical to SEQ ID NO: 21995

SEQ ID NO: 62514 - DNA, 201 bp, Bos taurus; identical to SEQ ID NO: 21997

SEQ ID NO: 62515 - DNA, 201 bp, Bos taurus; identical to SEQ ID NO: 21998

SEQ ID NO: 62516 - DNA, 201 bp, Bos taurus; identical to SEQ ID NO: 21999

SEQ ID NO: 62517 - DNA, 201 bp, Bos taurus; identical to SEQ ID NO: 22000

SEQ ID NO: 62518 - DNA, 201 bp, Bos taurus; identical to SEQ ID NO: 22004

SEQ ID NO: 62519 - DNA, 201 bp, Bos taurus; identical to SEQ ID NO: 22005

SEQ ID NO: 62520 - DNA, 201 bp, Bos taurus; identical to SEQ ID NO: 22006

SEQ ID NO: 62521 - DNA, 201 bp, Bos taurus; identical to SEQ ID NO: 22008

SEQ ID NO: 62522 - DNA, 201 bp, Bos taurus; identical to SEQ ID NO: 22009

SEQ ID NO: 62523 - DNA, 201 bp, Bos taurus; identical to SEQ ID NO: 22013

SEQ ID NO: 62524 - DNA, 201 bp, Bos taurus; identical to SEQ ID NO: 22014

SEQ ID NO: 62525 - DNA, 201 bp, Bos taurus; identical to SEQ ID NO: 22015

SEQ ID NO: 62526 - DNA, 201 bp, Bos taurus; identical to SEQ ID NO: 22016

SEQ ID NO: 62527 - DNA, 201 bp, Bos taurus; identical to SEQ ID NO: 22017

SEQ ID NO: 62528 - DNA, 201 bp, Bos taurus; identical to SEQ ID NO: 22018

SEQ ID NO: 62529 - DNA, 201 bp, Bos taurus; identical to SEQ ID NO: 22019

SEQ ID NO: 62530 - DNA, 201 bp, Bos taurus; identical to SEQ ID NO: 22025

SEQ ID NO: 62531 - DNA, 201 bp, Bos taurus; identical to SEQ ID NO: 22029

SEQ ID NO: 62532 - DNA, 201 bp, Bos taurus; identical to SEQ ID NO: 22032

SEQ ID NO: 62533 - DNA, 201 bp, Bos taurus; identical to SEQ ID NO: 22033

SEQ ID NO: 62534 - DNA, 201 bp, Bos taurus; identical to SEQ ID NO: 22034

SEQ ID NO: 62535 - DNA, 201 bp, Bos taurus; identical to SEQ ID NO: 22035

SEQ ID NO: 62536 - DNA, 201 bp, Bos taurus; identical to SEQ ID NO: 22036

SEQ ID NO: 62537 - DNA, 201 bp, Bos taurus; identical to SEQ ID NO: 22037

SEQ ID NO: 62538 - DNA, 201 bp, Bos taurus; identical to SEQ ID NO: 22038

SEQ ID NO: 62539 - DNA, 201 bp, Bos taurus; identical to SEQ ID NO: 22039

SEQ ID NO: 62540 - DNA, 201 bp, Bos taurus; identical to SEQ ID NO: 22040

SEQ ID NO: 62541 - DNA, 201 bp, Bos taurus; identical to SEQ ID NO: 22041

SEQ ID NO: 62542 - DNA, 201 bp, Bos taurus; identical to SEQ ID NO: 22042

SEQ ID NO: 62543 - DNA, 201 bp, Bos taurus; identical to SEQ ID NO: 22043

SEQ ID NO: 62544 - DNA, 201 bp, Bos taurus; identical to SEQ ID NO: 22048

SEQ ID NO: 62545 - DNA, 201 bp, Bos taurus; identical to SEQ ID NO: 22050

SEQ ID NO: 62546 - DNA, 201 bp, Bos taurus; identical to SEQ ID NO: 22052

SEQ ID NO: 62547 - DNA, 201 bp, Bos taurus; identical to SEQ ID NO: 22054

SEQ ID NO: 62548 - DNA, 201 bp, Bos taurus; identical to SEQ ID NO: 22055

SEQ ID NO: 62549 - DNA, 201 bp, Bos taurus; identical to SEQ ID NO: 22056

SEQ ID NO: 62550 - DNA, 201 bp, Bos taurus; identical to SEQ ID NO: 22057

SEQ ID NO: 62551 - DNA, 201 bp, Bos taurus; identical to SEQ ID NO: 22058

SEQ ID NO: 62552 - DNA, 201 bp, Bos taurus; identical to SEQ ID NO: 22059

SEQ ID NO: 62553 - DNA, 201 bp, Bos taurus; identical to SEQ ID NO: 22060

SEQ ID NO: 62554 - DNA, 201 bp, Bos taurus; identical to SEQ ID NO: 22061

SEQ ID NO: 62555 - DNA, 201 bp, Bos taurus; identical to SEQ ID NO: 22062

SEQ ID NO: 62556 - DNA, 201 bp, Bos taurus; identical to SEQ ID NO: 22063

SEQ ID NO: 62557 - DNA, 201 bp, Bos taurus; identical to SEQ ID NO: 22064

SEQ ID NO: 62558 - DNA, 201 bp, Bos taurus; identical to SEQ ID NO: 22065

SEQ ID NO: 62559 - DNA, 201 bp, Bos taurus; identical to SEQ ID NO: 22066

SEQ ID NO: 62560 - DNA, 201 bp, Bos taurus; identical to SEQ ID NO: 22067

SEQ ID NO: 62561 - DNA, 201 bp, Bos taurus; identical to SEQ ID NO: 22068

SEQ ID NO: 62562 - DNA, 201 bp, Bos taurus; identical to SEQ ID NO: 22069

SEQ ID NO: 62563 - DNA, 201 bp, Bos taurus; identical to SEQ ID NO: 22070

SEQ ID NO: 62564 - DNA, 201 bp, Bos taurus; identical to SEQ ID NO: 22071

SEQ ID NO: 62565 - DNA, 201 bp, Bos taurus; identical to SEQ ID NO: 22072

SEQ ID NO: 62566 - DNA, 201 bp, Bos taurus; identical to SEQ ID NO: 22073

SEQ ID NO: 62567 - DNA, 201 bp, Bos taurus; identical to SEQ ID NO: 22075

SEQ ID NO: 62568 - DNA, 201 bp, Bos taurus; identical to SEQ ID NO: 22076

SEQ ID NO: 62569 - DNA, 201 bp, Bos taurus; identical to SEQ ID NO: 22078

SEQ ID NO: 62570 - DNA, 201 bp, Bos taurus
tgaaaatagaaaactctctacagtaaaaatggaaaacataggttacttttacatttgcaaaaattgcctacatattaggccataaaaataaccatccaattcaaacttcaaaaaatgtatacagatctgattaaaacataaataatttgtataaggccctcagtgaactgccgcccgtctctcccctgcgcgtccatcccc

SEQ ID NO: 62571 - DNA, 201 bp, Bos taurus; identical to SEQ ID NO: 22079

SEQ ID NO: 62572 - DNA, 201 bp, Bos taurus; identical to SEQ ID NO: 22080

SEQ ID NO: 62573 - DNA, 201 bp, Bos taurus; identical to SEQ ID NO: 22082

SEQ ID NO: 62574 - DNA, 201 bp, Bos taurus; identical to SEQ ID NO: 22083

SEQ ID NO: 62575 - DNA, 201 bp, Bos taurus; identical to SEQ ID NO: 22084

SEQ ID NO: 62576 - DNA, 201 bp, Bos taurus; identical to SEQ ID NO: 22085

SEQ ID NO: 62577 - DNA, 201 bp, Bos taurus; identical to SEQ ID NO: 22086

SEQ ID NO: 62578 - DNA, 201 bp, Bos taurus; identical to SEQ ID NO: 22087

SEQ ID NO: 62579 - DNA, 201 bp, Bos taurus; identical to SEQ ID NO: 22090

SEQ ID NO: 62580 - DNA, 201 bp, Bos taurus; identical to SEQ ID NO: 22091

SEQ ID NO: 62581 - DNA, 201 bp, Bos taurus; identical to SEQ ID NO: 22093

SEQ ID NO: 62582 - DNA, 201 bp, Bos taurus; identical to SEQ ID NO: 22094

SEQ ID NO: 62583 - DNA, 201 bp, Bos taurus; identical to SEQ ID NO: 22095

SEQ ID NO: 62584 - DNA, 201 bp, Bos taurus; identical to SEQ ID NO: 22096

SEQ ID NO: 62585 - DNA, 201 bp, Bos taurus; identical to SEQ ID NO: 22097

SEQ ID NO: 62586 - DNA, 201 bp, Bos taurus; identical to SEQ ID NO: 22098

SEQ ID NO: 62587 - DNA, 201 bp, Bos taurus
ctcccagcaacttcctcgagatagatgtgagcaacccgcagacagtgggggtcggccggggccgcttcaccacctacgagatcagggtcaaggtgaggccgtcttttcccactacggagagactcctgtggtcctggctgtccgccgcggaccctggagcgcagaccttcaaacggccacggccgcccaggcggggccccc

SEQ ID NO: 62588 - DNA, 201 bp, Bos taurus; identical to SEQ ID NO: 22099

SEQ ID NO: 62589 - DNA, 201 bp, Bos taurus; identical to SEQ ID NO: 22100

SEQ ID NO: 62590 - DNA, 201 bp, Bos taurus; identical to SEQ ID NO: 22101

SEQ ID NO: 62591 - DNA, 201 bp, Bos taurus
tagggaatagaaaaaatttcatggcatggcatgaagttgcacatgacttacgagaaggcttcagaaaagaatatttggtgaacaaataatggcccatagatgctcactgcagatgaactgtaacttgatcagccaattttttttttttttttaatgtttgtgttgttcttgactgggccatggtctaaaaataactcctgt

SEQ ID NO: 62592 - DNA, 201 bp, Bos taurus
tattagcaaggaaagagcttttataagtttggccaagggtggaatggatgtgacaggttttagaatctgccctctcagccaacgaccagttagttacaagagagtgggaaggcctttcacctacctggcagcagagctggaagttctggctgtgggcaaggagacacttatgccttgaagtctctatatacttactatctg

SEQ ID NO: 62593 - DNA, 201 bp, Bos taurus; identical to SEQ ID NO: 22102

SEQ ID NO: 62594 - DNA, 201 bp, Bos taurus; identical to SEQ ID NO: 22103

SEQ ID NO: 62595 - DNA, 201 bp, Bos taurus; identical to SEQ ID NO: 22104

SEQ ID NO: 62596 - DNA, 201 bp, Bos taurus
ggaggtggggatttgactgagccacagtgaggttgactgagtgaagttctaattagaatggaagaaaaatgatggagccatgagtctggccatggggagaggacatcaggttaaaaccatgagaatcaacatgttgtagagtctagccttgtgggtggtggatccgcctggcttcacagggcagagatggggtggactgga

SEQ ID NO: 62597 - DNA, 201 bp, Bos taurus
atgctatttcatacttaatagactacagaataatataaacttagcttttatatgcagtggaaaagcaaaaagactcatatgactagcagacgttggttcacgagttttaaggaaagaagccatctccatgacataaaagtgcaagatgaagcagcaagtgctgatgtagaagctgcagcaagttgtccgaagatctcgtta

SEQ ID NO: 62598 - DNA, 201 bp, Bos taurus
gcaggagggacagcaccgggcctgtaggaagtgacagcatcaggcatacttggaggagggaagcatgtctgaggtttctctgtgacacatctccttgggactcacaaataaatggggccagaggttaagaatggggcaaggagggaggtggggtagcacaaggatctttgtggaaatatgtatcttgattgtggtggttga

SEQ ID NO: 62599 - DNA, 201 bp, Bos taurus; identical to SEQ ID NO: 22105

SEQ ID NO: 62600 - DNA, 201 bp, Bos taurus; identical to SEQ ID NO: 22106

SEQ ID NO: 62601 - DNA, 201 bp, Bos taurus
gaaccagtcacctatcagatcacaatctggtgggaaagatgtaagtgacagtttgtaactggcatctctggctctatgaagggccagatgtgctcatattccttgtaaaagagacagaaggcaccagtgtctgtcctcagctgccatctggcattttacagttctgggtggggagtctgtctctccaccagtgcttcatcc

SEQ ID NO: 62602 - DNA, 201 bp, Bos taurus
gggtcaggcaagggaccgagtatccccagggaacctgactttcaaggtcagcaggatttgattatagaacttccacaggactggggaaacagagactctttaaggacacaaacaaaatcttgtaggtaccaggacccaggagaaaggagcaatgaccccgtaagaaactgagccagacttgcctgtgtgtgatagggagtt

SEQ ID NO: 62603 - DNA, 201 bp, Bos taurus
ggacacaccatcagataattctaggcctggaaaggcccctagtgattacctggtgcagtccctcattgcacatttgaggagacattggctctgagaaaccccgaggctggcagggctctgggcccgctgcttacccatgtgcttggaactgatgttaggcttctctgctgaggctctccaagagtcagctaatggcagtgt

SEQ ID NO: 62604 - DNA, 201 bp, Bos taurus
tagcacagaaatgcatacctgtcaaaatgctgcactgtcacttttaagcctagtttattttcatacatgtgtataaaacagtgcagtgtgatggaaagacggccagaccagtgaaaggagacttggaacgcagctctgctctgttttctcagccaagtagccttgcaaagcaagtcacatgacctccctaggcttcagtat

SEQ ID NO: 62605 - DNA, 201 bp, Bos taurus
gcctgaggtgctgtgggatttctttttttaagtaagtttattacgtagctccgtttttaaaaactgcagcttcaagatacatcgaaggtcaaacgtgcacgaagaatgcaggcctggcctagagtgagctagaaagcagagaagccggcaaagcctcaggttccaccctctctgccccatctcaattcacagcagccccgt

SEQ ID NO: 62606 - DNA, 201 bp, Bos taurus
tcagctgtaaaaaggggccgagatttgactccgagtctgtcctcagagcccatggctgtcacctttacctttctcacctatgccagttgcctgcttggccatgtgcagacggtccacactctctgctcctagatgtctcagcagtaaaatgaccacacaatttctgctctgctcacttcctaagagagcagtggccactgg

SEQ ID NO: 62607 - DNA, 201 bp, Bos taurus; identical to SEQ ID NO: 22107

SEQ ID NO: 62608 - DNA, 201 bp, Bos taurus
tttggggactggccacccagatagactgtgtctatagccaagtggaggatttgcagggacagaaaagccatcccactttcagtttgctgatgtggcacccaaggcaggagtagctccatctgtggcctagaaagttatttcaacacatgtaatttttagaaaatcattaaatgacattttagaataatttttaaccacatg

SEQ ID NO: 62609 - DNA, 201 bp, Bos taurus; identical to SEQ ID NO: 22108

SEQ ID NO: 62610 - DNA, 201 bp, Bos taurus
gcccctcctgctcacagcagaaatgtctgcaggcctagggcgcagttcctaagctgcggtctctctggacctctttggctgaggcagagagagagcccattttgacttccacacgtggccccagaaagctggaggcggggaaaggaggctgtaggtgcctctcgtgggaagttgctgtgagtagaaaatgctagcattagg

SEQ ID NO: 62611 - DNA, 201 bp, Bos taurus; identical to SEQ ID NO: 22109

SEQ ID NO: 62612 - DNA, 201 bp, Bos taurus
tttccaacacgattcctttcccactgtgcttatgtgtcgcatgtgtacttgcctctgtgtgagtgaaatggcttggcagcagggaggggagggccagcccgcctctagcctgccgtgggcggcaactccataggttttcactggaactcatgtaaagttttagatactggccactgccagctcagaagataattataataa

SEQ ID NO: 62613 - DNA, 201 bp, Bos taurus
gtttagaggagtatgtaagcaaatgtgttttgaagactactttattgtttttgttcaatgcccaaattgtgtccagctatttgcaacctcaaagactgcagctccccaggcttctctgtcctccaatatcactgggagtttactcaagttcatgtccattgagtcagtgatgccatccaaccatgtcatcctctgttgtcc

SEQ ID NO: 62614 - DNA, 201 bp, Bos taurus
gatattctaattctatgtcccatgtttgtcaaagtttttttcatttttttaatctccttgtgttttatgcttagaatttttaaattttagatttgctttttacatatatctgacagttaactagtcctctccagttatattcttctgatatttaagcccacgcattaaattttaaatttcagtgactggacctgggttctg

SEQ ID NO: 62615 - DNA, 201 bp, Bos taurus
taatgtgcttgaaatttttaattcatgaagtctgtaaactattatatcacttggaatgggggcagagtttacatggcctgcacagtctcgttgagatgaccggatcaggcagagattagtaagaagggacatgtcagcacaaacaaattttacagaaagtttgagacagaggtgttggccagcctggtaaaagtattaatt

SEQ ID NO: 62616 - DNA, 201 bp, Bos taurus; identical to SEQ ID NO: 22110

SEQ ID NO: 62617 - DNA, 201 bp, Bos taurus; identical to SEQ ID NO: 22111

SEQ ID NO: 62618 - DNA, 201 bp, Bos taurus; identical to SEQ ID NO: 22112

SEQ ID NO: 62619 - DNA, 201 bp, Bos taurus; identical to SEQ ID NO: 22113

SEQ ID NO: 62620 - DNA, 201 bp, Bos taurus; identical to SEQ ID NO: 22114

SEQ ID NO: 62621 - DNA, 201 bp, Bos taurus; identical to SEQ ID NO: 22115

SEQ ID NO: 62622 - DNA, 201 bp, Bos taurus; identical to SEQ ID NO: 22116

SEQ ID NO: 62623 - DNA, 201 bp, Bos taurus; identical to SEQ ID NO: 22117

SEQ ID NO: 62624 - DNA, 201 bp, Bos taurus; identical to SEQ ID NO: 22118

SEQ ID NO: 62625 - DNA, 201 bp, Bos taurus; identical to SEQ ID NO: 22119

SEQ ID NO: 62626 - DNA, 201 bp, Bos taurus; identical to SEQ ID NO: 22120

SEQ ID NO: 62627 - DNA, 201 bp, Bos taurus; identical to SEQ ID NO: 22121

SEQ ID NO: 62628 - DNA, 201 bp, Bos taurus; identical to SEQ ID NO: 22123

SEQ ID NO: 62629 - DNA, 201 bp, Bos taurus; identical to SEQ ID NO: 22124

SEQ ID NO: 62630 - DNA, 201 bp, Bos taurus; identical to SEQ ID NO: 22125

SEQ ID NO: 62631 - DNA, 201 bp, Bos taurus; identical to SEQ ID NO: 22126

SEQ ID NO: 62632 - DNA, 201 bp, Bos taurus; identical to SEQ ID NO: 22127

SEQ ID NO: 62633 - DNA, 201 bp, Bos taurus
actaacgctaccttcccaagatcttgcaggccttcaagatcatccataacaccaccatgaaaccctcctttaccaagaagcagctcccttttccccatgatggccttcgccccccagtcaaggtctgcccctcctgctctttgttgtgtagatctgcatagggtcaccctggatgtgtgggaggaaattcctagaagacag

SEQ ID NO: 62634 - DNA, 201 bp, Bos taurus; identical to SEQ ID NO: 22128

SEQ ID NO: 62635 - DNA, 201 bp, Bos taurus
gtagtatttttcaggaagttaagtagaacatgatacattctttgaccatggtgcagtaaaactagaaggacactagacatttgctggttgactgaaataacgaacaggtaacaaaaaataaaagtacaaaaccaactctggatattttattgtatcaaagagaacatttaaaatacagttacatattatctaggaaatggt

SEQ ID NO: 62636 - DNA, 201 bp, Bos taurus
aagcgcaaagcacgcgtggttctctgaatccactgctgtggtgttctctgcacttccttctgtgcgcactcctgtttgatctccactgctttgaggtggaagtcttcccatttaatttgtgactttgggcttcagctatgtcctggttgctctgagaatgaactttgcatttctgctttctgttctttttgcccttggata

SEQ ID NO: 62637 - DNA, 201 bp, Bos taurus
cagagattagaagagaccaggtactagttctcatcccagaaggttggagactgctccatgttttctgcttctgagttcatcatggcccacttcatgactctcgggaataggcccaagcagaacaattctggggtggtagtttgtttcctctcctgatcaaggtagcagagcagagaggggagatgtaacattagcagctca

SEQ ID NO: 62638 - DNA, 201 bp, Bos taurus
attttaaaaagcatatttgagtagtcttaatgcagtctattcacttggcttgatgaagtatccaaaccagcacttagtaccagctacatacattccatattgcttttggtcactagaggttatggagagtaacaggcttaatatgaatcacagtgtacttgaggggagtctacttcctaggattttaaagcacttcaatga

SEQ ID NO: 62639 - DNA, 201 bp, Bos taurus
aagaaaagccaaagttctctttaaatctgcaggccagattcaaagtctcagctcaaagcagccaggcaggaggagctcccgcttcttctcgcttattctcagaagaattggccttttgttttgtttagaccttcaactgattggatgaggtccacccacattagagagagcaatctgctttgatcagtttactgatccaaa

SEQ ID NO: 62640 - DNA, 201 bp, Bos taurus; identical to SEQ ID NO: 22129

SEQ ID NO: 62641 - DNA, 201 bp, Bos taurus; identical to SEQ ID NO: 22130

SEQ ID NO: 62642 - DNA, 201 bp, Bos taurus
ggcctttgcattggcttttctccttgcctctaacactcgtcccctagaaatcagcagagctcatgccttcgtgtttattgttcagatttcaccttttaaacgaggccttccacaactgccttgtttaattctgggattaaacctttccactcccccactcccataccctattcttctttacactgctctagttttcctttt

SEQ ID NO: 62643 - DNA, 201 bp, Bos taurus
tatactaattctcaatggcatcatcagcaagatggctgatagctctgtggttcttgtagcatctattgccggaattctaacaaatcttcaggttttaatacatgttcatatgtttatgtatttcttcaaatggcaattttagaacattaacttgaaatatttaaatataaaagctgataaaggcaacttgactatttcaga

SEQ ID NO: 62644 - DNA, 201 bp, Bos taurus; identical to SEQ ID NO: 22131

SEQ ID NO: 62645 - DNA, 201 bp, Bos taurus
tgaatacaaattttaaattaagtttttctttatgtttaatatgaataataattcgttgcctatggtaaggggctttgtttttcctccttttcctgcctcttttattttggctcctcctcaaaagtgaaagtgaaagtcacttagtcgtgtccgactgtttgtgaccccatggtctatagagtccgagaaggcgatagcagc

SEQ ID NO: 62646 - DNA, 201 bp, Bos taurus; identical to SEQ ID NO: 22133

SEQ ID NO: 62647 - DNA, 201 bp, Bos taurus
gctttgtccacaagtggttcttcgagctaccctatcaccttgcgtcaggatgtctttttcctgtgatttttttgaaccaaagtaaaacaaaaggctatcttgatcaaatagaactgacgagaattatcctaatttttctcctacagtggcataggaaagaagcagggtcatgatgagctcaggaagatgaaaagatataag

SEQ ID NO: 62648 - DNA, 201 bp, Bos taurus; identical to SEQ ID NO: 22134

SEQ ID NO: 62649 - DNA, 201 bp, Bos taurus
cagggattaactttttttctttttttttagtttgatcttttatctgctctcttctccctacttgtaatcactagttcttaatcactgtctcgattccctttagaaactctatttaccagctttgtctgcagctaggacaatcagatctgactctgagcccaagtgtaacttggcccttgtgccacctaaacataagaacac

SEQ ID NO: 62650 - DNA, 201 bp, Bos taurus; identical to SEQ ID NO: 22135

SEQ ID NO: 62651 - DNA, 201 bp, Bos taurus; identical to SEQ ID NO: 22136

SEQ ID NO: 62652 - DNA, 201 bp, Bos taurus
aacattattaatttgatccctatgcattgtttttgtctctgtctacatcatagcttctgtttcctgaatatttctataccatgtacttttccttaacccacgatatttttcaaatttgtaacagaaactaaatgagatactggggggaaatgagctctaaaaaattttgcacttctcagaaatttctgaccctgagcatgg

SEQ ID NO: 62653 - DNA, 201 bp, Bos taurus; identical to SEQ ID NO: 22137

SEQ ID NO: 62654 - DNA, 201 bp, Bos taurus
tacagagagtcaattgtttagagctctttgtaatctgaatctattcctatctgtatcattataaatttttttatttgaaatagagttagtgaatagatatgctttgcttgtatggcctctattatctatcaaattaagggccttaaggcacaaaattacaaagtaaaaatgattatttgcagactagcttctccctagaat

SEQ ID NO: 62655 - DNA, 201 bp, Bos taurus
gcatttaataaggatttcagaatatgtcagattcaaagttggtgtacatgagaatatggaaggagttgaacctacacagcaggatagtaagattgggtggcatgctgggctcaaagggatgagttttgtggagttccagatggaagttattaatataattgtggtacccagaagtatcaacatctcatatttcaaattatg

SEQ ID NO: 62656 - DNA, 201 bp, Bos taurus; identical to SEQ ID NO: 22141

SEQ ID NO: 62657 - DNA, 201 bp, Bos taurus
ggatgaaattaagaattttcttgttcactattggggaaaatatggatctcatcctcgtagtttctatgatacactaaaggatggggaaagaaaaagcaaacaaacatgagtccttggcaaggttgatatagcaggatatgaaatcaaacactgaagaatctttttaggacactataaaatgttaaacttacaataaacttc

SEQ ID NO: 62658 - DNA, 201 bp, Bos taurus; identical to SEQ ID NO: 22142

SEQ ID NO: 62659 - DNA, 201 bp, Bos taurus
gtcggatacgagtgagcaactgaactgactgactgaggttattttgagttaggaaatatctcaagagaagtataaaaaatatgctttgagcaaaattgagctatgagctgggccaaatattggtaataagttgagtgatacaagggcttgagtaacagctggattgtgaaggcttttatgttcttaaaaagaatagtttca

SEQ ID NO: 62660 - DNA, 201 bp, Bos taurus
ctatatgttatccctcaggaaaatttctgattagaattcagtcctatgcacattaatatcaggttgggatgccaagaatggtgactgtcagtgttccagtctctcaaaaaagcaaaatggcataatccactttaaagtagtgacttgcctgttgacttaaatctaagtctcccatgtgtttgcaattgggaatcagttcac

SEQ ID NO: 62661 - DNA, 201 bp, Bos taurus; identical to SEQ ID NO: 22143

SEQ ID NO: 62662 - DNA, 201 bp, Bos taurus
gcactatttaccaaactttgctctaaatgttcagataaggagatatatttgtttatacacagtcagaggaaggtccctaacagattccaggcatctgcatataaatacagggttatgcacacaaatagggactggttgatgaaatgtgagtgaaccaggacaaagccttggaactattatggaagcaatgaaagcaacgtt

SEQ ID NO: 62663 - DNA, 201 bp, Bos taurus; identical to SEQ ID NO: 22144

SEQ ID NO: 62664 - DNA, 201 bp, Bos taurus; identical to SEQ ID NO: 22145

SEQ ID NO: 62665 - DNA, 201 bp, Bos taurus; identical to SEQ ID NO: 22146

SEQ ID NO: 62666 - DNA, 201 bp, Bos taurus; identical to SEQ ID NO: 22148

SEQ ID NO: 62667 - DNA, 201 bp, Bos taurus; identical to SEQ ID NO: 22149

SEQ ID NO: 62668 - DNA, 201 bp, Bos taurus; identical to SEQ ID NO: 22154

SEQ ID NO: 62669 - DNA, 201 bp, Bos taurus; identical to SEQ ID NO: 22155

SEQ ID NO: 62670 - DNA, 201 bp, Bos taurus; identical to SEQ ID NO: 22156

SEQ ID NO: 62671 - DNA, 201 bp, Bos taurus; identical to SEQ ID NO: 22157

SEQ ID NO: 62672 - DNA, 201 bp, Bos taurus; identical to SEQ ID NO: 22158

SEQ ID NO: 62673 - DNA, 201 bp, Bos taurus
gctgtgtacctacgaaattagtatgttgaagtgttaactcctagtaactcagaatgtgcctatatttagggataagatcttttaaagtaagatgaggtcatggggtgggccctagtacaatatgactggtgtcccataagaaaaggaatttaggacacaggccatgcagactgaaggaagaacaagtgaggaccaggccag

SEQ ID NO: 62674 - DNA, 201 bp, Bos taurus; identical to SEQ ID NO: 22159

SEQ ID NO: 62675 - DNA, 201 bp, Bos taurus
agggggctggccagcctaagaattgactgggcttgggtatagaatgaccacacaccagctgtggctgggagagcaaaatcgtgtgattacaaaacatgaccgcttaactacttccctttcatcaagggctgatgatggaacatggccatatagaagggctgaggcaggacagaacacttcctttgtaactcaattcttgtt

SEQ ID NO: 62676 - DNA, 201 bp, Bos taurus
atctgggtgcttgataacttgataattaaatttacaaaaggttggaaatatttgccacagaaagatttaaaatcattcctgaaatcctaatgacagctcctgcaatatgtgtatgcctcttgagggcccagtgaggataggtggtattaaaaatataattggttttaaagtacattagattaaatttttttcctatgattc

SEQ ID NO: 62677 - DNA, 201 bp, Bos taurus; identical to SEQ ID NO: 22161

SEQ ID NO: 62678 - DNA, 201 bp, Bos taurus; identical to SEQ ID NO: 22162

SEQ ID NO: 62679 - DNA, 201 bp, Bos taurus
agtctgactcaggcccttgtgtgtatatatatttttgtgtgtgtgtgttttaataaaaatgtaactgtataaatgaaaagaaaatgggagtaccctttcatctctatgtgtgccctccactcccattactaacaaaaacaatccttttaaaaatatcaaaaaatgctttgtttgcctccaggtctgatgggagatggcaaa

SEQ ID NO: 62680 - DNA, 201 bp, Bos taurus; identical to SEQ ID NO: 22166

SEQ ID NO: 62681 - DNA, 201 bp, Bos taurus
ttcaataataaggtacacttttgatggctatcatggtttaaaatgagagagaaatatcttaaaagataacattccatgatgggacaaacatatttatcttgtatatcatgactttaagtcaacagatataggagagaaaggtttgtgaaaaatccatggaactaagaataactgggccaatattttcagtctgcatgatat

SEQ ID NO: 62682 - DNA, 201 bp, Bos taurus; identical to SEQ ID NO: 22168

SEQ ID NO: 62683 - DNA, 201 bp, Bos taurus
atgggggaaagaaatagtagattctaaagtgcaaaatattttgcctctgggcaaaattctacttttggatgagcatggtgttttcatctgtcaagtcttgtactacctacagacatactatcagcactgaaagtgagaagtcattcttaaagaatcttatactactgagctgtcccatgcttcctagctgcaaaaattatt

SEQ ID NO: 62684 - DNA, 201 bp, Bos taurus; identical to SEQ ID NO: 22170

SEQ ID NO: 62685 - DNA, 201 bp, Bos taurus; identical to SEQ ID NO: 22171

SEQ ID NO: 62686 - DNA, 201 bp, Bos taurus
ggcaacctaagagggcccagtgatctgtgcctcctgacactcatgcccccatgtaactccttcccctgatataggctggagctagtgtcttgtctgtaacaaacagaatgcaggccaagtgatggaatgacacttctgaaattaggttataaaaagagtgtgacttccatcttggaatctttcactctcagccctcactct

SEQ ID NO: 62687 - DNA, 201 bp, Bos taurus; identical to SEQ ID NO: 22174

SEQ ID NO: 62688 - DNA, 201 bp, Bos taurus; identical to SEQ ID NO: 22175

SEQ ID NO: 62689 - DNA, 201 bp, Bos taurus
ggaatttgtgaccaacagtcaaatgttcctcagaggcatttttatcatcttgtagttgtgagacttcttgtaaagggactgaggaaggagccagaaccacggggcatgatcaggtccgagaagagctgtaaggaagtaataatgactttcacactcatgggcgacctggatttccacgcactatcaaccaagtttgtcact

SEQ ID NO: 62690 - DNA, 201 bp, Bos taurus; identical to SEQ ID NO: 22176

SEQ ID NO: 62691 - DNA, 201 bp, Bos taurus
attcctgcaaatcgaaacctctcccctccctgaaccttgtccctttgtctgagtctttttcaaaacagatagattctaggccttcatggtgttaaatagcactgtaaggaatttcagggggttatctccagcaatctgtcttttaggggttgcagtgcaaaggccaaaacccattactataaagtccttcttggaagacta

SEQ ID NO: 62692 - DNA, 201 bp, Bos taurus
tgcccaacgtagcataccacttttactctgtgggcacttagcaaatcctcgttgactaattggcaacaattcctggtctacttgtgggaaaacggggaggtaaaacaaattaaccaggccaccgtgcttcctcagtcacccgagggaagagttattagtggctacacacagtcactgaaaatagacatctggtcagaaaaa

SEQ ID NO: 62693 - DNA, 201 bp, Bos taurus; identical to SEQ ID NO: 22177

SEQ ID NO: 62694 - DNA, 201 bp, Bos taurus; identical to SEQ ID NO: 22178

SEQ ID NO: 62695 - DNA, 201 bp, Bos taurus
gtaattttaattttggaggatacatcatagtttgatagaatgatattaaagaaaagcatatggtaggaagagtgaagagcacatgcaaaaatatggaaacatgcaagaaaacgtgcattcagagatgggctacagtaattcaggagggctgcagcatagtgaaggaggtactgagatggggttgaaaaggtaagcaaagcc

SEQ ID NO: 62696 - DNA, 201 bp, Bos taurus; identical to SEQ ID NO: 22181

SEQ ID NO: 62697 - DNA, 201 bp, Bos taurus; identical to SEQ ID NO: 22183

SEQ ID NO: 62698 - DNA, 201 bp, Bos taurus; identical to SEQ ID NO: 22184

SEQ ID NO: 62699 - DNA, 201 bp, Bos taurus; identical to SEQ ID NO: 22185

SEQ ID NO: 62700 - DNA, 201 bp, Bos taurus
atatttatctttccaaaaattatgggaataaaacttttaatttttttcatatgtcttgagcaaaagaggagtgagatgtacaaagctagccaataccaagcaagtgaaacacaccaaaaggaactgtcagtatatattaagttattgcctatagaatctggaactgcatcaccttaggtcaaacaatgaacaaggagggag

SEQ ID NO: 62701 - DNA, 201 bp, Bos taurus; identical to SEQ ID NO: 22186

SEQ ID NO: 62702 - DNA, 201 bp, Bos taurus; identical to SEQ ID NO: 22187

SEQ ID NO: 62703 - DNA, 201 bp, Bos taurus; identical to SEQ ID NO: 22190

SEQ ID NO: 62704 - DNA, 201 bp, Bos taurus
gttatccagctgtggcagagaaatggggccttgattttgactttgttaattaaacacagagaagagaaaagagaatttgctccaagagattttagatagtacttggaatttgagctaaattttgaaagataaaatcacccaagtgccagcttccgtttttccatatgtaatttccagagccaaattagtgtttggaacact

SEQ ID NO: 62705 - DNA, 201 bp, Bos taurus; identical to SEQ ID NO: 22191

SEQ ID NO: 62706 - DNA, 201 bp, Bos taurus
caggactctgctttccgaagttttcatcacctccaacactgacagctttaaatccactattatacaacaactgtaaaagtaactctaaaccctccagttacgggtgaccctaaggaccctgattcgattacgcatgaatgagattggtagttcgagagaagaatggcattatgtcctccatctctttaggaaaatctgtca

SEQ ID NO: 62707 - DNA, 201 bp, Bos taurus
tgtctttaatgtcaaatggaattcagtcataaatctctcagttcccctcattcccatcagtactgctctcttccaaggccatcattacatttaaaatgtctctgaatctcttctgctcctgctaacagacacacaagtagacacatgttatatggcaaacaaggctggagccaggatctgatccacatccatctggcccaa

SEQ ID NO: 62708 - DNA, 201 bp, Bos taurus; identical to SEQ ID NO: 22193

SEQ ID NO: 62709 - DNA, 201 bp, Bos taurus
cacacccaggttctccatgttggccaagtgaataaattgcccatgttgctggtttacaattagtttattcatgaatattaagtattgcctctaattgttttgttcctaccaatcctgaaccaggcctatggtgagctgccacagcacccagacagctctgggtagcatctggtagcaagaaaaacaagggctgaggaaaca

SEQ ID NO: 62710 - DNA, 201 bp, Bos taurus; identical to SEQ ID NO: 22194

SEQ ID NO: 62711 - DNA, 201 bp, Bos taurus; identical to SEQ ID NO: 22195

SEQ ID NO: 62712 - DNA, 201 bp, Bos taurus
ccatcttggggagaaggaagagttgttaaagcatcatctagactcgtagctctctgggcatggtttcattgctgtgtctgaaattgtatattatttgttttttttcattttttttttacaagtttcttatatcactgtctcttgagatatcagtttttgatacttatttccttttatttcctcacatatgtactacctctt

SEQ ID NO: 62713 - DNA, 201 bp, Bos taurus
caaaagaattatatgctatcagaacactgagttattatatatatgtgttcatcaaagaaaaatcattaatattcagaattatagtgtttaatgaatatacggtatcacatcttatgtatatttcaaaaacaaaaactgaaatctgtaactatgatgctttctttcccaatgacccaaagagtttcagttttattatatgtg

SEQ ID NO: 62714 - DNA, 201 bp, Bos taurus; identical to SEQ ID NO: 22196

SEQ ID NO: 62715 - DNA, 201 bp, Bos taurus; identical to SEQ ID NO: 22197

SEQ ID NO: 62716 - DNA, 201 bp, Bos taurus; identical to SEQ ID NO: 22198

SEQ ID NO: 62717 - DNA, 201 bp, Bos taurus; identical to SEQ ID NO: 22199

SEQ ID NO: 62718 - DNA, 201 bp, Bos taurus
ttagtctccttcaaaagtctgttgtgttgtatttgcctccacttcatcttccttcaatccatttgtcatagtgtagcttcagtggccttcccatataaactaatcatgtcaagtctgtctgcctcatgcctaagagattccaacggcttcagattgccttcaggataaagcccaaactccttaatgtggccctcaagactt

SEQ ID NO: 62719 - DNA, 201 bp, Bos taurus
ttaccttcgcttttagaggtggttggtcctatttaagacacaaggtacttagaaagccttgctcagacacacatgtcccacccactgagtcattcaacattcttctcaggtcttggtcttgatttccagttctggtaattgggcttatggctattttagacatcaagctgtcccattcctccaggaagcaagactgatttg

SEQ ID NO: 62720 - DNA, 201 bp, Bos taurus
ctctgcactgaggtgcgcaggcctcccattatggtggcccctcggggcaaggagcatgggcttagggctcgtggacttcagtagctgtggctcccaggcatcgttgttttggcacacaggcccagatgctctgaggcacacgggatcctctcagacccaggatggaaaccccatcctctgcactggcaggcggactttcta

SEQ ID NO: 62721 - DNA, 201 bp, Bos taurus
gttgcttcttctaacctagggttgtggtcaagagcacgaattctggaggtgcattattcaagttcatatgccaaaatttcacttgcaagctttgagacctgggtcactttaccggtcctctgtgcctctgggtcctcatctgtaaaacagggaaagaaacagtgctaatctctcagggttgcttcaaggattaaatgattt

SEQ ID NO: 62722 - DNA, 201 bp, Bos taurus; identical to SEQ ID NO: 22200

SEQ ID NO: 62723 - DNA, 201 bp, Bos taurus
tatttgaatgaattctttaaagcatgttagtattacaacattaagctaacatttattggttattaacagtggcccaggtattatactagacacagtacttgggttcaaatataaataggaaagttcctgctctgttgatggtctttatcaaatacagttgaaatggctacttggggcttccccggtggctcagtgggtaaa

SEQ ID NO: 62724 - DNA, 201 bp, Bos taurus
aaggattcaggtaaggcttggcaaggtcacacagctgggctatgatgtgtctaggatgccaatccacggactccttttccagagggcctgccattattgctagggggctgagcaccctcccgagtgtccttgacttgctggcacaccatctctttgcttcaggccaccttgcacggacccctgcatgagccaacttactgc

SEQ ID NO: 62725 - DNA, 201 bp, Bos taurus; identical to SEQ ID NO: 22201

SEQ ID NO: 62726 - DNA, 201 bp, Bos taurus
ctggtgggtaacagaagtgaaggaaacggagaggtagggcgccgcgatctcgagccctcttccttgctcccaagccctggtcaagcctatcctgtttaagtagcacgaaaactaaactgtgctcactcttagcggtaacctcggctgggcgaacccctctgatgctgagtttactggtccggacgttactttacagaaaac

SEQ ID NO: 62727 - DNA, 201 bp, Bos taurus; identical to SEQ ID NO: 22202

SEQ ID NO: 62728 - DNA, 201 bp, Bos taurus; identical to SEQ ID NO: 22203

SEQ ID NO: 62729 - DNA, 201 bp, Bos taurus; identical to SEQ ID NO: 22204

SEQ ID NO: 62730 - DNA, 201 bp, Bos taurus
tcttaaacacacttgtggttctaggagtcactcagtcgtgtccaactctttgtgaccccaaggacagcagcccaccaggctcctctgcccatgggattcttcaggcaagaatgctggctatagaacacacagaatacttattaggcagatgtgagcagacacaggttatgtgattctgcttaatgagagcactaatatttc

SEQ ID NO: 62731 - DNA, 201 bp, Bos taurus; identical to SEQ ID NO: 22205

SEQ ID NO: 62732 - DNA, 201 bp, Bos taurus; identical to SEQ ID NO: 22206

SEQ ID NO: 62733 - DNA, 201 bp, Bos taurus; identical to SEQ ID NO: 22207

SEQ ID NO: 62734 - DNA, 201 bp, Bos taurus; identical to SEQ ID NO: 22209

SEQ ID NO: 62735 - DNA, 201 bp, Bos taurus; identical to SEQ ID NO: 22210

SEQ ID NO: 62736 - DNA, 201 bp, Bos taurus; identical to SEQ ID NO: 22211

SEQ ID NO: 62737 - DNA, 201 bp, Bos taurus; identical to SEQ ID NO: 22212

SEQ ID NO: 62738 - DNA, 201 bp, Bos taurus; identical to SEQ ID NO: 22213

SEQ ID NO: 62739 - DNA, 201 bp, Bos taurus; identical to SEQ ID NO: 22214

SEQ ID NO: 62740 - DNA, 201 bp, Bos taurus; identical to SEQ ID NO: 22215

SEQ ID NO: 62741 - DNA, 201 bp, Bos taurus; identical to SEQ ID NO: 22216

SEQ ID NO: 62742 - DNA, 201 bp, Bos taurus; identical to SEQ ID NO: 22217

SEQ ID NO: 62743 - DNA, 201 bp, Bos taurus; identical to SEQ ID NO: 22218

SEQ ID NO: 62744 - DNA, 201 bp, Bos taurus; identical to SEQ ID NO: 22219

SEQ ID NO: 62745 - DNA, 201 bp, Bos taurus
ctatgctctatccttaacaaaacacattttaaaaagcagtcatgtaattcataggccaagcaaaatgtctctatccctacggtagttaatatagtagttacaggtgtatctgcctccttatgctaaaatagctactaaaaagtccataaagggattcctgaaacttaacttcagcaccatttgcacaactgcttcactaag

SEQ ID NO: 62746 - DNA, 201 bp, Bos taurus
aaagggaaaaaaccctcagaaagtgtatgctgccatagtttaccatcctggttggcataaatagagaggaaatggagtcctgacatctttttcaggttacgtggtatccctttctacatttccatatttttcctctagtcaaatgtttttcttgaaatactttattatttttttttaacgtagagatagaaggaatctttt

SEQ ID NO: 62747 - DNA, 201 bp, Bos taurus; identical to SEQ ID NO: 22220

SEQ ID NO: 62748 - DNA, 201 bp, Bos taurus; identical to SEQ ID NO: 22221

SEQ ID NO: 62749 - DNA, 201 bp, Bos taurus; identical to SEQ ID NO: 22222

SEQ ID NO: 62750 - DNA, 201 bp, Bos taurus
gagatgtttgtccaggtgcaagcgctggtcccaggccccaggtttcaggtcccagcctatgtccgtgagggtggtagcctgaggtagaaggagtgaagaatgggtgggtttttccaggctctaaggcattcattctctacctgacgcctgtgggcacagtggaaggggcaagccagctctcagtctgctgaggcgggtgga

SEQ ID NO: 62751 - DNA, 201 bp, Bos taurus
tgtgaggtgactgaggctcttgcagaggcaagtcctcaagcaaattggcactgcaaaatcctttagtatctgttttgaggggcaggcctgccagtggggcgtatgaggtagaaccagcgctgtacttgtgattctggaggggtgccgggggagagctgggggtggccatggggtggaggggagccaggagctctgacagca

SEQ ID NO: 62752 - DNA, 201 bp, Bos taurus
aaagttatctttaaggcctttatcttaaactctgaattgcttaaaaaaccaaaggagaaaacataagtctaccagggattagaaagtgagaggctgatgcggctagacttcttgaggcccaggacagccctgcttccgagcctggacatgcccccctagaccagcccactgggacagagtgggatgttggttcccagaaga

SEQ ID NO: 62753 - DNA, 201 bp, Bos taurus
atatttcatgtgggtttgtctagcctcctcatttccactgtggtttccctgagtgcagagaattgccagagttaagggctcttgtaggtctctcagcctcttctgagttctaactattctgtgacttttgctgactatgaaaccatctgtcagagtaagtttgctggttactccttctgagtttgtggataccagacacta

SEQ ID NO: 62754 - DNA, 201 bp, Bos taurus
attatgctgttgcctatccctttgccctttactgagattgccaatcaaaagcattcctttctcatgccttcaattcccttgacgtgcttgctttgtcatagctgtcaagccccatccctggttaatctaagtctctacctattttctagcagtccccatgcagagaccttggctggaaaaaaacacatccttcattccttg

SEQ ID NO: 62755 - DNA, 201 bp, Bos taurus
gttgttcaggagatgtcgtgaaagattttccagcaaaactttacttttccttctcttttttactgagaagttctatttgaaacatcccaagctaagattagaaccagattgccatttgcatgcataatgttgctcaacctgaaaaccttgaatcagtatctggctgtgtcccactgcttccccatcactgtctgttctgta

SEQ ID NO: 62756 - DNA, 201 bp, Bos taurus
gattttcagcaataattctaataaatactttgttcaatgttttaacagcccatcataggccaacttgttaaatcataatcataagtcaaagtgccttgatagtaaagtgtttggcttggcacctggtccacagtaaatggtggctggtctcatctcccataactgctgagaatctgtcttgatagttttgattatatttat

SEQ ID NO: 62757 - DNA, 201 bp, Bos taurus
cgttagaaataaaactggtttttatttaaaattatataaacctgagaatattttctagcattttatttttcatctttaaggcctttaaaatacaaagatactgattttaaaagccgaatcttatagtataagatcaccactgaagaaagcttgaaagatatgagttctgtaattattctcaaactgaatctgaggaaactc

SEQ ID NO: 62758 - DNA, 201 bp, Bos taurus; identical to SEQ ID NO: 22223

SEQ ID NO: 62759 - DNA, 201 bp, Bos taurus; identical to SEQ ID NO: 22224

SEQ ID NO: 62760 - DNA, 201 bp, Bos taurus; identical to SEQ ID NO: 22225

SEQ ID NO: 62761 - DNA, 201 bp, Bos taurus; identical to SEQ ID NO: 22226

SEQ ID NO: 62762 - DNA, 201 bp, Bos taurus; identical to SEQ ID NO: 22227

SEQ ID NO: 62763 - DNA, 201 bp, Bos taurus
cacaaaagactgccagtttggagttaggcccacagcaagcaagagccttgtatcaagtccagtgtgcagtgtgaatgccttgccactgagctgtgtgatctgtcaggccatatagtggggtaatagatatttgtggtggaaaaatgcagcatgtagaatttatgccaagttcttctgggaaaagtgacagcacatgttcac

SEQ ID NO: 62764 - DNA, 201 bp, Bos taurus; identical to SEQ ID NO: 22228

SEQ ID NO: 62765 - DNA, 201 bp, Bos taurus; identical to SEQ ID NO: 22229

SEQ ID NO: 62766 - DNA, 201 bp, Bos taurus
tgtcttttgagaatgagccgtgcttctgttttcctcatagagcgagaaagaaatcctggttaattaagcagtggttctccttaattttactgggccacaggggaagcctaagaatacaggagtggatagcttatcccttctccagcagatcttcttgacccaggaatcgaaccgggattgcctgcattgcaggccaattct

SEQ ID NO: 62767 - DNA, 201 bp, Bos taurus; identical to SEQ ID NO: 22230

SEQ ID NO: 62768 - DNA, 201 bp, Bos taurus; identical to SEQ ID NO: 22231

SEQ ID NO: 62769 - DNA, 201 bp, Bos taurus; identical to SEQ ID NO: 22232

SEQ ID NO: 62770 - DNA, 201 bp, Bos taurus; identical to SEQ ID NO: 22234

SEQ ID NO: 62771 - DNA, 201 bp, Bos taurus
gtttctggcagttttcataagctgacctcctgcgttgagagcgaagagtcttagccactggaccaccatggaactccaaaactttttaaacgtagggccccgatcggtcttctcagttttcttgaaatttccaaatcccaaatttctcatctgatcaattagaaaaggccttcagtgttccctctcccgcttcccgtgtga

SEQ ID NO: 62772 - DNA, 201 bp, Bos taurus
tttgtggcagcgctatcacgggcgtccctgacttctgagcctgtgagctccgagcctgtgcagtgtcggccatggccttggacttggttcttcatactcctgccttgatcacttaggaaggtgacctttcagcaaaaaagccagaaagtacaggccaggaatagactgtgacatgaaagagaagcccgtatggagagtgtt

SEQ ID NO: 62773 - DNA, 201 bp, Bos taurus; identical to SEQ ID NO: 22235

SEQ ID NO: 62774 - DNA, 201 bp, Bos taurus; identical to SEQ ID NO: 22236

SEQ ID NO: 62775 - DNA, 201 bp, Bos taurus; identical to SEQ ID NO: 22238

SEQ ID NO: 62776 - DNA, 201 bp, Bos taurus; identical to SEQ ID NO: 22239

SEQ ID NO: 62777 - DNA, 201 bp, Bos taurus; identical to SEQ ID NO: 22240

SEQ ID NO: 62778 - DNA, 201 bp, Bos taurus
gtttaagtcagtaacacgttgggatcttgcttaaatgttgtgatcttctcttttacagcaggatcttagttttttaaacggctctaaatcttaaatacacgctctagaagttatcagaactggccctcccagcaaagcccttccctctgttgtgtgcaagtgtgtatgattctggcaggcagagccttagtgaggtgctga

SEQ ID NO: 62779 - DNA, 201 bp, Bos taurus
ttgcctctatctcagcccaatcagagaataatcatcttcttacaaacttaggaagaagggctagaggcacgaagaagcagcatataaaatccaaggggttgagcaaacttagttgctgacagtgtgtagaaacatatgtagacatagaaatagaggaaatggggatgtctctggtggtccagtggttaagaatcttcctgt

SEQ ID NO: 62780 - DNA, 201 bp, Bos taurus; identical to SEQ ID NO: 22241

SEQ ID NO: 62781 - DNA, 201 bp, Bos taurus; identical to SEQ ID NO: 22243

SEQ ID NO: 62782 - DNA, 201 bp, Bos taurus
gagaggattctaaaattttcctgtaaagatattcagacccagtgcttttcttaggagaaagactttgaccaactttctaatttattctatggttactggtatagttaagttcatttactcttgtaccaatattgataattcatattgtttttagaagatcagacatattatgtagatttcatttttcttactacccatttt

SEQ ID NO: 62783 - DNA, 201 bp, Bos taurus
gtaagcttagggtctttctactctgttgtctttgccaaacctcaggataggaacattttaagtttcttgatttgtattgtcaattaccctccagaaagatagtctaaaattacattaatcctagcagccaacaagagagcatatttgcctggacactggatacttctaggctattattctccctattcttcttatttaata

SEQ ID NO: 62784 - DNA, 201 bp, Bos taurus; identical to SEQ ID NO: 22244

SEQ ID NO: 62785 - DNA, 201 bp, Bos taurus; identical to SEQ ID NO: 22245

SEQ ID NO: 62786 - DNA, 201 bp, Bos taurus
tacacttatcagttgtcaagaatcaaagaatttgatgaagttgattgtctgtgtggcactacccttcatgagaaagagcagaagtcctcctgtgttccctccaaaagggacaatatgcttctggagaagccctttccttactgagaaagcttggaaatcttctattaatttttcacctatatcttcctttgaaatatatcc

SEQ ID NO: 62787 - DNA, 201 bp, Bos taurus; identical to SEQ ID NO: 22246

SEQ ID NO: 62788 - DNA, 201 bp, Bos taurus; identical to SEQ ID NO: 22247

SEQ ID NO: 62789 - DNA, 201 bp, Bos taurus
ccttggaattgggcaggcccataaacaaggctttgccatcaggtaggcccctggctgtgctcccctgttgggcaagattactggccagactctctgattacgagagccctccagctgaatcccacagtgagtgggtctagagactgtgtttcatggtcaagctgggttgttgtctaggctttcttgataagaaagccttgt

SEQ ID NO: 62790 - DNA, 201 bp, Bos taurus; identical to SEQ ID NO: 22248

SEQ ID NO: 62791 - DNA, 201 bp, Bos taurus; identical to SEQ ID NO: 22251

SEQ ID NO: 62792 - DNA, 201 bp, Bos taurus; identical to SEQ ID NO: 22252

SEQ ID NO: 62793 - DNA, 201 bp, Bos taurus; identical to SEQ ID NO: 22253

SEQ ID NO: 62794 - DNA, 201 bp, Bos taurus
attatctctaaacatattagactcctcaaaatgtattcttagaaaggataaattgatgaattactattctcagaggcaacatgacacttgattcttgattgtctcttccagatgcagagtcaactgagaattaactacttgagtgtgaagaaggaaatatccaggtctcctttccatccaataatctccattccattgaaa

SEQ ID NO: 62795 - DNA, 201 bp, Bos taurus; identical to SEQ ID NO: 22254

SEQ ID NO: 62796 - DNA, 201 bp, Bos taurus; identical to SEQ ID NO: 22255

SEQ ID NO: 62797 - DNA, 201 bp, Bos taurus; identical to SEQ ID NO: 22256

SEQ ID NO: 62798 - DNA, 201 bp, Bos taurus; identical to SEQ ID NO: 22257

SEQ ID NO: 62799 - DNA, 201 bp, Bos taurus; identical to SEQ ID NO: 22258

SEQ ID NO: 62800 - DNA, 201 bp, Bos taurus; identical to SEQ ID NO: 22259

SEQ ID NO: 62801 - DNA, 201 bp, Bos taurus; identical to SEQ ID NO: 22260

SEQ ID NO: 62802 - DNA, 201 bp, Bos taurus; identical to SEQ ID NO: 22261

SEQ ID NO: 62803 - DNA, 201 bp, Bos taurus; identical to SEQ ID NO: 22262

SEQ ID NO: 62804 - DNA, 201 bp, Bos taurus; identical to SEQ ID NO: 22263

SEQ ID NO: 62805 - DNA, 201 bp, Bos taurus; identical to SEQ ID NO: 22264

SEQ ID NO: 62806 - DNA, 201 bp, Bos taurus; identical to SEQ ID NO: 22265

SEQ ID NO: 62807 - DNA, 201 bp, Bos taurus; identical to SEQ ID NO: 22266

SEQ ID NO: 62808 - DNA, 201 bp, Bos taurus
cagattttttgccactgcgccagctgggaagcccaaagctgctagtgagcaccctacgactcctgctttggtttccttccctgggcctccctggcttaccacaatagctccttcctttcccacagcctcttcctgacctcaactctcaatgcccacatccactcttcttccaccagcctcctggctgaacaagcctctgtc

SEQ ID NO: 62809 - DNA, 201 bp, Bos taurus
cagcaacaggaatggtgtaagaaaggccgaatcagggagaaagaaggtcaggtctgaagtgcaatagagcaagaggactgagaggctagcagatgcaggggcactatgggccgtcctgggagcgtgtgagttaccagacacagggagatgcgtggagctgataaatgtctcaagccctgcaggtgcaacatcatcttccag

SEQ ID NO: 62810 - DNA, 201 bp, Bos taurus
gccagcccctgcctcactcagtccctgggaggcacacgtgtgtcggctcacccaggctgagctcctgccgctccatttctcgccttcaaccctccaggaaagatgctgtgtgcggccagcgtcgcaagcagacagaaatcactgttttcgatgtccctctgttagacgctcgttcttggtgtctggatgctgaagtgtcct

SEQ ID NO: 62811 - DNA, 201 bp, Bos taurus; identical to SEQ ID NO: 22269

SEQ ID NO: 62812 - DNA, 201 bp, Bos taurus; identical to SEQ ID NO: 22270

SEQ ID NO: 62813 - DNA, 201 bp, Bos taurus
gtcatgaggggagacatctcactctgttctgtttctcaccagattgcgcaaaagctgaggcaggccctcggccgcttcccggtgatgtaggacaggtggagtgaacgtggagaaacgccgaagtgcttccttctgacttgggacaacgcaattggatttttttttccaccatcgtccaaaaagaaacaaaaaagaaaacca

SEQ ID NO: 62814 - DNA, 201 bp, Bos taurus; identical to SEQ ID NO: 22271

SEQ ID NO: 62815 - DNA, 201 bp, Bos taurus; identical to SEQ ID NO: 22272

SEQ ID NO: 62816 - DNA, 201 bp, Bos taurus
ataaatggtatttgcaaaattatgaggccttccctggagtcaaagccttcagaactgactgtataggcactgcgtgagatgaaaggagctggggttatgggggatatccatatggggatatccggtccatatttctttctactctccaatgttgtttctcagtaaacattctaaaatctttgtaacacacctcttattagt

SEQ ID NO: 62817 - DNA, 201 bp, Bos taurus
tcttgtgggctctttctcagcactggtaggttcaactggagtgtgggttatcagttcttatcctgccttaatcctggggcccttgtatctgctgagatcatgagtgtaggaaaagcttgaagctatcataaatgtgagttgctattttcgtcctgagtggtaatgttgtagacggctgttcaggcctagcctgtgcagaca

SEQ ID NO: 62818 - DNA, 201 bp, Bos taurus; identical to SEQ ID NO: 22274

SEQ ID NO: 62819 - DNA, 201 bp, Bos taurus
ttcagagtgacttcattaaacctgcaagagttgccggtcgctgtcacagagagggggaccaggtcaggcttggagaaggggccgcgatgtgtgatggaccacacgatgccgcagagaagctgtcttgtctcccagtagagagcctgctgtccctccgtcgctgtgagcactcagcactcacctcgatgtctgcttgcctct

SEQ ID NO: 62820 - DNA, 201 bp, Bos taurus
agggctccccaggacccaggtggctgctggggcacacccattgtacccacacccactgctggggatggagccaggccccactgcaagggacagggcacattggggaggacacttcctggaagaatgaggacttcagataaaaactaagtctgagaaacacaagattgcatttctcacacatttgaatttcgtggcctgaga

SEQ ID NO: 62821 - DNA, 201 bp, Bos taurus
tgagatttttgggccatatcctcttttctctgtgggctgattgagaacttagccattgaataagatgtggtccacagtgcacgtaagacctgcccgccccccgcccccgccctggcccccaaccatcatcctagagattcttggaaggtataaggagaaaggctgacaactgtccaaacggcacgtgagcacccctaatag

SEQ ID NO: 62822 - DNA, 201 bp, Bos taurus; identical to SEQ ID NO: 22275

SEQ ID NO: 62823 - DNA, 201 bp, Bos taurus; identical to SEQ ID NO: 22276

SEQ ID NO: 62824 - DNA, 201 bp, Bos taurus; identical to SEQ ID NO: 22278

SEQ ID NO: 62825 - DNA, 201 bp, Bos taurus; identical to SEQ ID NO: 22279

SEQ ID NO: 62826 - DNA, 201 bp, Bos taurus; identical to SEQ ID NO: 22281

SEQ ID NO: 62827 - DNA, 201 bp, Bos taurus
catgtacacactgctatatttaaaatagataaccaacaaggacctgatgtaaaaaacaacaacaataacaataaaaggcttcgagaagcacattctctttgcttgcaaggtcaggctttttagatgagagttctcatacttgcaacattcatttcttcattttacttctgacatcttactggtgggtttccttccacccta

SEQ ID NO: 62828 - DNA, 201 bp, Bos taurus
ggtaggcggccaactgggaagccccacaaaacaatctatagggttgacaaaaagcatcagtggttgctacgagaagggaggaactcttaggccgaagagactacagacgggaatgagtaagcatgtggaggtgaaggaaatgttcattatcttgactgtgatggtggtttcataggtgtgcacgtatgttacaacttaaca

SEQ ID NO: 62829 - DNA, 201 bp, Bos taurus; identical to SEQ ID NO: 22282

SEQ ID NO: 62830 - DNA, 201 bp, Bos taurus; identical to SEQ ID NO: 22283

SEQ ID NO: 62831 - DNA, 201 bp, Bos taurus; identical to SEQ ID NO: 22284

SEQ ID NO: 62832 - DNA, 201 bp, Bos taurus; identical to SEQ ID NO: 22285

SEQ ID NO: 62833 - DNA, 201 bp, Bos taurus; identical to SEQ ID NO: 22286

SEQ ID NO: 62834 - DNA, 201 bp, Bos taurus
tgttacttcctcgaagaaacaggctgttctcctgggatgtcttctcactggatgttccaaggacttgactccaagatctgccctgtaactgactatggttcgtatagttttttgggccttaattttcccatctctgaagctggaatttttttcttgtttattaacaatagcaacaatggaattatggttctgtgaagcctt

SEQ ID NO: 62835 - DNA, 201 bp, Bos taurus
ccttgcattacatcagggtccattcactggattgatggatactcccatgaccacccctaacttgcaaagggtcagcctcatactgaagatgcatcacatccatggaccccactgcggccgttttcatcgcctccaccgggtggcttcgcttaaacagccaaagggaactcagatgtgctggcccgatttaggataagggga

SEQ ID NO: 62836 - DNA, 201 bp, Bos taurus
cctcatccaagtggagggtaatgcatttttgattgattctttaaggttttttttttttttccccccaaaattcccaaatttttgtgtgtgcagacctgccttcctactatgactaattcaaaatggccataataggttacaactgaagcaaagttgacatgagttgaagcagtcagactaaataatggggaaaacatttga

SEQ ID NO: 62837 - DNA, 201 bp, Bos taurus; identical to SEQ ID NO: 22287

SEQ ID NO: 62838 - DNA, 201 bp, Bos taurus; identical to SEQ ID NO: 22288

SEQ ID NO: 62839 - DNA, 201 bp, Bos taurus; identical to SEQ ID NO: 22291

SEQ ID NO: 62840 - DNA, 201 bp, Bos taurus; identical to SEQ ID NO: 22292

SEQ ID NO: 62841 - DNA, 201 bp, Bos taurus; identical to SEQ ID NO: 22293

SEQ ID NO: 62842 - DNA, 201 bp, Bos taurus; identical to SEQ ID NO: 22296

SEQ ID NO: 62843 - DNA, 201 bp, Bos taurus
gccggaatatctgctaaaatgcagattttcaatgtgatgtcaatagcattaaatgatgtcagtaatgaagtcagtgtggccccctaaataaacctaaaacgaaaaacacggtccacacaggtatggacaggaagccttgtgctctgtatgcagtagcatgaaatagggctacaggggcgagggcaatgccaggcccagcgg

SEQ ID NO: 62844 - DNA, 201 bp, Bos taurus; identical to SEQ ID NO: 22297

SEQ ID NO: 62845 - DNA, 201 bp, Bos taurus; identical to SEQ ID NO: 22298

SEQ ID NO: 62846 - DNA, 201 bp, Bos taurus; identical to SEQ ID NO: 22299

SEQ ID NO: 62847 - DNA, 201 bp, Bos taurus
gccccctgcctgcccacctccccctccaccctctctcgggcgtcttcagatgcccagggccctccaggtgcagctcagcgggcagaggccccgcctctccgtgcagccaggtgcctgcactctgactctgcacatgaattcattcgggttcatctcctgaaatgctcccaggcgggccatcccaccgctccgtcctctgag

SEQ ID NO: 62848 - DNA, 201 bp, Bos taurus
tcttggcatcctgagaggcaaagagaagggcccgcttgagtagccccgagtcgccacggaggggagtgttggaaacagaaacgctgggtctccgtctgagcagctgcggggccagcaattactctgtttcaagagacttgctctcactttcgcccacagttaagagtcaagtggtcacgcgcagattccgaatctctgtcc

SEQ ID NO: 62849 - DNA, 201 bp, Bos taurus; identical to SEQ ID NO: 22307

SEQ ID NO: 62850 - DNA, 201 bp, Bos taurus
atggggacctggaggagaagaagggcccacagctctgcagccctcggcccaggctggatgcactccccaagttcagctcgtgtcctggaacctcagcctgtagcctcacctgggcgtgggccgtcctgggggccgctctggagaaggctgtcccgaagaaggctgggaccaatcccgggactggcttcctcacaagagggg

SEQ ID NO: 62851 - DNA, 201 bp, Bos taurus
ttggggccctgcctgagctcatctgcgtgggcccctctgcctgcaggggggacccccacgacctttgctccttctgtccagcttgtcccccggggcactcgggcccactcggctggctcccctggtgcagagatgcccctcaggacttgagatggagcacgccggctcctctgcagtggcctcatgctgggctggccgctc

SEQ ID NO: 62852 - DNA, 201 bp, Bos taurus
gcgaactcctgaacctcttgctgcacgtcagagttgggtgctcgggcccaggaggcccacgtgtgggacaggttttgtttaaggcctgtggtcgcccacatgtcaggtgtgtgcttaaagctgccgtccagtggctcctagtagggacaggaaactgtgactgctctctggtgaagtgtccgtacagatggcagcctgggg

SEQ ID NO: 62853 - DNA, 201 bp, Bos taurus
acttgttattggaagaaaatcaagccttaagttaaaaagttttagaagtacctctaggagtatttaaatccctttccctataaatcaagtatgctttcttggtggtaaaagaatgaaaattagcaacttctagcattcagactatataatcagactgttagtatacagaatatgtaacttttagtgtagaaaatataaggc

SEQ ID NO: 62854 - DNA, 201 bp, Bos taurus; identical to SEQ ID NO: 22310

SEQ ID NO: 62855 - DNA, 201 bp, Bos taurus
attagtctccacattgcacctgatcatttcttttagggcactgaacatatttctcaattatctattcattgcttcttcaccattcagttcactaaactgaattccaccagggagggaagatgtttaacttactccatgcctagcaccatgcctggcatgagtgatcactcaatatgtgtgctgtttttaggaatgtccagt

SEQ ID NO: 62856 - DNA, 201 bp, Bos taurus
aagattaccagggccaagtgtcaggaatcataagcaagagaagccagggacagagctgaggatcttgctaacatgtgggttctgattcagtaggtttgggatgaggcctgagactgcattcctaacaagactccggacactgcctttggtccagggaccacacttggaagaacaaggttctaaattcaggtctgctgttga

SEQ ID NO: 62857 - DNA, 201 bp, Bos taurus; identical to SEQ ID NO: 22311

SEQ ID NO: 62858 - DNA, 201 bp, Bos taurus; identical to SEQ ID NO: 22312

SEQ ID NO: 62859 - DNA, 201 bp, Bos taurus; identical to SEQ ID NO: 22313

SEQ ID NO: 62860 - DNA, 201 bp, Bos taurus
ccccttaaatcgtttctccgttggggattacttattcccgtttgggggcctgggggaaatggggatctgtgtctatatctgtgttaaaactttgatccaagaagacagtggagtttcactgttggccattttctccgtaatcccagtgaccttcaaggagataaacaggctgataagaaaatgcgagatctttaaactctg

SEQ ID NO: 62861 - DNA, 201 bp, Bos taurus
gtatttgatatattgtctgaagagctctggtagtgcagagctagatgcagtctcagaactgcttggcaagtctgggttcatcagttagagcatctgcaatattaaccttgccatttaacaaacaagcaaaaatagacttgttacgtaaatgggaggaactggagagggaatctattgtgaccttggtgaagaaaattccag

SEQ ID NO: 62862 - DNA, 201 bp, Bos taurus; identical to SEQ ID NO: 22314

SEQ ID NO: 62863 - DNA, 201 bp, Bos taurus; identical to SEQ ID NO: 22315

SEQ ID NO: 62864 - DNA, 201 bp, Bos taurus; identical to SEQ ID NO: 22317

SEQ ID NO: 62865 - DNA, 201 bp, Bos taurus
atggctgcattgtatcggaagagagcgccctgctcctgcggtcctggtctggaggtttaagaatggaaagaaggcaaggtatggatgttaagtagccaaacgggcattctgtagcaggtacagcagacaggctcaaccaaatttatgccaacttccttttagtgaaccttcccgtactacaagtactaaaagctgtatttc

SEQ ID NO: 62866 - DNA, 201 bp, Bos taurus; identical to SEQ ID NO: 22321

SEQ ID NO: 62867 - DNA, 201 bp, Bos taurus
ggattttcctgtgttgttattgttcacatgatcgagatgttggcttcaggtatagctagatctagattctcaaacaatgttatgatttctttcaatatgattcaagtcttctttctctatggattatctcagaggatttggcccacaatggtcaccagcagcaatttattccccagccactccagaataacttacaagaaa

SEQ ID NO: 62868 - DNA, 201 bp, Bos taurus
gtcaggggtaaaccatgaagggcctctaatcttcatgcgaagtcagggagctggggcttctgacagctccacatgggcccccagaggtctacatcctcacagtggaacttgagaacattatgtggcaaaaaagactgtatatgtgattaagttaaggacattaggatggggaagttatcttgggttactgcagagggccct

SEQ ID NO: 62869 - DNA, 201 bp, Bos taurus; identical to SEQ ID NO: 22322

SEQ ID NO: 62870 - DNA, 201 bp, Bos taurus; identical to SEQ ID NO: 22323

SEQ ID NO: 62871 - DNA, 201 bp, Bos taurus
ttcatatggtatatatgtatttgcctattcaaacaatatttactgaatatttacaatatacaaggcattagcaaactttctgtaaggggcctgatagtaaacattttaaactttgctgacctcatttgatctctaggacatagccttctttgttttccatataatcctataaatatgtaaaaatcacttttaggtcagggg

SEQ ID NO: 62872 - DNA, 201 bp, Bos taurus; identical to SEQ ID NO: 22328

SEQ ID NO: 62873 - DNA, 201 bp, Bos taurus; identical to SEQ ID NO: 22329

SEQ ID NO: 62874 - DNA, 201 bp, Bos taurus; identical to SEQ ID NO: 22334

SEQ ID NO: 62875 - DNA, 201 bp, Bos taurus
caaaacaggaaattgccagcgttcttcctgctggacagtgacttatattataaatgacatttttttattcttctttaattcaaagtaaagcagcagtgaccgagaaggtaccatgtgccaagtgttggcttttgatgttattttgtttaatccccctccaacagcatttttattccccatcttacaggtaatgcagttgag

SEQ ID NO: 62876 - DNA, 201 bp, Bos taurus; identical to SEQ ID NO: 22336

SEQ ID NO: 62877 - DNA, 201 bp, Bos taurus
aaagagtcggacaagactgagcgactgaactcaactgacctgaatattccattgtctggatgtaccacagactgtttatccattggcctcctggaggacaccttggttgcttcagagttttggcaatgatgaataaagctgctataaatatctgtatataggttttcatgtggccataagttttcaactcctctggtacat

SEQ ID NO: 62878 - DNA, 201 bp, Bos taurus; identical to SEQ ID NO: 22337

SEQ ID NO: 62879 - DNA, 201 bp, Bos taurus
cctggaaaacaatattttcagttgatctgaagccagggtccctacaggattaggtgtttgcctctgtctgcccacctgcctgctccttccttcaaccggttgactggccacagcaaagggcagaagggattgtgcttctacagagtgcagacccccaagaagtcagagctggaagcgtccggttgcccactcctcacgggc

SEQ ID NO: 62880 - DNA, 201 bp, Bos taurus; identical to SEQ ID NO: 22339

SEQ ID NO: 62881 - DNA, 201 bp, Bos taurus; identical to SEQ ID NO: 22340

SEQ ID NO: 62882 - DNA, 201 bp, Bos taurus; identical to SEQ ID NO: 22341

SEQ ID NO: 62883 - DNA, 201 bp, Bos taurus; identical to SEQ ID NO: 22342

SEQ ID NO: 62884 - DNA, 201 bp, Bos taurus; identical to SEQ ID NO: 22343

SEQ ID NO: 62885 - DNA, 201 bp, Bos taurus; identical to SEQ ID NO: 22344

SEQ ID NO: 62886 - DNA, 201 bp, Bos taurus; identical to SEQ ID NO: 22345

SEQ ID NO: 62887 - DNA, 201 bp, Bos taurus; identical to SEQ ID NO: 22346

SEQ ID NO: 62888 - DNA, 201 bp, Bos taurus; identical to SEQ ID NO: 22347

SEQ ID NO: 62889 - DNA, 201 bp, Bos taurus
aaactggtgagtgttcatgagccatttcttcattgtcccttcaaaggtttgtcctggacacagtcctgcttgactggcaggtgaatccgttcacaaaccaatgagccatcaccccagctccaactatgcagccacccgttgcttcaccgtcaccacatctgtgagctctttctttagttgccattaaaatgacccctttca

SEQ ID NO: 62890 - DNA, 201 bp, Bos taurus; identical to SEQ ID NO: 22350

SEQ ID NO: 62891 - DNA, 201 bp, Bos taurus
tgcaccggccctgagcaccctgtctcaaggacattcttttgaatctgatgggcagtgagggggcatttgtacattgcagaggtcacaaagtgtcagtggtacattcacaaacagtacgtgtggccgtcccagtagttccaagctgctggggggcactggtctctgagatacaaacgccgcacattgcgcctctgcttcaga

SEQ ID NO: 62892 - DNA, 201 bp, Bos taurus
gaaatactggagaactgtaaacgcacaaaggcacacttaggtcccacaaaggtagcagattgttttgttgacactgtatctcccatcacatccatgcttttcatggcattccttgtgtcgtttattactgaccaggaatagacagctggatttgatccaggaggcacatgtgggatcccaaggcagaaattcactactagg

SEQ ID NO: 62893 - DNA, 201 bp, Bos taurus; identical to SEQ ID NO: 22351

SEQ ID NO: 62894 - DNA, 201 bp, Bos taurus
aaggaagggagagaaccagcaaaaaccagttttggtgtaagcaggctgctaacccctggcaatacgactcagggcagggcctctgtcgacactgggcactttccctgagccagagagtgagttcacgtggaagctttccacaaaggcacataccagttcttgttccatttatgtgcaaactccacaagcaagaggagctgg

SEQ ID NO: 62895 - DNA, 201 bp, Bos taurus; identical to SEQ ID NO: 22352

SEQ ID NO: 62896 - DNA, 201 bp, Bos taurus; identical to SEQ ID NO: 22354

SEQ ID NO: 62897 - DNA, 201 bp, Bos taurus; identical to SEQ ID NO: 22355

SEQ ID NO: 62898 - DNA, 201 bp, Bos taurus; identical to SEQ ID NO: 22357

SEQ ID NO: 62899 - DNA, 201 bp, Bos taurus; identical to SEQ ID NO: 22358

SEQ ID NO: 62900 - DNA, 201 bp, Bos taurus; identical to SEQ ID NO: 22359

SEQ ID NO: 62901 - DNA, 201 bp, Bos taurus
cagggctaaagaatcgctggctagagctctcggagggaggtgagaagggaccaagtcaacaactctcatttccatttcatctctgattggaaaggccaagcatcaaggtccagagagtaaacggagttccctttgactctctccttcacgtgtggctgagccccagagtggacgtgatttatacagggtgggccccagaga

SEQ ID NO: 62902 - DNA, 201 bp, Bos taurus
ctggtcaaggtggggagtggggccccggtgcagggagcagggattctggagcctccttttggtcaggtggtcagagaggcctctctgggaagaggccatccgatccacgaggatcaagaggagccaactctgcagattggagaaagctccttccaggcagagaactcagcaagtgcaaaggccccacagcagaaaaagtcc

SEQ ID NO: 62903 - DNA, 201 bp, Bos taurus; identical to SEQ ID NO: 22362

SEQ ID NO: 62904 - DNA, 201 bp, Bos taurus
ccagctgaggaaggagagagagggacgagccagggccagagtcgggggcttaagaaacagctgggccggggggaaggctagaaggccaagaactcaagacagtcaggactcttagccgcgctgagcagtgctgggtaaggaaacagacccagagagaagagggcagggactcgccttgctgaggtctactccagaggcaag

SEQ ID NO: 62905 - DNA, 201 bp, Bos taurus; identical to SEQ ID NO: 22363

SEQ ID NO: 62906 - DNA, 201 bp, Bos taurus
aagacctcccaaagacttgacccaaagaggggctcacacttctatcctcttcttcacgcctgaactcacccgaaccacttgaataaacctgaacacagctgtagcctctcctgccctctgctcacccagctcccatcatttttcttcatcatttaaccttttcctgaggctaaagcgaacaggtgaagttagaagcaccac

SEQ ID NO: 62907 - DNA, 201 bp, Bos taurus; identical to SEQ ID NO: 22364

SEQ ID NO: 62908 - DNA, 201 bp, Bos taurus; identical to SEQ ID NO: 22365

SEQ ID NO: 62909 - DNA, 201 bp, Bos taurus
ataaaggctggtagtggagggcctgtcctaccttgggtccatagtgaggctgtggtccttgtaactagtcagctcccagttaagactggtgaagtgaaaacggggtctgggcctgggtctcctacctgggagaggaggctgaaggccagtgccccactggagatggccagtagtaaagatgagctccattcaggagacacc

SEQ ID NO: 62910 - DNA, 201 bp, Bos taurus; identical to SEQ ID NO: 22369

SEQ ID NO: 62911 - DNA, 201 bp, Bos taurus; identical to SEQ ID NO: 22370

SEQ ID NO: 62912 - DNA, 201 bp, Bos taurus
aaatcaagaggtcccctgacaactgacataaagtctgaagggcattcctgtagacagaggagcaggtttttctgaaggcccacctcagattgcttgtcttgaatgtctgtgtgacagtgcctttggttagagtgagccctgtactctttctgctactttacccaccggcctgtcctccctagaggtcatttgaatgatgtc

SEQ ID NO: 62913 - DNA, 201 bp, Bos taurus; identical to SEQ ID NO: 22372

SEQ ID NO: 62914 - DNA, 201 bp, Bos taurus; identical to SEQ ID NO: 22373

SEQ ID NO: 62915 - DNA, 201 bp, Bos taurus; identical to SEQ ID NO: 22374

SEQ ID NO: 62916 - DNA, 201 bp, Bos taurus; identical to SEQ ID NO: 22376

SEQ ID NO: 62917 - DNA, 201 bp, Bos taurus; identical to SEQ ID NO: 22377

SEQ ID NO: 62918 - DNA, 201 bp, Bos taurus
agaacctgagcggggctctcagggtggccccgggtgagagtgtcacaccccaacttgaccctaaactcctggaggatggcgtggtcgcatctccatgccccctctggtgcctggcccccggccctcactcagttgctgagcagcggagtcagtcagcgatgagtactcacctttgcgttgtcaacttaaaaaacaatgcac

SEQ ID NO: 62919 - DNA, 201 bp, Bos taurus
tttgagcagaagcatatttattttttcctgtggggaattggtgtacagctcacttcaaattaagtaaaaccaaagagcagttaagaggccctgccttcccgggtcaaggaggaacgaccaagcaaagtggtactgatgctctactggctgctgggcatgtctgttctgggctggcccaggtttgagtggcaagggagatgc

SEQ ID NO: 62920 - DNA, 201 bp, Bos taurus
ctctaaaagcaattgcagttctttgcatgagcacaggagtgggccggggccaggagagctaacaagaggaagccgttcccacgactggcctgactttttgatgtaccactgagaacaatgagcaaagctacctctgagctagctatgattctgtgcccctgggccaggaataaatctgaacttaccggaaagatcatctca

SEQ ID NO: 62921 - DNA, 201 bp, Bos taurus; identical to SEQ ID NO: 22379

SEQ ID NO: 62922 - DNA, 201 bp, Bos taurus; identical to SEQ ID NO: 22382

SEQ ID NO: 62923 - DNA, 201 bp, Bos taurus; identical to SEQ ID NO: 22383

SEQ ID NO: 62924 - DNA, 201 bp, Bos taurus; identical to SEQ ID NO: 22384

SEQ ID NO: 62925 - DNA, 201 bp, Bos taurus; identical to SEQ ID NO: 22387

SEQ ID NO: 62926 - DNA, 201 bp, Bos taurus; identical to SEQ ID NO: 22390

SEQ ID NO: 62927 - DNA, 201 bp, Bos taurus; identical to SEQ ID NO: 22392

SEQ ID NO: 62928 - DNA, 201 bp, Bos taurus; identical to SEQ ID NO: 22393

SEQ ID NO: 62929 - DNA, 201 bp, Bos taurus; identical to SEQ ID NO: 22394

SEQ ID NO: 62930 - DNA, 201 bp, Bos taurus
ctctgagctactggtgccagtgccctgggggcagagcctggctaggggcccattcctgtctgaccatttgggaaccgaccactccaaccagaaaggacaggacagaggaccccttcaggggcccagaaagtggtccagcagggcctggccctgctatggaaagtgaggactctgaaggacggtgactgcccactcccgcta

SEQ ID NO: 62931 - DNA, 201 bp, Bos taurus
ctgtaatcggtcttcaagcaggggaaaggggacgcagagatggctcaaggaaataagactggaatttttcataaaccaggcccagactacccatacacatttagatcacgctgagcttcttgggttcagctgcgagaagaggggctggtagaggccaagctatcttaggcccagggattccaaatggaacacaattatttt

SEQ ID NO: 62932 - DNA, 201 bp, Bos taurus
aggtgcctactgagcgtaatttactgtcttcttatcaatgggcacgtgggtagtttcctaactaaatgttgctatttctgaatgctgctggcacaaaaacgtctcaaacatgcatagataccaatggaaaagcaacttggaaagcaacttatcaatttacaagtaaatttcacacacaaataaaaattatgtatatttctc

SEQ ID NO: 62933 - DNA, 201 bp, Bos taurus; identical to SEQ ID NO: 22396

SEQ ID NO: 62934 - DNA, 201 bp, Bos taurus; identical to SEQ ID NO: 22397

SEQ ID NO: 62935 - DNA, 201 bp, Bos taurus; identical to SEQ ID NO: 22398

SEQ ID NO: 62936 - DNA, 201 bp, Bos taurus
taccaggggcctggatgagggggagcacggggtgggggcaagctggctgggcccagggagtcagagaagcagggtcacaggcccaggcacaaggtctactatgccttgtctccttgaaagtcagacaaaaacaaccctcggagggagtcacagcggagactagaattcgttttcaaaacactgaggccaaaagaggttaag

SEQ ID NO: 62937 - DNA, 201 bp, Bos taurus; identical to SEQ ID NO: 22403

SEQ ID NO: 62938 - DNA, 201 bp, Bos taurus
ggccgaatctgcagccggggtaaaatagaacacttcccccagcccacccacaatagaaataaaggctgggtcccttaggggaccagccaggcacggcacactgcggaggccatgggcagacagacacacggacaagaagttagccagagacagaaggatggcacagggcctctttgctcacagcactcgatgggtaccgat

SEQ ID NO: 62939 - DNA, 201 bp, Bos taurus; identical to SEQ ID NO: 22405

SEQ ID NO: 62940 - DNA, 201 bp, Bos taurus; identical to SEQ ID NO: 22406

SEQ ID NO: 62941 - DNA, 201 bp, Bos taurus; identical to SEQ ID NO: 22407

SEQ ID NO: 62942 - DNA, 201 bp, Bos taurus; identical to SEQ ID NO: 22408

SEQ ID NO: 62943 - DNA, 201 bp, Bos taurus; identical to SEQ ID NO: 22411

SEQ ID NO: 62944 - DNA, 201 bp, Bos taurus; identical to SEQ ID NO: 22412

SEQ ID NO: 62945 - DNA, 201 bp, Bos taurus
ttccagcctgtgtaaaggggaggaagaccattggtcctggacccatttcaagaccacgttcccccgtccttgtcacagaggacgggcccttaccttgtttaaagctctttaggaagccttctcgtggagctaacttgtctgggtcgtgcacaacacgttggggaattttcagtacagtgcgtacagcaggaatacggagac

SEQ ID NO: 62946 - DNA, 201 bp, Bos taurus; identical to SEQ ID NO: 22413

SEQ ID NO: 62947 - DNA, 201 bp, Bos taurus; identical to SEQ ID NO: 22414

SEQ ID NO: 62948 - DNA, 201 bp, Bos taurus; identical to SEQ ID NO: 22415

SEQ ID NO: 62949 - DNA, 201 bp, Bos taurus; identical to SEQ ID NO: 22416

SEQ ID NO: 62950 - DNA, 201 bp, Bos taurus; identical to SEQ ID NO: 22417

SEQ ID NO: 62951 - DNA, 201 bp, Bos taurus; identical to SEQ ID NO: 22418

SEQ ID NO: 62952 - DNA, 201 bp, Bos taurus; identical to SEQ ID NO: 22419

SEQ ID NO: 62953 - DNA, 201 bp, Bos taurus; identical to SEQ ID NO: 22420

SEQ ID NO: 62954 - DNA, 201 bp, Bos taurus; identical to SEQ ID NO: 22421

SEQ ID NO: 62955 - DNA, 201 bp, Bos taurus; identical to SEQ ID NO: 22422

SEQ ID NO: 62956 - DNA, 201 bp, Bos taurus; identical to SEQ ID NO: 22423

SEQ ID NO: 62957 - DNA, 201 bp, Bos taurus; identical to SEQ ID NO: 22424

SEQ ID NO: 62958 - DNA, 201 bp, Bos taurus; identical to SEQ ID NO: 22425

SEQ ID NO: 62959 - DNA, 201 bp, Bos taurus; identical to SEQ ID NO: 22426

SEQ ID NO: 62960 - DNA, 201 bp, Bos taurus; identical to SEQ ID NO: 22427

SEQ ID NO: 62961 - DNA, 201 bp, Bos taurus; identical to SEQ ID NO: 22428

SEQ ID NO: 62962 - DNA, 201 bp, Bos taurus; identical to SEQ ID NO: 22429

SEQ ID NO: 62963 - DNA, 201 bp, Bos taurus; identical to SEQ ID NO: 22430

SEQ ID NO: 62964 - DNA, 201 bp, Bos taurus; identical to SEQ ID NO: 22431

SEQ ID NO: 62965 - DNA, 201 bp, Bos taurus; identical to SEQ ID NO: 22432

SEQ ID NO: 62966 - DNA, 201 bp, Bos taurus; identical to SEQ ID NO: 22433

SEQ ID NO: 62967 - DNA, 201 bp, Bos taurus; identical to SEQ ID NO: 22434

SEQ ID NO: 62968 - DNA, 201 bp, Bos taurus; identical to SEQ ID NO: 22435

SEQ ID NO: 62969 - DNA, 201 bp, Bos taurus; identical to SEQ ID NO: 22436

SEQ ID NO: 62970 - DNA, 201 bp, Bos taurus; identical to SEQ ID NO: 22437

SEQ ID NO: 62971 - DNA, 201 bp, Bos taurus; identical to SEQ ID NO: 22438

SEQ ID NO: 62972 - DNA, 201 bp, Bos taurus; identical to SEQ ID NO: 22439

SEQ ID NO: 62973 - DNA, 201 bp, Bos taurus; identical to SEQ ID NO: 22440

SEQ ID NO: 62974 - DNA, 201 bp, Bos taurus; identical to SEQ ID NO: 22441

SEQ ID NO: 62975 - DNA, 201 bp, Bos taurus; identical to SEQ ID NO: 22442

SEQ ID NO: 62976 - DNA, 201 bp, Bos taurus; identical to SEQ ID NO: 22443

SEQ ID NO: 62977 - DNA, 201 bp, Bos taurus; identical to SEQ ID NO: 22444

SEQ ID NO: 62978 - DNA, 201 bp, Bos taurus; identical to SEQ ID NO: 22445

SEQ ID NO: 62979 - DNA, 201 bp, Bos taurus; identical to SEQ ID NO: 22446

SEQ ID NO: 62980 - DNA, 201 bp, Bos taurus; identical to SEQ ID NO: 22447

SEQ ID NO: 62981 - DNA, 201 bp, Bos taurus; identical to SEQ ID NO: 22448

SEQ ID NO: 62982 - DNA, 201 bp, Bos taurus; identical to SEQ ID NO: 22449

SEQ ID NO: 62983 - DNA, 201 bp, Bos taurus
aacatgaaacagctagaggaaaattttaaagcagaggtcagcatactgtattctgtaggccaaacctggccccatggcctgtttatataaggaaaattgtattggaacacagccatgtccatttctttgcataattgtctatgactgcttcagtgctacaacagcatcggcgaatgattctgacagagaccatatggcccg

SEQ ID NO: 62984 - DNA, 201 bp, Bos taurus; identical to SEQ ID NO: 22450

SEQ ID NO: 62985 - DNA, 201 bp, Bos taurus; identical to SEQ ID NO: 22452

SEQ ID NO: 62986 - DNA, 201 bp, Bos taurus
tattactttattcggtttgacagtctctaggtccatccacattgcttcaaatggcattatttcgttctttttatggctaagcagaatttcattgtatatatgtaccacatcttatttatccattcctctgttgatgaacatttaggttgcttctatgtcttggctaatgtaaatactgctacagtgaacttggggtacatg

SEQ ID NO: 62987 - DNA, 201 bp, Bos taurus
gagtatttaattactgacactattgagaactgctggtacatggagttgtagtatggttttagaacgctctgtagattagacatccatctattacctgtacctctcattatatggactcctttgaaggccactgaaatgccactgaaaacaccttctctgagaggtttataagcaggcttagggaatagattcagtcctgat

SEQ ID NO: 62988 - DNA, 201 bp, Bos taurus
atgatagaagcttgaagccacccttgtttgacattatgcatgccccatggggaaatccatttgattcaggttcctgagagatatgatttccaagactatccccctgtacttgaagtatgacaagattaatttcctgccaatgccctgccttgagtcataatatcatctaatattcatggagcacttaatacattccaagtc

SEQ ID NO: 62989 - DNA, 201 bp, Bos taurus
atttcaattctaacagatgattgcaacttatcctatgattgctttatatatggctctttgtttacttatggattgtgacagccaacaggaaagttgtatggccctcagcaaaaacacagttctcaggagaattaccaggacaactgggcttctcagtgaggtggctgagggcctcaagaatcagccaaggcacatgtgtgg

SEQ ID NO: 62990 - DNA, 201 bp, Bos taurus
acccttttagtgtctcctaatttcaatctgatacacaaacccaacaactcaattccttagttgatattgttgggccctttatagccaattaaaatcagtccttcttactatggtagttaagggcccccacaacctgatctccgtctattctggtgatcctcaagctgcggggcagggggtggcagtggagcgtatctgtag

SEQ ID NO: 62991 - DNA, 201 bp, Bos taurus; identical to SEQ ID NO: 22453

SEQ ID NO: 62992 - DNA, 201 bp, Bos taurus; identical to SEQ ID NO: 22454

SEQ ID NO: 62993 - DNA, 201 bp, Bos taurus; identical to SEQ ID NO: 22459

SEQ ID NO: 62994 - DNA, 201 bp, Bos taurus; identical to SEQ ID NO: 22460

SEQ ID NO: 62995 - DNA, 201 bp, Bos taurus; identical to SEQ ID NO: 22461

SEQ ID NO: 62996 - DNA, 201 bp, Bos taurus; identical to SEQ ID NO: 22462

SEQ ID NO: 62997 - DNA, 201 bp, Bos taurus; identical to SEQ ID NO: 22463

SEQ ID NO: 62998 - DNA, 201 bp, Bos taurus; identical to SEQ ID NO: 22464

SEQ ID NO: 62999 - DNA, 201 bp, Bos taurus; identical to SEQ ID NO: 22465

SEQ ID NO: 63000 - DNA, 201 bp, Bos taurus; identical to SEQ ID NO: 22466

SEQ ID NO: 63001 - DNA, 201 bp, Bos taurus; identical to SEQ ID NO: 22467

SEQ ID NO: 63002 - DNA, 201 bp, Bos taurus; identical to SEQ ID NO: 22468

SEQ ID NO: 63003 - DNA, 201 bp, Bos taurus; identical to SEQ ID NO: 22469

SEQ ID NO: 63004 - DNA, 201 bp, Bos taurus; identical to SEQ ID NO: 22470

SEQ ID NO: 63005 - DNA, 201 bp, Bos taurus; identical to SEQ ID NO: 22471

SEQ ID NO: 63006 - DNA, 201 bp, Bos taurus; identical to SEQ ID NO: 22472

SEQ ID NO: 63007 - DNA, 201 bp, Bos taurus; identical to SEQ ID NO: 22473

SEQ ID NO: 63008 - DNA, 201 bp, Bos taurus; identical to SEQ ID NO: 22474

SEQ ID NO: 63009 - DNA, 201 bp, Bos taurus; identical to SEQ ID NO: 22475

SEQ ID NO: 63010 - DNA, 201 bp, Bos taurus; identical to SEQ ID NO: 22476

SEQ ID NO: 63011 - DNA, 201 bp, Bos taurus; identical to SEQ ID NO: 22477

SEQ ID NO: 63012 - DNA, 201 bp, Bos taurus; identical to SEQ ID NO: 22478

SEQ ID NO: 63013 - DNA, 201 bp, Bos taurus; identical to SEQ ID NO: 22479

SEQ ID NO: 63014 - DNA, 201 bp, Bos taurus; identical to SEQ ID NO: 22480

SEQ ID NO: 63015 - DNA, 201 bp, Bos taurus; identical to SEQ ID NO: 22481

SEQ ID NO: 63016 - DNA, 201 bp, Bos taurus; identical to SEQ ID NO: 22483

SEQ ID NO: 63017 - DNA, 201 bp, Bos taurus; identical to SEQ ID NO: 22484

SEQ ID NO: 63018 - DNA, 201 bp, Bos taurus; identical to SEQ ID NO: 22485

SEQ ID NO: 63019 - DNA, 201 bp, Bos taurus
ggccttgtgcaggccaaggaagcccattcagggacagaagcgggcatgagagaattaggcatgtgccatgttgtattatttgttcaaaatattttctgccgtcttctacaaggcccttctctggcacctctctattggaagagtgtatttcctacagcacggatgtcgatcttggccacatggtttgttttagccaatgga

SEQ ID NO: 63020 - DNA, 201 bp, Bos taurus
acccctggctcatctggctccaacgcagacctcggcaggggaccctggagctggtcagtggacagtccctctgagtgacatgtctcacctcaggcacatgcctggccatctctctgctttctgccttgggactttctccaaagtctgcttggtccacatggacgtgatgtagaagtgtgggagtgttaacgccttagggga

SEQ ID NO: 63021 - DNA, 201 bp, Bos taurus; identical to SEQ ID NO: 22486

SEQ ID NO: 63022 - DNA, 201 bp, Bos taurus; identical to SEQ ID NO: 22487

SEQ ID NO: 63023 - DNA, 201 bp, Bos taurus
acctgagctggcttttagggcctttttagctggtgtgcagccaggcctccacacatacctgggctgcattttgatgacttaggtttactaaaaaattctttggggccatttacaagggaccctcttgaatcacagagtggatttaaagcattccagagcagaaaagcacagcagtaaagtcagctacagagtcccacctta

SEQ ID NO: 63024 - DNA, 201 bp, Bos taurus; identical to SEQ ID NO: 22488

SEQ ID NO: 63025 - DNA, 201 bp, Bos taurus
atgtagcttgactaaatataataaacctgagactcaaaaactttatactgaaatatcagtgacaccataaagaatatgaagtaaatgaataataggttcatgaagggtggatgaaagagaattatataaggagggatatttacaatccaacatgagggggcaaaagtcaaagagacttttgattgatgggcttaagccaaa

SEQ ID NO: 63026 - DNA, 201 bp, Bos taurus
attgaaattcttcccgagatatgcagctaactctctatgagtttgtttatctaaaacagggaatgcctccttctgttttttcatcctaaattcctttcaggatgcattgttggttggttctgagttctgacttaactcttgtataacttgttgttacatatctttttaatcagtagtatgtggttattcacagtattttaa

SEQ ID NO: 63027 - DNA, 201 bp, Bos taurus; identical to SEQ ID NO: 22489

SEQ ID NO: 63028 - DNA, 201 bp, Bos taurus
gccacaactactgaagcccttgcaccctagagcccatgctccgcaataaaagaagccaccgcgatgagaagccctcacgcaactagagagtagcccctgctcaggacaactagagaaaatccagttaaggaccaaaggcccagtatggccaaaaagaaagaggaaaaaagggaatgggtcttggactctcttaagcccctg

SEQ ID NO: 63029 - DNA, 201 bp, Bos taurus
atcaaagctatctataatctctaaaagatgtccttataatactaatttaatcaagctgcaaaaaaaaaaaaaaaccaaactaccatatagaaaggaatatgccatcatcatcactctttgaaattcatgcacttgttgcaagttgccattctagaccaatgtatatcccttgctctctgaaatgtatcaggtgtttcatct

SEQ ID NO: 63030 - DNA, 201 bp, Bos taurus
ggaaatcccatggacagaggaacctggcaagctacagtccatggggtcgcaaagaataggacatgactgagcgactaacacacacacacacacgtatgctaggcattctgcagcttgtgtctttgcaggcctagccagaaggactgttttaacagcctcagctactccatctgctgctcacttttcacaatggtaaccaaa

SEQ ID NO: 63031 - DNA, 201 bp, Bos taurus
ctctctaatgaccgtgaaccaccctgcctggaaatgcgtgtgcaggcagcaccctgtcctcctcgacttttctgatggtctgtgggggtgcttatcccaccctggtcctcccatggcctggcgcatgcggtgaatgcagaggcggctggagtgccttccgcctgcaccttggagcagacatcaaattaactctggcccttc

SEQ ID NO: 63032 - DNA, 201 bp, Bos taurus
gcatttggtgttgaggttgtctctattcttcagtttgacacttaatttgttaccggtttatttgtgttttgcatatttctaaaaatgattttgagatagctcaaaacaaggccaaagcctattaaaacaagaaaaaatataaggtccaaatggagaagagggaattagagatgaagaataggaggataattataattatat

SEQ ID NO: 63033 - DNA, 201 bp, Bos taurus
agaagaaaataaaaaccacacgggcagacagagagcccccactttacacactgtggctcagactcagagaggttaaaggcctggcccccggtggcccagcgggctgcatgggtcccagaacagtactggtttagtggtctgctccctgcggcaggtaccatactgactaagttctagttctggactaggttctagacatgt

SEQ ID NO: 63034 - DNA, 201 bp, Bos taurus
cccctcctggttgccctggcaatggaacatcaccttacaggaatgaaataagattgagaagaaacccacaagcacaggggcgtttccgggtctacagactcgctgtttctctctctactttggcctagggaaggcgggaaacagggaaggtagctgtgtatgtcttttactcattggcacctgcctgggaggaaacttcgg

SEQ ID NO: 63035 - DNA, 201 bp, Bos taurus; identical to SEQ ID NO: 22501

SEQ ID NO: 63036 - DNA, 201 bp, Bos taurus; identical to SEQ ID NO: 22504

SEQ ID NO: 63037 - DNA, 201 bp, Bos taurus
atcaaggggctggaagactatgtgacatggcaaactgtgaaaaattcatccagctggattaatgtcagattcaccggcctttagttctaactcgtgagcacagcctggtcatcaatgaagggtattcctgtgagcactgaccaggactagacactgaaaccagggcaccaggaggaggcctttaactcacagccttttaca

SEQ ID NO: 63038 - DNA, 201 bp, Bos taurus; identical to SEQ ID NO: 22505

SEQ ID NO: 63039 - DNA, 201 bp, Bos taurus
agccaaagacggcgaaggcgccaacacaaaccagccagcttcctgcctctccagatcccacagccctcagtcccggcgggatccctccctgggcaggaccactttcccagggaggcaggccatttgaaaagcctcttctgccagtaaggctggaccaccaagtaagatggggcccagctcccctgcacagtcatccacccc

SEQ ID NO: 63040 - DNA, 201 bp, Bos taurus; identical to SEQ ID NO: 22506

SEQ ID NO: 63041 - DNA, 201 bp, Bos taurus
tacatcaaactaggtcctggacacggatgccaagcaattaaatgggcagtcatgaagcatgcaaatagcgagagaagacagggccttgatttaaacacacaaagtctggaggctgagagagtagtgcagagggaagcatagaacacttcacccatctgcaggaattcactctgcgagggcctcaaacactgtgcgagtaaa

SEQ ID NO: 63042 - DNA, 201 bp, Bos taurus
accagtaccaggccacggcccaggggttggggacccctgctctaaagaacataaactgggtgtagacgagataagctgtgtgatatccattccatagttcgtgaacctctttctcctttggccaaccaatcacaacctacaatatactatagaagcatacattagtatggagttgtgaactgttggggtttaaaaatatta

SEQ ID NO: 63043 - DNA, 201 bp, Bos taurus; identical to SEQ ID NO: 22507

SEQ ID NO: 63044 - DNA, 201 bp, Bos taurus
tgtatattttggcagatagtgcccgatttagttgtaataattcacagcactgcttcggggcttccatgttgctccaggcaaaaccctgtattataaattacagcacacaaagctgaatttgacctaccagttgatgcataatcaactgacttaattctgaatattaactacacattgtggcctaaaggttttatgctctct

SEQ ID NO: 63045 - DNA, 201 bp, Bos taurus
aagtccagccacatgtcttggaaagactcttgagaagagcatctcctgtcaagggagactaggtatccagcttacttaggagcagttatgacatcctctcggtgtgattgtggtaccagatggtaccagaaggtgacatgacacataagggaccactgactccaaatctgcccccttcacatccactatacatagcccttg

SEQ ID NO: 63046 - DNA, 201 bp, Bos taurus
tggctcagctcccagggcaaggccaaggtagagcaaaatcttgcacccaggtccctgacttccggccaggattcccggccacgcctctcttcaggaaccagctcttggcgtagttcttggcaattcctcttcagctccatccaccacccctgtgcacactagcaggcctctttcttccaggaatgattacacagaaaatgg

SEQ ID NO: 63047 - DNA, 201 bp, Bos taurus; identical to SEQ ID NO: 22509

SEQ ID NO: 63048 - DNA, 201 bp, Bos taurus
gcacacataccgatttaatatttcttatgttctctacgtttacttcctgactagcagtatcttctcctcaacttttacaaatttctacaaatttaagcatacgaaatatgcttaaaatatcaagtgagtattttgcagccactctactttgagaatctgccaggcctactcagagcatgattctgaaatatttttgctttg

SEQ ID NO: 63049 - DNA, 201 bp, Bos taurus; identical to SEQ ID NO: 22510

SEQ ID NO: 63050 - DNA, 201 bp, Bos taurus; identical to SEQ ID NO: 22511

SEQ ID NO: 63051 - DNA, 201 bp, Bos taurus; identical to SEQ ID NO: 22512

SEQ ID NO: 63052 - DNA, 201 bp, Bos taurus; identical to SEQ ID NO: 22513

SEQ ID NO: 63053 - DNA, 201 bp, Bos taurus; identical to SEQ ID NO: 22514

SEQ ID NO: 63054 - DNA, 201 bp, Bos taurus; identical to SEQ ID NO: 22515

SEQ ID NO: 63055 - DNA, 201 bp, Bos taurus; identical to SEQ ID NO: 22516

SEQ ID NO: 63056 - DNA, 201 bp, Bos taurus; identical to SEQ ID NO: 22517

SEQ ID NO: 63057 - DNA, 201 bp, Bos taurus; identical to SEQ ID NO: 22518

SEQ ID NO: 63058 - DNA, 201 bp, Bos taurus; identical to SEQ ID NO: 22519

SEQ ID NO: 63059 - DNA, 201 bp, Bos taurus; identical to SEQ ID NO: 22520

SEQ ID NO: 63060 - DNA, 201 bp, Bos taurus
agattgcttattaaaaatgattttataatgaagttgcctcaaatagcagctcttttcctggttgtccttgaagctgtggtgaagaatctcagagacaactatctagggttttcctccttgttaaaaacttctctctcaccactgttactcttgatttttaaggagacaaagtctaactgacacaagtccctctccagttga

SEQ ID NO: 63061 - DNA, 201 bp, Bos taurus
ctgaatgctagatacaaggaagctttgctgttacagtaagacaggcccattgactgcccactgcatggtattatccacccatcacggaagcctggctaaaaatcccgaaggccaagtttgttaaacaaaatggttatttggtaaggcctgcaaaagggccaagggtggaaggacacacaccagttgaagcacaggatttgt

SEQ ID NO: 63062 - DNA, 201 bp, Bos taurus
agaatttcttaaaatttttataccaaatttttgtaccacaaccatagtcctagttgtgatatgactgactcagcacttaacccactaggtagtaaagcatgaagattttaaattttgttttaatttctttgagatacatgacctaggctgtatcttttgaccatgtcatgaatggcctttgtgatgccactgtaatttttg

SEQ ID NO: 63063 - DNA, 201 bp, Bos taurus; identical to SEQ ID NO: 22522

SEQ ID NO: 63064 - DNA, 201 bp, Bos taurus; identical to SEQ ID NO: 22523

SEQ ID NO: 63065 - DNA, 201 bp, Bos taurus; identical to SEQ ID NO: 22524

SEQ ID NO: 63066 - DNA, 201 bp, Bos taurus; identical to SEQ ID NO: 22525

SEQ ID NO: 63067 - DNA, 201 bp, Bos taurus; identical to SEQ ID NO: 22526

SEQ ID NO: 63068 - DNA, 201 bp, Bos taurus; identical to SEQ ID NO: 22527

SEQ ID NO: 63069 - DNA, 201 bp, Bos taurus; identical to SEQ ID NO: 22528

SEQ ID NO: 63070 - DNA, 201 bp, Bos taurus; identical to SEQ ID NO: 22529

SEQ ID NO: 63071 - DNA, 201 bp, Bos taurus; identical to SEQ ID NO: 22530

SEQ ID NO: 63072 - DNA, 201 bp, Bos taurus; identical to SEQ ID NO: 22531

SEQ ID NO: 63073 - DNA, 201 bp, Bos taurus; identical to SEQ ID NO: 22532

SEQ ID NO: 63074 - DNA, 201 bp, Bos taurus; identical to SEQ ID NO: 22533

SEQ ID NO: 63075 - DNA, 201 bp, Bos taurus; identical to SEQ ID NO: 22534

SEQ ID NO: 63076 - DNA, 201 bp, Bos taurus; identical to SEQ ID NO: 22535

SEQ ID NO: 63077 - DNA, 201 bp, Bos taurus; identical to SEQ ID NO: 22536

SEQ ID NO: 63078 - DNA, 201 bp, Bos taurus; identical to SEQ ID NO: 22537

SEQ ID NO: 63079 - DNA, 201 bp, Bos taurus; identical to SEQ ID NO: 22538

SEQ ID NO: 63080 - DNA, 201 bp, Bos taurus; identical to SEQ ID NO: 22539

SEQ ID NO: 63081 - DNA, 201 bp, Bos taurus; identical to SEQ ID NO: 22540

SEQ ID NO: 63082 - DNA, 201 bp, Bos taurus; identical to SEQ ID NO: 22541

SEQ ID NO: 63083 - DNA, 201 bp, Bos taurus; identical to SEQ ID NO: 22542

SEQ ID NO: 63084 - DNA, 201 bp, Bos taurus; identical to SEQ ID NO: 22543

SEQ ID NO: 63085 - DNA, 201 bp, Bos taurus; identical to SEQ ID NO: 22545

SEQ ID NO: 63086 - DNA, 201 bp, Bos taurus
ctgatttactgtggggctttaatgagctaatagctaactgcctggcaaagtattaataacttatctacaggaagtgctcagtaagtatttaaatggccttgcataccgggagcaagtgaagttgtgtagactggaggaactccccatgctctcctccctcagagcccagggctggaggctggccttgggtgcgacttgtgc

SEQ ID NO: 63087 - DNA, 201 bp, Bos taurus
gcaagtctagtcctgaaaaaatgaaaatgttggcaaatgagttagcaaacatgggctgctagtgaggagggaaaaaatgactatctgtggccttgggaaattttctctacttgggctgatgatcttggcagtggctgagaggagccagaagggaaaaggagaggcttcagtggtcatcactctggaatgtgatggctgatg

SEQ ID NO: 63088 - DNA, 201 bp, Bos taurus
tatagatgagaaatataatgttgtacacatgagacatataatgttataaatcagtgtcaacaattaaaaaaattcactcaaattcacatcactggagaagagtttttctagtgagttattgagtagttactttacattctaatttaataattagataggcagaaaaattttgaaacattttaatgaggcatactaatgaat

SEQ ID NO: 63089 - DNA, 201 bp, Bos taurus; identical to SEQ ID NO: 22547

SEQ ID NO: 63090 - DNA, 201 bp, Bos taurus; identical to SEQ ID NO: 22548

SEQ ID NO: 63091 - DNA, 201 bp, Bos taurus; identical to SEQ ID NO: 22549

SEQ ID NO: 63092 - DNA, 201 bp, Bos taurus; identical to SEQ ID NO: 22550

SEQ ID NO: 63093 - DNA, 201 bp, Bos taurus; identical to SEQ ID NO: 22551

SEQ ID NO: 63094 - DNA, 201 bp, Bos taurus; identical to SEQ ID NO: 22552

SEQ ID NO: 63095 - DNA, 201 bp, Bos taurus
ataaggcatgcagacctgctgcttcagaggttctagagtctactcagaacatctggagctgtgacactagtttatatttcaaggaggttgtggggtaggcgtctgataagcttcccatggtccctgtcaggaactgagggttttcagaatctgtcctacgtctagctggagatctttggatggcttcagggccatctaagg

SEQ ID NO: 63096 - DNA, 201 bp, Bos taurus
agaaaataattttcattcatttgcatcaagaatgtgaaatattgggcaaattcaatctgaatgaagccatcttacattttaaaacttgctgcccctttgcatttccccctatagctgggtgtttttgtctcagaaggttgggttcctgcttagaaggaaggaaaccaatggctcaaccaaacctcatagtcctgacatgct

SEQ ID NO: 63097 - DNA, 201 bp, Bos taurus
ttggcagtcttagaaccagtgctactagcctgcctgtcgtcaccatggaaaccacatagtcttctagggagaaggagaaaaactgcctccctatcagctggtcccaggatctcaaagcagaaagcccatgtatagccttactcctcttctcctaagtgaccctccccagagcacaggagccgcctacccattcttttccac

SEQ ID NO: 63098 - DNA, 201 bp, Bos taurus; identical to SEQ ID NO: 22553

SEQ ID NO: 63099 - DNA, 201 bp, Bos taurus; identical to SEQ ID NO: 22554

SEQ ID NO: 63100 - DNA, 201 bp, Bos taurus
ttttcgccttttgggccctgaggaccaggctgtccgtctgatccgttgtgtcctggtaatccactggctccgggaggccctgcatcaaaacacgagaagcgggaacactgaaaaaaatgttcactgaagttaacattatttcctttagccagtgagactgggcaggcatcaaggcctctcccagagcttctcctgcttctt

SEQ ID NO: 63101 - DNA, 201 bp, Bos taurus
ccaatacaaatacaacaccaactgggccacctccagcatccacatagccatggaggcatcattatcctcacttttcctaacaagaaaatgcaggcccaagcaggtggagtaatgtgtctagtgagtagcagggcccagattcaaactccagcctggatggcaacaaggcctttgccccaccccctgagcatcactgctttc

SEQ ID NO: 63102 - DNA, 201 bp, Bos taurus
tttaaaaccattcttgtggttattgatacaagtactttttagaaaagtcccttaaacttcagtagaaaaaataaaatgcattcaaaagttaaaatacacacgtgtgcacatgcccataatgttcatctctctccataagaccaacaaaatgtttaaaaattttaacatttcacatacactactcaaaataccagtttacct

SEQ ID NO: 63103 - DNA, 201 bp, Bos taurus
tcattctttaacacttgcagtgttatggtgggttaaaaacagacagaaaatccaagactaaataaatagctgttttgggagaccacagagaataacttcagcctacacattactgtcatattgggataaaataaaataatgaacacgaaagccctttgaaaaatataaaagcatgctatgtacatgtaatatttggcttga

SEQ ID NO: 63104 - DNA, 201 bp, Bos taurus
cccccctcctgtgtttctgcttcttcttagtgttcatttgatttcattctggggttttttggtaatataataattcaaaataattttttaagaaatacaccggagtaattcttttagtggttttcagttctctgcctagtttaaaggcaaggagagccagttaagaaataacaacaaatatgtgtcctcaagtttgttttc

SEQ ID NO: 63105 - DNA, 201 bp, Bos taurus
tctgggtttctgttctggatcacagtgttatcttcttcagaacattcaggtttcactggaacattccagtttcacttgaacttagaggtccagttgtgtccggtgtcagatgggcaaggctcccactcgatcccagtgtgactcaccagagtcttctggtgtgctgaagtctaatttgctattaagcttatcgccgaatta

SEQ ID NO: 63106 - DNA, 201 bp, Bos taurus
attgtttaaatgcttttctcagggagagtatcacagttcctgttgttcaattaaaataatgcaactggatggatgtactgcaattattgctcttcctaacgtttgtgatttgcagagcacaacctgaccttcatataattaccacaccaaattactgccattaagatacctctagtggtttttctaaatagcagcatttta

SEQ ID NO: 63107 - DNA, 201 bp, Bos taurus
gttaaatcagtccttagttagatttttttgactgtcagaggcatgtaaaacaagtttcaacattttaaaactatccaagtattccttcccttgaatgataaaacttttaaaattaaatattcccatagtatgttcaaatgacagattcctgtgagcaataaatttgcttttcttctgtagagttggaagcaagtttttcct

SEQ ID NO: 63108 - DNA, 201 bp, Bos taurus; identical to SEQ ID NO: 22558

SEQ ID NO: 63109 - DNA, 201 bp, Bos taurus; identical to SEQ ID NO: 22559

SEQ ID NO: 63110 - DNA, 201 bp, Bos taurus
attttaaattcttccaaatacaggtaaatatcttttaagaatgttttccaagtaattttgttcagctcattattgttcttcgcctacgctattcccaccctgcttaccccacctttgctcaatcactgcagatgaatttgctacactctgtggaagtcaacggccaggctttgtcatcgacatctataccggtttacctgt

SEQ ID NO: 63111 - DNA, 201 bp, Bos taurus; identical to SEQ ID NO: 22566

SEQ ID NO: 63112 - DNA, 201 bp, Bos taurus
tgtcagctacaggtcataaagctttatagactcatgacctctgatctctgaccctgtgatttattttctctgagcagaagtgtgacccctcctccatctgagaaaaatgaggcaacgtggttgggtggcttctgccattcatcaggcagtgaaatgtgtctggttctcaattttccatctgcactcttgcttcaggccaac

SEQ ID NO: 63113 - DNA, 201 bp, Bos taurus; identical to SEQ ID NO: 22567

SEQ ID NO: 63114 - DNA, 201 bp, Bos taurus
cactggagcaagatgggccatactgggtacttggcatgggtctgggcatatactgaagtagttctggcatgccagtcagaactccaaatcagtcctgatccgccaatgctaggaatggccaccctcaccctgttcaggtcctatccagctccatcccccttgattgtacattttcttctttggaaacagcagcctttgccc

SEQ ID NO: 63115 - DNA, 201 bp, Bos taurus; identical to SEQ ID NO: 22569

SEQ ID NO: 63116 - DNA, 201 bp, Bos taurus
aatctctatatcttacaagtttgcttacatagttcttttgatttttgtgaagatttagaaacaaagaaataagggtggccaacaaagaaaaatttcattccattggagcttagagtatgtgtattggtggggagaggacacagcaagtagtgataaatgggcaacaggcactgaatataaggcatagaaagaggcctgaac

SEQ ID NO: 63117 - DNA, 201 bp, Bos taurus
cagcttggagcattccggcatgaccaagaatcctgaagagaccccagactcaggtgctgaggatcactatacttggcctctgtctgagctgctggaggtgagacaggtcatatagcctgtgtcaaccagggagaggtaagctgtttgagcacaccaagcactggccccaggctacagttggaaattactagactgttttaa

SEQ ID NO: 63118 - DNA, 201 bp, Bos taurus; identical to SEQ ID NO: 22570

SEQ ID NO: 63119 - DNA, 201 bp, Bos taurus; identical to SEQ ID NO: 22571

SEQ ID NO: 63120 - DNA, 201 bp, Bos taurus; identical to SEQ ID NO: 22572

SEQ ID NO: 63121 - DNA, 201 bp, Bos taurus; identical to SEQ ID NO: 22573

SEQ ID NO: 63122 - DNA, 201 bp, Bos taurus
gtgagaaccacaaaccctgatctacaacagtggaaatggaggcccagtgcagtgaggatcagtgaggggtggtgaaggtagcaggaggaggcctgcagtgtggctcccagattcccacatgtggcatgccttcacgtgatggagaattccacactccccggtcagaaagggatgtgaacaggctggtttaggggggctgca

SEQ ID NO: 63123 - DNA, 201 bp, Bos taurus; identical to SEQ ID NO: 22574

SEQ ID NO: 63124 - DNA, 201 bp, Bos taurus
cctccacggagctggaggccggacccgcgggtgaggccgggccgcacacatggtcgccgtccgggtcttgggcccgggctcgggcccccgtggcctgcagcagcgttcggaaggcaagctcgatgcggagcgagtcgtagccgatgaagggcttccaggtcttcttgtcctccttgtagaaccagcgcacctcctccgggc

SEQ ID NO: 63125 - DNA, 201 bp, Bos taurus
attttcctctcacatagattcagtctttgcttttttgaaagactttggattctggttatcaagttaccataggtctcctatagagaagaaaatctatatatatagcaattaaatatgatattttgtagtaagattttctgaattacagattaggattcattttttccccctttattcagggagtagaaacagaataaggga

SEQ ID NO: 63126 - DNA, 201 bp, Bos taurus
ccacacaactgagtgactcaggctggatttgaactcatctgtgtcaaactctgatcctcctaatcctaactactctctgcacctcagtctgcacctgttccccacctctgtctttacttcctcattcccagcctgggttgacagggcagatccttccatgtgaaactctctcctctacagactcgactcttccaagcctgt

SEQ ID NO: 63127 - DNA, 201 bp, Bos taurus
tccttaagaatctagactatcatgtgatccagcattcacactcctatgcatatatctggagaagaacatggtttaaatggaagcatgagcccaaattttcattgcagcgctatttacaataaccaagacatggaagcaacctaaatgttcattgacacaggaatggataaagaaaatgtggtatatacatacaatggaata

SEQ ID NO: 63128 - DNA, 201 bp, Bos taurus; identical to SEQ ID NO: 22575

SEQ ID NO: 63129 - DNA, 201 bp, Bos taurus; identical to SEQ ID NO: 22576

SEQ ID NO: 63130 - DNA, 201 bp, Bos taurus; identical to SEQ ID NO: 22577

SEQ ID NO: 63131 - DNA, 201 bp, Bos taurus; identical to SEQ ID NO: 22579

SEQ ID NO: 63132 - DNA, 201 bp, Bos taurus; identical to SEQ ID NO: 22580

SEQ ID NO: 63133 - DNA, 201 bp, Bos taurus
aatatgagctatggttaataaatgggaagcttaacaaggccagttactttgaatttctctttgtctgttcatcttcagaaataaggatcctcccttcctctaggtatagggaaggcctttctcacaccagggtcttaggacctgcttcagagtccaaagaggtcagttagtccttcctgcacctgtcatttctcaaatttc

SEQ ID NO: 63134 - DNA, 201 bp, Bos taurus
aagactccagcgccaggaaaaggtgccagaaagtggagacaactggaagagaaggaaacccctcaagggcaagagcccgatggttcatcagaaaacaaacagaactcctcagtggaagtttccacatctgtgtgatcagcagcatcatctggggaagtttaagaaacaaagcattccaagatggacaggaaggctggagcc

SEQ ID NO: 63135 - DNA, 201 bp, Bos taurus; identical to SEQ ID NO: 22581

SEQ ID NO: 63136 - DNA, 201 bp, Bos taurus; identical to SEQ ID NO: 22582

SEQ ID NO: 63137 - DNA, 201 bp, Bos taurus; identical to SEQ ID NO: 22584

SEQ ID NO: 63138 - DNA, 201 bp, Bos taurus; identical to SEQ ID NO: 22586

SEQ ID NO: 63139 - DNA, 201 bp, Bos taurus
ctacctattcttagggtttttgtgtaaggatccattcagaataattcactgtggagtcttttgcttctcagtagtatggcatttggggaacataaatgagtgatccagagcagctaaagtgctttggtttgactaaggagctttgggaactaatattgcaacatttgagcttgactttgcaaattccttctggacatgacc

SEQ ID NO: 63140 - DNA, 201 bp, Bos taurus; identical to SEQ ID NO: 22587

SEQ ID NO: 63141 - DNA, 201 bp, Bos taurus; identical to SEQ ID NO: 22588

SEQ ID NO: 63142 - DNA, 201 bp, Bos taurus; identical to SEQ ID NO: 22589

SEQ ID NO: 63143 - DNA, 201 bp, Bos taurus; identical to SEQ ID NO: 22590

SEQ ID NO: 63144 - DNA, 201 bp, Bos taurus; identical to SEQ ID NO: 22591

SEQ ID NO: 63145 - DNA, 201 bp, Bos taurus; identical to SEQ ID NO: 22592

SEQ ID NO: 63146 - DNA, 201 bp, Bos taurus
cagacctggttgagccccagaatagaccccaaagcaccgagtgatttgatgacattcccccgcgctttgctctcattaacatcctgcctgggctggtgagtggccctaccccatccacatgtgtcctgggggctggaactccacagggagagccccaggctgaattgctgccgctcctcctggggacctggaggcagtccc

SEQ ID NO: 63147 - DNA, 201 bp, Bos taurus; identical to SEQ ID NO: 22593

SEQ ID NO: 63148 - DNA, 201 bp, Bos taurus
acctgcagatggccatcttctctgtgtatctcttcacactgtcttccctctgcatgggtctacttctgtatcaaatttcccctttttcaaggacagcagtaatattgggttagggggcccattctattccagtatgacctcatcttaactaattgaatttatctgctgcaaacctattttccaagcaagatcacaatttga

SEQ ID NO: 63149 - DNA, 201 bp, Bos taurus; identical to SEQ ID NO: 22595

SEQ ID NO: 63150 - DNA, 201 bp, Bos taurus
atctttctctaataatcttttcttaaagtgtcttctgagattttaatggtttttatactcattaacaaaattaaggctctttaggttttgtcattatatatgaatatagttatacaagtatgaatgggcatacttaattaaaaaaaaaaacctttacaatataaattagagaattccctggtggtccatggttaggactcg

SEQ ID NO: 63151 - DNA, 201 bp, Bos taurus; identical to SEQ ID NO: 22596

SEQ ID NO: 63152 - DNA, 201 bp, Bos taurus; identical to SEQ ID NO: 22597

SEQ ID NO: 63153 - DNA, 201 bp, Bos taurus; identical to SEQ ID NO: 22598

SEQ ID NO: 63154 - DNA, 201 bp, Bos taurus
aaggatcaatcggtagcatatgctgagggccaatcagttaattcaagtggttagaggtttgcacataaacctcttcagcagttatactttgggggttgtcatctatcagccaatggccctcatcttgtggcttttctgaattctcctgtctgttttttctgagccaattccagattgcaaggggtttaccaaagatttact

SEQ ID NO: 63155 - DNA, 201 bp, Bos taurus; identical to SEQ ID NO: 22599

SEQ ID NO: 63156 - DNA, 201 bp, Bos taurus; identical to SEQ ID NO: 22600

SEQ ID NO: 63157 - DNA, 201 bp, Bos taurus; identical to SEQ ID NO: 22601

SEQ ID NO: 63158 - DNA, 201 bp, Bos taurus; identical to SEQ ID NO: 22602

SEQ ID NO: 63159 - DNA, 201 bp, Bos taurus
agagccaaggaaacttcatttagacccagtatctaccttctcagcatcactttctttttcccaatagtggatcccactctcttcccagctaacagaggccgaagaaaagcatactggccacattagtatctcttgtggtctaataatgggaccctccctatacctgttcctctgccctcctgctttccgtatttactttac

SEQ ID NO: 63160 - DNA, 201 bp, Bos taurus
ccaagttctccaccactcagcccttctcccatcccatactaatttcacacagtcctcctttcccggcctgaatcctgcagtcaaattgtttagtaccctatctcctccttagattccccctttcttcctcatttgcttaatgctgattctcaggcacagaggactccagggcctttgtctacctgtatccttctctagctg

SEQ ID NO: 63161 - DNA, 201 bp, Bos taurus
gtggaatcagccttttttctatatggaatgagctctccacatgaaagagcacttctgttataaaatgaagggggaagagaggcttcacccaggccaggtctacctggtacctgtttcaaagcatgatgaaagcccccatctgcccctcctctatggcaacattggggcacgttgtccttcagatcaaacttgggctgtgtg

SEQ ID NO: 63162 - DNA, 201 bp, Bos taurus
aagtactacctagcaccttacatcaaactatgacacagcatccctgggaagcccccagaaatttctgtttgctttctattgaagccatcacctaagtgaccggatatgtgggtctctagagaccaggctgatgggattaattttctcttcctctttcctcacagtgcagcatgtacattggtgactactttttgtagaagg

SEQ ID NO: 63163 - DNA, 201 bp, Bos taurus
gaaatactgcatgttgatgataattagcagttggcctttaaaaataagttccaacagcttaaagagttgtagatataaaaataacctaatttaggtttcaattcctctgattaagcatgtgaaagtacgttttaaaatctgtcacattgaaaagactactgctctgtgctcttctgtatttttgtctctttgggttgaata

SEQ ID NO: 63164 - DNA, 201 bp, Bos taurus; identical to SEQ ID NO: 22603

SEQ ID NO: 63165 - DNA, 201 bp, Bos taurus
acagctgcctcttgctctctaaagttcggggccctcaccacctccacccacaacacctgggatcttagtggtgattcaaatgcacatgtctctttcaggtgggttgaaaacatcgttgcaggcctgtcctccaacctcgcccgctctgtatgtccccctggcagtgcacacagcacatgctggtttgttgactctggaaac

SEQ ID NO: 63166 - DNA, 201 bp, Bos taurus; identical to SEQ ID NO: 22604

SEQ ID NO: 63167 - DNA, 201 bp, Bos taurus; identical to SEQ ID NO: 22605

SEQ ID NO: 63168 - DNA, 201 bp, Bos taurus; identical to SEQ ID NO: 22606

SEQ ID NO: 63169 - DNA, 201 bp, Bos taurus; identical to SEQ ID NO: 22607

SEQ ID NO: 63170 - DNA, 201 bp, Bos taurus
gaccaaatactattgaaactcgctgttaataacttctgtctcactcttgtgcgttcccaaacgtctaacacaatgatcacatttgactccccccaaatagtgtgaaagtgttagttgttcagtcatgtccgattctttgcaaacccatggactgcagcctgccaggctcccctgtccgtgtgtttctccaggcaagaaaac

SEQ ID NO: 63171 - DNA, 201 bp, Bos taurus; identical to SEQ ID NO: 22608

SEQ ID NO: 63172 - DNA, 201 bp, Bos taurus; identical to SEQ ID NO: 22610

SEQ ID NO: 63173 - DNA, 201 bp, Bos taurus; identical to SEQ ID NO: 22612

SEQ ID NO: 63174 - DNA, 201 bp, Bos taurus; identical to SEQ ID NO: 22613

SEQ ID NO: 63175 - DNA, 201 bp, Bos taurus
gaatcagctataaatacacatatctcccctccctcttgaaccaccctccagcacccacccccatcccactcctctaggccatcacagagtgcagacgagcttcttttgctgtacagcatgttcccactagccatctatttcacatgtggtatggtaatgtatatatgtcaatcctagtctcacagtttgtcccggccaccc

SEQ ID NO: 63176 - DNA, 201 bp, Bos taurus; identical to SEQ ID NO: 22614

SEQ ID NO: 63177 - DNA, 201 bp, Bos taurus; identical to SEQ ID NO: 22615

SEQ ID NO: 63178 - DNA, 201 bp, Bos taurus
acccgagtctggttcctctctctttgccctccctgacccaccctggcccttccccaacctgctgtgggtgtccacctggcctgcttccccaaactccctccttctccaacctcaataggagcagaaggtccttagagtgagctgaaggggctgggccaggggatttctgaccctgcttgttgcccaactgcaggtgcccac

SEQ ID NO: 63179 - DNA, 201 bp, Bos taurus; identical to SEQ ID NO: 22617

SEQ ID NO: 63180 - DNA, 201 bp, Bos taurus; identical to SEQ ID NO: 22619

SEQ ID NO: 63181 - DNA, 201 bp, Bos taurus; identical to SEQ ID NO: 22620

SEQ ID NO: 63182 - DNA, 201 bp, Bos taurus; identical to SEQ ID NO: 22621

SEQ ID NO: 63183 - DNA, 201 bp, Bos taurus; identical to SEQ ID NO: 22622

SEQ ID NO: 63184 - DNA, 201 bp, Bos taurus; identical to SEQ ID NO: 22623

SEQ ID NO: 63185 - DNA, 201 bp, Bos taurus; identical to SEQ ID NO: 22624

SEQ ID NO: 63186 - DNA, 201 bp, Bos taurus
tttttttcctatgtaaactcttcatttgcaaagttaatacttgttcctaacaaattctaacaatatagatgtattttcagtgaaattgcctatcgtaactaatctcacctaggtaacccatcccatagagtctgctggctgagtcaggcacacaggagagtattttgtttttatttattgttagtgttaaaagtttttcaa

SEQ ID NO: 63187 - DNA, 201 bp, Bos taurus; identical to SEQ ID NO: 22627

SEQ ID NO: 63188 - DNA, 201 bp, Bos taurus; identical to SEQ ID NO: 22629

SEQ ID NO: 63189 - DNA, 201 bp, Bos taurus; identical to SEQ ID NO: 22631

SEQ ID NO: 63190 - DNA, 201 bp, Bos taurus; identical to SEQ ID NO: 22632

SEQ ID NO: 63191 - DNA, 201 bp, Bos taurus; identical to SEQ ID NO: 22633

SEQ ID NO: 63192 - DNA, 201 bp, Bos taurus; identical to SEQ ID NO: 22634

SEQ ID NO: 63193 - DNA, 201 bp, Bos taurus; identical to SEQ ID NO: 22635

SEQ ID NO: 63194 - DNA, 201 bp, Bos taurus; identical to SEQ ID NO: 22637

SEQ ID NO: 63195 - DNA, 201 bp, Bos taurus; identical to SEQ ID NO: 22638

SEQ ID NO: 63196 - DNA, 201 bp, Bos taurus
tagcaaacgtgtattttgcatattttggttaaaatatatcattaagattaatgtgactaagaaaaatctaaaatgacctctgtggccgcattgtatttctgggggacagtattgtgctcggtgtttgcttcccatccattccttcctcccctttctatttttttgcacctgcttctctttgcctgggccctcaccttcctc

SEQ ID NO: 63197 - DNA, 201 bp, Bos taurus
gtaaccaggccacaggcactcctgccatctcgacgggactctgcctctgggggatggccccttttgatgaaaaattggccccatttcctccactgagaatgtgcattcagactttcaaagagatgttccaggttgctgtagggaacagagttgtgaggtcatggcagtgcgtcagggccatgccagaccatgtacaagacg

SEQ ID NO: 63198 - DNA, 201 bp, Bos taurus; identical to SEQ ID NO: 22641

SEQ ID NO: 63199 - DNA, 201 bp, Bos taurus; identical to SEQ ID NO: 22643

SEQ ID NO: 63200 - DNA, 201 bp, Bos taurus; identical to SEQ ID NO: 22644

SEQ ID NO: 63201 - DNA, 201 bp, Bos taurus; identical to SEQ ID NO: 22646

SEQ ID NO: 63202 - DNA, 201 bp, Bos taurus; identical to SEQ ID NO: 22648

SEQ ID NO: 63203 - DNA, 201 bp, Bos taurus; identical to SEQ ID NO: 22649

SEQ ID NO: 63204 - DNA, 201 bp, Bos taurus; identical to SEQ ID NO: 22651

SEQ ID NO: 63205 - DNA, 201 bp, Bos taurus
ggcagttgcctcatctccctgggcctttacttctttaggattgcaagcctcttcagcagctttgaggaaaccataaaggcattcagcaccatgtgagtctcgtgatagagaatggtgggccagtgcaacagtacatgtttattttaaggaaattacctttatccttctcaagacatgggaggcagctcaggaactgaaaaa

SEQ ID NO: 63206 - DNA, 201 bp, Bos taurus
gacgtcccatgtcccgtgacgacgcccccttttcctcccagcccctcctctccttccctttgtgtgtcccagctgccctggtgagaggggccaaggagactgtcctccttaggaacaatctcccctttctctctggggtgtaagtgatacaggagaagaggaagcaatttgtaactaatcggctgtgatgtggaacagagc

SEQ ID NO: 63207 - DNA, 201 bp, Bos taurus; identical to SEQ ID NO: 22658

SEQ ID NO: 63208 - DNA, 201 bp, Bos taurus; identical to SEQ ID NO: 22659

SEQ ID NO: 63209 - DNA, 201 bp, Bos taurus; identical to SEQ ID NO: 22660

SEQ ID NO: 63210 - DNA, 201 bp, Bos taurus; identical to SEQ ID NO: 22661

SEQ ID NO: 63211 - DNA, 201 bp, Bos taurus; identical to SEQ ID NO: 22664

SEQ ID NO: 63212 - DNA, 201 bp, Bos taurus
ggaggcctcagctggcccccgaggatgctatagaactgaaatgacctttcagatttgtgagtcatggtgggggggctagggcacagtttacatacttcctttctgccaacctgtccttggatatgggctgcctgggacaagaatgtaaccttgagtaatggggccgtcgctagaaagggctgagggtagcagtggaggtag

SEQ ID NO: 63213 - DNA, 201 bp, Bos taurus; identical to SEQ ID NO: 22665

SEQ ID NO: 63214 - DNA, 201 bp, Bos taurus
ctggtcaagggcagttcccaggagaaggctgtagtccttagaagctagagatggccaggcacaccaggggtgtgggggccaatggatctgagcaggacacgagcaccatctactacagagaggggctatgaggcagggtccggtgggggcctcagtctctgcgcctccttgtgggtctctctggaatttgatggtggattt

SEQ ID NO: 63215 - DNA, 201 bp, Bos taurus; identical to SEQ ID NO: 22666

SEQ ID NO: 63216 - DNA, 201 bp, Bos taurus; identical to SEQ ID NO: 22667

SEQ ID NO: 63217 - DNA, 201 bp, Bos taurus; identical to SEQ ID NO: 22668

SEQ ID NO: 63218 - DNA, 201 bp, Bos taurus; identical to SEQ ID NO: 22669

SEQ ID NO: 63219 - DNA, 201 bp, Bos taurus; identical to SEQ ID NO: 22670

SEQ ID NO: 63220 - DNA, 201 bp, Bos taurus; identical to SEQ ID NO: 22671

SEQ ID NO: 63221 - DNA, 201 bp, Bos taurus; identical to SEQ ID NO: 22672

SEQ ID NO: 63222 - DNA, 201 bp, Bos taurus; identical to SEQ ID NO: 22673

SEQ ID NO: 63223 - DNA, 201 bp, Bos taurus; identical to SEQ ID NO: 22674

SEQ ID NO: 63224 - DNA, 201 bp, Bos taurus; identical to SEQ ID NO: 22675

SEQ ID NO: 63225 - DNA, 201 bp, Bos taurus; identical to SEQ ID NO: 22676

SEQ ID NO: 63226 - DNA, 201 bp, Bos taurus
cttcctgaccctgggcttctgtggatttcaagctcctcagacctcacagaggctctggcaggcctgccccactgggctctgtgccaggcccagatgccccggctcaggcaggaagacttcatgcctacatgactatttaccatttgcttggagactgtcatgggtcatctggccttctcttttccaactcaataatcctgt

SEQ ID NO: 63227 - DNA, 201 bp, Bos taurus; identical to SEQ ID NO: 22677

SEQ ID NO: 63228 - DNA, 201 bp, Bos taurus; identical to SEQ ID NO: 22678

SEQ ID NO: 63229 - DNA, 201 bp, Bos taurus; identical to SEQ ID NO: 22679

SEQ ID NO: 63230 - DNA, 201 bp, Bos taurus; identical to SEQ ID NO: 22680

SEQ ID NO: 63231 - DNA, 201 bp, Bos taurus; identical to SEQ ID NO: 22681

SEQ ID NO: 63232 - DNA, 201 bp, Bos taurus; identical to SEQ ID NO: 22682

SEQ ID NO: 63233 - DNA, 201 bp, Bos taurus; identical to SEQ ID NO: 22683

SEQ ID NO: 63234 - DNA, 201 bp, Bos taurus; identical to SEQ ID NO: 22684

SEQ ID NO: 63235 - DNA, 201 bp, Bos taurus; identical to SEQ ID NO: 22685

SEQ ID NO: 63236 - DNA, 201 bp, Bos taurus; identical to SEQ ID NO: 22686

SEQ ID NO: 63237 - DNA, 201 bp, Bos taurus; identical to SEQ ID NO: 22687

SEQ ID NO: 63238 - DNA, 201 bp, Bos taurus; identical to SEQ ID NO: 22688

SEQ ID NO: 63239 - DNA, 201 bp, Bos taurus; identical to SEQ ID NO: 22689

SEQ ID NO: 63240 - DNA, 201 bp, Bos taurus; identical to SEQ ID NO: 22690

SEQ ID NO: 63241 - DNA, 201 bp, Bos taurus; identical to SEQ ID NO: 22691

SEQ ID NO: 63242 - DNA, 201 bp, Bos taurus; identical to SEQ ID NO: 22692

SEQ ID NO: 63243 - DNA, 201 bp, Bos taurus; identical to SEQ ID NO: 22693

SEQ ID NO: 63244 - DNA, 201 bp, Bos taurus; identical to SEQ ID NO: 22694

SEQ ID NO: 63245 - DNA, 201 bp, Bos taurus; identical to SEQ ID NO: 22695

SEQ ID NO: 63246 - DNA, 201 bp, Bos taurus; identical to SEQ ID NO: 22696

SEQ ID NO: 63247 - DNA, 201 bp, Bos taurus; identical to SEQ ID NO: 22697

SEQ ID NO: 63248 - DNA, 201 bp, Bos taurus; identical to SEQ ID NO: 22698

SEQ ID NO: 63249 - DNA, 201 bp, Bos taurus; identical to SEQ ID NO: 22699

SEQ ID NO: 63250 - DNA, 201 bp, Bos taurus; identical to SEQ ID NO: 22700

SEQ ID NO: 63251 - DNA, 201 bp, Bos taurus; identical to SEQ ID NO: 22701

SEQ ID NO: 63252 - DNA, 201 bp, Bos taurus; identical to SEQ ID NO: 22702

SEQ ID NO: 63253 - DNA, 201 bp, Bos taurus; identical to SEQ ID NO: 22703

SEQ ID NO: 63254 - DNA, 201 bp, Bos taurus; identical to SEQ ID NO: 22704

SEQ ID NO: 63255 - DNA, 201 bp, Bos taurus; identical to SEQ ID NO: 22705

SEQ ID NO: 63256 - DNA, 201 bp, Bos taurus; identical to SEQ ID NO: 22706

SEQ ID NO: 63257 - DNA, 201 bp, Bos taurus; identical to SEQ ID NO: 22707

SEQ ID NO: 63258 - DNA, 201 bp, Bos taurus; identical to SEQ ID NO: 22708

SEQ ID NO: 63259 - DNA, 201 bp, Bos taurus; identical to SEQ ID NO: 22709

SEQ ID NO: 63260 - DNA, 201 bp, Bos taurus; identical to SEQ ID NO: 22710

SEQ ID NO: 63261 - DNA, 201 bp, Bos taurus; identical to SEQ ID NO: 22712

SEQ ID NO: 63262 - DNA, 201 bp, Bos taurus
cctaagcatggaaatttcaggattatgggagaattgattatgaatcattgacatctaagacattggatttcatggagaattataaaaagatgagcaaaaaagggaaaaagaaattgaaaaataaaatttatgtttttctaggtaatatatgttaacacaatccttgtctcttttcactgcaataattacaagttcaaaaaa

SEQ ID NO: 63263 - DNA, 201 bp, Bos taurus; identical to SEQ ID NO: 22713

SEQ ID NO: 63264 - DNA, 201 bp, Bos taurus; identical to SEQ ID NO: 22714

SEQ ID NO: 63265 - DNA, 201 bp, Bos taurus; identical to SEQ ID NO: 22715

SEQ ID NO: 63266 - DNA, 201 bp, Bos taurus
caggaaaaaaaagaaacaaagacaaaaaaggcaagaggattccaactgaaatttgacaacaatgactatatgaagtattccagcttcttgaattggttaacgaggaaatgcactgggaaaaatgtttcagaagcaaattgattaggcatctcacagaataaacgatgtgactgttggaaatttaaaggtcaagagtaaact

SEQ ID NO: 63267 - DNA, 201 bp, Bos taurus; identical to SEQ ID NO: 22716

SEQ ID NO: 63268 - DNA, 201 bp, Bos taurus; identical to SEQ ID NO: 22717

SEQ ID NO: 63269 - DNA, 201 bp, Bos taurus; identical to SEQ ID NO: 22718

SEQ ID NO: 63270 - DNA, 201 bp, Bos taurus; identical to SEQ ID NO: 22719

SEQ ID NO: 63271 - DNA, 201 bp, Bos taurus; identical to SEQ ID NO: 22721

SEQ ID NO: 63272 - DNA, 201 bp, Bos taurus; identical to SEQ ID NO: 22722

SEQ ID NO: 63273 - DNA, 201 bp, Bos taurus; identical to SEQ ID NO: 22724

SEQ ID NO: 63274 - DNA, 201 bp, Bos taurus; identical to SEQ ID NO: 22734

SEQ ID NO: 63275 - DNA, 201 bp, Bos taurus; identical to SEQ ID NO: 22736

SEQ ID NO: 63276 - DNA, 201 bp, Bos taurus; identical to SEQ ID NO: 22739

SEQ ID NO: 63277 - DNA, 201 bp, Bos taurus; identical to SEQ ID NO: 22740

SEQ ID NO: 63278 - DNA, 201 bp, Bos taurus; identical to SEQ ID NO: 22741

SEQ ID NO: 63279 - DNA, 201 bp, Bos taurus; identical to SEQ ID NO: 22742

SEQ ID NO: 63280 - DNA, 201 bp, Bos taurus; identical to SEQ ID NO: 22743

SEQ ID NO: 63281 - DNA, 201 bp, Bos taurus; identical to SEQ ID NO: 22744

SEQ ID NO: 63282 - DNA, 201 bp, Bos taurus; identical to SEQ ID NO: 22745

SEQ ID NO: 63283 - DNA, 201 bp, Bos taurus; identical to SEQ ID NO: 22746

SEQ ID NO: 63284 - DNA, 201 bp, Bos taurus; identical to SEQ ID NO: 22747

SEQ ID NO: 63285 - DNA, 201 bp, Bos taurus; identical to SEQ ID NO: 22748

SEQ ID NO: 63286 - DNA, 201 bp, Bos taurus; identical to SEQ ID NO: 22749

SEQ ID NO: 63287 - DNA, 201 bp, Bos taurus; identical to SEQ ID NO: 22750

SEQ ID NO: 63288 - DNA, 201 bp, Bos taurus; identical to SEQ ID NO: 22751

SEQ ID NO: 63289 - DNA, 201 bp, Bos taurus; identical to SEQ ID NO: 22753

SEQ ID NO: 63290 - DNA, 201 bp, Bos taurus; identical to SEQ ID NO: 22754

SEQ ID NO: 63291 - DNA, 201 bp, Bos taurus; identical to SEQ ID NO: 22755

SEQ ID NO: 63292 - DNA, 201 bp, Bos taurus; identical to SEQ ID NO: 22756

SEQ ID NO: 63293 - DNA, 201 bp, Bos taurus; identical to SEQ ID NO: 22757

SEQ ID NO: 63294 - DNA, 201 bp, Bos taurus; identical to SEQ ID NO: 22758

SEQ ID NO: 63295 - DNA, 201 bp, Bos taurus; identical to SEQ ID NO: 22760

SEQ ID NO: 63296 - DNA, 201 bp, Bos taurus; identical to SEQ ID NO: 22761

SEQ ID NO: 63297 - DNA, 201 bp, Bos taurus; identical to SEQ ID NO: 22762

SEQ ID NO: 63298 - DNA, 201 bp, Bos taurus; identical to SEQ ID NO: 22763

SEQ ID NO: 63299 - DNA, 201 bp, Bos taurus; identical to SEQ ID NO: 22764

SEQ ID NO: 63300 - DNA, 201 bp, Bos taurus; identical to SEQ ID NO: 22765

SEQ ID NO: 63301 - DNA, 201 bp, Bos taurus; identical to SEQ ID NO: 22767

SEQ ID NO: 63302 - DNA, 201 bp, Bos taurus; identical to SEQ ID NO: 22768

SEQ ID NO: 63303 - DNA, 201 bp, Bos taurus; identical to SEQ ID NO: 22769

SEQ ID NO: 63304 - DNA, 201 bp, Bos taurus; identical to SEQ ID NO: 22770

SEQ ID NO: 63305 - DNA, 201 bp, Bos taurus; identical to SEQ ID NO: 22771

SEQ ID NO: 63306 - DNA, 201 bp, Bos taurus; identical to SEQ ID NO: 22772

SEQ ID NO: 63307 - DNA, 201 bp, Bos taurus; identical to SEQ ID NO: 22773

SEQ ID NO: 63308 - DNA, 201 bp, Bos taurus; identical to SEQ ID NO: 22774

SEQ ID NO: 63309 - DNA, 201 bp, Bos taurus; identical to SEQ ID NO: 22775

SEQ ID NO: 63310 - DNA, 201 bp, Bos taurus; identical to SEQ ID NO: 22776

SEQ ID NO: 63311 - DNA, 201 bp, Bos taurus; identical to SEQ ID NO: 22777

SEQ ID NO: 63312 - DNA, 201 bp, Bos taurus; identical to SEQ ID NO: 22778

SEQ ID NO: 63313 - DNA, 201 bp, Bos taurus; identical to SEQ ID NO: 22779

SEQ ID NO: 63314 - DNA, 201 bp, Bos taurus; identical to SEQ ID NO: 22780

SEQ ID NO: 63315 - DNA, 201 bp, Bos taurus; identical to SEQ ID NO: 22781

SEQ ID NO: 63316 - DNA, 201 bp, Bos taurus; identical to SEQ ID NO: 22782

SEQ ID NO: 63317 - DNA, 201 bp, Bos taurus; identical to SEQ ID NO: 22783

SEQ ID NO: 63318 - DNA, 201 bp, Bos taurus; identical to SEQ ID NO: 22784

SEQ ID NO: 63319 - DNA, 201 bp, Bos taurus; identical to SEQ ID NO: 22785

SEQ ID NO: 63320 - DNA, 201 bp, Bos taurus; identical to SEQ ID NO: 22786

SEQ ID NO: 63321 - DNA, 201 bp, Bos taurus; identical to SEQ ID NO: 22787

SEQ ID NO: 63322 - DNA, 201 bp, Bos taurus; identical to SEQ ID NO: 22788

SEQ ID NO: 63323 - DNA, 201 bp, Bos taurus; identical to SEQ ID NO: 22789

SEQ ID NO: 63324 - DNA, 201 bp, Bos taurus; identical to SEQ ID NO: 22790

SEQ ID NO: 63325 - DNA, 201 bp, Bos taurus; identical to SEQ ID NO: 22791

SEQ ID NO: 63326 - DNA, 201 bp, Bos taurus; identical to SEQ ID NO: 22793

SEQ ID NO: 63327 - DNA, 201 bp, Bos taurus; identical to SEQ ID NO: 22794

SEQ ID NO: 63328 - DNA, 201 bp, Bos taurus; identical to SEQ ID NO: 22795

SEQ ID NO: 63329 - DNA, 201 bp, Bos taurus; identical to SEQ ID NO: 22796

SEQ ID NO: 63330 - DNA, 201 bp, Bos taurus; identical to SEQ ID NO: 22797

SEQ ID NO: 63331 - DNA, 201 bp, Bos taurus; identical to SEQ ID NO: 22798

SEQ ID NO: 63332 - DNA, 201 bp, Bos taurus; identical to SEQ ID NO: 22799

SEQ ID NO: 63333 - DNA, 201 bp, Bos taurus; identical to SEQ ID NO: 22800

SEQ ID NO: 63334 - DNA, 201 bp, Bos taurus; identical to SEQ ID NO: 22801

SEQ ID NO: 63335 - DNA, 201 bp, Bos taurus; identical to SEQ ID NO: 22802

SEQ ID NO: 63336 - DNA, 201 bp, Bos taurus; identical to SEQ ID NO: 22804

SEQ ID NO: 63337 - DNA, 201 bp, Bos taurus; identical to SEQ ID NO: 22805

SEQ ID NO: 63338 - DNA, 201 bp, Bos taurus; identical to SEQ ID NO: 22806

SEQ ID NO: 63339 - DNA, 201 bp, Bos taurus; identical to SEQ ID NO: 22807

SEQ ID NO: 63340 - DNA, 201 bp, Bos taurus; identical to SEQ ID NO: 22808

SEQ ID NO: 63341 - DNA, 201 bp, Bos taurus; identical to SEQ ID NO: 22809

SEQ ID NO: 63342 - DNA, 201 bp, Bos taurus; identical to SEQ ID NO: 22810

SEQ ID NO: 63343 - DNA, 201 bp, Bos taurus; identical to SEQ ID NO: 22811

SEQ ID NO: 63344 - DNA, 201 bp, Bos taurus; identical to SEQ ID NO: 22812

SEQ ID NO: 63345 - DNA, 201 bp, Bos taurus; identical to SEQ ID NO: 22813

SEQ ID NO: 63346 - DNA, 201 bp, Bos taurus; identical to SEQ ID NO: 22814

SEQ ID NO: 63347 - DNA, 201 bp, Bos taurus; identical to SEQ ID NO: 22815

SEQ ID NO: 63348 - DNA, 201 bp, Bos taurus; identical to SEQ ID NO: 22816

SEQ ID NO: 63349 - DNA, 201 bp, Bos taurus; identical to SEQ ID NO: 22817

SEQ ID NO: 63350 - DNA, 201 bp, Bos taurus; identical to SEQ ID NO: 22818

SEQ ID NO: 63351 - DNA, 201 bp, Bos taurus; identical to SEQ ID NO: 22819

SEQ ID NO: 63352 - DNA, 201 bp, Bos taurus; identical to SEQ ID NO: 22820

SEQ ID NO: 63353 - DNA, 201 bp, Bos taurus; identical to SEQ ID NO: 22821

SEQ ID NO: 63354 - DNA, 201 bp, Bos taurus; identical to SEQ ID NO: 22822

SEQ ID NO: 63355 - DNA, 201 bp, Bos taurus; identical to SEQ ID NO: 22823

SEQ ID NO: 63356 - DNA, 201 bp, Bos taurus; identical to SEQ ID NO: 22824

SEQ ID NO: 63357 - DNA, 201 bp, Bos taurus; identical to SEQ ID NO: 22826

SEQ ID NO: 63358 - DNA, 201 bp, Bos taurus; identical to SEQ ID NO: 22827

SEQ ID NO: 63359 - DNA, 201 bp, Bos taurus; identical to SEQ ID NO: 22828

SEQ ID NO: 63360 - DNA, 201 bp, Bos taurus; identical to SEQ ID NO: 22829

SEQ ID NO: 63361 - DNA, 201 bp, Bos taurus; identical to SEQ ID NO: 22830

SEQ ID NO: 63362 - DNA, 201 bp, Bos taurus; identical to SEQ ID NO: 22831

SEQ ID NO: 63363 - DNA, 201 bp, Bos taurus; identical to SEQ ID NO: 22832

SEQ ID NO: 63364 - DNA, 201 bp, Bos taurus; identical to SEQ ID NO: 22833

SEQ ID NO: 63365 - DNA, 201 bp, Bos taurus; identical to SEQ ID NO: 22834

SEQ ID NO: 63366 - DNA, 201 bp, Bos taurus; identical to SEQ ID NO: 22835

SEQ ID NO: 63367 - DNA, 201 bp, Bos taurus; identical to SEQ ID NO: 22836

SEQ ID NO: 63368 - DNA, 201 bp, Bos taurus; identical to SEQ ID NO: 22837

SEQ ID NO: 63369 - DNA, 201 bp, Bos taurus; identical to SEQ ID NO: 22838

SEQ ID NO: 63370 - DNA, 201 bp, Bos taurus; identical to SEQ ID NO: 22839

SEQ ID NO: 63371 - DNA, 201 bp, Bos taurus; identical to SEQ ID NO: 22840

SEQ ID NO: 63372 - DNA, 201 bp, Bos taurus; identical to SEQ ID NO: 22841

SEQ ID NO: 63373 - DNA, 201 bp, Bos taurus; identical to SEQ ID NO: 22842

SEQ ID NO: 63374 - DNA, 201 bp, Bos taurus; identical to SEQ ID NO: 22843

SEQ ID NO: 63375 - DNA, 201 bp, Bos taurus; identical to SEQ ID NO: 22844

SEQ ID NO: 63376 - DNA, 201 bp, Bos taurus; identical to SEQ ID NO: 22845

SEQ ID NO: 63377 - DNA, 201 bp, Bos taurus; identical to SEQ ID NO: 22846

SEQ ID NO: 63378 - DNA, 201 bp, Bos taurus; identical to SEQ ID NO: 22847

SEQ ID NO: 63379 - DNA, 201 bp, Bos taurus; identical to SEQ ID NO: 22848

SEQ ID NO: 63380 - DNA, 201 bp, Bos taurus; identical to SEQ ID NO: 22849

SEQ ID NO: 63381 - DNA, 201 bp, Bos taurus; identical to SEQ ID NO: 22850

SEQ ID NO: 63382 - DNA, 201 bp, Bos taurus; identical to SEQ ID NO: 22851

SEQ ID NO: 63383 - DNA, 201 bp, Bos taurus; identical to SEQ ID NO: 22852

SEQ ID NO: 63384 - DNA, 201 bp, Bos taurus; identical to SEQ ID NO: 22853

SEQ ID NO: 63385 - DNA, 201 bp, Bos taurus; identical to SEQ ID NO: 22854

SEQ ID NO: 63386 - DNA, 201 bp, Bos taurus; identical to SEQ ID NO: 22855

SEQ ID NO: 63387 - DNA, 201 bp, Bos taurus; identical to SEQ ID NO: 22856

SEQ ID NO: 63388 - DNA, 201 bp, Bos taurus; identical to SEQ ID NO: 22857

SEQ ID NO: 63389 - DNA, 201 bp, Bos taurus; identical to SEQ ID NO: 22858

SEQ ID NO: 63390 - DNA, 201 bp, Bos taurus; identical to SEQ ID NO: 22859

SEQ ID NO: 63391 - DNA, 201 bp, Bos taurus; identical to SEQ ID NO: 22860

SEQ ID NO: 63392 - DNA, 201 bp, Bos taurus; identical to SEQ ID NO: 22861

SEQ ID NO: 63393 - DNA, 201 bp, Bos taurus; identical to SEQ ID NO: 22862

SEQ ID NO: 63394 - DNA, 201 bp, Bos taurus; identical to SEQ ID NO: 22863

SEQ ID NO: 63395 - DNA, 201 bp, Bos taurus; identical to SEQ ID NO: 22864

SEQ ID NO: 63396 - DNA, 201 bp, Bos taurus; identical to SEQ ID NO: 22865

SEQ ID NO: 63397 - DNA, 201 bp, Bos taurus; identical to SEQ ID NO: 22866

SEQ ID NO: 63398 - DNA, 201 bp, Bos taurus; identical to SEQ ID NO: 22867

SEQ ID NO: 63399 - DNA, 201 bp, Bos taurus; identical to SEQ ID NO: 22868

SEQ ID NO: 63400 - DNA, 201 bp, Bos taurus; identical to SEQ ID NO: 22869

SEQ ID NO: 63401 - DNA, 201 bp, Bos taurus; identical to SEQ ID NO: 22870

SEQ ID NO: 63402 - DNA, 201 bp, Bos taurus; identical to SEQ ID NO: 22871

SEQ ID NO: 63403 - DNA, 201 bp, Bos taurus; identical to SEQ ID NO: 22872

SEQ ID NO: 63404 - DNA, 201 bp, Bos taurus
ggacatcaattgggtgtcctacaatttaattcaattctgacactacgtggagttagtacaaaccccatacatgaagagcttagtcctgtaagactgcctcccttttctgattctgatttcaagtctgatacttctgactgaatggctataaactaggcgttttcatgacctccttctcagctcaggtttgatcatttgcta

SEQ ID NO: 63405 - DNA, 201 bp, Bos taurus
tctttttaattgatttttaagcctcagttcctttcttagttcatcaaacctgctgattctatttgcatcatcagtgtatttgttttgccgctagatggcaataatgtacctttgaaccctgtggcctctgagttctcagaatcggggatctgaaggagccttggaatttttgcttaatccccaccccccacccatttaaca

SEQ ID NO: 63406 - DNA, 201 bp, Bos taurus
ctctaataattagaggtacccatatggaacttctggaattgaacagggggttcaagtcctggtttaccgtgtggtgtcatggcctgctcattagggcatgtgctgtggagccagcctgactgggacctacgttccggatccttatcttccttgttagaccttgggtagttcatgtaatcgtcatgagcctgggttttcccg

SEQ ID NO: 63407 - DNA, 201 bp, Bos taurus; identical to SEQ ID NO: 22873

SEQ ID NO: 63408 - DNA, 201 bp, Bos taurus
gtttaaaggcttttccaagaactatgtttccaaagagcgttaataataactttggaacatcctacgagtgaggcacagtgcgtagtcaccgcctttggttggggcgggccagggatctcctcctgcttttggcactgcttctgtcaatcgcactggacgagttactgcagtttcctttgtcccaagttgagaactcttttg

SEQ ID NO: 63409 - DNA, 201 bp, Bos taurus
aggattcagcagatatcctagggagttctggacctggagttatcctttggagatgtcctgaatcaagataagaggactaggcctttatcctctctaagtcccagctgcccaggaaggggacaatgcctttgatgaggcaactctctttagctgagacaatctgtgtgtctctgtggggcctgaaggctgggggctgtctca

SEQ ID NO: 63410 - DNA, 201 bp, Bos taurus
gtatcctgaatagattgaaaaatgttaaatcaagtgaatttatgttaaagaaataagtgagttcacataatttaaaaattcctcaaccattaaaatgttcgctggactttactatttagagttagatttagttcattgctagttgagttctttaaacccctcattcatttagttccataatatcagtatgaaaagtgcatc

SEQ ID NO: 63411 - DNA, 201 bp, Bos taurus; identical to SEQ ID NO: 22878

SEQ ID NO: 63412 - DNA, 201 bp, Bos taurus; identical to SEQ ID NO: 22879

SEQ ID NO: 63413 - DNA, 201 bp, Bos taurus
ctgttagaaaaaaaaatttagctccccaaaaatgtgttgtgaatcatgtaccatattctcaatgtttccatcaatttaaaatgtgttgctagtaatgcacgtaaatggcttaaacatgaaaaccaaatgacatgatgatatacagctgtgcctacattgtatatatcttttatgacatgtttcacttgctttactctatgg

SEQ ID NO: 63414 - DNA, 201 bp, Bos taurus; identical to SEQ ID NO: 22880

SEQ ID NO: 63415 - DNA, 201 bp, Bos taurus; identical to SEQ ID NO: 22881

SEQ ID NO: 63416 - DNA, 201 bp, Bos taurus; identical to SEQ ID NO: 22882

SEQ ID NO: 63417 - DNA, 201 bp, Bos taurus; identical to SEQ ID NO: 22885

SEQ ID NO: 63418 - DNA, 201 bp, Bos taurus
gttacaattataaacattaacagagtctaagaaaagtatttttacaagatattgtgctgtgtagtcattagttctggacctgaagaaaggccaattctccggtaagatacattgttgcacaagacttaaggaaagcaggagggagaatgttcacctccttcttaaagggccctaagctttaactttcccacaatcagttat

SEQ ID NO: 63419 - DNA, 201 bp, Bos taurus; identical to SEQ ID NO: 22886

SEQ ID NO: 63420 - DNA, 201 bp, Bos taurus; identical to SEQ ID NO: 22887

SEQ ID NO: 63421 - DNA, 201 bp, Bos taurus; identical to SEQ ID NO: 22888

SEQ ID NO: 63422 - DNA, 201 bp, Bos taurus
gggaaaagattttatagacaaaagtcaatgaataatagtttgtaaaaatatgaggttataataaagtacatcatgcaaacaaaaaataaaagtgataacataataagaaagactgcaggtaaagaaaaaatttcaggtgttgggcaagaaaatcatggtatagaacaaatgggccaaattggaaaagggacctttaaaaag

SEQ ID NO: 63423 - DNA, 201 bp, Bos taurus
tagagcaaacaactgaacaaattttggggatcagtaatccaaaataaaagattagtatatattacccaagtcacaaattctttatagatttcctatcctggaaaggaactgatctcaaaatatagaaaattcagaccagagtggggaaggaagaggaaacatctgaataaaatgaggagatgtgacatattctaaggattt

SEQ ID NO: 63424 - DNA, 201 bp, Bos taurus
ttcaacatcatggtccatttaacttttggaatcatgtgctaccaaaaagcttgactaaaataatgttttgtaaacgagactctactttgaatgtagctaagtccattataagtggatttacttaaagctggtaaaaagaatctatacttgctaatgcaaagttgtcaacatagagcatatgcccaatcacaattcttgtga

SEQ ID NO: 63425 - DNA, 201 bp, Bos taurus; identical to SEQ ID NO: 22890

SEQ ID NO: 63426 - DNA, 201 bp, Bos taurus; identical to SEQ ID NO: 22891

SEQ ID NO: 63427 - DNA, 201 bp, Bos taurus
gaatgcaaagttattcccactccaacatgaaagttctctgggcttttcgatcttgtcacatttgaaagccatgtgctccagtagaatggcccctggactgccctcagggtacccgtgttccggtccagctctgcccagaagatgtgtaacattaggcaaagtgcttaacctcttcgaatcctagtctctctgcctgtaata

SEQ ID NO: 63428 - DNA, 201 bp, Bos taurus; identical to SEQ ID NO: 22892

SEQ ID NO: 63429 - DNA, 201 bp, Bos taurus; identical to SEQ ID NO: 22893

SEQ ID NO: 63430 - DNA, 201 bp, Bos taurus; identical to SEQ ID NO: 22895

SEQ ID NO: 63431 - DNA, 201 bp, Bos taurus; identical to SEQ ID NO: 22896

SEQ ID NO: 63432 - DNA, 201 bp, Bos taurus; identical to SEQ ID NO: 22898

SEQ ID NO: 63433 - DNA, 201 bp, Bos taurus
attgcccccacaatcagtattatataataaaaaggcaaaaccattagagagcctaaattaatctttcatcagttacacatttcaccaagttattagtcactatttattttgatgccaatcatagaaatacaagttgtacaaataactttactaaactggtaaagggaatcccctagattctacttatactggccagaagac

SEQ ID NO: 63434 - DNA, 201 bp, Bos taurus; identical to SEQ ID NO: 22899

SEQ ID NO: 63435 - DNA, 201 bp, Bos taurus; identical to SEQ ID NO: 22901

SEQ ID NO: 63436 - DNA, 201 bp, Bos taurus
tgaaactgcatagcaattgtttatgaaattaacgtgcattgtgtcctgcctgtggcagctcttgaaaagctgtttttaaattatgaatttaggtaattttcgaaagagaaaaatttaatatgtaaaaagcttattttacttacaattcctttacatttatactaatgtaatagaaggacctcaaaatataccaattggata

SEQ ID NO: 63437 - DNA, 201 bp, Bos taurus; identical to SEQ ID NO: 22902

SEQ ID NO: 63438 - DNA, 201 bp, Bos taurus; identical to SEQ ID NO: 22903

SEQ ID NO: 63439 - DNA, 201 bp, Bos taurus; identical to SEQ ID NO: 22905

SEQ ID NO: 63440 - DNA, 201 bp, Bos taurus; identical to SEQ ID NO: 22906

SEQ ID NO: 63441 - DNA, 201 bp, Bos taurus; identical to SEQ ID NO: 22907

SEQ ID NO: 63442 - DNA, 201 bp, Bos taurus; identical to SEQ ID NO: 22908

SEQ ID NO: 63443 - DNA, 201 bp, Bos taurus; identical to SEQ ID NO: 22909

SEQ ID NO: 63444 - DNA, 201 bp, Bos taurus; identical to SEQ ID NO: 22910

SEQ ID NO: 63445 - DNA, 201 bp, Bos taurus; identical to SEQ ID NO: 22911

SEQ ID NO: 63446 - DNA, 201 bp, Bos taurus; identical to SEQ ID NO: 22912

SEQ ID NO: 63447 - DNA, 201 bp, Bos taurus; identical to SEQ ID NO: 22913

SEQ ID NO: 63448 - DNA, 201 bp, Bos taurus; identical to SEQ ID NO: 22914

SEQ ID NO: 63449 - DNA, 201 bp, Bos taurus; identical to SEQ ID NO: 22915

SEQ ID NO: 63450 - DNA, 201 bp, Bos taurus; identical to SEQ ID NO: 22916

SEQ ID NO: 63451 - DNA, 201 bp, Bos taurus; identical to SEQ ID NO: 22917

SEQ ID NO: 63452 - DNA, 201 bp, Bos taurus; identical to SEQ ID NO: 22918

SEQ ID NO: 63453 - DNA, 201 bp, Bos taurus; identical to SEQ ID NO: 22919

SEQ ID NO: 63454 - DNA, 201 bp, Bos taurus; identical to SEQ ID NO: 22920

SEQ ID NO: 63455 - DNA, 201 bp, Bos taurus; identical to SEQ ID NO: 22921

SEQ ID NO: 63456 - DNA, 201 bp, Bos taurus; identical to SEQ ID NO: 22922

SEQ ID NO: 63457 - DNA, 201 bp, Bos taurus; identical to SEQ ID NO: 22923

SEQ ID NO: 63458 - DNA, 201 bp, Bos taurus; identical to SEQ ID NO: 22925

SEQ ID NO: 63459 - DNA, 201 bp, Bos taurus; identical to SEQ ID NO: 22926

SEQ ID NO: 63460 - DNA, 201 bp, Bos taurus; identical to SEQ ID NO: 22927

SEQ ID NO: 63461 - DNA, 201 bp, Bos taurus; identical to SEQ ID NO: 22928

SEQ ID NO: 63462 - DNA, 201 bp, Bos taurus; identical to SEQ ID NO: 22929

SEQ ID NO: 63463 - DNA, 201 bp, Bos taurus; identical to SEQ ID NO: 22930

SEQ ID NO: 63464 - DNA, 201 bp, Bos taurus; identical to SEQ ID NO: 22931

SEQ ID NO: 63465 - DNA, 201 bp, Bos taurus; identical to SEQ ID NO: 22932

SEQ ID NO: 63466 - DNA, 201 bp, Bos taurus; identical to SEQ ID NO: 22933

SEQ ID NO: 63467 - DNA, 201 bp, Bos taurus; identical to SEQ ID NO: 22934

SEQ ID NO: 63468 - DNA, 201 bp, Bos taurus; identical to SEQ ID NO: 22935

SEQ ID NO: 63469 - DNA, 201 bp, Bos taurus; identical to SEQ ID NO: 22936

SEQ ID NO: 63470 - DNA, 201 bp, Bos taurus; identical to SEQ ID NO: 22937

SEQ ID NO: 63471 - DNA, 201 bp, Bos taurus
agtccatcacatactataagggggctggcatcaatatgtgcactcactctggtccttgtgaccaagtccatcatcagccccacaaatagctgcttctcaaccatccctcagagcctagaagcaggatctgtgctatctgagcaaggaattctgtgatgctggagacctagaggagtcttgagtaggagagagtgtgggctc

SEQ ID NO: 63472 - DNA, 201 bp, Bos taurus
ccatggggtggcaaaaagttggacacaactgagcaactagtgactgactgactgactcaaagaacagccttcccagaacaatgatccagccccaaatatcggtacttctgagtgtttgatacgtgaattttaacatcttgaacatgtgcccttggacctgcctgctgcaggatgctgaaccaggaaagtataaagtcccag

SEQ ID NO: 63473 - DNA, 201 bp, Bos taurus; identical to SEQ ID NO: 22938

SEQ ID NO: 63474 - DNA, 201 bp, Bos taurus; identical to SEQ ID NO: 22939

SEQ ID NO: 63475 - DNA, 201 bp, Bos taurus; identical to SEQ ID NO: 22940

SEQ ID NO: 63476 - DNA, 201 bp, Bos taurus; identical to SEQ ID NO: 22941

SEQ ID NO: 63477 - DNA, 201 bp, Bos taurus; identical to SEQ ID NO: 22942

SEQ ID NO: 63478 - DNA, 201 bp, Bos taurus; identical to SEQ ID NO: 22944

SEQ ID NO: 63479 - DNA, 201 bp, Bos taurus; identical to SEQ ID NO: 22947

SEQ ID NO: 63480 - DNA, 201 bp, Bos taurus; identical to SEQ ID NO: 22949

SEQ ID NO: 63481 - DNA, 201 bp, Bos taurus; identical to SEQ ID NO: 22950

SEQ ID NO: 63482 - DNA, 201 bp, Bos taurus; identical to SEQ ID NO: 22951

SEQ ID NO: 63483 - DNA, 201 bp, Bos taurus
caacataatgcagagaggtttatatgaagctgctctgtaccaacacattcctaaataacagaagaagaaaacagttctagaggatattctacagagtctagaagcatttcccctagtcacaggatgtcagtgtgataaaaggcacattaaggaggaaaggatctgcctttctcaaccctacagactgttcactgtaaaaat

SEQ ID NO: 63484 - DNA, 201 bp, Bos taurus; identical to SEQ ID NO: 22952

SEQ ID NO: 63485 - DNA, 201 bp, Bos taurus; identical to SEQ ID NO: 22953

SEQ ID NO: 63486 - DNA, 201 bp, Bos taurus
taattgaactgaaatcagaagacctgaattatcatcattgttcattctctgactaatcatgtcatttatattctctaggccccttcgttatttaagaaacgtatacaataaaaacgattgctttctatatcttttggagttgtttaaagattatgctgaaatgctttgaattataaaataagatataaaatatgagattca

SEQ ID NO: 63487 - DNA, 201 bp, Bos taurus
aataacactaagcaggctacgtaagttcttacagtttctgattagcaaataaaatttgcttaatttggtactactgtacattctagatttggaaaagttagtaaaggccatctagtctggactcttcactttatacataaggaatcatgctaagagagagggtaaggaccttgcctaagatcacaaatgatgttgggcaat

SEQ ID NO: 63488 - DNA, 201 bp, Bos taurus; identical to SEQ ID NO: 22954

SEQ ID NO: 63489 - DNA, 201 bp, Bos taurus; identical to SEQ ID NO: 22955

SEQ ID NO: 63490 - DNA, 201 bp, Bos taurus
gcagattcgcagttatatttgggtgtgggtccagggaatcccttaatctccacttccagaatacattcattttgtgtcttgaacaatccaccagacccatcgcttctcaaatcaccacacttggcagtggtggggggtatgcagaggggctagagttggtaaaagacagaagaaaaatactaagtgggcagggaatgtcac

SEQ ID NO: 63491 - DNA, 201 bp, Bos taurus
tgtctacctggtctaccctgtgaaggggtagatctataattggaattctctcttaacacctttgtttttcatgctattctaaagctcctgtggatccaagtatctgctacaggaaaagaatcatgtcaaatcgttatggtactaatggtacagagaatagcatgacaaagatgtactgaggcattctcttatttgggactg

SEQ ID NO: 63492 - DNA, 201 bp, Bos taurus
aaagtgcattctcttttcactgttaattaaggcacagggccacaggcaataccatcgatcctgtctagtcataaggcatttctctgagttcttactaatatagagaactaggcttaaccaaaggaacttctgttatgcaaatccaagtcatgcccaaagtgtaatcaaatcctgatgaccaaaaatagtcttctcataaga

SEQ ID NO: 63493 - DNA, 201 bp, Bos taurus
taagagggcggagaggcccgaaacaggttttcacctggaccctacgcgacacaagctctccagagaaggaaggccgcatgcacaggccccggcctgcctcacccttcctccccgtaccctgcccaggccaaggccccagggctccagcgtcatcgggccttaccttggctgcagtccttgccacggaagccagttcgcgag

SEQ ID NO: 63494 - DNA, 201 bp, Bos taurus
catagctaggattgcctttggcataatatagacataaaaatgatatacttttcaccttataaatagtttctatctaggtggaggagacaggctaattaacaaggccagcgattcatagattaagatggaacaatatcatattggtcaaaatgtatattgtataattctgaattgagtgatctgcaaatcagaagcaaaaac

SEQ ID NO: 63495 - DNA, 201 bp, Bos taurus
cataaatggtatgtgaaaacagttcattacctacatgaattttcgtttttccctggctatcatcatcacacttttcacaattacttaaatgttctatacagtttaccatttacaaacaagcacatctttcgtattctgttatccaaattatttaactatttgtactatttacactgtggctaaaaggtgaactagattgcc

SEQ ID NO: 63496 - DNA, 201 bp, Bos taurus; identical to SEQ ID NO: 22956

SEQ ID NO: 63497 - DNA, 201 bp, Bos taurus
agtatttctactaagagaaaggtgctaaaatcccaaatcagatatttggatttaatgaatttttatatatgttctgattcattagctgccattcccatctcctcattaatatgatatgagatactcagatttttttatttgctttctttttcttattggggccaagactgaataaagaatattgtgtcagatattttgcaa

SEQ ID NO: 63498 - DNA, 201 bp, Bos taurus
gaattctccaggccagaatactggcatgggtagccattccctttcttcaagggatcttcccaactcagggatcgaatccaggtctcccgcattgaaggccgattctttaccaactgaaggattagggaagccctatcactctctcagttcagttcagtcactcagtcttgtccaactctttgcgaccccatggactgcagc

SEQ ID NO: 63499 - DNA, 201 bp, Bos taurus
aaacaagtggtctggggacacatgaagtttccaccattttatttgtagtttatttattaagagcaaaaaacagcaagtaaaatagggccctgtctgaaaacggacacccaagaatgccaagagactgagagcatgctcaataatgcagagtagcagtcgtgctcggcaaatccattccatggcccactcgtttctgtctgc

SEQ ID NO: 63500 - DNA, 201 bp, Bos taurus; identical to SEQ ID NO: 22957

SEQ ID NO: 63501 - DNA, 201 bp, Bos taurus; identical to SEQ ID NO: 22958

SEQ ID NO: 63502 - DNA, 201 bp, Bos taurus; identical to SEQ ID NO: 22959

SEQ ID NO: 63503 - DNA, 201 bp, Bos taurus; identical to SEQ ID NO: 22960

SEQ ID NO: 63504 - DNA, 201 bp, Bos taurus; identical to SEQ ID NO: 22961

SEQ ID NO: 63505 - DNA, 201 bp, Bos taurus; identical to SEQ ID NO: 22962

SEQ ID NO: 63506 - DNA, 201 bp, Bos taurus; identical to SEQ ID NO: 22964

SEQ ID NO: 63507 - DNA, 201 bp, Bos taurus; identical to SEQ ID NO: 22965

SEQ ID NO: 63508 - DNA, 201 bp, Bos taurus; identical to SEQ ID NO: 22966

SEQ ID NO: 63509 - DNA, 201 bp, Bos taurus
aatctttccacaacagtactatagacctgctagtactaagataataatcaaactgaaagtgcttcttcaaacaaatatttctatgaccaaacaagaaatacaattaggcgaatatacctccaacaatatagttgttgctgttcagttgctaagtagtgtctgactcttggcaaccgcatggactgcagcatgccaggctcc

SEQ ID NO: 63510 - DNA, 201 bp, Bos taurus
tgagccacaaaagatcaagagaattatgaatcatataaaacaagggtatagaaagtataaagaacgacagaaatgtcaaacctgctttggaaacttttaaaattaacctacaataccaggttcactggtacagatatgaagatgctactgtcagcagcaaaagaaagctcacttcacccttcaagactagaaatgttcata

SEQ ID NO: 63511 - DNA, 201 bp, Bos taurus; identical to SEQ ID NO: 22967

SEQ ID NO: 63512 - DNA, 201 bp, Bos taurus
caaaagaatgttctttagtattttctttaatttaggcctgctggtgattcaaaactgttttagattttttttgtctccatgtttttttattttaccttcagtcttgaaaaatatctttgctgtgagtagaattctaacttgccatttattttttcagttccttgtggatgccatgacagtgttttggcatccattgcttta

SEQ ID NO: 63513 - DNA, 201 bp, Bos taurus
ctctgtgtttctccactgcttccctttcctcacccacctgcttctccacttcaaccttctcctcctggttcgctgcttctgagaacatggggcccctttccgtctttgctttcgcagccttccatccagccgtcagctcagactctgatctcccagtgtcacaggtttctagggccttctccccaccagtttcacactgaa

SEQ ID NO: 63514 - DNA, 201 bp, Bos taurus; identical to SEQ ID NO: 22968

SEQ ID NO: 63515 - DNA, 201 bp, Bos taurus; identical to SEQ ID NO: 22969

SEQ ID NO: 63516 - DNA, 201 bp, Bos taurus; identical to SEQ ID NO: 22970

SEQ ID NO: 63517 - DNA, 201 bp, Bos taurus
atgaattaacagagttccaggcccagttaagagtcataacaacttgtatttccagaaaacctaaactagaaatcatttcccagtgtgagaatagagccaccaaaagggccagatctgaggtaaatatacaatcaattacattcctctatgtatgaaacagggagaaggcgagggcaccccactccagtactgttgcctgga

SEQ ID NO: 63518 - DNA, 201 bp, Bos taurus; identical to SEQ ID NO: 22971

SEQ ID NO: 63519 - DNA, 201 bp, Bos taurus; identical to SEQ ID NO: 22972

SEQ ID NO: 63520 - DNA, 201 bp, Bos taurus
actaaaatgttatagttcatcaaactagcaaacattaaaaaaaacaggtaatatccagtgttggaatttcagtttgacctaccaagaaaaaaagaagacagagaattcaaataaataaaattataaaggaaagaggagacattacaagtgataccacagaaatacaaaggatcctaagagactactatgaacaactgtgct

SEQ ID NO: 63521 - DNA, 201 bp, Bos taurus; identical to SEQ ID NO: 22973

SEQ ID NO: 63522 - DNA, 201 bp, Bos taurus; identical to SEQ ID NO: 22974

SEQ ID NO: 63523 - DNA, 201 bp, Bos taurus
agatacttttttcccagagttagctggaagtttatttcaatatttgagtacagtagggactttgtacattttgttccttacagtatgctagcacagagaacggttcctggcacatgataggtactcattaaacacttatatactgaatggacattaattaggatttttttgtgtgtgcagattcttatgtatcattagaaa

SEQ ID NO: 63524 - DNA, 201 bp, Bos taurus
agggccacggaggagagtttcagagagacaggctcttttctccgtactactcagaatccagtgggtctctctgaatccaagatgaagtcctagaggaaatgtgtgatgcaggttgaatggaggcccctggtcgtgctaaggcagtatgactcctcccctggttttcttgggtaccataatcacgtcctgacctctctggac

SEQ ID NO: 63525 - DNA, 201 bp, Bos taurus
aaaggcatttctaaagattccctgataaggccacttcattatacacaaaacagctttcaacaaagctatgtcaagagtggggagtagggggtctggagggctctctccaggccaacctctcttccacttcatgaggtaggtagctcctaaggtatgttcatagattctttgaatttccctcgagattagtttcaaaatagt

SEQ ID NO: 63526 - DNA, 201 bp, Bos taurus
atccattgccaggcttgaagcaggaactggttctttatgacctgaggctctgagatctttgctcaccatcttaaatttctcagaaggtctaaatttgtaagggttcatgtttcacaattctagaagccttttcaatctggcttcgttgcttgccagagttccagaataaaccctcctacaatatggaccatgctctaccca

SEQ ID NO: 63527 - DNA, 201 bp, Bos taurus
gaaggttggggcccagagagtctcctgcagaatcttcaaactcctcctgttttctttggatgaagactatcatccggatgacactgtgttaactgtgagagtctggcctgagccttggactactcatatataaaggggaatcaaatgcctggtcccatagttgatccagtaagatcgtgtaccttgcccatgagacttctc

SEQ ID NO: 63528 - DNA, 201 bp, Bos taurus
acatgtgctcttcatctggggcagccctgcatttaactggcttgttcacacttctgcttaagcttctgtggaacaaaggtgactttttacaaagtttgaaaacccatgatctaacccagagaggccaacagaagcaacatttggatgcatgagctgggtttctggaccagagaatagatggtcccagatgacaccatttct

SEQ ID NO: 63529 - DNA, 201 bp, Bos taurus
ggagttggtgatggacagggaggcctggcgtgctgcgattcatggggtcgcaaagagttggacacaactgagtgactgatctgatctgatggtggttttgttattttggccgccatttagtctcaggctctgtttccttcacaattgctcatttacagtgggttctactgtttcttttcccttctctgttcttactgttgt

SEQ ID NO: 63530 - DNA, 201 bp, Bos taurus
aggtctgttaaggttaggactgctgtcttttgcagactctcactttaagccaagtctttgcccagcagaccacaatgcaacaaagaggatttggggcccaatgtacttggttttgccaaatattcactgctctgataaatcatctattagctaagctaactttggggaattatctatggaatttaattctatttgctggcc

SEQ ID NO: 63531 - DNA, 201 bp, Bos taurus
gcctgtgcacggcaactagaaagcagcctccctctccatagctagagaagaagcctgtatgcagcaatgaaaacccagcatagctagataaagaaataaacaaaaattacatatatatataaagtacgtcaatagactgattgagtaactccttttttgctcttccctgtgttttatatatcctcaataacacccaaaagg

SEQ ID NO: 63532 - DNA, 201 bp, Bos taurus; identical to SEQ ID NO: 22975

SEQ ID NO: 63533 - DNA, 201 bp, Bos taurus; identical to SEQ ID NO: 22976

SEQ ID NO: 63534 - DNA, 201 bp, Bos taurus; identical to SEQ ID NO: 22977

SEQ ID NO: 63535 - DNA, 201 bp, Bos taurus
acacataggagcatccctggtatcttattatttagaaagagaaaatacaccatttgtgcaacatgatagagtaagagtttgttctttttcctctggtaaagaagtttgattaaatttctcataagttggtctattttgggctgcagtcatgaaatttttgtgaagggcaagtctgggaaaaaaatgaacactgaatttgaa

SEQ ID NO: 63536 - DNA, 201 bp, Bos taurus; identical to SEQ ID NO: 22978

SEQ ID NO: 63537 - DNA, 201 bp, Bos taurus
gtgttcatatttcatttcttccaatgttacacatgtgaaaaaacactagggatttcccttgtgatccagtggctgactctgcactcccagtgccatgggtcccagtttaatccctggtcagggactagatcccagatgccttaactaagagtttgtatacagcaatggaaagattccacaggccacaaggaaaatcgaaga

SEQ ID NO: 63538 - DNA, 201 bp, Bos taurus
tttatgttggtccattcaagtgagtgcattttctatgattctgcaggaagggctttatagtttttaaaaggggtcaaggcaggaacactgatttaaatacgctgctgtcaatttggcctcacatatctgcattcatatatcccaggagtttaaacaaataggcaaaggcttttcattgacacaatgtctgttcaaataaaa

SEQ ID NO: 63539 - DNA, 201 bp, Bos taurus
caataacttaattgtatctgttatgagccttctattctacaagaaggagtgagaaggtttgatatgcacacttgtgtgtagggagagatggatagtaaaagaagttagaaagaaggaatataagcggggaagttgactcaggcatgaagtgatttaattccatcttgtggcaagggagtatgtaaacatgaagctaagagt

SEQ ID NO: 63540 - DNA, 201 bp, Bos taurus; identical to SEQ ID NO: 22979

SEQ ID NO: 63541 - DNA, 201 bp, Bos taurus; identical to SEQ ID NO: 22980

SEQ ID NO: 63542 - DNA, 201 bp, Bos taurus; identical to SEQ ID NO: 22981

SEQ ID NO: 63543 - DNA, 201 bp, Bos taurus
ctctgtgtcaactaccactcagctgtttggcccttggaaattacacactggggtgtggctgtgttcttataagatgattgacaaaatagattaatgcccagatttggcctgtgggtcagggtttgccaacctctgatctataatcttccttgttttaaattctctaccctgagtatcaactctaccgactagtttgcaata

SEQ ID NO: 63544 - DNA, 201 bp, Bos taurus; identical to SEQ ID NO: 22982

SEQ ID NO: 63545 - DNA, 201 bp, Bos taurus; identical to SEQ ID NO: 22983

SEQ ID NO: 63546 - DNA, 201 bp, Bos taurus; identical to SEQ ID NO: 22984

SEQ ID NO: 63547 - DNA, 201 bp, Bos taurus
tcttcctggcccagggatcaaacctgggtctcctgcattgcaggcagattctttaccatctgagccaccagatattctatggccccaaacaaattccaatcaatattattcatctgtcagcccttgaaatagaatgtgggctactccaccatatctttcttacctgtagggattagcaaggaaaacctcactctctgacag

SEQ ID NO: 63548 - DNA, 201 bp, Bos taurus
tctttttctccttttgaaaatttaaacaacaacaacagtgtccagaaccaccggaattccacaactccactggaaaacaactgaaatgtaatacggtatgattagaccctggagcatttcattctatgtgaatggtgccttctgaagtcacaaaacacaatagtcctatcatgtctgatatttttacagagctgtactttt

SEQ ID NO: 63549 - DNA, 201 bp, Bos taurus
gagtccatttggaagagaatcacagtaaaaaagaaataagatggaggtccagattttgagggatgacatagaagagtgggagcaagaagcattgacaaataacatagatgaagttagggaggtgatggaacagttcttacatgtgactagccataagggataaaggtttcagacccctgcgctgcacaaaacattgcatat

SEQ ID NO: 63550 - DNA, 201 bp, Bos taurus; identical to SEQ ID NO: 22985

SEQ ID NO: 63551 - DNA, 201 bp, Bos taurus; identical to SEQ ID NO: 22986

SEQ ID NO: 63552 - DNA, 201 bp, Bos taurus; identical to SEQ ID NO: 22987

SEQ ID NO: 63553 - DNA, 201 bp, Bos taurus; identical to SEQ ID NO: 22988

SEQ ID NO: 63554 - DNA, 201 bp, Bos taurus
caaattcctgaccttgtaaaatttatagtcaagaaacagataacaagcaaaataaataaatgaatcacatgctatttcatgtgataaatgcaatgagaaacgatccatttattggttcagttcagttcagccactcagtcaggtccgattttttgcaacccatggactgtgtcacgccaggtctccttgtccatcaccaac

SEQ ID NO: 63555 - DNA, 201 bp, Bos taurus
gaggtgattttggttgggaatggccctgtgggaatcctggagtattggcagtattctgttttttagtgtggattgtgttaaatggatattagttaaggtatgcatttatgtttcatgcttttttctgtataagtaatattttttcttaagaaaaagttgtaaactcgttcatgggatggtgtgacagagcaaaaaagaaca

SEQ ID NO: 63556 - DNA, 201 bp, Bos taurus; identical to SEQ ID NO: 22990

SEQ ID NO: 63557 - DNA, 201 bp, Bos taurus; identical to SEQ ID NO: 22991

SEQ ID NO: 63558 - DNA, 201 bp, Bos taurus
gagcccagatgaggcctctttgttaccaccagcttaccactgctttaagtttccaatttcagcctcagctagctgcagccagaggaccactaagatctggtcactttcttcaatcaatactgctgctaagtcccttcaattgtgtctgactctgtgcaaccccatagacagcagcccaccaggttcctctgtccctgggat

SEQ ID NO: 63559 - DNA, 201 bp, Bos taurus
tttgtctttttctgtctgactgacttcactcagtatgattatctctcagttgatggacactttgaatgtatccagtgttttctattacagtgctgcaagaatgttctattacatttgtcttcatgccgtaaccttactgatgtttctgtaaaatatagtgtttccagtgggtttattggttataagcaacacacaaccttt

SEQ ID NO: 63560 - DNA, 201 bp, Bos taurus; identical to SEQ ID NO: 22999

SEQ ID NO: 63561 - DNA, 201 bp, Bos taurus; identical to SEQ ID NO: 23000

SEQ ID NO: 63562 - DNA, 201 bp, Bos taurus
cagaactgtgagccgaggtaggaataggccacctggaaatccacctaaatgtcctcctgccccaagaatactgcgtgaagcctgtcagcctctaggatctatccatggaaaagggattttgttggccaaattgaggtcaggtgaaagagatcagggaacaccagtgatggtttaagtgttacactaactggaaggttaact

SEQ ID NO: 63563 - DNA, 201 bp, Bos taurus
ccatctccaaacaaagatgaattgaggaaccccaatacctctttatgttcctcaagaccttttctcatccctagaccttattttcaacccaggcaagaaatctggaaagaaaacagtttcttggcttcctttgctcctttttaaaaccgagaggagggtatggggggctttccatctgtgatctaaggaagttagagaaac

SEQ ID NO: 63564 - DNA, 201 bp, Bos taurus; identical to SEQ ID NO: 23001

SEQ ID NO: 63565 - DNA, 201 bp, Bos taurus; identical to SEQ ID NO: 23003

SEQ ID NO: 63566 - DNA, 201 bp, Bos taurus; identical to SEQ ID NO: 23004

SEQ ID NO: 63567 - DNA, 201 bp, Bos taurus; identical to SEQ ID NO: 23005

SEQ ID NO: 63568 - DNA, 201 bp, Bos taurus
ggaaaaataaagaagctacttttggctaaaagggagttggttactgtaaggtgaattcctgtaggggatggcaggggtctcccaggcagatggcctcactagtgctgatcaggcgatccttgattggctgggctaagattccatttctgggggagccaaaagcgtaattaagtatcagtttggtgacctgtggcttggcat

SEQ ID NO: 63569 - DNA, 201 bp, Bos taurus; identical to SEQ ID NO: 23007

SEQ ID NO: 63570 - DNA, 201 bp, Bos taurus; identical to SEQ ID NO: 23008

SEQ ID NO: 63571 - DNA, 201 bp, Bos taurus
tatcaatattctcaacaccatttgctataaagattatccttccttcattgaactgcttttgtacctttgttaaaattcaactggcaaaactttgtgtgtgactatttctggactttattttgtgctgtgatctaagtgtctttccgtcttgatgctgcactgtcttaattactgaaacaatttcagtaaatatataggcct

SEQ ID NO: 63572 - DNA, 201 bp, Bos taurus; identical to SEQ ID NO: 23009

SEQ ID NO: 63573 - DNA, 201 bp, Bos taurus; identical to SEQ ID NO: 23012

SEQ ID NO: 63574 - DNA, 201 bp, Bos taurus; identical to SEQ ID NO: 23013

SEQ ID NO: 63575 - DNA, 201 bp, Bos taurus
atcagaatggccaagtaaaatgtttccaggtttaaaaataggcacttacacaaaggcatgttttttaatcccaacgtttttgatgacattatctactctacgtccagcacgacgatgcagaaggccacttatttcactacttcacaaatcagaaattatctcattatgcttctatttatgtcttcttccacccagactttt

SEQ ID NO: 63576 - DNA, 201 bp, Bos taurus; identical to SEQ ID NO: 23014

SEQ ID NO: 63577 - DNA, 201 bp, Bos taurus; identical to SEQ ID NO: 23015

SEQ ID NO: 63578 - DNA, 201 bp, Bos taurus; identical to SEQ ID NO: 23016

SEQ ID NO: 63579 - DNA, 201 bp, Bos taurus; identical to SEQ ID NO: 23018

SEQ ID NO: 63580 - DNA, 201 bp, Bos taurus; identical to SEQ ID NO: 23019

SEQ ID NO: 63581 - DNA, 201 bp, Bos taurus; identical to SEQ ID NO: 23020

SEQ ID NO: 63582 - DNA, 201 bp, Bos taurus; identical to SEQ ID NO: 23021

SEQ ID NO: 63583 - DNA, 201 bp, Bos taurus; identical to SEQ ID NO: 23025

SEQ ID NO: 63584 - DNA, 201 bp, Bos taurus; identical to SEQ ID NO: 23026

SEQ ID NO: 63585 - DNA, 201 bp, Bos taurus; identical to SEQ ID NO: 23027

SEQ ID NO: 63586 - DNA, 201 bp, Bos taurus; identical to SEQ ID NO: 23028

SEQ ID NO: 63587 - DNA, 201 bp, Bos taurus; identical to SEQ ID NO: 23029

SEQ ID NO: 63588 - DNA, 201 bp, Bos taurus
ccatgaagttttaatgctctattatatatcctttagttggatgtgaggtgctaaaatcccagaaaatagagggatctaccttgaatcagatagggatagggtaggaaaataaagcttactggtggatatgatgtctaagctcactttgatggactgaacagaacattgttggtgcctagatggttaagaatgctgaagaag

SEQ ID NO: 63589 - DNA, 201 bp, Bos taurus; identical to SEQ ID NO: 23033

SEQ ID NO: 63590 - DNA, 201 bp, Bos taurus
gacaggtaaggatatcttgggcctgtactgggatgatatggagaaaggacaagtttgagacagaattcccaggcagaattggagagtgtgacagagaccatctttttcacttggcctcagtctcttgagttctgctagagactcaggtgcctttcatatctttttttttttttttttttttttaacatataaagtataaac

SEQ ID NO: 63591 - DNA, 201 bp, Bos taurus; identical to SEQ ID NO: 23034

SEQ ID NO: 63592 - DNA, 201 bp, Bos taurus
aaggagaggaggcctggggtaagcctttctgataaataactatgttgatttccacagcaaaagggagggttagaactgggaagggactgaacaagacgcttagtaaaatgtctttttcatggtggcctccctgcttacctgatgttgtagaaatcatgaagcaataaaaccctttgagaatccatgagccagtcataattt

SEQ ID NO: 63593 - DNA, 201 bp, Bos taurus; identical to SEQ ID NO: 23036

SEQ ID NO: 63594 - DNA, 201 bp, Bos taurus
atttttaggtgtgatgcattcccaaaggcatcatcttttaagtcacagcctgaattacacacactctcttttaacatcaaactaatagattaaggcagcaggaactctaaagtagggtaaagtcagaactgatcattttttatccctgttaactaactgactcaggggaaacttgaaattttcagaattaatgaaccaatt

SEQ ID NO: 63595 - DNA, 201 bp, Bos taurus; identical to SEQ ID NO: 23037

SEQ ID NO: 63596 - DNA, 201 bp, Bos taurus; identical to SEQ ID NO: 23038

SEQ ID NO: 63597 - DNA, 201 bp, Bos taurus; identical to SEQ ID NO: 23039

SEQ ID NO: 63598 - DNA, 201 bp, Bos taurus
taaatataaagaagcatggttttctttatattgtttaaataacttgatagaaataatatcactaaaacctacactaaatcaggttttcagtaacctggaacaaattatgcagctacagctatattgtttttcaattattagtgggtaaaatactatggtaagaatccctcctgaaccatgccaccacttggatacccagct

SEQ ID NO: 63599 - DNA, 201 bp, Bos taurus; identical to SEQ ID NO: 23041

SEQ ID NO: 63600 - DNA, 201 bp, Bos taurus; identical to SEQ ID NO: 23044

SEQ ID NO: 63601 - DNA, 201 bp, Bos taurus; identical to SEQ ID NO: 23045

SEQ ID NO: 63602 - DNA, 201 bp, Bos taurus; identical to SEQ ID NO: 23047

SEQ ID NO: 63603 - DNA, 201 bp, Bos taurus; identical to SEQ ID NO: 23048

SEQ ID NO: 63604 - DNA, 201 bp, Bos taurus; identical to SEQ ID NO: 23049

SEQ ID NO: 63605 - DNA, 201 bp, Bos taurus; identical to SEQ ID NO: 23050

SEQ ID NO: 63606 - DNA, 201 bp, Bos taurus
cacctttaaaactgagatactagagtttcctggtggtccagtagttaggactccatgctttcactgtagtgagccttggttccattcctggtcaggaaactaagatcctgaaagccacatggcaaagccaaaaaaaaaacctgcgataccaatacctgctcctgcctatcacaaagggcagctaggaaagacaaatgaatt

SEQ ID NO: 63607 - DNA, 201 bp, Bos taurus; identical to SEQ ID NO: 23051

SEQ ID NO: 63608 - DNA, 201 bp, Bos taurus; identical to SEQ ID NO: 23052

SEQ ID NO: 63609 - DNA, 201 bp, Bos taurus; identical to SEQ ID NO: 23053

SEQ ID NO: 63610 - DNA, 201 bp, Bos taurus; identical to SEQ ID NO: 23054

SEQ ID NO: 63611 - DNA, 201 bp, Bos taurus; identical to SEQ ID NO: 23055

SEQ ID NO: 63612 - DNA, 201 bp, Bos taurus; identical to SEQ ID NO: 23065

SEQ ID NO: 63613 - DNA, 201 bp, Bos taurus; identical to SEQ ID NO: 23067

SEQ ID NO: 63614 - DNA, 201 bp, Bos taurus; identical to SEQ ID NO: 23068

SEQ ID NO: 63615 - DNA, 201 bp, Bos taurus; identical to SEQ ID NO: 23069

SEQ ID NO: 63616 - DNA, 201 bp, Bos taurus
tgtgccacaagggaagcccaagatggtttaattgctgagtaaatgtacagtgaagtttctagatctatagaaaagcaaatcatggtcttctggtcacttattgtctaatgtgaatatgacagtgtcgggcttttatcaactacaacactggttgacaaatctcagcaatggctcatcttatgggacgtgtcccagtgctgc

SEQ ID NO: 63617 - DNA, 201 bp, Bos taurus; identical to SEQ ID NO: 23071

SEQ ID NO: 63618 - DNA, 201 bp, Bos taurus; identical to SEQ ID NO: 23072

SEQ ID NO: 63619 - DNA, 201 bp, Bos taurus; identical to SEQ ID NO: 23073

SEQ ID NO: 63620 - DNA, 201 bp, Bos taurus; identical to SEQ ID NO: 23075

SEQ ID NO: 63621 - DNA, 201 bp, Bos taurus
aagtaattctctaaggtgaggggtgggccagggttcaaaaccaggttatcaaactctgaagttcacacttttaatggcaatgtctttgatgattattagatagggccatgggtttcttgcttgataacagaggagactgaaatggagtgtgtacttcttgcccatttgagggatggcatgggacacaggataaagatgggc

SEQ ID NO: 63622 - DNA, 201 bp, Bos taurus
atggggatagggaggaaaaacccagacccaaggaaagggctgagcagggccctggggcatagccttcgatggaagccaagttttatttagctagtccctcatgtgaagagccagcccaccttatggccagccgaaagcagcacaagcatttctgctcaaactgcccaccgtcccctcatcagctcatgctcagcccctctc

SEQ ID NO: 63623 - DNA, 201 bp, Bos taurus; identical to SEQ ID NO: 23076

SEQ ID NO: 63624 - DNA, 201 bp, Bos taurus
agatgtttgctctctccacggggacctgagcaggcctgaagtcgctgcatttagtgttgctcgcagaggcatgcagagagactcagcattttgagcagagggtggcccaaggggtgagtggactcaaaatcctagaactcacattctggaaggaacttgttaggaatcacggatgtttaacctagggagaagaggggagac

SEQ ID NO: 63625 - DNA, 201 bp, Bos taurus; identical to SEQ ID NO: 23077

SEQ ID NO: 63626 - DNA, 201 bp, Bos taurus
tcgggctagggcgcagccgaggctggtgggccaggagcgggagacggagggcctccgtctgcaggtgctggaggtggtggctgctgctgcggcggaggggaatacatgccgttaggtgccgtgaggggtacccggggtcctaagatgtttcctgggattggaggcataccaggaggggtggggccactcccaggggggtgg

SEQ ID NO: 63627 - DNA, 201 bp, Bos taurus; identical to SEQ ID NO: 23078

SEQ ID NO: 63628 - DNA, 201 bp, Bos taurus
atttttcaggcaagaatactggagtgggttgccatttcctactccagaaaatcttcctgacccaggaattgaaactgcatctcctgaatttaccactgagtgaccagggaagccccagaagttaatgggaatggtcatgttaatcggggatagtatgacagtcaaaagagcactggatcagaagtttgcaaattaagaaat

SEQ ID NO: 63629 - DNA, 201 bp, Bos taurus; identical to SEQ ID NO: 23084

SEQ ID NO: 63630 - DNA, 201 bp, Bos taurus; identical to SEQ ID NO: 23085

SEQ ID NO: 63631 - DNA, 201 bp, Bos taurus; identical to SEQ ID NO: 23086

SEQ ID NO: 63632 - DNA, 201 bp, Bos taurus; identical to SEQ ID NO: 23087

SEQ ID NO: 63633 - DNA, 201 bp, Bos taurus; identical to SEQ ID NO: 23088

SEQ ID NO: 63634 - DNA, 201 bp, Bos taurus
cctagattcatcgtgctttctggacccctttccagcctccacccactcccatctgaacacgccttgctctgaagcttgcaagattacacagagctctgccgtggcctgccctgcaccgcaagccccagacgcccagtctgttgtcatctccaccttgccttcatggcttccctcatccctgcagggctggtcttgacactt

SEQ ID NO: 63635 - DNA, 201 bp, Bos taurus
gggcctcccttcttccagcctgccacttccagagatgcccacagcttcctcatagagctaaaatcagagatgttttccagggctccctccctcacccccccatcctggcccaaattatctattttgaaaacattgggcttcttctttagtacagtcttccatgaagcaggtgtcagactgtcgcagcgacccgcagtgcca

SEQ ID NO: 63636 - DNA, 201 bp, Bos taurus; identical to SEQ ID NO: 23089

SEQ ID NO: 63637 - DNA, 201 bp, Bos taurus; identical to SEQ ID NO: 23090

SEQ ID NO: 63638 - DNA, 201 bp, Bos taurus; identical to SEQ ID NO: 23091

SEQ ID NO: 63639 - DNA, 201 bp, Bos taurus; identical to SEQ ID NO: 23092

SEQ ID NO: 63640 - DNA, 201 bp, Bos taurus; identical to SEQ ID NO: 23093

SEQ ID NO: 63641 - DNA, 201 bp, Bos taurus; identical to SEQ ID NO: 23094

SEQ ID NO: 63642 - DNA, 201 bp, Bos taurus
cctcctgataatagtagtgacataatataataacagctattactatctccgtcttacaagtgagtgacttgagagccaagaaggttaataagcaggggaagtgagattcaagtccaagaaatccactccagggcttggggtttccaaccacaggactacgctgcttctcactaaagggacagaatagcagacattcctttc

SEQ ID NO: 63643 - DNA, 201 bp, Bos taurus; identical to SEQ ID NO: 23095

SEQ ID NO: 63644 - DNA, 201 bp, Bos taurus; identical to SEQ ID NO: 23099

SEQ ID NO: 63645 - DNA, 201 bp, Bos taurus; identical to SEQ ID NO: 23100

SEQ ID NO: 63646 - DNA, 201 bp, Bos taurus; identical to SEQ ID NO: 23101

SEQ ID NO: 63647 - DNA, 201 bp, Bos taurus; identical to SEQ ID NO: 23102

SEQ ID NO: 63648 - DNA, 201 bp, Bos taurus; identical to SEQ ID NO: 23104

SEQ ID NO: 63649 - DNA, 201 bp, Bos taurus; identical to SEQ ID NO: 23105

SEQ ID NO: 63650 - DNA, 201 bp, Bos taurus
atggaatcagagatatagggcagcctccgtctttctggcttgtcctcagtctggcttctttttggttgccagggttgaatgttgcttgggtttgcctaattatactctgaatgggcctcactggcttgggggccagttctgcagtgatggcatgtgacgtctcctggatgcttttcctgggtggtggcaatggcttggagc

SEQ ID NO: 63651 - DNA, 201 bp, Bos taurus
tgaatcataaggccttcaagggaaggaatcatgctgttgatgtttcttttagaacatccctaatatgctgaattgcatactattggtgcctaataagtgcgtggtaaccggccagtgctaaatcattggcactttgttattgtatcagtcctcaaagtcaaatggctgcagtggagattatagtcagagccaggggacctc

SEQ ID NO: 63652 - DNA, 201 bp, Bos taurus; identical to SEQ ID NO: 23107

SEQ ID NO: 63653 - DNA, 201 bp, Bos taurus; identical to SEQ ID NO: 23108

SEQ ID NO: 63654 - DNA, 201 bp, Bos taurus; identical to SEQ ID NO: 23109

SEQ ID NO: 63655 - DNA, 201 bp, Bos taurus; identical to SEQ ID NO: 23111

SEQ ID NO: 63656 - DNA, 201 bp, Bos taurus; identical to SEQ ID NO: 23113

SEQ ID NO: 63657 - DNA, 201 bp, Bos taurus; identical to SEQ ID NO: 23114

SEQ ID NO: 63658 - DNA, 201 bp, Bos taurus; identical to SEQ ID NO: 23115

SEQ ID NO: 63659 - DNA, 201 bp, Bos taurus; identical to SEQ ID NO: 23116

SEQ ID NO: 63660 - DNA, 201 bp, Bos taurus
cttgctttggggagccttgaagaagcagagacagactccatggtagctctgcaatacccagctgggtggtccatccctggccaggacatcgtggtgggcccggcaggaagcagtttccctctggctcccatggggtaacgctgacatctgaagtaagtcagagcagcatggtggccccaggcagctgcctgcctcctgccc

SEQ ID NO: 63661 - DNA, 201 bp, Bos taurus
ttaatatattcccagtaaaccctgaatggtttcctcatctgttaagtaagtttggatgacatcatcgctaaggttatcttcccatccacacgtttggcctgtggttcaaagtctccatccgtccatctctcccgcctgtaggacccagatgtgatcaacaccgctttgccggtagaatacgggcccctcgtggaagaggag

SEQ ID NO: 63662 - DNA, 201 bp, Bos taurus; identical to SEQ ID NO: 23117

SEQ ID NO: 63663 - DNA, 201 bp, Bos taurus
ctgtggtggctccccggtggctctgggccatggacagggcgggcaatgcgtggagccacacatgaagggtggcagggcacttccttctgccccactggactgcccaccatggcctgccctggagagtgcccagtcaggcagggcctccaccaggcactgggcacctttgtgtgaatgtgagtaaagcatccctctgtgcag

SEQ ID NO: 63664 - DNA, 201 bp, Bos taurus
tcagaccacttggccacaactggataatcacacagggtaccggggtgctttagaacaggaagatgaaaccactggtccatctgaaaattccccaggaagtggcctacaaagtccactgcctggctcctacccgggtagaggccgagttacattaaacccttcccatctcccgatcacctgacctgtccccaggaggccagc

SEQ ID NO: 63665 - DNA, 201 bp, Bos taurus
cccagcttgtggaggagagaaaggtacagcaaccacagtggaagagctaacctttcacaggtgaggctagagttatctggatgggcaggcagcctgacccgggcggtcatttggttggggtccagcagtgtttcctctgttatctgccaggcagttttctgttgaggagctggaggacctggggcatcaggaatgggcagg

SEQ ID NO: 63666 - DNA, 201 bp, Bos taurus; identical to SEQ ID NO: 23120

SEQ ID NO: 63667 - DNA, 201 bp, Bos taurus; identical to SEQ ID NO: 23121

SEQ ID NO: 63668 - DNA, 201 bp, Bos taurus; identical to SEQ ID NO: 23122

SEQ ID NO: 63669 - DNA, 201 bp, Bos taurus; identical to SEQ ID NO: 23125

SEQ ID NO: 63670 - DNA, 201 bp, Bos taurus
ccctgttatcagcaattccattttcatccctatgaggacttgtcatgcttgtctagatcattattttgagtttcaactgtataatgctgtcaactgctttataattatacaaatacgattaaaagtccttgagagcagagattctaccttttatttctgcaatgctggattcttaataaatatttgtaggattgaaatgaa

SEQ ID NO: 63671 - DNA, 201 bp, Bos taurus
acttggcggggcctgcgacttccccccaaacagagcgggcacttgctcggtcttcggggcgctcctttcctttctagaactctgggattcggctaggggcgccaggtggggaggacaacaggcccacacttggggcagcaggacgagccctgggcagcggcccttctccagctttctgcgggcctgggccctgccccaccc

SEQ ID NO: 63672 - DNA, 201 bp, Bos taurus; identical to SEQ ID NO: 23126

SEQ ID NO: 63673 - DNA, 201 bp, Bos taurus; identical to SEQ ID NO: 23127

SEQ ID NO: 63674 - DNA, 201 bp, Bos taurus; identical to SEQ ID NO: 23129

SEQ ID NO: 63675 - DNA, 201 bp, Bos taurus
taaatcaatggggtggggctgctgccctggtcttgggctgaggagacaattggttctcaccaatcatcggggactcgatgaaactccatgtgttggtctgggggacgtaagactggaggacgcccgcagctcggcctgcctcgttcacgcccccaaacacatagatcttcccaccacacacggtggctgctgctgagtgca

SEQ ID NO: 63676 - DNA, 201 bp, Bos taurus
caggatggtgaaagtggggttcccaagggcctggtgggagcccaaggcagatgatctgggagcagccaggggtcaggggttttggagggaaggtggccccctcaaggagctagaacttggttagaatttccttagggaggtggacactgggaggagccttggtccttgggatgaggggaggacaagattgggtctggccgc

SEQ ID NO: 63677 - DNA, 201 bp, Bos taurus
gaaaaggaaattctgccaccatcacaaatctgaaggactgtcatggagaacaggagccagctttgctctgatgggcccagagggcagaccatggaagttataggaagacagctcttgaccatttaacatcataaaccatctagctgtgagtggccgcagcttagtccccagcggtggagggaaaattcttgcttctgctgg

SEQ ID NO: 63678 - DNA, 201 bp, Bos taurus
cccgccgaaaggacccagggaggagtcagcggatggcaaccctgagtaaggtgctcaccagagcctgattgtgctggcctcctaatctcagccttccactttgcagaaccacgagcaataaatacctgctgtttataagccgcccaggttacggtttttcattagggccgtctgagctaagacatacacacgcacctccca

SEQ ID NO: 63679 - DNA, 201 bp, Bos taurus
gagttgccgcctcagacgctggaataaccctgcatgactggccagctcctatcttattctccctctaaaacagaagatgcgctgatggctgtcagacttagagcccctctgccagccctggccggcactcagcactctgccaggggctgtgaggggtacagagatgctctcaagaagcccccatctgtaggggttggacca

SEQ ID NO: 63680 - DNA, 201 bp, Bos taurus
caggctgtttttctggagctctctagaggacgtgcaaagttcagtgtgtgctccaccaagtagtacacttttatcaaatgtctgttaggggctaggccccgagctaagtggagaggtgataggatgtacttggtccctgctctaaatttagaaggaaactgtcactcttccaggcctcccagccttcatctacaaccatgc

SEQ ID NO: 63681 - DNA, 201 bp, Bos taurus; identical to SEQ ID NO: 23132

SEQ ID NO: 63682 - DNA, 201 bp, Bos taurus; identical to SEQ ID NO: 23135

SEQ ID NO: 63683 - DNA, 201 bp, Bos taurus; identical to SEQ ID NO: 23136

SEQ ID NO: 63684 - DNA, 201 bp, Bos taurus; identical to SEQ ID NO: 23137

SEQ ID NO: 63685 - DNA, 201 bp, Bos taurus
ataaatatttcttaaatgacaataatcaaataatggagatctagaattggtggtacattttcaaaattgctatttgttaattgtatagtgggcttgaattgaattttaatgggcttgaattgaaagtagtccaaagtgagtgtttttttccatagtaaagtatgttctaatcattaccacagtagttcatatttggtaatg

SEQ ID NO: 63686 - DNA, 201 bp, Bos taurus; identical to SEQ ID NO: 23138

SEQ ID NO: 63687 - DNA, 201 bp, Bos taurus; identical to SEQ ID NO: 23139

SEQ ID NO: 63688 - DNA, 201 bp, Bos taurus; identical to SEQ ID NO: 23141

SEQ ID NO: 63689 - DNA, 201 bp, Bos taurus; identical to SEQ ID NO: 23142

SEQ ID NO: 63690 - DNA, 201 bp, Bos taurus; identical to SEQ ID NO: 23143

SEQ ID NO: 63691 - DNA, 201 bp, Bos taurus; identical to SEQ ID NO: 23144

SEQ ID NO: 63692 - DNA, 201 bp, Bos taurus; identical to SEQ ID NO: 23145

SEQ ID NO: 63693 - DNA, 201 bp, Bos taurus; identical to SEQ ID NO: 23146

SEQ ID NO: 63694 - DNA, 201 bp, Bos taurus; identical to SEQ ID NO: 23148

SEQ ID NO: 63695 - DNA, 201 bp, Bos taurus; identical to SEQ ID NO: 23150

SEQ ID NO: 63696 - DNA, 201 bp, Bos taurus; identical to SEQ ID NO: 23151

SEQ ID NO: 63697 - DNA, 201 bp, Bos taurus; identical to SEQ ID NO: 23152

SEQ ID NO: 63698 - DNA, 201 bp, Bos taurus; identical to SEQ ID NO: 23153

SEQ ID NO: 63699 - DNA, 201 bp, Bos taurus; identical to SEQ ID NO: 23154

SEQ ID NO: 63700 - DNA, 201 bp, Bos taurus; identical to SEQ ID NO: 23155

SEQ ID NO: 63701 - DNA, 201 bp, Bos taurus; identical to SEQ ID NO: 23156

SEQ ID NO: 63702 - DNA, 201 bp, Bos taurus; identical to SEQ ID NO: 23157

SEQ ID NO: 63703 - DNA, 201 bp, Bos taurus; identical to SEQ ID NO: 23158

SEQ ID NO: 63704 - DNA, 201 bp, Bos taurus; identical to SEQ ID NO: 23161

SEQ ID NO: 63705 - DNA, 201 bp, Bos taurus; identical to SEQ ID NO: 23162

SEQ ID NO: 63706 - DNA, 201 bp, Bos taurus; identical to SEQ ID NO: 23163

SEQ ID NO: 63707 - DNA, 201 bp, Bos taurus; identical to SEQ ID NO: 23166

SEQ ID NO: 63708 - DNA, 201 bp, Bos taurus; identical to SEQ ID NO: 23167

SEQ ID NO: 63709 - DNA, 201 bp, Bos taurus; identical to SEQ ID NO: 23168

SEQ ID NO: 63710 - DNA, 201 bp, Bos taurus; identical to SEQ ID NO: 23169

SEQ ID NO: 63711 - DNA, 201 bp, Bos taurus
tgagtctcctctgttaaactgtgagctccttgaaggctaacattatgtggtattattcagctcagtaccacaaagcctggcccattacaggtgctctgtggctgctttaagaataaaagaatgagatggatggatggatggatggatggatggatggatagatggatgatggatacaaggatggaatacaggccttcaggc

SEQ ID NO: 63712 - DNA, 201 bp, Bos taurus; identical to SEQ ID NO: 23170

SEQ ID NO: 63713 - DNA, 201 bp, Bos taurus; identical to SEQ ID NO: 23171

SEQ ID NO: 63714 - DNA, 201 bp, Bos taurus; identical to SEQ ID NO: 23172

SEQ ID NO: 63715 - DNA, 201 bp, Bos taurus
ggagagatggcagagccagacgctggggtcggccgtaggggcaggagtggacacttttcttttgatcccactccagccgcatttcacagtcctttggggccagggtgagctgggtgttccagcagggccacatctctgtgcctgattcatctttggagagctggttattgtaccgtttgatcgcatctgcatgcgacccct

SEQ ID NO: 63716 - DNA, 201 bp, Bos taurus; identical to SEQ ID NO: 23174

SEQ ID NO: 63717 - DNA, 201 bp, Bos taurus; identical to SEQ ID NO: 23175

SEQ ID NO: 63718 - DNA, 201 bp, Bos taurus; identical to SEQ ID NO: 23176

SEQ ID NO: 63719 - DNA, 201 bp, Bos taurus; identical to SEQ ID NO: 23179

SEQ ID NO: 63720 - DNA, 201 bp, Bos taurus
agatgcagaatcaagttaagaggagaagaaagcagttctgtcttgaatattatcgttaaatttaaaaaccctgggaaagaggatttacagttgcggcatttggcctctatgttacacactctccaattatggtgcagctcttctctggtggctcaggcagtaaagaatctgcctgcaataagggagcccaggttcaatccc

SEQ ID NO: 63721 - DNA, 201 bp, Bos taurus
ttgagggtgtggtcagctacttccttttagttcatgggctcaagaacagacctgagatttcactaactctaactactgttaaactgggcacagggcctggcacagtggtctatcctcagcaaatgtttgactgaatgaaatagataagtggaacataaaaactttggccccagagttgttcaccttgattctaatcctagt

SEQ ID NO: 63722 - DNA, 201 bp, Bos taurus; identical to SEQ ID NO: 23180

SEQ ID NO: 63723 - DNA, 201 bp, Bos taurus
aaaaaccatatcatctcttacctaccatactgcaatagatcctcatttttcctccttccaagcttcccctttccacctgtctcacatccacgaggtggccgtgatctgcttaaaactgaaatatgaccatgtcatgtttcctattaaggtcctccagtgtcttcccattgtttatagactaacatccaagatcttcaggct

SEQ ID NO: 63724 - DNA, 201 bp, Bos taurus
taaagataacatgcaagtgagaatacactgtatttaggaagctagacaatctctcaaacacgtttatatattccaactctcatggcccactattagaaaaaaaattatatctgggatgtttcagaaatatctaaattatacatgttcagttcagttcagtcgctcagtcatgtccgactctttgcgaccccatgaatcgca

SEQ ID NO: 63725 - DNA, 201 bp, Bos taurus; identical to SEQ ID NO: 23182

SEQ ID NO: 63726 - DNA, 201 bp, Bos taurus; identical to SEQ ID NO: 23183

SEQ ID NO: 63727 - DNA, 201 bp, Bos taurus; identical to SEQ ID NO: 23184

SEQ ID NO: 63728 - DNA, 201 bp, Bos taurus; identical to SEQ ID NO: 23185

SEQ ID NO: 63729 - DNA, 201 bp, Bos taurus; identical to SEQ ID NO: 23186

SEQ ID NO: 63730 - DNA, 201 bp, Bos taurus; identical to SEQ ID NO: 23187

SEQ ID NO: 63731 - DNA, 201 bp, Bos taurus; identical to SEQ ID NO: 23188

SEQ ID NO: 63732 - DNA, 201 bp, Bos taurus; identical to SEQ ID NO: 23189

SEQ ID NO: 63733 - DNA, 201 bp, Bos taurus; identical to SEQ ID NO: 23190

SEQ ID NO: 63734 - DNA, 201 bp, Bos taurus; identical to SEQ ID NO: 23191

SEQ ID NO: 63735 - DNA, 201 bp, Bos taurus
ccaccagaccccgggagccctcctcccagcccagaccctcggatgcccaccctccctccatccctgtagtctgtggatccgtgccctggggccacccacacggagcctgcttcccatcgtggcatctccagctctcatctccatggcaacactcaccacccccgcgtgcgaggccactgtgcacagctaacccaaggcctg

SEQ ID NO: 63736 - DNA, 201 bp, Bos taurus
tcacatacatccagagatgcaatcacacttgactcattccttcattcgagttcctgtcgtgtatctgatcctgtgttggactctgataatccagtagtgcaagcaaggcacccacagtccctgataccctagagctggcaatcgaaggtggaggacagactttggacatgaaggtatatacttcattgagttcaacaggtg

SEQ ID NO: 63737 - DNA, 201 bp, Bos taurus
gaggccttgcctgctgcattccatggggtggcaaagggtctgatacgactgaacgactgaactgatctgtattacagttattttctcctttaatattttattttttattggagtataattggtttacaatgttgtgttagtttctgctgtacgacacagtgaatcagctgtatgtttacatatatcccctccctctctagc

SEQ ID NO: 63738 - DNA, 201 bp, Bos taurus
gtaatggagtagtcttgtggtgtggaccgcgagcctctcccgcttttgcagcagtaacgactcttaatcgtgatgacagcagttcactaactctgcatttgtggtgtgatgggctgctagtgtagagtagctgagtactaataattatagctcacggattaattaaaaagctaatgtttaactttacccttcatttcctcc

SEQ ID NO: 63739 - DNA, 201 bp, Bos taurus; identical to SEQ ID NO: 23197

SEQ ID NO: 63740 - DNA, 201 bp, Bos taurus; identical to SEQ ID NO: 23198

SEQ ID NO: 63741 - DNA, 201 bp, Bos taurus; identical to SEQ ID NO: 23199

SEQ ID NO: 63742 - DNA, 201 bp, Bos taurus; identical to SEQ ID NO: 23201

SEQ ID NO: 63743 - DNA, 201 bp, Bos taurus; identical to SEQ ID NO: 23202

SEQ ID NO: 63744 - DNA, 201 bp, Bos taurus
cctacaagcaggccagacaagtagatgttaagcttcccttttccagacatcactgtccactgagggagtagggagcatggacacagcatggtcccctcaagtcagcagacaggggccaggtcctgagcaggacccgagtcttcctgaactcctatgctattccccatttgcacagcatcccttgatacatctggtctgtac

SEQ ID NO: 63745 - DNA, 201 bp, Bos taurus; identical to SEQ ID NO: 23203

SEQ ID NO: 63746 - DNA, 201 bp, Bos taurus; identical to SEQ ID NO: 23205

SEQ ID NO: 63747 - DNA, 201 bp, Bos taurus; identical to SEQ ID NO: 23206

SEQ ID NO: 63748 - DNA, 201 bp, Bos taurus; identical to SEQ ID NO: 23209

SEQ ID NO: 63749 - DNA, 201 bp, Bos taurus; identical to SEQ ID NO: 23210

SEQ ID NO: 63750 - DNA, 201 bp, Bos taurus
tgtgaggtgagtcaaccaccgaacctggcttcctgcccacagaacgtggcccacccccttgagtctctgaggctggaggcagtcacttgtgttaacacatggaatacactcataatgacgcctggtgccaaagtgctctgaaccatttgctgctcttacacacgtgagcctcactctccgaataagagtcacgtgagtacc

SEQ ID NO: 63751 - DNA, 201 bp, Bos taurus; identical to SEQ ID NO: 23211

SEQ ID NO: 63752 - DNA, 201 bp, Bos taurus; identical to SEQ ID NO: 23212

SEQ ID NO: 63753 - DNA, 201 bp, Bos taurus
gtcgcttggccccttgggagcgattgattcccagccagcttgagacaggtttggtggagaacgtgacaggtactgtggggtgtgtgggggaaaggggggcagggtaagtgccttgccaaggcccctgggctttgacttactgtgcttcccagggcttttcttgggatgaagagagtggttgctgaattaaagaggaagatc

SEQ ID NO: 63754 - DNA, 201 bp, Bos taurus
gcaaaagactgatgcagggtaggccagagatgatgaggtctgagctgggaggacagacggaggacaaacaagagggatttgggagttctggggatggaggcgcctgtctccgggaggccctgcctctgcacctggggtggggtccgttgggaccagtgttgcaaacagtccacctgcatccttcacaagcccctgcagcaa

SEQ ID NO: 63755 - DNA, 201 bp, Bos taurus; identical to SEQ ID NO: 23215

SEQ ID NO: 63756 - DNA, 201 bp, Bos taurus; identical to SEQ ID NO: 23216

SEQ ID NO: 63757 - DNA, 201 bp, Bos taurus; identical to SEQ ID NO: 23217

SEQ ID NO: 63758 - DNA, 201 bp, Bos taurus; identical to SEQ ID NO: 23218

SEQ ID NO: 63759 - DNA, 201 bp, Bos taurus; identical to SEQ ID NO: 23219

SEQ ID NO: 63760 - DNA, 201 bp, Bos taurus; identical to SEQ ID NO: 23220

SEQ ID NO: 63761 - DNA, 201 bp, Bos taurus; identical to SEQ ID NO: 23221

SEQ ID NO: 63762 - DNA, 201 bp, Bos taurus; identical to SEQ ID NO: 23227

SEQ ID NO: 63763 - DNA, 201 bp, Bos taurus; identical to SEQ ID NO: 23230

SEQ ID NO: 63764 - DNA, 201 bp, Bos taurus; identical to SEQ ID NO: 23231

SEQ ID NO: 63765 - DNA, 201 bp, Bos taurus; identical to SEQ ID NO: 23237

SEQ ID NO: 63766 - DNA, 201 bp, Bos taurus; identical to SEQ ID NO: 23241

SEQ ID NO: 63767 - DNA, 201 bp, Bos taurus; identical to SEQ ID NO: 23242

SEQ ID NO: 63768 - DNA, 201 bp, Bos taurus; identical to SEQ ID NO: 23243

SEQ ID NO: 63769 - DNA, 201 bp, Bos taurus; identical to SEQ ID NO: 23244

SEQ ID NO: 63770 - DNA, 201 bp, Bos taurus; identical to SEQ ID NO: 23245

SEQ ID NO: 63771 - DNA, 201 bp, Bos taurus; identical to SEQ ID NO: 23246

SEQ ID NO: 63772 - DNA, 201 bp, Bos taurus; identical to SEQ ID NO: 23247

SEQ ID NO: 63773 - DNA, 201 bp, Bos taurus; identical to SEQ ID NO: 23248

SEQ ID NO: 63774 - DNA, 201 bp, Bos taurus; identical to SEQ ID NO: 23249

SEQ ID NO: 63775 - DNA, 201 bp, Bos taurus; identical to SEQ ID NO: 23253

SEQ ID NO: 63776 - DNA, 201 bp, Bos taurus; identical to SEQ ID NO: 23254

SEQ ID NO: 63777 - DNA, 201 bp, Bos taurus; identical to SEQ ID NO: 23255

SEQ ID NO: 63778 - DNA, 201 bp, Bos taurus; identical to SEQ ID NO: 23256

SEQ ID NO: 63779 - DNA, 201 bp, Bos taurus; identical to SEQ ID NO: 23257

SEQ ID NO: 63780 - DNA, 201 bp, Bos taurus; identical to SEQ ID NO: 23258

SEQ ID NO: 63781 - DNA, 201 bp, Bos taurus; identical to SEQ ID NO: 23259

SEQ ID NO: 63782 - DNA, 201 bp, Bos taurus
tgcactgagtgtcctaaccttcactcaaggcaggccctgggggacacctccaaatcctccaggaccagagtgtgtctgaccaggccagaccagctcaagggggatgatggatggaggaggacctcagccaccagtcacagccctggaagtcttggacacacacacacacatacccacacatgaaaccgctgtggaacctgg

SEQ ID NO: 63783 - DNA, 201 bp, Bos taurus; identical to SEQ ID NO: 23261

SEQ ID NO: 63784 - DNA, 201 bp, Bos taurus; identical to SEQ ID NO: 23262

SEQ ID NO: 63785 - DNA, 201 bp, Bos taurus
ggatttatccttagtccagaggcatggcccttactgtagaggacattcttgatactaatgcttgacttttctggaatctcagctaaatgaaagaggtgttaagcaaggcctctccactctggaccggctgcacgtgcatgttctgggcgccgtgaagtcttggtacccctgttcacttctcacctcgcagctgatgctgcc

SEQ ID NO: 63786 - DNA, 201 bp, Bos taurus
gggatctcagactcggaagccctggtcttgcccttgagctgaccacggcatgccatgcgttccaggtcggcacaggccacaggtcatccgcaggtcctcccaggctcccaggagtgttttctctaactcggggttcagggtgaactgcagttgtggcttcaggtttttggaaaccagctgggctttggggaccctggaggg

SEQ ID NO: 63787 - DNA, 201 bp, Bos taurus; identical to SEQ ID NO: 23264

SEQ ID NO: 63788 - DNA, 201 bp, Bos taurus; identical to SEQ ID NO: 23265

SEQ ID NO: 63789 - DNA, 201 bp, Bos taurus; identical to SEQ ID NO: 23266

SEQ ID NO: 63790 - DNA, 201 bp, Bos taurus; identical to SEQ ID NO: 23270

SEQ ID NO: 63791 - DNA, 201 bp, Bos taurus; identical to SEQ ID NO: 23271

SEQ ID NO: 63792 - DNA, 201 bp, Bos taurus; identical to SEQ ID NO: 23272

SEQ ID NO: 63793 - DNA, 201 bp, Bos taurus; identical to SEQ ID NO: 23273

SEQ ID NO: 63794 - DNA, 201 bp, Bos taurus
acgcaggatagaccctggaaaaggccttttgtttacggctacttccgtcctgcacgaagtattggaccttctctcttctcagtaccttccgtgaggccacttggtaagttttctgaatcaggagaccaagctgagaacagcattgtggtgtgtcatgtagacactgctgtatttgagatggataaccaagccttgagcctg

SEQ ID NO: 63795 - DNA, 201 bp, Bos taurus; identical to SEQ ID NO: 23274

SEQ ID NO: 63796 - DNA, 201 bp, Bos taurus; identical to SEQ ID NO: 23275

SEQ ID NO: 63797 - DNA, 201 bp, Bos taurus; identical to SEQ ID NO: 23276

SEQ ID NO: 63798 - DNA, 201 bp, Bos taurus
aagacccagcccccaagcagtgggaaggacggaagcacctttctgtgaccacccagagcagcggccatcccggccaggtgctggcaggggctgcaggccaacctgctcgatgtcccgctgtcactgctcctcatctgtcccctacctgtaaaatggggcacgcagaaggggcgaccccgtgggccccagtgaggatggagg

SEQ ID NO: 63799 - DNA, 201 bp, Bos taurus
gaggagctgggaggctggtcagcagagatcgcgggacttcggctggttaaggatgggcagagagccttcacccgcctctgagggcctgcaggtgcccctatcccaaatctcatccttgtccaggggcgttctgcctaagccagtgccaccactgacctaggagccaggggcatccccacacctcccaggcctgtctctgat

SEQ ID NO: 63800 - DNA, 201 bp, Bos taurus
ctataaattgtaaggtacatgaataaaacgcaaaaagcatgccgccagtcttcgtaaccaacatcgccacatcatgaccaatctgttcattttggaactatgatgtaatggcctccagagagggacgggggtggcgggggtggggtggtgcttctcacctggggggtcctctccctgcaccgtcttctgctgcttctgtct

SEQ ID NO: 63801 - DNA, 201 bp, Bos taurus
gcctcacccagaggcaccgggcagtcggccccaggggccaccctccgcctccgaaagcagcaccagcaggggcagtggaaccccagacacaccacgaaacagcaccgcaaaggccctgagcagtgcactgccgctggaaccgcagtccacacggtggcccgggacctgcgtgcggagcctacgcggggagactgcctacta

SEQ ID NO: 63802 - DNA, 201 bp, Bos taurus
cacttaacttggaggccggtatggaaggacctgggtaggagaaacacagccccttctgagctccgagcggaccccacatctcagtttgagcaaaggccccgtgcgggcaaagttaaggtgccccttcactttgtgctacgtttgttccccaggacaggacaagggcgtccaagccagggagctgagcgggtgttgggtgca

SEQ ID NO: 63803 - DNA, 201 bp, Bos taurus; identical to SEQ ID NO: 23280

SEQ ID NO: 63804 - DNA, 201 bp, Bos taurus; identical to SEQ ID NO: 23281

SEQ ID NO: 63805 - DNA, 201 bp, Bos taurus; identical to SEQ ID NO: 23282

SEQ ID NO: 63806 - DNA, 201 bp, Bos taurus; identical to SEQ ID NO: 23283

SEQ ID NO: 63807 - DNA, 201 bp, Bos taurus; identical to SEQ ID NO: 23284

SEQ ID NO: 63808 - DNA, 201 bp, Bos taurus; identical to SEQ ID NO: 23287

SEQ ID NO: 63809 - DNA, 201 bp, Bos taurus
gttcaacaaggaggacagaaaagttcccaaatgaataggaaaaacgccgttaacccaggtcccaagaactgtgcttctggaaggcccccagcagagaactcccccctggagaactccctgtgctgatcctggagctggcaaactcgcccccatggggtacgggccccgcggggagagtcggtccggcgtgccccgggcagg

SEQ ID NO: 63810 - DNA, 201 bp, Bos taurus; identical to SEQ ID NO: 23288

SEQ ID NO: 63811 - DNA, 201 bp, Bos taurus; identical to SEQ ID NO: 23289

SEQ ID NO: 63812 - DNA, 201 bp, Bos taurus; identical to SEQ ID NO: 23290

SEQ ID NO: 63813 - DNA, 201 bp, Bos taurus
cggggtttcctagggccctggcccctcgtgccttactgggggaggtgggtagcaagatagccccgccggacacccttggcctcgtaggttgaagcccagcttgccgcacgctctgactcaaggcgcttccgctcgggaaatgcacacatggccccgagagatgtgtacagacagactcacgacagcgccttcgccagccaa

SEQ ID NO: 63814 - DNA, 201 bp, Bos taurus
gctgggccccaccgtcctcgcccgctgcatgggtgtcagtgagttatctcagaaggctgagctgctgcccaaaccagcgtcacatcaagagtcgaacaggtggctgctggggggccacctgtcgccagcagacacacgggttcaactcaaaagcctccctctgggatgccccaatgcagggactgaactcccccaaaccca

SEQ ID NO: 63815 - DNA, 201 bp, Bos taurus
ccagaggtgcaggtggaacagcggctgccccgccccaagaacacccagtagagcacaggacacagtttagtgggaatttggggccaggccttccccaaagggacatgcccaccccaggagccaacctgatcctcgggcagacggggctgtcccgcgctctgggtgcccacgacccgccctgtcgtgtgtcagaggagtgcc

SEQ ID NO: 63816 - DNA, 201 bp, Bos taurus
caggggacatgatgggctggttggtctcagcagcgtgtaattggacgagagcttccctgggcaccaggggcagaggcgggccccggggacttacagctgtttaatgtttcatcgccctctgtcagtgtctctgccactcagtaacaaacactccggtcctcacctggtgcggcttttttgtcagcatcgcgggccccgggg

SEQ ID NO: 63817 - DNA, 201 bp, Bos taurus
ggacggctcccacggcggggcccgcggtacggacgctcagcagagaatcaaagagctccctgaagctgcacagaggctccaggaggcttctcagacgacacggcctcgaaggtgtgggcgacaggcaggaatggctcctcatgtgtgatggaaattgggttgaactggcgtcgtcctgagccggctgagtgtcttgcccct

SEQ ID NO: 63818 - DNA, 201 bp, Bos taurus; identical to SEQ ID NO: 23291

SEQ ID NO: 63819 - DNA, 201 bp, Bos taurus; identical to SEQ ID NO: 23292

SEQ ID NO: 63820 - DNA, 201 bp, Bos taurus
ggagatgagtgttaaatcattaccaaaaaaaaagaagaagaaagaaatctagaaaactgtctttcagttcttgtttcatgggcaattcattttcttgctatgtaagtcaatttaacttgagatatccagatacctacagcctcaagaatcctaaataagccattgttatgtgctctagaatgcctctagaatacctgtcat

SEQ ID NO: 63821 - DNA, 201 bp, Bos taurus; identical to SEQ ID NO: 23294

SEQ ID NO: 63822 - DNA, 201 bp, Bos taurus; identical to SEQ ID NO: 23297

SEQ ID NO: 63823 - DNA, 201 bp, Bos taurus
gttaacaagctttaatccttacaaaactggaatcgacccttgaaaattggatttatacgtgtgatggttaattttatgtgtcagcttaactaggccacagatatttggtcaaacattattctgtgtacttctgtgaagatattttgggaggcaattaacattcaaattgatagactgaaaagcaggttgcccttgttaaca

SEQ ID NO: 63824 - DNA, 201 bp, Bos taurus; identical to SEQ ID NO: 23298

SEQ ID NO: 63825 - DNA, 201 bp, Bos taurus
tttgcttggccatcctctatgtgcaaatgttctacaatgttttgaaacttgtgtggtctcagaaagcctcttccttagggaacagagctgcacagattgcgggggaagagatggcctggcggaaacatggcagggaaatggaccactcttattcaaagtcctgctagggcttcctctgccttctaaaccagtaaactctcc

SEQ ID NO: 63826 - DNA, 201 bp, Bos taurus
taggatgtgtgcaaactaattactgaggggaagctcattctggagagaggcaagaaagccaactgcttattatgggttgctccagaactccagcctgtcacaccttggcgaaagcagagaatgcagacctgaaaatgcagtcttaaacctgcagccatttctatgcctagtggcaaagcagaatactgtaaagcaactttt

SEQ ID NO: 63827 - DNA, 201 bp, Bos taurus; identical to SEQ ID NO: 23300

SEQ ID NO: 63828 - DNA, 201 bp, Bos taurus; identical to SEQ ID NO: 23301

SEQ ID NO: 63829 - DNA, 201 bp, Bos taurus
ctgtttttgaacatgcaggcacaagtcagtgaagggcatggtgtgtgaagaggtaaccagtggagtctccaagcagagaaaagcaccttctcctgagagcgcccctgggtccatgccacacttgcaccattggcagtattgtcctctctaatacgtctcagggttctcatcatgtcctaaacactgctctccctgtttgct

SEQ ID NO: 63830 - DNA, 201 bp, Bos taurus
tctcttaaaatgctcagcacaggaaactccgcactctctctggagagccctcagtgcgggctgtcatagggacctgtgagggtgagaggaagacagagcacgccgtccctggaggcctccctcagcaccccagccccagccagacacaggcctcgggagccactcgggccccccgcccccgcccttatcaccatccccgcg

SEQ ID NO: 63831 - DNA, 201 bp, Bos taurus
ttgaacagtcgtccccccccccccgctttaaattcctaagggctttgaacacgaaggactttgaacaccgactctccaacagggataatgagatgtcttatggacaatgttttgaccacagttctatatcaaatgtaaaaccttctttatgtgattgtatctttattcagaaacatttgccttgcttttgttgtcaagtga

SEQ ID NO: 63832 - DNA, 201 bp, Bos taurus
cttgagacagctgtcagtgacagatagcaagactagtaatagtaaacagacgctttggttggttttggtatgtaaaagttaagagggagttgctttgcacgtgaaaatttgaattgaaaatgtgttctgtgattgtgcaaaacagcagtgctgtctttaaatttttattcaaaggacagtgaaatagaccaagactgaatt

SEQ ID NO: 63833 - DNA, 201 bp, Bos taurus
gttcattgtatatccgcttaagaatattgtgccagagagagaataacagaacaaaagttgcatttttaaagtgaaagaaagctgcattttgaaggttcataactaatatcacttggcatagaagtagttaaagacacatttagaaaaatggtgatgaaccaaatatttgaattcgtgtgtaattatggttattccaataca

SEQ ID NO: 63834 - DNA, 201 bp, Bos taurus
acacttctttttataaaaggtgatgagattgttttttcaaaaaatacatagatatgtatttaatcatataatagacatctgaataagtccataaataaggaagtggtcaatgactggaacagtcagcataatttatttcagaatccaagatactaaaatagaaatttcctcccctaggttctagtttctcactctcttttt

SEQ ID NO: 63835 - DNA, 201 bp, Bos taurus; identical to SEQ ID NO: 23304

SEQ ID NO: 63836 - DNA, 201 bp, Bos taurus
ttgttagggaccaagcaagaaacaaaacaaccattccagtcaggaggaaagagataggtagataataaatatatagtacacttgaaaatgataaggcctattaaataaacacacagcactgattagtgttgggataaggatctgaggggtagagacaagaattagacattgtaactagagtggccagtagggtgaagacca

SEQ ID NO: 63837 - DNA, 201 bp, Bos taurus; identical to SEQ ID NO: 23305

SEQ ID NO: 63838 - DNA, 201 bp, Bos taurus
caatttttcttttttcttaaatctattcatttgttattgggttgtatgagtctttatgcactttgaatataaacccctcaacattgtatattggaatatgacatggataatacataaataaggatctctgcagatagcctgagtacctccaataaatcattgccacaaggtctatctggctaaatttagcagctttatatg

SEQ ID NO: 63839 - DNA, 201 bp, Bos taurus
agagttcccattcagataaagcaagctttgaacaagaagtgaggaaacttgcttggaagagtgaagacagacgtatggctttctactctttatttacgtgtggccagttaaaatctctgttccctcatatgtaaagtggacttgatatatatctttgaaggtattaataattagaaattacataatgtttgtgaagtacat

SEQ ID NO: 63840 - DNA, 201 bp, Bos taurus; identical to SEQ ID NO: 23306

SEQ ID NO: 63841 - DNA, 201 bp, Bos taurus; identical to SEQ ID NO: 23307

SEQ ID NO: 63842 - DNA, 201 bp, Bos taurus; identical to SEQ ID NO: 23308

SEQ ID NO: 63843 - DNA, 201 bp, Bos taurus; identical to SEQ ID NO: 23309

SEQ ID NO: 63844 - DNA, 201 bp, Bos taurus; identical to SEQ ID NO: 23310

SEQ ID NO: 63845 - DNA, 201 bp, Bos taurus; identical to SEQ ID NO: 23311

SEQ ID NO: 63846 - DNA, 201 bp, Bos taurus; identical to SEQ ID NO: 23312

SEQ ID NO: 63847 - DNA, 201 bp, Bos taurus; identical to SEQ ID NO: 23313

SEQ ID NO: 63848 - DNA, 201 bp, Bos taurus; identical to SEQ ID NO: 23314

SEQ ID NO: 63849 - DNA, 201 bp, Bos taurus
gaaattacatctgaaaaaatattctgaatattaatctctttctcatcatgacatacttcaaaatgcttgtcatactatggccactgatctaaaattattatatcatgaattctggccaacatctactacctctatatcacttaactgggcttcacttgtggctcagatggtaaagaatctgcctgcaatgagagagaccca

SEQ ID NO: 63850 - DNA, 201 bp, Bos taurus; identical to SEQ ID NO: 23316

SEQ ID NO: 63851 - DNA, 201 bp, Bos taurus; identical to SEQ ID NO: 23319

SEQ ID NO: 63852 - DNA, 201 bp, Bos taurus; identical to SEQ ID NO: 23320

SEQ ID NO: 63853 - DNA, 201 bp, Bos taurus; identical to SEQ ID NO: 23321

SEQ ID NO: 63854 - DNA, 201 bp, Bos taurus; identical to SEQ ID NO: 23322

SEQ ID NO: 63855 - DNA, 201 bp, Bos taurus
cttattctcagcaattaaccttagctcttgccttacagagaaattagacaccatcagatcccacccccctttctcattctgaaatcccacaccttcaaacgtgtcctaattttcacctaaatattttccttctctttcttcacaggagatgtttggaactagcacgcgtgccccacttccgtgccccgggtgatctctgta

SEQ ID NO: 63856 - DNA, 201 bp, Bos taurus
gcctaagtgctctgttgctttgtgctttattttattatattgtagggaaacgtatatagcttcaattagtttcatactattaggcttgtgataaagaccaggttctgttctggttgccttacagttaatttatttaattttcatgatgacacactgagaaaggcactgttattagccccattttaaagatgaggaataaat

SEQ ID NO: 63857 - DNA, 201 bp, Bos taurus; identical to SEQ ID NO: 23326

SEQ ID NO: 63858 - DNA, 201 bp, Bos taurus; identical to SEQ ID NO: 23327

SEQ ID NO: 63859 - DNA, 201 bp, Bos taurus
ccaaagtgtgtgcgccgaacagctgacccggtcttgttccaaatccaagggcctgtaagacaaatgggatcggaatggaagccaaataaaaatggaaaaagtgctactccggttacataaagaagtcggtgtttaattagacaggggctatgaatcgcagccttcaaaataaaattgaggggtgaaaaaaaacaataaaac

SEQ ID NO: 63860 - DNA, 201 bp, Bos taurus
aaataaagcagtcatctctcccagtctttttgtttttgtttttgctacttagcttgtaggatcctaattccccaaccaaggatcgaacccgggcccccagcagtggaaactcaaagccctaaacactagcccaccaggggattccccttcaccagtcgcgaaggagtggccatatgttcaagataaatcttgtcagtcagc

SEQ ID NO: 63861 - DNA, 201 bp, Bos taurus
ctcgattagatttgggttccatgtgaatacttcataggtgacactttgaacttcctgttacagcacatctgaaggccgaaggcattctcgttgtctctctctttgtgaaactaagattcatcagaatttagatgtttgtcagcctaatctggccatgcagtcagtgtttcttagtggtcacttacctgatgatttttgcag

SEQ ID NO: 63862 - DNA, 201 bp, Bos taurus; identical to SEQ ID NO: 23330

SEQ ID NO: 63863 - DNA, 201 bp, Bos taurus
atctaatggtgtaacatggtaactatagttagaaacattgtgctgtataactgaaatttgctaagacagtaaaacttaaatgttctcaccaaataaatatataaataaaaaggtaaatacgtgacataatgaatgtagtatataactcagcaggagaaatttttccacaatgtacctgtaagaaacatgtatattaccata

SEQ ID NO: 63864 - DNA, 201 bp, Bos taurus; identical to SEQ ID NO: 23332

SEQ ID NO: 63865 - DNA, 201 bp, Bos taurus; identical to SEQ ID NO: 23334

SEQ ID NO: 63866 - DNA, 201 bp, Bos taurus; identical to SEQ ID NO: 23335

SEQ ID NO: 63867 - DNA, 201 bp, Bos taurus; identical to SEQ ID NO: 23336

SEQ ID NO: 63868 - DNA, 201 bp, Bos taurus; identical to SEQ ID NO: 23338

SEQ ID NO: 63869 - DNA, 201 bp, Bos taurus; identical to SEQ ID NO: 23339

SEQ ID NO: 63870 - DNA, 201 bp, Bos taurus; identical to SEQ ID NO: 23340

SEQ ID NO: 63871 - DNA, 201 bp, Bos taurus; identical to SEQ ID NO: 23341

SEQ ID NO: 63872 - DNA, 201 bp, Bos taurus; identical to SEQ ID NO: 23342

SEQ ID NO: 63873 - DNA, 201 bp, Bos taurus
cctcctggcaggaggaagcatggctggagagcagagagatcaggggccgaaggtcacaataaaaccaaggtcaaaaatggggaatttagcccagagccacacattccattctactaccaagccatcccagccaacaaacatcaccttctctccactcagaactttccacagagggagttccctggcagttcagtggttatg

SEQ ID NO: 63874 - DNA, 201 bp, Bos taurus; identical to SEQ ID NO: 23343

SEQ ID NO: 63875 - DNA, 201 bp, Bos taurus
gccttccaaaacagccgaattctcttttctttcacaacaggccttgacttgctcatcctaaccacaaccccatcattaccagccaaggctaatctgaaccacctttccttgggggccaagaaggctggtcttcaaagacctttgaaaaccttcaaagagatccagagcctgatcctacaaacctgccgcttagaaagcttc

SEQ ID NO: 63876 - DNA, 201 bp, Bos taurus; identical to SEQ ID NO: 23346

SEQ ID NO: 63877 - DNA, 201 bp, Bos taurus
ctttgtctgtgggtaaggcaggattcccctctaaagagctctctctacttcccacactcatgctaatgggccacctaaatggccagaatttatggagtggttcctgtgagtccagaattttttctgaactttcagttcagtcgctcagtcgtgtccaactctttgcgaccccgtggtcagcacgccaggcctccctgtcca

SEQ ID NO: 63878 - DNA, 201 bp, Bos taurus; identical to SEQ ID NO: 23348

SEQ ID NO: 63879 - DNA, 201 bp, Bos taurus; identical to SEQ ID NO: 23349

SEQ ID NO: 63880 - DNA, 201 bp, Bos taurus; identical to SEQ ID NO: 23351

SEQ ID NO: 63881 - DNA, 201 bp, Bos taurus; identical to SEQ ID NO: 23353

SEQ ID NO: 63882 - DNA, 201 bp, Bos taurus; identical to SEQ ID NO: 23355

SEQ ID NO: 63883 - DNA, 201 bp, Bos taurus; identical to SEQ ID NO: 23357

SEQ ID NO: 63884 - DNA, 201 bp, Bos taurus; identical to SEQ ID NO: 23361

SEQ ID NO: 63885 - DNA, 201 bp, Bos taurus; identical to SEQ ID NO: 23362

SEQ ID NO: 63886 - DNA, 201 bp, Bos taurus; identical to SEQ ID NO: 23363

SEQ ID NO: 63887 - DNA, 201 bp, Bos taurus; identical to SEQ ID NO: 23364

SEQ ID NO: 63888 - DNA, 201 bp, Bos taurus; identical to SEQ ID NO: 23365

SEQ ID NO: 63889 - DNA, 201 bp, Bos taurus; identical to SEQ ID NO: 23367

SEQ ID NO: 63890 - DNA, 201 bp, Bos taurus; identical to SEQ ID NO: 23368

SEQ ID NO: 63891 - DNA, 201 bp, Bos taurus; identical to SEQ ID NO: 23369

SEQ ID NO: 63892 - DNA, 201 bp, Bos taurus; identical to SEQ ID NO: 23370

SEQ ID NO: 63893 - DNA, 201 bp, Bos taurus; identical to SEQ ID NO: 23371

SEQ ID NO: 63894 - DNA, 201 bp, Bos taurus; identical to SEQ ID NO: 23372

SEQ ID NO: 63895 - DNA, 201 bp, Bos taurus; identical to SEQ ID NO: 23373

SEQ ID NO: 63896 - DNA, 201 bp, Bos taurus; identical to SEQ ID NO: 23374

SEQ ID NO: 63897 - DNA, 201 bp, Bos taurus; identical to SEQ ID NO: 23375

SEQ ID NO: 63898 - DNA, 201 bp, Bos taurus; identical to SEQ ID NO: 23376

SEQ ID NO: 63899 - DNA, 201 bp, Bos taurus; identical to SEQ ID NO: 23377

SEQ ID NO: 63900 - DNA, 201 bp, Bos taurus; identical to SEQ ID NO: 23378

SEQ ID NO: 63901 - DNA, 201 bp, Bos taurus; identical to SEQ ID NO: 23379

SEQ ID NO: 63902 - DNA, 201 bp, Bos taurus; identical to SEQ ID NO: 23382

SEQ ID NO: 63903 - DNA, 201 bp, Bos taurus; identical to SEQ ID NO: 23383

SEQ ID NO: 63904 - DNA, 201 bp, Bos taurus; identical to SEQ ID NO: 23384

SEQ ID NO: 63905 - DNA, 201 bp, Bos taurus; identical to SEQ ID NO: 23386

SEQ ID NO: 63906 - DNA, 201 bp, Bos taurus; identical to SEQ ID NO: 23388

SEQ ID NO: 63907 - DNA, 201 bp, Bos taurus; identical to SEQ ID NO: 23389

SEQ ID NO: 63908 - DNA, 201 bp, Bos taurus; identical to SEQ ID NO: 23391

SEQ ID NO: 63909 - DNA, 201 bp, Bos taurus; identical to SEQ ID NO: 23393

SEQ ID NO: 63910 - DNA, 201 bp, Bos taurus; identical to SEQ ID NO: 23394

SEQ ID NO: 63911 - DNA, 201 bp, Bos taurus; identical to SEQ ID NO: 23395

SEQ ID NO: 63912 - DNA, 201 bp, Bos taurus; identical to SEQ ID NO: 23396

SEQ ID NO: 63913 - DNA, 201 bp, Bos taurus; identical to SEQ ID NO: 23397

SEQ ID NO: 63914 - DNA, 201 bp, Bos taurus; identical to SEQ ID NO: 23398

SEQ ID NO: 63915 - DNA, 201 bp, Bos taurus; identical to SEQ ID NO: 23400

SEQ ID NO: 63916 - DNA, 201 bp, Bos taurus; identical to SEQ ID NO: 23402

SEQ ID NO: 63917 - DNA, 201 bp, Bos taurus; identical to SEQ ID NO: 23404

SEQ ID NO: 63918 - DNA, 201 bp, Bos taurus; identical to SEQ ID NO: 23405

SEQ ID NO: 63919 - DNA, 201 bp, Bos taurus; identical to SEQ ID NO: 23406

SEQ ID NO: 63920 - DNA, 201 bp, Bos taurus; identical to SEQ ID NO: 23407

SEQ ID NO: 63921 - DNA, 201 bp, Bos taurus; identical to SEQ ID NO: 23408

SEQ ID NO: 63922 - DNA, 201 bp, Bos taurus; identical to SEQ ID NO: 23409

SEQ ID NO: 63923 - DNA, 201 bp, Bos taurus; identical to SEQ ID NO: 23410

SEQ ID NO: 63924 - DNA, 201 bp, Bos taurus; identical to SEQ ID NO: 23412

SEQ ID NO: 63925 - DNA, 201 bp, Bos taurus; identical to SEQ ID NO: 23414

SEQ ID NO: 63926 - DNA, 201 bp, Bos taurus; identical to SEQ ID NO: 23421

SEQ ID NO: 63927 - DNA, 201 bp, Bos taurus; identical to SEQ ID NO: 23422

SEQ ID NO: 63928 - DNA, 201 bp, Bos taurus
tccacaaagtttgacagagggtgatgaatctgcactcctttctcctggcagtcactgacagcagagcccaccagtaacttcaactatcacctaaagaggtttcatgattttctgtattttctaatttcctatatccctaaactaagaggcaatggtaaagccttcctgtgagtaagctgatacacattttgtccttgtgta

SEQ ID NO: 63929 - DNA, 201 bp, Bos taurus
gctcttgggtgacacaactagacttcaaagacaggtagcccagcttgcaagtcgaggcctgtacgctgtgaccccccacactgcagcttctgtttctatcaggcatcattaaggaggcagcacttggcttgtttctgtagatgaagtatgagacaagatttttttaagttttgataaatgaactgtttttctactttctaa

SEQ ID NO: 63930 - DNA, 201 bp, Bos taurus; identical to SEQ ID NO: 23425

SEQ ID NO: 63931 - DNA, 201 bp, Bos taurus; identical to SEQ ID NO: 23426

SEQ ID NO: 63932 - DNA, 201 bp, Bos taurus; identical to SEQ ID NO: 23427

SEQ ID NO: 63933 - DNA, 201 bp, Bos taurus
ctgagagtgaccttgggtcacgtatctttgccaggacctatgtgcatgtcttggaaaggagttgggattgatgcttggctcaggggaaaggctaccttgtaatataggggcccactgggtagtcattcatgaaaaagcagccattcgggtgaaaaagaagaaacaaggccaagcggtctgtactcctaagagcagacggct

SEQ ID NO: 63934 - DNA, 201 bp, Bos taurus
acaaataaaactttgtgtagcacacgtatatagccagactcaaggaggcagctgacttgggataactttttttttctgtctaaaaatcaaaatcatgacacgaggcaccaacatctgggaagatctctacatccttctgaacacaacagtccagtccttctaggttcctggcatcaatatcaactctgagagggtgactgt

SEQ ID NO: 63935 - DNA, 201 bp, Bos taurus
tgtgatttcacaaacttctggggtaggttctactataatcccccacttacagaccaggaaagtggtgtttacagaggttaagaacttgctcaaggccacatcgctagaagatttcaactggatatcaagggatgctagtctggtgagagggaaataggatgaaggagagaggccagtgagatccttgtatctgcccccaca

SEQ ID NO: 63936 - DNA, 201 bp, Bos taurus
ctctaacaaatgaaagtaacaaatctttggtttttatgtaacagatatttattttttaaatgttttagaaattatagggagctaaggcatttagctgaacgatgtgttgatagggacttctaaattttcttcaagcaaatcctggatataaatatggctggtggagattcccctgggaatccccctacatcctactgtact

SEQ ID NO: 63937 - DNA, 201 bp, Bos taurus
catccccgggcgtgcacttacttggcaaggactccatcctgatgggaaccttgtccccactcccccaccccctactctcccacccccatttcacctcccttggttatgcttcctttgtcctgaaacaacactctgtctctctccttaggagatgggttgccctggctcctcagagccagttattaaattttcaggtatttt

SEQ ID NO: 63938 - DNA, 201 bp, Bos taurus
cagcatcagaggacacttgaaatcagacaggagacaaggtctcaaatgatcccctagggtcagacgaagcaggtttgcccgttgggacaagccttggacgcgtggccagtgtggtggaccattcaaggcccaatcccgtgggagacctggaacttagcaggtgtgtagtccaccccccggggatacgtagtagaggactag

SEQ ID NO: 63939 - DNA, 201 bp, Bos taurus
ctgagaataataaactatattgaagggaccctgcccaaccctagggtgagcccacctcttagagggacccccatataaatatgctcaggctaggacaagcgggaatccccagggccggatccaaagccctatttttagaggtgaggagctgcattttgctgggctcaggcaccatctggtgtctactattacactgttaac

SEQ ID NO: 63940 - DNA, 201 bp, Bos taurus
ctcggcggggagaactgtgttgcttgttcaatcacgcgagcactgtcctcgtgtggagctgtgggaagcttgggtttggggattagctgatctgtgcgtcggttgtggctggtttcagagggcaggtgtggcgttggtgtgagatgcacacccagtgatgggggtgcctctgaaactttctgtgtggctgcatgcttgtgc

SEQ ID NO: 63941 - DNA, 201 bp, Bos taurus
catagagggctccagcttggggcatgctgtggacccgccctccccccgccacacacacacttcttactcaggctctgcagcaggagcaccgacggaggccggttcacacacgacactaacctagggcgagggtatctgctcctcacaggggatggagccagagccctagatctgctgtggccactgccttcccaagaagag

SEQ ID NO: 63942 - DNA, 201 bp, Bos taurus
aggattcccaccagctgccccaccctctgcctccccacacttgttccggttagcattagcatctatgggggactgctgatggaggcgaggggaagggttcgggtcacaaaggcacaaggtacctttgtgcagagccttctcccacccttccctccccgggaagcagcaccgcacgtgggcagcacttaggggagcaagtgt

SEQ ID NO: 63943 - DNA, 201 bp, Bos taurus
cggcttggtgctatccggcagagacggggtaagagttaagcacacaacatggaatgaaacaaggcagtgatcttccagaggcaggccattcacaggacacccacagaggcgttgtgcctcgtaaccagccctccctcctaaccacctcaacctgttctctagaatgcaggaagaagaaattttaactacccatgggccctc

SEQ ID NO: 63944 - DNA, 201 bp, Bos taurus
gtgcttgggatggcaaagagtagactgagcaactacatatgcacacacacacacactctccataaatgaccagcgtgtagttcaggcttccttacagacagctttatcacatttgatttctgctccaaagttgatgaatgtcgggcaaattttttgccgcatgaatgcagtgagtgcttggatgacatttttatacacacc

SEQ ID NO: 63945 - DNA, 201 bp, Bos taurus
tccatggagtcacaaagagtcagacatgactaagtgactaacacattgggcatagggatttgggggtgtaattgtaaggagttaatctgtacaagatgcacatcctggcacctggcacttagtgagtaactgctgggggatgtcattgttgctgttgttacagcaccttacagtttacgaggcgcttctatcaatattaca

SEQ ID NO: 63946 - DNA, 201 bp, Bos taurus
ctgcagtccatggggtctcaaagaatcagacacaactgagcgactgaaccgaactgaactgtgctgggtctcgttgctgtgagggctttctctcgttgcaacgagcagggcctaactactcttcctgcagagcacaggctcaatagctgtgttgcatgggctttgttgctcatgggatcttctgggaccaggatcgaactt

SEQ ID NO: 63947 - DNA, 201 bp, Bos taurus
tatttctgccacaacaactttcctttcctctgtgttacttggcaacgtctggttctccactcgccttttaaagatataatacgcgaatacactctgactataaacaggccacatacagttaaaagattctaaagagtcagagactcttctaccacccgtcactcctccaccgcatcccgaacaccacgctctcctccagag

SEQ ID NO: 63948 - DNA, 201 bp, Bos taurus
tctgtatgtgaattttccagggctcttctttgactattcaactgagatttggctgtaaatgaaaacctaataacagaatcctgaaattctagttagcttccatacacccttgcatctcagttcagttcttgcttctctaggcctcattataataattgttttaattggaatactcttctctgaggcttgctgctgctgcta

SEQ ID NO: 63949 - DNA, 201 bp, Bos taurus
actgccaggaattactgtcagaataaattaacactctctgagaaccaatgtcagtctctgcagtaggcagcatgcattggaggccaaggaaggcagaaacgcttgggaaaagggaaaatgaaaaagttttgaaaactctcccaaaatgcaagtttctgcaaatagagactttcgagagtacaggccgagattttggtaaac

SEQ ID NO: 63950 - DNA, 201 bp, Bos taurus
aagccagcctgaggccctcccccatggcatattagtttaggagtaaaaggaatgactggaaaaggaaatggtgaccccttccagtgttcttgccggggaagtcccatggacagaggccaggctacagccccccagggtcacaagagtgggacatgacttagtgactaaactgacactaccaaaaggagcggcagggaagcc

SEQ ID NO: 63951 - DNA, 201 bp, Bos taurus; identical to SEQ ID NO: 23430

SEQ ID NO: 63952 - DNA, 201 bp, Bos taurus; identical to SEQ ID NO: 23431

SEQ ID NO: 63953 - DNA, 201 bp, Bos taurus
cttgctttctagaactctctgcaatcaaacaaactagattatctctgggaaggtggtagaagagagactcctgccttttattacatctggtttatgttccatgttatgaaatagaattaattttgtaaaatggcttttgggatgtacttaaaataatctttcttactcaaagattgtttttactgcttcattttaaatttt

SEQ ID NO: 63954 - DNA, 201 bp, Bos taurus
accaggagtaggtgactttaccgccctgccctgcctctggaggcttttagtgcaaaagaagttggaagtctaactctgccaagatggttctttacgggcccaagtacaccattttctctgttttctggcttttggaataaagttatcattccttgccccaacaactgtccattactgccctgtcctgtcctgcagggccag

SEQ ID NO: 63955 - DNA, 201 bp, Bos taurus
ctctccctcccatgcttaggacctatagtggaaaaggccagccctctctttctacttctggttccaccagtgttgggtgggggtaggggcgggggcgaggagggcagagccagaccacacactggccatgtcacggcagacctctgctgggtgtcgctgcttctctggcataccctgacaggcatcactgtgggtgtactc

SEQ ID NO: 63956 - DNA, 201 bp, Bos taurus; identical to SEQ ID NO: 23432

SEQ ID NO: 63957 - DNA, 201 bp, Bos taurus
acagacaaggtcagctagccagctggctgcccgtgagactcacctggtggagagaaggcagaactcccacagggcaggcagcctgcctggcctggctgggtactgaaggtgcctgaggggcagggaaggcactctcccacgctgtctgcctggttgctgttctggaaggttccaggtgggcagggcctggggctgggagtc

SEQ ID NO: 63958 - DNA, 201 bp, Bos taurus; identical to SEQ ID NO: 23433

SEQ ID NO: 63959 - DNA, 201 bp, Bos taurus; identical to SEQ ID NO: 23435

SEQ ID NO: 63960 - DNA, 201 bp, Bos taurus
catgcttggaaaaattccacctggcacaaatcagtcactaggtggctgaatattgtgaatggaaatagctggcaagaagggaaattctcttggtaaaagatagaggcacataagcgctcgagggtaacatgaaaaaaaaaaaaaaaaacaatttgcttttgagaagctttgataatattttagtggaaacaatattccttt

SEQ ID NO: 63961 - DNA, 201 bp, Bos taurus; identical to SEQ ID NO: 23439

SEQ ID NO: 63962 - DNA, 201 bp, Bos taurus
atgcagctgttgctttttcctttttacaggtgaagaatctgaaggctaacaaaatgggtaacttgcccaaagtcaggactctgggaaaagcacaggtccccagggctgactctgaagcacacatctttacctgtaaagcagtgcttcccagaaagcatgttcatttttactctcacttaaacatttattgtttcatttcca

SEQ ID NO: 63963 - DNA, 201 bp, Bos taurus; identical to SEQ ID NO: 23441

SEQ ID NO: 63964 - DNA, 201 bp, Bos taurus; identical to SEQ ID NO: 23449

SEQ ID NO: 63965 - DNA, 201 bp, Bos taurus; identical to SEQ ID NO: 23450

SEQ ID NO: 63966 - DNA, 201 bp, Bos taurus; identical to SEQ ID NO: 23451

SEQ ID NO: 63967 - DNA, 201 bp, Bos taurus; identical to SEQ ID NO: 23455

SEQ ID NO: 63968 - DNA, 201 bp, Bos taurus; identical to SEQ ID NO: 23456

SEQ ID NO: 63969 - DNA, 201 bp, Bos taurus; identical to SEQ ID NO: 23457

SEQ ID NO: 63970 - DNA, 201 bp, Bos taurus
agtccctccttgctcaaggattaggagatctatctcccgtctactttggagtacaacccctgccaaactgaattggctttttagagctatcctgagaaatcttacccccagaaacttaatttgggatgttccttagaatggcactcatttgtagtcctgaataggtatctgagatctcccaggagctcacaagtggattga

SEQ ID NO: 63971 - DNA, 201 bp, Bos taurus
taagtccatttatgcattatgtagactcatcaataagtggaaaaatattgaaacagacttcactatgcctttctaaatttttttgctccattacctgtgttatttgttctgtatagaattaggactgtcacatattcataaaatttgccttaaattattatgtaatgtgtcttttcaatgactttagtactctgaatatta

SEQ ID NO: 63972 - DNA, 201 bp, Bos taurus; identical to SEQ ID NO: 23460

SEQ ID NO: 63973 - DNA, 201 bp, Bos taurus
gggttccttacttattttgcaaatcttcataagaacaattcatttgctatcactgatatggaaagagaagaaaggcaggagaaatagggagcaagtaaaagagcaagtaaagtgaatggagaatgaagagagaaaaatagagatggacagccaactcccaattatccacagaagaaagaacacagcatatagtcatatatt

SEQ ID NO: 63974 - DNA, 201 bp, Bos taurus; identical to SEQ ID NO: 23462

SEQ ID NO: 63975 - DNA, 201 bp, Bos taurus; identical to SEQ ID NO: 23463

SEQ ID NO: 63976 - DNA, 201 bp, Bos taurus; identical to SEQ ID NO: 23464

SEQ ID NO: 63977 - DNA, 201 bp, Bos taurus; identical to SEQ ID NO: 23465

SEQ ID NO: 63978 - DNA, 201 bp, Bos taurus; identical to SEQ ID NO: 23466

SEQ ID NO: 63979 - DNA, 201 bp, Bos taurus
agaactccttattttaaaactatgaattggttaaatctataagcagtaaaaattatgtgattaatgatataatggatatatttcattatatatatggtacgaagagacgagaaaccatgtcctttaaaggttaagctcaggattcaaatcctgcactaagctatagctacaagtaaaaacaaaaaagttacagtttcatag

SEQ ID NO: 63980 - DNA, 201 bp, Bos taurus; identical to SEQ ID NO: 23467

SEQ ID NO: 63981 - DNA, 201 bp, Bos taurus
cagacacgtgggtctctgtctttcatgagtcccatggcctttagcaaattatttctttggagtcttctttatctcaaaatttttatctacttaataattcgtaccttataaggccgatagtttgttactattattatcctgattttttaaatttaaattacttttgcaatcttaatgttttcctatctactttccctttga

SEQ ID NO: 63982 - DNA, 201 bp, Bos taurus
catactactactgatttcattcaagtggcttaagagttctctcctggactattaaaatcacaggataaatagccaccatatttacatttactttctattccccaggttgctgctgcagtgaaatttttaacatccaatctacacatgatacttgcttgtctccatcatccttcttttgacagaatattgtccacacaattt

SEQ ID NO: 63983 - DNA, 201 bp, Bos taurus; identical to SEQ ID NO: 23469

SEQ ID NO: 63984 - DNA, 201 bp, Bos taurus
ataaaaaggtgagaggagtatagatgaaatgtttaaagttcaacctgcttatcaaatatatagacatagctttgaaatttctaatccagagtaaagataataaaggaaaattgatatttctcctcctcttttccaaaaaggacatttggtatgctcctgcttcagaggtactgtttaagaaaattagaatatttgatagag

SEQ ID NO: 63985 - DNA, 201 bp, Bos taurus; identical to SEQ ID NO: 23471

SEQ ID NO: 63986 - DNA, 201 bp, Bos taurus; identical to SEQ ID NO: 23472

SEQ ID NO: 63987 - DNA, 201 bp, Bos taurus
aggggaaactaggggcttacaaaattatgtgattttcatccttatacataattggtgtcaaatataaacattttagctccaagacttgtaatcctaaccttgtactcagatcactaaactgcatgtacttcagaacattccaaacataaactcttacctggtaaggacctgaaagcttttctagtccagcccttggattgt

SEQ ID NO: 63988 - DNA, 201 bp, Bos taurus; identical to SEQ ID NO: 23473

SEQ ID NO: 63989 - DNA, 201 bp, Bos taurus
tacctttggagaatgtatacccagattttacaaatcacctcttaaaaaatgtctcatttaaggaataataattcacgtgtagccctaggaaataaagacatcctctcatcgtgtcacatcctcccttccttctgtgcaccttgtaaacttcctgccagcctgcaaggcttatttcttgctgtgtacctgccttatcctccc

SEQ ID NO: 63990 - DNA, 201 bp, Bos taurus
acctatggtgctcattagtaaatgtgtagaaatgcttctcctggttattagtcatatctcggattcgtttgtataccggagcactcctatttctcacttcctggagaactgtctgtagcacgatgacattcctgatggcagggtcctcaaggacatcaatcttttaagtaaataaataaatggttattttttcccatgttc

SEQ ID NO: 63991 - DNA, 201 bp, Bos taurus; identical to SEQ ID NO: 23474

SEQ ID NO: 63992 - DNA, 201 bp, Bos taurus
gtgttccaaaaatgccagtgaggcataatttgaattttcatttaaaacaattttgttttattgtaatgagaccctcttgaagtaattagtagaaacaaccactggacatgaaactagttttgagattcactttctttgatataagtcagtttcttaagacatagatccataatgccagtttcccataaaaattagtttgaa

SEQ ID NO: 63993 - DNA, 201 bp, Bos taurus; identical to SEQ ID NO: 23477

SEQ ID NO: 63994 - DNA, 201 bp, Bos taurus; identical to SEQ ID NO: 23478

SEQ ID NO: 63995 - DNA, 201 bp, Bos taurus; identical to SEQ ID NO: 23479

SEQ ID NO: 63996 - DNA, 201 bp, Bos taurus; identical to SEQ ID NO: 23480

SEQ ID NO: 63997 - DNA, 201 bp, Bos taurus; identical to SEQ ID NO: 23481

SEQ ID NO: 63998 - DNA, 201 bp, Bos taurus; identical to SEQ ID NO: 23482

SEQ ID NO: 63999 - DNA, 201 bp, Bos taurus; identical to SEQ ID NO: 23483

SEQ ID NO: 64000 - DNA, 201 bp, Bos taurus; identical to SEQ ID NO: 23485

SEQ ID NO: 64001 - DNA, 201 bp, Bos taurus; identical to SEQ ID NO: 23486

SEQ ID NO: 64002 - DNA, 201 bp, Bos taurus; identical to SEQ ID NO: 23487

SEQ ID NO: 64003 - DNA, 201 bp, Bos taurus; identical to SEQ ID NO: 23488

SEQ ID NO: 64004 - DNA, 201 bp, Bos taurus
gccccccacacatcaaccaagcactgcattctccctcacacagcatccatcaaacgacagtcatcaaggaaagagagtaggggaaaaaagaatcttcccatgtaactgggcatcttttcagacaaagctcatgcagcatcatcagacagtcatattagaaggcgctatataaacacaggcaggaagggtagtgctaacact

SEQ ID NO: 64005 - DNA, 201 bp, Bos taurus; identical to SEQ ID NO: 23489

SEQ ID NO: 64006 - DNA, 201 bp, Bos taurus; identical to SEQ ID NO: 23491

SEQ ID NO: 64007 - DNA, 201 bp, Bos taurus; identical to SEQ ID NO: 23492

SEQ ID NO: 64008 - DNA, 201 bp, Bos taurus
aagctccaaaaaaagaaaacaaagaaacaaaacacattctagtcacataatttcatacatgaaagtgaaagaatggagaacaggccaatgacttgttctgttttttcaccatggagggaaagtagttctggggcgtccccaagagatttacattatgtctgattggccagaatgaaggcacatatccacttctagctggaa

SEQ ID NO: 64009 - DNA, 201 bp, Bos taurus; identical to SEQ ID NO: 23493

SEQ ID NO: 64010 - DNA, 201 bp, Bos taurus; identical to SEQ ID NO: 23494

SEQ ID NO: 64011 - DNA, 201 bp, Bos taurus; identical to SEQ ID NO: 23495

SEQ ID NO: 64012 - DNA, 201 bp, Bos taurus
ggtttctgccatgcaacagtgaaaatcagtcataattatacatatatctcccagttacaaggtccttaaagaattatcccaaaaccaattccagcccccacccatgaaaaactgtctcccatgaaactagtcggagaaggcaatggcaccccactccagtactcttgcctggaaaatcccatggatggaggagcctggtag

SEQ ID NO: 64013 - DNA, 201 bp, Bos taurus
ctccaaaaacagatgaatgagaaagctgatggccaagtctaaggggctaaactctggaaactgctcccctcagcgctcacactcaagatgggaactcagactgacaagaaactgctagacatgaaatcaaacttgagcagaacaggaaaaggaaagagaaggtccagagaaaagaagaaaagaataagccaggaaatctca

SEQ ID NO: 64014 - DNA, 201 bp, Bos taurus; identical to SEQ ID NO: 23496

SEQ ID NO: 64015 - DNA, 201 bp, Bos taurus
gttttattatattccagagactggtatccatcaggctgatcattaatgagtattctcactacctacatcttcgttcccatatttcaactgctttatatgacgtctgatgaaaaaaaaaagtttctatattattagctatactgttttttttttttcttaaaaattctgtacccactcttgaagagtcagtaattatttctt

SEQ ID NO: 64016 - DNA, 201 bp, Bos taurus
cctgggggcagcaatattctacctggctgtgtggttccacctctccaaagcttccctggaggtacaggactttattcagttctttaaaagatgagcgcctaagctcacctcattcactgtggccttccatcgtcacaagatcagaccaacctctttgcagttaggactcttgattttccaagtccctgtaatttatgcgtg

SEQ ID NO: 64017 - DNA, 201 bp, Bos taurus
ttccattaaatcttattcttctagcaggctcttgtatcagctaattaacacaaaagttactgttctcatttttggaataccaacgagttgtcagaacacagccctgactgtgctgctaggttgggaaagacacagcataaacagcatcttctgccccatgagaaggtggatggggctgtttctgatcatgtctctatgttt

SEQ ID NO: 64018 - DNA, 201 bp, Bos taurus
atgcaatgccttaatatccaagcattaataattcttaccactgttttcttaactatagttaacttttaattatctgcaatacagagcaatttatcaacagcgaaacttcatctcctctacagaagcattgtgctaagatttgattactgatcagcgggatttttaattaaaatacaatatgtgatgctggaggaatctgca

SEQ ID NO: 64019 - DNA, 201 bp, Bos taurus; identical to SEQ ID NO: 23497

SEQ ID NO: 64020 - DNA, 201 bp, Bos taurus; identical to SEQ ID NO: 23498

SEQ ID NO: 64021 - DNA, 201 bp, Bos taurus
cagtttcttggtcttgaaacagtaattcataagggttttctgttattgctgcttcagtttatattgcttactttacagactggtgctgcatgttattaaatgttccttttgtaagtgcctgtgactgtactaccagaggagatttggagggagtcacgattgcatcgaagcagaaggaaatgccattcacttttggatttt

SEQ ID NO: 64022 - DNA, 201 bp, Bos taurus
gctaaagctggtgacttttggaaagtatctaggtcccctaaggatgggagctggttgccagtggagctcacaatgtgattagagggttggaattttcagtcgctgatctcctgggagggaagaggggctggagattgaactcagttgtcaatggccaatgttttaatcaatcattgtatatttgattacatatgcttatgc

SEQ ID NO: 64023 - DNA, 201 bp, Bos taurus
cccagcatatgtagtctaagagagaaaggaaaaatggcaacaagggggaaggtgggaaatttttaaataatgggtaacacatgataaggactattctaaaaaccttgcatgtacagttcatggggtgttggaaaggaaggaattttcctttactttccctggttcttctggctggtttaagaattaaattgacatgagaca

SEQ ID NO: 64024 - DNA, 201 bp, Bos taurus
ccaggccccgtcaaaacctctaccagaagttctccagcagctcttcctgaactttatgggtaagttcaaggcaaaggttccaggaagtcatattttagcctgcctctggcccaagccccagtgcagcatgatcagtagtgagccgaacactgcattttcatctccatctggcttgtgtgtcgaacacacaattgattctga

SEQ ID NO: 64025 - DNA, 201 bp, Bos taurus
aaatgaaaatatctcctgctatatcaataaacaagaaatgtcacagtcatcagtggtttctggcctccaaatgtgaatgagggcccccaaaactgtgatctgtcagatgctgccatgccccatgattgctgaagatctgggggaatgcaaaaagcaaggtaaacaaggaaaccggagtggccctagatagctgaggtgcat

SEQ ID NO: 64026 - DNA, 201 bp, Bos taurus
agaagaaaacaagcagcggtctccagcctccaggtcatgaactgatgcctcccgtcagatgaccgagggcattagattacagtgcacaatagatgtaatgcgctaggatcatcccaaaaccaccccctccccctggtccatggaaaacttgtctcccctggtgtcaaaaagcctgggtaccactggtttaaggagttaaat

SEQ ID NO: 64027 - DNA, 201 bp, Bos taurus
ctcacctttgccacaactgaattcctcttcccttccctccacataaatgtctacaaacataaaagacaaactttactccaaatttttttttaaactacttttctattttttttatctccttacacaactcaagtcaactaatcccttagcaaatttcaactttatatgatactatttcactatccaccttcttatatttta

SEQ ID NO: 64028 - DNA, 201 bp, Bos taurus; identical to SEQ ID NO: 23499

SEQ ID NO: 64029 - DNA, 201 bp, Bos taurus
ataatacactattattatcaatacttttaagcacaattgcttaaattactacccaatgaagctggaaaataactaaatacagtcaagaaaaatcagctttctgtactatttatatatttgtagaccatcagaatcacagtcctctctagtacgatttctcaaaaatgatttcataaaggtcccaattagtatacagtgaaa

SEQ ID NO: 64030 - DNA, 201 bp, Bos taurus
ttattggattgcttgtgtacctgtatccatctgtacatttttaaaattcccagagtttgataaaccggtatatttctctaccaatatgggaattttgttatgtacattcctaaagggcaaggttcattggttttatttattctgtactgtctttggcataatttcatctacacagttggtaataattagatatttacagaa

SEQ ID NO: 64031 - DNA, 201 bp, Bos taurus
gaatgaagggctgaggtgagactctgaaagatgaacttgagtggagaggtcaggtctggctcacgggtcaccaccaatctgagttacatccctaactgcccgtccagagctcttccccagagccgtgaaacgtcccatgatccatcatacaggccacacgctgaggccttcaaggaccaagatttggacacaggcacaccc

SEQ ID NO: 64032 - DNA, 201 bp, Bos taurus; identical to SEQ ID NO: 23500

SEQ ID NO: 64033 - DNA, 201 bp, Bos taurus; identical to SEQ ID NO: 23501

SEQ ID NO: 64034 - DNA, 201 bp, Bos taurus; identical to SEQ ID NO: 23503

SEQ ID NO: 64035 - DNA, 201 bp, Bos taurus
ggtgtcagtaagtttggtttctccagaggcctctctccttgacttgtggacaactgcttccttgttatgtcctcacacggccacctcatataacaacatcagttctattggatcatggtcccactcttatgatagcatttaacattaattgcttacttaaaggccctatcggagaaggcaatggcaccacactccagtact

SEQ ID NO: 64036 - DNA, 201 bp, Bos taurus; identical to SEQ ID NO: 23504

SEQ ID NO: 64037 - DNA, 201 bp, Bos taurus; identical to SEQ ID NO: 23505

SEQ ID NO: 64038 - DNA, 201 bp, Bos taurus; identical to SEQ ID NO: 23506

SEQ ID NO: 64039 - DNA, 201 bp, Bos taurus; identical to SEQ ID NO: 23507

SEQ ID NO: 64040 - DNA, 201 bp, Bos taurus; identical to SEQ ID NO: 23512

SEQ ID NO: 64041 - DNA, 201 bp, Bos taurus
tgtgtaagagcctggaagacagacttaaggagaaagatgcccacacaattcagtatcttaaggaaagaccttctcctgtgaatggtcactaaggaggactcgtgctcagtcgctaagtcatgtccaactctttgtgacaccatagactattgccaaggaggactagacctgatcaaaggtctatcatggccccggctctgc

SEQ ID NO: 64042 - DNA, 201 bp, Bos taurus; identical to SEQ ID NO: 23513

SEQ ID NO: 64043 - DNA, 201 bp, Bos taurus; identical to SEQ ID NO: 23514

SEQ ID NO: 64044 - DNA, 201 bp, Bos taurus; identical to SEQ ID NO: 23515

SEQ ID NO: 64045 - DNA, 201 bp, Bos taurus; identical to SEQ ID NO: 23516

SEQ ID NO: 64046 - DNA, 201 bp, Bos taurus; identical to SEQ ID NO: 23518

SEQ ID NO: 64047 - DNA, 201 bp, Bos taurus; identical to SEQ ID NO: 23521

SEQ ID NO: 64048 - DNA, 201 bp, Bos taurus; identical to SEQ ID NO: 23522

SEQ ID NO: 64049 - DNA, 201 bp, Bos taurus; identical to SEQ ID NO: 23523

SEQ ID NO: 64050 - DNA, 201 bp, Bos taurus; identical to SEQ ID NO: 23524

SEQ ID NO: 64051 - DNA, 201 bp, Bos taurus
aaagaagaaatgatttaaataactttcttttgcacacaccacttatgtctcttcacatcaatgttttctgactttgaagtgaccccttcaaaggaagaatcttccccttatcctcgcctctctcttacctctgccagatgaatactttttccagatatttaaaaataatgtatcactgatgttttatttcaaatatgcaac

SEQ ID NO: 64052 - DNA, 201 bp, Bos taurus
actatgtacctctcaagtctgaacaattcatccctctctttgtcaaaatgagaaagccagggccagtgctgagacccaataaactcttccctcgattggagcaaattcctggaggataagggaagcagaatgagatgggaagttggaatgagaaggagggaatagaataatgtcaaactcctcctagaggccaatatcttc

SEQ ID NO: 64053 - DNA, 201 bp, Bos taurus; identical to SEQ ID NO: 23526

SEQ ID NO: 64054 - DNA, 201 bp, Bos taurus; identical to SEQ ID NO: 23527

SEQ ID NO: 64055 - DNA, 201 bp, Bos taurus
aaatagtgttttttcctcaaattgtcttttgtaaaacttccacccaacatgtattaatgatgtctcctaaataaggtataccaggagagaaatgaaagcatagctccttgtaaaacaagtctgcctcattctctcccctagctagttagcttttttcctcacccttcatcttcttctgtgattctaaagagaataataaaa

SEQ ID NO: 64056 - DNA, 201 bp, Bos taurus
ataatatcatttatgtatacataatatcatttaaaataaagtctgatataaaatttacactgattgtcccaatcagaaatgtattcatttctcttctctatgctgactttacccagcaaagtctcacatactccatttgttttttttggtttatggtttttttggtatatgttttatccaggaaaattgtgtgttcctcta

SEQ ID NO: 64057 - DNA, 201 bp, Bos taurus
aaagctcaccaatcacaggaaaaaataaaaccctgtagcattaaacaccaatgttcctagactttcttcacatatgagggctacacttaagagaggcaatgcaactctcagttgaactcataaactgaattaagttcctatttgctacattattttgatatattagctaatccttttaaatatgattttgataaggcgtat

SEQ ID NO: 64058 - DNA, 201 bp, Bos taurus; identical to SEQ ID NO: 23528

SEQ ID NO: 64059 - DNA, 201 bp, Bos taurus
aggaggttgtcaggtgttgaatttgcaatttatgaagaagcacatttccatctttagtagcttgatgtctccagcaccagaagcaagcatcttcatggtgcccttaggttccaagttgatcctcagcacgtcctacatcccttgaacccctgcactgcactgatattgaccaccaatgctgcttgggctcaggccaccttg

SEQ ID NO: 64060 - DNA, 201 bp, Bos taurus; identical to SEQ ID NO: 23529

SEQ ID NO: 64061 - DNA, 201 bp, Bos taurus
aatcctttggaagcagggaaccaacaaaaggcaaaaaagaagggatagttgagaaagagaccagtaccctaaagggtaccttagctcatgatcttagaaactgatgtcttagagcctaccttgctcttagatttttaggtttctgatattatttttaaaattcaagtgaaaggaaaactctatataagcttccttaaggtg

SEQ ID NO: 64062 - DNA, 201 bp, Bos taurus
cacactataaatctttataaagtcctgctagctatgaaataagacattgaagactgactcagacatttaaaaattaatagcagagagacattcagttctctctgtccacaaatgcctctgttttagagggcagcagaagggaaacaaaagaataatgagaatcatttggccagcggtattgctagcacattttagctgcta

SEQ ID NO: 64063 - DNA, 201 bp, Bos taurus; identical to SEQ ID NO: 23530

SEQ ID NO: 64064 - DNA, 201 bp, Bos taurus
gatattcagcactttattagaaaataggttttgtgttagatgcttttgccaaattataggctaatctaagcgtgtaagtattctgagtgtgtttaacgtaggctaggctaagctatgatgttctggaagttacatgaattaagtgcatttttaacatatactattttcaactttcagcgggttaatcaggacataattcca

SEQ ID NO: 64065 - DNA, 201 bp, Bos taurus
cttgaaaaatactgataaattagtaattatttactaacttactaatactgattagtatttacattagctctctgggtcaacacttgaattcacaaggaaaacaaaaccaccatgaaggaatttagtactaaataagggattcatgcctaattgatcaatgctcacaaaatagaagctatttttgagcttctccaaggacac

SEQ ID NO: 64066 - DNA, 201 bp, Bos taurus
cactgttctgtcgcttcaaatttttgtcgcgacgtgacagaaccgaggaaattacacactcccccaacatctatggtgccgtcattaggatttaacctggttgaaacaacctcggctgggccccatcaagcaggagcccaactcagcgaaagctcacacggaggaagctgaacacaaagaaaacccagcgcaggggaagtg

SEQ ID NO: 64067 - DNA, 201 bp, Bos taurus; identical to SEQ ID NO: 23531

SEQ ID NO: 64068 - DNA, 201 bp, Bos taurus; identical to SEQ ID NO: 23532

SEQ ID NO: 64069 - DNA, 201 bp, Bos taurus; identical to SEQ ID NO: 23533

SEQ ID NO: 64070 - DNA, 201 bp, Bos taurus; identical to SEQ ID NO: 23534

SEQ ID NO: 64071 - DNA, 201 bp, Bos taurus; identical to SEQ ID NO: 23535

SEQ ID NO: 64072 - DNA, 201 bp, Bos taurus; identical to SEQ ID NO: 23536

SEQ ID NO: 64073 - DNA, 201 bp, Bos taurus
ggtccaagggtaaggggttttaaaaaggactagaaaatatactttatgaaggtaaaggtttgtcatgaaatgattaaagaaaaccatgctgtttttgaaataagttaaaaagtgacatgagcttgaactctgtcagaacttccctaggacatactttggtcagaactgagggtacaactttctacaaaaatgtcacagaca

SEQ ID NO: 64074 - DNA, 201 bp, Bos taurus; identical to SEQ ID NO: 23538

SEQ ID NO: 64075 - DNA, 201 bp, Bos taurus; identical to SEQ ID NO: 23539

SEQ ID NO: 64076 - DNA, 201 bp, Bos taurus
tcctactccaaggggcctatcttctcagcctagagattgaacctacctctcttgcatctcctgtttggcaggtagatttttttttttttttttaccagtaacaccacctggcctttactcatattggtgcttgatttgaatggattcatccagtttcttaccagtagtttcatatatcattagctctaggtaatgttcagt

SEQ ID NO: 64077 - DNA, 201 bp, Bos taurus
agtatatattaatacctggaagaatctagagattttatttcagcaaatatcataccctcaagcaattgaattcaatcaaacgttgagtccaaatttgttttagagaaagaaacttttcaaattacttcataaaccaaaaatcgagctcctatcagttcttccctgacaatagcgatcaaattacccacataaaacagggaa

SEQ ID NO: 64078 - DNA, 201 bp, Bos taurus; identical to SEQ ID NO: 23540

SEQ ID NO: 64079 - DNA, 201 bp, Bos taurus; identical to SEQ ID NO: 23541

SEQ ID NO: 64080 - DNA, 201 bp, Bos taurus; identical to SEQ ID NO: 23542

SEQ ID NO: 64081 - DNA, 201 bp, Bos taurus
aatggaaactttggaataagatttaattctacttctgacaattcatttctctcttaatggtgagaatacacagaatttatcaaacctgctggactgattctacatctttaatctgaggccatgtctagaagaatgattgctaatgtaattcaagcagcaaaaacatatttagtcaagttagacatttgcataatacataaa

SEQ ID NO: 64082 - DNA, 201 bp, Bos taurus; identical to SEQ ID NO: 23543

SEQ ID NO: 64083 - DNA, 201 bp, Bos taurus; identical to SEQ ID NO: 23545

SEQ ID NO: 64084 - DNA, 201 bp, Bos taurus
atcacacttattcttaatatgctgaaagtcatttagaatgtgtgtgtgtgtgtttcttaaaattacatggcacctcaatcacatgctatggaagatctcactgttgctgagtttctcaaacactccatcccactgtcatgatcttgccccttaaaacagtccccattgtccccactgtatgtttccattggtgttccttca

SEQ ID NO: 64085 - DNA, 201 bp, Bos taurus
ttagacaaaaagcaaactcagaggattttattattcgagttaaaaatgggtcgtaaatcagaggagacaactcacatcagtaacacatctggcccaagaatgggtaacaaacatacagcacagtggtggttcaagaagtattgtaaatgagatgagagccttgaagatgaggagtgcagtgtctggccattggaagttgac

SEQ ID NO: 64086 - DNA, 201 bp, Bos taurus
taattgctctctattataatgccattctgataacaaaacttcattcaataattgaataataattttcaagtgcagtactcataaggggtagtgcagaaaacacacagacaatgcatgcttcctcaacttcaaggtgttcattagtgagaaagatactaaccaagcttactccattgaaagcagaattatgtaaatggtatg

SEQ ID NO: 64087 - DNA, 201 bp, Bos taurus
ttacagtctccataggccaaattgagagtttgctttgctttgttgaacccataccagaagatgtatttccccccatacttctatactttttacaagggtaggaatgagaagtggatgtctctagttgctctggtgtatcaatctagacttaactaaagaaactgaaccaataaaatgtgtatatcaaatatatgttgttgt

SEQ ID NO: 64088 - DNA, 201 bp, Bos taurus; identical to SEQ ID NO: 23549

SEQ ID NO: 64089 - DNA, 201 bp, Bos taurus; identical to SEQ ID NO: 23552

SEQ ID NO: 64090 - DNA, 201 bp, Bos taurus
acattgcaggtagattctttaccgtctgagtcaaagagacccatgttgatgatagagatctaaaagaagcctagatctttgatgaatcatagaaattgacattctcacattttaaaagtgatatcagtacagttcagttcactagttcagtcatgtccaactttgtttaccccatggactgcagcacaccaggcttcccta

SEQ ID NO: 64091 - DNA, 201 bp, Bos taurus; identical to SEQ ID NO: 23553

SEQ ID NO: 64092 - DNA, 201 bp, Bos taurus
ccaacagccctacttgaagcacaatagggaattacagtcagctgaaaggcagcctaagttcagattgttaattagtgagagtaaaaaaattactaataaataagagaaaggaacaaagggatagatagaatggtgatagaagcaaatttcacctaatttctctgagttacccctcatttctatttaaacagttgaacaaat

SEQ ID NO: 64093 - DNA, 201 bp, Bos taurus
tatctgtgacccaaaataaattctctgttccatataagaatataccagagaaaaatagggcactaaaaatcgtacaaagagatttataatcctttcttccatacagactcacctcaaggaatatagaatttagaatcctgataaggccacaagactaaaataaagcccatctctaaagatcaagaataactactctccata

SEQ ID NO: 64094 - DNA, 201 bp, Bos taurus
aaaaatgcatattctcaatgaaattgctatttttgtactcaaaactcagcaaaaattgttttgagattttttttttctcatttcaaaatatttttcttatatatgttaattagaaattgaagcaaatacaagtcttagtttaagttcatgtgaaaattcaagatatttgttaaattccaacaaaatttataaagcagtcta

SEQ ID NO: 64095 - DNA, 201 bp, Bos taurus; identical to SEQ ID NO: 23554

SEQ ID NO: 64096 - DNA, 201 bp, Bos taurus; identical to SEQ ID NO: 23555

SEQ ID NO: 64097 - DNA, 201 bp, Bos taurus; identical to SEQ ID NO: 23557

SEQ ID NO: 64098 - DNA, 201 bp, Bos taurus; identical to SEQ ID NO: 23558

SEQ ID NO: 64099 - DNA, 201 bp, Bos taurus
tagtaacatcagggttttccaaaaatattgagaaccttaaaaaataaaaatatgccatcctggactcatgtattcatccatgttcttttgtacgtgtatacgtgtgtatgcatggatgattgtggaaaattgcattctgctacacatgaaaataaagaagagtccatgatttcaaggacccaaactgagtggcagttagaa

SEQ ID NO: 64100 - DNA, 201 bp, Bos taurus; identical to SEQ ID NO: 23560

SEQ ID NO: 64101 - DNA, 201 bp, Bos taurus; identical to SEQ ID NO: 23561

SEQ ID NO: 64102 - DNA, 201 bp, Bos taurus
tggcaggacactcagagctccccgttgttcaggggcctatatggagctattaccatttgtaactttatggacttaatccaagaggttatgacctggtaactgcactgagaatacaagggccagacaagagtgctgcaaagagcataaaaagagggcctgttaaagggagaagccacgatgcccagctccagatattatgcc

SEQ ID NO: 64103 - DNA, 201 bp, Bos taurus
atgttcctgttttaatcctccaaatttatgaatatgtaacttttcattgtaaagctacacaattaaataagtgtaattgagtcaatgaccttgaaatggagagattatgttggattgtgttaatttgtcatagcagcaaggggacactaatgtagaagttgtgagtggattaaatatgaaatgaattataatatgtaaaca

SEQ ID NO: 64104 - DNA, 201 bp, Bos taurus; identical to SEQ ID NO: 23564

SEQ ID NO: 64105 - DNA, 201 bp, Bos taurus; identical to SEQ ID NO: 23565

SEQ ID NO: 64106 - DNA, 201 bp, Bos taurus; identical to SEQ ID NO: 23566

SEQ ID NO: 64107 - DNA, 201 bp, Bos taurus; identical to SEQ ID NO: 23567

SEQ ID NO: 64108 - DNA, 201 bp, Bos taurus; identical to SEQ ID NO: 23573

SEQ ID NO: 64109 - DNA, 201 bp, Bos taurus
acatttaaatatatacagtgtcttctatatctaatgcacacctctcaagtaatagtattagctggcatttctgaaatttaatggtgagtttctatatgtcacgcactagactaagagctgttcattcttatttccaaaacaaaacacaatagccttatgacaaggattctctttttatcacctgtttagaggcaagaaaac

SEQ ID NO: 64110 - DNA, 201 bp, Bos taurus
aatcaataaactgaaatataatcaggttggagaacatgttgaagtacatcagtgcagggagagaaaagaagaaaatggccacatcagattgaattatttgggaaagttgaagggcaatgtagtttagcctctgctgtattacttagtatgggagaaatgagctccaccacagggcttgagggccaggggtctggacaacaa

SEQ ID NO: 64111 - DNA, 201 bp, Bos taurus; identical to SEQ ID NO: 23574

SEQ ID NO: 64112 - DNA, 201 bp, Bos taurus; identical to SEQ ID NO: 23575

SEQ ID NO: 64113 - DNA, 201 bp, Bos taurus; identical to SEQ ID NO: 23577

SEQ ID NO: 64114 - DNA, 201 bp, Bos taurus; identical to SEQ ID NO: 23579

SEQ ID NO: 64115 - DNA, 201 bp, Bos taurus; identical to SEQ ID NO: 23581

SEQ ID NO: 64116 - DNA, 201 bp, Bos taurus; identical to SEQ ID NO: 23583

SEQ ID NO: 64117 - DNA, 201 bp, Bos taurus
aagcaaatcagcacatttttagccagtagaaaatataaatgaatttaaaaatcaggatgcattaattgaatgcactcaattataatttaagttcctaactgaagttttccgtctttagatttgggtattccaggctaccctttacttcatggatgctaatattaatagatgaacttagaagcaaaatcaagaccttatcca

SEQ ID NO: 64118 - DNA, 201 bp, Bos taurus; identical to SEQ ID NO: 23585

SEQ ID NO: 64119 - DNA, 201 bp, Bos taurus; identical to SEQ ID NO: 23586

SEQ ID NO: 64120 - DNA, 201 bp, Bos taurus; identical to SEQ ID NO: 23587

SEQ ID NO: 64121 - DNA, 201 bp, Bos taurus; identical to SEQ ID NO: 23588

SEQ ID NO: 64122 - DNA, 201 bp, Bos taurus
cgcgccgagcgcggagcccgggccagcctccgcgcggcgcggcgggccaggcacgggccgcttcccactcctcggtcctctgggcctccgcccgggacttacaactaacttcgcccaagtttcctgcgccggcgccgccgcgcccctgtcggcgcgctagcttcggagcgtgcgcccgcgtgtgctccgcggccagagccc

SEQ ID NO: 64123 - DNA, 201 bp, Bos taurus
ctcttcaccgtccccaagcttcctggcatcagctcacattttttgcaaactgcccgagaccaagtgtcctacctcttccagctctagccctcagctggaaaccgatttattaaatagctgcacaaggtttggaaggttgcccgggatgttcccatccggacaaaaaaagagaatccagtgagacaaaactgagatcctggg

SEQ ID NO: 64124 - DNA, 201 bp, Bos taurus; identical to SEQ ID NO: 23589

SEQ ID NO: 64125 - DNA, 201 bp, Bos taurus; identical to SEQ ID NO: 23590

SEQ ID NO: 64126 - DNA, 201 bp, Bos taurus
gcgcgcgtccgcggaggtgaaggccaagccgctgcgggcgctgatgagcgcctggcccgcgcctgctgccctcagctcctttcgcacatggttggcctagggtggggtaggagcgctttccattggcgctggactttttgcatggcttagtgccgccccaggcaggctgtgtggtcccagctggcgccctggtacactgtg

SEQ ID NO: 64127 - DNA, 201 bp, Bos taurus; identical to SEQ ID NO: 23592

SEQ ID NO: 64128 - DNA, 201 bp, Bos taurus; identical to SEQ ID NO: 23593

SEQ ID NO: 64129 - DNA, 201 bp, Bos taurus
gacaattagaacaggtgcatcggagcccatggtgtgagagcctgataaaagaaatggtaagggtgtggactcaattagctgggcaggaatgagaactgaccggcccctagccatgacctcgaaagtggatcaagatggcatttaaaacaaagaaactatattacagcaaatatagggcctttataattgcttaagtaccta

SEQ ID NO: 64130 - DNA, 201 bp, Bos taurus
ggaaaggattttcacaaatgaaaggacgctcctcagaaggaggaaggttcagcatttgtgagaaacatatccatcctctataacgggatttcctccaatgcggccactctgctgatttctgtcatcacaatgatttttgtcaacttttgacattcccataagtggagctgcacggtacccgctcttgtgtctgccttcttt

SEQ ID NO: 64131 - DNA, 201 bp, Bos taurus
ggtgggtttcagatgacctggtggccctctgctacctggggcggcaggacctggagggaggctgtggatgcgtggaaggaattcctgcgaggtcagtacatagcatttctccttccacatggccaggaggagcagagggatagaaaacaaagccagagccacagggaggcagcgaacagagcttgctggtgagcaaggcac

SEQ ID NO: 64132 - DNA, 201 bp, Bos taurus
ataacagaataatatatatatatataatagaataataatataataacagaataaaccagtctttgagaattttctgggaaagttagaaatgagtgaggaggtaacattttgaatacattcagattaaagcagaggcttcgtactgtctcaaggagggaggagtttaggggagttgattctgtctttgacagactttcagca

SEQ ID NO: 64133 - DNA, 201 bp, Bos taurus
gacagaggagcctggcaggctacagtccatggggtcgcaagagtcggacatgacttaagaactgaaccaccaccaccatgccgtagggtatacagtagtagaaacggaacgttgtaacatgaaacttacataatgctataagtcaatgttacctcagtaaaacaaagtgtttaaaaactgaagtgaatattgaaataaaga

SEQ ID NO: 64134 - DNA, 201 bp, Bos taurus; identical to SEQ ID NO: 23596

SEQ ID NO: 64135 - DNA, 201 bp, Bos taurus; identical to SEQ ID NO: 23597

SEQ ID NO: 64136 - DNA, 201 bp, Bos taurus; identical to SEQ ID NO: 23598

SEQ ID NO: 64137 - DNA, 201 bp, Bos taurus; identical to SEQ ID NO: 23601

SEQ ID NO: 64138 - DNA, 201 bp, Bos taurus; identical to SEQ ID NO: 23602

SEQ ID NO: 64139 - DNA, 201 bp, Bos taurus
tcttgaccttcagtgggcatccctaaccttctaaagctgaccttcaaagttccgtttcccccacagcccttcccaggccaaaccaccccacttgatggctatttctgtagcttctaatcccttaagcaccacttacagatggactcgcttgcacttttaatggtaggtcatttgcacgagttaacctgaccccaacccagc

SEQ ID NO: 64140 - DNA, 201 bp, Bos taurus; identical to SEQ ID NO: 23605

SEQ ID NO: 64141 - DNA, 201 bp, Bos taurus; identical to SEQ ID NO: 23606

SEQ ID NO: 64142 - DNA, 201 bp, Bos taurus; identical to SEQ ID NO: 23607

SEQ ID NO: 64143 - DNA, 201 bp, Bos taurus; identical to SEQ ID NO: 23609

SEQ ID NO: 64144 - DNA, 201 bp, Bos taurus; identical to SEQ ID NO: 23610

SEQ ID NO: 64145 - DNA, 201 bp, Bos taurus; identical to SEQ ID NO: 23612

SEQ ID NO: 64146 - DNA, 201 bp, Bos taurus; identical to SEQ ID NO: 23613

SEQ ID NO: 64147 - DNA, 201 bp, Bos taurus; identical to SEQ ID NO: 23615

SEQ ID NO: 64148 - DNA, 201 bp, Bos taurus; identical to SEQ ID NO: 23616

SEQ ID NO: 64149 - DNA, 201 bp, Bos taurus; identical to SEQ ID NO: 23617

SEQ ID NO: 64150 - DNA, 201 bp, Bos taurus; identical to SEQ ID NO: 23619

SEQ ID NO: 64151 - DNA, 201 bp, Bos taurus; identical to SEQ ID NO: 23627

SEQ ID NO: 64152 - DNA, 201 bp, Bos taurus
ttgttccagtcactttcattccatgagggtttcatcatctacaatatgtgccctcacccatggatcctgtaatgcgaccaagcccttaacacatactcaacgggaagtagttttgcaagttacacatattttcatttttatgtaattaatgtttctttctatctacatttcaacaaggaacattttaaggacaggatgtca

SEQ ID NO: 64153 - DNA, 201 bp, Bos taurus; identical to SEQ ID NO: 23633

SEQ ID NO: 64154 - DNA, 201 bp, Bos taurus; identical to SEQ ID NO: 23635

SEQ ID NO: 64155 - DNA, 201 bp, Bos taurus; identical to SEQ ID NO: 23636

SEQ ID NO: 64156 - DNA, 201 bp, Bos taurus; identical to SEQ ID NO: 23638

SEQ ID NO: 64157 - DNA, 201 bp, Bos taurus; identical to SEQ ID NO: 23639

SEQ ID NO: 64158 - DNA, 201 bp, Bos taurus; identical to SEQ ID NO: 23640

SEQ ID NO: 64159 - DNA, 201 bp, Bos taurus; identical to SEQ ID NO: 23641

SEQ ID NO: 64160 - DNA, 201 bp, Bos taurus; identical to SEQ ID NO: 23643

SEQ ID NO: 64161 - DNA, 201 bp, Bos taurus; identical to SEQ ID NO: 23644

SEQ ID NO: 64162 - DNA, 201 bp, Bos taurus
tcttgtttcagagtctgtgtgcaattagggaccctgcaacttataaactctgtaaattacctctgggattgcagcctcagtccagtgacgaagtgctttgcgtcacacaccacctgtatgctcatggaatgtccaccccagagagggatgtgcatgccacaaatggtgggagagcaggagagctattcctagagtataaaa

SEQ ID NO: 64163 - DNA, 201 bp, Bos taurus; identical to SEQ ID NO: 23645

SEQ ID NO: 64164 - DNA, 201 bp, Bos taurus; identical to SEQ ID NO: 23648

SEQ ID NO: 64165 - DNA, 201 bp, Bos taurus
tttcaaacagccttgggatgcagggcctgaccatctcactgcaatgcagcttggttagttcccttaggctccaccagcgctgtgttatggagcacgtgactggtcgtgggccatcaccatctgacatacgacagtcatgagctactagaaacattcagtcctgggctggatgggatctttgtgctggcaaagagttgggac

SEQ ID NO: 64166 - DNA, 201 bp, Bos taurus
gtaaccttgctctttggctcatcggattattcgtggtcttgaaatactattttatgcagatgccagccggtctgctggcatgccacatgtgcctgagtgatagagaatggtgactttgaaaggtgtttcacatgctaaatgaatgtcctcttcctaccggattctgaaataattccagtgtgatccaaatgctgatagtat

SEQ ID NO: 64167 - DNA, 201 bp, Bos taurus
taagacagagactttgacacatgtttgtagaatccattataggtgttttgggtcatgtttataggaaatagaaaggggtgatgttcaggtccacggcagaaaactcacttttattaatcattatattaataagataaagatttgacagcaacagttccatctatgattttgagttgccaagagaaaaatctgtcttccatt

SEQ ID NO: 64168 - DNA, 201 bp, Bos taurus; identical to SEQ ID NO: 23649

SEQ ID NO: 64169 - DNA, 201 bp, Bos taurus
tagagcagatcactgtggttgaaacaaaactggggccggggggatatgttaggaaaggaagaatagcatctaaaaggctaagcctaatgagatgggaggaacttcccaggggcaaagaactggcctgccaatgcaggaaacataagagatgcaggttcgatccctggatcgggaagatcctctggaggagggcatgacaac

SEQ ID NO: 64170 - DNA, 201 bp, Bos taurus; identical to SEQ ID NO: 23651

SEQ ID NO: 64171 - DNA, 201 bp, Bos taurus; identical to SEQ ID NO: 23652

SEQ ID NO: 64172 - DNA, 201 bp, Bos taurus; identical to SEQ ID NO: 23653

SEQ ID NO: 64173 - DNA, 201 bp, Bos taurus; identical to SEQ ID NO: 23654

SEQ ID NO: 64174 - DNA, 201 bp, Bos taurus; identical to SEQ ID NO: 23656

SEQ ID NO: 64175 - DNA, 201 bp, Bos taurus; identical to SEQ ID NO: 23657

SEQ ID NO: 64176 - DNA, 201 bp, Bos taurus
gatggtctccagaataaagtaccgcgggagccagcatcctgtgtgcttttaataaagcagagagacggcccgggctccgacagcactttctgcatattcacatttggattgttgcatgtttaacgttaatgctgtctattttctgccttttaggtgcttaggcgattgtaacattttaacactgctctgaaataagtgctt

SEQ ID NO: 64177 - DNA, 201 bp, Bos taurus
caccgggcagccaggaacctgtctgtcggctggctttctggaaggttcccacctggtttatccccaaggcctccctctgtcttggcctcaacccacacctcgagatgctgagtgtgagtccatgggggtcgtctcaggggggacccgggatcggtacccggcccctggcagacacacagaaaatacaggtggaatggaagg

SEQ ID NO: 64178 - DNA, 201 bp, Bos taurus; identical to SEQ ID NO: 23661

SEQ ID NO: 64179 - DNA, 201 bp, Bos taurus
ttaaggtctatttatttattcattcattttcggccgtggcgggtcttcacggctgcagtgaagttctctcttgtggcaggtgggccccctctcccttgccgtgctcaggcttctcatcgcagcggctcctcttgaggagcacagctctgggctcgtggactcagcagttgtggcctgagggtgctagagcgctggctcagt

SEQ ID NO: 64180 - DNA, 201 bp, Bos taurus; identical to SEQ ID NO: 23662

SEQ ID NO: 64181 - DNA, 201 bp, Bos taurus
tgaaaactaaagtgttaaggtagctttaaacaaatgtatacacttgaattaaggactttgataaaggatacttctaaaattaaaagaaactattgtatccaatgtaatatttatataacattttaaagctatcatttacaccatctattatgtggcagacactttaaatatacaaagtatcattattgatcttgctggaaa

SEQ ID NO: 64182 - DNA, 201 bp, Bos taurus
gcaaggaactgccaggctctgggaggccctggcttgtccacgaggctgtgtggtgggatgacagctccctgtgtacctgcaccccccgtaccccatgaaacaagcaagtgaccgggtaggccttgcttggagggggcatccgggccagggtggtgggtcaccagcagcaatggtgggaggtgaggaccccacggagctgcc

SEQ ID NO: 64183 - DNA, 201 bp, Bos taurus
gcccacacggtgcagggcgacccctcagggcagacgtaaagctaacgtccaggtgcccacttatcagcgtgcagggtgactgatttagactgttgcttaatactaaagggccctgctctacagaagcgggagggactctgggcgaaccgccgtcccctgcagccaccctggcccccggctgcccaccccgcccgcccccct

SEQ ID NO: 64184 - DNA, 201 bp, Bos taurus
tgtgtcccagtaaacctatcgtgagcgaaaatatttaagtcaaaaatgcatttaatacacctcacctacttggtggcttggcctggcctacctcaaacatactcaggacactaaagtctatttcataataaagtgttgaagagttcatgtgatttattgaacactgtactgaaagtgaaaatcagagtggccgtctgtaca

SEQ ID NO: 64185 - DNA, 201 bp, Bos taurus; identical to SEQ ID NO: 23663

SEQ ID NO: 64186 - DNA, 201 bp, Bos taurus; identical to SEQ ID NO: 23668

SEQ ID NO: 64187 - DNA, 201 bp, Bos taurus; identical to SEQ ID NO: 23670

SEQ ID NO: 64188 - DNA, 201 bp, Bos taurus; identical to SEQ ID NO: 23671

SEQ ID NO: 64189 - DNA, 201 bp, Bos taurus; identical to SEQ ID NO: 23672

SEQ ID NO: 64190 - DNA, 201 bp, Bos taurus; identical to SEQ ID NO: 23673

SEQ ID NO: 64191 - DNA, 201 bp, Bos taurus; identical to SEQ ID NO: 23674

SEQ ID NO: 64192 - DNA, 201 bp, Bos taurus; identical to SEQ ID NO: 23675

SEQ ID NO: 64193 - DNA, 201 bp, Bos taurus; identical to SEQ ID NO: 23677

SEQ ID NO: 64194 - DNA, 201 bp, Bos taurus; identical to SEQ ID NO: 23679

SEQ ID NO: 64195 - DNA, 201 bp, Bos taurus
gtgatcctcttgaaaggttctgaggcatacagtgttcatattcctttgggttttgccttccacccacctgctctgacagacctttaattttggaccgctgcggttgaagcccgtggatgcacagtccccaaagccagcactaacttgtttgctttggagaggcctgacgaaaataggctgctttttaacgcaaatagctca

SEQ ID NO: 64196 - DNA, 201 bp, Bos taurus
aatagaaatgtatattttatgtttcttcaagttcattagtacctttactagtgttgctgtttcctttcctccatgattgattatctgaaatatttttctataaacatagacacacatgtatttgcctcaaatctggcccaaattattatacaaatggatcttcatttgttcccttcactcatttttatttcctttatcaca

SEQ ID NO: 64197 - DNA, 201 bp, Bos taurus; identical to SEQ ID NO: 23680

SEQ ID NO: 64198 - DNA, 201 bp, Bos taurus
gcggccccctgcaggggtgacaagcgggtggtctgtgtccctgactttcctgaaggtcttcctcataggaacgtgatggaaggctcaggagcagagcctctggccctagaggtaggcctcttgggtgcgtgtgggagctgagcgcctggagaagggggagcggggtgccgcctgtggaggggccacgtctgcaggccccgg

SEQ ID NO: 64199 - DNA, 201 bp, Bos taurus; identical to SEQ ID NO: 23681

SEQ ID NO: 64200 - DNA, 201 bp, Bos taurus; identical to SEQ ID NO: 23682

SEQ ID NO: 64201 - DNA, 201 bp, Bos taurus; identical to SEQ ID NO: 23683

SEQ ID NO: 64202 - DNA, 201 bp, Bos taurus
gcccaggaggaacagggggaattctggtcccttctcaccctgcgcagtgtggctcccggtccagctcaaactcttgcgtccagactcttgtgagacctcacgtttgcataatcttgaaagagaatggatgtacttaaaacaaacaaaccaaaagtttgaagacgtttatcccttgaaagcaaagtggtctgttgtccttct

SEQ ID NO: 64203 - DNA, 201 bp, Bos taurus
catataattctcagatccataacttgagccttgaccttacttttcctaagcactggtacttctaagagattttcagttaaacaaatggcccaagtgcacactgtatgtaattgatcaaaaaatgaagacctttcctacatctgtcctccttgtttaacagtctgtaacaggtgctaaaccccagggccatcttgtatctgc

SEQ ID NO: 64204 - DNA, 201 bp, Bos taurus
aggtagttaagtgtagtgggttttggtttttgttttattttcttttaaaattacactcggctattgttttttcaggagacacatcgaatttcagactcaagtctgccccctggtgttgaaaatagtaaaagcacctgaagctacttagttctgttcagttcggtttagtccctcagtggtgtctgactctttgtgacccca

SEQ ID NO: 64205 - DNA, 201 bp, Bos taurus; identical to SEQ ID NO: 23684

SEQ ID NO: 64206 - DNA, 201 bp, Bos taurus; identical to SEQ ID NO: 23685

SEQ ID NO: 64207 - DNA, 201 bp, Bos taurus
ggcaaggatgtggctacaagtagtttatttgggaggtgacggaggaagtgcagcaagggagggggtactgaaatggggtgggaaaggcagtaagtatgtgtgcgtgagcctattattggtgtctcagtcttgcaggaagtgtgccccactgagcgacagggaagctggggtgtctctgcaccagctccagttcattgggtg

SEQ ID NO: 64208 - DNA, 201 bp, Bos taurus; identical to SEQ ID NO: 23686

SEQ ID NO: 64209 - DNA, 201 bp, Bos taurus
attatatttttataagagaagatggcagaaaccacattggaaacagagaatcaaatctgtcatttggccatagcatccaaaagagaagagagatctaaaagcattccatacacacggagagcaccaagcaaggtttactatggattcatggtctacatcatctgagtctattcagcaatttcctccaacagaatgacaaag

SEQ ID NO: 64210 - DNA, 201 bp, Bos taurus
tgagtcacatctgctcatatcccattggctaaggccaggtaatatggataaaatcagagtcaaagggcaggggagcaagctcagcctgtggaaggaagacactggaaagccacagggccaaaggcgtggataccagaagggctgaagaataggaagacagagcttttcaaaggactggcaatgctacattaacagctggga

SEQ ID NO: 64211 - DNA, 201 bp, Bos taurus; identical to SEQ ID NO: 23687

SEQ ID NO: 64212 - DNA, 201 bp, Bos taurus
agattagggcatactaaagggcagagaaaaacatctagcagttcatgttccttgacctctcagaagcccattatgtaggcctttaggttataaagggtcagtttccttctcaacacatttcccttaaggcgtaaatgtttggtaatgtgctcattaaacattaaggcctcaaacaagcacaaacacccttttttggtacag

SEQ ID NO: 64213 - DNA, 201 bp, Bos taurus; identical to SEQ ID NO: 23688

SEQ ID NO: 64214 - DNA, 201 bp, Bos taurus
agtgacacagtagtggcaaagtgatcacacatcattacatagtgcacacgtgattatttatgccttctcaaccacagtgtaagttacaagcaattattttcccgtctcctccatgtaattacactgtaatctgctgggacatgtaattgcatggacggcttctgcactgaattacgcagctctcagggaccatgtgagacc

SEQ ID NO: 64215 - DNA, 201 bp, Bos taurus
cacagaagttctcccctacatatccataacccttgtccttgaatcttgtcttagtctcacattatagtttccatttagttatttgctgctccactacatataaactgttaagataaaatcattttttaaagtatttatttatttatttatttttatctgtctgtgccaggagaaggaaatggcaacccactccagtgttct

SEQ ID NO: 64216 - DNA, 201 bp, Bos taurus
ctctctgagacttttccatcatagctggaacttcatgccaacgtttcttaaccatagagacccatttctcatcttgcaaaacgtgccagaacagaactcctactgacttgcagaatggttctgacacaggcagacccctgagagctcagagcatgatgagcaaagggaagactgtgtccatctcctgattctcagctctca

SEQ ID NO: 64217 - DNA, 201 bp, Bos taurus
ttttagatagttaaaatgagaaggtcttatggagaacctgtacttgtagagctgtagattattttgttcaaaggagatctcaaacagaagcaaaattgatcaaaactgtcataaaataaagaattcttataatgtagtaggtttgtgcaaataacagaagcttttcctgggcccagttcaggtcatgtggtgtcaagacca

SEQ ID NO: 64218 - DNA, 201 bp, Bos taurus; identical to SEQ ID NO: 23689

SEQ ID NO: 64219 - DNA, 201 bp, Bos taurus; identical to SEQ ID NO: 23690

SEQ ID NO: 64220 - DNA, 201 bp, Bos taurus; identical to SEQ ID NO: 23692

SEQ ID NO: 64221 - DNA, 201 bp, Bos taurus; identical to SEQ ID NO: 23694

SEQ ID NO: 64222 - DNA, 201 bp, Bos taurus
tgtgcttggggactgggagggccattcaaacccagagggcaggcttcaatcctgcagagactgtgagtctgtgagtctgactggggcccggggttctacgttgctcacaagcccccaggtgatcccccactgccggaccacccttctccaagtatgtaccatggcagcacccacaactaaaaggctgaggtccagggactc

SEQ ID NO: 64223 - DNA, 201 bp, Bos taurus; identical to SEQ ID NO: 23696

SEQ ID NO: 64224 - DNA, 201 bp, Bos taurus; identical to SEQ ID NO: 23697

SEQ ID NO: 64225 - DNA, 201 bp, Bos taurus; identical to SEQ ID NO: 23698

SEQ ID NO: 64226 - DNA, 201 bp, Bos taurus; identical to SEQ ID NO: 23699

SEQ ID NO: 64227 - DNA, 201 bp, Bos taurus; identical to SEQ ID NO: 23701

SEQ ID NO: 64228 - DNA, 201 bp, Bos taurus; identical to SEQ ID NO: 23703

SEQ ID NO: 64229 - DNA, 201 bp, Bos taurus; identical to SEQ ID NO: 23704

SEQ ID NO: 64230 - DNA, 201 bp, Bos taurus; identical to SEQ ID NO: 23705

SEQ ID NO: 64231 - DNA, 201 bp, Bos taurus; identical to SEQ ID NO: 23706

SEQ ID NO: 64232 - DNA, 201 bp, Bos taurus
acagtcttaagtagtgtgtcctaagtccaaataactgagccagcccaaaactcaaatccttaaggggtcagacagatgagaggaatacagaagtattagcgtgtaaggcttaaggaagggcaggttctgctgcgaaaggaaatgcactgtgttcttcccaccacccacccccgccccagggaatccatagtgtgctgtcca

SEQ ID NO: 64233 - DNA, 201 bp, Bos taurus
ggcaggaactagaatttactgagagtggtactccatgaagttgcagttagggaaggtctgtgtgccacaaaaagcagcagtttgatttcactgtgattgcggtgggccaccattagacgcttttttttttttttctttctcttgaatattcgtgttttattttattttattttttttaattttattttatttttaccttta

SEQ ID NO: 64234 - DNA, 201 bp, Bos taurus
gaactctgggagttggtgatggacagggaggcctggcgtgctgcaattcatggggtcgcaaagagtcagacatgactgagcgactgaactgaactgaactgttggtcatgtgtagaggtatggcctttgaagtcaaacgatctggctctgtaagtgtctgtccctctctgcacacagctcacgtcctctcctgcccttagt

SEQ ID NO: 64235 - DNA, 201 bp, Bos taurus
ctcgacctactggagtctgcattttaacactcctgttcctgatgcttgaattgactttctctccccaccccagctagctagtctctaaagaggctgagaacgaaggcctcgcttgtggagtggggaagtcatgccctggtgagctgactctgcccacagcaacaggaggagaaaggagaacaactttggaggtgagagacc

SEQ ID NO: 64236 - DNA, 201 bp, Bos taurus
tggaagactctgttagtttagatgtaatattcacttttagccttcttcatttataataatcccaattttatttggaatggcaattcacccagctattaaagaaagaagccacacatgtttaccaggactccaattcaattacgtgtgattgtgtgtctgggacatgaattctaaatgcaagtttgttggagattactatca

SEQ ID NO: 64237 - DNA, 201 bp, Bos taurus
ccccttctgtcatctgatttaatggaaattctagtcagtgtcagcttgtacagtgattttagagactgattaatgagttgtcactgttttaaattggatataggtaatcagaggcaggaataaaagtatcttagcatctgagcaacccagaacattcaacaagtgatgaatgaaaccatgagagcccttcagatgtgtgat

SEQ ID NO: 64238 - DNA, 201 bp, Bos taurus; identical to SEQ ID NO: 23708

SEQ ID NO: 64239 - DNA, 201 bp, Bos taurus; identical to SEQ ID NO: 23709

SEQ ID NO: 64240 - DNA, 201 bp, Bos taurus; identical to SEQ ID NO: 23710

SEQ ID NO: 64241 - DNA, 201 bp, Bos taurus; identical to SEQ ID NO: 23711

SEQ ID NO: 64242 - DNA, 201 bp, Bos taurus; identical to SEQ ID NO: 23712

SEQ ID NO: 64243 - DNA, 201 bp, Bos taurus; identical to SEQ ID NO: 23713

SEQ ID NO: 64244 - DNA, 201 bp, Bos taurus; identical to SEQ ID NO: 23714

SEQ ID NO: 64245 - DNA, 201 bp, Bos taurus; identical to SEQ ID NO: 23715

SEQ ID NO: 64246 - DNA, 201 bp, Bos taurus; identical to SEQ ID NO: 23716

SEQ ID NO: 64247 - DNA, 201 bp, Bos taurus; identical to SEQ ID NO: 23717

SEQ ID NO: 64248 - DNA, 201 bp, Bos taurus; identical to SEQ ID NO: 23718

SEQ ID NO: 64249 - DNA, 201 bp, Bos taurus; identical to SEQ ID NO: 23720

SEQ ID NO: 64250 - DNA, 201 bp, Bos taurus
gggccccggggacagacgctttggctcttcttgcccctggcgctcctgtaaccagagggtctcacctgcagtgtggacatctcccctcccctcccgttcagggcaggggcttgggggcctggcggccccactgctagtgggaaaggcctcggacctcagctacgaaggcagctcaggaggctccgaggggacgcaccccga

SEQ ID NO: 64251 - DNA, 201 bp, Bos taurus; identical to SEQ ID NO: 23722

SEQ ID NO: 64252 - DNA, 201 bp, Bos taurus; identical to SEQ ID NO: 23723

SEQ ID NO: 64253 - DNA, 201 bp, Bos taurus; identical to SEQ ID NO: 23724

SEQ ID NO: 64254 - DNA, 201 bp, Bos taurus; identical to SEQ ID NO: 23726

SEQ ID NO: 64255 - DNA, 201 bp, Bos taurus; identical to SEQ ID NO: 23727

SEQ ID NO: 64256 - DNA, 201 bp, Bos taurus; identical to SEQ ID NO: 23729

SEQ ID NO: 64257 - DNA, 201 bp, Bos taurus; identical to SEQ ID NO: 23730

SEQ ID NO: 64258 - DNA, 201 bp, Bos taurus; identical to SEQ ID NO: 23731

SEQ ID NO: 64259 - DNA, 201 bp, Bos taurus; identical to SEQ ID NO: 23732

SEQ ID NO: 64260 - DNA, 201 bp, Bos taurus; identical to SEQ ID NO: 23733

SEQ ID NO: 64261 - DNA, 201 bp, Bos taurus; identical to SEQ ID NO: 23737

SEQ ID NO: 64262 - DNA, 201 bp, Bos taurus
ctcggcctctttgggaatgggacccagatactgtgcattttttaaaatataaatttatttattttaattggaggctaattactttatgcattccgggccatgcacggtcacggtgaagacaggggtttcgggttaaaggttgggagaaagttaagaggggacgggggtgtgcgtctctgctaccctagagagaggccagaa

SEQ ID NO: 64263 - DNA, 201 bp, Bos taurus
atcacacgtcttatcacagcccccaaggccaacagcaggggttccctcttaacttctgagccccttggaggaagggagtatgttgatcacaccacagagaatcactgaaaaagaaaagccacttctcccactgacgacaacactggtaataaggaagagctcagaagtcaagcagatgtcgattttgaaaaatctaaatat

SEQ ID NO: 64264 - DNA, 201 bp, Bos taurus; identical to SEQ ID NO: 23738

SEQ ID NO: 64265 - DNA, 201 bp, Bos taurus
aatcttccgtggtgcgcccggttttaggccgtgcattatctgttctcacaaatcactctcttagttggcgccatagttttattttttgatttttctcaaacagtggccccaacacagtgcattgtttcagatggagtattcagaatgtgggtactgaatgatagcagctgcccatcctgaactagaaatggaggaaagcat

SEQ ID NO: 64266 - DNA, 201 bp, Bos taurus
cagagacaggacggctgagtgggaagggaatcagggaaaagagctaagtcttcctggttttaaaaggccaagtctgaggacaggatgtgtacacactgttagctgtactttgtgattacaacttttgagcatattttcaatataggtctctggaccattctctgctctgtacacatacctttcacaagtatttaaagcaga

SEQ ID NO: 64267 - DNA, 201 bp, Bos taurus; identical to SEQ ID NO: 23743

SEQ ID NO: 64268 - DNA, 201 bp, Bos taurus; identical to SEQ ID NO: 23744

SEQ ID NO: 64269 - DNA, 201 bp, Bos taurus; identical to SEQ ID NO: 23745

SEQ ID NO: 64270 - DNA, 201 bp, Bos taurus; identical to SEQ ID NO: 23747

SEQ ID NO: 64271 - DNA, 201 bp, Bos taurus
tttgggtatttatcttgaatttaaatccatggtcatcaacatcaggatagataacagctttcctataaaactttgtttcaggcacatttttatgctgcctatctctacccgtctatctctctgtctgtctgtctctccatccatccatctaatcagcgaatcctcttttctgtgagaaaatatcaatattattattatctc

SEQ ID NO: 64272 - DNA, 201 bp, Bos taurus; identical to SEQ ID NO: 23750

SEQ ID NO: 64273 - DNA, 201 bp, Bos taurus
ttccctaccaagaccatcacagaaatcagaaaactccaacctaggagatcctcgagtgtgtgtatgaattccttctttaccactgtcatctcagatgctatgatgatacttaacgttttgactaagattttccagtttcaacttaaatttcaatgcgtgtgcctaattattgcctgcctgacatgtattttaaatcatcca

SEQ ID NO: 64274 - DNA, 201 bp, Bos taurus; identical to SEQ ID NO: 23752

SEQ ID NO: 64275 - DNA, 201 bp, Bos taurus; identical to SEQ ID NO: 23756

SEQ ID NO: 64276 - DNA, 201 bp, Bos taurus; identical to SEQ ID NO: 23757

SEQ ID NO: 64277 - DNA, 201 bp, Bos taurus; identical to SEQ ID NO: 23763

SEQ ID NO: 64278 - DNA, 201 bp, Bos taurus; identical to SEQ ID NO: 23764

SEQ ID NO: 64279 - DNA, 201 bp, Bos taurus; identical to SEQ ID NO: 23765

SEQ ID NO: 64280 - DNA, 201 bp, Bos taurus
gggaagtccccccaaacagcaccttttaaattactaattgcctgcctctgttttgttatcttttgtttttttgttcactgggccgcgcttattgttgttggctctttcttcttattgggtaaatgcagaggctggtttgatggtctatgtaatttctgggtcatagtgactcaaacttgtgtgaaatggatgagcttctcc

SEQ ID NO: 64281 - DNA, 201 bp, Bos taurus
gaaaaccctgtaagtttttttgtgacatgacacaaaaatgttttatttctcatgcatacaaagtctgttgtttgcgatgactttatgatttaggccacattcatggtgtggtgatgccatcataacatgtggattccaagtcgtcatgacaggggaagaaagagctaatggttcctcacagctcttacatatgttggccca

SEQ ID NO: 64282 - DNA, 201 bp, Bos taurus
ccagtgcccagtctgggtctccaggccaccctccactctggcacagctccctccaggggtacccaaacctccaaactgccacgcccagcacacatctgagacaggctggggcctaggaccctctgctctagcactgcaatgcttaccccaggcacccctctcctctagcaacaaaatacaaagaaactgaatgggactaaa

SEQ ID NO: 64283 - DNA, 201 bp, Bos taurus; identical to SEQ ID NO: 23767

SEQ ID NO: 64284 - DNA, 201 bp, Bos taurus; identical to SEQ ID NO: 23768

SEQ ID NO: 64285 - DNA, 201 bp, Bos taurus
ttctccatagatggattatatgtcatggcaattatgtgttgtagtatgccctgcagtctttacataatttttgttgagggagaaaagactgttttgctctaaactcttaaaaacttttttttaaattgtggtaaaaatacataggggcttccctggtagctcagctggtaaagaatctgcctgcagtgcaggagaccccag

SEQ ID NO: 64286 - DNA, 201 bp, Bos taurus
agacatgggccgatctggatcctacctgaacagcagtatcaattcagcctggagtgagcacagcttggatccagaagacattcgggtaacaccagcatttctacttttctgttttagattaggcccatttgtacatcatacgtgtgtgggcaggtgttcatgtgttctttgtgttatagaacttgtgtgattatgtaagga

SEQ ID NO: 64287 - DNA, 201 bp, Bos taurus; identical to SEQ ID NO: 23769

SEQ ID NO: 64288 - DNA, 201 bp, Bos taurus; identical to SEQ ID NO: 23770

SEQ ID NO: 64289 - DNA, 201 bp, Bos taurus
gattttgagaagggacgaatcagctgcatttccaattccaggcagggggcagatccattccttttacctgaaattggactttaatcagcctccttttataatttcctcaatggttaaaacagcgttgtagttgttgtaggtgttcacaggtcatattgtttacaaggacaaatctaccatataaatgctggctttgtgatt

SEQ ID NO: 64290 - DNA, 201 bp, Bos taurus; identical to SEQ ID NO: 23772

SEQ ID NO: 64291 - DNA, 201 bp, Bos taurus
gggggggcggttcaggatgaatcaagcacactaccttcattgtgcactttttctctattattattattattacgacataataataataataataataatattattattattataactcgaaggttgaggatccctgttctagagcaaagggaagagggaaagtgttggaaggagagcattctagagatggctatattttca

SEQ ID NO: 64292 - DNA, 201 bp, Bos taurus
cgggtaaaataaaactgtcaggtctctgcagagtgccacaagtaaatgcaccatgggccaatctgtctactagatcttagtgacgtttatcatcaaacccacctgcttttctgaaaaatggaaacttatttaatcatcgtgaaaacagcaagaagccgaataattattgcaatgatggcaatcgttggaaatgcaatagac

SEQ ID NO: 64293 - DNA, 201 bp, Bos taurus
attttgtatgacagtcatgaaagaaaggtaaagaagtaatcacctggctgtcttaattaatgtacatttgagagagttcagctttctataattagatccccccaccccagtgtcaaaagacacacatacacacagagctcttccctttctttcccaggactgccatagacaactttttggttaaatccatgttcagtggtt

SEQ ID NO: 64294 - DNA, 201 bp, Bos taurus; identical to SEQ ID NO: 23774

SEQ ID NO: 64295 - DNA, 201 bp, Bos taurus; identical to SEQ ID NO: 23775

SEQ ID NO: 64296 - DNA, 201 bp, Bos taurus; identical to SEQ ID NO: 23776

SEQ ID NO: 64297 - DNA, 201 bp, Bos taurus; identical to SEQ ID NO: 23777

SEQ ID NO: 64298 - DNA, 201 bp, Bos taurus; identical to SEQ ID NO: 23778

SEQ ID NO: 64299 - DNA, 201 bp, Bos taurus; identical to SEQ ID NO: 23779

SEQ ID NO: 64300 - DNA, 201 bp, Bos taurus; identical to SEQ ID NO: 23780

SEQ ID NO: 64301 - DNA, 201 bp, Bos taurus; identical to SEQ ID NO: 23781

SEQ ID NO: 64302 - DNA, 201 bp, Bos taurus; identical to SEQ ID NO: 23782

SEQ ID NO: 64303 - DNA, 201 bp, Bos taurus; identical to SEQ ID NO: 23783

SEQ ID NO: 64304 - DNA, 201 bp, Bos taurus
tgacacaaaaggtactctgtagataatactgaaaaacattgtcagggaaagtgcaaagttgatatttgtgtccctgttatgcagaaggggccctagagagctgaagactaactaaagctgtgtgcttctgggtaggacaagattcataccatctgcctgggtctgggcctcagtgctctctgcaataccatgctgtctcct

SEQ ID NO: 64305 - DNA, 201 bp, Bos taurus
cagaggacccattttcaaagaactaaacgagaaaaaaagcattaaatattgatgttgaggtgtttacaataagaagctgtggtccagccactatcctacaacgtaatcactaactggcaaactccggacctcacaaagtcttgctagtttccagcgccttttctactgcctctctcctaaatgcagcagacaaggaaggca

SEQ ID NO: 64306 - DNA, 201 bp, Bos taurus
aaggtccttcccttcatctctgcccttaaaaatcctaaccctccttctagacccatcccaaatttcacttcccctgcaatgtgcctttccagacactccaacctccttgaaccatctttcgtgtgtctctctttggggcacttacattcagccttgcagtgtgtgtgacggctggttccatcaaaagccctgcctcacctc

SEQ ID NO: 64307 - DNA, 201 bp, Bos taurus
tctggagcgaagcagggtgattgagcagatgtgcagtgaggaggcctaaattatgctagacctgactggcctgctaactggccatgtgaccttgattagatgacttcttttccttgactgtggtttccccggaagaaatgtaaatggatggggccaaatcagcgttttcaaaacttctaaagacaaagtggccagtaagct

SEQ ID NO: 64308 - DNA, 201 bp, Bos taurus; identical to SEQ ID NO: 23785

SEQ ID NO: 64309 - DNA, 201 bp, Bos taurus; identical to SEQ ID NO: 23786

SEQ ID NO: 64310 - DNA, 201 bp, Bos taurus; identical to SEQ ID NO: 23788

SEQ ID NO: 64311 - DNA, 201 bp, Bos taurus; identical to SEQ ID NO: 23789

SEQ ID NO: 64312 - DNA, 201 bp, Bos taurus; identical to SEQ ID NO: 23790

SEQ ID NO: 64313 - DNA, 201 bp, Bos taurus; identical to SEQ ID NO: 23791

SEQ ID NO: 64314 - DNA, 201 bp, Bos taurus; identical to SEQ ID NO: 23792

SEQ ID NO: 64315 - DNA, 201 bp, Bos taurus; identical to SEQ ID NO: 23793

SEQ ID NO: 64316 - DNA, 201 bp, Bos taurus; identical to SEQ ID NO: 23794

SEQ ID NO: 64317 - DNA, 201 bp, Bos taurus; identical to SEQ ID NO: 23795

SEQ ID NO: 64318 - DNA, 201 bp, Bos taurus; identical to SEQ ID NO: 23796

SEQ ID NO: 64319 - DNA, 201 bp, Bos taurus
ccatcaaagctgctcactttttttttcttaaatagagaataaccaggctgaagagttacaagtgatgctttccacagcgtagtatataaaaccttcatctcccagctgctagcatcaaccacatccaaatcatttaagtaaaaactgggtctgacttctgagtgatgcaaagcctgactcttggggaaatggcaaggtttg

SEQ ID NO: 64320 - DNA, 201 bp, Bos taurus
gttgatgctgttttgttttttatgaaggactcccaaagtacaaggttctgtttcatgtttctcatgaaatatctgtttacttaaacatgaaagtctgttaagaaatagagaaagaacatggaaacaccatacaataggggagaaaattttactctacacagatatgcatgttctcaacttagttttagctgtttttattaa

SEQ ID NO: 64321 - DNA, 201 bp, Bos taurus; identical to SEQ ID NO: 23797

SEQ ID NO: 64322 - DNA, 201 bp, Bos taurus; identical to SEQ ID NO: 23798

SEQ ID NO: 64323 - DNA, 201 bp, Bos taurus; identical to SEQ ID NO: 23799

SEQ ID NO: 64324 - DNA, 201 bp, Bos taurus
cagggtggctggagaggaggggaatttgaaataagaacatggataagagaaggaaggggcagcagataacgtacagccagttgggccatcgtgaagactacggatttccctccaagtgagataaaaggtcattagatgattttcaaggaaagcaacatggcctgatttaggtttaaactcatcacacgggctgctgtgttg

SEQ ID NO: 64325 - DNA, 201 bp, Bos taurus; identical to SEQ ID NO: 23800

SEQ ID NO: 64326 - DNA, 201 bp, Bos taurus; identical to SEQ ID NO: 23801

SEQ ID NO: 64327 - DNA, 201 bp, Bos taurus; identical to SEQ ID NO: 23802

SEQ ID NO: 64328 - DNA, 201 bp, Bos taurus; identical to SEQ ID NO: 23803

SEQ ID NO: 64329 - DNA, 201 bp, Bos taurus; identical to SEQ ID NO: 23804

SEQ ID NO: 64330 - DNA, 201 bp, Bos taurus; identical to SEQ ID NO: 23805

SEQ ID NO: 64331 - DNA, 201 bp, Bos taurus
aaaccccaagcatggttggccagacctccaggggctcaagaattccaagacccactctctatcttatctgtagtgccactcagcttactggtaacaactggtacactggcaagcagacacatcatcagggcagtgtccaggcaggtcagaagcaaggtcagaggcctgctctgctttcttgtctctgagcagtgaagatgg

SEQ ID NO: 64332 - DNA, 201 bp, Bos taurus
tttacagcttggtagatgattttagcccagtggaacagtcagctgagataacttgttaaaagttggtctcttcttccttatcctgatggacctgctgtgtctctggactatggtgatggatacaggaagctacacatgggataaaactgcatagaactcagtacacatacacatgcagatgagtacataaaactcaggcag

SEQ ID NO: 64333 - DNA, 201 bp, Bos taurus
caaaaggcaacccaaagaatgggagaaaatgtttgcaaaccatgtgaccaacaagggattaatctccaaaatttacaaacaggccatatgactcaatgtccgaaaaaaaaaaaaaaaaaaaacttaatcaaaaaatgggaaaaaaaactctaaaaaaacatttatccaaggagacacacagatggccaagaggcacaggaa

SEQ ID NO: 64334 - DNA, 201 bp, Bos taurus; identical to SEQ ID NO: 23806

SEQ ID NO: 64335 - DNA, 201 bp, Bos taurus
atctgccagaaaagacactcattaagtaacaatcactcaacagtatgagtgaccaccatagtaacacttaatttctgtgctgggccttggaaatacaacaaagactaaaacagacatacttggttttgtggagtttattgtagtgggtttgttctgggccctaagtaaggacttttccagaaaggttctaagtgatgcata

SEQ ID NO: 64336 - DNA, 201 bp, Bos taurus; identical to SEQ ID NO: 23807

SEQ ID NO: 64337 - DNA, 201 bp, Bos taurus
ctggcccctgtggtcaccacatgcttgtgtcaccaggaagattgcctgtccagctccttcctctccctctgctccccatgtccttctgccaggtcatcaaaccactggcccctcggagtctggatttcacagaaatgtacgtgcatacggctcaggactggaagggacctctggaagtagttggtacatctgtcgtgcact

SEQ ID NO: 64338 - DNA, 201 bp, Bos taurus
aactgtctctgagccagtgatccatctgaagtgtaaacttaaggttttcttgagtcttttctgagccttttcctgagcatgtgaaattactttctaatttcctccatatattagttgttttaaatgttctaatgtctagctcccagagtctttattggtatggagatgtggaggaaaaggaggttagagttaagggtggga

SEQ ID NO: 64339 - DNA, 201 bp, Bos taurus; identical to SEQ ID NO: 23808

SEQ ID NO: 64340 - DNA, 201 bp, Bos taurus; identical to SEQ ID NO: 23809

SEQ ID NO: 64341 - DNA, 201 bp, Bos taurus
catccctggtggtccagtggttaagacttcatgctcccaatgcaggggacatgggtttgatccctggtcagggaactaagatcccacaaggcctgtctggataactagatttctctgaaggaggcaggtacttgtatttccagcccattttatatttagggccagagcccgggggccactgttttaataggcgtacatgaa

SEQ ID NO: 64342 - DNA, 201 bp, Bos taurus; identical to SEQ ID NO: 23810

SEQ ID NO: 64343 - DNA, 201 bp, Bos taurus; identical to SEQ ID NO: 23811

SEQ ID NO: 64344 - DNA, 201 bp, Bos taurus
gcccagattccctcctatttacctccctccccatcccccggccagtccaccctctttttcagttgtaaaaaaacacccacagatgcagctgtattgaggtaagatgctcacctcagggcccatgagtgttgggaaaaggtgggttagaggccagtggaatgacatgaatatgagagaagagaggatttgcttttgcccaag

SEQ ID NO: 64345 - DNA, 201 bp, Bos taurus; identical to SEQ ID NO: 23812

SEQ ID NO: 64346 - DNA, 201 bp, Bos taurus
caacacataaacttaaaactcctgctgttccagcccctgcaggtctgttaaccaggctgattttgttcaaactggccagaagaataaagcaaaaggcagtgacttcagaagcagagcctccactggaggaccagggatcccagttactcattcatcaaggcatcgctcggcctccatgagcaacttgtgagcatcaaaatc

SEQ ID NO: 64347 - DNA, 201 bp, Bos taurus; identical to SEQ ID NO: 23813

SEQ ID NO: 64348 - DNA, 201 bp, Bos taurus; identical to SEQ ID NO: 23815

SEQ ID NO: 64349 - DNA, 201 bp, Bos taurus
tagtatttcagtttcattccatcaatttttcatcataaaggtaacataattcaacttcccacctactccttgtcccaaaaaatgaactagcaagtggtatgggggctacaagataatgaacaaaagctggaagcaggaagagcaatttagatggtccagtggccctggaaattaattagcagtcagaatcagggtggttat

SEQ ID NO: 64350 - DNA, 201 bp, Bos taurus; identical to SEQ ID NO: 23817

SEQ ID NO: 64351 - DNA, 201 bp, Bos taurus; identical to SEQ ID NO: 23819

SEQ ID NO: 64352 - DNA, 201 bp, Bos taurus; identical to SEQ ID NO: 23820

SEQ ID NO: 64353 - DNA, 201 bp, Bos taurus; identical to SEQ ID NO: 23822

SEQ ID NO: 64354 - DNA, 201 bp, Bos taurus
ttttatgccgctatgtgcacacccactgttgcttctttggggtagccgccagaaacagaactaatgggtcagagctgtattttggccctggactgagagtaaggcttcatcctacaggaagtggacgtgggtcctttgtgtttcagaaagtgtgacagagccttcctctcaccctcggagtcacccgaaggaagttcgctg

SEQ ID NO: 64355 - DNA, 201 bp, Bos taurus; identical to SEQ ID NO: 23823

SEQ ID NO: 64356 - DNA, 201 bp, Bos taurus; identical to SEQ ID NO: 23824

SEQ ID NO: 64357 - DNA, 201 bp, Bos taurus; identical to SEQ ID NO: 23825

SEQ ID NO: 64358 - DNA, 201 bp, Bos taurus; identical to SEQ ID NO: 23826

SEQ ID NO: 64359 - DNA, 201 bp, Bos taurus; identical to SEQ ID NO: 23830

SEQ ID NO: 64360 - DNA, 201 bp, Bos taurus; identical to SEQ ID NO: 23831

SEQ ID NO: 64361 - DNA, 201 bp, Bos taurus
gcgagcacgctgtcctccgagccccgggatgctccgtgacagcgacctccaatcaggctggcgtgttttccgcgcgattggagtcagtgcgcccgctcagagcacgtgcctcgctcgccaggccaccagtgctcctgggaaatgtagttctccaggaggccagcccctgagaccgcctctccagatgggtgcagcatctgc

SEQ ID NO: 64362 - DNA, 201 bp, Bos taurus; identical to SEQ ID NO: 23838

SEQ ID NO: 64363 - DNA, 201 bp, Bos taurus; identical to SEQ ID NO: 23839

SEQ ID NO: 64364 - DNA, 201 bp, Bos taurus; identical to SEQ ID NO: 23840

SEQ ID NO: 64365 - DNA, 201 bp, Bos taurus; identical to SEQ ID NO: 23841

SEQ ID NO: 64366 - DNA, 201 bp, Bos taurus
gtgctgcaggccatgggatcacaaagactgaacaacaacaagctgaaataagtgtaccaccctcctccttcctgcagcaaagaacattcaccacaggccatcttcaaataacattcgtctccaatctttgaaaatgaacatcgttttccatgttttggggggcaacatttgcctttcccatgagcagtctgctcttcagtc

SEQ ID NO: 64367 - DNA, 201 bp, Bos taurus; identical to SEQ ID NO: 23842

SEQ ID NO: 64368 - DNA, 201 bp, Bos taurus
aagagcccaagcgctgcaacaaaaacccagtgcagccaaaataaagtaaaatcatcatgatgatttggtgacttctcttcattttctgtttaggcttccatgcctgcagatagatgcagtcaacacaagctggatgatatcgatgctattttaattgtagcttccattcatatgtaaaagaggagtattttgttttgttta

SEQ ID NO: 64369 - DNA, 201 bp, Bos taurus; identical to SEQ ID NO: 23843

SEQ ID NO: 64370 - DNA, 201 bp, Bos taurus
atgctgtctcccctccatccccaggcctccgggcagccgccccccgacaggggcacaggggcccctaaggtttgggccatgctccaagggccgcagccattcaggtgtggctgaaggactggatcctctactgttctgtctgtcctcccccagacagcctgggggtgtcatgagtccacccaagactgccccctgctgtcc

SEQ ID NO: 64371 - DNA, 201 bp, Bos taurus; identical to SEQ ID NO: 23847

SEQ ID NO: 64372 - DNA, 201 bp, Bos taurus; identical to SEQ ID NO: 23848

SEQ ID NO: 64373 - DNA, 201 bp, Bos taurus; identical to SEQ ID NO: 23849

SEQ ID NO: 64374 - DNA, 201 bp, Bos taurus; identical to SEQ ID NO: 23852

SEQ ID NO: 64375 - DNA, 201 bp, Bos taurus; identical to SEQ ID NO: 23853

SEQ ID NO: 64376 - DNA, 201 bp, Bos taurus
gagtgaaaatgcaatgagaccttgactggtgagaagctccccttagagaaggatgatttatggtgagaaaacacaaacacaggctgggtcaaaaaatgtcaaaaaagattaaaagttaaggcatgtatgctcacaatggagaaggcaatggcaccccactccagtactcttgcctggaaaatcccatggacggaggagcct

SEQ ID NO: 64377 - DNA, 201 bp, Bos taurus; identical to SEQ ID NO: 23854

SEQ ID NO: 64378 - DNA, 201 bp, Bos taurus; identical to SEQ ID NO: 23855

SEQ ID NO: 64379 - DNA, 201 bp, Bos taurus; identical to SEQ ID NO: 23857

SEQ ID NO: 64380 - DNA, 201 bp, Bos taurus; identical to SEQ ID NO: 23860

SEQ ID NO: 64381 - DNA, 201 bp, Bos taurus; identical to SEQ ID NO: 23862

SEQ ID NO: 64382 - DNA, 201 bp, Bos taurus; identical to SEQ ID NO: 23863

SEQ ID NO: 64383 - DNA, 201 bp, Bos taurus; identical to SEQ ID NO: 23864

SEQ ID NO: 64384 - DNA, 201 bp, Bos taurus; identical to SEQ ID NO: 23865

SEQ ID NO: 64385 - DNA, 201 bp, Bos taurus; identical to SEQ ID NO: 23867

SEQ ID NO: 64386 - DNA, 201 bp, Bos taurus
tgccagccattctttaagttataagcaatcaacattgttaatttactcagatttctatattctgaacagactgaggcaaaaggccaccggctacatcccgtcaagactagggggaaaaaacagagttgcagcctgaatgtctgctaagcgatggtacaacatgaagaggccacacgtctgaactccccactgggcacgggc

SEQ ID NO: 64387 - DNA, 201 bp, Bos taurus; identical to SEQ ID NO: 23868

SEQ ID NO: 64388 - DNA, 201 bp, Bos taurus
agagaactataaaggatattctgcattttgcaggttacatttgcaggtaacacagccagctattgcatcaagaatggatattcatgcaacctttgacttacgggtagaggacattttcacaaggaatgagcataatacgaaaggcttctgagactaaaaaattccaacatatgggagaggtgcccttggtggcagccttcc

SEQ ID NO: 64389 - DNA, 201 bp, Bos taurus; identical to SEQ ID NO: 23870

SEQ ID NO: 64390 - DNA, 201 bp, Bos taurus; identical to SEQ ID NO: 23871

SEQ ID NO: 64391 - DNA, 201 bp, Bos taurus; identical to SEQ ID NO: 23873

SEQ ID NO: 64392 - DNA, 201 bp, Bos taurus
ggaggaaaaggggatgacagaggatgagatggttggatggcatcactgcttagtcttacatttctgactctttagaaagaaatcagtcggaaaaggaaattttattttaaagccaatttcccccattgaattccacatttgtgggaaaaagcattttttgagccatagtttaggattaaattgtatgtcttttatccacct

SEQ ID NO: 64393 - DNA, 201 bp, Bos taurus
ttggcctccaagttcatgcataaagagaccatagagcacagttagcaaaccaatatttataacattttaaaacactttgaataaatacaactcactgatctggttgtaatagctgttacactgcttggagaaaggcaatggggaagggatatgtgaatatccttccccataggctaggagaggttggatttctccctgact

SEQ ID NO: 64394 - DNA, 201 bp, Bos taurus
tttatatatttagaacttacctttaaggaaaacctgaatgaactgtttggccaacccagtatattttatgtataaataatggagttcctactcaatttctaaatttttattcttcccagaacatttctgagcattttcctacctgtttttctctgtcccagtcatgacgtttcctttataatgtatgcattgattttatac

SEQ ID NO: 64395 - DNA, 201 bp, Bos taurus; identical to SEQ ID NO: 23874

SEQ ID NO: 64396 - DNA, 201 bp, Bos taurus; identical to SEQ ID NO: 23875

SEQ ID NO: 64397 - DNA, 201 bp, Bos taurus; identical to SEQ ID NO: 23876

SEQ ID NO: 64398 - DNA, 201 bp, Bos taurus
ttctttgaagggttctagtgagtaactgaatggtaaaggggagagtttaagagaactcctcaatttgtagacatctggacataagtgcatgtagcctgacgttagaagtgaggatagtctatgagcctaaagcccttaactcgtgggctctgcattgactgtaggtagagtcataattgaattgctggacaccagatggaa

SEQ ID NO: 64399 - DNA, 201 bp, Bos taurus; identical to SEQ ID NO: 23877

SEQ ID NO: 64400 - DNA, 201 bp, Bos taurus; identical to SEQ ID NO: 23878

SEQ ID NO: 64401 - DNA, 201 bp, Bos taurus
aaatcaattttctaatctagaatgatctccaatgccaggtatgattctgattttccctggtaatacaaccgatagtagtgatttttaaatgtcttcagtttaactgtgggcaataaggttgtatcatctcctccacaaaaagagactgctcttgggaactgtcacatctttgcctgaagttctctcactcagtgctggaat

SEQ ID NO: 64402 - DNA, 201 bp, Bos taurus; identical to SEQ ID NO: 23879

SEQ ID NO: 64403 - DNA, 201 bp, Bos taurus; identical to SEQ ID NO: 23882

SEQ ID NO: 64404 - DNA, 201 bp, Bos taurus; identical to SEQ ID NO: 23883

SEQ ID NO: 64405 - DNA, 201 bp, Bos taurus; identical to SEQ ID NO: 23884

SEQ ID NO: 64406 - DNA, 201 bp, Bos taurus; identical to SEQ ID NO: 23885

SEQ ID NO: 64407 - DNA, 201 bp, Bos taurus; identical to SEQ ID NO: 23887

SEQ ID NO: 64408 - DNA, 201 bp, Bos taurus; identical to SEQ ID NO: 23888

SEQ ID NO: 64409 - DNA, 201 bp, Bos taurus
cacccaccacctccatccaggtaagcatcacccgttcaaatgaaccccagctgttgggaccgcctgctctgacattctgcgtctccatgtggcctaaggtcctcaggctccagctgctcaagaaggtcctctggactacactgtgaggaccagggagtcctttgcatggccctctgcactgaggcccaggccctgtgacac

SEQ ID NO: 64410 - DNA, 201 bp, Bos taurus
tcgtgacagagtgacaacagaggcaagaatccccagccacaagtggggttccctttccacatgtgcctcccatgagaggcccgcaccctgggctgatctgcgaggctctggtgaaattccccgtcatggtgacatatgtaaacagtggttaaccctggcaggcctccatgggaattggagggaaggggcaacctgagattt

SEQ ID NO: 64411 - DNA, 201 bp, Bos taurus; identical to SEQ ID NO: 23889

SEQ ID NO: 64412 - DNA, 201 bp, Bos taurus; identical to SEQ ID NO: 23890

SEQ ID NO: 64413 - DNA, 201 bp, Bos taurus; identical to SEQ ID NO: 23891

SEQ ID NO: 64414 - DNA, 201 bp, Bos taurus
tttgggccccgccaggcctggccctggttctcatctatgacatggcgtgacagctcacaggaatcgccccccgctcaccaggcagctgtgagccttaaaggagttaaaacacagaagctcctggcccagtcaggtgtgtgggagaccctcagggaatctagtgacagtggtgccgatgacagtgtcaaaagcagccggagc

SEQ ID NO: 64415 - DNA, 201 bp, Bos taurus; identical to SEQ ID NO: 23893

SEQ ID NO: 64416 - DNA, 201 bp, Bos taurus; identical to SEQ ID NO: 23894

SEQ ID NO: 64417 - DNA, 201 bp, Bos taurus; identical to SEQ ID NO: 23895

SEQ ID NO: 64418 - DNA, 201 bp, Bos taurus
gtctccatggtgagtggagggtgtgccccaaagcccagaggacccatcacttctacctgcagctgacggctgacaatgaccaaagaaaggatccatcctatgggctaccagtgtggcctgagaacttacacgagggtaaatcagagaatgactcttacggaccattcagagctgtggagagcaacctggtccatttcagac

SEQ ID NO: 64419 - DNA, 201 bp, Bos taurus; identical to SEQ ID NO: 23896

SEQ ID NO: 64420 - DNA, 201 bp, Bos taurus; identical to SEQ ID NO: 23897

SEQ ID NO: 64421 - DNA, 201 bp, Bos taurus; identical to SEQ ID NO: 23898

SEQ ID NO: 64422 - DNA, 201 bp, Bos taurus; identical to SEQ ID NO: 23899

SEQ ID NO: 64423 - DNA, 201 bp, Bos taurus; identical to SEQ ID NO: 23905

SEQ ID NO: 64424 - DNA, 201 bp, Bos taurus; identical to SEQ ID NO: 23907

SEQ ID NO: 64425 - DNA, 201 bp, Bos taurus
agagatgggccagggatcattaaactggctggctttctctccctcctccacagtcatggttagactgaacgtgaaatgaacatctagtccaccctccatcgtgggagcctagtagggccagatcaggatcgtgcttcaagttccccaaagtaagcgtcccctcactttggggaggcttccaccagacaactaagcacacag

SEQ ID NO: 64426 - DNA, 201 bp, Bos taurus; identical to SEQ ID NO: 23908

SEQ ID NO: 64427 - DNA, 201 bp, Bos taurus; identical to SEQ ID NO: 23910

SEQ ID NO: 64428 - DNA, 201 bp, Bos taurus
cagagcctttctggaaagtccagtggacacccactgtggtgtggtgctgagagtgggtggtcagggaggaccttggaaaccagacagaggtcagaggtgatggtgccctggagctgagataggcctgttccccttccttctggtgtgagcaccccaattctgttcttaggccctgctcttccctcacaagtgctctgggct

SEQ ID NO: 64429 - DNA, 201 bp, Bos taurus
aaactgagccatagagcagccaatctcagagccagagtggttcaagcccagggaatctggttagaggctgtgcccttaaaccatgagtcctccgtggtggcgctacggtgcccagattggcctggagtcagcctttgtcttggatgaactatttggattaaaataaaactgacttacttcactctgtataatgggttccag

SEQ ID NO: 64430 - DNA, 201 bp, Bos taurus
agagaaaggggctggaccccgtgtgagttatgaaagggaagaccagatgagaggagataacagcttcaatgccttgcttttattatacaaatctgcactttcagttggaagaaaagattttttttttctattggtggttatttgcttaagagaattggagacctgagagctgtctcggtggatgattaatgggaaaaaatt

SEQ ID NO: 64431 - DNA, 201 bp, Bos taurus; identical to SEQ ID NO: 23911

SEQ ID NO: 64432 - DNA, 201 bp, Bos taurus; identical to SEQ ID NO: 23912

SEQ ID NO: 64433 - DNA, 201 bp, Bos taurus; identical to SEQ ID NO: 23913

SEQ ID NO: 64434 - DNA, 201 bp, Bos taurus; identical to SEQ ID NO: 23915

SEQ ID NO: 64435 - DNA, 201 bp, Bos taurus; identical to SEQ ID NO: 23916

SEQ ID NO: 64436 - DNA, 201 bp, Bos taurus; identical to SEQ ID NO: 23917

SEQ ID NO: 64437 - DNA, 201 bp, Bos taurus; identical to SEQ ID NO: 23918

SEQ ID NO: 64438 - DNA, 201 bp, Bos taurus; identical to SEQ ID NO: 23919

SEQ ID NO: 64439 - DNA, 201 bp, Bos taurus
tcagtttcgagctgagtggagaaaaaactgccaagctcaggctggtggagaaagcaaacccacacaggtaagcagtcacaggcctgtgtacagaatgagacgttattgttgctcatatgctgagtcaagataaggatacaagcatcctcaagctccctgtgatctgggggccattaatgatagtttgtatacctccttatt

SEQ ID NO: 64440 - DNA, 201 bp, Bos taurus
ttgaaagaggtcttttccctcctccactccactgatcctctggggcaacactgcctctgttttgcagcccgtgagttacctgccttggccaatgtagggcaggaaccttgcctttccatccagccccagccactgctccctcccctctacctgtagctctgcctctgctttggcccatgatgcatctgggtcctgccgccc

SEQ ID NO: 64441 - DNA, 201 bp, Bos taurus; identical to SEQ ID NO: 23922

SEQ ID NO: 64442 - DNA, 201 bp, Bos taurus; identical to SEQ ID NO: 23927

SEQ ID NO: 64443 - DNA, 201 bp, Bos taurus; identical to SEQ ID NO: 23928

SEQ ID NO: 64444 - DNA, 201 bp, Bos taurus; identical to SEQ ID NO: 23930

SEQ ID NO: 64445 - DNA, 201 bp, Bos taurus; identical to SEQ ID NO: 23932

SEQ ID NO: 64446 - DNA, 201 bp, Bos taurus; identical to SEQ ID NO: 23938

SEQ ID NO: 64447 - DNA, 201 bp, Bos taurus; identical to SEQ ID NO: 23939

SEQ ID NO: 64448 - DNA, 201 bp, Bos taurus; identical to SEQ ID NO: 23941

SEQ ID NO: 64449 - DNA, 201 bp, Bos taurus; identical to SEQ ID NO: 23942

SEQ ID NO: 64450 - DNA, 201 bp, Bos taurus; identical to SEQ ID NO: 23950

SEQ ID NO: 64451 - DNA, 201 bp, Bos taurus; identical to SEQ ID NO: 23951

SEQ ID NO: 64452 - DNA, 201 bp, Bos taurus; identical to SEQ ID NO: 23952

SEQ ID NO: 64453 - DNA, 201 bp, Bos taurus; identical to SEQ ID NO: 23953

SEQ ID NO: 64454 - DNA, 201 bp, Bos taurus; identical to SEQ ID NO: 23954

SEQ ID NO: 64455 - DNA, 201 bp, Bos taurus; identical to SEQ ID NO: 23955

SEQ ID NO: 64456 - DNA, 201 bp, Bos taurus; identical to SEQ ID NO: 23959

SEQ ID NO: 64457 - DNA, 201 bp, Bos taurus; identical to SEQ ID NO: 23960

SEQ ID NO: 64458 - DNA, 201 bp, Bos taurus; identical to SEQ ID NO: 23963

SEQ ID NO: 64459 - DNA, 201 bp, Bos taurus; identical to SEQ ID NO: 23964

SEQ ID NO: 64460 - DNA, 201 bp, Bos taurus; identical to SEQ ID NO: 23966

SEQ ID NO: 64461 - DNA, 201 bp, Bos taurus; identical to SEQ ID NO: 23967

SEQ ID NO: 64462 - DNA, 201 bp, Bos taurus; identical to SEQ ID NO: 23968

SEQ ID NO: 64463 - DNA, 201 bp, Bos taurus; identical to SEQ ID NO: 23969

SEQ ID NO: 64464 - DNA, 201 bp, Bos taurus; identical to SEQ ID NO: 23971

SEQ ID NO: 64465 - DNA, 201 bp, Bos taurus; identical to SEQ ID NO: 23973

SEQ ID NO: 64466 - DNA, 201 bp, Bos taurus; identical to SEQ ID NO: 23976

SEQ ID NO: 64467 - DNA, 201 bp, Bos taurus; identical to SEQ ID NO: 23977

SEQ ID NO: 64468 - DNA, 201 bp, Bos taurus; identical to SEQ ID NO: 23978

SEQ ID NO: 64469 - DNA, 201 bp, Bos taurus; identical to SEQ ID NO: 23982

SEQ ID NO: 64470 - DNA, 201 bp, Bos taurus; identical to SEQ ID NO: 23983

SEQ ID NO: 64471 - DNA, 201 bp, Bos taurus; identical to SEQ ID NO: 23990

SEQ ID NO: 64472 - DNA, 201 bp, Bos taurus; identical to SEQ ID NO: 23994

SEQ ID NO: 64473 - DNA, 201 bp, Bos taurus; identical to SEQ ID NO: 23995

SEQ ID NO: 64474 - DNA, 201 bp, Bos taurus; identical to SEQ ID NO: 23996

SEQ ID NO: 64475 - DNA, 201 bp, Bos taurus; identical to SEQ ID NO: 23998

SEQ ID NO: 64476 - DNA, 201 bp, Bos taurus; identical to SEQ ID NO: 23999

SEQ ID NO: 64477 - DNA, 201 bp, Bos taurus; identical to SEQ ID NO: 24000

SEQ ID NO: 64478 - DNA, 201 bp, Bos taurus; identical to SEQ ID NO: 24001

SEQ ID NO: 64479 - DNA, 201 bp, Bos taurus; identical to SEQ ID NO: 24002

SEQ ID NO: 64480 - DNA, 201 bp, Bos taurus; identical to SEQ ID NO: 24003

SEQ ID NO: 64481 - DNA, 201 bp, Bos taurus
aaattataaaagaaaactattattaacatccccagagacataaaagaacacatcataaaactatagacaaaatgttagtggaaaatgaacattccccaaataagaaaaagcccttggaaattaaaaatatggtagtgtgtactaaaattcaatagaagggtcagaagatgaagctgaggaaatctcttcaaaagcagagcc

SEQ ID NO: 64482 - DNA, 201 bp, Bos taurus
aagacacctccctgtcgcctaggtaagcagaaagaaaaaaatgtaaagtgaacacctttgcccctgagaccccacaacacctggccttggtgatgatgctgatactgaggacaatggtgggggtaggggagcaaagagaagaggagggaaagaggaggagaacaccaatggccttcactcactcgcggcttagtattcgcc

SEQ ID NO: 64483 - DNA, 201 bp, Bos taurus
gtgacaacctctggtggcctgaatccaaagaagagaaacacagaggaagtggcaggtataacaggcacacattaggggaaggagatgggctccctgagatttacagagaaagggggccatccccatggcggtggctttggttcccagaagcggagtgagtgtgtggggcttttgaactggatgaaaagcatctctggatta

SEQ ID NO: 64484 - DNA, 201 bp, Bos taurus; identical to SEQ ID NO: 24005

SEQ ID NO: 64485 - DNA, 201 bp, Bos taurus; identical to SEQ ID NO: 24006

SEQ ID NO: 64486 - DNA, 201 bp, Bos taurus
acatgttggtgtctattcttctagatttcctctgtatgcttgaacacacacatttaataaaaatgagagtgggcttaataaggcgggacaaggaggggccggcactcagtgagtcagcagctggtgtccttgaaggtgaggaagaggaaaacggaaaaaaaaaaaaaaaaagccaaacacaaaaatccagtggaggggaag

SEQ ID NO: 64487 - DNA, 201 bp, Bos taurus; identical to SEQ ID NO: 24010

SEQ ID NO: 64488 - DNA, 201 bp, Bos taurus; identical to SEQ ID NO: 24011

SEQ ID NO: 64489 - DNA, 201 bp, Bos taurus
cttagcctgttgaggacagcagtctttcatcggacctttacagatcctaacctacaggccctcaatttatgttcatggaatgaatgaacgaatttgtcatcttctgttattacataaccatctttcagaacatttcctttgaattcattgttagtggatagtcttctagttaagtcagattccacaggaaagcataaaaaa

SEQ ID NO: 64490 - DNA, 201 bp, Bos taurus; identical to SEQ ID NO: 24012

SEQ ID NO: 64491 - DNA, 201 bp, Bos taurus; identical to SEQ ID NO: 24013

SEQ ID NO: 64492 - DNA, 201 bp, Bos taurus; identical to SEQ ID NO: 24014

SEQ ID NO: 64493 - DNA, 201 bp, Bos taurus; identical to SEQ ID NO: 24015

SEQ ID NO: 64494 - DNA, 201 bp, Bos taurus; identical to SEQ ID NO: 24016

SEQ ID NO: 64495 - DNA, 201 bp, Bos taurus; identical to SEQ ID NO: 24017

SEQ ID NO: 64496 - DNA, 201 bp, Bos taurus; identical to SEQ ID NO: 24018

SEQ ID NO: 64497 - DNA, 201 bp, Bos taurus; identical to SEQ ID NO: 24019

SEQ ID NO: 64498 - DNA, 201 bp, Bos taurus; identical to SEQ ID NO: 24020

SEQ ID NO: 64499 - DNA, 201 bp, Bos taurus; identical to SEQ ID NO: 24021

SEQ ID NO: 64500 - DNA, 201 bp, Bos taurus; identical to SEQ ID NO: 24022

SEQ ID NO: 64501 - DNA, 201 bp, Bos taurus; identical to SEQ ID NO: 24023

SEQ ID NO: 64502 - DNA, 201 bp, Bos taurus; identical to SEQ ID NO: 24024

SEQ ID NO: 64503 - DNA, 201 bp, Bos taurus; identical to SEQ ID NO: 24025

SEQ ID NO: 64504 - DNA, 201 bp, Bos taurus; identical to SEQ ID NO: 24026

SEQ ID NO: 64505 - DNA, 201 bp, Bos taurus; identical to SEQ ID NO: 24027

SEQ ID NO: 64506 - DNA, 201 bp, Bos taurus; identical to SEQ ID NO: 24028

SEQ ID NO: 64507 - DNA, 201 bp, Bos taurus; identical to SEQ ID NO: 24029

SEQ ID NO: 64508 - DNA, 201 bp, Bos taurus; identical to SEQ ID NO: 24030

SEQ ID NO: 64509 - DNA, 201 bp, Bos taurus; identical to SEQ ID NO: 24031

SEQ ID NO: 64510 - DNA, 201 bp, Bos taurus; identical to SEQ ID NO: 24032

SEQ ID NO: 64511 - DNA, 201 bp, Bos taurus; identical to SEQ ID NO: 24033

SEQ ID NO: 64512 - DNA, 201 bp, Bos taurus; identical to SEQ ID NO: 24034

SEQ ID NO: 64513 - DNA, 201 bp, Bos taurus; identical to SEQ ID NO: 24035

SEQ ID NO: 64514 - DNA, 201 bp, Bos taurus; identical to SEQ ID NO: 24036

SEQ ID NO: 64515 - DNA, 201 bp, Bos taurus; identical to SEQ ID NO: 24037

SEQ ID NO: 64516 - DNA, 201 bp, Bos taurus; identical to SEQ ID NO: 24038

SEQ ID NO: 64517 - DNA, 201 bp, Bos taurus; identical to SEQ ID NO: 24039

SEQ ID NO: 64518 - DNA, 201 bp, Bos taurus; identical to SEQ ID NO: 24040

SEQ ID NO: 64519 - DNA, 201 bp, Bos taurus; identical to SEQ ID NO: 24041

SEQ ID NO: 64520 - DNA, 201 bp, Bos taurus; identical to SEQ ID NO: 24042

SEQ ID NO: 64521 - DNA, 201 bp, Bos taurus; identical to SEQ ID NO: 24043

SEQ ID NO: 64522 - DNA, 201 bp, Bos taurus; identical to SEQ ID NO: 24044

SEQ ID NO: 64523 - DNA, 201 bp, Bos taurus; identical to SEQ ID NO: 24045

SEQ ID NO: 64524 - DNA, 201 bp, Bos taurus; identical to SEQ ID NO: 24047

SEQ ID NO: 64525 - DNA, 201 bp, Bos taurus; identical to SEQ ID NO: 24048

SEQ ID NO: 64526 - DNA, 201 bp, Bos taurus; identical to SEQ ID NO: 24049

SEQ ID NO: 64527 - DNA, 201 bp, Bos taurus; identical to SEQ ID NO: 24050

SEQ ID NO: 64528 - DNA, 201 bp, Bos taurus; identical to SEQ ID NO: 24051

SEQ ID NO: 64529 - DNA, 201 bp, Bos taurus; identical to SEQ ID NO: 24052

SEQ ID NO: 64530 - DNA, 201 bp, Bos taurus
gcaggagagacaaagctgggaaaattaaacagtgtagactggctggtgaggatcatttcagtgggctttgagctgaaggggtggtcctggttccttggcatctggccccagggtgaattaggcagaggcatgttactccctgctgggatgtgtggctctggtctggtttacttgagagaggagtgctccagcctggccttt

SEQ ID NO: 64531 - DNA, 201 bp, Bos taurus
ctgtaatccaagccatcttcttccaggtctttattgagaatttgctctgtgcttagccttgattcaacatgtatttgataaacagtttatattccaattacggtaccaagcactggaaataaaattacagatagcatattctagaggggaagaaggatggttaataaactaattagttatgatgagtgcttttttgggcaa

SEQ ID NO: 64532 - DNA, 201 bp, Bos taurus
cacaacccagtttctccctgtatttgctccatggtggaaactttactaacttaatttgatagaaacccacaattccagacattttccttttgataccagatagtgcagcaatttcaagcctcattttcttaagctacatagtccagggaagaagaatcttctttagtcctcaagtattgcttggcattcattctctcattt

SEQ ID NO: 64533 - DNA, 201 bp, Bos taurus; identical to SEQ ID NO: 24054

SEQ ID NO: 64534 - DNA, 201 bp, Bos taurus; identical to SEQ ID NO: 24058

SEQ ID NO: 64535 - DNA, 201 bp, Bos taurus; identical to SEQ ID NO: 24059

SEQ ID NO: 64536 - DNA, 201 bp, Bos taurus; identical to SEQ ID NO: 24060

SEQ ID NO: 64537 - DNA, 201 bp, Bos taurus; identical to SEQ ID NO: 24061

SEQ ID NO: 64538 - DNA, 201 bp, Bos taurus; identical to SEQ ID NO: 24062

SEQ ID NO: 64539 - DNA, 201 bp, Bos taurus; identical to SEQ ID NO: 24063

SEQ ID NO: 64540 - DNA, 201 bp, Bos taurus; identical to SEQ ID NO: 24064

SEQ ID NO: 64541 - DNA, 201 bp, Bos taurus; identical to SEQ ID NO: 24065

SEQ ID NO: 64542 - DNA, 201 bp, Bos taurus; identical to SEQ ID NO: 24066

SEQ ID NO: 64543 - DNA, 201 bp, Bos taurus; identical to SEQ ID NO: 24067

SEQ ID NO: 64544 - DNA, 201 bp, Bos taurus; identical to SEQ ID NO: 24068

SEQ ID NO: 64545 - DNA, 201 bp, Bos taurus; identical to SEQ ID NO: 24069

SEQ ID NO: 64546 - DNA, 201 bp, Bos taurus; identical to SEQ ID NO: 24070

SEQ ID NO: 64547 - DNA, 201 bp, Bos taurus; identical to SEQ ID NO: 24071

SEQ ID NO: 64548 - DNA, 201 bp, Bos taurus; identical to SEQ ID NO: 24072

SEQ ID NO: 64549 - DNA, 201 bp, Bos taurus; identical to SEQ ID NO: 24073

SEQ ID NO: 64550 - DNA, 201 bp, Bos taurus; identical to SEQ ID NO: 24074

SEQ ID NO: 64551 - DNA, 201 bp, Bos taurus; identical to SEQ ID NO: 24075

SEQ ID NO: 64552 - DNA, 201 bp, Bos taurus; identical to SEQ ID NO: 24076

SEQ ID NO: 64553 - DNA, 201 bp, Bos taurus; identical to SEQ ID NO: 24077

SEQ ID NO: 64554 - DNA, 201 bp, Bos taurus; identical to SEQ ID NO: 24078

SEQ ID NO: 64555 - DNA, 201 bp, Bos taurus; identical to SEQ ID NO: 24079

SEQ ID NO: 64556 - DNA, 201 bp, Bos taurus; identical to SEQ ID NO: 24080

SEQ ID NO: 64557 - DNA, 201 bp, Bos taurus; identical to SEQ ID NO: 24081

SEQ ID NO: 64558 - DNA, 201 bp, Bos taurus; identical to SEQ ID NO: 24082

SEQ ID NO: 64559 - DNA, 201 bp, Bos taurus; identical to SEQ ID NO: 24083

SEQ ID NO: 64560 - DNA, 201 bp, Bos taurus; identical to SEQ ID NO: 24084

SEQ ID NO: 64561 - DNA, 201 bp, Bos taurus; identical to SEQ ID NO: 24085

SEQ ID NO: 64562 - DNA, 201 bp, Bos taurus; identical to SEQ ID NO: 24086

SEQ ID NO: 64563 - DNA, 201 bp, Bos taurus; identical to SEQ ID NO: 24087

SEQ ID NO: 64564 - DNA, 201 bp, Bos taurus; identical to SEQ ID NO: 24088

SEQ ID NO: 64565 - DNA, 201 bp, Bos taurus; identical to SEQ ID NO: 24089

SEQ ID NO: 64566 - DNA, 201 bp, Bos taurus; identical to SEQ ID NO: 24090

SEQ ID NO: 64567 - DNA, 201 bp, Bos taurus; identical to SEQ ID NO: 24091

SEQ ID NO: 64568 - DNA, 201 bp, Bos taurus; identical to SEQ ID NO: 24092

SEQ ID NO: 64569 - DNA, 201 bp, Bos taurus; identical to SEQ ID NO: 24093

SEQ ID NO: 64570 - DNA, 201 bp, Bos taurus; identical to SEQ ID NO: 24094

SEQ ID NO: 64571 - DNA, 201 bp, Bos taurus; identical to SEQ ID NO: 24095

SEQ ID NO: 64572 - DNA, 201 bp, Bos taurus; identical to SEQ ID NO: 24096

SEQ ID NO: 64573 - DNA, 201 bp, Bos taurus; identical to SEQ ID NO: 24097

SEQ ID NO: 64574 - DNA, 201 bp, Bos taurus; identical to SEQ ID NO: 24098

SEQ ID NO: 64575 - DNA, 201 bp, Bos taurus; identical to SEQ ID NO: 24099

SEQ ID NO: 64576 - DNA, 201 bp, Bos taurus; identical to SEQ ID NO: 24100

SEQ ID NO: 64577 - DNA, 201 bp, Bos taurus; identical to SEQ ID NO: 24101

SEQ ID NO: 64578 - DNA, 201 bp, Bos taurus; identical to SEQ ID NO: 24102

SEQ ID NO: 64579 - DNA, 201 bp, Bos taurus; identical to SEQ ID NO: 24103

SEQ ID NO: 64580 - DNA, 201 bp, Bos taurus; identical to SEQ ID NO: 24104

SEQ ID NO: 64581 - DNA, 201 bp, Bos taurus; identical to SEQ ID NO: 24105

SEQ ID NO: 64582 - DNA, 201 bp, Bos taurus; identical to SEQ ID NO: 24106

SEQ ID NO: 64583 - DNA, 201 bp, Bos taurus; identical to SEQ ID NO: 24107

SEQ ID NO: 64584 - DNA, 201 bp, Bos taurus; identical to SEQ ID NO: 24108

SEQ ID NO: 64585 - DNA, 201 bp, Bos taurus; identical to SEQ ID NO: 24109

SEQ ID NO: 64586 - DNA, 201 bp, Bos taurus; identical to SEQ ID NO: 24110

SEQ ID NO: 64587 - DNA, 201 bp, Bos taurus; identical to SEQ ID NO: 24111

SEQ ID NO: 64588 - DNA, 201 bp, Bos taurus; identical to SEQ ID NO: 24112

SEQ ID NO: 64589 - DNA, 201 bp, Bos taurus; identical to SEQ ID NO: 24113

SEQ ID NO: 64590 - DNA, 201 bp, Bos taurus; identical to SEQ ID NO: 24114

SEQ ID NO: 64591 - DNA, 201 bp, Bos taurus; identical to SEQ ID NO: 24115

SEQ ID NO: 64592 - DNA, 201 bp, Bos taurus; identical to SEQ ID NO: 24116

SEQ ID NO: 64593 - DNA, 201 bp, Bos taurus; identical to SEQ ID NO: 24117

SEQ ID NO: 64594 - DNA, 201 bp, Bos taurus; identical to SEQ ID NO: 24118

SEQ ID NO: 64595 - DNA, 201 bp, Bos taurus; identical to SEQ ID NO: 24119

SEQ ID NO: 64596 - DNA, 201 bp, Bos taurus; identical to SEQ ID NO: 24120

SEQ ID NO: 64597 - DNA, 201 bp, Bos taurus; identical to SEQ ID NO: 24121

SEQ ID NO: 64598 - DNA, 201 bp, Bos taurus; identical to SEQ ID NO: 24122

SEQ ID NO: 64599 - DNA, 201 bp, Bos taurus; identical to SEQ ID NO: 24123

SEQ ID NO: 64600 - DNA, 201 bp, Bos taurus; identical to SEQ ID NO: 24124

SEQ ID NO: 64601 - DNA, 201 bp, Bos taurus; identical to SEQ ID NO: 24125

SEQ ID NO: 64602 - DNA, 201 bp, Bos taurus; identical to SEQ ID NO: 24126

SEQ ID NO: 64603 - DNA, 201 bp, Bos taurus; identical to SEQ ID NO: 24127

SEQ ID NO: 64604 - DNA, 201 bp, Bos taurus; identical to SEQ ID NO: 24128

SEQ ID NO: 64605 - DNA, 201 bp, Bos taurus; identical to SEQ ID NO: 24129

SEQ ID NO: 64606 - DNA, 201 bp, Bos taurus; identical to SEQ ID NO: 24130

SEQ ID NO: 64607 - DNA, 201 bp, Bos taurus; identical to SEQ ID NO: 24131

SEQ ID NO: 64608 - DNA, 201 bp, Bos taurus; identical to SEQ ID NO: 24132

SEQ ID NO: 64609 - DNA, 201 bp, Bos taurus; identical to SEQ ID NO: 24133

SEQ ID NO: 64610 - DNA, 201 bp, Bos taurus; identical to SEQ ID NO: 24134

SEQ ID NO: 64611 - DNA, 201 bp, Bos taurus; identical to SEQ ID NO: 24135

SEQ ID NO: 64612 - DNA, 201 bp, Bos taurus; identical to SEQ ID NO: 24136

SEQ ID NO: 64613 - DNA, 201 bp, Bos taurus; identical to SEQ ID NO: 24137

SEQ ID NO: 64614 - DNA, 201 bp, Bos taurus; identical to SEQ ID NO: 24138

SEQ ID NO: 64615 - DNA, 201 bp, Bos taurus; identical to SEQ ID NO: 24139

SEQ ID NO: 64616 - DNA, 201 bp, Bos taurus; identical to SEQ ID NO: 24140

SEQ ID NO: 64617 - DNA, 201 bp, Bos taurus; identical to SEQ ID NO: 24141

SEQ ID NO: 64618 - DNA, 201 bp, Bos taurus; identical to SEQ ID NO: 24142

SEQ ID NO: 64619 - DNA, 201 bp, Bos taurus; identical to SEQ ID NO: 24143

SEQ ID NO: 64620 - DNA, 201 bp, Bos taurus; identical to SEQ ID NO: 24144

SEQ ID NO: 64621 - DNA, 201 bp, Bos taurus; identical to SEQ ID NO: 24145

SEQ ID NO: 64622 - DNA, 201 bp, Bos taurus; identical to SEQ ID NO: 24146

SEQ ID NO: 64623 - DNA, 201 bp, Bos taurus; identical to SEQ ID NO: 24147

SEQ ID NO: 64624 - DNA, 201 bp, Bos taurus; identical to SEQ ID NO: 24148

SEQ ID NO: 64625 - DNA, 201 bp, Bos taurus; identical to SEQ ID NO: 24149

SEQ ID NO: 64626 - DNA, 201 bp, Bos taurus; identical to SEQ ID NO: 24150

SEQ ID NO: 64627 - DNA, 201 bp, Bos taurus; identical to SEQ ID NO: 24151

SEQ ID NO: 64628 - DNA, 201 bp, Bos taurus; identical to SEQ ID NO: 24152

SEQ ID NO: 64629 - DNA, 201 bp, Bos taurus; identical to SEQ ID NO: 24153

SEQ ID NO: 64630 - DNA, 201 bp, Bos taurus; identical to SEQ ID NO: 24154

SEQ ID NO: 64631 - DNA, 201 bp, Bos taurus; identical to SEQ ID NO: 24156

SEQ ID NO: 64632 - DNA, 201 bp, Bos taurus; identical to SEQ ID NO: 24157

SEQ ID NO: 64633 - DNA, 201 bp, Bos taurus; identical to SEQ ID NO: 24158

SEQ ID NO: 64634 - DNA, 201 bp, Bos taurus; identical to SEQ ID NO: 24159

SEQ ID NO: 64635 - DNA, 201 bp, Bos taurus; identical to SEQ ID NO: 24160

SEQ ID NO: 64636 - DNA, 201 bp, Bos taurus; identical to SEQ ID NO: 24161

SEQ ID NO: 64637 - DNA, 201 bp, Bos taurus; identical to SEQ ID NO: 24162

SEQ ID NO: 64638 - DNA, 201 bp, Bos taurus; identical to SEQ ID NO: 24163

SEQ ID NO: 64639 - DNA, 201 bp, Bos taurus; identical to SEQ ID NO: 24164

SEQ ID NO: 64640 - DNA, 201 bp, Bos taurus; identical to SEQ ID NO: 24165

SEQ ID NO: 64641 - DNA, 201 bp, Bos taurus; identical to SEQ ID NO: 24166

SEQ ID NO: 64642 - DNA, 201 bp, Bos taurus; identical to SEQ ID NO: 24167

SEQ ID NO: 64643 - DNA, 201 bp, Bos taurus; identical to SEQ ID NO: 24168

SEQ ID NO: 64644 - DNA, 201 bp, Bos taurus; identical to SEQ ID NO: 24169

SEQ ID NO: 64645 - DNA, 201 bp, Bos taurus; identical to SEQ ID NO: 24170

SEQ ID NO: 64646 - DNA, 201 bp, Bos taurus; identical to SEQ ID NO: 24171

SEQ ID NO: 64647 - DNA, 201 bp, Bos taurus; identical to SEQ ID NO: 24172

SEQ ID NO: 64648 - DNA, 201 bp, Bos taurus; identical to SEQ ID NO: 24173

SEQ ID NO: 64649 - DNA, 201 bp, Bos taurus; identical to SEQ ID NO: 24174

SEQ ID NO: 64650 - DNA, 201 bp, Bos taurus; identical to SEQ ID NO: 24175

SEQ ID NO: 64651 - DNA, 201 bp, Bos taurus; identical to SEQ ID NO: 24176

SEQ ID NO: 64652 - DNA, 201 bp, Bos taurus; identical to SEQ ID NO: 24177

SEQ ID NO: 64653 - DNA, 201 bp, Bos taurus; identical to SEQ ID NO: 24178

SEQ ID NO: 64654 - DNA, 201 bp, Bos taurus; identical to SEQ ID NO: 24179

SEQ ID NO: 64655 - DNA, 201 bp, Bos taurus; identical to SEQ ID NO: 24180

SEQ ID NO: 64656 - DNA, 201 bp, Bos taurus; identical to SEQ ID NO: 24181

SEQ ID NO: 64657 - DNA, 201 bp, Bos taurus; identical to SEQ ID NO: 24182

SEQ ID NO: 64658 - DNA, 201 bp, Bos taurus; identical to SEQ ID NO: 24183

SEQ ID NO: 64659 - DNA, 201 bp, Bos taurus; identical to SEQ ID NO: 24184

SEQ ID NO: 64660 - DNA, 201 bp, Bos taurus; identical to SEQ ID NO: 24185

SEQ ID NO: 64661 - DNA, 201 bp, Bos taurus; identical to SEQ ID NO: 24187

SEQ ID NO: 64662 - DNA, 201 bp, Bos taurus; identical to SEQ ID NO: 24188

SEQ ID NO: 64663 - DNA, 201 bp, Bos taurus; identical to SEQ ID NO: 24189

SEQ ID NO: 64664 - DNA, 201 bp, Bos taurus; identical to SEQ ID NO: 24190

SEQ ID NO: 64665 - DNA, 201 bp, Bos taurus; identical to SEQ ID NO: 24191

SEQ ID NO: 64666 - DNA, 201 bp, Bos taurus; identical to SEQ ID NO: 24192

SEQ ID NO: 64667 - DNA, 201 bp, Bos taurus; identical to SEQ ID NO: 24193

SEQ ID NO: 64668 - DNA, 201 bp, Bos taurus; identical to SEQ ID NO: 24194

SEQ ID NO: 64669 - DNA, 201 bp, Bos taurus; identical to SEQ ID NO: 24195

SEQ ID NO: 64670 - DNA, 201 bp, Bos taurus; identical to SEQ ID NO: 24196

SEQ ID NO: 64671 - DNA, 201 bp, Bos taurus; identical to SEQ ID NO: 24197

SEQ ID NO: 64672 - DNA, 201 bp, Bos taurus; identical to SEQ ID NO: 24198

SEQ ID NO: 64673 - DNA, 201 bp, Bos taurus; identical to SEQ ID NO: 24199

SEQ ID NO: 64674 - DNA, 201 bp, Bos taurus; identical to SEQ ID NO: 24200

SEQ ID NO: 64675 - DNA, 201 bp, Bos taurus; identical to SEQ ID NO: 24201

SEQ ID NO: 64676 - DNA, 201 bp, Bos taurus; identical to SEQ ID NO: 24202

SEQ ID NO: 64677 - DNA, 201 bp, Bos taurus; identical to SEQ ID NO: 24203

SEQ ID NO: 64678 - DNA, 201 bp, Bos taurus; identical to SEQ ID NO: 24204

SEQ ID NO: 64679 - DNA, 201 bp, Bos taurus; identical to SEQ ID NO: 24205

SEQ ID NO: 64680 - DNA, 201 bp, Bos taurus; identical to SEQ ID NO: 24206

SEQ ID NO: 64681 - DNA, 201 bp, Bos taurus; identical to SEQ ID NO: 24207

SEQ ID NO: 64682 - DNA, 201 bp, Bos taurus; identical to SEQ ID NO: 24208

SEQ ID NO: 64683 - DNA, 201 bp, Bos taurus; identical to SEQ ID NO: 24209

SEQ ID NO: 64684 - DNA, 201 bp, Bos taurus; identical to SEQ ID NO: 24210

SEQ ID NO: 64685 - DNA, 201 bp, Bos taurus; identical to SEQ ID NO: 24211

SEQ ID NO: 64686 - DNA, 201 bp, Bos taurus; identical to SEQ ID NO: 24212

SEQ ID NO: 64687 - DNA, 201 bp, Bos taurus; identical to SEQ ID NO: 24213

SEQ ID NO: 64688 - DNA, 201 bp, Bos taurus; identical to SEQ ID NO: 24214

SEQ ID NO: 64689 - DNA, 201 bp, Bos taurus; identical to SEQ ID NO: 24215

SEQ ID NO: 64690 - DNA, 201 bp, Bos taurus; identical to SEQ ID NO: 24217

SEQ ID NO: 64691 - DNA, 201 bp, Bos taurus; identical to SEQ ID NO: 24219

SEQ ID NO: 64692 - DNA, 201 bp, Bos taurus; identical to SEQ ID NO: 24221

SEQ ID NO: 64693 - DNA, 201 bp, Bos taurus; identical to SEQ ID NO: 24222

SEQ ID NO: 64694 - DNA, 201 bp, Bos taurus; identical to SEQ ID NO: 24223

SEQ ID NO: 64695 - DNA, 201 bp, Bos taurus; identical to SEQ ID NO: 24225

SEQ ID NO: 64696 - DNA, 201 bp, Bos taurus; identical to SEQ ID NO: 24226

SEQ ID NO: 64697 - DNA, 201 bp, Bos taurus; identical to SEQ ID NO: 24227

SEQ ID NO: 64698 - DNA, 201 bp, Bos taurus; identical to SEQ ID NO: 24228

SEQ ID NO: 64699 - DNA, 201 bp, Bos taurus; identical to SEQ ID NO: 24232

SEQ ID NO: 64700 - DNA, 201 bp, Bos taurus
tgaggctacgacctttaaccctaaggtcctgcctggtccacagcaccatcagctccatctaaaggagtatctaggagtctgaggccagacaaggatgaagagagggtatggaggacagggtccccagagcagggagtggagcctcagtggaaagaacgggagggcaggccgggccccactccctgcatccctgcctgtggg

SEQ ID NO: 64701 - DNA, 201 bp, Bos taurus
gagactgcacacagatacagcaacgttattataatgggcagacggagacacaacccaactgcccagcagcaggtcaccgaataaacaaaacggcccacgataccactgtggtatgatatgaactgtgtcctgcccaaattcattagctaaagccctattcccagaatgtgagtcaaggccttcaaagaggtgattaagtta

SEQ ID NO: 64702 - DNA, 201 bp, Bos taurus; identical to SEQ ID NO: 24233

SEQ ID NO: 64703 - DNA, 201 bp, Bos taurus; identical to SEQ ID NO: 24234

SEQ ID NO: 64704 - DNA, 201 bp, Bos taurus; identical to SEQ ID NO: 24237

SEQ ID NO: 64705 - DNA, 201 bp, Bos taurus; identical to SEQ ID NO: 24238

SEQ ID NO: 64706 - DNA, 201 bp, Bos taurus; identical to SEQ ID NO: 24239

SEQ ID NO: 64707 - DNA, 201 bp, Bos taurus
atcttaccaaaatccagctggaaaaagagaaatatggcttttagaaatccagatgcagtatcacaaagcaaactataaaagggattttggccaagaaaaattagcttaataactgatacacacacacacacacacacacacacacacacacaacctctgaaaatacactcaagattctgaaaaaaaatgtgtattctatga

SEQ ID NO: 64708 - DNA, 201 bp, Bos taurus; identical to SEQ ID NO: 24240

SEQ ID NO: 64709 - DNA, 201 bp, Bos taurus
atatgtctattttcaattgtttctgaactaatatgcaaagcttttctctcttcttatactaaagatcattcgaggaaaagttttgctatgccccaaatttgtttgttgactgagaggcttggggagttcaatagacatttaaatcaatgaggttgaatgaaatcagttttgagggctgcagttaaggacagtcttggggta

SEQ ID NO: 64710 - DNA, 201 bp, Bos taurus
tcatcattttggcaatgctctataaatgtgtagaaactaatgtttataccttctgattccactccagttctcccctttgtgaggccaacttacgaaatgcttatataagcttttttccaccctgttcattagtataacccccagagactaggcagctcctctgatactagttaattcttatcatactatcctatcattcta

SEQ ID NO: 64711 - DNA, 201 bp, Bos taurus
ctgggatgtttggcattgagcaggccacctgttttctcttggtaactcaagcttgtaaaagcttttctggctgttagaaatttattctttctgttcatttctttgctgagacatcacacccagtttttgcacgatgttcttgttagaaagaaagaaagaaggaaggaagaaagaaagagagagggaattacaagatatcta

SEQ ID NO: 64712 - DNA, 201 bp, Bos taurus
gaagatccagcacaaccaaaactaaacagatagataaataaaaataattatcaactgaaaaaaagaatttaactttcctgaatgttgacaatgggcctccctggagaaaaatctatttccaactttttgcctcaggctgggatgttgagaaatctctgccagaaacaaatagtacacaaacatagatggttaagatgtgtg

SEQ ID NO: 64713 - DNA, 201 bp, Bos taurus; identical to SEQ ID NO: 24241

SEQ ID NO: 64714 - DNA, 201 bp, Bos taurus; identical to SEQ ID NO: 24242

SEQ ID NO: 64715 - DNA, 201 bp, Bos taurus
ggacagaggaacctgacaggctatagtccatgggctcgtaaaagagtcagacatgacgtagcgactaaacaacaacaaaagacaccttagaatggaatgatttacacatgttttcaacttcaataaatactgtcaaacagttttccaatgtggttctaccaatttatattcctacgagggatataggagagtatccttact

SEQ ID NO: 64716 - DNA, 201 bp, Bos taurus; identical to SEQ ID NO: 24243

SEQ ID NO: 64717 - DNA, 201 bp, Bos taurus; identical to SEQ ID NO: 24244

SEQ ID NO: 64718 - DNA, 201 bp, Bos taurus; identical to SEQ ID NO: 24247

SEQ ID NO: 64719 - DNA, 201 bp, Bos taurus; identical to SEQ ID NO: 24248

SEQ ID NO: 64720 - DNA, 201 bp, Bos taurus; identical to SEQ ID NO: 24250

SEQ ID NO: 64721 - DNA, 201 bp, Bos taurus
accctggactggcaactcgtttcttacatgatattttacatgtttcaatgtcatgaaaagagaatacagaggaaggccaccaagtagatgtatcacattacgttgtcctatgtcctccttgatggattccaatgctcatccatcttctgctgtcactgatgccgctgagcatcctggaggaggccacattccctcttatac

SEQ ID NO: 64722 - DNA, 201 bp, Bos taurus; identical to SEQ ID NO: 24252

SEQ ID NO: 64723 - DNA, 201 bp, Bos taurus; identical to SEQ ID NO: 24253

SEQ ID NO: 64724 - DNA, 201 bp, Bos taurus; identical to SEQ ID NO: 24255

SEQ ID NO: 64725 - DNA, 201 bp, Bos taurus; identical to SEQ ID NO: 24256

SEQ ID NO: 64726 - DNA, 201 bp, Bos taurus; identical to SEQ ID NO: 24258

SEQ ID NO: 64727 - DNA, 201 bp, Bos taurus
cgccaaatcagaataaggaacctgggtaatttccatctgcctttgacaactaggtggagcaggccctgttaaaccagtcaccactctaaccgaaggaagccacctgccacagggctgatcccaatgattcaggtctcattaaatcaggagatgacgctcagtcaaagcaaagaaaaatgtcgcaaaacgtggttaagacac

SEQ ID NO: 64728 - DNA, 201 bp, Bos taurus; identical to SEQ ID NO: 24260

SEQ ID NO: 64729 - DNA, 201 bp, Bos taurus; identical to SEQ ID NO: 24261

SEQ ID NO: 64730 - DNA, 201 bp, Bos taurus; identical to SEQ ID NO: 24263

SEQ ID NO: 64731 - DNA, 201 bp, Bos taurus; identical to SEQ ID NO: 24264

SEQ ID NO: 64732 - DNA, 201 bp, Bos taurus; identical to SEQ ID NO: 24265

SEQ ID NO: 64733 - DNA, 201 bp, Bos taurus; identical to SEQ ID NO: 24266

SEQ ID NO: 64734 - DNA, 201 bp, Bos taurus; identical to SEQ ID NO: 24267

SEQ ID NO: 64735 - DNA, 201 bp, Bos taurus
ttcattttttaaaaagccaagtaagagctaagtagtttttctgttgtcagaatcacagcccccaaaccttaatcttatactaattagaggggtttaataggagaatatgttaagaaaaatttaaaacacgtttcccacaaaaatttttatataccagaaatggaagagacaaattcagtcctttcatctctatctgattca

SEQ ID NO: 64736 - DNA, 201 bp, Bos taurus
cctcttgcagtccagggtgtggcccgggaacacccagacctacgcggcttgtcctgctccctggaccctataggagagaggccagctgccaggtgactagttgtatacacaggccaacttgagagcggagacaaagatctccagagcatgccttggaaggttaactcattctcagctcatcatttcctgaagctttttcct

SEQ ID NO: 64737 - DNA, 201 bp, Bos taurus; identical to SEQ ID NO: 24268

SEQ ID NO: 64738 - DNA, 201 bp, Bos taurus; identical to SEQ ID NO: 24269

SEQ ID NO: 64739 - DNA, 201 bp, Bos taurus; identical to SEQ ID NO: 24270

SEQ ID NO: 64740 - DNA, 201 bp, Bos taurus; identical to SEQ ID NO: 24271

SEQ ID NO: 64741 - DNA, 201 bp, Bos taurus; identical to SEQ ID NO: 24272

SEQ ID NO: 64742 - DNA, 201 bp, Bos taurus; identical to SEQ ID NO: 24273

SEQ ID NO: 64743 - DNA, 201 bp, Bos taurus; identical to SEQ ID NO: 24274

SEQ ID NO: 64744 - DNA, 201 bp, Bos taurus; identical to SEQ ID NO: 24275

SEQ ID NO: 64745 - DNA, 201 bp, Bos taurus; identical to SEQ ID NO: 24277

SEQ ID NO: 64746 - DNA, 201 bp, Bos taurus; identical to SEQ ID NO: 24278

SEQ ID NO: 64747 - DNA, 201 bp, Bos taurus; identical to SEQ ID NO: 24279

SEQ ID NO: 64748 - DNA, 201 bp, Bos taurus; identical to SEQ ID NO: 24280

SEQ ID NO: 64749 - DNA, 201 bp, Bos taurus; identical to SEQ ID NO: 24283

SEQ ID NO: 64750 - DNA, 201 bp, Bos taurus
ctctctcctccccttctttgagtggaaatgctcacactctgacatacaatatcaaatgtcttctcttctgagaagtcttcctttattatctgaagaagagtttgctgagttgctcactgtgctagccagagaagtgctgatacttagtctttatagttatataattcatattaaatcccaagaagagaaagaacagatcac

SEQ ID NO: 64751 - DNA, 201 bp, Bos taurus
gagcatggaagtgatgacgtggatgctgcttgctgaggggccaggccagggcaccagcacttgtggtgcttcctacaacctcagaggtatcagcatctccgcgcctgtgcagcctcctgagggcacacggggaactggccaacggagcaaccaggaccgcccatcagcacgagtggcaactacccccaaacaaggccaagg

SEQ ID NO: 64752 - DNA, 201 bp, Bos taurus
tcattcttctttctccggggtctagaacccaccttgcccagagaagagtttcagaaaactttgttgctatggaaggaagtgtggaatgaacagcctgagataggctggcatcattactttctgtggtatgtgattcctttgtattgctaattctattatcaatatttattggaattaatcagatgatgatgttctgactag

SEQ ID NO: 64753 - DNA, 201 bp, Bos taurus; identical to SEQ ID NO: 24284

SEQ ID NO: 64754 - DNA, 201 bp, Bos taurus
ttaaactctataattcatctgtattttcattcagttactcattcattcatataaaactgagcttttgtcatatgtaaaacattgtgtcatgtttatactggaagatatgtaaatcctaatatggaagatatattcattgtctttatggaattcacagtttacaatagaaaattgatacccacagatacaatagtacaacat

SEQ ID NO: 64755 - DNA, 201 bp, Bos taurus; identical to SEQ ID NO: 24286

SEQ ID NO: 64756 - DNA, 201 bp, Bos taurus; identical to SEQ ID NO: 24288

SEQ ID NO: 64757 - DNA, 201 bp, Bos taurus; identical to SEQ ID NO: 24289

SEQ ID NO: 64758 - DNA, 201 bp, Bos taurus; identical to SEQ ID NO: 24290

SEQ ID NO: 64759 - DNA, 201 bp, Bos taurus; identical to SEQ ID NO: 24291

SEQ ID NO: 64760 - DNA, 201 bp, Bos taurus; identical to SEQ ID NO: 24292

SEQ ID NO: 64761 - DNA, 201 bp, Bos taurus; identical to SEQ ID NO: 24293

SEQ ID NO: 64762 - DNA, 201 bp, Bos taurus; identical to SEQ ID NO: 24294

SEQ ID NO: 64763 - DNA, 201 bp, Bos taurus; identical to SEQ ID NO: 24295

SEQ ID NO: 64764 - DNA, 201 bp, Bos taurus; identical to SEQ ID NO: 24297

SEQ ID NO: 64765 - DNA, 201 bp, Bos taurus; identical to SEQ ID NO: 24298

SEQ ID NO: 64766 - DNA, 201 bp, Bos taurus; identical to SEQ ID NO: 24299

SEQ ID NO: 64767 - DNA, 201 bp, Bos taurus; identical to SEQ ID NO: 24300

SEQ ID NO: 64768 - DNA, 201 bp, Bos taurus; identical to SEQ ID NO: 24301

SEQ ID NO: 64769 - DNA, 201 bp, Bos taurus; identical to SEQ ID NO: 24302

SEQ ID NO: 64770 - DNA, 201 bp, Bos taurus; identical to SEQ ID NO: 24303

SEQ ID NO: 64771 - DNA, 201 bp, Bos taurus; identical to SEQ ID NO: 24304

SEQ ID NO: 64772 - DNA, 201 bp, Bos taurus; identical to SEQ ID NO: 24305

SEQ ID NO: 64773 - DNA, 201 bp, Bos taurus; identical to SEQ ID NO: 24306

SEQ ID NO: 64774 - DNA, 201 bp, Bos taurus; identical to SEQ ID NO: 24307

SEQ ID NO: 64775 - DNA, 201 bp, Bos taurus; identical to SEQ ID NO: 24309

SEQ ID NO: 64776 - DNA, 201 bp, Bos taurus; identical to SEQ ID NO: 24310

SEQ ID NO: 64777 - DNA, 201 bp, Bos taurus; identical to SEQ ID NO: 24311

SEQ ID NO: 64778 - DNA, 201 bp, Bos taurus; identical to SEQ ID NO: 24313

SEQ ID NO: 64779 - DNA, 201 bp, Bos taurus; identical to SEQ ID NO: 24314

SEQ ID NO: 64780 - DNA, 201 bp, Bos taurus; identical to SEQ ID NO: 24315

SEQ ID NO: 64781 - DNA, 201 bp, Bos taurus; identical to SEQ ID NO: 24316

SEQ ID NO: 64782 - DNA, 201 bp, Bos taurus; identical to SEQ ID NO: 24319

SEQ ID NO: 64783 - DNA, 201 bp, Bos taurus; identical to SEQ ID NO: 24320

SEQ ID NO: 64784 - DNA, 201 bp, Bos taurus
tctatataatttatcatccaaacaaggacactttgagagtgaaaagcaatgctattaataattgtgccaagccagtaggaataaaccaggattgtccccccaaataaggacatatggtcactgtattgattacctcatttcaatattaccaagacaacatcggtaccctttttctgctttcttttgctacctgacttcata

SEQ ID NO: 64785 - DNA, 201 bp, Bos taurus
aagtataattcacaatagaaaataatgtcacctgtagaaagacccatgcaaataacatttcataactaaagaaaagccagtcctttaaaagtcattgtccttggtttcatccttctggatatttttccagtctcaagctctctgtttcttcaaatgtctgtctagcaatggcaccccactccagtactcttgcctagaaaa

SEQ ID NO: 64786 - DNA, 201 bp, Bos taurus
cccaacttaaatcacagtggtaagaaagggaggaggtgtgtcccaacctggatcccattttccaacaaaaagcccatttccagcacactggcccacaatttgggctcctgcacgaatgtgcctcacaaataataacctcgctgcacatcaagctgggaaatgaacactggcagagtcctgctaaattcccttaaactggcc

SEQ ID NO: 64787 - DNA, 201 bp, Bos taurus
agacacaactgagcgacaaaggatgcacaaagtaaatcagaaattcatatttcagtaaaccttcactcagacacatatttgaagcagttactgatattttcccctgtggaaagtccttgtatttcccatccaccgactcatcttccttagtctctttcaaaattaacctcttgcaggaagcattctctgatcaccctaatc

SEQ ID NO: 64788 - DNA, 201 bp, Bos taurus; identical to SEQ ID NO: 24321

SEQ ID NO: 64789 - DNA, 201 bp, Bos taurus; identical to SEQ ID NO: 24322

SEQ ID NO: 64790 - DNA, 201 bp, Bos taurus; identical to SEQ ID NO: 24325

SEQ ID NO: 64791 - DNA, 201 bp, Bos taurus
gagaagtgtggactttccagctctcccaggcccctggaaacacatgaatcccacactgcagaaatggatgaccattgctcagagggggcctaaatccccactcaagaaacctagaaataacactattgttcgcagctgccctctcctgtcatctctacacctaacaggacatgagcatgaagcatgggggcatatagtcca

SEQ ID NO: 64792 - DNA, 201 bp, Bos taurus
tactttaaattttcaagcctcctattgggaggcttctaattcttaatctgccactgagattttgtttgtgatgttcagtgatctaaaacaataaaatgctataagtatttacaacaatgtagcaatcagaagcaatgaaattttgactagatattttcattttcagagaatttgcaacaggcagtaatgcactgaatactt

SEQ ID NO: 64793 - DNA, 201 bp, Bos taurus; identical to SEQ ID NO: 24327

SEQ ID NO: 64794 - DNA, 201 bp, Bos taurus; identical to SEQ ID NO: 24328

SEQ ID NO: 64795 - DNA, 201 bp, Bos taurus; identical to SEQ ID NO: 24330

SEQ ID NO: 64796 - DNA, 201 bp, Bos taurus; identical to SEQ ID NO: 24331

SEQ ID NO: 64797 - DNA, 201 bp, Bos taurus; identical to SEQ ID NO: 24332

SEQ ID NO: 64798 - DNA, 201 bp, Bos taurus
aatttagtgtcctattagagcacataccctgttttgttaatcaactgatttgtttattaagttattaatatgttctctttcaccacactcattgcataaagcttcatagaagaaaggtgtgaagtgaaatggtttcagctctaaggacattctggtctcttaggaagattatctgtacaccaagttgaaaactgttaagta

SEQ ID NO: 64799 - DNA, 201 bp, Bos taurus
cagtccacggggtctcaaagagttgaacaggactgaagtgactgagcatgcacgcacaccagagcagtttcaagtggttcctcataacttcaggaagttatctgaaggccggagacagcacacagaggaggggagactaactcaaggtgtcgagacgcagcatcacagtctccgagggtgtcagacaggaaaagaagcacc

SEQ ID NO: 64800 - DNA, 201 bp, Bos taurus
gaatgccatagcaagaagataagccagcagtgatgctgagaaaactgctccagtggccttaagcagatgagtccagcctggctcgctgaaccctgggcttccactgactataaacactgtcgcctggaagcattttgttttataatgtatgttgggagaggcttaatttttttaatatgttcagtagtaagaatagctatt

SEQ ID NO: 64801 - DNA, 201 bp, Bos taurus
caacgcatgtcaggaaggataaggccatgttgcaaggggtttttgtctccttaggtgcatggattttaaattaattcactgtgtaatgagggacaatgatcggtttggtttctttaaaggccagaccaattgattgtccaaacttctccatgctattttttattgactccagaatgaggtcaaaatcatcacttattttca

SEQ ID NO: 64802 - DNA, 201 bp, Bos taurus
gcttgggaggactcacatgggtatcccccaagggctcagcatagaatgaggagacagaaattcacgtctctcagccttttccagaaagaggccagtttgcatatcttaaaagctgtagcctgaaggtcctaaactagcatgcactgggggactgagtgtgattggagaggccggctggagtcatctctacattctccctct

SEQ ID NO: 64803 - DNA, 201 bp, Bos taurus; identical to SEQ ID NO: 24333

SEQ ID NO: 64804 - DNA, 201 bp, Bos taurus
caagaaaaaagaagtaaatatttagttaatggatgtattaattaactcagtggcaagaatccattcacaacataaacatatatcaaatcatcatgtcatatgcattactacaaatttatctgtcaattatgtatcagtaaaggagaaaaatgcatttctgtgggcagcaaacaaaaattgcaatggagcaattccttcaaa

SEQ ID NO: 64805 - DNA, 201 bp, Bos taurus; identical to SEQ ID NO: 24334

SEQ ID NO: 64806 - DNA, 201 bp, Bos taurus; identical to SEQ ID NO: 24335

SEQ ID NO: 64807 - DNA, 201 bp, Bos taurus; identical to SEQ ID NO: 24336

SEQ ID NO: 64808 - DNA, 201 bp, Bos taurus; identical to SEQ ID NO: 24337

SEQ ID NO: 64809 - DNA, 201 bp, Bos taurus; identical to SEQ ID NO: 24338

SEQ ID NO: 64810 - DNA, 201 bp, Bos taurus; identical to SEQ ID NO: 24339

SEQ ID NO: 64811 - DNA, 201 bp, Bos taurus; identical to SEQ ID NO: 24344

SEQ ID NO: 64812 - DNA, 201 bp, Bos taurus; identical to SEQ ID NO: 24345

SEQ ID NO: 64813 - DNA, 201 bp, Bos taurus; identical to SEQ ID NO: 24346

SEQ ID NO: 64814 - DNA, 201 bp, Bos taurus; identical to SEQ ID NO: 24347

SEQ ID NO: 64815 - DNA, 201 bp, Bos taurus; identical to SEQ ID NO: 24350

SEQ ID NO: 64816 - DNA, 201 bp, Bos taurus; identical to SEQ ID NO: 24352

SEQ ID NO: 64817 - DNA, 201 bp, Bos taurus; identical to SEQ ID NO: 24353

SEQ ID NO: 64818 - DNA, 201 bp, Bos taurus; identical to SEQ ID NO: 24356

SEQ ID NO: 64819 - DNA, 201 bp, Bos taurus; identical to SEQ ID NO: 24357

SEQ ID NO: 64820 - DNA, 201 bp, Bos taurus; identical to SEQ ID NO: 24363

SEQ ID NO: 64821 - DNA, 201 bp, Bos taurus; identical to SEQ ID NO: 24365

SEQ ID NO: 64822 - DNA, 201 bp, Bos taurus; identical to SEQ ID NO: 24366

SEQ ID NO: 64823 - DNA, 201 bp, Bos taurus; identical to SEQ ID NO: 24367

SEQ ID NO: 64824 - DNA, 201 bp, Bos taurus; identical to SEQ ID NO: 24368

SEQ ID NO: 64825 - DNA, 201 bp, Bos taurus; identical to SEQ ID NO: 24369

SEQ ID NO: 64826 - DNA, 201 bp, Bos taurus; identical to SEQ ID NO: 24370

SEQ ID NO: 64827 - DNA, 201 bp, Bos taurus; identical to SEQ ID NO: 24373

SEQ ID NO: 64828 - DNA, 201 bp, Bos taurus; identical to SEQ ID NO: 24374

SEQ ID NO: 64829 - DNA, 201 bp, Bos taurus; identical to SEQ ID NO: 24375

SEQ ID NO: 64830 - DNA, 201 bp, Bos taurus; identical to SEQ ID NO: 24378

SEQ ID NO: 64831 - DNA, 201 bp, Bos taurus; identical to SEQ ID NO: 24379

SEQ ID NO: 64832 - DNA, 201 bp, Bos taurus; identical to SEQ ID NO: 24380

SEQ ID NO: 64833 - DNA, 201 bp, Bos taurus; identical to SEQ ID NO: 24382

SEQ ID NO: 64834 - DNA, 201 bp, Bos taurus; identical to SEQ ID NO: 24383

SEQ ID NO: 64835 - DNA, 201 bp, Bos taurus; identical to SEQ ID NO: 24386

SEQ ID NO: 64836 - DNA, 201 bp, Bos taurus; identical to SEQ ID NO: 24391

SEQ ID NO: 64837 - DNA, 201 bp, Bos taurus; identical to SEQ ID NO: 24397

SEQ ID NO: 64838 - DNA, 201 bp, Bos taurus; identical to SEQ ID NO: 24398

SEQ ID NO: 64839 - DNA, 201 bp, Bos taurus; identical to SEQ ID NO: 24400

SEQ ID NO: 64840 - DNA, 201 bp, Bos taurus; identical to SEQ ID NO: 24402

SEQ ID NO: 64841 - DNA, 201 bp, Bos taurus; identical to SEQ ID NO: 24403

SEQ ID NO: 64842 - DNA, 201 bp, Bos taurus; identical to SEQ ID NO: 24404

SEQ ID NO: 64843 - DNA, 201 bp, Bos taurus; identical to SEQ ID NO: 24405

SEQ ID NO: 64844 - DNA, 201 bp, Bos taurus; identical to SEQ ID NO: 24407

SEQ ID NO: 64845 - DNA, 201 bp, Bos taurus; identical to SEQ ID NO: 24408

SEQ ID NO: 64846 - DNA, 201 bp, Bos taurus; identical to SEQ ID NO: 24409

SEQ ID NO: 64847 - DNA, 201 bp, Bos taurus; identical to SEQ ID NO: 24410

SEQ ID NO: 64848 - DNA, 201 bp, Bos taurus; identical to SEQ ID NO: 24411

SEQ ID NO: 64849 - DNA, 201 bp, Bos taurus; identical to SEQ ID NO: 24413

SEQ ID NO: 64850 - DNA, 201 bp, Bos taurus; identical to SEQ ID NO: 24419

SEQ ID NO: 64851 - DNA, 201 bp, Bos taurus; identical to SEQ ID NO: 24421

SEQ ID NO: 64852 - DNA, 201 bp, Bos taurus; identical to SEQ ID NO: 24424

SEQ ID NO: 64853 - DNA, 201 bp, Bos taurus; identical to SEQ ID NO: 24427

SEQ ID NO: 64854 - DNA, 201 bp, Bos taurus; identical to SEQ ID NO: 24433

SEQ ID NO: 64855 - DNA, 201 bp, Bos taurus; identical to SEQ ID NO: 24436

SEQ ID NO: 64856 - DNA, 201 bp, Bos taurus; identical to SEQ ID NO: 24437

SEQ ID NO: 64857 - DNA, 201 bp, Bos taurus; identical to SEQ ID NO: 24438

SEQ ID NO: 64858 - DNA, 201 bp, Bos taurus; identical to SEQ ID NO: 24439

SEQ ID NO: 64859 - DNA, 201 bp, Bos taurus; identical to SEQ ID NO: 24441

SEQ ID NO: 64860 - DNA, 201 bp, Bos taurus; identical to SEQ ID NO: 24443

SEQ ID NO: 64861 - DNA, 201 bp, Bos taurus; identical to SEQ ID NO: 24447

SEQ ID NO: 64862 - DNA, 201 bp, Bos taurus; identical to SEQ ID NO: 24449

SEQ ID NO: 64863 - DNA, 201 bp, Bos taurus; identical to SEQ ID NO: 24450

SEQ ID NO: 64864 - DNA, 201 bp, Bos taurus; identical to SEQ ID NO: 24452

SEQ ID NO: 64865 - DNA, 201 bp, Bos taurus; identical to SEQ ID NO: 24456

SEQ ID NO: 64866 - DNA, 201 bp, Bos taurus; identical to SEQ ID NO: 24458

SEQ ID NO: 64867 - DNA, 201 bp, Bos taurus; identical to SEQ ID NO: 24459

SEQ ID NO: 64868 - DNA, 201 bp, Bos taurus
acaaagctggaagtatcacactccttgacttcaaattatattacaaaaccatagtaatccaaacagcaaggtactggatgcactgaatgactggcctggcactgcagattgagaggagagcctgaaggtgcaggggaaattatgaagccacttctgttagtgaacctcaaaaaatctgaggcagaatggccaaaatgacag

SEQ ID NO: 64869 - DNA, 201 bp, Bos taurus
aatgactagtcaaacatagattatttatatttttcctacaatttaaggactactttctatttcagtttattcatcccttctgtaagttgaattcatagtacacacatattcaccaaattatactattaaatactgagctatacatatttaggatattggcatttgtaatgtttaaaatgcaaaatatttattttcccaact

SEQ ID NO: 64870 - DNA, 201 bp, Bos taurus; identical to SEQ ID NO: 24461

SEQ ID NO: 64871 - DNA, 201 bp, Bos taurus; identical to SEQ ID NO: 24464

SEQ ID NO: 64872 - DNA, 201 bp, Bos taurus; identical to SEQ ID NO: 24466

SEQ ID NO: 64873 - DNA, 201 bp, Bos taurus
tattttttcatatttattttaatgactgtcaaactctattcctctcttacaggataacttattgctaaattcaatgcatattttactggcttcaatttttcggtcactgcttgttacagtaatggtatttcttcttgcccttgcttctgtcttatcatttggatcattcttccgaacccttactaatgatcttcactattc

SEQ ID NO: 64874 - DNA, 201 bp, Bos taurus
ggccagagaggccttctgattgccagctacaagagggtcaaaaaaaaaaaaaactctgatagagccataattcctgtagcagagacagtccatgtccctgtacagttggccctgccagggtccccataacccaataatagtaggagacattaacaccccactcacaccaatggacaggtcatcaaaacagaaaattaataa

SEQ ID NO: 64875 - DNA, 201 bp, Bos taurus; identical to SEQ ID NO: 24468

SEQ ID NO: 64876 - DNA, 201 bp, Bos taurus; identical to SEQ ID NO: 24469

SEQ ID NO: 64877 - DNA, 201 bp, Bos taurus; identical to SEQ ID NO: 24471

SEQ ID NO: 64878 - DNA, 201 bp, Bos taurus; identical to SEQ ID NO: 24472

SEQ ID NO: 64879 - DNA, 201 bp, Bos taurus; identical to SEQ ID NO: 24473

SEQ ID NO: 64880 - DNA, 201 bp, Bos taurus; identical to SEQ ID NO: 24474

SEQ ID NO: 64881 - DNA, 201 bp, Bos taurus
actttcttccattagagaaaagctaaagaagagatgtagagacttacttggccagctgttgcttagcaaagaaaaaacattattctacattgatgtcacagaaaagcaactaccagaactcacggctcttactaaagctaaaattatatttcctgctatcaatcatagggaaatatggtggatctgacactaaaaatatca

SEQ ID NO: 64882 - DNA, 201 bp, Bos taurus
tgtaagatcctgaagaaaaggacctggcttagccatgtccaaacttctgacacatagaaatgatgaggctgtttaagtgtgctgttttaaaccacgtcatttgtggcccaatttttaactaataatctttccacatagaataaaaaatctacacttatgtaaatctcttctgagtgaaaagaccatctttttccaaatatt

SEQ ID NO: 64883 - DNA, 201 bp, Bos taurus; identical to SEQ ID NO: 24476

SEQ ID NO: 64884 - DNA, 201 bp, Bos taurus; identical to SEQ ID NO: 24477

SEQ ID NO: 64885 - DNA, 201 bp, Bos taurus
gaggggaattagcaatattgtcgacatgccaaacatatattgaggcttccaaaagtattactgttacagcaaacaagacccaaagtcatcaccctatcttccgtgtgttccccaaatatgttgtgttccactgataagggcattaataactaaaggggtttgaataaaataaaatcagaaacatatttatatcttatttct

SEQ ID NO: 64886 - DNA, 201 bp, Bos taurus
tgggattctccaggaaagaatgctggagtgggctgccatttcctcctccaggggatcttcccaatccagggatagaacccatgtctcctgcactgcaggcggattcttcaccgctaaggcccaagggaagccttgtttcaataatcatcataagaataatcatatcttaatgaaggttaaaaaccctgtgtgtaggcacag

SEQ ID NO: 64887 - DNA, 201 bp, Bos taurus; identical to SEQ ID NO: 24480

SEQ ID NO: 64888 - DNA, 201 bp, Bos taurus
ccaattcttcctaattaccaggcagtaaagtaggggactattcattgcctgatttattatacagtttgatctttatgtttgttgctagtccccacagacttcactcagatagtataaattaaaccataaggccctcgtattttctaggagagctgtggctctgtcagcatccattctttctctccaaaatggtagtaggtt

SEQ ID NO: 64889 - DNA, 201 bp, Bos taurus; identical to SEQ ID NO: 24481

SEQ ID NO: 64890 - DNA, 201 bp, Bos taurus; identical to SEQ ID NO: 24482

SEQ ID NO: 64891 - DNA, 201 bp, Bos taurus
ctaaatatctttttactatggtttcttagtaattctgatgatgcccaatgcaaatatgtttctgttcccaatgacattttaatactttcttcaaggaatttttgaaatatttaacaatagtaaattaactaaacatatttttcctttcctttcttttaagaaaaatagctgtctttttgttaaatttttactactattagt

SEQ ID NO: 64892 - DNA, 201 bp, Bos taurus; identical to SEQ ID NO: 24485

SEQ ID NO: 64893 - DNA, 201 bp, Bos taurus; identical to SEQ ID NO: 24487

SEQ ID NO: 64894 - DNA, 201 bp, Bos taurus; identical to SEQ ID NO: 24488

SEQ ID NO: 64895 - DNA, 201 bp, Bos taurus; identical to SEQ ID NO: 24491

SEQ ID NO: 64896 - DNA, 201 bp, Bos taurus; identical to SEQ ID NO: 24493

SEQ ID NO: 64897 - DNA, 201 bp, Bos taurus; identical to SEQ ID NO: 24496

SEQ ID NO: 64898 - DNA, 201 bp, Bos taurus; identical to SEQ ID NO: 24498

SEQ ID NO: 64899 - DNA, 201 bp, Bos taurus; identical to SEQ ID NO: 24499

SEQ ID NO: 64900 - DNA, 201 bp, Bos taurus; identical to SEQ ID NO: 24500

SEQ ID NO: 64901 - DNA, 201 bp, Bos taurus; identical to SEQ ID NO: 24504

SEQ ID NO: 64902 - DNA, 201 bp, Bos taurus; identical to SEQ ID NO: 24506

SEQ ID NO: 64903 - DNA, 201 bp, Bos taurus; identical to SEQ ID NO: 24508

SEQ ID NO: 64904 - DNA, 201 bp, Bos taurus; identical to SEQ ID NO: 24511

SEQ ID NO: 64905 - DNA, 201 bp, Bos taurus; identical to SEQ ID NO: 24512

SEQ ID NO: 64906 - DNA, 201 bp, Bos taurus; identical to SEQ ID NO: 24515

SEQ ID NO: 64907 - DNA, 201 bp, Bos taurus; identical to SEQ ID NO: 24517

SEQ ID NO: 64908 - DNA, 201 bp, Bos taurus; identical to SEQ ID NO: 24518

SEQ ID NO: 64909 - DNA, 201 bp, Bos taurus; identical to SEQ ID NO: 24519

SEQ ID NO: 64910 - DNA, 201 bp, Bos taurus; identical to SEQ ID NO: 24520

SEQ ID NO: 64911 - DNA, 201 bp, Bos taurus; identical to SEQ ID NO: 24522

SEQ ID NO: 64912 - DNA, 201 bp, Bos taurus; identical to SEQ ID NO: 24523

SEQ ID NO: 64913 - DNA, 201 bp, Bos taurus; identical to SEQ ID NO: 24525

SEQ ID NO: 64914 - DNA, 201 bp, Bos taurus; identical to SEQ ID NO: 24529

SEQ ID NO: 64915 - DNA, 201 bp, Bos taurus; identical to SEQ ID NO: 24531

SEQ ID NO: 64916 - DNA, 201 bp, Bos taurus; identical to SEQ ID NO: 24533

SEQ ID NO: 64917 - DNA, 201 bp, Bos taurus; identical to SEQ ID NO: 24536

SEQ ID NO: 64918 - DNA, 201 bp, Bos taurus; identical to SEQ ID NO: 24538

SEQ ID NO: 64919 - DNA, 201 bp, Bos taurus; identical to SEQ ID NO: 24539

SEQ ID NO: 64920 - DNA, 201 bp, Bos taurus; identical to SEQ ID NO: 24540

SEQ ID NO: 64921 - DNA, 201 bp, Bos taurus; identical to SEQ ID NO: 24541

SEQ ID NO: 64922 - DNA, 201 bp, Bos taurus; identical to SEQ ID NO: 24542

SEQ ID NO: 64923 - DNA, 201 bp, Bos taurus; identical to SEQ ID NO: 24543

SEQ ID NO: 64924 - DNA, 201 bp, Bos taurus; identical to SEQ ID NO: 24547

SEQ ID NO: 64925 - DNA, 201 bp, Bos taurus; identical to SEQ ID NO: 24548

SEQ ID NO: 64926 - DNA, 201 bp, Bos taurus; identical to SEQ ID NO: 24551

SEQ ID NO: 64927 - DNA, 201 bp, Bos taurus; identical to SEQ ID NO: 24553

SEQ ID NO: 64928 - DNA, 201 bp, Bos taurus; identical to SEQ ID NO: 24554

SEQ ID NO: 64929 - DNA, 201 bp, Bos taurus; identical to SEQ ID NO: 24555

SEQ ID NO: 64930 - DNA, 201 bp, Bos taurus; identical to SEQ ID NO: 24556

SEQ ID NO: 64931 - DNA, 201 bp, Bos taurus; identical to SEQ ID NO: 24557

SEQ ID NO: 64932 - DNA, 201 bp, Bos taurus; identical to SEQ ID NO: 24558

SEQ ID NO: 64933 - DNA, 201 bp, Bos taurus; identical to SEQ ID NO: 24559

SEQ ID NO: 64934 - DNA, 201 bp, Bos taurus; identical to SEQ ID NO: 24560

SEQ ID NO: 64935 - DNA, 201 bp, Bos taurus; identical to SEQ ID NO: 24561

SEQ ID NO: 64936 - DNA, 201 bp, Bos taurus; identical to SEQ ID NO: 24562

SEQ ID NO: 64937 - DNA, 201 bp, Bos taurus; identical to SEQ ID NO: 24564

SEQ ID NO: 64938 - DNA, 201 bp, Bos taurus; identical to SEQ ID NO: 24565

SEQ ID NO: 64939 - DNA, 201 bp, Bos taurus; identical to SEQ ID NO: 24566

SEQ ID NO: 64940 - DNA, 201 bp, Bos taurus; identical to SEQ ID NO: 24567

SEQ ID NO: 64941 - DNA, 201 bp, Bos taurus; identical to SEQ ID NO: 24568

SEQ ID NO: 64942 - DNA, 201 bp, Bos taurus; identical to SEQ ID NO: 24569

SEQ ID NO: 64943 - DNA, 201 bp, Bos taurus; identical to SEQ ID NO: 24571

SEQ ID NO: 64944 - DNA, 201 bp, Bos taurus; identical to SEQ ID NO: 24574

SEQ ID NO: 64945 - DNA, 201 bp, Bos taurus; identical to SEQ ID NO: 24576

SEQ ID NO: 64946 - DNA, 201 bp, Bos taurus; identical to SEQ ID NO: 24577

SEQ ID NO: 64947 - DNA, 201 bp, Bos taurus; identical to SEQ ID NO: 24578

SEQ ID NO: 64948 - DNA, 201 bp, Bos taurus; identical to SEQ ID NO: 24580

SEQ ID NO: 64949 - DNA, 201 bp, Bos taurus; identical to SEQ ID NO: 24581

SEQ ID NO: 64950 - DNA, 201 bp, Bos taurus; identical to SEQ ID NO: 24582

SEQ ID NO: 64951 - DNA, 201 bp, Bos taurus; identical to SEQ ID NO: 24583

SEQ ID NO: 64952 - DNA, 201 bp, Bos taurus; identical to SEQ ID NO: 24586

SEQ ID NO: 64953 - DNA, 201 bp, Bos taurus; identical to SEQ ID NO: 24589

SEQ ID NO: 64954 - DNA, 201 bp, Bos taurus; identical to SEQ ID NO: 24590

SEQ ID NO: 64955 - DNA, 201 bp, Bos taurus; identical to SEQ ID NO: 24594

SEQ ID NO: 64956 - DNA, 201 bp, Bos taurus; identical to SEQ ID NO: 24595

SEQ ID NO: 64957 - DNA, 201 bp, Bos taurus; identical to SEQ ID NO: 24597

SEQ ID NO: 64958 - DNA, 201 bp, Bos taurus; identical to SEQ ID NO: 24598

SEQ ID NO: 64959 - DNA, 201 bp, Bos taurus; identical to SEQ ID NO: 24600

SEQ ID NO: 64960 - DNA, 201 bp, Bos taurus; identical to SEQ ID NO: 24601

SEQ ID NO: 64961 - DNA, 201 bp, Bos taurus; identical to SEQ ID NO: 24604

SEQ ID NO: 64962 - DNA, 201 bp, Bos taurus; identical to SEQ ID NO: 24605

SEQ ID NO: 64963 - DNA, 201 bp, Bos taurus; identical to SEQ ID NO: 24606

SEQ ID NO: 64964 - DNA, 201 bp, Bos taurus; identical to SEQ ID NO: 24607

SEQ ID NO: 64965 - DNA, 201 bp, Bos taurus; identical to SEQ ID NO: 24608

SEQ ID NO: 64966 - DNA, 201 bp, Bos taurus; identical to SEQ ID NO: 24609

SEQ ID NO: 64967 - DNA, 201 bp, Bos taurus; identical to SEQ ID NO: 24610

SEQ ID NO: 64968 - DNA, 201 bp, Bos taurus; identical to SEQ ID NO: 24611

SEQ ID NO: 64969 - DNA, 201 bp, Bos taurus; identical to SEQ ID NO: 24612

SEQ ID NO: 64970 - DNA, 201 bp, Bos taurus; identical to SEQ ID NO: 24613

SEQ ID NO: 64971 - DNA, 201 bp, Bos taurus; identical to SEQ ID NO: 24614

SEQ ID NO: 64972 - DNA, 201 bp, Bos taurus; identical to SEQ ID NO: 24615

SEQ ID NO: 64973 - DNA, 201 bp, Bos taurus; identical to SEQ ID NO: 24616

SEQ ID NO: 64974 - DNA, 201 bp, Bos taurus; identical to SEQ ID NO: 24617

SEQ ID NO: 64975 - DNA, 201 bp, Bos taurus; identical to SEQ ID NO: 24618

SEQ ID NO: 64976 - DNA, 201 bp, Bos taurus; identical to SEQ ID NO: 24619

SEQ ID NO: 64977 - DNA, 201 bp, Bos taurus; identical to SEQ ID NO: 24620

SEQ ID NO: 64978 - DNA, 201 bp, Bos taurus; identical to SEQ ID NO: 24621

SEQ ID NO: 64979 - DNA, 201 bp, Bos taurus; identical to SEQ ID NO: 24622

SEQ ID NO: 64980 - DNA, 201 bp, Bos taurus; identical to SEQ ID NO: 24623

SEQ ID NO: 64981 - DNA, 201 bp, Bos taurus; identical to SEQ ID NO: 24624

SEQ ID NO: 64982 - DNA, 201 bp, Bos taurus; identical to SEQ ID NO: 24625

SEQ ID NO: 64983 - DNA, 201 bp, Bos taurus; identical to SEQ ID NO: 24626

SEQ ID NO: 64984 - DNA, 201 bp, Bos taurus; identical to SEQ ID NO: 24627

SEQ ID NO: 64985 - DNA, 201 bp, Bos taurus; identical to SEQ ID NO: 24628

SEQ ID NO: 64986 - DNA, 201 bp, Bos taurus; identical to SEQ ID NO: 24629

SEQ ID NO: 64987 - DNA, 201 bp, Bos taurus; identical to SEQ ID NO: 24630

SEQ ID NO: 64988 - DNA, 201 bp, Bos taurus; identical to SEQ ID NO: 24631

SEQ ID NO: 64989 - DNA, 201 bp, Bos taurus; identical to SEQ ID NO: 24632

SEQ ID NO: 64990 - DNA, 201 bp, Bos taurus; identical to SEQ ID NO: 24633

SEQ ID NO: 64991 - DNA, 201 bp, Bos taurus; identical to SEQ ID NO: 24634

SEQ ID NO: 64992 - DNA, 201 bp, Bos taurus; identical to SEQ ID NO: 24635

SEQ ID NO: 64993 - DNA, 201 bp, Bos taurus; identical to SEQ ID NO: 24636

SEQ ID NO: 64994 - DNA, 201 bp, Bos taurus; identical to SEQ ID NO: 24637

SEQ ID NO: 64995 - DNA, 201 bp, Bos taurus; identical to SEQ ID NO: 24638

SEQ ID NO: 64996 - DNA, 201 bp, Bos taurus; identical to SEQ ID NO: 24639

SEQ ID NO: 64997 - DNA, 201 bp, Bos taurus; identical to SEQ ID NO: 24640

SEQ ID NO: 64998 - DNA, 201 bp, Bos taurus; identical to SEQ ID NO: 24641

SEQ ID NO: 64999 - DNA, 201 bp, Bos taurus; identical to SEQ ID NO: 24642

SEQ ID NO: 65000 - DNA, 201 bp, Bos taurus; identical to SEQ ID NO: 24643

SEQ ID NO: 65001 - DNA, 201 bp, Bos taurus; identical to SEQ ID NO: 24644

SEQ ID NO: 65002 - DNA, 201 bp, Bos taurus; identical to SEQ ID NO: 24645

SEQ ID NO: 65003 - DNA, 201 bp, Bos taurus; identical to SEQ ID NO: 24646

SEQ ID NO: 65004 - DNA, 201 bp, Bos taurus; identical to SEQ ID NO: 24647

SEQ ID NO: 65005 - DNA, 201 bp, Bos taurus; identical to SEQ ID NO: 24653

SEQ ID NO: 65006 - DNA, 201 bp, Bos taurus; identical to SEQ ID NO: 24654

SEQ ID NO: 65007 - DNA, 201 bp, Bos taurus; identical to SEQ ID NO: 24655

SEQ ID NO: 65008 - DNA, 201 bp, Bos taurus; identical to SEQ ID NO: 24657

SEQ ID NO: 65009 - DNA, 201 bp, Bos taurus; identical to SEQ ID NO: 24658

SEQ ID NO: 65010 - DNA, 201 bp, Bos taurus; identical to SEQ ID NO: 24659

SEQ ID NO: 65011 - DNA, 201 bp, Bos taurus; identical to SEQ ID NO: 24660

SEQ ID NO: 65012 - DNA, 201 bp, Bos taurus; identical to SEQ ID NO: 24662

SEQ ID NO: 65013 - DNA, 201 bp, Bos taurus; identical to SEQ ID NO: 24663

SEQ ID NO: 65014 - DNA, 201 bp, Bos taurus; identical to SEQ ID NO: 24664

SEQ ID NO: 65015 - DNA, 201 bp, Bos taurus; identical to SEQ ID NO: 24665

SEQ ID NO: 65016 - DNA, 201 bp, Bos taurus; identical to SEQ ID NO: 24666

SEQ ID NO: 65017 - DNA, 201 bp, Bos taurus; identical to SEQ ID NO: 24667

SEQ ID NO: 65018 - DNA, 201 bp, Bos taurus; identical to SEQ ID NO: 24669

SEQ ID NO: 65019 - DNA, 201 bp, Bos taurus; identical to SEQ ID NO: 24670

SEQ ID NO: 65020 - DNA, 201 bp, Bos taurus; identical to SEQ ID NO: 24672

SEQ ID NO: 65021 - DNA, 201 bp, Bos taurus; identical to SEQ ID NO: 24673

SEQ ID NO: 65022 - DNA, 201 bp, Bos taurus; identical to SEQ ID NO: 24675

SEQ ID NO: 65023 - DNA, 201 bp, Bos taurus; identical to SEQ ID NO: 24677

SEQ ID NO: 65024 - DNA, 201 bp, Bos taurus; identical to SEQ ID NO: 24678

SEQ ID NO: 65025 - DNA, 201 bp, Bos taurus; identical to SEQ ID NO: 24679

SEQ ID NO: 65026 - DNA, 201 bp, Bos taurus; identical to SEQ ID NO: 24687

SEQ ID NO: 65027 - DNA, 201 bp, Bos taurus; identical to SEQ ID NO: 24688

SEQ ID NO: 65028 - DNA, 201 bp, Bos taurus; identical to SEQ ID NO: 24694

SEQ ID NO: 65029 - DNA, 201 bp, Bos taurus; identical to SEQ ID NO: 24695

SEQ ID NO: 65030 - DNA, 201 bp, Bos taurus; identical to SEQ ID NO: 24696

SEQ ID NO: 65031 - DNA, 201 bp, Bos taurus
actgtgcatatttgaaaggaatggaattgacctaggccctgaccctgcctctgaccagagtaggagtctgtgtagccttgggagggagtggaaccagctctggggtggaggccatcaccgcaggtatgcgcatccacatgcagacctgggaacatgtggaaacagctcagtagtgtgactccagccccttcagtcctgagc

SEQ ID NO: 65032 - DNA, 201 bp, Bos taurus; identical to SEQ ID NO: 24697

SEQ ID NO: 65033 - DNA, 201 bp, Bos taurus; identical to SEQ ID NO: 24698

SEQ ID NO: 65034 - DNA, 201 bp, Bos taurus; identical to SEQ ID NO: 24700

SEQ ID NO: 65035 - DNA, 201 bp, Bos taurus
ggctctaaggacccagcatccagcaggatgtgacacactgatttctattgaggcaacgtcagaacccgctctctaaacaaactatagcaatagctctctaaagagtaccaagaaatggatgggataaggtcatgtttcaaggagcgtgtgaggcaagaaaattgatgactattttatctccttgccccaaatgtattttta

SEQ ID NO: 65036 - DNA, 201 bp, Bos taurus
gtctgtattacattgtttacatttaggtttgggtttacttttcttttccttagtcagaacttcttctaagtgtcatctgttcatctgcaggttttagacattgaatatatcgatcatctctcaagtccctttctcgatgtttcctttttaacagtactgcaatattctgcattttcccaaagttatattatctaattattt

SEQ ID NO: 65037 - DNA, 201 bp, Bos taurus; identical to SEQ ID NO: 24701

SEQ ID NO: 65038 - DNA, 201 bp, Bos taurus
tggaagttttggtgaaatatcttgttggatcttttaaagaaaataaaaaccatattatcctaatataatttatatattgatgtcctggtttgaacttacactggtgtttgttgtataatcaactctgatagatgcttaaacctttttttttttttttatttacttgattgaaacctcactgtaaaatccttatgcttattc

SEQ ID NO: 65039 - DNA, 201 bp, Bos taurus
tcaataatctttgttcactctcctttttattttagtgattttcataattttgaaatttttattatactcaaaaaatctagcttcttactagaaagaaatcgttttagagcatgaagaatacaaaaagaatccctagtccactttctcagcttttaggatggttcgatacagctttcctatctcttcctagcaggattttta

SEQ ID NO: 65040 - DNA, 201 bp, Bos taurus; identical to SEQ ID NO: 24706

SEQ ID NO: 65041 - DNA, 201 bp, Bos taurus
caagagtgaggtttttggtttccagacaacctgctccccttctacctctctggagcctactttggtttgcttaataaaacacttgctacttaaaactgctttatgtcccttgactgaatgctttcctttgggagaaaaaaggactgaggaaattgctattttgacattaacaacagtagaatgaaacagatatccaatata

SEQ ID NO: 65042 - DNA, 201 bp, Bos taurus
ctcttccaagatcttcctgttttgggtcatcttctttcctttgaaattgtataaatttcagccaccattttggataatggagtctgagcaagcaatggccgccaatcaataatagctttctgtccttcatgttattgtgggactacagactagattgtcttccctggtggctcagtggtaaagaatccacctgccaatgca

SEQ ID NO: 65043 - DNA, 201 bp, Bos taurus; identical to SEQ ID NO: 24709

SEQ ID NO: 65044 - DNA, 201 bp, Bos taurus; identical to SEQ ID NO: 24710

SEQ ID NO: 65045 - DNA, 201 bp, Bos taurus; identical to SEQ ID NO: 24711

SEQ ID NO: 65046 - DNA, 201 bp, Bos taurus; identical to SEQ ID NO: 24712

SEQ ID NO: 65047 - DNA, 201 bp, Bos taurus; identical to SEQ ID NO: 24714

SEQ ID NO: 65048 - DNA, 201 bp, Bos taurus
ctttgttggcaaagtaatgcctatggctaattcatgttgaagtttgatagtatacatttctagtgaagtcatctggacttattacatattgcttttgttgtatgcaaatgaggaggcaagatcttaaaatacaaatgcaaattctatactagatatacgtctcctcggattatctatttcaccttatggtgatttgatact

SEQ ID NO: 65049 - DNA, 201 bp, Bos taurus
cccattttaatcctactgctgtttattcttttactaatctgccatttttatatccataatctttttatgcttctttcaccccctatgaatctattatccagaaatcaagagacataaatacaaagaattttgctactttgcatgtgttgaagtttcattcaatagcattctcattttggggaagaaaaaccctgcttttcc

SEQ ID NO: 65050 - DNA, 201 bp, Bos taurus
tctagtggaagtgggactgaggttttctgactggagtggcaccgggtttgagttctatagggcttgttgttttgcaagcccagggcggcacgggtggggagatttggggggtggttgtcttctgcccagacctcagggaattgttgagttaatggtccctctcaaccgtttagcccttctggcttcccgtccaggagattg

SEQ ID NO: 65051 - DNA, 201 bp, Bos taurus
agaggacaggttgacaccatggcctgtttttccccagctgatttcctctgtgggaggtagcgttaagatatgagatggcagaggaaggagggaaggcccgtagtattgctgccacccctatcaccatccctacctcacaccagcctctcctgaggctgcatttaaaattttggccatgagttttccatggtttccactcta

SEQ ID NO: 65052 - DNA, 201 bp, Bos taurus
agagaattcatgcccccccccccttccaagactttcaagatcacatttttatttatattaaggtcacatttcttaaaaaagaacaaaatgtgagccaagtaaaggacgtctgcaggctaaaaaatattcaagtttttcccttgcaaagctagatattttgtttgatcattcagctgccacctgcatcacacccccagctct

SEQ ID NO: 65053 - DNA, 201 bp, Bos taurus
tttatttcatcttcattttaaaggatgacttcataatttacaaaattctgggtcagtggttattttctcccagcactttactctattcctttcttttcttgcttgcatggtttcagaggattagtcagatgcagtttctgttacggttcctccctagataaggtttctgtggtttttgctgagatatcctaaagcacagaa

SEQ ID NO: 65054 - DNA, 201 bp, Bos taurus
atatctgaggttattgaaatccttcaataaaaaaattaattaaaaagtaaaagaagatggataactcaaaaataaaataaaagtttttaaaaatgaaatgcagagagaaaaccaaaccactgcaccttcaccagaaaattgttatcaacagtaaatttcactcactgttaaactagattctaaccgggttctgagtcatta

SEQ ID NO: 65055 - DNA, 201 bp, Bos taurus; identical to SEQ ID NO: 24715

SEQ ID NO: 65056 - DNA, 201 bp, Bos taurus; identical to SEQ ID NO: 24716

SEQ ID NO: 65057 - DNA, 201 bp, Bos taurus; identical to SEQ ID NO: 24717

SEQ ID NO: 65058 - DNA, 201 bp, Bos taurus; identical to SEQ ID NO: 24718

SEQ ID NO: 65059 - DNA, 201 bp, Bos taurus
gggaccagaatagtagagcagtgattgcagttaggctctgagaaggggtgcattttgatctgggatttgaggacagtgaaagaaatacactggttgaaaagaaagaccctctttgagattgaaatggcatatggggagagatgacaaatgcagagaaccagtcatgtataaggaagtattttatcctctagaaatccaact

SEQ ID NO: 65060 - DNA, 201 bp, Bos taurus; identical to SEQ ID NO: 24720

SEQ ID NO: 65061 - DNA, 201 bp, Bos taurus; identical to SEQ ID NO: 24721

SEQ ID NO: 65062 - DNA, 201 bp, Bos taurus
cctgaggctgtggccttgatgagcgggggaaggaggcagaaagtctgcaggagacaaatttggacgtaggtctggggaggaggaagtcagaagcaaagacgaccataaagctgtatgatcaattgaaactgataagtttgcaaataaagatgagtgcattcactcagtttgggggcattcatgtttgcaatcaggttgtct

SEQ ID NO: 65063 - DNA, 201 bp, Bos taurus; identical to SEQ ID NO: 24722

SEQ ID NO: 65064 - DNA, 201 bp, Bos taurus; identical to SEQ ID NO: 24723

SEQ ID NO: 65065 - DNA, 201 bp, Bos taurus
gtatttgagcaaggcctccggtgactctgatgcttgttcaagcttgggaacggctgatccagaccacacgtaacgaggtattaaagagtgacagggaaacagcgaggaggggcgtggaaagtgaggccatgaggttatctggtgaagtaaagccctgggggaccatgaggagtgcaggggctgagggctgcaggaggaagg

SEQ ID NO: 65066 - DNA, 201 bp, Bos taurus
tggcactattcacattttggctcagataacgcattatctggggggagggggacctgtcctatacattataggatgtttagtagtaatcttggcctctagataccagtatctcttgtcattgtgagaatcaaaagtgtccgtagacgctgacaaatgtcttctgcagggtaaattgccctagattaagaaccactgaggaac

SEQ ID NO: 65067 - DNA, 201 bp, Bos taurus; identical to SEQ ID NO: 24724

SEQ ID NO: 65068 - DNA, 201 bp, Bos taurus; identical to SEQ ID NO: 24725

SEQ ID NO: 65069 - DNA, 201 bp, Bos taurus
aatctttgtatccatagtcatcaaaggtattttctgttttggcagtgtctttgtctggttttgatgatcagggtgatggtggctttatggaatgaatttaggaatgtttcttcctcttcaatctttttgaagtgtttgagaaggatcactgtaagctcttatttgtgtatctggcagaatttcccagtgaaaccatctggt

SEQ ID NO: 65070 - DNA, 201 bp, Bos taurus
atcttcattcccctggcctgtacctaggaacccaatcagagcctcaaagcatttggggttgactggctggagtgaaatggactgtcatcagtggagcatcttccctggaactcctggccagaggtatcccatgggcctactaggaccagacctcagaccttctgatcttaccacaatcttgccatagtcactagctgaagc

SEQ ID NO: 65071 - DNA, 201 bp, Bos taurus
cttcagggctgaaatgtaccaaatctctttaggttttaggatctttgcctgttattttcattctacctcccactcctctaagtacaactgtgccacccctttccacgtagccaaaatcattccttcttcagcactaagctcaaagattatttaagggcgatttcatgtccctgacttggtcaaccctacccctctactgcc

SEQ ID NO: 65072 - DNA, 201 bp, Bos taurus
gggccctctcagctgaaagaggccctgagggagcaaatcttaagctcaggacccacatagccataagggtccccagaaggtagattcaggcccaggtcccaagaagactcgctggggccaagtgggcagtgaagacactggccatgttcccctccagtctctgatcccctgaaggtttctcaccatccccactgattccca

SEQ ID NO: 65073 - DNA, 201 bp, Bos taurus; identical to SEQ ID NO: 24726

SEQ ID NO: 65074 - DNA, 201 bp, Bos taurus
aacaagtcatttcacttaagtatctagggtaaaagttctctttatatgaattggtaatattgatttccatcattgtcattaattacttcaatatttggatatatttacattttacactgtattttttaactacgcctttttattctcttttcctatttctttatattgatctgtttctttaatccttcttttctcttttac

SEQ ID NO: 65075 - DNA, 201 bp, Bos taurus
aacaacaatcaacaaagaagatattctacatccaaagataagaagaatccacaatgagacagcaggaagagtgcatctgcaacacaatcaaattccattccgactgaatgggcaacccacaaactggaaaatacatcacagagtttctcccacaggactgagagttctgagccccagatcaggctccccagtctgcaagcc

SEQ ID NO: 65076 - DNA, 201 bp, Bos taurus
tgataaggattttgcatctgcaaagcacatttcttatcagccccatcttggcgctcctgctctccactgcagaaccaggccacaggaacgcatctcacactacaagcagcttacctaattacattaaactgtatttcatcggttgtggagcccacgagccacccagcatcgtcagcacaggcagcgggagcaggagtacct

SEQ ID NO: 65077 - DNA, 201 bp, Bos taurus
agtgtatcaggttgtcatgtatatcccttgaggaggaaccaggaccctgcctcatggctgcactagttttcttgactgtctttcctttgtttctgttatctcttaaacgccttactcccctaactcataactgtttgaatctgcctttggaactcaaggaagctctgagaggctgaaacattcctacaaacaagaaacagg

SEQ ID NO: 65078 - DNA, 201 bp, Bos taurus; identical to SEQ ID NO: 24727

SEQ ID NO: 65079 - DNA, 201 bp, Bos taurus
atgagccaattggtcagtaagccaaatggatttgtgaacactctgtaatgttatacaaatgagtgaagttttgtgattatgatatgtaccctggaagccacgccaccattttcacattttgattagaataatgttacagtgtctaattatttttctgatgtgatagagaaagagtctcagggaatcggttttcaagattta

SEQ ID NO: 65080 - DNA, 201 bp, Bos taurus; identical to SEQ ID NO: 24728

SEQ ID NO: 65081 - DNA, 201 bp, Bos taurus; identical to SEQ ID NO: 24729

SEQ ID NO: 65082 - DNA, 201 bp, Bos taurus; identical to SEQ ID NO: 24730

SEQ ID NO: 65083 - DNA, 201 bp, Bos taurus; identical to SEQ ID NO: 24731

SEQ ID NO: 65084 - DNA, 201 bp, Bos taurus; identical to SEQ ID NO: 24732

SEQ ID NO: 65085 - DNA, 201 bp, Bos taurus
acagcaagagcagcacaatggctgtatctactggttggtgccctcggtggtgttgtttgtattggagagtctgaggttggaatgtggccgtgtcctcagcagactggtactgtggtatggggattttggctgtaatccaggttaatgcattagcttcccttgttcttgactgttttccaaacctggcctcccttgcaatta

SEQ ID NO: 65086 - DNA, 201 bp, Bos taurus
ccataggtcaaattcgtgtgtaaaaatagtcttcttataacttaccaggggcctagtacacagggtggaaggaggaagattttcctgggcaaaagggaggtgggagagtgcagagtgcatgaaggccacctgaataagcactaacatagtatgcatgggaaccttggaacaggctagaaaagagtccttaatggggagctt

SEQ ID NO: 65087 - DNA, 201 bp, Bos taurus
gaagggcctgcaaaataacaactgtccatcaagacagagggaaaggaagatgaaggagttccagagcaaatgtcagactggacactgggtaggtcaggagcagtgtctggaaagtcagggcctgaacctcagggcaaaggcttaaggtaaccataggcagggatgctctaagctgagagtccacatgctagtcagagggtg

SEQ ID NO: 65088 - DNA, 201 bp, Bos taurus
ttccatcacctccactagctttgttcatagtgatgctttctaaggcccacttgacttcacattccaggatgtctggctctaggtcagtgatcacaccatcatgattatctaggtacttaaaaggccaggaacacaagatggtgtccattattccaataaatgcccttagcttctctatgacatgaactaaaataatcttag

SEQ ID NO: 65089 - DNA, 201 bp, Bos taurus; identical to SEQ ID NO: 24733

SEQ ID NO: 65090 - DNA, 201 bp, Bos taurus; identical to SEQ ID NO: 24734

SEQ ID NO: 65091 - DNA, 201 bp, Bos taurus
tgacaaaaaggtgcagttaattcttcaaaaagctaaaaaaataaaaaaaacttctcaataattttgcaaattggtcattcagcaaataggcctctttccacagtagggcagatactttgataagtataccatgaagtgtatcagttcagttcagttgctcagtcgtggccaactctttgcgaccccatgggctgcagcacg

SEQ ID NO: 65092 - DNA, 201 bp, Bos taurus; identical to SEQ ID NO: 24735

SEQ ID NO: 65093 - DNA, 201 bp, Bos taurus; identical to SEQ ID NO: 24736

SEQ ID NO: 65094 - DNA, 201 bp, Bos taurus; identical to SEQ ID NO: 24737

SEQ ID NO: 65095 - DNA, 201 bp, Bos taurus; identical to SEQ ID NO: 24738

SEQ ID NO: 65096 - DNA, 201 bp, Bos taurus
gggtgatctgaacagttcagtgagcaatgaactatttcttgtcttccctacacacctgaaccactaacttgtggagacataccccaaagacggtggccctgcaaggcaaaaaggaaattatttctacccctgccccttgcatctacatcctattatcacaaggtttcgaccactggacgagctaaagcttcccattatcgt

SEQ ID NO: 65097 - DNA, 201 bp, Bos taurus
tgaattattttcttctaatattaataactaatttatgggtagtgtggttaaagtaattttaaactttgttttctggattgctggatcctttttaattagcgtgtgttatttttacaaaagcaatagagcggtttttctataaaacaaacaaaaaagctaatttgctaagatgttaacagtaattgattctgggtgcagata

SEQ ID NO: 65098 - DNA, 201 bp, Bos taurus; identical to SEQ ID NO: 24739

SEQ ID NO: 65099 - DNA, 201 bp, Bos taurus; identical to SEQ ID NO: 24740

SEQ ID NO: 65100 - DNA, 201 bp, Bos taurus
acacctggccaggtggggaaacagtcccacctactgtcaggcataatgcccaaagacgagcccacagccaccccagaatactacactgtccaccagagggtgcagcacctggccccacacaccagggcaccagcactaatcccaggacccccagggccctgcaagcagagacctaggacccagctctgcctaccagtgttc

SEQ ID NO: 65101 - DNA, 201 bp, Bos taurus
actgacagaggggctgggtaacctgacccttgtctgtgggacccgctacctttcccctccaccagaaggatcaccccaagatcaggacagacgggagaatattcaacagcaaaggtaataggaaaagacagtgttacttcagttctgaaaagacagtttagttggagatccttcagtcacagtatacattataaaaagaac

SEQ ID NO: 65102 - DNA, 201 bp, Bos taurus
gcggacttcagctgggtgcgttgtccttccctctaaaatttccctgtaccaggacaacaggtttccatatgctaattcggatgttccactgtccgtggaacataggcctgtcagagaagagcagccctaagcctgctttgttttcattttctcctggtgtttcccctctggtctgtgaataagcctaagcattcaggacct

SEQ ID NO: 65103 - DNA, 201 bp, Bos taurus
ctgggaggggaaaggggtatgtcatccaaacagcccggagggcactgtctgagctggtgattagagacacaaaaacaagggtctccagactgtctggcctattttgggtaggggttgggaaaacggcttttggatgcagagatgcctaaagccctggtctgcccactgaaattggcctctgattctgagggatcgagaatg

SEQ ID NO: 65104 - DNA, 201 bp, Bos taurus
gcacttagataaaatctacactctttattttagtccacaaaacctctggccaagccccaatcacctctcccaccccatccgtggccattctcccttctgctaactctctttcagttacagtagtctctttccctgcctcacactccccaagctgttccaacctcaagacttttgtactagctgtttcctttgcctagaatg

SEQ ID NO: 65105 - DNA, 201 bp, Bos taurus; identical to SEQ ID NO: 24741

SEQ ID NO: 65106 - DNA, 201 bp, Bos taurus; identical to SEQ ID NO: 24742

SEQ ID NO: 65107 - DNA, 201 bp, Bos taurus; identical to SEQ ID NO: 24743

SEQ ID NO: 65108 - DNA, 201 bp, Bos taurus; identical to SEQ ID NO: 24744

SEQ ID NO: 65109 - DNA, 201 bp, Bos taurus; identical to SEQ ID NO: 24745

SEQ ID NO: 65110 - DNA, 201 bp, Bos taurus; identical to SEQ ID NO: 24746

SEQ ID NO: 65111 - DNA, 201 bp, Bos taurus
gttgaggagggaggatgatgtggcctttaatcaaagggcggaatgaggctggtgaatgtggtgggtggtcgtagggaggcaggccctccagggtgctcagaatggctttgagcacatttcttctcctcagacttctgtttccacctcttctggaagatgcagacagaactctgagcctccagttccaacctgggagtgcct

SEQ ID NO: 65112 - DNA, 201 bp, Bos taurus; identical to SEQ ID NO: 24747

SEQ ID NO: 65113 - DNA, 201 bp, Bos taurus; identical to SEQ ID NO: 24748

SEQ ID NO: 65114 - DNA, 201 bp, Bos taurus; identical to SEQ ID NO: 24749

SEQ ID NO: 65115 - DNA, 201 bp, Bos taurus
gtggggcaggaggtggcgctcccatgccctctccaagtgtaccatctccgatacctccatgggttccccagcccagaagctctctgaatccctgtacttctggaatcttatggaggcctcatcacttaggtgtgtgtgtttgtattagccactcagtcatgtccaactctctgtgacctcatggactgtagccctccaggc

SEQ ID NO: 65116 - DNA, 201 bp, Bos taurus; identical to SEQ ID NO: 24750

SEQ ID NO: 65117 - DNA, 201 bp, Bos taurus; identical to SEQ ID NO: 24751

SEQ ID NO: 65118 - DNA, 201 bp, Bos taurus
ttatatcaatggatgcagaaaagcattttataaaattcaacattcatttatgataaaaactctcaatagagtgggcaaggagggaacatacctcagcatagtataggccatatgagacaaacccatgcagatgtaggagacatgagttctatccccgggtcaggaagactccctggagcaggaaatggcacccaactccaa

SEQ ID NO: 65119 - DNA, 201 bp, Bos taurus
ttgcagggatgtgtcttctgtccccaccatctgcagtccaggcttgggaatgaacaagacgcatggtggggatgggccagggctgggacctgacttgagaggcttaggagaatgccagggcaggaggctgggctactggagagagtcgtttccaaattgttcatcctgaatctcagatgagaggatggaggccagtgtaga

SEQ ID NO: 65120 - DNA, 201 bp, Bos taurus
acaatgaagactttttaaaactgttcattgtatgcagttttaaaggttactttccatgtgtagttattacaagatattggcagccttccccacgccatactgtatatccttgagcccttcttacagccagtagcttgtacctcccacccctacagttaagaatttaactgttctttcagattttttctgtctatataaaca

SEQ ID NO: 65121 - DNA, 201 bp, Bos taurus
acggtcctgcaagggaacggggagtgccatgcgggaaactgaggcccagacagtcaaaagacttgtccaaggtcagagcaaggactgagagcatctgagccctgaggggaccactctggctcaggccctgctgggaggcactgtgccacctgctcccaagcttcgggaaagaggtgagcttctggccttctgctcaggagg

SEQ ID NO: 65122 - DNA, 201 bp, Bos taurus
agaagggaaggggggatacaggaaggaccagctccatgttccctgaagttgctaaccaggaggctcaccgcttggccagttctggcctcctggctttgtccggtggcttgagaagacggagggagagtactgattacttggaagggtttgtgtcttagggggctggggtcacaggagtccatcatctcttacagacagagg

SEQ ID NO: 65123 - DNA, 201 bp, Bos taurus; identical to SEQ ID NO: 24755

SEQ ID NO: 65124 - DNA, 201 bp, Bos taurus; identical to SEQ ID NO: 24756

SEQ ID NO: 65125 - DNA, 201 bp, Bos taurus
ctcattaatacctgtccaaattattttctgcctcacaaattattttttattagcatgtctgccacaaaactcatcagttgagtctctatcattgtacttttcatttctggaaattctatttgtttctatttcaaatatattctttgttgccttttatcattttttgtttcctgaggatattttacagtttaccttttttcc

SEQ ID NO: 65126 - DNA, 201 bp, Bos taurus
caattaactctctcctcatctgattccagaatatctttctcctgccattttcccaccatactcccctccaccaggccacacactagcctccaactcattcccacctctgtgctcacaggtgacccctgctaagaaagaatctaggctttagaagccgacttggattggtggggccctagcacagaacagggtgcactggaa

SEQ ID NO: 65127 - DNA, 201 bp, Bos taurus
tattagttcttagagctcagggactattgaagaatatgtcctaatttcatcctcaaaatatttgaagtcagtgatgaattgaatcaaaccaaaaccacaacgaagacccgatccagttcaactgcagatctggtggtctgacataaaacagggtatgcctttccctgaagtcaaacattatttgtcaagtttctgctttgt

SEQ ID NO: 65128 - DNA, 201 bp, Bos taurus
actctaggctctcctcctacctgcccttctaaagctctttctgtaactaagcaggagtctaggagccttcctgggacagactcctcccctaaaacctcttccgtagctcctccctgatgcacatttcctaagttgtttcacagaggctaaaaacctcaactagatggaagaaatgaactacttgatgaccttgagctggaa

SEQ ID NO: 65129 - DNA, 201 bp, Bos taurus; identical to SEQ ID NO: 24757

SEQ ID NO: 65130 - DNA, 201 bp, Bos taurus; identical to SEQ ID NO: 24758

SEQ ID NO: 65131 - DNA, 201 bp, Bos taurus; identical to SEQ ID NO: 24759

SEQ ID NO: 65132 - DNA, 201 bp, Bos taurus; identical to SEQ ID NO: 24760

SEQ ID NO: 65133 - DNA, 201 bp, Bos taurus; identical to SEQ ID NO: 24761

SEQ ID NO: 65134 - DNA, 201 bp, Bos taurus; identical to SEQ ID NO: 24762

SEQ ID NO: 65135 - DNA, 201 bp, Bos taurus
tacaaatctgacaacaaaagaatttcacaacagataggtggctgaagcatgaggtaccaacataagcccaagtatttcatggccacttgggagtcccgaaagacagtatttaatgtccttaaagaaaaaatagcttttctattctaggcaagttgatctgaaggcccagcatcagtaagactgaagccagtgaacaattta

SEQ ID NO: 65136 - DNA, 201 bp, Bos taurus; identical to SEQ ID NO: 24763

SEQ ID NO: 65137 - DNA, 201 bp, Bos taurus; identical to SEQ ID NO: 24764

SEQ ID NO: 65138 - DNA, 201 bp, Bos taurus
atgaaggcgagagaagggggcaggcaggcttcatttctcagttctttttcctaggcaaaaagggaattaagagtcagtctacgcgggcctgggggaatcagcactcaggattcagagagccggcagacacagagggtcaactttctagtgcgggagcaggagagtgatctggccgcgaggctgggaagggcagcgggttgc

SEQ ID NO: 65139 - DNA, 201 bp, Bos taurus; identical to SEQ ID NO: 24766

SEQ ID NO: 65140 - DNA, 201 bp, Bos taurus; identical to SEQ ID NO: 24767

SEQ ID NO: 65141 - DNA, 201 bp, Bos taurus; identical to SEQ ID NO: 24768

SEQ ID NO: 65142 - DNA, 201 bp, Bos taurus
aacagaaaggcgggacatgctctatcatcttggaaatggcacagtcgtggtcattgtttttgccaggacaggctagattttgctgcagagacaaaaacctccaagtgccatcatttaaaacaaccacagtctgttcctcactcacactgcatgtccattgagggttgcctgggagacctgggctgtcagcacctacctggc

SEQ ID NO: 65143 - DNA, 201 bp, Bos taurus
atggtggggagacatatatctcaattcattctcactcagggacccaggctgacagcatctccagcatctcaaatgtatcagtcacaacagcagaaaggaaacacagtgaagtacatatcatctcttaaggcctctgtccaaagacaatcttctactcacattttgttttcaaaagcaaatcacactgcaatgcctaacttc

SEQ ID NO: 65144 - DNA, 201 bp, Bos taurus
tatggttctggcccaggactcacccggaccttgatggttcgagggaagtcctctcacagagttcttactacctgctccccactacctaccagaggtaaaatggccctttagcagcctttctccatcctaaggacaccacataccctgccctgcctcctccatctcacgctggccagtcaaaaatgttctttcttcacctgt

SEQ ID NO: 65145 - DNA, 201 bp, Bos taurus; identical to SEQ ID NO: 24769

SEQ ID NO: 65146 - DNA, 201 bp, Bos taurus; identical to SEQ ID NO: 24770

SEQ ID NO: 65147 - DNA, 201 bp, Bos taurus; identical to SEQ ID NO: 24771

SEQ ID NO: 65148 - DNA, 201 bp, Bos taurus; identical to SEQ ID NO: 24772

SEQ ID NO: 65149 - DNA, 201 bp, Bos taurus
ctgctcagggcctttcctggggcatgagagcatgagttccccgtctcctctgagttcaggagggagcagcaggagcctgagtccctgggggccttgcgtgccctgtccaccttcctggtatagttagaaccactggtttcagagcaggacaagcctccccatctgagcacgcactcacccacttcagttatcaccactgca

SEQ ID NO: 65150 - DNA, 201 bp, Bos taurus
agtccatctctcgccccagacaggccccccagcttcacctgtcatacttccagacacaaaaggttcacaccattgcatctttgacccaccgtcaccttcagtctctgggcctggctccccggcccactgcagcccccagcccccaacccagaggtcggacttgggttccctcttcaccgatctccctgctcgcaactggct

SEQ ID NO: 65151 - DNA, 201 bp, Bos taurus
gacccaagccctgtctccaccgatcttgcagttctggctgctccagcaacccaggcatggagggcatcatggagaaaggaagccacagcacaggagcgagcgttagaggggccagggctgctggtcggctgcctagaggagagggctcaggtgggcaggacatctgcatactagtggtcagtgtgcccatgtagaagagga

SEQ ID NO: 65152 - DNA, 201 bp, Bos taurus; identical to SEQ ID NO: 24774

SEQ ID NO: 65153 - DNA, 201 bp, Bos taurus
catgataatccaaatgaggtagttattatttttatccccaacatgcaaaatgaagaaacagcctcagagagattaacttgctcaaggccacacaactggtaagtggaataagcagactacagaccgagctctgctttccaccactctgtgacggtgcctctccaagggaacaacgccgtcagggccagccctccttaaagc

SEQ ID NO: 65154 - DNA, 201 bp, Bos taurus
gctttacatgctgatacattctctgtttgatacacctgagttgtgtctatgagcatatctcttaggccaggtacataactcatcttcaagacatggggctcccaaaaaattctctgggaattcttagagacagtgtctaactccactcaaaattttttacccacaatttaaacttcaaccaaggttattttcttaccattc

SEQ ID NO: 65155 - DNA, 201 bp, Bos taurus; identical to SEQ ID NO: 24775

SEQ ID NO: 65156 - DNA, 201 bp, Bos taurus; identical to SEQ ID NO: 24776

SEQ ID NO: 65157 - DNA, 201 bp, Bos taurus; identical to SEQ ID NO: 24777

SEQ ID NO: 65158 - DNA, 201 bp, Bos taurus; identical to SEQ ID NO: 24779

SEQ ID NO: 65159 - DNA, 201 bp, Bos taurus
cctggacttctctttttttgtgggagatatgaggaccattaaatgagggatctctgaagacaaagcctaatgagttcactacccagctcacagtaggtacctgaaagatgtgtaatgaatacacaaggaaggcacacagccagaagggattcatgggtgctgattttcccatgttcccagctccatggcacccgagtatgg

SEQ ID NO: 65160 - DNA, 201 bp, Bos taurus; identical to SEQ ID NO: 24780

SEQ ID NO: 65161 - DNA, 201 bp, Bos taurus; identical to SEQ ID NO: 24781

SEQ ID NO: 65162 - DNA, 201 bp, Bos taurus; identical to SEQ ID NO: 24782

SEQ ID NO: 65163 - DNA, 201 bp, Bos taurus; identical to SEQ ID NO: 24784

SEQ ID NO: 65164 - DNA, 201 bp, Bos taurus; identical to SEQ ID NO: 24785

SEQ ID NO: 65165 - DNA, 201 bp, Bos taurus
agggtatgagaagaacatggagggtgggcagaggccaggccttgtagggcccggtgggtgtggagggcttagtatgaaggaccctggtctttatccttaatagttgaagggtctcagcaggggccagtgtgaccatagttgaggctttgtagagatggctggctgctgccaagtgtctaacagaacaaacagaggccctgg

SEQ ID NO: 65166 - DNA, 201 bp, Bos taurus; identical to SEQ ID NO: 24788

SEQ ID NO: 65167 - DNA, 201 bp, Bos taurus; identical to SEQ ID NO: 24789

SEQ ID NO: 65168 - DNA, 201 bp, Bos taurus; identical to SEQ ID NO: 24790

SEQ ID NO: 65169 - DNA, 201 bp, Bos taurus
atttatatgaccctgacttatatttgtttacccatttctctctcccactggccaatgaactctacggaaatatggattctttgtttgtaatggccagaacctagtacagtgtccagtgtagagtaaaaatttcctggaattttctctcttccttccttcctcattgacctccagcactggcaatttggccatgccttctat

SEQ ID NO: 65170 - DNA, 201 bp, Bos taurus; identical to SEQ ID NO: 24793

SEQ ID NO: 65171 - DNA, 201 bp, Bos taurus; identical to SEQ ID NO: 24794

SEQ ID NO: 65172 - DNA, 201 bp, Bos taurus; identical to SEQ ID NO: 24795

SEQ ID NO: 65173 - DNA, 201 bp, Bos taurus; identical to SEQ ID NO: 24796

SEQ ID NO: 65174 - DNA, 201 bp, Bos taurus; identical to SEQ ID NO: 24797

SEQ ID NO: 65175 - DNA, 201 bp, Bos taurus; identical to SEQ ID NO: 24799

SEQ ID NO: 65176 - DNA, 201 bp, Bos taurus
tcttcaaagtattttttccgatttgcaactcaaatggaatgagtagtcatttaaggggaattaaattgtgacttaacattggccttataatcaagatgggcagacattctttggacaggaaaccatggcagagaatggttattttctggagcgcagggcagctccagagctcaggagggcctgggcttcccacacagggaa

SEQ ID NO: 65177 - DNA, 201 bp, Bos taurus
gagaattacatgggcagaggagcctggcatgctgcagtccatggggccacaaagagtcagacacgactgagcgactgagcacacacaaacgatagctatcatttatgaagtacttagagtgtgggcctgggtcagagctgtagggagtcagtagataccactgtttcttgctattcaggaccacttgtgagacagactcag

SEQ ID NO: 65178 - DNA, 201 bp, Bos taurus; identical to SEQ ID NO: 24811

SEQ ID NO: 65179 - DNA, 201 bp, Bos taurus; identical to SEQ ID NO: 24812

SEQ ID NO: 65180 - DNA, 201 bp, Bos taurus; identical to SEQ ID NO: 24813

SEQ ID NO: 65181 - DNA, 201 bp, Bos taurus; identical to SEQ ID NO: 24814

SEQ ID NO: 65182 - DNA, 201 bp, Bos taurus; identical to SEQ ID NO: 24815

SEQ ID NO: 65183 - DNA, 201 bp, Bos taurus; identical to SEQ ID NO: 24816

SEQ ID NO: 65184 - DNA, 201 bp, Bos taurus; identical to SEQ ID NO: 24817

SEQ ID NO: 65185 - DNA, 201 bp, Bos taurus
aaaaatcagctttcttctcttttgctcaagaggaaaatgaaatagctggtactcatggaatgagaagtattttgaatttggtggtatacagaggacactattattttgagaattaagtcaccaaattatcttaaactgcttccaattcaaaacttccatttcttaagaggaaagccaaggaaatcagatctaggaatgtac

SEQ ID NO: 65186 - DNA, 201 bp, Bos taurus; identical to SEQ ID NO: 24818

SEQ ID NO: 65187 - DNA, 201 bp, Bos taurus
gcagatgctcttagaaaaaatcttgagatcaagactgtcctcatcattggtctattctttgatgaatagaggagaaatttagcaggagaaataagaacattgtgatctcagcaatatataatataatctatgccaatttttttttgtccaattgttctcagaacaaattaaaggttttgttttatttttaggattttaaat

SEQ ID NO: 65188 - DNA, 201 bp, Bos taurus; identical to SEQ ID NO: 24819

SEQ ID NO: 65189 - DNA, 201 bp, Bos taurus
tcctttcactgctcttggttaccttgctttttcctgaacaattggcttccagtaatacactttggggataccgaaagtcaagcctcaccagggccctggtggtcactcagcatctgaaccccaaagtccagcatcagccttgtagggttgagacgtgccctgcaaagaccatgctggcccctgaagcagtgctctgtctac

SEQ ID NO: 65190 - DNA, 201 bp, Bos taurus
caaacgtgcatacagcaactatggactatactgtccttgcaaattggtcacaactagaaaatgagtatgtagttagaggcagtgctactgtcctgtgccccgatgtggatctcaaaccattagtcctctctgaaaaatactatttttgccctcactctactagatcaacactgaggagcattctaccaagatgtcagctgg

SEQ ID NO: 65191 - DNA, 201 bp, Bos taurus; identical to SEQ ID NO: 24824

SEQ ID NO: 65192 - DNA, 201 bp, Bos taurus; identical to SEQ ID NO: 24825

SEQ ID NO: 65193 - DNA, 201 bp, Bos taurus; identical to SEQ ID NO: 24827

SEQ ID NO: 65194 - DNA, 201 bp, Bos taurus
caagcaaataggacaaactgctgacataagcgtggcactgacgtatctgtctatttgccttcagttgctaggattcactgtgtccatttttctctaagctgtaaaacatgcaactctttgatgttatgaagagtccatggttaaacaaaaagttggcagaacatttaacataaaaagtatttcaaattcaaatctctaatt

SEQ ID NO: 65195 - DNA, 201 bp, Bos taurus; identical to SEQ ID NO: 24830

SEQ ID NO: 65196 - DNA, 201 bp, Bos taurus
atttatagctagtagttggggaactgagtgtaaatctggggatgcctttggcattgtatatctgaacaatgtcatcatttgtttccagaaaaaaaaaagttaagcattctactacttgtctacaagatagggtacatatttttcagttttacttatcctatcaacctcattctctgccctccttgcttttcatccacttat

SEQ ID NO: 65197 - DNA, 201 bp, Bos taurus
ctttgctaaaatagcaataagactgactttcacccacggacgctcaatgcctccagaagaactggctgctcattttctgagctctgggcctgttgacaactctctactgaaacaaattgaaatttctatcatcaattcacttcgaaatgtcataaagccgcttaggcctcggctggctgagcagtaaagcaggccctcttg

SEQ ID NO: 65198 - DNA, 201 bp, Bos taurus; identical to SEQ ID NO: 24840

SEQ ID NO: 65199 - DNA, 201 bp, Bos taurus; identical to SEQ ID NO: 24841

SEQ ID NO: 65200 - DNA, 201 bp, Bos taurus
tttcatctggacagtgtgtcttatctcaattaaagtcaaagttctgatgttagatttcatttttctgctcccctcactccatgacattagctttgttcttccacatattaatctggtccttcggactttcctatacaggtaggttttgcttaccttgaccttcatacactacggagtgttctcttggaacctataggaagc

SEQ ID NO: 65201 - DNA, 201 bp, Bos taurus; identical to SEQ ID NO: 24843

SEQ ID NO: 65202 - DNA, 201 bp, Bos taurus
cccgaaggggatagttactacctgatagccgggtacaggcccagctcttagaggcactagagacgtgggactggggaaacctgagactccaggagacctgaacagaaggaggccggtcaaaagggccccaaatcttcctgcagagacagagctacacatagcgcccgccacccgcccccaacacacccccaacacacacac

SEQ ID NO: 65203 - DNA, 201 bp, Bos taurus
tgattaaagtgttttcaaagtaaccagctttttttctgtagagatttgtggtttgagataagaagagtacttagctatttcggtagtcaaatctctttggacttaagcaatgtttttttttccctaggaatatttcttgattcagagcggaggaagtctgatgccagctccgtcatgtctcccctgaaaatctccctcatt

SEQ ID NO: 65204 - DNA, 201 bp, Bos taurus
ctttgagctggtcttcatgcaggcctctcatctggaagtgggaccatggaccctatctctctgctctgagcccttgaagcaacatcttctgatgtctcataatcttacggccaagtcgactatagcccaagtcagacttggtgtcactctgcgccctctaatcatcagatgcatttagcaatctttgagaatgcagattct

SEQ ID NO: 65205 - DNA, 201 bp, Bos taurus
agaaggtttttaaaaaaacaaaaaactagagacacaacagcatgtctgttgtgctgatgtgaaagactagcagagagagaaaaatcgtaatgtaggaaagaaagggcagaatgacgggaataacgcccttgatttgctgagagaagagggagctggtgagcaaagtggagggaggagccttggctggatgctctgagggtt

SEQ ID NO: 65206 - DNA, 201 bp, Bos taurus
gagaaattagtgttggcagtcactaattagtgtcactagctggtgtggctaatttgtgtcaaggtgggaagtgctcacttaaagctgtttgcagcagtccttcctttctggcagctctctcagagtgaggacctcatgttccgctctacctcgtctgtcttttgtgcctagtggagcccctattcttcagtgaggatactc

SEQ ID NO: 65207 - DNA, 201 bp, Bos taurus
ttcctcacacacgctgagagatcttccctgcctcaggacctttgtacttgctctttgttctgcctggtgggattttccttctcatcctgcaggtctcagcccctcagagaaggcctaccctgactgcctgatctaaaccagctccaaaacaggaggtaggtttctgtctacttcctgttttgtttccttcaaaggtcttat

SEQ ID NO: 65208 - DNA, 201 bp, Bos taurus; identical to SEQ ID NO: 24850

SEQ ID NO: 65209 - DNA, 201 bp, Bos taurus
aagcgaatcaccacctgctcacccatcagcaggctctgacatagagtggttggtcattctttattttttcattcttttctcctcactctcaggcctgacagttacattcttggtgatgtctgtttcacaggcagaatcttcccagccccgagtattcaaataccagcatagctttcaagtaagcccgctgtttgtctgagg

SEQ ID NO: 65210 - DNA, 201 bp, Bos taurus
gctaaaagaatgtgatgggggagcacagcccaggggtcatcatcagtacttggtggtgatcaagtactacatcctcagtacttcagctgagggctgggtcgtgcctgttcttcttgttgttccctcattactctgtacatgtacagtgtgtgcactgtgtggcatacatgtgtattataaaaatgaaaccttggtaaatct

SEQ ID NO: 65211 - DNA, 201 bp, Bos taurus; identical to SEQ ID NO: 24851

SEQ ID NO: 65212 - DNA, 201 bp, Bos taurus
tgattaggaaccagatcttttgactgcagagccaaaatcatttcccttcatactacatctaaactgtctttctgccatgagtctggaatgagaccatcttaatgaaaccttttccatgctcctaatagaaagtttctcacaatggagtttctagagcattttgtatctctcatagctcatgtcacattctaccctcactgt

SEQ ID NO: 65213 - DNA, 201 bp, Bos taurus; identical to SEQ ID NO: 24852

SEQ ID NO: 65214 - DNA, 201 bp, Bos taurus
aaaggagccagatcacatgggtctgggaattccctggtggtccagtggttaggactcttatgtgttcactgctgagggcccagggttctgtccttggtcggagaactaagatcctgcaagctgtgcatggaccaaccaaaaaagaaaaaagattatatcatgggcctggtaaggattttcaactgtaaaaggaagccagga

SEQ ID NO: 65215 - DNA, 201 bp, Bos taurus; identical to SEQ ID NO: 24853

SEQ ID NO: 65216 - DNA, 201 bp, Bos taurus
cctgaactccttttagggagtgttaaagttcagcagctgcagtggctctaattggatctttgtagaggtagaacgcaagtgccaatttataggtgacagtatattgtattgctttttaactttatcggtctatgctctctcttctccaaactttattgtatcaaagaatatcctatagtaatcttttctctacagctattc

SEQ ID NO: 65217 - DNA, 201 bp, Bos taurus; identical to SEQ ID NO: 24856

SEQ ID NO: 65218 - DNA, 201 bp, Bos taurus; identical to SEQ ID NO: 24859

SEQ ID NO: 65219 - DNA, 201 bp, Bos taurus
tggtacaggctggccactgcgctgctctctccagtcctggacctagggctcataggtgcttcctacgccttcatcctccacatggtctgtcacctgcccttccacagcacccggcacaaggccctgggcacctgcggggcccatgccagtgtcatcaccctcttctacacacccgctctcttcttcctggctcacagtttt

SEQ ID NO: 65220 - DNA, 201 bp, Bos taurus; identical to SEQ ID NO: 24860

SEQ ID NO: 65221 - DNA, 201 bp, Bos taurus; identical to SEQ ID NO: 24862

SEQ ID NO: 65222 - DNA, 201 bp, Bos taurus; identical to SEQ ID NO: 24865

SEQ ID NO: 65223 - DNA, 201 bp, Bos taurus
tcacaggtttggtattgacatgacaatcaaaaaaaaaacaaacaaacaagtcttaaataagaaagtgctttgaaaagtgtgaagcaccaattaatctgacaggtcattataatatgattatcacaagctagctggagagaagattaatgtccatgaaacaattagaaggtgaaacagtatagttaattaggcaccaaatga

SEQ ID NO: 65224 - DNA, 201 bp, Bos taurus
tggcttctccaaggggaaatttgcaaccccaggggagggtgagtgggtcgggagtttgtgagcttattaaaactgtatctgagaattaaggtcatttaatggagtgaaaccgtactttttgttttcccacgtgtcccacataaagttagacgagaaacagggtgaggtttctggattacttattttagccataaggacctt

SEQ ID NO: 65225 - DNA, 201 bp, Bos taurus; identical to SEQ ID NO: 24866

SEQ ID NO: 65226 - DNA, 201 bp, Bos taurus
caagtccccggggtgagtttaactttcttggcccttctcagacacagcaggtggcaggcacatctcttaaatcctggattctggacccccaggtccttggccactctgaaagaggaaccctgccactccaaaagctcatgctgccagaaagctcttccctgagctgctgactgatgggagcatccaaaacacagagctagg

SEQ ID NO: 65227 - DNA, 201 bp, Bos taurus
caggtctggtccttcacacctgctccgtggatcaccagccctggtctctccaccccttgaagccacatgtgtgaccctgacttctgtagctctgttgttgctccagccagtgctgggtgtacctactcttccctggaaagcaccctctcctctctgtagggccagtgctctagcttgtgctccaagcgtgtctgagaggtt

SEQ ID NO: 65228 - DNA, 201 bp, Bos taurus; identical to SEQ ID NO: 24868

SEQ ID NO: 65229 - DNA, 201 bp, Bos taurus; identical to SEQ ID NO: 24869

SEQ ID NO: 65230 - DNA, 201 bp, Bos taurus
aaacatgatctccaataaaactaggaaacatgaaatgtaagtggaagagaggcctgaggagagacaattaaattggagaaagagggtaaaatataaggcacgaggttacaaaactcaaaaagatgtggggagtacatttcttcaactgcacttactgaggtataaaatttaaaccacattcccaacaacaagaacaaggga

SEQ ID NO: 65231 - DNA, 201 bp, Bos taurus
gtcttttgagcatctttccatgtgcttatttccatcatataccttcttggtggaatatctgttcatatctattgtccatttttgattgggtggtttgtttccttattactgagttttcacagtaattttgttttttgctttggccttttatagttgttctggatagaactccttctatggatactgattttgatagcttct

SEQ ID NO: 65232 - DNA, 201 bp, Bos taurus
gggggtggggaatgaaaaccctaagggaaccatggacaggcccaggccccatctctggatcctggtcagactgcctggcccctttttgtggacattgagctttgctgttcagtgggcaggtcaccctccttgagggtgggttcccgaccctgttgccttatactattttcagcccaagtaagagcaggattttccactcct

SEQ ID NO: 65233 - DNA, 201 bp, Bos taurus
ggcttacacacccactgtgttccctgcagagtgaggaacctaaaaaccctgaaccttggactaatttggtcactgccggttctcagtgctctcacggcccactctgaactctctctctttgtttctccctcctgtctctagttttttctagtcctggctctggtgtctctcacagaggctgcagtcagtgggcagggagag

SEQ ID NO: 65234 - DNA, 201 bp, Bos taurus; identical to SEQ ID NO: 24871

SEQ ID NO: 65235 - DNA, 201 bp, Bos taurus; identical to SEQ ID NO: 24872

SEQ ID NO: 65236 - DNA, 201 bp, Bos taurus
ctgggctaccataaggatcaaatgaggactattccttattgcactcaactctaatctaatgattaaccttgtctttctggaacacacagaaaactaggaaataagtttaaagaaagcctctttagaaccaaaataactgcctctcattcttcacactttattactgataccagtagagttcctggagcctcaatcttcctt

SEQ ID NO: 65237 - DNA, 201 bp, Bos taurus; identical to SEQ ID NO: 24876

SEQ ID NO: 65238 - DNA, 201 bp, Bos taurus; identical to SEQ ID NO: 24877

SEQ ID NO: 65239 - DNA, 201 bp, Bos taurus; identical to SEQ ID NO: 24878

SEQ ID NO: 65240 - DNA, 201 bp, Bos taurus; identical to SEQ ID NO: 24879

SEQ ID NO: 65241 - DNA, 201 bp, Bos taurus; identical to SEQ ID NO: 24880

SEQ ID NO: 65242 - DNA, 201 bp, Bos taurus; identical to SEQ ID NO: 24881

SEQ ID NO: 65243 - DNA, 201 bp, Bos taurus; identical to SEQ ID NO: 24882

SEQ ID NO: 65244 - DNA, 201 bp, Bos taurus; identical to SEQ ID NO: 24883

SEQ ID NO: 65245 - DNA, 201 bp, Bos taurus; identical to SEQ ID NO: 24884

SEQ ID NO: 65246 - DNA, 201 bp, Bos taurus; identical to SEQ ID NO: 24885

SEQ ID NO: 65247 - DNA, 201 bp, Bos taurus; identical to SEQ ID NO: 24886

SEQ ID NO: 65248 - DNA, 201 bp, Bos taurus; identical to SEQ ID NO: 24887

SEQ ID NO: 65249 - DNA, 201 bp, Bos taurus; identical to SEQ ID NO: 24888

SEQ ID NO: 65250 - DNA, 201 bp, Bos taurus; identical to SEQ ID NO: 24889

SEQ ID NO: 65251 - DNA, 201 bp, Bos taurus; identical to SEQ ID NO: 24890

SEQ ID NO: 65252 - DNA, 201 bp, Bos taurus; identical to SEQ ID NO: 24891

SEQ ID NO: 65253 - DNA, 201 bp, Bos taurus; identical to SEQ ID NO: 24892

SEQ ID NO: 65254 - DNA, 201 bp, Bos taurus; identical to SEQ ID NO: 24893

SEQ ID NO: 65255 - DNA, 201 bp, Bos taurus
catattttgcttcagagtttagagatgccaaccataattaaacccagatgcacacatccagtcgctgcttactgtaaaaggggaaaagctctaggcccaactttaaattttctcaaactgcccaattttttaatgtcaaagaagaaaataaaaaccctcatccttaatatttatccgagaatgaacaacattgaggaagaa

SEQ ID NO: 65256 - DNA, 201 bp, Bos taurus; identical to SEQ ID NO: 24897

SEQ ID NO: 65257 - DNA, 201 bp, Bos taurus; identical to SEQ ID NO: 24898

SEQ ID NO: 65258 - DNA, 201 bp, Bos taurus
cagtctcaaaaggcttgttcttttcctttaagtctctgcagccctttggaattcatctctcatcacagagaagtttcagtgcctttagattagggatctatacccacaaatgatgatccactggactctgatccttggccttggagaagagccaacagagctggttacaaattcattgttaattactgtgtgtaatcacag

SEQ ID NO: 65259 - DNA, 201 bp, Bos taurus
ataatgtgcatatacatatctacacaacctctttcatgtagttttagaaattcattggatccactgaagtctaataagggcccaccaaaaccaaataataatttctattgtaagtggttgcttatgacatatagatacatattttcactttgaatgttatatatctggtttgtctctaagctcttctgctactgctactac

SEQ ID NO: 65260 - DNA, 201 bp, Bos taurus; identical to SEQ ID NO: 24900

SEQ ID NO: 65261 - DNA, 201 bp, Bos taurus; identical to SEQ ID NO: 24901

SEQ ID NO: 65262 - DNA, 201 bp, Bos taurus
cccaaagtaaaacatgttatggtaaaaatgtaagagtttaatctggcattgcctctttgtatcagcataattgcttcccttacagaaaaacccagtaagaataagctcttggcgtcctttctggcctcaaaactttcagtgatctcttttgtctccttttgaggtccctatcctgtttttccatcttgctgacacctccta

SEQ ID NO: 65263 - DNA, 201 bp, Bos taurus; identical to SEQ ID NO: 24903

SEQ ID NO: 65264 - DNA, 201 bp, Bos taurus; identical to SEQ ID NO: 24906

SEQ ID NO: 65265 - DNA, 201 bp, Bos taurus; identical to SEQ ID NO: 24908

SEQ ID NO: 65266 - DNA, 201 bp, Bos taurus
ctagttacatacaaaattcatgtagaatcacaattagtcacatggtagtcaaagatttcatacatcactgaaatttctggaatcatatatccattttctgggtccaatgaatgcctgcctcatcttcattatgtcaataccatttaccattaatatgagcctaaaatacatatgtgcctcagaatgacccacttcaaacat

SEQ ID NO: 65267 - DNA, 201 bp, Bos taurus; identical to SEQ ID NO: 24909

SEQ ID NO: 65268 - DNA, 201 bp, Bos taurus; identical to SEQ ID NO: 24910

SEQ ID NO: 65269 - DNA, 201 bp, Bos taurus; identical to SEQ ID NO: 24911

SEQ ID NO: 65270 - DNA, 201 bp, Bos taurus; identical to SEQ ID NO: 24913

SEQ ID NO: 65271 - DNA, 201 bp, Bos taurus; identical to SEQ ID NO: 24914

SEQ ID NO: 65272 - DNA, 201 bp, Bos taurus
gtcataatttcccttaagaggttttgctgataattgcttaagacatcagatttcctagttgttttctattttaaataggccacaatgaaaaagtaattcaggacccaaaggaccgaatgaaaggtagaaaattctaggcacagggatagcacttggtgcctcccatcatgctggcaaactaccaggccagtgctctattgg

SEQ ID NO: 65273 - DNA, 201 bp, Bos taurus
tactctttgcgactccatggactgtagcccaccaggctcctcagtccatggaattctccaggcaagagtactggagtgggttgccatttccttctccatgtaactgctaggaagaagcaaaaatagtctacagggaggagacaaagggaggcaggacaagggtagaaacaagctgcatcatctctttccagtcataaatat

SEQ ID NO: 65274 - DNA, 201 bp, Bos taurus; identical to SEQ ID NO: 24916

SEQ ID NO: 65275 - DNA, 201 bp, Bos taurus; identical to SEQ ID NO: 24917

SEQ ID NO: 65276 - DNA, 201 bp, Bos taurus; identical to SEQ ID NO: 24918

SEQ ID NO: 65277 - DNA, 201 bp, Bos taurus; identical to SEQ ID NO: 24919

SEQ ID NO: 65278 - DNA, 201 bp, Bos taurus
tttgagaatctgctatatgaggaggcactggtgatgcagaaatgaataagacattatttctattttaaggagctcactatttaataattaaagggatttgtccaatctgtattacagggtaaattcagttgagtaaatccagttggctaaatatgaatttcaaaattgatcagaagtagaaaagacctctgtcaaagactt

SEQ ID NO: 65279 - DNA, 201 bp, Bos taurus
taaaaggaaacatatgttttattatgctcttttagattggatatgaatatgtatggttaccataaccatgggccaagaagaaaactggttatggtagatacaacattctgatactctctaactcaaaggacatggtattattcagaaccatatataaatatcaaaagcaaaatgtacttatttctagatacccttttcaaa

SEQ ID NO: 65280 - DNA, 201 bp, Bos taurus; identical to SEQ ID NO: 24921

SEQ ID NO: 65281 - DNA, 201 bp, Bos taurus; identical to SEQ ID NO: 24922

SEQ ID NO: 65282 - DNA, 201 bp, Bos taurus
gggaatgaggaccagcagctcagccccctcttcttgctgcccctgtacttccctgactcctgaggaccctcctggagcccttgggcaacagttcttagcccaggtccctagacttgctaaagcaatatgaaaatagctgtgtattggcttttggagggcaagactcctaactctcagattttctactgatcttccaaaaat

SEQ ID NO: 65283 - DNA, 201 bp, Bos taurus; identical to SEQ ID NO: 24925

SEQ ID NO: 65284 - DNA, 201 bp, Bos taurus
cacttaaattggagcactgaacatttagatgcataccgaattatgcatgggccctaatcacacagacaaggctggtgccagccttaggcttgacacggcagtgttcaccctctggccagacgactgtggttcaagacacatgtaaattgctttttaacagctgatactgtataagacaaagccaaaatgcaaaattaggct

SEQ ID NO: 65285 - DNA, 201 bp, Bos taurus
cttctttaaaatgactccctgatcagagaatttacgtttatttagaaagcgactctatctaccttcgatggaaaatcaacatcactggccacagatacacgttacctgttacttaagtgttagtccctcagtcgtgtccgactctgcgaccccatggactatggcccaccaggctcctctgttcatgaaattcttcaggca

SEQ ID NO: 65286 - DNA, 201 bp, Bos taurus; identical to SEQ ID NO: 24928

SEQ ID NO: 65287 - DNA, 201 bp, Bos taurus; identical to SEQ ID NO: 24929

SEQ ID NO: 65288 - DNA, 201 bp, Bos taurus
ccaatcttccctttgagcttgccaataattcctcttctcgtttatgtctttcaccatccttctacccggataactgaaactgaagtggcctctgtgaaacagaattagtgtggaagggacaaaaaggtaaagggttgtttcagtgcttcaccccacgcacttcactcaccttacggtcacaatctggcctccgtctaggac

SEQ ID NO: 65289 - DNA, 201 bp, Bos taurus; identical to SEQ ID NO: 24931

SEQ ID NO: 65290 - DNA, 201 bp, Bos taurus; identical to SEQ ID NO: 24932

SEQ ID NO: 65291 - DNA, 201 bp, Bos taurus
gatgcaattaactgaacataaaatgataagcccaaagccagaagataggcagaccactggctggcctctccacccatcctgagtcttgtctttgttgctgctgtgtaaagatgtgattccagggcatttatgggctggcattcgattatagcttgacatgaacaactctgcgtctgggttagaaataatcgctttgcattt

SEQ ID NO: 65292 - DNA, 201 bp, Bos taurus
atgcaagtaaggtatcattattatgcccttctacagatagggatgctatctgtagagggtttgagaggaggtcctctcacttacccaagtccagaaaaccgggaagagttggctttcagtaaggacccccaattctgtggatcgttaaggtctccatgaaaacctcaggccagctgcatccctgctgaagcacccaggatg

SEQ ID NO: 65293 - DNA, 201 bp, Bos taurus; identical to SEQ ID NO: 24933

SEQ ID NO: 65294 - DNA, 201 bp, Bos taurus; identical to SEQ ID NO: 24934

SEQ ID NO: 65295 - DNA, 201 bp, Bos taurus
gtaaaaataataaaatggcaaagttagaattcaccccaaggcagcaaacagcagaagtgatgctgtggaaaaccgggttattgactcagttggtaaaattgaaaagtgctcctacaatgtggaaatcaatgaaagacaatataatagctttggtagatagaagacaaagatgctttaataactaactggtgttccacatat

SEQ ID NO: 65296 - DNA, 201 bp, Bos taurus; identical to SEQ ID NO: 24937

SEQ ID NO: 65297 - DNA, 201 bp, Bos taurus; identical to SEQ ID NO: 24939

SEQ ID NO: 65298 - DNA, 201 bp, Bos taurus; identical to SEQ ID NO: 24940

SEQ ID NO: 65299 - DNA, 201 bp, Bos taurus; identical to SEQ ID NO: 24942

SEQ ID NO: 65300 - DNA, 201 bp, Bos taurus
atggacatgagtttgagcaagctctagagttggtaatgaacagggaagcctggtgtgctgcagtccatgaagtagcaaagagttggacataactgagcgagtgaactgaactgatgcttatatatcatagaattagatgcaaaccttgcaaatccttgaggcttctttcaggatgcatgatggaagtttaaagtaagaaag

SEQ ID NO: 65301 - DNA, 201 bp, Bos taurus; identical to SEQ ID NO: 24943

SEQ ID NO: 65302 - DNA, 201 bp, Bos taurus
ctatagaaattatttagtatgtcaatctttgccatttaagagctgatcaggatatcctagtgaatgaaatgaagctgtctctcctgtttgtcccacataaacaaacacttcatggaaactttggagactggcactggaaaagaaatttggatgattatcccatgcttctcatagttaaagattgtttactatgaaaaaact

SEQ ID NO: 65303 - DNA, 201 bp, Bos taurus; identical to SEQ ID NO: 24944

SEQ ID NO: 65304 - DNA, 201 bp, Bos taurus
ttagtttctagacatgaacatggatctgtatatgatatggacttagaattatatgtgaaggatcaattatagctactaatgggaattgctaactttgtattagtaaggatgctgaccgcacctctgcaatgagaggtccccaaacagcatcttatataatacacacatgttttattttacatgctcactcaaggctgttat

SEQ ID NO: 65305 - DNA, 201 bp, Bos taurus; identical to SEQ ID NO: 24946

SEQ ID NO: 65306 - DNA, 201 bp, Bos taurus; identical to SEQ ID NO: 24947

SEQ ID NO: 65307 - DNA, 201 bp, Bos taurus; identical to SEQ ID NO: 24948

SEQ ID NO: 65308 - DNA, 201 bp, Bos taurus; identical to SEQ ID NO: 24949

SEQ ID NO: 65309 - DNA, 201 bp, Bos taurus; identical to SEQ ID NO: 24950

SEQ ID NO: 65310 - DNA, 201 bp, Bos taurus; identical to SEQ ID NO: 24951

SEQ ID NO: 65311 - DNA, 201 bp, Bos taurus; identical to SEQ ID NO: 24952

SEQ ID NO: 65312 - DNA, 201 bp, Bos taurus
ctcctttccttcccaactcctagttttcaggtaaggtgtcctgatcatttttcttcacatatccccttcatcttatccatatgattaaaaagggaacagttgtattttttctggctggactctgactcctggatgcgatttatagacaacagacagacaatagacactccagactggattaatcgaaagtcatccctgaaa

SEQ ID NO: 65313 - DNA, 201 bp, Bos taurus
gtgtaaattaaggtgttaattaatttatctgtttattcagtcatatgattgtacatgaactatttgcatattttatcttaagccatagtatcttctttgaaggagtttatagtgtaattagggggataaattaaacaaataaattacatataaagtgaggatatatgagccatataagataagtaaagtaaaagggctata

SEQ ID NO: 65314 - DNA, 201 bp, Bos taurus; identical to SEQ ID NO: 24953

SEQ ID NO: 65315 - DNA, 201 bp, Bos taurus
acacacatatagtacattagaagtacaggtatttgtcagaagaatattcagccagaggggacaaccagtgccaaggccttaggacaaaagcatgactgatctgagaacagcaaaatagccagcgtgtctgaagcagagtgaaggagaaggaaggtagcaggacgtgaggtcagactggccaggagtgtcttgaggttagat

SEQ ID NO: 65316 - DNA, 201 bp, Bos taurus
tccttgcatggatactccttagtcttctttcatctcctcactgtaagccccaagagggcaagaatcttttctgcttttgcccaccattgtgtcctttaacccttaaagttaacagtgcgtgtcattcaacagttgagatatctatgaatgtgttcagtaaaaaggatgaatgaatgaaagaaggtcaaggttgaatgttgg

SEQ ID NO: 65317 - DNA, 201 bp, Bos taurus; identical to SEQ ID NO: 24954

SEQ ID NO: 65318 - DNA, 201 bp, Bos taurus; identical to SEQ ID NO: 24955

SEQ ID NO: 65319 - DNA, 201 bp, Bos taurus
gtctccctagggcccagagtatgcaagcccactcgatgcttccagctcagggatgtgggccaacaccattcttgcactggggagcagggcccccagatatattcaggcatccttttcattcctgggatcccgggactcaatggtgtgtctccacatctctgtcccagtatctggcttcatggtgccacgcccaggccacct

SEQ ID NO: 65320 - DNA, 201 bp, Bos taurus
agtaaaaagaggtcagcgggcctgacatccgctctccacgtcactcaagggcctcgttcgtgagactgtctcctcgttttttggtccaggggtggaagggaagagtctttcacagccccggttgctcgtgtcactcctttcagaagaagtcgaaaaccctctgttctcgaggtcaacaggtgtttgtcttcctgtgatata

SEQ ID NO: 65321 - DNA, 201 bp, Bos taurus; identical to SEQ ID NO: 24956

SEQ ID NO: 65322 - DNA, 201 bp, Bos taurus
gggccaatattctggtttctctttagattgtataaatctttcaccttcttaaaacatgtggactttacaatcatttcaaagttttctatgagatggaaagtaagggaggaagggcccttgaacatttaatgttaatcatatacttcataccatatataaattaatgttcagagtttgttgtgcctctcaaggcctgcacaa

SEQ ID NO: 65323 - DNA, 201 bp, Bos taurus; identical to SEQ ID NO: 24957

SEQ ID NO: 65324 - DNA, 201 bp, Bos taurus
aaagcagacctaatgaggctcacagagcctgatgactcgtccaaggtcgcataatgggcaagttgtgtaaacaagcaggaacccgggtcttctacccacaaagtgtcttgactggcttatgcagtattatgggagccattgagcctcctccaggctgaaacatttccactcttctgagcatatggtacaagcttgagacaa

SEQ ID NO: 65325 - DNA, 201 bp, Bos taurus; identical to SEQ ID NO: 24959

SEQ ID NO: 65326 - DNA, 201 bp, Bos taurus; identical to SEQ ID NO: 24960

SEQ ID NO: 65327 - DNA, 201 bp, Bos taurus; identical to SEQ ID NO: 24961

SEQ ID NO: 65328 - DNA, 201 bp, Bos taurus; identical to SEQ ID NO: 24962

SEQ ID NO: 65329 - DNA, 201 bp, Bos taurus; identical to SEQ ID NO: 24963

SEQ ID NO: 65330 - DNA, 201 bp, Bos taurus; identical to SEQ ID NO: 24964

SEQ ID NO: 65331 - DNA, 201 bp, Bos taurus; identical to SEQ ID NO: 24965

SEQ ID NO: 65332 - DNA, 201 bp, Bos taurus; identical to SEQ ID NO: 24966

SEQ ID NO: 65333 - DNA, 201 bp, Bos taurus; identical to SEQ ID NO: 24967

SEQ ID NO: 65334 - DNA, 201 bp, Bos taurus; identical to SEQ ID NO: 24969

SEQ ID NO: 65335 - DNA, 201 bp, Bos taurus; identical to SEQ ID NO: 24970

SEQ ID NO: 65336 - DNA, 201 bp, Bos taurus; identical to SEQ ID NO: 24971

SEQ ID NO: 65337 - DNA, 201 bp, Bos taurus; identical to SEQ ID NO: 24972

SEQ ID NO: 65338 - DNA, 201 bp, Bos taurus; identical to SEQ ID NO: 24974

SEQ ID NO: 65339 - DNA, 201 bp, Bos taurus; identical to SEQ ID NO: 24975

SEQ ID NO: 65340 - DNA, 201 bp, Bos taurus; identical to SEQ ID NO: 24977

SEQ ID NO: 65341 - DNA, 201 bp, Bos taurus
cagggggcagcttggtgagaagatgtaaaggggtatcggctgctgaccctcacccggccatcagccacggcggccaaccctggcctgcgcagagaagactacaggaaaccagagacaggctcagccagcgctccacccgtcctcactaagcaccaccccccacacaagggagagccagggtaggggccgggctgccccggt

SEQ ID NO: 65342 - DNA, 201 bp, Bos taurus; identical to SEQ ID NO: 24979

SEQ ID NO: 65343 - DNA, 201 bp, Bos taurus; identical to SEQ ID NO: 24980

SEQ ID NO: 65344 - DNA, 201 bp, Bos taurus
cgattgcttctccgggccaggcatgcgtcctgcttctcttttccccaaggtttctccagggttaaagatgaaaggggaaccttgatgaagctcctgaccctgggaggtggccacaatgggccttgtctttcccttggtgaataggctcccgtgtacccttgctgggtaaagtgtgtggtgtggggagccctgtgttcacag

SEQ ID NO: 65345 - DNA, 201 bp, Bos taurus; identical to SEQ ID NO: 24983

SEQ ID NO: 65346 - DNA, 201 bp, Bos taurus
agctcctcctaaaataggatttgctttcatatttgtttaacatttcattatgcttatttttacaggatactttgtttcaaagcaaaacccagaggtgcttggaggtaaatacaatcttgattctcaaattggagtttaaaagttatctcagtaggtatttctttcactggcaataagtaaaaacattaaacttacatagat

SEQ ID NO: 65347 - DNA, 201 bp, Bos taurus; identical to SEQ ID NO: 24984

SEQ ID NO: 65348 - DNA, 201 bp, Bos taurus; identical to SEQ ID NO: 24985

SEQ ID NO: 65349 - DNA, 201 bp, Bos taurus
tactcagacacgggcatttcaatattcgcttacacaataagaggccagccacaagcatccgtttctgcaaaaattccctggtcgttaaaaatctgtggccagactatctgacagtgatctttttattttcacaaaatcacacttctttttatgcaattgagtttcatatgtttcggtatcgcctctttaaaaagtctgtaa

SEQ ID NO: 65350 - DNA, 201 bp, Bos taurus; identical to SEQ ID NO: 24986

SEQ ID NO: 65351 - DNA, 201 bp, Bos taurus
gaaactctggaagagggccacagggtgaacccagagtaacgttcttcccttccgaggtgaggaaggtttttgcagccctgagttgtccttcacgcctgtagacgggagtggtgcccctggccgcggccaccctaccgtgtgatctatgatctcccctccgtttctgtcgtcctttcagccctcacagatggaccctcacct

SEQ ID NO: 65352 - DNA, 201 bp, Bos taurus
ctcaagtattctggcctggagaatcccgtgcacagaggagcctggcaggctacagtccacggggtcgcagtgtcagacatgactgaacagctaacacttttactttcaagggccaccaaattcaactcaactccttttattttatgccagaggcaattcagcattaaagagataaaaatcctgttctcccagcaatcccac

SEQ ID NO: 65353 - DNA, 201 bp, Bos taurus; identical to SEQ ID NO: 24987

SEQ ID NO: 65354 - DNA, 201 bp, Bos taurus
tcctcttgagatgacgggggaatcttgtggtttttttcgagctgtggggcgacgtgtgttgtttccctcaagttatgacggggtattcagggagcctctcgtatggccccagggaagtccagtctccattcaagttacgagggggagcacggcattgctctcgagtcacggcatgggaatcgggcctcaagacacgttgaa

SEQ ID NO: 65355 - DNA, 201 bp, Bos taurus
atcttgcgatgacaggggaatcttgtagtttttttcgagctgtggcgagatgtgtggggtttctcacgagttacgacaggaaaatcagggagcctttcgtgtggccacagggaagaccagtctccattagagttgcgagtgggagcgtggcattgctttcaaatcacggcaggggaattgggtctcataacgagttgaagg

SEQ ID NO: 65356 - DNA, 201 bp, Bos taurus; identical to SEQ ID NO: 24991

SEQ ID NO: 65357 - DNA, 201 bp, Bos taurus
ccagttctttttccctttttcaagtctttatgaatttgtaacaatagtgcttctgttcagtgttttggccatttggcccctgcagcatgtgggaacttagtgccctgaccagggtctgagcccgcatcccctgcacaggaagatgaagtcccaagcaccggcccgcagggaggcctctaggcccaggccttatctccagcg

SEQ ID NO: 65358 - DNA, 201 bp, Bos taurus
atagaaggcgccctcgggccatagaagaaagcctaactctctgatgctggcctttttttctccttacaatgctgaacggagatgaacgcatcggggcctcatgtctagatatgaattttcctttgtgcagcgctagtcatgatgggaattccatagcaatttatcaccgtaatgactacagattctagagcatcagggtga

SEQ ID NO: 65359 - DNA, 201 bp, Bos taurus; identical to SEQ ID NO: 24992

SEQ ID NO: 65360 - DNA, 201 bp, Bos taurus; identical to SEQ ID NO: 24993

SEQ ID NO: 65361 - DNA, 201 bp, Bos taurus
gaggggtggggtgagtgccttttgtgtgtgggagggatgtgaacactagtggccagagggcagaggtagccagcctccacgatggcccccagtgatcctggtttcctggtggtcacacctttgtgtagtttcttgcacactgcaccactagcataaaagtgatggcatgccacttccgagatagcttatcaaagactatgg

SEQ ID NO: 65362 - DNA, 201 bp, Bos taurus; identical to SEQ ID NO: 24994

SEQ ID NO: 65363 - DNA, 201 bp, Bos taurus; identical to SEQ ID NO: 24995

SEQ ID NO: 65364 - DNA, 201 bp, Bos taurus; identical to SEQ ID NO: 24997

SEQ ID NO: 65365 - DNA, 201 bp, Bos taurus; identical to SEQ ID NO: 24999

SEQ ID NO: 65366 - DNA, 201 bp, Bos taurus; identical to SEQ ID NO: 25000

SEQ ID NO: 65367 - DNA, 201 bp, Bos taurus; identical to SEQ ID NO: 25001

SEQ ID NO: 65368 - DNA, 201 bp, Bos taurus; identical to SEQ ID NO: 25002

SEQ ID NO: 65369 - DNA, 201 bp, Bos taurus
tgcaagtatgctctctgctaacaaaatagtaaacgcctgaaagattgtgaccataccttatattcttttgccattccctcattagttcaaatttggatgtggaacttactgactaaaaagttgggtcatgtggaattttcactaaacatgaaaatctataaattgatagtaaaattaacacagagaaatcttaaaacacta

SEQ ID NO: 65370 - DNA, 201 bp, Bos taurus
tgtttcggttctgttgtccagagctgttatctgttggaggactccctgcccattttgtaagcacacagctggcaggccctgttgcaatctcgctgccttccgatcagccctgccccggcagcaggcaggcagggggtgggggtggggggcctgggaaacacgcggccaaacagttgtggtgagtgtcaaaataaaagcccc

SEQ ID NO: 65371 - DNA, 201 bp, Bos taurus; identical to SEQ ID NO: 25005

SEQ ID NO: 65372 - DNA, 201 bp, Bos taurus; identical to SEQ ID NO: 25006

SEQ ID NO: 65373 - DNA, 201 bp, Bos taurus; identical to SEQ ID NO: 25010

SEQ ID NO: 65374 - DNA, 201 bp, Bos taurus; identical to SEQ ID NO: 25011

SEQ ID NO: 65375 - DNA, 201 bp, Bos taurus; identical to SEQ ID NO: 25012

SEQ ID NO: 65376 - DNA, 201 bp, Bos taurus; identical to SEQ ID NO: 25013

SEQ ID NO: 65377 - DNA, 201 bp, Bos taurus; identical to SEQ ID NO: 25014

SEQ ID NO: 65378 - DNA, 201 bp, Bos taurus
cagcccaagagagcaagtgaaccccaatgagatttggcctttgccccctcatgtccaaggcaggaacagtggaccaaagtggcaactctaaacattgggaacaactacaacctggaataaggccagatctgacactgaagtcaccctacacggcccacagcaggtccagagacctttctagaaacattagaggcctttggt

SEQ ID NO: 65379 - DNA, 201 bp, Bos taurus
caggctgtcacagcaatagaaatttatttttacagttctgaagcctggaagtcctagatttaggtctgatagcattcagtcacatggccttccctctgcatatgcatgaggttgagagagagtgagctctgtgatgtctcttcttataagaactctaatgctagtgaatcagggcccctcctttatcacttaatttagcct

SEQ ID NO: 65380 - DNA, 201 bp, Bos taurus
agtgggtagcctttcccttctccaggggatcttcgcaacccagggatctaacccaggtcttctgcattgcaggcagattctttaccagctgaaccacaagtgaagaccctgaggcctgttactgagtcctatttgagccttaattcttggtagatcatacagggatcttgtctccagagagaagggcagtctggggtcttt

SEQ ID NO: 65381 - DNA, 201 bp, Bos taurus
aaaaaatggccacagatgcttcctgtccttgtatctacatctttaagaatccctccaatttgaggtagaagctttcttcatcctttgagtttgggctactttgtcatttgctttggccaatgggacaaaagtaacaaatatgatataagcagaaccttgcaaatcactttgtgcattagggttccccttgttgctgctctt

SEQ ID NO: 65382 - DNA, 201 bp, Bos taurus; identical to SEQ ID NO: 25015

SEQ ID NO: 65383 - DNA, 201 bp, Bos taurus; identical to SEQ ID NO: 25016

SEQ ID NO: 65384 - DNA, 201 bp, Bos taurus
ccattccaagtaattaacatgatttccttaatccttctatcctaccatcactccatcattctcaaacacatcaccacttcctcaaaatcagactgaaaacaagctgacaaactagccaatatattggagcttcacttaagttattctcttccacctacccaacaaattgctattctctgtgatccttccctgtagttaata

SEQ ID NO: 65385 - DNA, 201 bp, Bos taurus; identical to SEQ ID NO: 25021

SEQ ID NO: 65386 - DNA, 201 bp, Bos taurus; identical to SEQ ID NO: 25022

SEQ ID NO: 65387 - DNA, 201 bp, Bos taurus; identical to SEQ ID NO: 25023

SEQ ID NO: 65388 - DNA, 201 bp, Bos taurus; identical to SEQ ID NO: 25024

SEQ ID NO: 65389 - DNA, 201 bp, Bos taurus; identical to SEQ ID NO: 25025

SEQ ID NO: 65390 - DNA, 201 bp, Bos taurus; identical to SEQ ID NO: 25026

SEQ ID NO: 65391 - DNA, 201 bp, Bos taurus; identical to SEQ ID NO: 25027

SEQ ID NO: 65392 - DNA, 201 bp, Bos taurus
ttgaaaatcctcaagtagaagctaagcaacaaacttcaggagaggtaatagcagaggagacagcatgggtgtgaatagggccatatgactcacacttctctcaaaaaaagcaatactctgattttatcagtcctcaaagattctcctatgggccaataccattgttatcttactggtattttttccctaaaaatttattcc

SEQ ID NO: 65393 - DNA, 201 bp, Bos taurus
gagaatatttcaggttagacttttactctctgtggccataaattccccccaaattgatagaccagcttcttggcttctgggcagttctgcaaacaggcaaccataggcaaatgctgtacagacataaagcctgaaaaccctggtcttttactcactggacttagtattatggtcaccaccaccatcgccagcatgtaactg

SEQ ID NO: 65394 - DNA, 201 bp, Bos taurus
tacagatagacattcaaggaattttagatccaaatgtgccatgtttatagtctaaattgtgagagttggaaagatggttttattttaggaactagtgagagattgcttaaaaagcctcaatttgctttggagaacattgattgataagaattttgatgtgggtcttctttgtaacagagagacactgctgttagttaagca

SEQ ID NO: 65395 - DNA, 201 bp, Bos taurus
ctacaaataatatgcaccagaatcactggggagcttgccaagaataagtggtatctcttcacaaaaggaaactttgttatagaaagcatgtcatgtgatacatgaatctgtaccttttaaaaatacataagtatttttagggtgagtgattctagaaccacattttgaaaacaacttcttaaaaccattttcttattctga

SEQ ID NO: 65396 - DNA, 201 bp, Bos taurus; identical to SEQ ID NO: 25028

SEQ ID NO: 65397 - DNA, 201 bp, Bos taurus; identical to SEQ ID NO: 25029

SEQ ID NO: 65398 - DNA, 201 bp, Bos taurus; identical to SEQ ID NO: 25030

SEQ ID NO: 65399 - DNA, 201 bp, Bos taurus; identical to SEQ ID NO: 25031

SEQ ID NO: 65400 - DNA, 201 bp, Bos taurus; identical to SEQ ID NO: 25032

SEQ ID NO: 65401 - DNA, 201 bp, Bos taurus
aacactgctggcttattgaaatagcgggtggtatttttttgtccacaatattctttctatattccagatatttctagactgttattgcatttttaacatatacataagtcctacaaatttttaatcactttctcatgtaaatctcagttagctttttatttaaattttattgtgtacaggaatatgcttgagataatgtat

SEQ ID NO: 65402 - DNA, 201 bp, Bos taurus; identical to SEQ ID NO: 25033

SEQ ID NO: 65403 - DNA, 201 bp, Bos taurus; identical to SEQ ID NO: 25034

SEQ ID NO: 65404 - DNA, 201 bp, Bos taurus
agttaccaccactgttcactgtagttgatacattattctggatcccagaatgagagctttaatgagtagaactcccaggcctgctcatctatgcatatggaatgggcaggaagtaaattgtggtggttgttttaaatttgtcaagacagcataggctctattttgaattataaaccaaacttgaaaaattggccttcagtt

SEQ ID NO: 65405 - DNA, 201 bp, Bos taurus; identical to SEQ ID NO: 25036

SEQ ID NO: 65406 - DNA, 201 bp, Bos taurus; identical to SEQ ID NO: 25037

SEQ ID NO: 65407 - DNA, 201 bp, Bos taurus; identical to SEQ ID NO: 25038

SEQ ID NO: 65408 - DNA, 201 bp, Bos taurus; identical to SEQ ID NO: 25042

SEQ ID NO: 65409 - DNA, 201 bp, Bos taurus; identical to SEQ ID NO: 25043

SEQ ID NO: 65410 - DNA, 201 bp, Bos taurus
aaaaccaccttccttaagtattccattcttaactcctcctatatgtcaggtgggggagattttgactccatatggctcatctgggccagtcatggcactgtggaaaatttatttcaggtctcaatttaatgagagtctttcactttgaagtgccatcttttcccctaaattattgtgcagagagcatgtcctaggggtcat

SEQ ID NO: 65411 - DNA, 201 bp, Bos taurus
ctaattctggatgctctgttttgttccattgatacgtatgtctgtctttacacctatactacactggcttgatttataatgagttcagatcagctgggtagatgttttccaaatctgtttttcttaagagttgtcttgactattcttgttctttgcatttctgtgtgcgtgtgtgtgtgtgtgtgtgtgtattagtatcag

SEQ ID NO: 65412 - DNA, 201 bp, Bos taurus; identical to SEQ ID NO: 25044

SEQ ID NO: 65413 - DNA, 201 bp, Bos taurus
gattactgcctgtagtcctgatccatggagattgggagagaatgaatatattttttaagctgctaaattttcaacaatcaaacaataatcaaatgacaaaccaggctgactttacctactaaaaattcccagattcatgaaaaagagtaaataaagatttcaagcttatggattggacagtattttaagaacccacggctt

SEQ ID NO: 65414 - DNA, 201 bp, Bos taurus; identical to SEQ ID NO: 25046

SEQ ID NO: 65415 - DNA, 201 bp, Bos taurus; identical to SEQ ID NO: 25047

SEQ ID NO: 65416 - DNA, 201 bp, Bos taurus; identical to SEQ ID NO: 25049

SEQ ID NO: 65417 - DNA, 201 bp, Bos taurus; identical to SEQ ID NO: 25050

SEQ ID NO: 65418 - DNA, 201 bp, Bos taurus; identical to SEQ ID NO: 25054

SEQ ID NO: 65419 - DNA, 201 bp, Bos taurus; identical to SEQ ID NO: 25056

SEQ ID NO: 65420 - DNA, 201 bp, Bos taurus
ttattagctgaagacacaactacatctctgataaactaagaaggcaaaaagaagataaattccaagtttctaaattgacaaaagaagaaacttgtcaggtgtaagatatagaatatacatagcttatgaaacagatttgtcaaaaatacagaactaaaagatacaattgccttaaagaaaggagaaaattatttgtgctta

SEQ ID NO: 65421 - DNA, 201 bp, Bos taurus
cccatggactgcagcctaccaggctccttcatccatgagatttttccaggcaagagtactggagtgggttgccattgtcttctccatgagcagaacatagacagcattaaatataggagaaaaatccataagtttaagaactatgaccaggaaagtcttttggatgtggtaactttcacacacaattgcttgaaaacaaga

SEQ ID NO: 65422 - DNA, 201 bp, Bos taurus; identical to SEQ ID NO: 25057

SEQ ID NO: 65423 - DNA, 201 bp, Bos taurus; identical to SEQ ID NO: 25058

SEQ ID NO: 65424 - DNA, 201 bp, Bos taurus; identical to SEQ ID NO: 25059

SEQ ID NO: 65425 - DNA, 201 bp, Bos taurus; identical to SEQ ID NO: 25060

SEQ ID NO: 65426 - DNA, 201 bp, Bos taurus; identical to SEQ ID NO: 25061

SEQ ID NO: 65427 - DNA, 201 bp, Bos taurus
agaaatccacttcctctcaccacccatactgctgttctcctgatccaagccacctgatatcttatgtggattttgcacagtctctcaaatggccttctgactgtgtcttgtctcctggagtcaacgccccaacctaacacccagagtcactttgttaaaaagcaagtgagctcacaggattcttttggtaattttccttca

SEQ ID NO: 65428 - DNA, 201 bp, Bos taurus
gaatcccatggacagaggagcctggcagactttagtcaaaggggtcacaaagagtccaacacaacttagcaactaaacaacagcagcaacaagaagttaggagacagttttcattctgtctgtgcctcttagtagctttgtgattataggccagctacctaacatttaactttctcagtttcatcttctgtaacatcagaa

SEQ ID NO: 65429 - DNA, 201 bp, Bos taurus
tagcaagccagaaggtgtgatgaatatccctgtttcattttgtttcctctttattcctgctctgagaatgattccagataaggagctgaatgatggcagttgtggccaaataagaataaaatatgctaagaaaaatctagctttctggccagagaaaccagaaaagtgccccttgtggcccaaagaatgtatggcacaaaa

SEQ ID NO: 65430 - DNA, 201 bp, Bos taurus
taaatgggcttcatgttcatcctggctctacaagaattttgatagcctggtgagaatcatttcaactgagttgtgaagtcattatggacccagtggatggcgagtaggtttaattttgtgccctctaaagacatgctcaagtcgtagccctcataccagtgaatgtgaccatgtttggaaatagagccttggcagatatga

SEQ ID NO: 65431 - DNA, 201 bp, Bos taurus
atacataagcacccatctattttgatataatcactccatatagcctgttttataaatagagaatggaaagaatggggatgctcctgaagattcatggaagccagtatagcatagccaagaagcccttggctaatcagcccctgtcctacccaactttatcttgcttggcagaagtagggcacaacaggagctctgttggct

SEQ ID NO: 65432 - DNA, 201 bp, Bos taurus
aactccgggaactggtgatggacagggaggcctggcgtgcggcagtccatggggtcgcagagtcgcatatgactgagagactgaatgacccttgtgctgacagaaagaacactggccataccgtatcatggagagtaacaagagcttctcatcttccaagaatgttatacatatcatgatttagtatgtgtacaaagtaaa

SEQ ID NO: 65433 - DNA, 201 bp, Bos taurus; identical to SEQ ID NO: 25063

SEQ ID NO: 65434 - DNA, 201 bp, Bos taurus
tctactctaatggaatgatgaaaggatgaaacaagataattaatgtaaaacacttagaataatgtgtggcgaattttaagaattgaatatattattattacgaaaaattaacaaacatttcatatattactggtataaaggcattgcattcaattggagagggtgaaaccagctgtttacattgtccacataacgtaatta

SEQ ID NO: 65435 - DNA, 201 bp, Bos taurus
ctagactcttcttgggagtcctggcaggacaaagcaagaaaggttaaagacctatgccgaattagaatgataacttctttgtaaagaatgaataaatgcacttcccagagaaccccactcattaccaaaagctgccttctctgagtcagtatgaccccttaagccaaaaagaaacattttctagtcttctgacttggcatc

SEQ ID NO: 65436 - DNA, 201 bp, Bos taurus; identical to SEQ ID NO: 25065

SEQ ID NO: 65437 - DNA, 201 bp, Bos taurus
ctaatggaaaaaccctggggacaaggcctttgacacagagttctacaggacagtgagagtgacatcaagtggatgaaggagtgaatgaaacagtcccatgaactcagtcccgtggtagaggattgccattctgtgaagcaggcttcctgttcagagtcatccttaggattcagtgtttggttctaccccccaccctggttc

SEQ ID NO: 65438 - DNA, 201 bp, Bos taurus; identical to SEQ ID NO: 25066

SEQ ID NO: 65439 - DNA, 201 bp, Bos taurus; identical to SEQ ID NO: 25067

SEQ ID NO: 65440 - DNA, 201 bp, Bos taurus; identical to SEQ ID NO: 25068

SEQ ID NO: 65441 - DNA, 201 bp, Bos taurus; identical to SEQ ID NO: 25069

SEQ ID NO: 65442 - DNA, 201 bp, Bos taurus; identical to SEQ ID NO: 25070

SEQ ID NO: 65443 - DNA, 201 bp, Bos taurus; identical to SEQ ID NO: 25071

SEQ ID NO: 65444 - DNA, 201 bp, Bos taurus; identical to SEQ ID NO: 25072

SEQ ID NO: 65445 - DNA, 201 bp, Bos taurus; identical to SEQ ID NO: 25073

SEQ ID NO: 65446 - DNA, 201 bp, Bos taurus; identical to SEQ ID NO: 25074

SEQ ID NO: 65447 - DNA, 201 bp, Bos taurus; identical to SEQ ID NO: 25075

SEQ ID NO: 65448 - DNA, 201 bp, Bos taurus; identical to SEQ ID NO: 25076

SEQ ID NO: 65449 - DNA, 201 bp, Bos taurus; identical to SEQ ID NO: 25077

SEQ ID NO: 65450 - DNA, 201 bp, Bos taurus; identical to SEQ ID NO: 25078

SEQ ID NO: 65451 - DNA, 201 bp, Bos taurus; identical to SEQ ID NO: 25079

SEQ ID NO: 65452 - DNA, 201 bp, Bos taurus; identical to SEQ ID NO: 25080

SEQ ID NO: 65453 - DNA, 201 bp, Bos taurus; identical to SEQ ID NO: 25081

SEQ ID NO: 65454 - DNA, 201 bp, Bos taurus; identical to SEQ ID NO: 25082

SEQ ID NO: 65455 - DNA, 201 bp, Bos taurus; identical to SEQ ID NO: 25085

SEQ ID NO: 65456 - DNA, 201 bp, Bos taurus; identical to SEQ ID NO: 25086

SEQ ID NO: 65457 - DNA, 201 bp, Bos taurus; identical to SEQ ID NO: 25087

SEQ ID NO: 65458 - DNA, 201 bp, Bos taurus; identical to SEQ ID NO: 25088

SEQ ID NO: 65459 - DNA, 201 bp, Bos taurus; identical to SEQ ID NO: 25093

SEQ ID NO: 65460 - DNA, 201 bp, Bos taurus; identical to SEQ ID NO: 25094

SEQ ID NO: 65461 - DNA, 201 bp, Bos taurus; identical to SEQ ID NO: 25099

SEQ ID NO: 65462 - DNA, 201 bp, Bos taurus; identical to SEQ ID NO: 25100

SEQ ID NO: 65463 - DNA, 201 bp, Bos taurus; identical to SEQ ID NO: 25107

SEQ ID NO: 65464 - DNA, 201 bp, Bos taurus; identical to SEQ ID NO: 25108

SEQ ID NO: 65465 - DNA, 201 bp, Bos taurus; identical to SEQ ID NO: 25115

SEQ ID NO: 65466 - DNA, 201 bp, Bos taurus; identical to SEQ ID NO: 25116

SEQ ID NO: 65467 - DNA, 201 bp, Bos taurus; identical to SEQ ID NO: 25119

SEQ ID NO: 65468 - DNA, 201 bp, Bos taurus; identical to SEQ ID NO: 25120

SEQ ID NO: 65469 - DNA, 201 bp, Bos taurus; identical to SEQ ID NO: 25121

SEQ ID NO: 65470 - DNA, 201 bp, Bos taurus; identical to SEQ ID NO: 25123

SEQ ID NO: 65471 - DNA, 201 bp, Bos taurus; identical to SEQ ID NO: 25125

SEQ ID NO: 65472 - DNA, 201 bp, Bos taurus; identical to SEQ ID NO: 25126

SEQ ID NO: 65473 - DNA, 201 bp, Bos taurus; identical to SEQ ID NO: 25127

SEQ ID NO: 65474 - DNA, 201 bp, Bos taurus; identical to SEQ ID NO: 25128

SEQ ID NO: 65475 - DNA, 201 bp, Bos taurus; identical to SEQ ID NO: 25131

SEQ ID NO: 65476 - DNA, 201 bp, Bos taurus; identical to SEQ ID NO: 25132

SEQ ID NO: 65477 - DNA, 201 bp, Bos taurus; identical to SEQ ID NO: 25134

SEQ ID NO: 65478 - DNA, 201 bp, Bos taurus; identical to SEQ ID NO: 25135

SEQ ID NO: 65479 - DNA, 201 bp, Bos taurus; identical to SEQ ID NO: 25136

SEQ ID NO: 65480 - DNA, 201 bp, Bos taurus; identical to SEQ ID NO: 25137

SEQ ID NO: 65481 - DNA, 201 bp, Bos taurus; identical to SEQ ID NO: 25138

SEQ ID NO: 65482 - DNA, 201 bp, Bos taurus; identical to SEQ ID NO: 25139

SEQ ID NO: 65483 - DNA, 201 bp, Bos taurus; identical to SEQ ID NO: 25140

SEQ ID NO: 65484 - DNA, 201 bp, Bos taurus
tatgagtcctaacccagcatcacaaagatttacttctatgttttcttccaagagtttgtagttttaggtcttccatttaagtccatgatccattttgagttaatttttgtgtgtggtataagtaaggggacatcaagtcatccctgtgcagcttgttgaaaacattattctttccccatagaattgtttgggcacccttgt

SEQ ID NO: 65485 - DNA, 201 bp, Bos taurus
taaagataagctgagggaggggagctgtggggtgcatgctcagctcatggaaattcttctgattggttggtggtaagctaattgggagtcaacatcattactcttttggttcccaactggcttggtttctatgtgcttatgagcaaaatatagctaacttcatccatttgcaggggatttcattagctgcagaaaaactca

SEQ ID NO: 65486 - DNA, 201 bp, Bos taurus; identical to SEQ ID NO: 25142

SEQ ID NO: 65487 - DNA, 201 bp, Bos taurus
tgccgtaatgcgacttacgtctacttcggaaaaaacacatataacatacacacaggcagaggaaccatttctaaacactttcacaaagcagcttagtatgtggacggggtaaagagtaggagtgtctgggagtggttcccctgcattgtcagctaacccagtgattcttcaggggctctagtcaaaggactagttctatga

SEQ ID NO: 65488 - DNA, 201 bp, Bos taurus; identical to SEQ ID NO: 25147

SEQ ID NO: 65489 - DNA, 201 bp, Bos taurus; identical to SEQ ID NO: 25148

SEQ ID NO: 65490 - DNA, 201 bp, Bos taurus; identical to SEQ ID NO: 25149

SEQ ID NO: 65491 - DNA, 201 bp, Bos taurus; identical to SEQ ID NO: 25150

SEQ ID NO: 65492 - DNA, 201 bp, Bos taurus
tttttctagactagtaaaaggaaatataaagcacaaatattttgaaactcccagtggtattttgggtaagcgactcgaactaaatttgaggaaggaatgacactccttaattctcctcttttgaatcttaattctgtgcttctttttcattttcttgacaataaagttctttttcttcccaacagggctcttagactcttt

SEQ ID NO: 65493 - DNA, 201 bp, Bos taurus; identical to SEQ ID NO: 25152

SEQ ID NO: 65494 - DNA, 201 bp, Bos taurus
tttcatttccctatggctagttaagggaaaccgggaagatggccacttggcagtctcagccgctatcctaggaagctggtttcagtctgcagggaagaatggaaagggggaatgggcctttccccagacaaaaacaaaaatcccagaatcagaatgaagaaccaagcagtagatattgctggagcttataaatccattcca

SEQ ID NO: 65495 - DNA, 201 bp, Bos taurus
cagctctggaggctggaaggccgagataaggtgtctgcaggtctggctttgcctgagggctcggtgtttggtttacagacggccaaccttttcactgtgctctcatgtggcttttctctggtgtggtgtctctctattttgtcctaatcgcctctttttataaggataccggtcagattggattggggcccaccccaaagg

SEQ ID NO: 65496 - DNA, 201 bp, Bos taurus
caaggatgctcaccgccatgggctgactcatgttcttggctagagaagtggatgccagctcagtgtcctagaaagcctgctctccttctgtgaagttggaaccctgaaatgtttatgccggagagctgggaaaagctggaagaataatttctaatatgctcatctcttattccctctcacccctatttccacctctagccc

SEQ ID NO: 65497 - DNA, 201 bp, Bos taurus; identical to SEQ ID NO: 25156

SEQ ID NO: 65498 - DNA, 201 bp, Bos taurus; identical to SEQ ID NO: 25157

SEQ ID NO: 65499 - DNA, 201 bp, Bos taurus; identical to SEQ ID NO: 25158

SEQ ID NO: 65500 - DNA, 201 bp, Bos taurus; identical to SEQ ID NO: 25159

SEQ ID NO: 65501 - DNA, 201 bp, Bos taurus; identical to SEQ ID NO: 25161

SEQ ID NO: 65502 - DNA, 201 bp, Bos taurus; identical to SEQ ID NO: 25162

SEQ ID NO: 65503 - DNA, 201 bp, Bos taurus
aaattgaatttgcagtatattacttgtacagtgacagatttttaatattttcctactatctacaggcaaaagactttgaccccttaggtggggcaacagagctctccccaagcagacctcaagctgactttgtggcaataattcctctgcagtacttgtctactcactgggcctgtgcttcttgcttacatctgctctgtc

SEQ ID NO: 65504 - DNA, 201 bp, Bos taurus
ccatcaaatatcgtctactcttgcccacttctgattcatattctattcttcattcagactgatctgcttctaaaaatgtcaatcaaatcatatcactctattgtttaaaatccatccaagttagagtagatgtctctgttgtagcactctgaacttcaccttagcatttgtcacagctgcaatccatcaattattcttaca

SEQ ID NO: 65505 - DNA, 201 bp, Bos taurus
gttgaacctatgtgagttcaaaggcctcatgggtctgctgtctacagccataacagcaaagcttctaattatactttggatcagttaaaactctgaacaacccagaatgatggcctagatcctgacttgattaaataaggaaagggctaaattattacactgacaagcaggtggcaagacaaacactggtcctctcctatt

SEQ ID NO: 65506 - DNA, 201 bp, Bos taurus; identical to SEQ ID NO: 25163

SEQ ID NO: 65507 - DNA, 201 bp, Bos taurus; identical to SEQ ID NO: 25164

SEQ ID NO: 65508 - DNA, 201 bp, Bos taurus; identical to SEQ ID NO: 25165

SEQ ID NO: 65509 - DNA, 201 bp, Bos taurus; identical to SEQ ID NO: 25166

SEQ ID NO: 65510 - DNA, 201 bp, Bos taurus
agaccatggattcctaactgagtcacatgagcactaaatcctttcatatttcctttgatgtgtgagtgtgtgaggtggggtgtccaacctctctctgggcccttagcttcaaggagagagacacagagaatggagagggaagaaaataaccatctagctgctcaaagtataaaaatttaatagtagtggtaagtgttgagt

SEQ ID NO: 65511 - DNA, 201 bp, Bos taurus; identical to SEQ ID NO: 25168

SEQ ID NO: 65512 - DNA, 201 bp, Bos taurus; identical to SEQ ID NO: 25169

SEQ ID NO: 65513 - DNA, 201 bp, Bos taurus; identical to SEQ ID NO: 25170

SEQ ID NO: 65514 - DNA, 201 bp, Bos taurus; identical to SEQ ID NO: 25172

SEQ ID NO: 65515 - DNA, 201 bp, Bos taurus
cagacacactgattattttcatctggtatttaatttgatttattaatgacacttagctttcctcatttacacttgcacttcctctccttcaaaattctctgtcagcttcattcttgttgaatctcattttgatgtggtgaactatctagtctcctcttttctcttcttaattgaaatatagtctatgatattgtgttagtt

SEQ ID NO: 65516 - DNA, 201 bp, Bos taurus
ggaaggggtggggtgggagagcagggcaggagactgggagcagggcagggggcgagctgggggagcagggcagggcaggtagggccagcagtctctagaatcggctctggctttggctccaagtgaagctgggagctgttgttctgcaaagggaagtagaagtgacaggatctaacccaagtcacttagggccaggtcact

SEQ ID NO: 65517 - DNA, 201 bp, Bos taurus; identical to SEQ ID NO: 25177

SEQ ID NO: 65518 - DNA, 201 bp, Bos taurus; identical to SEQ ID NO: 25178

SEQ ID NO: 65519 - DNA, 201 bp, Bos taurus; identical to SEQ ID NO: 25179

SEQ ID NO: 65520 - DNA, 201 bp, Bos taurus; identical to SEQ ID NO: 25181

SEQ ID NO: 65521 - DNA, 201 bp, Bos taurus; identical to SEQ ID NO: 25182

SEQ ID NO: 65522 - DNA, 201 bp, Bos taurus; identical to SEQ ID NO: 25183

SEQ ID NO: 65523 - DNA, 201 bp, Bos taurus; identical to SEQ ID NO: 25184

SEQ ID NO: 65524 - DNA, 201 bp, Bos taurus
gccctgcatggtggctggctgagcccagggaccccagcacggagtccttctcatccgccccatcaggctgccagcccatagcatggtgctgaggggacttttgtgacacctggcccatgcaggtgctgacccaatgttcccattggatctgcatgaaaacatcgaggcctcaagccgccctgtccagcctctgtggtctcc

SEQ ID NO: 65525 - DNA, 201 bp, Bos taurus
aacctgaaatctcccaaacctgcagaatggtcccctcctccctaggaaaagctggcacccacctccacctcccatcctaggaaataatgcagaggcctcagtgcaagaaatgttcccacattctctactaaatattgggcggaaaacttgggttacataacagtataactcagaaggcatgtgctggcctgataggaaagg

SEQ ID NO: 65526 - DNA, 201 bp, Bos taurus; identical to SEQ ID NO: 25186

SEQ ID NO: 65527 - DNA, 201 bp, Bos taurus
tgataaggagcccattgggcaagtcctttctctctgagctggggccctgcatcagtaacagaggctgtggttcagcctccccttgttcctgagaacagacacagcgattcctgctcctaccttggccgggcattttagcctgcaggctccacagcatcccagagccccacatcaagggttttggaagtaccaaaaacagat

SEQ ID NO: 65528 - DNA, 201 bp, Bos taurus
ggaaaagaggaacaaggggactgtctccatggctccctaagggtgagaacacacggggtcagggtgataccaaggaaaccagaccataccctgtcttcccacaggccccaaactgaagttggcacaacattccaagatgttctctgcagcgcccacctctgccccagccttgcaacacaccttgttagcccatgtaatgat

SEQ ID NO: 65529 - DNA, 201 bp, Bos taurus
gcaactggttccttccaaattgtcacataaagatttggtaaatgtcagacacatcatttactagaaaatgatgtttcactgccaggggaggtaggtggctaagagaataaggtaaaaggcccagagatgaccttaaggcagctcacggcatgcagtcctctagcctggggctcctaacttgggtccctctcgcctggcagg

SEQ ID NO: 65530 - DNA, 201 bp, Bos taurus; identical to SEQ ID NO: 25187

SEQ ID NO: 65531 - DNA, 201 bp, Bos taurus; identical to SEQ ID NO: 25190

SEQ ID NO: 65532 - DNA, 201 bp, Bos taurus; identical to SEQ ID NO: 25191

SEQ ID NO: 65533 - DNA, 201 bp, Bos taurus; identical to SEQ ID NO: 25193

SEQ ID NO: 65534 - DNA, 201 bp, Bos taurus
ctggggaggctggaccatgagtgcaaagtgaatgggacctgccaaggagcccttatgagatgttagggaggactctcctggtggggaggtgagggtggcctggaactggacatcattgcccagggggagcgttttattgtctcaggaacatgagggtggaaaggaccaggctttggagtgaggccccaggtcctactcttg

SEQ ID NO: 65535 - DNA, 201 bp, Bos taurus; identical to SEQ ID NO: 25194

SEQ ID NO: 65536 - DNA, 201 bp, Bos taurus; identical to SEQ ID NO: 25195

SEQ ID NO: 65537 - DNA, 201 bp, Bos taurus; identical to SEQ ID NO: 25196

SEQ ID NO: 65538 - DNA, 201 bp, Bos taurus; identical to SEQ ID NO: 25197

SEQ ID NO: 65539 - DNA, 201 bp, Bos taurus; identical to SEQ ID NO: 25198

SEQ ID NO: 65540 - DNA, 201 bp, Bos taurus; identical to SEQ ID NO: 25199

SEQ ID NO: 65541 - DNA, 201 bp, Bos taurus; identical to SEQ ID NO: 25200

SEQ ID NO: 65542 - DNA, 201 bp, Bos taurus
tggccattgttgcacctgctgaccctttcacctggcacgggtaagctctgtcacccctcctttttctcctcccaacttgggtaaattctgttccttgtgtctgggcaccagggaagctggcctgctggtgggagcagggtttgcctggacccaggagaagccgggacagcccaggatttattgggaagggaaggaagagaa

SEQ ID NO: 65543 - DNA, 201 bp, Bos taurus
gcaacagaactatttcctaaagcaaaatcccaggtagacctcactcagggatgcgttagatgaactgttttagtgaaccaccagagaggttcttttttcccgtaatatttattcacttttctctttatcaaaatatactaatctttcaatctagcaagttagtaataaagaaagatgtcggttcaaataacttgccggcaa

SEQ ID NO: 65544 - DNA, 201 bp, Bos taurus
gtaagaagtatcaagtcaccaatgagttattctgctgagccttccatcctgttgttccaggcactcccatccaaacccactcactgacccgtgagtcagcgggtggatgttgcgagacctgagcacttagtttaagtttttaaattatagtttcaaatgcttaaattgcaccaacatttctcctagtctactccctgttat

SEQ ID NO: 65545 - DNA, 201 bp, Bos taurus; identical to SEQ ID NO: 25202

SEQ ID NO: 65546 - DNA, 201 bp, Bos taurus; identical to SEQ ID NO: 25204

SEQ ID NO: 65547 - DNA, 201 bp, Bos taurus; identical to SEQ ID NO: 25207

SEQ ID NO: 65548 - DNA, 201 bp, Bos taurus; identical to SEQ ID NO: 25209

SEQ ID NO: 65549 - DNA, 201 bp, Bos taurus; identical to SEQ ID NO: 25210

SEQ ID NO: 65550 - DNA, 201 bp, Bos taurus; identical to SEQ ID NO: 25211

SEQ ID NO: 65551 - DNA, 201 bp, Bos taurus
tccatggggtcgcaaggagtcggacacgactgagcgactgaacaagtcagtacatgaagcataggcctgcctaagacacagcaaagggccccagggtgacgggcagcagaagccagagtgacagccacttgagctccttctccgggtggaggcaagagatgaagaaggaaggttctggccagcacggactgtgcggccatg

SEQ ID NO: 65552 - DNA, 201 bp, Bos taurus
cctgtgaaaaccattgccattgtaagttggaggtctatgactgaagagagcctctcagaccccagtttctcctttagccaccagacccaaaggattattattattggcacatttgatgagtcattagaataattccatctccttgttagcaccgatggcagtgcctgactcataaaaggtgctgggtgaatatctgttgaa

SEQ ID NO: 65553 - DNA, 201 bp, Bos taurus; identical to SEQ ID NO: 25212

SEQ ID NO: 65554 - DNA, 201 bp, Bos taurus
ggcctggcatgttgcagtccacggggtctcaaagagtcagacacgactgagtgactgaactgatgaagcactttcttagcacatatccaggtgtaatattttggggggcctgtgggtttgaaacttctttttaaattagcaagcaagattaaaacttctttttaatctcacttttcaagtgagatcttaaagggacccaat

SEQ ID NO: 65555 - DNA, 201 bp, Bos taurus
gggagaagaggcatgatctctcaagttatttcccctcaagtctcaacaacaagagtaccaacaatatgtactgagcatctacatgggccagacacaggatcactgctgggtcaacactgataaataagatgcatgaggtcttataagccccctggagctggccaccccagaagaaataagaatgcacatcatttcaaattg

SEQ ID NO: 65556 - DNA, 201 bp, Bos taurus; identical to SEQ ID NO: 25213

SEQ ID NO: 65557 - DNA, 201 bp, Bos taurus; identical to SEQ ID NO: 25214

SEQ ID NO: 65558 - DNA, 201 bp, Bos taurus; identical to SEQ ID NO: 25216

SEQ ID NO: 65559 - DNA, 201 bp, Bos taurus
tatagtcgaagggatctctgttcttgggtcaggcctcaggaattacaaatacaggaaataaaaagggtactcggggctgaaaacttaatttaggactctagaaaatcctgggacaggaaaaaaggactttggcatttgtggttgaataaccaggtatggaatgtttgagtcatttaggcatccggattaattagattttat

SEQ ID NO: 65560 - DNA, 201 bp, Bos taurus
aatctataaaactggcactatgagtatgcgtttgtgtatattatctacttctctatatttcacctaaaaaacaaacacaactccataaaaaaggtacaaacaagtacataatcccaagggttagaataagatggcacaggctcatttacaaaaaagactacgcatttctcctcattaatttatcatttaatataaatgctg

SEQ ID NO: 65561 - DNA, 201 bp, Bos taurus; identical to SEQ ID NO: 25219

SEQ ID NO: 65562 - DNA, 201 bp, Bos taurus; identical to SEQ ID NO: 25220

SEQ ID NO: 65563 - DNA, 201 bp, Bos taurus; identical to SEQ ID NO: 25221

SEQ ID NO: 65564 - DNA, 201 bp, Bos taurus; identical to SEQ ID NO: 25222

SEQ ID NO: 65565 - DNA, 201 bp, Bos taurus; identical to SEQ ID NO: 25223

SEQ ID NO: 65566 - DNA, 201 bp, Bos taurus
acagagcgagaagagttcaaggtccaggggcccagcctggagtaagggttgatgatgggtgccctggcgaggcaaagaaacttgcaaaaatgcctgaggggcagatggccaaccagcttttcagaacaggaaatatctactgtttcatttgaagatgtgaatgctgccgtgtaaataagcaccttccaaatcgacatcgaa

SEQ ID NO: 65567 - DNA, 201 bp, Bos taurus
gatgccgtcagtagcaaggccagggtgaccatggagatgctagtcctgatctccctttaagattgttatcccattttatagatgaggaaacagaggctccgaggttgagtagctggcctagactcacacgagagctggactccactgtctttagttttggattcaacttcctcactgacctgaagggtctctgcccacact

SEQ ID NO: 65568 - DNA, 201 bp, Bos taurus; identical to SEQ ID NO: 25227

SEQ ID NO: 65569 - DNA, 201 bp, Bos taurus; identical to SEQ ID NO: 25228

SEQ ID NO: 65570 - DNA, 201 bp, Bos taurus; identical to SEQ ID NO: 25229

SEQ ID NO: 65571 - DNA, 201 bp, Bos taurus; identical to SEQ ID NO: 25230

SEQ ID NO: 65572 - DNA, 201 bp, Bos taurus; identical to SEQ ID NO: 25231

SEQ ID NO: 65573 - DNA, 201 bp, Bos taurus; identical to SEQ ID NO: 25232

SEQ ID NO: 65574 - DNA, 201 bp, Bos taurus; identical to SEQ ID NO: 25233

SEQ ID NO: 65575 - DNA, 201 bp, Bos taurus
agcacgcacatatgactcatggggggaaaatattttaaatctggtgaatatggaagtccaagccatcctccatgaggccctctttattctgctgctaccaatcacttcatgcagcctttcagctgttgacttttttgggtgtagtcaggtaggcccctgagtgcaccaagcttcagggaatacatatcaagtttcttgggt

SEQ ID NO: 65576 - DNA, 201 bp, Bos taurus; identical to SEQ ID NO: 25235

SEQ ID NO: 65577 - DNA, 201 bp, Bos taurus; identical to SEQ ID NO: 25236

SEQ ID NO: 65578 - DNA, 201 bp, Bos taurus; identical to SEQ ID NO: 25237

SEQ ID NO: 65579 - DNA, 201 bp, Bos taurus
acttgcttgccccatgctagctgctgctgagtatgcgaagataaatcagagacagttcctgctcttaaagttatatgttccatcatgcctagcatgtcacaggggcccaataagttttcattgagtattaccttagccttcagctctgtgtggcctctattctctgccttcccaggtactttcgtatattgttctgttgtt

SEQ ID NO: 65580 - DNA, 201 bp, Bos taurus
ggaagacaggggccaaaggacagagcagggaggaattccagagttaaagatggaggcatccaagagagatgggagcggcaggtcagaggagagtaggaacggtgagcagccgggggccgctccgggcaggatggccgtggagccgaggagaagatggagctgtttggagacagaagagcagaaggagctgcagacaggcgt

SEQ ID NO: 65581 - DNA, 201 bp, Bos taurus
agtttttttttatttgtctttatataattttatttagttgcttttggctgtgctggatcttcgctgctgcttgaaggctttctctagtcgcagtgagtggtggccacactctggttgcggtgtgcagtggcttctcactcactgcagtggcttctcttgttgcagagcatgggctccagttttgtgaacttcagtagttgt

SEQ ID NO: 65582 - DNA, 201 bp, Bos taurus
taaaatatcatggtttcatttaaaagaataagaattacttacctatgctgcttcaattgttctgaatttaagccatcctagtatgagatcaacactgttcttaacttgaagcttcacccttgacagaaatatgtgtaggacacaaaaaggcaggaatgctttcattaatcattaaggggggttccctgaaactcattgtca

SEQ ID NO: 65583 - DNA, 201 bp, Bos taurus; identical to SEQ ID NO: 25239

SEQ ID NO: 65584 - DNA, 201 bp, Bos taurus; identical to SEQ ID NO: 25240

SEQ ID NO: 65585 - DNA, 201 bp, Bos taurus; identical to SEQ ID NO: 25242

SEQ ID NO: 65586 - DNA, 201 bp, Bos taurus; identical to SEQ ID NO: 25243

SEQ ID NO: 65587 - DNA, 201 bp, Bos taurus; identical to SEQ ID NO: 25244

SEQ ID NO: 65588 - DNA, 201 bp, Bos taurus; identical to SEQ ID NO: 25245

SEQ ID NO: 65589 - DNA, 201 bp, Bos taurus; identical to SEQ ID NO: 25246

SEQ ID NO: 65590 - DNA, 201 bp, Bos taurus; identical to SEQ ID NO: 25248

SEQ ID NO: 65591 - DNA, 201 bp, Bos taurus; identical to SEQ ID NO: 25249

SEQ ID NO: 65592 - DNA, 201 bp, Bos taurus; identical to SEQ ID NO: 25256

SEQ ID NO: 65593 - DNA, 201 bp, Bos taurus; identical to SEQ ID NO: 25259

SEQ ID NO: 65594 - DNA, 201 bp, Bos taurus; identical to SEQ ID NO: 25260

SEQ ID NO: 65595 - DNA, 201 bp, Bos taurus; identical to SEQ ID NO: 25261

SEQ ID NO: 65596 - DNA, 201 bp, Bos taurus; identical to SEQ ID NO: 25263

SEQ ID NO: 65597 - DNA, 201 bp, Bos taurus; identical to SEQ ID NO: 25264

SEQ ID NO: 65598 - DNA, 201 bp, Bos taurus; identical to SEQ ID NO: 25265

SEQ ID NO: 65599 - DNA, 201 bp, Bos taurus; identical to SEQ ID NO: 25266

SEQ ID NO: 65600 - DNA, 201 bp, Bos taurus; identical to SEQ ID NO: 25267

SEQ ID NO: 65601 - DNA, 201 bp, Bos taurus; identical to SEQ ID NO: 25268

SEQ ID NO: 65602 - DNA, 201 bp, Bos taurus; identical to SEQ ID NO: 25269

SEQ ID NO: 65603 - DNA, 201 bp, Bos taurus; identical to SEQ ID NO: 25271

SEQ ID NO: 65604 - DNA, 201 bp, Bos taurus; identical to SEQ ID NO: 25272

SEQ ID NO: 65605 - DNA, 201 bp, Bos taurus; identical to SEQ ID NO: 25273

SEQ ID NO: 65606 - DNA, 201 bp, Bos taurus; identical to SEQ ID NO: 25274

SEQ ID NO: 65607 - DNA, 201 bp, Bos taurus; identical to SEQ ID NO: 25275

SEQ ID NO: 65608 - DNA, 201 bp, Bos taurus; identical to SEQ ID NO: 25276

SEQ ID NO: 65609 - DNA, 201 bp, Bos taurus; identical to SEQ ID NO: 25278

SEQ ID NO: 65610 - DNA, 201 bp, Bos taurus; identical to SEQ ID NO: 25279

SEQ ID NO: 65611 - DNA, 201 bp, Bos taurus; identical to SEQ ID NO: 25283

SEQ ID NO: 65612 - DNA, 201 bp, Bos taurus; identical to SEQ ID NO: 25285

SEQ ID NO: 65613 - DNA, 201 bp, Bos taurus; identical to SEQ ID NO: 25286

SEQ ID NO: 65614 - DNA, 201 bp, Bos taurus; identical to SEQ ID NO: 25290

SEQ ID NO: 65615 - DNA, 201 bp, Bos taurus; identical to SEQ ID NO: 25292

SEQ ID NO: 65616 - DNA, 201 bp, Bos taurus; identical to SEQ ID NO: 25293

SEQ ID NO: 65617 - DNA, 201 bp, Bos taurus
gccagtagtctcacagcttttatgaaggagaaaatttttgaagtcgttactaattccagttgtattacccccaaagagtttatttaaaatgctttcacggctgtttggccatatagcattttacatctgaatatcagccagactcctaagcacagttggcatgcttcaccaattgtgaattattaatttaagtattaattt

SEQ ID NO: 65618 - DNA, 201 bp, Bos taurus; identical to SEQ ID NO: 25294

SEQ ID NO: 65619 - DNA, 201 bp, Bos taurus
tactgtttttgaccaaaagcaaatctttgcttgtagaaacatccccatcttcaaagatattatacattccccagaaagaagggttttgccaagttaaactataattaacaaataataaaaacagatgccttctctgaaatttttataaagctacacaacatattttcttttcatatttaagtaagaagtttgagtcaaaaa

SEQ ID NO: 65620 - DNA, 201 bp, Bos taurus
atttggctgagagtgaagaatgaaatgaagtccataaagatatccctgaggtgaaggatgaaggaactgtatctctgggccactgggacaagagcaactttaagaagaaagcaatcttagcatcctgtccaccagtccttccagatgctggagggagtgcctttctcttctggatcaggcctagatcagcccaagtagaag

SEQ ID NO: 65621 - DNA, 201 bp, Bos taurus; identical to SEQ ID NO: 25298

SEQ ID NO: 65622 - DNA, 201 bp, Bos taurus
aagcctggcatgctgcagtccatggggtcgcaaagagtcagatgggactgagtgactgaacaacagcaagaacaactttaaaagccaacagatttacttacgacttagggggaacatttcagtgtattcatcagtgggcctggccacccatctcttttcacaatatactgctgctgctgctaagtcgcttcaatcgtgtcc

SEQ ID NO: 65623 - DNA, 201 bp, Bos taurus
aattgagaatcgtaactctaaagtataagcacattaatcagattatggaggaaaccaggtagaatcaatggaaatgaggagaaccagcgctatgggaaggaggagggaattttgcttttcattttctactattctgctttggtcgagagaggcaccatgaaccctacaaatgatcacaggccccacagacaatggtccttg

SEQ ID NO: 65624 - DNA, 201 bp, Bos taurus
ggggtcccaagagtcgtccacgactgaatgactaagcacgtgcgtgcacacagtataaagtacttactatgtgcaggccccattctaagctctttgcctacgttgtctcattaattctcgttacaacctgatgagattggcaccattataattcctcctttacagttggagaaagtgaggccagagattgttgaataactt

SEQ ID NO: 65625 - DNA, 201 bp, Bos taurus; identical to SEQ ID NO: 25300

SEQ ID NO: 65626 - DNA, 201 bp, Bos taurus
tggtctgtcccctgatgagtgcatttaagattcaaaaaatgatctttgagatcagattttacattcattacatacagatgaggaaaatgctgcctggagacttacagggaagctagaaacagatccaccaggacacagacctgaagttcctgattcccagctaagttcttctggtaacacgctctccagggtaagattcca

SEQ ID NO: 65627 - DNA, 201 bp, Bos taurus; identical to SEQ ID NO: 25302

SEQ ID NO: 65628 - DNA, 201 bp, Bos taurus
ccaatacaactaaataaaaatttaaagttttctgtgcttttagttatccttgctcactcacactccatcaatataatggctatcactaattaggtactacgttttggacatatattcagtgagtataaatattaccccatttaatctgcacacccttttgacataggcattgctgtaatccatggtatggatcaagagaca

SEQ ID NO: 65629 - DNA, 201 bp, Bos taurus; identical to SEQ ID NO: 25309

SEQ ID NO: 65630 - DNA, 201 bp, Bos taurus; identical to SEQ ID NO: 25310

SEQ ID NO: 65631 - DNA, 201 bp, Bos taurus; identical to SEQ ID NO: 25311

SEQ ID NO: 65632 - DNA, 201 bp, Bos taurus; identical to SEQ ID NO: 25312

SEQ ID NO: 65633 - DNA, 201 bp, Bos taurus
tggacagagcagcctgtcaggctacagtccatagggtcacaaagagtcagacatcactgagcgactaaccctttcaagcttcactttccttttcacgatacgtatgtatctccctttttgtctgaagttaaatctgacaacgctcagactgtatgactgtcttagaggctaatttctaggttgcaactgtgcctagtgatg

SEQ ID NO: 65634 - DNA, 201 bp, Bos taurus; identical to SEQ ID NO: 25313

SEQ ID NO: 65635 - DNA, 201 bp, Bos taurus
tacccaagcctgggatgggggtcgggtggcccatggtgttgagcaggggctacctgacctggcagcatcttgtcatccgctcccctgacaccacatctacaatgatgctctggcagcccagagctgctgctcatcccgtgttcagtcacagacctgatgctcacagtcagcttggccctggagacttggctgtttctaatc

SEQ ID NO: 65636 - DNA, 201 bp, Bos taurus; identical to SEQ ID NO: 25315

SEQ ID NO: 65637 - DNA, 201 bp, Bos taurus
atcataccttagcagggtgctttgacctgttctcaacgttatgtgttgctatcatcattgttattggtgagcttagcttttctggaaatgcagggatcctatcaggtgctgaaagttttaaaaggggaataggggctaaatttgaacaggtagaaatctcccagacagatgattccaaggtctgtccctgggcccctcaag

SEQ ID NO: 65638 - DNA, 201 bp, Bos taurus
cctgagcatctgaaggagtggactcagagagctgctgcgccctacactctgaatgacccatcacctgatccagaaagtgttggggcctcctatgtgctgatggctgaaggcagttagaagagctctgcccttgaaccttgaacacataagagataagatggccaggcttgtggctgagtacaagataaggatgctttgctg

SEQ ID NO: 65639 - DNA, 201 bp, Bos taurus; identical to SEQ ID NO: 25316

SEQ ID NO: 65640 - DNA, 201 bp, Bos taurus; identical to SEQ ID NO: 25317

SEQ ID NO: 65641 - DNA, 201 bp, Bos taurus; identical to SEQ ID NO: 25318

SEQ ID NO: 65642 - DNA, 201 bp, Bos taurus; identical to SEQ ID NO: 25319

SEQ ID NO: 65643 - DNA, 201 bp, Bos taurus; identical to SEQ ID NO: 25320

SEQ ID NO: 65644 - DNA, 201 bp, Bos taurus; identical to SEQ ID NO: 25322

SEQ ID NO: 65645 - DNA, 201 bp, Bos taurus; identical to SEQ ID NO: 25323

SEQ ID NO: 65646 - DNA, 201 bp, Bos taurus
agggcttggccaattgcgtcatatttaaagtaagacccaagccaacttcacttcagcttccaatgctctccatcagacccaactggcactgcaaacagactgcgcggccttccgttcctcatccttctctctgcccaggactctgcagcgttccaggatctccttcagcctcgcggaaggtgtcccgtctcctctgaacag

SEQ ID NO: 65647 - DNA, 201 bp, Bos taurus
actggtggtttcctctcgggtgaagctctcgggatctgctgcagagcagtctcctggggtctgtggcaaggtttccagtgacgaaagttgggggtgtgtgcggtatccaaagaggccactgaggtccttagcagtggaggctactggagactgtgaaagagcaggacatggtggctcctgctgtgtgactgacacaggtga

SEQ ID NO: 65648 - DNA, 201 bp, Bos taurus; identical to SEQ ID NO: 25324

SEQ ID NO: 65649 - DNA, 201 bp, Bos taurus; identical to SEQ ID NO: 25325

SEQ ID NO: 65650 - DNA, 201 bp, Bos taurus; identical to SEQ ID NO: 25327

SEQ ID NO: 65651 - DNA, 201 bp, Bos taurus; identical to SEQ ID NO: 25328

SEQ ID NO: 65652 - DNA, 201 bp, Bos taurus; identical to SEQ ID NO: 25329

SEQ ID NO: 65653 - DNA, 201 bp, Bos taurus
acgatgttccctacactgtcgaatggggatctgtcagaatccgtttctctcatccttgattacgagccccttatggagaggaccgtgtatcctgagatgacgtgtactaaagcagaggacagtgttatccacatcgtcagtatttctcaaactttaatgggtgcacaaatcagtgagaggatcctgtcaaatgcagtttct

SEQ ID NO: 65654 - DNA, 201 bp, Bos taurus; identical to SEQ ID NO: 25330

SEQ ID NO: 65655 - DNA, 201 bp, Bos taurus; identical to SEQ ID NO: 25331

SEQ ID NO: 65656 - DNA, 201 bp, Bos taurus
aaggtgaagaccgtgaaagtgtctgctgaggaccctccaggtgaccaaggacatggactccagctcctgctaggagctcgtctagaactcctagacggccatgtgggaactgctgcagggctgcaggggggtgacctgacacgccatgctcccagagagatatgccctccccttttggccctaaatcctggagaagaaata

SEQ ID NO: 65657 - DNA, 201 bp, Bos taurus
tataggtccgtatccttccccacttctttctaaattcatcatctcaaaactcacctctcttctaagaagtctcctatagcactatgctcagattattctctcagagtttgaaacacaaacatatcaggctgttttctctcagaagacacgggcccagagggcaggaatcagatgccttctttttctactaaactgtatact

SEQ ID NO: 65658 - DNA, 201 bp, Bos taurus; identical to SEQ ID NO: 25336

SEQ ID NO: 65659 - DNA, 201 bp, Bos taurus
catggccttgacaggagctcatcagcagatagggggcctcctaagctactcaaaatccacccagcttgagcgtttgtcgctgttgttattgtagatgcaggctagacttaaagggcgtctgggacctgggcttcggggtcaaggcagtccagtctccccatcagagcagacgcccttcctcccaggggcgtggggcggcct

SEQ ID NO: 65660 - DNA, 201 bp, Bos taurus
gccggtggaggacagcttgctgggaaggagcaacgtgcggcgagaggaccaccgctcggggtgttgcgtgagttgaaagaaggcctgggcataaagaattttaggcaatttaccaaggcagcaacagtcaagattgagttggagaacagtattacagttgagagagccaacctggggctagacttcctggtcacccatctt

SEQ ID NO: 65661 - DNA, 201 bp, Bos taurus; identical to SEQ ID NO: 25340

SEQ ID NO: 65662 - DNA, 201 bp, Bos taurus
tagaccttggaggacttgctgatgaatcacatgtggggtgtgagtgaaaggggggagtctaggatgatttccagatttgtggctggagaaacttcaaggatggaattgccattaactgaggtgggaagtgctgtgggagggctggtttggaggagaccaggaactggttccggacatgttaaatttgaaaggtctcttata

SEQ ID NO: 65663 - DNA, 201 bp, Bos taurus
cgtttttattccgtatcacagaccagtctgcctctaaaagcaatcattcaattcccaaatgtttaccatgtacatattgtcagcagaattataggaaatataaatacggataagatccagttttgaaggaggttagattggtaaagaatccacctgcaatgcgggagacctggattcaatccctgggttgggaagatgctc

SEQ ID NO: 65664 - DNA, 201 bp, Bos taurus; identical to SEQ ID NO: 25343

SEQ ID NO: 65665 - DNA, 201 bp, Bos taurus
gaagagagaggagggctgacgccacgctctaagggctctaacgggtagctctggggtcaaagaggcagacgtgcacaagtgatggggaggaatggccagcgaggtgagggaaaacaggaggtatcagttcatgggaggtccaaggaaaggagcctcttcaggaggaggctgggtttcctttgctgaaagctgctgagaagt

SEQ ID NO: 65666 - DNA, 201 bp, Bos taurus
gacaaatgcctctcctccatcctccagggcgacagcatcagtgaggaccctggtcgatggccgagacctcacgtggcctctgagcccttcttaacgttgtccttcagggctccaccaagaagtgaagtgatgtggcatgcaagatgcaatctctctttatccttgaagtaccagcgagagaaaatgggccaaagagacatc

SEQ ID NO: 65667 - DNA, 201 bp, Bos taurus; identical to SEQ ID NO: 25344

SEQ ID NO: 65668 - DNA, 201 bp, Bos taurus
caggcaggaagctgtagaagtgttatcaatacgacaaatgaaatgtggatgcctctagagtcttatacaaccaccaaggcccctctcggaatcatacgtatatccatcgatacatacaattttgcatacaagctcataactggaagctgagatgtctcacttaggatactgtcacaaattacgtattttaaagacaaggca

SEQ ID NO: 65669 - DNA, 201 bp, Bos taurus; identical to SEQ ID NO: 25349

SEQ ID NO: 65670 - DNA, 201 bp, Bos taurus; identical to SEQ ID NO: 25350

SEQ ID NO: 65671 - DNA, 201 bp, Bos taurus; identical to SEQ ID NO: 25351

SEQ ID NO: 65672 - DNA, 201 bp, Bos taurus; identical to SEQ ID NO: 25352

SEQ ID NO: 65673 - DNA, 201 bp, Bos taurus; identical to SEQ ID NO: 25353

SEQ ID NO: 65674 - DNA, 201 bp, Bos taurus; identical to SEQ ID NO: 25354

SEQ ID NO: 65675 - DNA, 201 bp, Bos taurus; identical to SEQ ID NO: 25355

SEQ ID NO: 65676 - DNA, 201 bp, Bos taurus; identical to SEQ ID NO: 25356

SEQ ID NO: 65677 - DNA, 201 bp, Bos taurus; identical to SEQ ID NO: 25357

SEQ ID NO: 65678 - DNA, 201 bp, Bos taurus; identical to SEQ ID NO: 25358

SEQ ID NO: 65679 - DNA, 201 bp, Bos taurus; identical to SEQ ID NO: 25359

SEQ ID NO: 65680 - DNA, 201 bp, Bos taurus; identical to SEQ ID NO: 25360

SEQ ID NO: 65681 - DNA, 201 bp, Bos taurus; identical to SEQ ID NO: 25361

SEQ ID NO: 65682 - DNA, 201 bp, Bos taurus
tcagagccatgagtgcacccaccagatccgggtccgcgtgcaggcagccatcagcgtcagggggctttctctccactttcttctggcccacagttgctgtagcgggacgagcccgatagccacctccgctgatgggagggggcacaggtctcaggctgggggcctcttccttcttcttgtcatagggccgatgaccgcggg

SEQ ID NO: 65683 - DNA, 201 bp, Bos taurus; identical to SEQ ID NO: 25362

SEQ ID NO: 65684 - DNA, 201 bp, Bos taurus
aattcaataaaggacactgtgaaatgggcaggagaccttgaattgtacatgatgaaagagaaagcctaaaaacgaatgggaaaatagatgtttcaagttcctgatttcccatttgtttctaaactaaaccactgtttacagtgaatgtgtcagtgaaagctgtggagaaactagctccttttcctttatttttagactcaa

SEQ ID NO: 65685 - DNA, 201 bp, Bos taurus; identical to SEQ ID NO: 25364

SEQ ID NO: 65686 - DNA, 201 bp, Bos taurus; identical to SEQ ID NO: 25365

SEQ ID NO: 65687 - DNA, 201 bp, Bos taurus
cagtcccacagtttgctgggccctgggtccacccattagtaagctgctccagccttcagaccagcctcacccaccagagggggaacaccagccctgggacgacggcagtcctgtggcctgctatgacaggccccagtcaacatgtcagcaccagacctgggcctgggggagggggctgtcttgcccaccagcaggtcaaca

SEQ ID NO: 65688 - DNA, 201 bp, Bos taurus
ctttgtgtttgaggccatagttgacttccagctccatgagcagcacactcttgcgcacgtttaaagtcttctggagttcatcaaaggtagaatggatgtcgtccacaatactggccttctggttggttaactgatggatgatttccgagatgaactgaagagctgaatctatttctgggagcctggaggacagttgtcaga

SEQ ID NO: 65689 - DNA, 201 bp, Bos taurus
tggatcagaagcacaggtgctaacctggccttgtgactggcttcagaagggagtggcggtaggtgggggagtggagggtgcggtcttgtgagaccaaacctttggcctgtgggctctgatgcgctcgctctccagcgatcagtgtcagaactgaattgaactgtaggacaccctgctggtgttgcagaaaattgcttggtg

SEQ ID NO: 65690 - DNA, 201 bp, Bos taurus; identical to SEQ ID NO: 25367

SEQ ID NO: 65691 - DNA, 201 bp, Bos taurus; identical to SEQ ID NO: 25369

SEQ ID NO: 65692 - DNA, 201 bp, Bos taurus; identical to SEQ ID NO: 25370

SEQ ID NO: 65693 - DNA, 201 bp, Bos taurus; identical to SEQ ID NO: 25371

SEQ ID NO: 65694 - DNA, 201 bp, Bos taurus
gatcaaggataatgccaacagtggggaagctgttgatagtatgtgctcctgacaggacgtgacgagcacgagccctggcctctgtcatcttcctcctaaacatggagtaactcagtctaatctcgagagtagcatcaggcaaacccaaactgaaggccattttacaaaatacctgaccagctctcataattgtcaaggcgc

SEQ ID NO: 65695 - DNA, 201 bp, Bos taurus; identical to SEQ ID NO: 25372

SEQ ID NO: 65696 - DNA, 201 bp, Bos taurus; identical to SEQ ID NO: 25373

SEQ ID NO: 65697 - DNA, 201 bp, Bos taurus; identical to SEQ ID NO: 25374

SEQ ID NO: 65698 - DNA, 201 bp, Bos taurus; identical to SEQ ID NO: 25375

SEQ ID NO: 65699 - DNA, 201 bp, Bos taurus
ccaagggaggcagacagcaaacacttcacctgcagaggaatacaggcctgctctatcaaggtctcaccagtgaacctggcagatggaggagagatggaaaacaagggtgtggaaaagaggcctagaggaaggctctcagctgtgcaggaggaagctgcaagaatgctcatcccacttgtgtttgtgaaagagaaaaattga

SEQ ID NO: 65700 - DNA, 201 bp, Bos taurus
ggtccactcgtcatcatctaatacagagcagctcaattgggccgagtctgtgccaagcctcctcagagctcattggccaccctggtgacctgcctgcattagttgggacaccaaataccacagcatcagatgcggtgcaggtagcatgattggcccactaagtgcaagaaccaatctgggaacccaggaaggttgtgctag

SEQ ID NO: 65701 - DNA, 201 bp, Bos taurus; identical to SEQ ID NO: 25377

SEQ ID NO: 65702 - DNA, 201 bp, Bos taurus; identical to SEQ ID NO: 25378

SEQ ID NO: 65703 - DNA, 201 bp, Bos taurus; identical to SEQ ID NO: 25379

SEQ ID NO: 65704 - DNA, 201 bp, Bos taurus
aacacacaatgcaaatgtcagagttctttttcaatcaggtcccacatattttatcttttatataaagaagaaaaaataacaaagagaaaaacaagacttaggaagtatttcattttatgtaaaaatgcatgttcctgaaaaactgagttgcacccgggtaataaaaaacccataccttattactgagtaaatatttttctt

SEQ ID NO: 65705 - DNA, 201 bp, Bos taurus; identical to SEQ ID NO: 25383

SEQ ID NO: 65706 - DNA, 201 bp, Bos taurus; identical to SEQ ID NO: 25384

SEQ ID NO: 65707 - DNA, 201 bp, Bos taurus; identical to SEQ ID NO: 25385

SEQ ID NO: 65708 - DNA, 201 bp, Bos taurus; identical to SEQ ID NO: 25386

SEQ ID NO: 65709 - DNA, 201 bp, Bos taurus
aagatggaaacagagcaaagaaatctgagataatcactactaacaaattattattcttttacatatctctttatggacatgagaaatgtatactgaactattttcaggttcagtactttccatattttaaggtggcctagccaaggcaccattctggaagaagatagggatcaattttgaaagtgtaacaatgcagtaaaa

SEQ ID NO: 65710 - DNA, 201 bp, Bos taurus
agctttgttgtcttgtgtttcactagaatttcactgtagattgatggaaccattagtcatacgtttaaactcgttctccaggccctctcccctctgtggagatcaggctgatatcaccaggctcagttccccaaccctcatgagtcatcatcttagtataaacaagggacccaaggtgagtcacagcattagcataaactc

SEQ ID NO: 65711 - DNA, 201 bp, Bos taurus; identical to SEQ ID NO: 25387

SEQ ID NO: 65712 - DNA, 201 bp, Bos taurus
tgcaaaggaaaacaaaattgaatacttctgcatattcaaatttaggttgaaggaaatgaagttcttcaatgtacctttgcctaacttcaaagataaattacacattaaatactcttacaacaacaatgataaatgtgagtgcattttaaatattaattttccatcaaagaaatttattatgcatttatctattagagctaa

SEQ ID NO: 65713 - DNA, 201 bp, Bos taurus; identical to SEQ ID NO: 25388

SEQ ID NO: 65714 - DNA, 201 bp, Bos taurus
tgactaggaactcaacgcattcggctcttggtaaatggatctcacatccttggtggattcttccaaaataatcatctaataatctaaggaaagatgattttgaatcctactctataagtgactgatgtgctagagtgagacatttcattaaatcgattattcactgagaaaatctgtgttcccatcttgtgccaaacacca

SEQ ID NO: 65715 - DNA, 201 bp, Bos taurus; identical to SEQ ID NO: 25393

SEQ ID NO: 65716 - DNA, 201 bp, Bos taurus
gcatatcaaagctcactgacagctgtcatcaccacaatcctttctaacttttaacaaaaacctggaatctcattagagtatttacaggccaacagcttttttttttaataaatcagattggttctgaccagtagcaaagacatggggagtgctctccagttcactgatgagcagctgatgacggctgtccccgggcacagt

SEQ ID NO: 65717 - DNA, 201 bp, Bos taurus
aatggaaaagccagtggggtgggagaaaaagcaagtaggtgtgaggttactgagccaagtagagcaagcgtatcacagaggggaaggtgaacggccacatgagacgctgccgccaggaaagaacaggaagacggagaactgacgctggaggcggcgctctgacaccacgatgaccctcacagaacacgcagcggagggtgg

SEQ ID NO: 65718 - DNA, 201 bp, Bos taurus; identical to SEQ ID NO: 25394

SEQ ID NO: 65719 - DNA, 201 bp, Bos taurus; identical to SEQ ID NO: 25395

SEQ ID NO: 65720 - DNA, 201 bp, Bos taurus; identical to SEQ ID NO: 25396

SEQ ID NO: 65721 - DNA, 201 bp, Bos taurus; identical to SEQ ID NO: 25397

SEQ ID NO: 65722 - DNA, 201 bp, Bos taurus; identical to SEQ ID NO: 25398

SEQ ID NO: 65723 - DNA, 201 bp, Bos taurus; identical to SEQ ID NO: 25399

SEQ ID NO: 65724 - DNA, 201 bp, Bos taurus; identical to SEQ ID NO: 25400

SEQ ID NO: 65725 - DNA, 201 bp, Bos taurus; identical to SEQ ID NO: 25401

SEQ ID NO: 65726 - DNA, 201 bp, Bos taurus; identical to SEQ ID NO: 25402

SEQ ID NO: 65727 - DNA, 201 bp, Bos taurus; identical to SEQ ID NO: 25403

SEQ ID NO: 65728 - DNA, 201 bp, Bos taurus; identical to SEQ ID NO: 25404

SEQ ID NO: 65729 - DNA, 201 bp, Bos taurus; identical to SEQ ID NO: 25405

SEQ ID NO: 65730 - DNA, 201 bp, Bos taurus; identical to SEQ ID NO: 25406

SEQ ID NO: 65731 - DNA, 201 bp, Bos taurus; identical to SEQ ID NO: 25407

SEQ ID NO: 65732 - DNA, 201 bp, Bos taurus; identical to SEQ ID NO: 25408

SEQ ID NO: 65733 - DNA, 201 bp, Bos taurus; identical to SEQ ID NO: 25409

SEQ ID NO: 65734 - DNA, 201 bp, Bos taurus; identical to SEQ ID NO: 25410

SEQ ID NO: 65735 - DNA, 201 bp, Bos taurus; identical to SEQ ID NO: 25411

SEQ ID NO: 65736 - DNA, 201 bp, Bos taurus; identical to SEQ ID NO: 25412

SEQ ID NO: 65737 - DNA, 201 bp, Bos taurus
gacccagggatcaaacctggatctcctgcattgcaggcagattctttactgcctgagctaccagggaaatccattcgtactataatcccttttaaagatatgaaatatcttttaagatttatatcatgaaatatactagtgatatgaaaaattatatagtgcaagcacagtttcttgatttaaataatagaaacaattttg

SEQ ID NO: 65738 - DNA, 201 bp, Bos taurus; identical to SEQ ID NO: 25413

SEQ ID NO: 65739 - DNA, 201 bp, Bos taurus; identical to SEQ ID NO: 25414

SEQ ID NO: 65740 - DNA, 201 bp, Bos taurus; identical to SEQ ID NO: 25415

SEQ ID NO: 65741 - DNA, 201 bp, Bos taurus; identical to SEQ ID NO: 25416

SEQ ID NO: 65742 - DNA, 201 bp, Bos taurus; identical to SEQ ID NO: 25417

SEQ ID NO: 65743 - DNA, 201 bp, Bos taurus; identical to SEQ ID NO: 25418

SEQ ID NO: 65744 - DNA, 201 bp, Bos taurus; identical to SEQ ID NO: 25419

SEQ ID NO: 65745 - DNA, 201 bp, Bos taurus; identical to SEQ ID NO: 25420

SEQ ID NO: 65746 - DNA, 201 bp, Bos taurus; identical to SEQ ID NO: 25421

SEQ ID NO: 65747 - DNA, 201 bp, Bos taurus; identical to SEQ ID NO: 25422

SEQ ID NO: 65748 - DNA, 201 bp, Bos taurus; identical to SEQ ID NO: 25423

SEQ ID NO: 65749 - DNA, 201 bp, Bos taurus; identical to SEQ ID NO: 25424

SEQ ID NO: 65750 - DNA, 201 bp, Bos taurus; identical to SEQ ID NO: 25425

SEQ ID NO: 65751 - DNA, 201 bp, Bos taurus; identical to SEQ ID NO: 25426

SEQ ID NO: 65752 - DNA, 201 bp, Bos taurus; identical to SEQ ID NO: 25427

SEQ ID NO: 65753 - DNA, 201 bp, Bos taurus; identical to SEQ ID NO: 25428

SEQ ID NO: 65754 - DNA, 201 bp, Bos taurus; identical to SEQ ID NO: 25429

SEQ ID NO: 65755 - DNA, 201 bp, Bos taurus; identical to SEQ ID NO: 25430

SEQ ID NO: 65756 - DNA, 201 bp, Bos taurus; identical to SEQ ID NO: 25431

SEQ ID NO: 65757 - DNA, 201 bp, Bos taurus; identical to SEQ ID NO: 25432

SEQ ID NO: 65758 - DNA, 201 bp, Bos taurus; identical to SEQ ID NO: 25433

SEQ ID NO: 65759 - DNA, 201 bp, Bos taurus; identical to SEQ ID NO: 25434

SEQ ID NO: 65760 - DNA, 201 bp, Bos taurus; identical to SEQ ID NO: 25435

SEQ ID NO: 65761 - DNA, 201 bp, Bos taurus; identical to SEQ ID NO: 25436

SEQ ID NO: 65762 - DNA, 201 bp, Bos taurus; identical to SEQ ID NO: 25437

SEQ ID NO: 65763 - DNA, 201 bp, Bos taurus; identical to SEQ ID NO: 25438

SEQ ID NO: 65764 - DNA, 201 bp, Bos taurus; identical to SEQ ID NO: 25439

SEQ ID NO: 65765 - DNA, 201 bp, Bos taurus; identical to SEQ ID NO: 25440

SEQ ID NO: 65766 - DNA, 201 bp, Bos taurus; identical to SEQ ID NO: 25441

SEQ ID NO: 65767 - DNA, 201 bp, Bos taurus; identical to SEQ ID NO: 25442

SEQ ID NO: 65768 - DNA, 201 bp, Bos taurus; identical to SEQ ID NO: 25443

SEQ ID NO: 65769 - DNA, 201 bp, Bos taurus; identical to SEQ ID NO: 25444

SEQ ID NO: 65770 - DNA, 201 bp, Bos taurus; identical to SEQ ID NO: 25445

SEQ ID NO: 65771 - DNA, 201 bp, Bos taurus; identical to SEQ ID NO: 25446

SEQ ID NO: 65772 - DNA, 201 bp, Bos taurus; identical to SEQ ID NO: 25447

SEQ ID NO: 65773 - DNA, 201 bp, Bos taurus; identical to SEQ ID NO: 25448

SEQ ID NO: 65774 - DNA, 201 bp, Bos taurus; identical to SEQ ID NO: 25449

SEQ ID NO: 65775 - DNA, 201 bp, Bos taurus; identical to SEQ ID NO: 25450

SEQ ID NO: 65776 - DNA, 201 bp, Bos taurus; identical to SEQ ID NO: 25451

SEQ ID NO: 65777 - DNA, 201 bp, Bos taurus; identical to SEQ ID NO: 25452

SEQ ID NO: 65778 - DNA, 201 bp, Bos taurus; identical to SEQ ID NO: 25453

SEQ ID NO: 65779 - DNA, 201 bp, Bos taurus; identical to SEQ ID NO: 25454

SEQ ID NO: 65780 - DNA, 201 bp, Bos taurus; identical to SEQ ID NO: 25455

SEQ ID NO: 65781 - DNA, 201 bp, Bos taurus; identical to SEQ ID NO: 25456

SEQ ID NO: 65782 - DNA, 201 bp, Bos taurus; identical to SEQ ID NO: 25457

SEQ ID NO: 65783 - DNA, 201 bp, Bos taurus; identical to SEQ ID NO: 25458

SEQ ID NO: 65784 - DNA, 201 bp, Bos taurus; identical to SEQ ID NO: 25459

SEQ ID NO: 65785 - DNA, 201 bp, Bos taurus; identical to SEQ ID NO: 25460

SEQ ID NO: 65786 - DNA, 201 bp, Bos taurus; identical to SEQ ID NO: 25461

SEQ ID NO: 65787 - DNA, 201 bp, Bos taurus; identical to SEQ ID NO: 25462

SEQ ID NO: 65788 - DNA, 201 bp, Bos taurus; identical to SEQ ID NO: 25463

SEQ ID NO: 65789 - DNA, 201 bp, Bos taurus; identical to SEQ ID NO: 25464

SEQ ID NO: 65790 - DNA, 201 bp, Bos taurus; identical to SEQ ID NO: 25465

SEQ ID NO: 65791 - DNA, 201 bp, Bos taurus; identical to SEQ ID NO: 25466

SEQ ID NO: 65792 - DNA, 201 bp, Bos taurus; identical to SEQ ID NO: 25467

SEQ ID NO: 65793 - DNA, 201 bp, Bos taurus; identical to SEQ ID NO: 25468

SEQ ID NO: 65794 - DNA, 201 bp, Bos taurus; identical to SEQ ID NO: 25469

SEQ ID NO: 65795 - DNA, 201 bp, Bos taurus; identical to SEQ ID NO: 25471

SEQ ID NO: 65796 - DNA, 201 bp, Bos taurus; identical to SEQ ID NO: 25472

SEQ ID NO: 65797 - DNA, 201 bp, Bos taurus; identical to SEQ ID NO: 25474

SEQ ID NO: 65798 - DNA, 201 bp, Bos taurus; identical to SEQ ID NO: 25475

SEQ ID NO: 65799 - DNA, 201 bp, Bos taurus; identical to SEQ ID NO: 25476

SEQ ID NO: 65800 - DNA, 201 bp, Bos taurus; identical to SEQ ID NO: 25477

SEQ ID NO: 65801 - DNA, 201 bp, Bos taurus; identical to SEQ ID NO: 25478

SEQ ID NO: 65802 - DNA, 201 bp, Bos taurus; identical to SEQ ID NO: 25479

SEQ ID NO: 65803 - DNA, 201 bp, Bos taurus; identical to SEQ ID NO: 25480

SEQ ID NO: 65804 - DNA, 201 bp, Bos taurus; identical to SEQ ID NO: 25481

SEQ ID NO: 65805 - DNA, 201 bp, Bos taurus; identical to SEQ ID NO: 25483

SEQ ID NO: 65806 - DNA, 201 bp, Bos taurus; identical to SEQ ID NO: 25484

SEQ ID NO: 65807 - DNA, 201 bp, Bos taurus; identical to SEQ ID NO: 25487

SEQ ID NO: 65808 - DNA, 201 bp, Bos taurus; identical to SEQ ID NO: 25491

SEQ ID NO: 65809 - DNA, 201 bp, Bos taurus; identical to SEQ ID NO: 25492

SEQ ID NO: 65810 - DNA, 201 bp, Bos taurus; identical to SEQ ID NO: 25493

SEQ ID NO: 65811 - DNA, 201 bp, Bos taurus; identical to SEQ ID NO: 25495

SEQ ID NO: 65812 - DNA, 201 bp, Bos taurus; identical to SEQ ID NO: 25501

SEQ ID NO: 65813 - DNA, 201 bp, Bos taurus; identical to SEQ ID NO: 25504

SEQ ID NO: 65814 - DNA, 201 bp, Bos taurus; identical to SEQ ID NO: 25513

SEQ ID NO: 65815 - DNA, 201 bp, Bos taurus; identical to SEQ ID NO: 25515

SEQ ID NO: 65816 - DNA, 201 bp, Bos taurus; identical to SEQ ID NO: 25516

SEQ ID NO: 65817 - DNA, 201 bp, Bos taurus; identical to SEQ ID NO: 25518

SEQ ID NO: 65818 - DNA, 201 bp, Bos taurus; identical to SEQ ID NO: 25519

SEQ ID NO: 65819 - DNA, 201 bp, Bos taurus; identical to SEQ ID NO: 25522

SEQ ID NO: 65820 - DNA, 201 bp, Bos taurus; identical to SEQ ID NO: 25523

SEQ ID NO: 65821 - DNA, 201 bp, Bos taurus; identical to SEQ ID NO: 25526

SEQ ID NO: 65822 - DNA, 201 bp, Bos taurus; identical to SEQ ID NO: 25527

SEQ ID NO: 65823 - DNA, 201 bp, Bos taurus; identical to SEQ ID NO: 25528

SEQ ID NO: 65824 - DNA, 201 bp, Bos taurus; identical to SEQ ID NO: 25529

SEQ ID NO: 65825 - DNA, 201 bp, Bos taurus; identical to SEQ ID NO: 25530

SEQ ID NO: 65826 - DNA, 201 bp, Bos taurus; identical to SEQ ID NO: 25531

SEQ ID NO: 65827 - DNA, 201 bp, Bos taurus; identical to SEQ ID NO: 25534

SEQ ID NO: 65828 - DNA, 201 bp, Bos taurus; identical to SEQ ID NO: 25535

SEQ ID NO: 65829 - DNA, 201 bp, Bos taurus; identical to SEQ ID NO: 25536

SEQ ID NO: 65830 - DNA, 201 bp, Bos taurus; identical to SEQ ID NO: 25537

SEQ ID NO: 65831 - DNA, 201 bp, Bos taurus; identical to SEQ ID NO: 25539

SEQ ID NO: 65832 - DNA, 201 bp, Bos taurus; identical to SEQ ID NO: 25541

SEQ ID NO: 65833 - DNA, 201 bp, Bos taurus; identical to SEQ ID NO: 25542

SEQ ID NO: 65834 - DNA, 201 bp, Bos taurus; identical to SEQ ID NO: 25543

SEQ ID NO: 65835 - DNA, 201 bp, Bos taurus; identical to SEQ ID NO: 25544

SEQ ID NO: 65836 - DNA, 201 bp, Bos taurus; identical to SEQ ID NO: 25545

SEQ ID NO: 65837 - DNA, 201 bp, Bos taurus; identical to SEQ ID NO: 25547

SEQ ID NO: 65838 - DNA, 201 bp, Bos taurus; identical to SEQ ID NO: 25548

SEQ ID NO: 65839 - DNA, 201 bp, Bos taurus; identical to SEQ ID NO: 25551

SEQ ID NO: 65840 - DNA, 201 bp, Bos taurus; identical to SEQ ID NO: 25553

SEQ ID NO: 65841 - DNA, 201 bp, Bos taurus; identical to SEQ ID NO: 25554

SEQ ID NO: 65842 - DNA, 201 bp, Bos taurus; identical to SEQ ID NO: 25555

SEQ ID NO: 65843 - DNA, 201 bp, Bos taurus; identical to SEQ ID NO: 25556

SEQ ID NO: 65844 - DNA, 201 bp, Bos taurus; identical to SEQ ID NO: 25557

SEQ ID NO: 65845 - DNA, 201 bp, Bos taurus; identical to SEQ ID NO: 25558

SEQ ID NO: 65846 - DNA, 201 bp, Bos taurus; identical to SEQ ID NO: 25559

SEQ ID NO: 65847 - DNA, 201 bp, Bos taurus; identical to SEQ ID NO: 25561

SEQ ID NO: 65848 - DNA, 201 bp, Bos taurus; identical to SEQ ID NO: 25564

SEQ ID NO: 65849 - DNA, 201 bp, Bos taurus; identical to SEQ ID NO: 25565

SEQ ID NO: 65850 - DNA, 201 bp, Bos taurus; identical to SEQ ID NO: 25568

SEQ ID NO: 65851 - DNA, 201 bp, Bos taurus; identical to SEQ ID NO: 25570

SEQ ID NO: 65852 - DNA, 201 bp, Bos taurus; identical to SEQ ID NO: 25572

SEQ ID NO: 65853 - DNA, 201 bp, Bos taurus; identical to SEQ ID NO: 25574

SEQ ID NO: 65854 - DNA, 201 bp, Bos taurus
tcaacttctctccaccattcaaattaaatgcctcattttaatattgcacacacatcccaatgtctggagtatttaaaggaataattgtgaattttttcgaaggcttcataatattaggaaaccagagaacttttggttcttaacaaaaagttatttttagtttctttttttgggaagagagtgttggaaaggtttttattt

SEQ ID NO: 65855 - DNA, 201 bp, Bos taurus; identical to SEQ ID NO: 25577

SEQ ID NO: 65856 - DNA, 201 bp, Bos taurus; identical to SEQ ID NO: 25578

SEQ ID NO: 65857 - DNA, 201 bp, Bos taurus; identical to SEQ ID NO: 25581

SEQ ID NO: 65858 - DNA, 201 bp, Bos taurus; identical to SEQ ID NO: 25582

SEQ ID NO: 65859 - DNA, 201 bp, Bos taurus; identical to SEQ ID NO: 25583

SEQ ID NO: 65860 - DNA, 201 bp, Bos taurus
gcaaagtcaccaccaaatccacaaccccatgaaggcacacaacgtaagtgataactgaacaaggactgctcacacaggtaaacctcagatgccccacaaattccacgggggcccatctccccagatagagagcatgtgtgcacacagtgtggccatggtacagtgtggtgctccagcctgggcacatgggctgtgggaaca

SEQ ID NO: 65861 - DNA, 201 bp, Bos taurus
tcccttcactatgtggccaataagggtcaggggagaatctcaatggggtaaaccatttcactatcataaacagatcacagagcactattacagacaggccatttgtgtgcagtagcagaaaatgaccgggtgcaaaaggatacccgataaatgacagggagcgtgctacactggatctatgctggcctctttaacagtcta

SEQ ID NO: 65862 - DNA, 201 bp, Bos taurus
cacacccatgtaggtgcatcagacacaagtgggaggattcagagtcaatggggtcactgagaattcttaagaaaacattcaagtaaaaggagccatcactcaccaacaaggccacacaggtgctggatgagaggggctaaagaacaaaagacaacatagttattgaacagaggtcacaatctgagagtcttgcctgagccc

SEQ ID NO: 65863 - DNA, 201 bp, Bos taurus; identical to SEQ ID NO: 25586

SEQ ID NO: 65864 - DNA, 201 bp, Bos taurus
aggagttgatgaaacttcaaggggagaagaggtccgtggaggtggagcactcacgcctgcagaaggagatgtcacagatccagcagcaggtggtggatctcgaagggcacctgcagtccgcacagagggagcgtgatgaaatggagacgcagttacaggtttgggggtgtctttgatgtgtgagggttcagctgaatgtgc

SEQ ID NO: 65865 - DNA, 201 bp, Bos taurus; identical to SEQ ID NO: 25588

SEQ ID NO: 65866 - DNA, 201 bp, Bos taurus; identical to SEQ ID NO: 25590

SEQ ID NO: 65867 - DNA, 201 bp, Bos taurus; identical to SEQ ID NO: 25591

SEQ ID NO: 65868 - DNA, 201 bp, Bos taurus; identical to SEQ ID NO: 25596

SEQ ID NO: 65869 - DNA, 201 bp, Bos taurus
aaggaaataaattgttggcaatattttgtgaggtcatttgggaacctcctctgtgtcttggtttaaaagttttgtgcttaagagtttgtgaaagtcagattgatcagcttgggcaacagcttaaggctcttttcctgaatatagcagctggaagaaaaaagcaaaatcagtgagaagattctgtggtcgcctcaagtgcca

SEQ ID NO: 65870 - DNA, 201 bp, Bos taurus; identical to SEQ ID NO: 25597

SEQ ID NO: 65871 - DNA, 201 bp, Bos taurus
aaacatacgattgcctcaatttcgttctttctcaaatatacatacaggctcacattcacatgcactgctgaagggatcaaatttttcacagtgatttcacgtgcagtgattcaaagactgtggaaaccttcccagtctcatagcatcttcctctcaggagaatgcttctttctttaacctatattaaaaaaagcctcatat

SEQ ID NO: 65872 - DNA, 201 bp, Bos taurus; identical to SEQ ID NO: 25601

SEQ ID NO: 65873 - DNA, 201 bp, Bos taurus; identical to SEQ ID NO: 25602

SEQ ID NO: 65874 - DNA, 201 bp, Bos taurus; identical to SEQ ID NO: 25603

SEQ ID NO: 65875 - DNA, 201 bp, Bos taurus
ggattcgtcatctttgggggcccataagcccctcactctccagctccttgaaacccatggggacttggctgacctgtgctggctctgactagggtacctcacctgggactgctgtgatgggccagcaaaaggggtggaccgaggagggatagaggaacccaggttgcaacagcttcacgcagaagcaccagatctttctcc

SEQ ID NO: 65876 - DNA, 201 bp, Bos taurus
aattacaaaatggccccattctcttcttatatctataccttttgtgtgtgactttgcaattttcccttcaaaagtagaagtctgttgccccactccttgagtttagcttggccctgggttttctttggccagcagtatatggcagaagtgacaatgtgctaattccaaagccaggtctcaggagacattgcacacttgcac

SEQ ID NO: 65877 - DNA, 201 bp, Bos taurus
taattgtttagtgttatcaacatgccagttgctgtcactatttttgttcaggttgtttttacgaagattatcactcttcctcactctggcctggaaccaaaacacaaaggcactaagcaattcttgcagactggaaaaatgagaaatatttatgtcagttatatttgtcctgttagcatttcttggcagtggggtatgtga

SEQ ID NO: 65878 - DNA, 201 bp, Bos taurus
ccctatttttcaaataaggaaactgagactctttgaaaatggagcagaaacagagatggggcaagttgcactcagtggcaaggacaggatttgagagactagctactgataaatccaaggtttggtgagataaattcttgtgcagaataagacacacaggagcactcacagctggtacccatgggattccccattaggaag

SEQ ID NO: 65879 - DNA, 201 bp, Bos taurus; identical to SEQ ID NO: 25605

SEQ ID NO: 65880 - DNA, 201 bp, Bos taurus; identical to SEQ ID NO: 25606

SEQ ID NO: 65881 - DNA, 201 bp, Bos taurus
catccaaccatctcatcccctgttgccctcttctcctggcctcaatctttcccagcatcagggtctttttcaatgagtcgactcttctcatcaggtggccatatacactgagaaagtcttatttctctaggcaatcctcaggcgatcctgaggatttgatccctgatcagggaattaggatctcacatgacacagcatggc

SEQ ID NO: 65882 - DNA, 201 bp, Bos taurus; identical to SEQ ID NO: 25607

SEQ ID NO: 65883 - DNA, 201 bp, Bos taurus
caggatgagtgccagagacattctaggatttctgtctccttggagtgagcaccgcctgactaagcaagtggaatctgatggacaggtggcctctcctaggggcagttggattcccttcactcagaacagctttgggtctcccagaactcacctgtgttcttaggaggcccccggatacagggtgtctgggggcaaaaactc

SEQ ID NO: 65884 - DNA, 201 bp, Bos taurus
ttctttttctgaaaagtccaaagggtcagggccttgtccctgaccactggtctagagggtaggattcgacactctcactgccgtgacccaacccaatttccggccgggaaccaaagccctgcctcaagtcactgcaggccgagaccactctttctcagttcttgtgtccctcctgatgaccctgttcaaagtgactgctag

SEQ ID NO: 65885 - DNA, 201 bp, Bos taurus
tggcagaggcctggatgctgattaagtagctaactcggggaaattaaagatgctccagaaccttcatcttggcggctagagcctagctccgcaggtgacaaggatgtcgctccctggcccagagatggatggtaaacagatggaaggaactcactgatggggccactctcttgctcaccccacccatgatacaaaattcag

SEQ ID NO: 65886 - DNA, 201 bp, Bos taurus; identical to SEQ ID NO: 25608

SEQ ID NO: 65887 - DNA, 201 bp, Bos taurus; identical to SEQ ID NO: 25609

SEQ ID NO: 65888 - DNA, 201 bp, Bos taurus; identical to SEQ ID NO: 25611

SEQ ID NO: 65889 - DNA, 201 bp, Bos taurus; identical to SEQ ID NO: 25612

SEQ ID NO: 65890 - DNA, 201 bp, Bos taurus
aatcttcgcagccatttaaaaaaaaaaaatgaaattttccctctcatactgaggtgtaatcatcaagtctatcattttgcctaaaagattgtttttaatatagccagaatgtttggtggtcaagaaaaacagaaaagtattatttttatgcacaaagtcaagttacagtgtccagagacacagctttcctatagtgtagtc

SEQ ID NO: 65891 - DNA, 201 bp, Bos taurus
acactggcccctgaagcggagctgagtgcatcaggcagcagatgggttcttccaaacagctggtctctgcagactctgacccaaagcgtgtgtgttgggaggaggccgttaatctgatttggggtcacggtcagagccgacagctccaaggacagaaacccgggaacttgagatgttgctcatggtgggctctttgaggct

SEQ ID NO: 65892 - DNA, 201 bp, Bos taurus
gggtctaaacaatccttcattttcaaacctagtattatttttcccataaacatcctgttggaaaaaaatgggtccccattatactctaagtagtgtccctagagcctggacttggccttgctggctaattgagggacctcagtgacattggctggagtcactgctttcccttaaccactcagtacaggaagtctacaatct

SEQ ID NO: 65893 - DNA, 201 bp, Bos taurus; identical to SEQ ID NO: 25617

SEQ ID NO: 65894 - DNA, 201 bp, Bos taurus; identical to SEQ ID NO: 25619

SEQ ID NO: 65895 - DNA, 201 bp, Bos taurus; identical to SEQ ID NO: 25620

SEQ ID NO: 65896 - DNA, 201 bp, Bos taurus; identical to SEQ ID NO: 25628

SEQ ID NO: 65897 - DNA, 201 bp, Bos taurus; identical to SEQ ID NO: 25629

SEQ ID NO: 65898 - DNA, 201 bp, Bos taurus; identical to SEQ ID NO: 25630

SEQ ID NO: 65899 - DNA, 201 bp, Bos taurus; identical to SEQ ID NO: 25631

SEQ ID NO: 65900 - DNA, 201 bp, Bos taurus; identical to SEQ ID NO: 25632

SEQ ID NO: 65901 - DNA, 201 bp, Bos taurus; identical to SEQ ID NO: 25635

SEQ ID NO: 65902 - DNA, 201 bp, Bos taurus; identical to SEQ ID NO: 25639

SEQ ID NO: 65903 - DNA, 201 bp, Bos taurus; identical to SEQ ID NO: 25640

SEQ ID NO: 65904 - DNA, 201 bp, Bos taurus; identical to SEQ ID NO: 25641

SEQ ID NO: 65905 - DNA, 201 bp, Bos taurus; identical to SEQ ID NO: 25645

SEQ ID NO: 65906 - DNA, 201 bp, Bos taurus; identical to SEQ ID NO: 25652

SEQ ID NO: 65907 - DNA, 201 bp, Bos taurus; identical to SEQ ID NO: 25658

SEQ ID NO: 65908 - DNA, 201 bp, Bos taurus; identical to SEQ ID NO: 25659

SEQ ID NO: 65909 - DNA, 201 bp, Bos taurus; identical to SEQ ID NO: 25660

SEQ ID NO: 65910 - DNA, 201 bp, Bos taurus; identical to SEQ ID NO: 25661

SEQ ID NO: 65911 - DNA, 201 bp, Bos taurus; identical to SEQ ID NO: 25662

SEQ ID NO: 65912 - DNA, 201 bp, Bos taurus; identical to SEQ ID NO: 25663

SEQ ID NO: 65913 - DNA, 201 bp, Bos taurus; identical to SEQ ID NO: 25664

SEQ ID NO: 65914 - DNA, 201 bp, Bos taurus; identical to SEQ ID NO: 25669

SEQ ID NO: 65915 - DNA, 201 bp, Bos taurus; identical to SEQ ID NO: 25672

SEQ ID NO: 65916 - DNA, 201 bp, Bos taurus; identical to SEQ ID NO: 25673

SEQ ID NO: 65917 - DNA, 201 bp, Bos taurus; identical to SEQ ID NO: 25674

SEQ ID NO: 65918 - DNA, 201 bp, Bos taurus; identical to SEQ ID NO: 25675

SEQ ID NO: 65919 - DNA, 201 bp, Bos taurus
aggtgaggcatcacatgaccttgctcatcaggtccaggggcagtcaccaataagagtctttcctggaaaccagtaactggtgagaggcaaggcatgacagcggtggcatggtggggtaaaggtccatgagcctccatgaagacccaagagctacccttttcccttcctttcctggatctttattgtccagctatatgctga

SEQ ID NO: 65920 - DNA, 201 bp, Bos taurus
taatggatgtgtctcctttccctccccactctctggagtcagggacagggacaggatcccgtggagcttctgctgtggcccctctgcatcatgccccaacaatgctcttaggactttggcacggcagtgaccataactgtctatgatgatggccgagacggccaaagcctctctctgcagcccaaagggtccccagggccc

SEQ ID NO: 65921 - DNA, 201 bp, Bos taurus
tgttctttacaagcccccaagttcagcaaagctccaagcccttaaaaagaagtagaaaggcatcttgcaacacaattagagagattggttcaggggcctcgcacacagcactccatccggcaaagcctcaaagggtcccgggtggaccatttgctggctttcatttctcaggggctgcttcagcaggtggccactagcagg

SEQ ID NO: 65922 - DNA, 201 bp, Bos taurus; identical to SEQ ID NO: 25678

SEQ ID NO: 65923 - DNA, 201 bp, Bos taurus; identical to SEQ ID NO: 25679

SEQ ID NO: 65924 - DNA, 201 bp, Bos taurus; identical to SEQ ID NO: 25680

SEQ ID NO: 65925 - DNA, 201 bp, Bos taurus; identical to SEQ ID NO: 25681

SEQ ID NO: 65926 - DNA, 201 bp, Bos taurus; identical to SEQ ID NO: 25682

SEQ ID NO: 65927 - DNA, 201 bp, Bos taurus; identical to SEQ ID NO: 25683

SEQ ID NO: 65928 - DNA, 201 bp, Bos taurus; identical to SEQ ID NO: 25684

SEQ ID NO: 65929 - DNA, 201 bp, Bos taurus; identical to SEQ ID NO: 25685

SEQ ID NO: 65930 - DNA, 201 bp, Bos taurus; identical to SEQ ID NO: 25686

SEQ ID NO: 65931 - DNA, 201 bp, Bos taurus; identical to SEQ ID NO: 25687

SEQ ID NO: 65932 - DNA, 201 bp, Bos taurus; identical to SEQ ID NO: 25689

SEQ ID NO: 65933 - DNA, 201 bp, Bos taurus; identical to SEQ ID NO: 25690

SEQ ID NO: 65934 - DNA, 201 bp, Bos taurus; identical to SEQ ID NO: 25691

SEQ ID NO: 65935 - DNA, 201 bp, Bos taurus; identical to SEQ ID NO: 25692

SEQ ID NO: 65936 - DNA, 201 bp, Bos taurus
tgttcaacagtgaatatcccaggaatgtagcccagaggagagaggtgggttagagtttggggaaggttgtttagaaagagcaaagaaagcaaaaagaggcgagagagagacctggctgtttatgggcaaacaatggaccctggcccagaaccaggttcttgctccatcctcctgggtgggggatggtactgccatggaggt

SEQ ID NO: 65937 - DNA, 201 bp, Bos taurus; identical to SEQ ID NO: 25694

SEQ ID NO: 65938 - DNA, 201 bp, Bos taurus; identical to SEQ ID NO: 25695

SEQ ID NO: 65939 - DNA, 201 bp, Bos taurus
tcccagctgtcctccctttcatcattcaagtggctgaagtctgaccacatttgcaatgtaggtaggagtattcttagagctcagctctgaattcgcagctctcctaattcatgtcttactcttcaccctcatttttatagaaaactctttactagaacttcatatagtactaagtactacataatacataaaatgaatttc

SEQ ID NO: 65940 - DNA, 201 bp, Bos taurus
gagcttcccttccgagggctgccattctccccaggtcacaccccactgctgatccagccctggggcagctccaagcctccgggcatgagaaggggccctccggttttcctctgacctcccaggtccctgatcctggcttggacccagtcttaggtcccctctgaagcttcagttgagaagagcttgggactctggaggacc

SEQ ID NO: 65941 - DNA, 201 bp, Bos taurus
ggtggggtgacctttcctctccggcaaaagccccacccagggccctgccggagtcctcacaatcggcccccgatgtccactctggcaggcaggccggtctagacaagttgtgtgcggagggggcggggggaagggaaggggcagacaaggatgcttcaggatcccccacagcccagggcctctttatttccaatccggctg

SEQ ID NO: 65942 - DNA, 201 bp, Bos taurus; identical to SEQ ID NO: 25697

SEQ ID NO: 65943 - DNA, 201 bp, Bos taurus; identical to SEQ ID NO: 25700

SEQ ID NO: 65944 - DNA, 201 bp, Bos taurus
ggtgatgggctctggtttgggatgacctggggtttgaggtggacatctggggcggagcctagcagagggactgtcccgcctccgatgggcttgtgaacccgggccagaagagatgtattaatatctgagatgcttatgattggggcatggccttcctcccctgggtgaggcgttcagagtttctcagcccctgcccgtgag

SEQ ID NO: 65945 - DNA, 201 bp, Bos taurus; identical to SEQ ID NO: 25701

SEQ ID NO: 65946 - DNA, 201 bp, Bos taurus; identical to SEQ ID NO: 25702

SEQ ID NO: 65947 - DNA, 201 bp, Bos taurus
tcacacacacacacacaacttgggctggaatcttggcttcatcacttactagcattgagaaggtgaggaagccacttaccttttctaagctgcgggttccacactcataaaatgggatgaggatgacggtactcgctgctggagttgtttagggggttagttcacgtaatgcatgtagagcacttagccgggagtcaggcg

SEQ ID NO: 65948 - DNA, 201 bp, Bos taurus
ctgttattgttatattcattatccactgtatactttttgtgttcaggaacatagacttacaatattcttgtagtgtcctttttaaccagatagaataaaatagtacatggtttatatggacttccctcatagctcagttggtagagaatccacctgcaatgcaggagaccccggttcgattcctggggcaggaggatcccc

SEQ ID NO: 65949 - DNA, 201 bp, Bos taurus; identical to SEQ ID NO: 25705

SEQ ID NO: 65950 - DNA, 201 bp, Bos taurus; identical to SEQ ID NO: 25707

SEQ ID NO: 65951 - DNA, 201 bp, Bos taurus; identical to SEQ ID NO: 25709

SEQ ID NO: 65952 - DNA, 201 bp, Bos taurus; identical to SEQ ID NO: 25714

SEQ ID NO: 65953 - DNA, 201 bp, Bos taurus
taagagagactgtaaaaagaaagagaacttagacaacgaaggctccttgtctcacagaaagccccatccctaccaaggaatgtttctggcagatgcaggaccgaaaagagattctctggttaaacaggtttggtgagcattgtaaagaaagaatgaagcgactgtctttcctgcagggcaggttgccgtccttagcgtgtg

SEQ ID NO: 65954 - DNA, 201 bp, Bos taurus
tacttatcatcattcagaagaactctagttcccccttctcttgctcaccaccctcacacacacatgcagtgaattatacccctaggcgagtgggggagtggaatggtggggtcctgcctgggtattaaaaaaaaaaaacctgtaatagaaaactccaccagtcatttttccctcctttttgtatccatgagcaggtgcaca

SEQ ID NO: 65955 - DNA, 201 bp, Bos taurus
tgccttttgcatctagacagttgtacagttttaactcagaagcacttgtgaatcctgagtatctcacagcctggaattatctagtctctacttaggaggaggaacatgggtctcttcctagcttttcttccttcagtaaacacagtgatcaaacaaatgaggaggtttcacttccactagctcaacagcctgtgtgcacga

SEQ ID NO: 65956 - DNA, 201 bp, Bos taurus
tatttttggaaacaaattatctgtgtttaggttagttcagtatacccaaaattttccaaagttcttctgagcggtaaattctttatgatggggccaagcaaccaccaacacaggtacttactgcctctctctcagagccgatagcaaacttcctcttgctaatgatctttatggccactttcttacatgtcttcctctcga

SEQ ID NO: 65957 - DNA, 201 bp, Bos taurus
agacactttaccgtctgagccaccagggaagtaagtgctcaataaatgctcgttgctgatgtttgcttctttcgacttcttgtttttaacctcatgttctactccatctgggttaatatacaatgaggtgcaatggacacaaacattcggtgcattgcatctcattgtattgaacatgtttattttaaaaacattgtcagc

SEQ ID NO: 65958 - DNA, 201 bp, Bos taurus
ccagccgtgagttaccacatccttcattcatcggataaacttgtaccaaggcccattatgcagccacgcagcaggctcctggccagacgtctggggcagcgacaggtcttgctctcagtaggcttactgactagcgactccaaaaaggtccgggccacctgggtgggcagatacttagggtgttacccagaaggttctctg

SEQ ID NO: 65959 - DNA, 201 bp, Bos taurus; identical to SEQ ID NO: 25720

SEQ ID NO: 65960 - DNA, 201 bp, Bos taurus; identical to SEQ ID NO: 25721

SEQ ID NO: 65961 - DNA, 201 bp, Bos taurus
aaggaagaaggcaggtacccagatgccttacatcagaaggtgggagcatgaaggaaggccctgcccctgctgccggcccccgtgccgggcacgtcaccaccgtccagaactgagttctgtcctcactgcctgcctaaaaataggtgatgttgccacttcagaaataaggagccgagcagctggcctgagatcacccggggg

SEQ ID NO: 65962 - DNA, 201 bp, Bos taurus
gcgactgaacaagagggagcccgcaaacaagccagcagagaaccaaaggccatttacaaaagcagcagagtatgtgcccagagccttgtgccaaggcccgcatttcaaaacctaaggggctggaggaagaaggaaagcaggaactcatgctttccaaggacccactaaggtgccaggaagtggccttcccaccttccaccc

SEQ ID NO: 65963 - DNA, 201 bp, Bos taurus
atagttctggggaccgcacaaggctctggagagaaaagggcagagtagtaacagagggggccagggaaggcttggggcccactcacgcccagggatgtgcccgatgtgtgtgattcagcctcaatacaacctcccaggtcagtgctgtggccccccttcacgtcaggaggccaaggcgtggagcatcgccacggctgtgga

SEQ ID NO: 65964 - DNA, 201 bp, Bos taurus; identical to SEQ ID NO: 25722

SEQ ID NO: 65965 - DNA, 201 bp, Bos taurus; identical to SEQ ID NO: 25723

SEQ ID NO: 65966 - DNA, 201 bp, Bos taurus; identical to SEQ ID NO: 25724

SEQ ID NO: 65967 - DNA, 201 bp, Bos taurus; identical to SEQ ID NO: 25728

SEQ ID NO: 65968 - DNA, 201 bp, Bos taurus; identical to SEQ ID NO: 25730

SEQ ID NO: 65969 - DNA, 201 bp, Bos taurus; identical to SEQ ID NO: 25732

SEQ ID NO: 65970 - DNA, 201 bp, Bos taurus; identical to SEQ ID NO: 25733

SEQ ID NO: 65971 - DNA, 201 bp, Bos taurus; identical to SEQ ID NO: 25734

SEQ ID NO: 65972 - DNA, 201 bp, Bos taurus
gccagctgtcacataatccaagtacccacagcagcagaacctgccctcgtgcccagtccagacgggcctcctctgaggcctgcagaaggcagtcagcaagccagcaaggactccttcaggctgatcataagaaggaggtggggctgagcacggagagctttttgagagcttactgtggcctgagcactgggaaacagactg

SEQ ID NO: 65973 - DNA, 201 bp, Bos taurus; identical to SEQ ID NO: 25735

SEQ ID NO: 65974 - DNA, 201 bp, Bos taurus
cacagtcaagtgcctataggggaacgtggcaagactagtagtccgtggttctctctgcagtgtctgtaaagtcagattagagaacacctgggggctagcattggccgcttcccttcccaggagacaaatctggctctaaaacacagacatgcctataagaaaggcctgggattcaaatagttctcatcacggaaaattcct

SEQ ID NO: 65975 - DNA, 201 bp, Bos taurus; identical to SEQ ID NO: 25738

SEQ ID NO: 65976 - DNA, 201 bp, Bos taurus; identical to SEQ ID NO: 25739

SEQ ID NO: 65977 - DNA, 201 bp, Bos taurus
ggtggcaggagccccattgcaccagcccactgcccaccccgagatgtttgcagctcaatgccaggacagagatgatcattttgcaacatttaaagatatcgaatcactatgtcgtgcacctggaacttatatagcactgtaggtcaattatataattaaaagtacaataaaatttcggagagaagaggagaagaggtggag

SEQ ID NO: 65978 - DNA, 201 bp, Bos taurus; identical to SEQ ID NO: 25740

SEQ ID NO: 65979 - DNA, 201 bp, Bos taurus
gacagcaatcaactgttcttttgcatggctcaagtcttacccttagcatttcacagcctgtgcatggcattgggagttgatggtgaaagtactgaccaccgtttatcgtttactaagtgtgtcttgaatgtcagcttacagaatataacattttaaacagctggaagttttttaagaaggtaataaaaatggttttctatt

SEQ ID NO: 65980 - DNA, 201 bp, Bos taurus; identical to SEQ ID NO: 25742

SEQ ID NO: 65981 - DNA, 201 bp, Bos taurus; identical to SEQ ID NO: 25743

SEQ ID NO: 65982 - DNA, 201 bp, Bos taurus
agtgactaaacaccaccaccacattcctttgatgccaaggcagtgcattcactttacattccaccactgagattcatttccatgaagttttaaaaatgcatagacaacagatgccatattcttcttctgtagatctggtgagcaaaggctcatagtggcagatacgaggttgccctccctggtttattcacttcagaagcc

SEQ ID NO: 65983 - DNA, 201 bp, Bos taurus
cttttaatttcatggctgcaacaccatctgcaatacagtttgatgagtctgaacatatgcaaacactcagggtaccatcaccacaaggaagtggttgtatccaacatctcccaaattttaaaaaagtcaacctggatagtaggagatccacaaatggaagcagatggtaacaagcaggtagtaagcagaattctaaaacag

SEQ ID NO: 65984 - DNA, 201 bp, Bos taurus; identical to SEQ ID NO: 25744

SEQ ID NO: 65985 - DNA, 201 bp, Bos taurus; identical to SEQ ID NO: 25746

SEQ ID NO: 65986 - DNA, 201 bp, Bos taurus; identical to SEQ ID NO: 25747

SEQ ID NO: 65987 - DNA, 201 bp, Bos taurus
ggccttcagttgagattttggtggctaggtacagtgcaaagtggaatttaggggaggaggtaaaaagttccatagagactgtgagtcagacaatcaaccatgaggcccagacaatcaacatgagttccaccgcccaagcccccagggcttcaaccggtcaaggttctgtgaatgtcctgccttcactttttccaagcacta

SEQ ID NO: 65988 - DNA, 201 bp, Bos taurus
aagtggccattaacaagcctgtctgtttggcttgtggtggaaaggctctaatggactggggacgtttattttcccagactgatttacagcaagaggccacatgaagctgctggaatgagaccaatcggatgaaaaatagttgcagccagtcatggctccattggctgatctgaaaatgggccgagggcgggccacgctaga

SEQ ID NO: 65989 - DNA, 201 bp, Bos taurus; identical to SEQ ID NO: 25748

SEQ ID NO: 65990 - DNA, 201 bp, Bos taurus; identical to SEQ ID NO: 25749

SEQ ID NO: 65991 - DNA, 201 bp, Bos taurus; identical to SEQ ID NO: 25750

SEQ ID NO: 65992 - DNA, 201 bp, Bos taurus; identical to SEQ ID NO: 25752

SEQ ID NO: 65993 - DNA, 201 bp, Bos taurus; identical to SEQ ID NO: 25753

SEQ ID NO: 65994 - DNA, 201 bp, Bos taurus; identical to SEQ ID NO: 25754

SEQ ID NO: 65995 - DNA, 201 bp, Bos taurus; identical to SEQ ID NO: 25755

SEQ ID NO: 65996 - DNA, 201 bp, Bos taurus; identical to SEQ ID NO: 25756

SEQ ID NO: 65997 - DNA, 201 bp, Bos taurus; identical to SEQ ID NO: 25759

SEQ ID NO: 65998 - DNA, 201 bp, Bos taurus; identical to SEQ ID NO: 25761

SEQ ID NO: 65999 - DNA, 201 bp, Bos taurus; identical to SEQ ID NO: 25764

SEQ ID NO: 66000 - DNA, 201 bp, Bos taurus
cttgctctcacactcgccagctgtgtgagtttcctgtgacagagaaccacaaactgggtggcatcagcacaagtgtgccatctctcgggtgtcagggtgcaggcaggtgccttcctggcctcttgcagcttctgggggctgccgtgctgcttggcgtccctctgctggtgggagcctttctcctgtccctgctcccgtcct

SEQ ID NO: 66001 - DNA, 201 bp, Bos taurus
tgtcccttgcattgcaaggtggattcctaaccactggacccccaggggagccctggatgatgttcatgttatgtctagaccatgttttgcttatctcctcattcatcagcggccacttgggttgcttctacatcttggctaactgtgaataatactgctaatgctgctgtgcaagtatctgttcttaatcccgttttgact

SEQ ID NO: 66002 - DNA, 201 bp, Bos taurus
cacacagtgcctgacaccctgttcctcctggggggctcttagcatcattcctggggtgctaacagacagtgggcacccctctcccggcctgcgttccatgcgatagctgctttttaggaataatcctcaggtggagcaaccagggggtaaaggaatatttcctgacacacgattttcttttcctctttgagcagacctggc

SEQ ID NO: 66003 - DNA, 201 bp, Bos taurus
gtgatgagaagagatggaagatcagagcaccttggtacctctcgttaccaagtaaaacatgcagggagctgggccaggcccttccgatcgctgtgtgccccctacgggctcctgccggatggcagggaagccagcacagccctttacctggacttggccgttgttttcctgatgcaggcgctccccaaggctgtcggggcg

SEQ ID NO: 66004 - DNA, 201 bp, Bos taurus; identical to SEQ ID NO: 25769

SEQ ID NO: 66005 - DNA, 201 bp, Bos taurus
aggacaagacttttgttttctttgtcttagtagccccagaaccttggcatcctcatcacctcacagtgaatctgcaggtagcaagtggccacagatgaccgctcaactgacctaacttaacttaaagctttatttccaactgtaccagttattcatttgttggccatgccactgattttttttttaaccaagtaagaagaa

SEQ ID NO: 66006 - DNA, 201 bp, Bos taurus; identical to SEQ ID NO: 25776

SEQ ID NO: 66007 - DNA, 201 bp, Bos taurus; identical to SEQ ID NO: 25777

SEQ ID NO: 66008 - DNA, 201 bp, Bos taurus; identical to SEQ ID NO: 25779

SEQ ID NO: 66009 - DNA, 201 bp, Bos taurus
ccgccgggagcgggagcccaccagaccgagccgggggcccggcggttctcaccccgatgaggtagatcttgtccaggctgaagttcgggatgatggtgaccagctccttctcggccagaaactccacctccgctgcatccatggcgtcgccaccggccgacccagggctcgccgccgccgcctcaggtccctcagtttccg

SEQ ID NO: 66010 - DNA, 201 bp, Bos taurus; identical to SEQ ID NO: 25780

SEQ ID NO: 66011 - DNA, 201 bp, Bos taurus; identical to SEQ ID NO: 25781

SEQ ID NO: 66012 - DNA, 201 bp, Bos taurus; identical to SEQ ID NO: 25782

SEQ ID NO: 66013 - DNA, 201 bp, Bos taurus; identical to SEQ ID NO: 25785

SEQ ID NO: 66014 - DNA, 201 bp, Bos taurus; identical to SEQ ID NO: 25786

SEQ ID NO: 66015 - DNA, 201 bp, Bos taurus; identical to SEQ ID NO: 25787

SEQ ID NO: 66016 - DNA, 201 bp, Bos taurus; identical to SEQ ID NO: 25788

SEQ ID NO: 66017 - DNA, 201 bp, Bos taurus
cttctagaaacattcagacagcagatgaagttgctttgttatccataatagtgataataagtcatggtgataataagatatcatcaccaccatcaccatctgatcgttggatctgcccagcacacctgtgctaggaacttctactcggcagacaggaatctctgaagccctgagagtaacctatcctgagttctgcctcct

SEQ ID NO: 66018 - DNA, 201 bp, Bos taurus; identical to SEQ ID NO: 25791

SEQ ID NO: 66019 - DNA, 201 bp, Bos taurus; identical to SEQ ID NO: 25796

SEQ ID NO: 66020 - DNA, 201 bp, Bos taurus; identical to SEQ ID NO: 25798

SEQ ID NO: 66021 - DNA, 201 bp, Bos taurus; identical to SEQ ID NO: 25799

SEQ ID NO: 66022 - DNA, 201 bp, Bos taurus
aatataatttgattaagacattttacatgcctggtagtggtggttcatttgtagaaatgatttcagatctgaggaaaacagctacattgaaagagtttctgggcagtcgaaaaggacaatgtgaacaaaacttaattaggagtacaggctaatggaatcgagagggaggcaggatgaattcattacattaataataacctg

SEQ ID NO: 66023 - DNA, 201 bp, Bos taurus
gtgggggcaggtggtgatagatgaataggaagaactcagaggatttttagggcagtgagaatactctgtgtatcacgatgacagcatatgttgtttgctcaagcccatacaatatacaacaccaagagtgaatcctaaagtgaactatggactttgggttgttacgatatgttcatctttaataaaaatcatatagaataa

SEQ ID NO: 66024 - DNA, 201 bp, Bos taurus; identical to SEQ ID NO: 25800

SEQ ID NO: 66025 - DNA, 201 bp, Bos taurus
gatggctgatagcaggctgctcttgccactccctgtgttgccacagacccctagcatggtaccctgcaaagccaaggagaacagacaggcgttgggacaggtgacttgcccaggacaggtctattgtctgttatgcaaaatgacaaacagaaaacagctacacgcaccccaaggcccctcagacaaagctcaagaggagct

SEQ ID NO: 66026 - DNA, 201 bp, Bos taurus; identical to SEQ ID NO: 25801

SEQ ID NO: 66027 - DNA, 201 bp, Bos taurus
ttgtgatctgagatgagagggcagcagcggctgaatcatgaactcctggggtacttgaactgattctctcgagcaccaccctccgtccaaagacccggccctgcaagaggaaatggatggaagagaattgagccaggaggtcagaactgctttgcttgcaaaggggagacgcccccaggctcgtgttggagcatccattgc

SEQ ID NO: 66028 - DNA, 201 bp, Bos taurus; identical to SEQ ID NO: 25804

SEQ ID NO: 66029 - DNA, 201 bp, Bos taurus; identical to SEQ ID NO: 25808

SEQ ID NO: 66030 - DNA, 201 bp, Bos taurus
gctgtcatgttttgtctccgacggccgctggggaggagaagatggagaagcgaaccagaggtaggcagtggagggcagccatggggtggcatggggagcttgataaatccagctaatctgtggccagcactgaggcctggcgctcctaattgcccctggtccaggagcagcactcagggtgaggatgctggggcgcaaatc

SEQ ID NO: 66031 - DNA, 201 bp, Bos taurus
ggctgagctgctacacacgcccggcttggccagccagggccgggcgccccgcagcatccattgtcgcactctcaaccaggcccaaaggctcagagagcttgcaggtgacccatggtgcagctcctggggaggggaaccaaaattcacagccaggcccctccctgcccccaggccctgaggaaggtgagaaaaagatggagg

SEQ ID NO: 66032 - DNA, 201 bp, Bos taurus
tgaaaagggccctgtgagatgatctagtccaaccacccggctggaaagatgggggaactgatgtctggatgggaatagacttgcccaaggttatattcccaagtaatgacagagctggcctgaaaccaaggctcccaattccgacttaggtagtgaagaaatgttcgttggggtgggggtgggggtggggggatgggggag

SEQ ID NO: 66033 - DNA, 201 bp, Bos taurus
accatctcggggacaggaagtgactggctctctctcctgtgtctccttgagggaaatagaccatcggctagaaagacccctagcccatcccacaccccttcttgggcagaactgagagtaggccggctcaacaccagttatcggtgagagaaacagaattaccatgatggatttagattggttgatttgttctgaagctga

SEQ ID NO: 66034 - DNA, 201 bp, Bos taurus; identical to SEQ ID NO: 25812

SEQ ID NO: 66035 - DNA, 201 bp, Bos taurus
tggcatcgagagcgcggggttgtaatcttaccatcggtgccttgggggtgtatcggttgatcggttttggagtgtgtggctcccgtccaggaagagcagtcggggttctggcctcgttaatggcgtgttatgctttttctttcagtttccccctttccagggtgagaatgcttttacacaacaacctggagttctttagtt

SEQ ID NO: 66036 - DNA, 201 bp, Bos taurus
gtaaaacaggagatccttgggggcaagtcctgtgttttgatgaccatttggcccccaagtactcacctagaatatagtaggcctggagtaaatgtttgataaaggaaggaaaggagaaaaggaaggaagggagagagggaaggaagaaggaaggagaaaagctcagggaacagtggagactatgtccttggcccagcgtgg

SEQ ID NO: 66037 - DNA, 201 bp, Bos taurus
ggcctgtgttagaagtggagaggcttgggatcatttccttatgcgacatcaggttcctctaggaatgctcagcccagaacgggcaggtggcagtctggagcaccctggaaactggctgcagggaaataaggaggatgtggatgctgatggtctgattcccctccacagcagggaccctttcccagcccctcccacaaaggc

SEQ ID NO: 66038 - DNA, 201 bp, Bos taurus; identical to SEQ ID NO: 25814

SEQ ID NO: 66039 - DNA, 201 bp, Bos taurus; identical to SEQ ID NO: 25815

SEQ ID NO: 66040 - DNA, 201 bp, Bos taurus; identical to SEQ ID NO: 25816

SEQ ID NO: 66041 - DNA, 201 bp, Bos taurus
gagggcctccttttcagaagaattctcctttggacaaaattccttccaggaatcttctatctagttttccatttcaccagccccctacattaagttaccccactccttccccatgatacatgaacttgagttgtgtactttaacttctgagagttaagtatcatgccaatggttcatcaacccactgatgtccactagcaa

SEQ ID NO: 66042 - DNA, 201 bp, Bos taurus; identical to SEQ ID NO: 25817

SEQ ID NO: 66043 - DNA, 201 bp, Bos taurus; identical to SEQ ID NO: 25818

SEQ ID NO: 66044 - DNA, 201 bp, Bos taurus; identical to SEQ ID NO: 25819

SEQ ID NO: 66045 - DNA, 201 bp, Bos taurus; identical to SEQ ID NO: 25820

SEQ ID NO: 66046 - DNA, 201 bp, Bos taurus; identical to SEQ ID NO: 25821

SEQ ID NO: 66047 - DNA, 201 bp, Bos taurus; identical to SEQ ID NO: 25822

SEQ ID NO: 66048 - DNA, 201 bp, Bos taurus; identical to SEQ ID NO: 25825

SEQ ID NO: 66049 - DNA, 201 bp, Bos taurus; identical to SEQ ID NO: 25826

SEQ ID NO: 66050 - DNA, 201 bp, Bos taurus
tttattccctgagacggtctgacccacagccgacactccgaaatggaaaagaccttccaggcagtcagcatttgagcacatttcccgcctgcggcctgtattgacctcacctcaagtcaaaactcacaggaacgctagacttggatgatccgggacatggaaactttcaatcctaaagtgtgccccctcctcactgagact

SEQ ID NO: 66051 - DNA, 201 bp, Bos taurus
agtgaacgggcctgactattcttgttaaacttcacagaagcaggtgatgggactgatttgcctatgggctagagtggggttcacggacttgaatgcctgtcgggggccaggcaggtatcttaatggagtcacgtggctgacggaactgccacttgtgccttgtctgaaagatgcagctacttcttacttatggccacttgt

SEQ ID NO: 66052 - DNA, 201 bp, Bos taurus
tgctgatatcagtcatgacaatttctaatatctattgagcattttgtgtgtgccaggcgttgggcagaatacttgtgctggataatctcatgtaatcgtctcaagaagtctagatgctgttacatagaccccttgacagatgagaagacggatcaaagaaaggtttgccctgaattcttttctcacagacattcctgatta

SEQ ID NO: 66053 - DNA, 201 bp, Bos taurus
aggggttctgtccttaggttatcttttgagggatggccctgggtggtgacaggtcaaccttaaggtgacctttttttttttaaacagaggccgtagccccataaaagttttcttctcccctggcttcagctaggctggcatttctgacagacgtgtaaacagatgccagcattgtcgctaatgacaggtgattataagagg

SEQ ID NO: 66054 - DNA, 201 bp, Bos taurus
ttgcacctgggaagcctgttatctcggtatcaaatgtgatggtaacatatcgttctggaactaagtaggagatacagcgtgaaccactggggtgacaggacaggccaaccagttaggcgttacaaaaacaaagactggatcacagggagcccccagatcctcttcccatgattgcacacccctgctctgtatccagttacc

SEQ ID NO: 66055 - DNA, 201 bp, Bos taurus; identical to SEQ ID NO: 25829

SEQ ID NO: 66056 - DNA, 201 bp, Bos taurus
tcctgatcttgactgtgttgtcttataatccaaccaaatttaactgacattgagcatttctgatctgaacagttaacatggaaatttggcccaaataactttatatacattctgaacatgaactcggttcaggcatcagaaatgatggggaagacccctcccactaccatccagggagccaggcagggggcccctggtggg

SEQ ID NO: 66057 - DNA, 201 bp, Bos taurus; identical to SEQ ID NO: 25830

SEQ ID NO: 66058 - DNA, 201 bp, Bos taurus; identical to SEQ ID NO: 25832

SEQ ID NO: 66059 - DNA, 201 bp, Bos taurus
ggcccagtgaacttcgggcaagtttattagcttttctgttctttatctataaaatggcttaacaataatacctactttatagggtgagaattatgttagcatgcctaagtatttagaagggtacctgcacttaagtgttctagtaattttctttttgtctgctgccaaattttcaaggaatgattatagtaccattgtaaa

SEQ ID NO: 66060 - DNA, 201 bp, Bos taurus; identical to SEQ ID NO: 25833

SEQ ID NO: 66061 - DNA, 201 bp, Bos taurus
ggaacctgcggcccagagaagcctagagagcggcccccaaccccatcctgaggtctccagcttccttggagcaccgtggtttcctcccaagtggcacatcaccccagggcctgtggtctctccctttgcagaagttcgtgagcacaaccatccggcccacactgatgccctaccctgagctctacaactgggacacctgtg

SEQ ID NO: 66062 - DNA, 201 bp, Bos taurus
cttagggctggcacgtgcccaccagcaacccactacagagagcagcagaaggaagccgacgccaccccggctgtgctaatcctcacaggaggtgcaccccggggccgtgacctcattaccaaagccgcctctaggtggcaatttctcccctgccttcataaagagcaaccccacactgggtggcctggtcctcacggcctt

SEQ ID NO: 66063 - DNA, 201 bp, Bos taurus; identical to SEQ ID NO: 25838

SEQ ID NO: 66064 - DNA, 201 bp, Bos taurus; identical to SEQ ID NO: 25839

SEQ ID NO: 66065 - DNA, 201 bp, Bos taurus; identical to SEQ ID NO: 25840

SEQ ID NO: 66066 - DNA, 201 bp, Bos taurus; identical to SEQ ID NO: 25842

SEQ ID NO: 66067 - DNA, 201 bp, Bos taurus
aggggagtgcccaccctcgaggcccagagcaggtttcccagagtgagcttggatgtttccaggcagaggtccgaaagccgggaagggtttgaggaggatttggggaggctgggccagctcatggagctccagggcaggagggtatgctgagatgtgagcaggggtgggcggtgtgtggagctaacgataagctggtgtcct

SEQ ID NO: 66068 - DNA, 201 bp, Bos taurus; identical to SEQ ID NO: 25845

SEQ ID NO: 66069 - DNA, 201 bp, Bos taurus; identical to SEQ ID NO: 25846

SEQ ID NO: 66070 - DNA, 201 bp, Bos taurus
aagagtcagacaagacagagcgactttcactgttcacttttacttttcattgtattcatcagtaataagagagtaattccaggggattttttagtggatgaagtaaaatattattcacagtgcctagaaatcatagaaaacaaaaataagcaagcaaaacccaaaacctctggattgtattgaagtttcaagaaaccatca

SEQ ID NO: 66071 - DNA, 201 bp, Bos taurus
caccttttcctcctccacaggtgctcgggaaccacttctcaattgaattgtgctagatatattagatattggctgcaagtaacaaaacattcaactttgcatagcttaaacaatgcattctttttcttggagaacaagaaatccctatgtgcatggtttgggtcagtgattgggcagcttacagatgtattcagtgatact

SEQ ID NO: 66072 - DNA, 201 bp, Bos taurus; identical to SEQ ID NO: 25848

SEQ ID NO: 66073 - DNA, 201 bp, Bos taurus; identical to SEQ ID NO: 25849

SEQ ID NO: 66074 - DNA, 201 bp, Bos taurus; identical to SEQ ID NO: 25850

SEQ ID NO: 66075 - DNA, 201 bp, Bos taurus; identical to SEQ ID NO: 25851

SEQ ID NO: 66076 - DNA, 201 bp, Bos taurus; identical to SEQ ID NO: 25852

SEQ ID NO: 66077 - DNA, 201 bp, Bos taurus; identical to SEQ ID NO: 25853

SEQ ID NO: 66078 - DNA, 201 bp, Bos taurus; identical to SEQ ID NO: 25854

SEQ ID NO: 66079 - DNA, 201 bp, Bos taurus
aaaacccttatgatgagaagaacacagaccccatttgcaaagacttatttgcaatacattttcagagaataagcatttcaatagcaggtgaaaaataaaacagctgaaccttccacactagctgaaactcagaaaggtgtgcataactggccctcccaggaacatctcccaaatctgacttgccctttcagctatcctggg

SEQ ID NO: 66080 - DNA, 201 bp, Bos taurus
aagttcctaaaacgtccattatgtttttcttaaaataaaaatgcatattactttttctttcttactggtgagagaaactaaggtacaaaaacatgttctacttgttcaaggtcatgaagtaagcaaaaggcagtagagatagtaagcttaatctacctaccaaagggctttttttcttttacatttactctctttcttcgt

SEQ ID NO: 66081 - DNA, 201 bp, Bos taurus; identical to SEQ ID NO: 25856

SEQ ID NO: 66082 - DNA, 201 bp, Bos taurus; identical to SEQ ID NO: 25857

SEQ ID NO: 66083 - DNA, 201 bp, Bos taurus
tagcatcaaggttgatttaaaaaaaaaaaaaagaaagtaagaaagaaaaagcttccaggatctcaccaaataaatacatttggaaaagaatccatctctcagcttatgtgaaaataatgaaaagatgcacagtgatgacacatttcaggaataaatttgaagggaattgtttcatacaatttcacaaagggaccttaggga

SEQ ID NO: 66084 - DNA, 201 bp, Bos taurus
agaaggggtacatacaattgatataaagtgagacttgagacagtttcctaataattataattaatgctagaaattactgttaggctctataataatctgcaactaatattaaatatagttattcctatcatctgcaacctcaaacctccagttttggtaaagcagctgaatcttgaggtttgttcatcatgatatgtgctc

SEQ ID NO: 66085 - DNA, 201 bp, Bos taurus; identical to SEQ ID NO: 25858

SEQ ID NO: 66086 - DNA, 201 bp, Bos taurus; identical to SEQ ID NO: 25859

SEQ ID NO: 66087 - DNA, 201 bp, Bos taurus; identical to SEQ ID NO: 25860

SEQ ID NO: 66088 - DNA, 201 bp, Bos taurus; identical to SEQ ID NO: 25861

SEQ ID NO: 66089 - DNA, 201 bp, Bos taurus
ggcctcagtttccccctctgtcaaatgggcaccctgacaacaccactttacagggggtgggaggctttcatgagatggagatagagcgtgcctctgatgccctgctgctgatcattacggcccacgtctcactctggtctttgaaaggaccactgagagcctgtattcctaacccgcagcccctgccttaactctggtgca

SEQ ID NO: 66090 - DNA, 201 bp, Bos taurus
atatggacacctggataattcacttaaaatgcaggtccccaggcccaactcacataaactgtgctacatgagatttggggtcaggctcagagttgcatctgttaacaacaccccaggccatctggataatggtagtcaaaagactgtgctccaagaaacaataccacatgttcaatgctgctcttttttctcttatataat

SEQ ID NO: 66091 - DNA, 201 bp, Bos taurus; identical to SEQ ID NO: 25863

SEQ ID NO: 66092 - DNA, 201 bp, Bos taurus; identical to SEQ ID NO: 25864

SEQ ID NO: 66093 - DNA, 201 bp, Bos taurus; identical to SEQ ID NO: 25865

SEQ ID NO: 66094 - DNA, 201 bp, Bos taurus
gtgggaattcaaggacagcaataaagagttctggagtgtggggcacgctgaggtcaagctcattagcttggtaagttgggcctgtatccctgggtgggagtgggatgtccaaagatgggaggaaggagaaggagttggctccctggggctcctgtggcctgagccctttgccatggctcaaagggcatgtctcccggcagg

SEQ ID NO: 66095 - DNA, 201 bp, Bos taurus
agattaatcaggaggccatgaaaacagcccagtggagaagctatagaggctggaggtgcagtggaggaagaatagagaggaaggccagattaaagagatgcttaagagcagtagaaccatgggatgagggaaaaggaggaaggatcctacttaggggccagggtggacagtgactgtcaacagagactgggaacacatgag

SEQ ID NO: 66096 - DNA, 201 bp, Bos taurus; identical to SEQ ID NO: 25875

SEQ ID NO: 66097 - DNA, 201 bp, Bos taurus; identical to SEQ ID NO: 25878

SEQ ID NO: 66098 - DNA, 201 bp, Bos taurus; identical to SEQ ID NO: 25879

SEQ ID NO: 66099 - DNA, 201 bp, Bos taurus
atgcacccttctgagttttacaattaggcaacttgttccataatctattgtttcactttttgaatagggaggaaacaacccaaatcatcaccaggtacctgagcatgaacaatggatgttctctttaggtgtaaagtatgtctgccaaggactgacagcaaaatggggatagatggtcacattcttgtattattttagggg

SEQ ID NO: 66100 - DNA, 201 bp, Bos taurus
tttggaaggacttgggcttggaccttgaatgaaaggattagccgttagaagatcttgagcagaagagagatggtggcttcggagttgagaacagaggccagaagtagacatcctactgctgtaatctgggttagtgatgacatcagctctgaccagcagccctgggggtgctaagaagtggcccaccctccagtagcactg

SEQ ID NO: 66101 - DNA, 201 bp, Bos taurus; identical to SEQ ID NO: 25881

SEQ ID NO: 66102 - DNA, 201 bp, Bos taurus
caccaagttggggatcaataagaaatcagcaaaaactaatttcaaagcagctacttgcagtatgaaacgttaagtgaagatatgacccaaagaggccaaggtttagtttgaaagaatagttttataagaccatcatgtaaagtcctcttcctaaaggcaaagatgtctaacatgagtccattggcattttgctgaggccac

SEQ ID NO: 66103 - DNA, 201 bp, Bos taurus; identical to SEQ ID NO: 25883

SEQ ID NO: 66104 - DNA, 201 bp, Bos taurus; identical to SEQ ID NO: 25884

SEQ ID NO: 66105 - DNA, 201 bp, Bos taurus
agatccttaatttaattacatttgcaaagttctttctgccatgtaatgtgacatattcacaggttctgggcattagcacgtggatctctttggggcctctattcagcccaccacaggtggaaaccattgtgggaactgtatgagtgcaggaaagcccagcagagattaggaggccgcctgtggtacccactgcctctcgtt

SEQ ID NO: 66106 - DNA, 201 bp, Bos taurus
tttccgtattactattctttttatggaggagggctttccaggaagcatagaactggacaagcctaaggggtggcccctctggaaggaaaggacacttggactgtacttggagaaaaactcagatcctcatcttggcctgtggacctgcaagactggcttctacagcacctttaaccttacttgttacacctcctgcctcca

SEQ ID NO: 66107 - DNA, 201 bp, Bos taurus; identical to SEQ ID NO: 25885

SEQ ID NO: 66108 - DNA, 201 bp, Bos taurus; identical to SEQ ID NO: 25886

SEQ ID NO: 66109 - DNA, 201 bp, Bos taurus; identical to SEQ ID NO: 25887

SEQ ID NO: 66110 - DNA, 201 bp, Bos taurus; identical to SEQ ID NO: 25888

SEQ ID NO: 66111 - DNA, 201 bp, Bos taurus; identical to SEQ ID NO: 25889

SEQ ID NO: 66112 - DNA, 201 bp, Bos taurus; identical to SEQ ID NO: 25890

SEQ ID NO: 66113 - DNA, 201 bp, Bos taurus; identical to SEQ ID NO: 25891

SEQ ID NO: 66114 - DNA, 201 bp, Bos taurus; identical to SEQ ID NO: 25892

SEQ ID NO: 66115 - DNA, 201 bp, Bos taurus; identical to SEQ ID NO: 25893

SEQ ID NO: 66116 - DNA, 201 bp, Bos taurus; identical to SEQ ID NO: 25894

SEQ ID NO: 66117 - DNA, 201 bp, Bos taurus; identical to SEQ ID NO: 25895

SEQ ID NO: 66118 - DNA, 201 bp, Bos taurus; identical to SEQ ID NO: 25896

SEQ ID NO: 66119 - DNA, 201 bp, Bos taurus; identical to SEQ ID NO: 25897

SEQ ID NO: 66120 - DNA, 201 bp, Bos taurus; identical to SEQ ID NO: 25898

SEQ ID NO: 66121 - DNA, 201 bp, Bos taurus; identical to SEQ ID NO: 25899

SEQ ID NO: 66122 - DNA, 201 bp, Bos taurus; identical to SEQ ID NO: 25902

SEQ ID NO: 66123 - DNA, 201 bp, Bos taurus; identical to SEQ ID NO: 25903

SEQ ID NO: 66124 - DNA, 201 bp, Bos taurus; identical to SEQ ID NO: 25906

SEQ ID NO: 66125 - DNA, 201 bp, Bos taurus; identical to SEQ ID NO: 25907

SEQ ID NO: 66126 - DNA, 201 bp, Bos taurus; identical to SEQ ID NO: 25909

SEQ ID NO: 66127 - DNA, 201 bp, Bos taurus; identical to SEQ ID NO: 25911

SEQ ID NO: 66128 - DNA, 201 bp, Bos taurus; identical to SEQ ID NO: 25912

SEQ ID NO: 66129 - DNA, 201 bp, Bos taurus; identical to SEQ ID NO: 25913

SEQ ID NO: 66130 - DNA, 201 bp, Bos taurus; identical to SEQ ID NO: 25914

SEQ ID NO: 66131 - DNA, 201 bp, Bos taurus; identical to SEQ ID NO: 25920

SEQ ID NO: 66132 - DNA, 201 bp, Bos taurus; identical to SEQ ID NO: 25921

SEQ ID NO: 66133 - DNA, 201 bp, Bos taurus; identical to SEQ ID NO: 25922

SEQ ID NO: 66134 - DNA, 201 bp, Bos taurus; identical to SEQ ID NO: 25923

SEQ ID NO: 66135 - DNA, 201 bp, Bos taurus; identical to SEQ ID NO: 25927

SEQ ID NO: 66136 - DNA, 201 bp, Bos taurus; identical to SEQ ID NO: 25931

SEQ ID NO: 66137 - DNA, 201 bp, Bos taurus; identical to SEQ ID NO: 25932

SEQ ID NO: 66138 - DNA, 201 bp, Bos taurus; identical to SEQ ID NO: 25936

SEQ ID NO: 66139 - DNA, 201 bp, Bos taurus; identical to SEQ ID NO: 25938

SEQ ID NO: 66140 - DNA, 201 bp, Bos taurus; identical to SEQ ID NO: 25939

SEQ ID NO: 66141 - DNA, 201 bp, Bos taurus; identical to SEQ ID NO: 25940

SEQ ID NO: 66142 - DNA, 201 bp, Bos taurus; identical to SEQ ID NO: 25941

SEQ ID NO: 66143 - DNA, 201 bp, Bos taurus; identical to SEQ ID NO: 25942

SEQ ID NO: 66144 - DNA, 201 bp, Bos taurus; identical to SEQ ID NO: 25943

SEQ ID NO: 66145 - DNA, 201 bp, Bos taurus; identical to SEQ ID NO: 25946

SEQ ID NO: 66146 - DNA, 201 bp, Bos taurus; identical to SEQ ID NO: 25950

SEQ ID NO: 66147 - DNA, 201 bp, Bos taurus; identical to SEQ ID NO: 25953

SEQ ID NO: 66148 - DNA, 201 bp, Bos taurus; identical to SEQ ID NO: 25955

SEQ ID NO: 66149 - DNA, 201 bp, Bos taurus; identical to SEQ ID NO: 25956

SEQ ID NO: 66150 - DNA, 201 bp, Bos taurus; identical to SEQ ID NO: 25957

SEQ ID NO: 66151 - DNA, 201 bp, Bos taurus; identical to SEQ ID NO: 25958

SEQ ID NO: 66152 - DNA, 201 bp, Bos taurus; identical to SEQ ID NO: 25959

SEQ ID NO: 66153 - DNA, 201 bp, Bos taurus; identical to SEQ ID NO: 25962

SEQ ID NO: 66154 - DNA, 201 bp, Bos taurus; identical to SEQ ID NO: 25963

SEQ ID NO: 66155 - DNA, 201 bp, Bos taurus; identical to SEQ ID NO: 25964

SEQ ID NO: 66156 - DNA, 201 bp, Bos taurus; identical to SEQ ID NO: 25966

SEQ ID NO: 66157 - DNA, 201 bp, Bos taurus; identical to SEQ ID NO: 25967

SEQ ID NO: 66158 - DNA, 201 bp, Bos taurus; identical to SEQ ID NO: 25968

SEQ ID NO: 66159 - DNA, 201 bp, Bos taurus; identical to SEQ ID NO: 25969

SEQ ID NO: 66160 - DNA, 201 bp, Bos taurus; identical to SEQ ID NO: 25970

SEQ ID NO: 66161 - DNA, 201 bp, Bos taurus; identical to SEQ ID NO: 25971

SEQ ID NO: 66162 - DNA, 201 bp, Bos taurus; identical to SEQ ID NO: 25972

SEQ ID NO: 66163 - DNA, 201 bp, Bos taurus; identical to SEQ ID NO: 25973

SEQ ID NO: 66164 - DNA, 201 bp, Bos taurus; identical to SEQ ID NO: 25974

SEQ ID NO: 66165 - DNA, 201 bp, Bos taurus; identical to SEQ ID NO: 25975

SEQ ID NO: 66166 - DNA, 201 bp, Bos taurus; identical to SEQ ID NO: 25978

SEQ ID NO: 66167 - DNA, 201 bp, Bos taurus; identical to SEQ ID NO: 25985

SEQ ID NO: 66168 - DNA, 201 bp, Bos taurus; identical to SEQ ID NO: 25986

SEQ ID NO: 66169 - DNA, 201 bp, Bos taurus; identical to SEQ ID NO: 25991

SEQ ID NO: 66170 - DNA, 201 bp, Bos taurus; identical to SEQ ID NO: 25993

SEQ ID NO: 66171 - DNA, 201 bp, Bos taurus; identical to SEQ ID NO: 25997

SEQ ID NO: 66172 - DNA, 201 bp, Bos taurus; identical to SEQ ID NO: 25998

SEQ ID NO: 66173 - DNA, 201 bp, Bos taurus; identical to SEQ ID NO: 26000

SEQ ID NO: 66174 - DNA, 201 bp, Bos taurus; identical to SEQ ID NO: 26001

SEQ ID NO: 66175 - DNA, 201 bp, Bos taurus; identical to SEQ ID NO: 26006

SEQ ID NO: 66176 - DNA, 201 bp, Bos taurus
tttccatcttattttttaccccaatagattcctgagttttgtttaccctcatgttgtgaacagtgactttcacctaatggccctcaaaaattcctctggcgtggatattagatgagtaatgatgcgtttactgcctttccaggatttctagtgtccctccagagcccctgggtcaggccacatcacggagactgcaggatc

SEQ ID NO: 66177 - DNA, 201 bp, Bos taurus; identical to SEQ ID NO: 26007

SEQ ID NO: 66178 - DNA, 201 bp, Bos taurus; identical to SEQ ID NO: 26009

SEQ ID NO: 66179 - DNA, 201 bp, Bos taurus
actgaaggtgcccacatatttgggagcttttctcttaagctctgcccacctggagtcactgggaatgatgatcacctgaaaggcactcaagaggaagatggtgccaatggacacatctctgccgactcttggaacatgaaaagcaagtgtgcatccaaggctgccagtgtttcaggaattcctttcaaatgaacaactaag

SEQ ID NO: 66180 - DNA, 201 bp, Bos taurus
catgaatgatttaagagacagaatggggcaggtgatacattcctatgacagtagcagacacaaacccaagttcctgaaaaccatttccactgaagcaaatattccacaaccatgtgatgaaggatgagttcctcactgttccttggacctctcatctgattcatcatctccaaccattcatacctacctgggtaaatggct

SEQ ID NO: 66181 - DNA, 201 bp, Bos taurus
gagcagacccggctagagcgagaaccctggcggaattttctcggatggctccagtacagctgctggtgacccatgttgctttctcggctgcaacgaggtacaaggccaaagaagatttcaaaggtaagcatagaacagatcactttagaggtaaagaaacttaaagtccatcatgaaaggcagttcaacatatcaagaaaa

SEQ ID NO: 66182 - DNA, 201 bp, Bos taurus
tcagaggccagtagtggaagaaacaacaattttgcgaaacaggagaaacacaaataacaaagctggtagaattcgtaagatcataagtgagaattaagccgagaacttccattagatgtggcccaggtagatttcaggtcgtctgactcaatccattctgtatcagtccttatctctcagagaaattatttattggcaccg

SEQ ID NO: 66183 - DNA, 201 bp, Bos taurus; identical to SEQ ID NO: 26014

SEQ ID NO: 66184 - DNA, 201 bp, Bos taurus
agagcacttttcctgaaaccgacgagaggaagcatgctggcccctccccagatggcgcagggggtggctggtgagggtgttgtcgccccagtggcctgggcgtcctcagtggcttctgcttggtttgtcctcttgtgagtgatgaaggtgacaaaacacaggaagatgccgggctaagggccgtatcagtagtgaaagggg

SEQ ID NO: 66185 - DNA, 201 bp, Bos taurus; identical to SEQ ID NO: 26020

SEQ ID NO: 66186 - DNA, 201 bp, Bos taurus; identical to SEQ ID NO: 26021

SEQ ID NO: 66187 - DNA, 201 bp, Bos taurus; identical to SEQ ID NO: 26022

SEQ ID NO: 66188 - DNA, 201 bp, Bos taurus; identical to SEQ ID NO: 26023

SEQ ID NO: 66189 - DNA, 201 bp, Bos taurus; identical to SEQ ID NO: 26024

SEQ ID NO: 66190 - DNA, 201 bp, Bos taurus
cccgcggcccctctctgtggcgtcagacggccaccttctcccagtaacctcgcacggtcttcaccgcgcgtgtccagactctgtcctcttatgagggtgccgatggttggattagggcccgccctaatgactgcaccttactttaactatctgcagactgaaaagactaaatctagactatctgaagactgagaagcctat

SEQ ID NO: 66191 - DNA, 201 bp, Bos taurus
tttctgttaatgaccaccgtgggcgtgcagttgttggcaaggctgtgcttgtcgctgctctgcggcggtgagtcagcgtatgcatgcgtgtacgtttacatgcaggccctctgttttggatttgcctcccattgaggtcgccagggagcactgagcagagctccccgtgctctgcagtctgctcatgttagtcacctgtgt

SEQ ID NO: 66192 - DNA, 201 bp, Bos taurus; identical to SEQ ID NO: 26026

SEQ ID NO: 66193 - DNA, 201 bp, Bos taurus; identical to SEQ ID NO: 26027

SEQ ID NO: 66194 - DNA, 201 bp, Bos taurus
cacagtaaggttaatgggaagagctgaaatgcaagagagagaataaaagaagacaaagaagcttaccaggaccaggagggtacgtgtggctctggcctcgctggaaggtctgggggaaagtctgctgctgtgaatgtgctaagctcattgcttgtgcctgatcaggacaatgaccatggagccaccagtccatacaaagag

SEQ ID NO: 66195 - DNA, 201 bp, Bos taurus
ggcaggtagaaactggtttgaggggtatacacaaagtatcagaatattgacatttacttattaaatacgtaaaatttaagtctactgcacaaccataaaatgagttttaaaatatgcaaaacctgtcgccatatgatcattcaactatggtagcattcttaaaagttatttttggctactgaacctgtaagaggggaaagt

SEQ ID NO: 66196 - DNA, 201 bp, Bos taurus
ctacaaagttgttttagggcaaaatgtcatggcctggaagccactcagaagacagggagtgctgagagaaacccctctggccactctgtgaaaatagaaggaaagtttacatccatcatcatcaagtaattatttccatccaaaagctgtcatcatctgggggacctctctgaaaaagagatccaagttgttgcctaaggc

SEQ ID NO: 66197 - DNA, 201 bp, Bos taurus
agccaccatgataggaagcccatgcactgcaactagaggaaagctcgcacagcaatgaaaacccagcacagccagaaacaatttttttaagcaaagatgtcgtcatgagtgagtttatgctaagttgcttcagtcgtgactgactctgtgaccccatagactgtagcttgccaggctcctttctccatgggattttccaga

SEQ ID NO: 66198 - DNA, 201 bp, Bos taurus; identical to SEQ ID NO: 26028

SEQ ID NO: 66199 - DNA, 201 bp, Bos taurus; identical to SEQ ID NO: 26029

SEQ ID NO: 66200 - DNA, 201 bp, Bos taurus; identical to SEQ ID NO: 26030

SEQ ID NO: 66201 - DNA, 201 bp, Bos taurus; identical to SEQ ID NO: 26031

SEQ ID NO: 66202 - DNA, 201 bp, Bos taurus; identical to SEQ ID NO: 26032

SEQ ID NO: 66203 - DNA, 201 bp, Bos taurus; identical to SEQ ID NO: 26034

SEQ ID NO: 66204 - DNA, 201 bp, Bos taurus; identical to SEQ ID NO: 26035

SEQ ID NO: 66205 - DNA, 201 bp, Bos taurus; identical to SEQ ID NO: 26038

SEQ ID NO: 66206 - DNA, 201 bp, Bos taurus; identical to SEQ ID NO: 26039

SEQ ID NO: 66207 - DNA, 201 bp, Bos taurus; identical to SEQ ID NO: 26041

SEQ ID NO: 66208 - DNA, 201 bp, Bos taurus; identical to SEQ ID NO: 26044

SEQ ID NO: 66209 - DNA, 201 bp, Bos taurus; identical to SEQ ID NO: 26046

SEQ ID NO: 66210 - DNA, 201 bp, Bos taurus; identical to SEQ ID NO: 26048

SEQ ID NO: 66211 - DNA, 201 bp, Bos taurus; identical to SEQ ID NO: 26049

SEQ ID NO: 66212 - DNA, 201 bp, Bos taurus; identical to SEQ ID NO: 26050

SEQ ID NO: 66213 - DNA, 201 bp, Bos taurus; identical to SEQ ID NO: 26051

SEQ ID NO: 66214 - DNA, 201 bp, Bos taurus; identical to SEQ ID NO: 26052

SEQ ID NO: 66215 - DNA, 201 bp, Bos taurus; identical to SEQ ID NO: 26057

SEQ ID NO: 66216 - DNA, 201 bp, Bos taurus; identical to SEQ ID NO: 26058

SEQ ID NO: 66217 - DNA, 201 bp, Bos taurus; identical to SEQ ID NO: 26059

SEQ ID NO: 66218 - DNA, 201 bp, Bos taurus; identical to SEQ ID NO: 26060

SEQ ID NO: 66219 - DNA, 201 bp, Bos taurus; identical to SEQ ID NO: 26063

SEQ ID NO: 66220 - DNA, 201 bp, Bos taurus; identical to SEQ ID NO: 26066

SEQ ID NO: 66221 - DNA, 201 bp, Bos taurus
aggaagtactattgtgctcttgcctgtctcagggccctactgtgctaggataagcccatttttaccctgtttcatcatatcgtttccttcccaaggtctttcaagggtctcggtggcccatggggatgcttttccagtggtcctatgctgacagtcgatgtagccacagaatgaacaaaatgcatcttcctgaaacaacat

SEQ ID NO: 66222 - DNA, 201 bp, Bos taurus; identical to SEQ ID NO: 26073

SEQ ID NO: 66223 - DNA, 201 bp, Bos taurus; identical to SEQ ID NO: 26074

SEQ ID NO: 66224 - DNA, 201 bp, Bos taurus
attggcaggtggattcttaaccactggaccacagggaagtccaatatgtatttcaaactgtgataagaacatatttatccctgatggtccagcggttagcgcttggtattttcactgccatgccctgggttcaacccctggtcagagaactaagattctgcaagatgcaaggtatgatcaaaaaaaaaaacaaccatactt

SEQ ID NO: 66225 - DNA, 201 bp, Bos taurus; identical to SEQ ID NO: 26075

SEQ ID NO: 66226 - DNA, 201 bp, Bos taurus; identical to SEQ ID NO: 26076

SEQ ID NO: 66227 - DNA, 201 bp, Bos taurus
tacttcagtaagtggaagcaccagttactataatgatgggagtaggaataacaatgcaataatttttagttttattgaatattcgctatttcattgaatctaatgccattagttatgatgtgtattttaaaaattaattcattttaaggatggatatttttaatgtactgtttaacgcacttaaaaatcacttaggttctt

SEQ ID NO: 66228 - DNA, 201 bp, Bos taurus
gagggccaactccttaatgcaggtggtagatggcattgatgtcaacctagctgatgctaatttaggaaaacaaccctgagataaagagttacagcaagaagactctgtaatgagcctgctggcctagctggaatgatgagttttgatctattgcaggtcagagctatttggcttctggagcttcggggacaggcctgtggg

SEQ ID NO: 66229 - DNA, 201 bp, Bos taurus; identical to SEQ ID NO: 26078

SEQ ID NO: 66230 - DNA, 201 bp, Bos taurus; identical to SEQ ID NO: 26079

SEQ ID NO: 66231 - DNA, 201 bp, Bos taurus
tttaactgtcactggagggccctaacaggcccagggattctcaagtaggacctcgctctgaaactcgctgacagccaaggcgcagtcatccatgaccaccggagggtgccagatcgtcagcatagggagcgggcccaggcaatttggctgacctcggagactattcttggagaatgaactgagagaaggaaagagggccga

SEQ ID NO: 66232 - DNA, 201 bp, Bos taurus
agtgaatttctctttactttccttgctgtcttactccctgaaaactatttcccacccccgaggccccagctatttccttttggtatgtggtttcacatattctttgctacaggttgaaccatatgagattacaactattcaactatttttgacctctgaaaatgcagtttcatgtggttgaagctaatagaaacacacaca

SEQ ID NO: 66233 - DNA, 201 bp, Bos taurus
atggcaacccactccagtattcttgcctgggaaagccctgggctacagtccgtggggtctcaaagagtcggacacaactgagtgactaagcacgcacaatacaaaaacacaaagggcatgtttgaggagcagcataactgcagtggtagaaaatgaagcttcgtagaaaggtacagtttgggaacagccttgtaaaccctg

SEQ ID NO: 66234 - DNA, 201 bp, Bos taurus; identical to SEQ ID NO: 26080

SEQ ID NO: 66235 - DNA, 201 bp, Bos taurus
ggccacctgatgcaaagagccgattcactggaaaagatctgactcactggaaaagatactaatgctgggaaagactgaatgcaaaagaagaagagagtgtgggaggaagagaaggttagaaagcaccactaactcaatggacaagaatttgagcaaagtctgggagacagcattggacagaggagcctggcttgctacagc

SEQ ID NO: 66236 - DNA, 201 bp, Bos taurus; identical to SEQ ID NO: 26083

SEQ ID NO: 66237 - DNA, 201 bp, Bos taurus
agtttgcacatgtgagttgctttgaatgtttgttatgcttggactgcacctgactttagtgtgaattctttggtaatttttaatgagctttcatgtaatattgattattttgcttggcgttgagtctcagatctaccaggttctgtttttcttgaggctgttgagtaaatctgcctccggctaaatccaaaatgctgctat

SEQ ID NO: 66238 - DNA, 201 bp, Bos taurus
ttttactcacactacaacagatcacatttatataaaattagaaagaagggaataaacatacgaaaacataaaatcaagactcactttaaagggagcagaatatcaagaactctgttggggctctcatcaactttttttttttttttaaagaaatgctctgcactgatgtggtataatgtaaacatatgcatatataggttt

SEQ ID NO: 66239 - DNA, 201 bp, Bos taurus; identical to SEQ ID NO: 26090

SEQ ID NO: 66240 - DNA, 201 bp, Bos taurus
ggtttacaggacctgaggggggtcctgagggtggtgaacatctccaaggaagttcaggaggggctgtgtgtccatagatggcctcttccagagatggacttgattccacctggctgtcccaagagttggctcactacggggagaggggaagggtgctctgggatgcctcctgcaggcctcagaccctccttcttctgggag

SEQ ID NO: 66241 - DNA, 201 bp, Bos taurus
gatagcaacagcaactactaaaataactgagtagactattacaggcatagaatatttgccttgaatttatccctcatggagtgggcagagttgcaggttgccgatcgatggtgctctgatagtggagtaggtaggggcatactttccagtgtatgggctggtgtgtcttaatttggggtttcctgtactgcctaaagagga

SEQ ID NO: 66242 - DNA, 201 bp, Bos taurus
acttccagggaacagcgaggagagataagaaggcttcaatgaacaatgcgatcagaggaaaacaaaagaatggttaggactagcgatctcttcaagaaaattggagattcaggggaacttacaattatgtccacgtcacctcggggagggaagaacaggcataggagaaagcactgttctacttttaacttctattattta

SEQ ID NO: 66243 - DNA, 201 bp, Bos taurus; identical to SEQ ID NO: 26092

SEQ ID NO: 66244 - DNA, 201 bp, Bos taurus; identical to SEQ ID NO: 26093

SEQ ID NO: 66245 - DNA, 201 bp, Bos taurus; identical to SEQ ID NO: 26094

SEQ ID NO: 66246 - DNA, 201 bp, Bos taurus; identical to SEQ ID NO: 26095

SEQ ID NO: 66247 - DNA, 201 bp, Bos taurus; identical to SEQ ID NO: 26098

SEQ ID NO: 66248 - DNA, 201 bp, Bos taurus
ggggagcaagtggaagatgattctgaaagcacttagcgccacggtagcatatggtataagcacatgatgaatgttggttaacagcattatctcacatcccaggtattggatagacttcagctgcaatagaagacactggcaaggcttgtgaggaaatgcagatgacatgcacagtttgagtgtttaccccagcatcatttg

SEQ ID NO: 66249 - DNA, 201 bp, Bos taurus; identical to SEQ ID NO: 26100

SEQ ID NO: 66250 - DNA, 201 bp, Bos taurus; identical to SEQ ID NO: 26104

SEQ ID NO: 66251 - DNA, 201 bp, Bos taurus
tctattttactgatgagaaaaccatggcagagaaagtaatttgctccaggtcaaacagccagtaagtggcagagcctaggtagaaacccaggccatctggatttggagcacctcctctcagccacaaagtcacggctgtgaaatgcaacaggtgagcacctctccaacagaacttccattgtgttcagctgagctcctgca

SEQ ID NO: 66252 - DNA, 201 bp, Bos taurus; identical to SEQ ID NO: 26107

SEQ ID NO: 66253 - DNA, 201 bp, Bos taurus
tcatcaacgggaaagtcttatatgtgatcttaaaaaaataaaaacagtatactacaggtatagtatgtgcctgataaaagaaattttagccctgtgctgaagacaaggcctggctttaaaaaaaaaaaatcttgagttaaattgtcacgtaccatccttatgttgtatctgaatacaaattacagatagagctgtaagagg

SEQ ID NO: 66254 - DNA, 201 bp, Bos taurus; identical to SEQ ID NO: 26109

SEQ ID NO: 66255 - DNA, 201 bp, Bos taurus
agtagaactggtcagattgcctacaaaatttaaatctctgatctttgttttcttgcccaagtattgaggaaatattttgtgatttcagcctgtcacatatctaacctaggatgaagatatcaataacttaaaggtaaatactaataaaaattctttaaacatagaaaatcaatagtttatcttctccatggctaaacaacc

SEQ ID NO: 66256 - DNA, 201 bp, Bos taurus; identical to SEQ ID NO: 26111

SEQ ID NO: 66257 - DNA, 201 bp, Bos taurus
gctcaggtcaggagcagagataggaaagcccagaaagtcagatttgtttcttagcagacttcactttctgaactaagtggaaacatttcaaaaaacttaaaattatatggccctcacactgacccagagaattgctggtgggagccctgatgaaaataccagcttctctggtgaaaatcatcacctgagaacacataagag

SEQ ID NO: 66258 - DNA, 201 bp, Bos taurus; identical to SEQ ID NO: 26112

SEQ ID NO: 66259 - DNA, 201 bp, Bos taurus; identical to SEQ ID NO: 26113

SEQ ID NO: 66260 - DNA, 201 bp, Bos taurus
aagtatttctatattatatgctaatataggaagtcaggcattgttatagcagttacaaattacataattttatacaaggctagtctttgtggttgttgttcagtcgctaagtcgtgtccgactcgttgcaaccccatggactgtagcccactaggctcctcagtccacgggatttcccagacaagaatactggagtgagtt

SEQ ID NO: 66261 - DNA, 201 bp, Bos taurus; identical to SEQ ID NO: 26114

SEQ ID NO: 66262 - DNA, 201 bp, Bos taurus; identical to SEQ ID NO: 26115

SEQ ID NO: 66263 - DNA, 201 bp, Bos taurus
agtggaggctgcagcgctgtgggcagggcaaggggaattcagggcctctgcttgcttgctccccagcttcgacttagctgtaacagttctctcttcctttcgtagcccctcgtactggccgcatggggcttagcgctggagatggcgtgggtggagccggcccgggctgcccactggctgaagaggaggcagtggcggaag

SEQ ID NO: 66264 - DNA, 201 bp, Bos taurus
agagttgacaaagctatttctcaatttgagtggatgtgctggtaaataccaccatacataacgtatctgtaaaacgcagacattcaggagtttgcagttattaacccaccgcctcttgtttgtcactcaaagtctcttggatcttattgcttcttgtaaattggcagagcggccttgagctccttctggctgctgtatggt

SEQ ID NO: 66265 - DNA, 201 bp, Bos taurus; identical to SEQ ID NO: 26117

SEQ ID NO: 66266 - DNA, 201 bp, Bos taurus
tggggactgactcttaaccactgcatgcacctcccttttcaacactcagcagtgccctgagcacttgagagcttggaaatgcattatagggggtaagggggtatgaagagaaggacgctgtagggggagatgctctaggagaaggatgtgttgttttaatataggggccacctaagagaatcacggggcagggaggatgca

SEQ ID NO: 66267 - DNA, 201 bp, Bos taurus; identical to SEQ ID NO: 26118

SEQ ID NO: 66268 - DNA, 201 bp, Bos taurus; identical to SEQ ID NO: 26119

SEQ ID NO: 66269 - DNA, 201 bp, Bos taurus
cagagagagtaaacaggattctgtctatggccagggctttctgggaacacacctgtataagcagcagccattcccaacagaaccgaattctcaggaaatcaggacagagccagggctgggcctttgtttggttttctgaccatgtgggaagcctgaggcctggtggccagccacgccctgcctctccgcctctgcatcctt

SEQ ID NO: 66270 - DNA, 201 bp, Bos taurus
aagcaaaatattactttcacaatcatcaaactagcatgagcaaaaaaaccaaaaaccatgtaaaagacaaagtaaattaagagcccagaacaagaggatctagaatataaattgtatggaaccaaaatgccaagtataatttagtatggcttggaggcatctctctcatgtaagagaattaggcatgagcacctacccatt

SEQ ID NO: 66271 - DNA, 201 bp, Bos taurus
gcaccgaaataaaaatgcaatatttcattcttacaatgaaatgttctaagaatgcttatttcctgttttcaggggcctaaaatgagagattttatctaacgtttatagtgttcctcggatcaagccatcaccggctatctatgcacatacagtcaaggaacacaaaaacagaagctccggtcctgaatgatttctttttag

SEQ ID NO: 66272 - DNA, 201 bp, Bos taurus; identical to SEQ ID NO: 26120

SEQ ID NO: 66273 - DNA, 201 bp, Bos taurus; identical to SEQ ID NO: 26121

SEQ ID NO: 66274 - DNA, 201 bp, Bos taurus
ggaaaagcagtccagaagctcccagttaaggaaactctctaagtgtaactggtttcattgggctgctttccttgaatgggacagacttgtgctgggaagactggaactccacttctgtacctagatttgggctaaaaaggcttgtaactcatccctctacacagggctcttgtaattcccctctctacacttcctctagta

SEQ ID NO: 66275 - DNA, 201 bp, Bos taurus
gaaacagtttagaaaaggggaaatggagaggtcaagaaaaattgcatcagtggtggcagggctgggttgcattaatcattcccaacactgtcccttggtggtcctgcacccagtatccaacagtcagccctgaagtgggtgatggtggtggcggcggcaagtgacaggcagaatgtttttgaagaggtcattgcttacact

SEQ ID NO: 66276 - DNA, 201 bp, Bos taurus; identical to SEQ ID NO: 26124

SEQ ID NO: 66277 - DNA, 201 bp, Bos taurus; identical to SEQ ID NO: 26125

SEQ ID NO: 66278 - DNA, 201 bp, Bos taurus; identical to SEQ ID NO: 26126

SEQ ID NO: 66279 - DNA, 201 bp, Bos taurus
ggacagaagagcctggtgggcttcagtccatggggtcgagactgagtgactttcacttcatataccaacatatggcatgacacaagtcaggaggtggtggacccgagacggcttcaaattctgccatgtttgcttgtgatgacacagacccccagatgtagctcgtgtcttccaaggagtcattcagcacccagaggtggg

SEQ ID NO: 66280 - DNA, 201 bp, Bos taurus; identical to SEQ ID NO: 26127

SEQ ID NO: 66281 - DNA, 201 bp, Bos taurus
tgttgacactcagcaagggccagtatatttaaatcattcactctcctcaccacgcctcctggtctctctaccatgagactgaatagcgtgaccttgttcctgtgggtctgcagtgaaacagtggccttgggcccagcaatggggctggccaagcagaaagccgtcggtcccatcatcgggcccagcacagagcaagtctca

SEQ ID NO: 66282 - DNA, 201 bp, Bos taurus
aagtaaatcaacaaactttttccatttgatccattactctttcttttagaaggaatctaatccaagaccatgtatataacaaacacaataaacctatcatgaaaattccaacacaatttcactgagaactacatcttatgaccttgaaaacgtcagtgacaggctgtcatacttgcaaatgtaaaaccagataaacttacc

SEQ ID NO: 66283 - DNA, 201 bp, Bos taurus; identical to SEQ ID NO: 26129

SEQ ID NO: 66284 - DNA, 201 bp, Bos taurus
aagttcagcgactccagaaagaattgagcagttgtatccgtaaaattgaagaagtagctaaaagaggtgagacaaattggactcttgactttgaaaaaaacgctccaagagggtagaggccaaatacgttcttcaggacccctgcccctcatcagttccctttctgtccttctgtcactagaatgagcattcatggcaaga

SEQ ID NO: 66285 - DNA, 201 bp, Bos taurus; identical to SEQ ID NO: 26130

SEQ ID NO: 66286 - DNA, 201 bp, Bos taurus; identical to SEQ ID NO: 26133

SEQ ID NO: 66287 - DNA, 201 bp, Bos taurus; identical to SEQ ID NO: 26136

SEQ ID NO: 66288 - DNA, 201 bp, Bos taurus
atactacattttgtttacccattcatcagctgagggatatttccatacaacacttctgtaatatacatatataagttgtgtggcccatgttttcatttcacttgtctatccaactgtgagctgatggctcatatggtcactctatctctagaattttgaggaactaccaaactgttttccaaaatggccacaccgtttaat

SEQ ID NO: 66289 - DNA, 201 bp, Bos taurus
gagagccacccccatccctccccgactcagactcctgttccagcttcgccgtacccccctatcgctccattccctgtagcatggaggccaagagtacccactcctgccctgtcctcctagctgtaggacccctgagcatcactcacttcgggggagagtgaagtaggcctggggagagggatcccagcacttggccaccgt

SEQ ID NO: 66290 - DNA, 201 bp, Bos taurus
gggcccagagcccacaatacaaagggtgatgggcattgaaactagagcttggggaccctaagggacacaaaatctccaggaaggggtcagggatcggagaagggttatctatggttttctatggggccacaatcagccaaagagggattgggattgaatacaaatgtagaagactgttggagtgaaatttggggcataaga

SEQ ID NO: 66291 - DNA, 201 bp, Bos taurus
gactgccaaatgccaactcctcttcccactggaccttctctgagccccacactggcactccacatggtctcctgggccctcccctgcctcgacccacatacccatctggggaccagctcaggtgatgctagcttctgagatgctccttagtcctgccggggcctctcagtgggtccttgtcctgaaacctgagcccccttg

SEQ ID NO: 66292 - DNA, 201 bp, Bos taurus; identical to SEQ ID NO: 26138

SEQ ID NO: 66293 - DNA, 201 bp, Bos taurus; identical to SEQ ID NO: 26139

SEQ ID NO: 66294 - DNA, 201 bp, Bos taurus; identical to SEQ ID NO: 26140

SEQ ID NO: 66295 - DNA, 201 bp, Bos taurus; identical to SEQ ID NO: 26142

SEQ ID NO: 66296 - DNA, 201 bp, Bos taurus; identical to SEQ ID NO: 26146

SEQ ID NO: 66297 - DNA, 201 bp, Bos taurus; identical to SEQ ID NO: 26147

SEQ ID NO: 66298 - DNA, 201 bp, Bos taurus; identical to SEQ ID NO: 26149

SEQ ID NO: 66299 - DNA, 201 bp, Bos taurus; identical to SEQ ID NO: 26150

SEQ ID NO: 66300 - DNA, 201 bp, Bos taurus; identical to SEQ ID NO: 26152

SEQ ID NO: 66301 - DNA, 201 bp, Bos taurus; identical to SEQ ID NO: 26153

SEQ ID NO: 66302 - DNA, 201 bp, Bos taurus; identical to SEQ ID NO: 26154

SEQ ID NO: 66303 - DNA, 201 bp, Bos taurus; identical to SEQ ID NO: 26155

SEQ ID NO: 66304 - DNA, 201 bp, Bos taurus; identical to SEQ ID NO: 26156

SEQ ID NO: 66305 - DNA, 201 bp, Bos taurus; identical to SEQ ID NO: 26157

SEQ ID NO: 66306 - DNA, 201 bp, Bos taurus; identical to SEQ ID NO: 26158

SEQ ID NO: 66307 - DNA, 201 bp, Bos taurus; identical to SEQ ID NO: 26159

SEQ ID NO: 66308 - DNA, 201 bp, Bos taurus; identical to SEQ ID NO: 26160

SEQ ID NO: 66309 - DNA, 201 bp, Bos taurus; identical to SEQ ID NO: 26161

SEQ ID NO: 66310 - DNA, 201 bp, Bos taurus; identical to SEQ ID NO: 26162

SEQ ID NO: 66311 - DNA, 201 bp, Bos taurus; identical to SEQ ID NO: 26164

SEQ ID NO: 66312 - DNA, 201 bp, Bos taurus; identical to SEQ ID NO: 26165

SEQ ID NO: 66313 - DNA, 201 bp, Bos taurus; identical to SEQ ID NO: 26166

SEQ ID NO: 66314 - DNA, 201 bp, Bos taurus; identical to SEQ ID NO: 26167

SEQ ID NO: 66315 - DNA, 201 bp, Bos taurus; identical to SEQ ID NO: 26168

SEQ ID NO: 66316 - DNA, 201 bp, Bos taurus; identical to SEQ ID NO: 26169

SEQ ID NO: 66317 - DNA, 201 bp, Bos taurus; identical to SEQ ID NO: 26170

SEQ ID NO: 66318 - DNA, 201 bp, Bos taurus; identical to SEQ ID NO: 26171

SEQ ID NO: 66319 - DNA, 201 bp, Bos taurus; identical to SEQ ID NO: 26172

SEQ ID NO: 66320 - DNA, 201 bp, Bos taurus; identical to SEQ ID NO: 26174

SEQ ID NO: 66321 - DNA, 201 bp, Bos taurus; identical to SEQ ID NO: 26175

SEQ ID NO: 66322 - DNA, 201 bp, Bos taurus; identical to SEQ ID NO: 26176

SEQ ID NO: 66323 - DNA, 201 bp, Bos taurus; identical to SEQ ID NO: 26178

SEQ ID NO: 66324 - DNA, 201 bp, Bos taurus; identical to SEQ ID NO: 26179

SEQ ID NO: 66325 - DNA, 201 bp, Bos taurus; identical to SEQ ID NO: 26180

SEQ ID NO: 66326 - DNA, 201 bp, Bos taurus; identical to SEQ ID NO: 26181

SEQ ID NO: 66327 - DNA, 201 bp, Bos taurus; identical to SEQ ID NO: 26184

SEQ ID NO: 66328 - DNA, 201 bp, Bos taurus; identical to SEQ ID NO: 26185

SEQ ID NO: 66329 - DNA, 201 bp, Bos taurus; identical to SEQ ID NO: 26186

SEQ ID NO: 66330 - DNA, 201 bp, Bos taurus; identical to SEQ ID NO: 26187

SEQ ID NO: 66331 - DNA, 201 bp, Bos taurus; identical to SEQ ID NO: 26192

SEQ ID NO: 66332 - DNA, 201 bp, Bos taurus; identical to SEQ ID NO: 26194

SEQ ID NO: 66333 - DNA, 201 bp, Bos taurus; identical to SEQ ID NO: 26195

SEQ ID NO: 66334 - DNA, 201 bp, Bos taurus; identical to SEQ ID NO: 26196

SEQ ID NO: 66335 - DNA, 201 bp, Bos taurus; identical to SEQ ID NO: 26198

SEQ ID NO: 66336 - DNA, 201 bp, Bos taurus; identical to SEQ ID NO: 26199

SEQ ID NO: 66337 - DNA, 201 bp, Bos taurus; identical to SEQ ID NO: 26202

SEQ ID NO: 66338 - DNA, 201 bp, Bos taurus; identical to SEQ ID NO: 26203

SEQ ID NO: 66339 - DNA, 201 bp, Bos taurus; identical to SEQ ID NO: 26205

SEQ ID NO: 66340 - DNA, 201 bp, Bos taurus; identical to SEQ ID NO: 26208

SEQ ID NO: 66341 - DNA, 201 bp, Bos taurus; identical to SEQ ID NO: 26209

SEQ ID NO: 66342 - DNA, 201 bp, Bos taurus; identical to SEQ ID NO: 26210

SEQ ID NO: 66343 - DNA, 201 bp, Bos taurus; identical to SEQ ID NO: 26213

SEQ ID NO: 66344 - DNA, 201 bp, Bos taurus; identical to SEQ ID NO: 26214

SEQ ID NO: 66345 - DNA, 201 bp, Bos taurus; identical to SEQ ID NO: 26216

SEQ ID NO: 66346 - DNA, 201 bp, Bos taurus; identical to SEQ ID NO: 26220

SEQ ID NO: 66347 - DNA, 201 bp, Bos taurus; identical to SEQ ID NO: 26225

SEQ ID NO: 66348 - DNA, 201 bp, Bos taurus; identical to SEQ ID NO: 26227

SEQ ID NO: 66349 - DNA, 201 bp, Bos taurus; identical to SEQ ID NO: 26229

SEQ ID NO: 66350 - DNA, 201 bp, Bos taurus; identical to SEQ ID NO: 26230

SEQ ID NO: 66351 - DNA, 201 bp, Bos taurus; identical to SEQ ID NO: 26231

SEQ ID NO: 66352 - DNA, 201 bp, Bos taurus; identical to SEQ ID NO: 26232

SEQ ID NO: 66353 - DNA, 201 bp, Bos taurus; identical to SEQ ID NO: 26233

SEQ ID NO: 66354 - DNA, 201 bp, Bos taurus; identical to SEQ ID NO: 26235

SEQ ID NO: 66355 - DNA, 201 bp, Bos taurus; identical to SEQ ID NO: 26236

SEQ ID NO: 66356 - DNA, 201 bp, Bos taurus; identical to SEQ ID NO: 26237

SEQ ID NO: 66357 - DNA, 201 bp, Bos taurus; identical to SEQ ID NO: 26239

SEQ ID NO: 66358 - DNA, 201 bp, Bos taurus; identical to SEQ ID NO: 26240

SEQ ID NO: 66359 - DNA, 201 bp, Bos taurus; identical to SEQ ID NO: 26241

SEQ ID NO: 66360 - DNA, 201 bp, Bos taurus; identical to SEQ ID NO: 26242

SEQ ID NO: 66361 - DNA, 201 bp, Bos taurus; identical to SEQ ID NO: 26243

SEQ ID NO: 66362 - DNA, 201 bp, Bos taurus; identical to SEQ ID NO: 26246

SEQ ID NO: 66363 - DNA, 201 bp, Bos taurus; identical to SEQ ID NO: 26248

SEQ ID NO: 66364 - DNA, 201 bp, Bos taurus; identical to SEQ ID NO: 26249

SEQ ID NO: 66365 - DNA, 201 bp, Bos taurus; identical to SEQ ID NO: 26250

SEQ ID NO: 66366 - DNA, 201 bp, Bos taurus; identical to SEQ ID NO: 26251

SEQ ID NO: 66367 - DNA, 201 bp, Bos taurus; identical to SEQ ID NO: 26252

SEQ ID NO: 66368 - DNA, 201 bp, Bos taurus; identical to SEQ ID NO: 26253

SEQ ID NO: 66369 - DNA, 201 bp, Bos taurus; identical to SEQ ID NO: 26254

SEQ ID NO: 66370 - DNA, 201 bp, Bos taurus; identical to SEQ ID NO: 26255

SEQ ID NO: 66371 - DNA, 201 bp, Bos taurus; identical to SEQ ID NO: 26256

SEQ ID NO: 66372 - DNA, 201 bp, Bos taurus; identical to SEQ ID NO: 26257

SEQ ID NO: 66373 - DNA, 201 bp, Bos taurus; identical to SEQ ID NO: 26258

SEQ ID NO: 66374 - DNA, 201 bp, Bos taurus; identical to SEQ ID NO: 26259

SEQ ID NO: 66375 - DNA, 201 bp, Bos taurus; identical to SEQ ID NO: 26260

SEQ ID NO: 66376 - DNA, 201 bp, Bos taurus; identical to SEQ ID NO: 26261

SEQ ID NO: 66377 - DNA, 201 bp, Bos taurus; identical to SEQ ID NO: 26262

SEQ ID NO: 66378 - DNA, 201 bp, Bos taurus; identical to SEQ ID NO: 26269

SEQ ID NO: 66379 - DNA, 201 bp, Bos taurus; identical to SEQ ID NO: 26270

SEQ ID NO: 66380 - DNA, 201 bp, Bos taurus; identical to SEQ ID NO: 26273

SEQ ID NO: 66381 - DNA, 201 bp, Bos taurus; identical to SEQ ID NO: 26276

SEQ ID NO: 66382 - DNA, 201 bp, Bos taurus; identical to SEQ ID NO: 26277

SEQ ID NO: 66383 - DNA, 201 bp, Bos taurus; identical to SEQ ID NO: 26278

SEQ ID NO: 66384 - DNA, 201 bp, Bos taurus; identical to SEQ ID NO: 26279

SEQ ID NO: 66385 - DNA, 201 bp, Bos taurus; identical to SEQ ID NO: 26280

SEQ ID NO: 66386 - DNA, 201 bp, Bos taurus; identical to SEQ ID NO: 26281

SEQ ID NO: 66387 - DNA, 201 bp, Bos taurus; identical to SEQ ID NO: 26282

SEQ ID NO: 66388 - DNA, 201 bp, Bos taurus
agctcatcaaaggtggcaagttcagcgcctgcctggaagtccacattcagaacgacgggcctgtgaccatggaactggaatctccggcccctggtgctgttgcctctgatccagaacacctgtcgaagcttgaaaagcaacaacagaggacagaaaaagccagagccaaagggccttccggatcaagcaagaagagaagtg

SEQ ID NO: 66389 - DNA, 201 bp, Bos taurus
tgaagtggaggctccaggtaacgccttgtttcttctttctggggagaatcggggcttcttccttcgctcctctttggtgtcgcacccgctggacccccaaacccatccttctgactgtaacacgtgctcaggttgccttctgtgcagaaggtaccactgtggggccggaaaacaaacgtgcctgtgtgcctgtgggggacg

SEQ ID NO: 66390 - DNA, 201 bp, Bos taurus; identical to SEQ ID NO: 26284

SEQ ID NO: 66391 - DNA, 201 bp, Bos taurus; identical to SEQ ID NO: 26285

SEQ ID NO: 66392 - DNA, 201 bp, Bos taurus; identical to SEQ ID NO: 26286

SEQ ID NO: 66393 - DNA, 201 bp, Bos taurus
atcctcccccacgtcccccaggcagctccactctgcacaacccaaactctctgggcaaagaatgttccggaagggccaggcaggcctctttctggaagacgaagctgagaaagacagccttagagaagccagtgctgagcgcctgcttcgtgccggccatactcagggctctatggggattctgtgcagcagcctgtgggc

SEQ ID NO: 66394 - DNA, 201 bp, Bos taurus; identical to SEQ ID NO: 26287

SEQ ID NO: 66395 - DNA, 201 bp, Bos taurus; identical to SEQ ID NO: 26288

SEQ ID NO: 66396 - DNA, 201 bp, Bos taurus; identical to SEQ ID NO: 26289

SEQ ID NO: 66397 - DNA, 201 bp, Bos taurus; identical to SEQ ID NO: 26290

SEQ ID NO: 66398 - DNA, 201 bp, Bos taurus
atgcatctttggtcagctgctggtcagctagcagatcagctggggactggctgctctaagtggcctcaggtgggatggcttggctttgttctacgtggccactcatcctccacaggctggcttgggcttgtttacagggaggatgggctgagcgccaagagggaagtggagctacacaaggcctattgagtcgtagctcag

SEQ ID NO: 66399 - DNA, 201 bp, Bos taurus
accctgtccctcacccccactgagctcaaccctctgcttccccagactttcccccactcttccccccgccctgcctggaagcaatctcttgaaaaccctcaggaaagcacaagccaagactatgaccatgagtttgctgggtttatcttccgggaggttgcaatcagtgtgaccgcaccgatctttcctgagacagcggtc

SEQ ID NO: 66400 - DNA, 201 bp, Bos taurus; identical to SEQ ID NO: 26293

SEQ ID NO: 66401 - DNA, 201 bp, Bos taurus
ggtgctgccccaggtgggggtaaagccactcagcttgggccttccagaagcctcagaaccagagcccgcaggacactgataggctgaacgcctattctcagtggggcacccaggtgcacctgcggccaggattccagggggcaggggtccccctgagtgtgggcgtttccctgcacccgggcccattgcctggggccccag

SEQ ID NO: 66402 - DNA, 201 bp, Bos taurus
acacacgacaaaagcacactggccctagggtggccaggggttcactcctcagttcacctggcacgcagctcactccctgctcatccatggttagtccagcagagttcaggccacttcatcaggaacaagtgaacacgttttcatgtatgagaaaatgagtcgttcctctctatttaaaacagatgaaaagcaggcaggcag

SEQ ID NO: 66403 - DNA, 201 bp, Bos taurus; identical to SEQ ID NO: 26294

SEQ ID NO: 66404 - DNA, 201 bp, Bos taurus; identical to SEQ ID NO: 26295

SEQ ID NO: 66405 - DNA, 201 bp, Bos taurus; identical to SEQ ID NO: 26296

SEQ ID NO: 66406 - DNA, 201 bp, Bos taurus; identical to SEQ ID NO: 26297

SEQ ID NO: 66407 - DNA, 201 bp, Bos taurus; identical to SEQ ID NO: 26298

SEQ ID NO: 66408 - DNA, 201 bp, Bos taurus
ccacttcctcctcactctcacctgcaggggtgggggtggggcactgcagacactgagtgcacactgcgggaggtacctcaattcagcaggagacatggtgaggtcgcaggactgggggcccccagcaccctccagacacgctggtcctcgagtcagactggccaggccgggagagccttcgtgggcatgctgccgcacctc

SEQ ID NO: 66409 - DNA, 201 bp, Bos taurus
tccagcctctaccgggcactttcggaggtaagtccggtgggtggctgcgagccctgggccggctcttccggggagggatggccctgaaacgggtctcaggagagggaggaccctggggaagaccctagagaggggtggaccctggggaaagaccctgggaggggtgcatcgtgagggagggcccttggggctgggattcta

SEQ ID NO: 66410 - DNA, 201 bp, Bos taurus
agcgcattgaggcaatgggttcacatgactcccgaagcaccgggcaccctggagtcctgtcccaaaaaggacgcagggccatttacacgccttagcctcttcttccctgtttcaggtcatttacgtttcttccaaattccgtcatttcaggtgacggtgacggtgagcacctgcaagcgtgtggcccttctccgacggaag

SEQ ID NO: 66411 - DNA, 201 bp, Bos taurus
gcctgtgctctttgtgccttattaaagaaactactgcctaacccaaggtcagaaagattttcttccagaattttcatggttccaagcttcacatttaaggagtgagttattgtacaaggtgtgagtgagtgactgaatttctacttttggcaaatgggtgtccaattaccatggtgccactccgctggaaagacacattcc

SEQ ID NO: 66412 - DNA, 201 bp, Bos taurus; identical to SEQ ID NO: 26299

SEQ ID NO: 66413 - DNA, 201 bp, Bos taurus; identical to SEQ ID NO: 26300

SEQ ID NO: 66414 - DNA, 201 bp, Bos taurus; identical to SEQ ID NO: 26301

SEQ ID NO: 66415 - DNA, 201 bp, Bos taurus; identical to SEQ ID NO: 26302

SEQ ID NO: 66416 - DNA, 201 bp, Bos taurus; identical to SEQ ID NO: 26303

SEQ ID NO: 66417 - DNA, 201 bp, Bos taurus
tatgtggttgggagatctcctgacctccagaatgagaatgacacagcagagcccagcctcctctcttaattatcctgctgttctccacttggttttcagtccgcagggaacgaatctccaatcaatttactctgggggtgcccatctactggctcaaaagcatgcataaacagaaggcagccatttttaaaatttctttca

SEQ ID NO: 66418 - DNA, 201 bp, Bos taurus
agctgtatgaccacagccctgttagggtggccggaaatgtgcctgacatctcaaaattagcaagtgatacagccaggatccgagccagggcccacacctgcgccttgaaccctgggacctgccttttgatactcacatgcagcttaatgtctgggcgcccacccctctccaaccccggatcccaaaagggcccacccagac

SEQ ID NO: 66419 - DNA, 201 bp, Bos taurus
tggggtggaaggcggtcagagggttgactgaggggcccctgaacccagatgtgcagccaccaagaccacagactgcagctggaagacgggctggcgtcccgactggccactcaccacagccttgggcaagatgtccttatgcggacaaggggctcatggggtcagttaggagaggactttgaaaagtgccattgttaatgg

SEQ ID NO: 66420 - DNA, 201 bp, Bos taurus; identical to SEQ ID NO: 26306

SEQ ID NO: 66421 - DNA, 201 bp, Bos taurus
tttgattcctccagatggctttggaggggcctgccccgtggggctgggggtcaggaggaaggcatgctcatctcaagccttggctgccctgtctggcacttggccctctgacagtgtgccctctgcaggaattcagacatggctctgtctgcttgataagaatgtactggattcattgactttgagcccgtggaaggctga

SEQ ID NO: 66422 - DNA, 201 bp, Bos taurus
agggtcagcttagccagcttcagcccggcgggatcccacgaccctgagccacagacctcggcccggagcccaggatgggccgagcccactcagtgcactaagaccactcagtgcagagacactcatgacaccagagcgcacgcgtgtgtgaaaacaggcacggccttgctcaggcaccaccacaggcagcaaggagagaac

SEQ ID NO: 66423 - DNA, 201 bp, Bos taurus; identical to SEQ ID NO: 26309

SEQ ID NO: 66424 - DNA, 201 bp, Bos taurus; identical to SEQ ID NO: 26311

SEQ ID NO: 66425 - DNA, 201 bp, Bos taurus; identical to SEQ ID NO: 26313

SEQ ID NO: 66426 - DNA, 201 bp, Bos taurus; identical to SEQ ID NO: 26314

SEQ ID NO: 66427 - DNA, 201 bp, Bos taurus; identical to SEQ ID NO: 26317

SEQ ID NO: 66428 - DNA, 201 bp, Bos taurus; identical to SEQ ID NO: 26318

SEQ ID NO: 66429 - DNA, 201 bp, Bos taurus; identical to SEQ ID NO: 26319

SEQ ID NO: 66430 - DNA, 201 bp, Bos taurus; identical to SEQ ID NO: 26320

SEQ ID NO: 66431 - DNA, 201 bp, Bos taurus
gcaccgggcgctcattccgtgagtcagtctgactcggcaccgggaggctgggggttcacggtggttgcgaatgtggtaatggatgcttcttcaacctgcttggccaccacgtcaccatctccgggtgtttgggggccgaattttgggagaaaacccaccactcctattaaatcctgtgagcgaggacgtttgctatcggag

SEQ ID NO: 66432 - DNA, 201 bp, Bos taurus; identical to SEQ ID NO: 26321

SEQ ID NO: 66433 - DNA, 201 bp, Bos taurus
tgtgggttctgagaaagctggagccggcccacaggtttaagacgacgctccccagtattctggacagtccaggggacccccggaaggtctggcccagtaatgtttggggtgagggagagcgtctgatgtccacgcaggcgcaccctcagaccagaggcgtggctcgggcaccgccacgcccggtcgggagcgctggggaag

SEQ ID NO: 66434 - DNA, 201 bp, Bos taurus
atgtggagtaccttctcccctcccccattccctccagccaccaccaaagtcttgcatcactagatatttggcttctggaggagaggggcctgtcctccccaacctctaccctgagctgctttctcatcagtgcagacccagagtagaagtgagccagtcctggcaggctgctccttgacacctcagagggccccattcgcc

SEQ ID NO: 66435 - DNA, 201 bp, Bos taurus; identical to SEQ ID NO: 26322

SEQ ID NO: 66436 - DNA, 201 bp, Bos taurus
ggtcagaaaaaggggaaccaaaggagcggatgcccagaatgccccagaatgccgggagatggacaagaaagatgctggagaggaccggctttgaaactgtcggcctagtgatggagtggggaccgagggtgaggatggggggcaggggacggaggctggaaaggttgcgggcccgggggatgggggtggcgctgagtgtaa

SEQ ID NO: 66437 - DNA, 201 bp, Bos taurus
tgccgctggtgtgaggaccgtggcccgtgacgcagagagcccgaatcccagagcgtccttgacgcaagtgaggcgcttcaaagaggccgctgtccctcaggcattttaaattattatgatgattttaaagaacataactttttttttaactgttgagccgcacagcatgtgggatcctagtttcccaaccagggatggaac

SEQ ID NO: 66438 - DNA, 201 bp, Bos taurus
cccctccagcttgttgatgccccagctcaggggctgcctgctgacctgagccacttgatcatctccgtgacagcagcgcctgtggccactggcacccgagcgccagaaccagtgtgtgtgtgtgtgggtgggtgtgagtgtttgtgagtgtgactgggcctgtgtatttccatgtgtgtgtgtctgggtgtgtctgtgtta

SEQ ID NO: 66439 - DNA, 201 bp, Bos taurus; identical to SEQ ID NO: 26328

SEQ ID NO: 66440 - DNA, 201 bp, Bos taurus; identical to SEQ ID NO: 26329

SEQ ID NO: 66441 - DNA, 201 bp, Bos taurus; identical to SEQ ID NO: 26330

SEQ ID NO: 66442 - DNA, 201 bp, Bos taurus; identical to SEQ ID NO: 26331

SEQ ID NO: 66443 - DNA, 201 bp, Bos taurus; identical to SEQ ID NO: 26332

SEQ ID NO: 66444 - DNA, 201 bp, Bos taurus; identical to SEQ ID NO: 26333

SEQ ID NO: 66445 - DNA, 201 bp, Bos taurus; identical to SEQ ID NO: 26334

SEQ ID NO: 66446 - DNA, 201 bp, Bos taurus; identical to SEQ ID NO: 26339

SEQ ID NO: 66447 - DNA, 201 bp, Bos taurus; identical to SEQ ID NO: 26344

SEQ ID NO: 66448 - DNA, 201 bp, Bos taurus; identical to SEQ ID NO: 26345

SEQ ID NO: 66449 - DNA, 201 bp, Bos taurus; identical to SEQ ID NO: 26346

SEQ ID NO: 66450 - DNA, 201 bp, Bos taurus
tgggatttcactaactcctctgccgctctgggtattttacaattaactgcctttcagttcactcatgctcttgggccagaagtgatcttgcccttttctccgtatcttagccacggtcagccaatcaaacatactccattcccactctagctcttggaacacgagacagggccaagttctcagcccaccgttgttttaagg

SEQ ID NO: 66451 - DNA, 201 bp, Bos taurus; identical to SEQ ID NO: 26348

SEQ ID NO: 66452 - DNA, 201 bp, Bos taurus; identical to SEQ ID NO: 26349

SEQ ID NO: 66453 - DNA, 201 bp, Bos taurus
actgaagcgacttagcagcagcagcagcaggttatgtgtgagtaggagtgactaatggaagacagcagaagagacagatctttggagtaatgaatgcacttgtgtgggaggggcagagtcttcctttgtttcaccgctgcttgtcgcgtgcacacacacacacacacacacacacacacgcgcgcgcgcgcgcgcggctct

SEQ ID NO: 66454 - DNA, 201 bp, Bos taurus; identical to SEQ ID NO: 26352

SEQ ID NO: 66455 - DNA, 201 bp, Bos taurus
aaatcactatggccttgggtgacaaaggtgggattacagactgagaatttcacacgttgctttctgatttctctggggggaacctgttgaggtgaaaaacgaaggaaacagaaaggaggccacaaggtacagggaagacaaagaaatgcaagtgagtgaaaagaataacattaaaaagatgaaataaaaaagaaaaaagat

SEQ ID NO: 66456 - DNA, 201 bp, Bos taurus; identical to SEQ ID NO: 26354

SEQ ID NO: 66457 - DNA, 201 bp, Bos taurus; identical to SEQ ID NO: 26355

SEQ ID NO: 66458 - DNA, 201 bp, Bos taurus; identical to SEQ ID NO: 26356

SEQ ID NO: 66459 - DNA, 201 bp, Bos taurus; identical to SEQ ID NO: 26357

SEQ ID NO: 66460 - DNA, 201 bp, Bos taurus
gccccgtggcaggcctcgttagctgtccggggcagcttgggtctggcagctgaccagccctgctctggggagagggcgggaccacaagcctgggaagctctggcctccttgagaggatggtacccttccttttaaagagactcctgaccatccaagcaaagggcccttcactttgaccttcctgccgggctcaggggtggg

SEQ ID NO: 66461 - DNA, 201 bp, Bos taurus; identical to SEQ ID NO: 26358

SEQ ID NO: 66462 - DNA, 201 bp, Bos taurus
agattggccaaagtacgagcttagagctttaccacagagccttgaaatgggggtgctttctccctgggtaactgtgtgcttggcgcctcatccgaggaccactgacggcccgctagagcacactccagagccagacgcaccaggtgtgtgggcgcggggtcttcccaccagatcagaagtctggcggtttattcagaattt

SEQ ID NO: 66463 - DNA, 201 bp, Bos taurus
aagacaaagtaacagccactgaaatgtctgaagcagggatgggtaatgctttctgtgtgaaggccaacagtgacgtctcaggccccagccgtgcatctgttgcgactattcagctccgctgctgaagcacagaggcgtccgaagaaaatatagggagtgagtgggcacgactgtgttccatccgataaaactttattcact

SEQ ID NO: 66464 - DNA, 201 bp, Bos taurus; identical to SEQ ID NO: 26360

SEQ ID NO: 66465 - DNA, 201 bp, Bos taurus; identical to SEQ ID NO: 26363

SEQ ID NO: 66466 - DNA, 201 bp, Bos taurus; identical to SEQ ID NO: 26366

SEQ ID NO: 66467 - DNA, 201 bp, Bos taurus
gtttgggcatgtggtgtcagttccagcctgccgggagtcagagtaattcctttactggagctgcatctcctgggctgacggtggcccctggggtcagcatcatcacaggatgagtcagacagttgccgcccaccagtcctgctgctcctctgagtttgagtcagtaaaaaccctctgattaatactaggtgacagaaggcc

SEQ ID NO: 66468 - DNA, 201 bp, Bos taurus; identical to SEQ ID NO: 26368

SEQ ID NO: 66469 - DNA, 201 bp, Bos taurus; identical to SEQ ID NO: 26369

SEQ ID NO: 66470 - DNA, 201 bp, Bos taurus; identical to SEQ ID NO: 26370

SEQ ID NO: 66471 - DNA, 201 bp, Bos taurus; identical to SEQ ID NO: 26371

SEQ ID NO: 66472 - DNA, 201 bp, Bos taurus; identical to SEQ ID NO: 26372

SEQ ID NO: 66473 - DNA, 201 bp, Bos taurus; identical to SEQ ID NO: 26373

SEQ ID NO: 66474 - DNA, 201 bp, Bos taurus; identical to SEQ ID NO: 26374

SEQ ID NO: 66475 - DNA, 201 bp, Bos taurus
taaattacttgatcagggtagtgttctgtttttacattgctaatataaaggctgcatacttagccaattatgatttcatagttttgtgatagattaagaggatatggatacttatcttaccaggtaagattttttttttaatttctttttgaaaaataattgatttgttgttaattgctcataaagatttcaaaaatcttg

SEQ ID NO: 66476 - DNA, 201 bp, Bos taurus; identical to SEQ ID NO: 26376

SEQ ID NO: 66477 - DNA, 201 bp, Bos taurus; identical to SEQ ID NO: 26377

SEQ ID NO: 66478 - DNA, 201 bp, Bos taurus; identical to SEQ ID NO: 26378

SEQ ID NO: 66479 - DNA, 201 bp, Bos taurus; identical to SEQ ID NO: 26379

SEQ ID NO: 66480 - DNA, 201 bp, Bos taurus
ccatgggacgctccactctgcctcctctctcctggcctcagagctcctggctggcaaagtagagagatgctggcttccattgccttcccaaaaaaggctgcggtcacccctggccaccaaaaggcccagtcgactgaagaaaaccttcagaagtgggtgcccttgctgggggctgggaggacaagagagacttcattttcc

SEQ ID NO: 66481 - DNA, 201 bp, Bos taurus
gcactggccggtggattctctaccactgatccccaccatcatgttcaaattggtaatttcatgtaagaccccagatttctttctggttttctctgatctgactgcccttcttctggccacaggccgagctaggaggctttctcccctctttaggtgggctgtggatcctctggttgccacaggctccaccggtccacctct

SEQ ID NO: 66482 - DNA, 201 bp, Bos taurus; identical to SEQ ID NO: 26382

SEQ ID NO: 66483 - DNA, 201 bp, Bos taurus; identical to SEQ ID NO: 26383

SEQ ID NO: 66484 - DNA, 201 bp, Bos taurus; identical to SEQ ID NO: 26384

SEQ ID NO: 66485 - DNA, 201 bp, Bos taurus; identical to SEQ ID NO: 26386

SEQ ID NO: 66486 - DNA, 201 bp, Bos taurus; identical to SEQ ID NO: 26387

SEQ ID NO: 66487 - DNA, 201 bp, Bos taurus; identical to SEQ ID NO: 26388

SEQ ID NO: 66488 - DNA, 201 bp, Bos taurus
atatattttttcacacctgaaaacttgaagttccctttcaatctagagattcttgctcttcaagtttgggaaatattattttattttgttgatgaagcgctcctcctcttctttatttgtggtactcttgtttgcaagtcagacttcttggactggtctccaagttattttctcttttcttccctgttttctttctttttg

SEQ ID NO: 66489 - DNA, 201 bp, Bos taurus
cacaggggcagacaccccaaagcacaccccagttctgggccctgtgactttgtcaccgcgtgtaaagtccccttggtggggtggagtgctgagtctgtgtcttccggggtgcccttcatcctcatctcttctagtctctaggggaatacaggtgggacaggaacagtctctctcactcccaagctccctgagtcccactct

SEQ ID NO: 66490 - DNA, 201 bp, Bos taurus; identical to SEQ ID NO: 26390

SEQ ID NO: 66491 - DNA, 201 bp, Bos taurus; identical to SEQ ID NO: 26392

SEQ ID NO: 66492 - DNA, 201 bp, Bos taurus; identical to SEQ ID NO: 26393

SEQ ID NO: 66493 - DNA, 201 bp, Bos taurus; identical to SEQ ID NO: 26394

SEQ ID NO: 66494 - DNA, 201 bp, Bos taurus; identical to SEQ ID NO: 26401

SEQ ID NO: 66495 - DNA, 201 bp, Bos taurus; identical to SEQ ID NO: 26402

SEQ ID NO: 66496 - DNA, 201 bp, Bos taurus
gggccgggggagggctgggaggtgtagcatgtcacctccggctgggtgttcacttccagagagaatctgacactcggggaggaagagcacaaacctctgtcagggccccaggccacactgacttcacaagcctatctcacaaaccacacgaggaaggaaagccatgccatcctcctttcacacactccaaaagaggagtga

SEQ ID NO: 66497 - DNA, 201 bp, Bos taurus; identical to SEQ ID NO: 26403

SEQ ID NO: 66498 - DNA, 201 bp, Bos taurus; identical to SEQ ID NO: 26404

SEQ ID NO: 66499 - DNA, 201 bp, Bos taurus
gttttgctgacattttgtagacacttcttggctgtaatccctcaattagctgggcatctatcaagtagttttgtgttctgaatatttttctaattaatctttgctgtacaagacgaaatcaaaaaaattttcttcgatcgagatatattacatcgctgacttctcttccatttactgggtctattactctgtcatagaaat

SEQ ID NO: 66500 - DNA, 201 bp, Bos taurus; identical to SEQ ID NO: 26405

SEQ ID NO: 66501 - DNA, 201 bp, Bos taurus; identical to SEQ ID NO: 26408

SEQ ID NO: 66502 - DNA, 201 bp, Bos taurus; identical to SEQ ID NO: 26409

SEQ ID NO: 66503 - DNA, 201 bp, Bos taurus; identical to SEQ ID NO: 26410

SEQ ID NO: 66504 - DNA, 201 bp, Bos taurus; identical to SEQ ID NO: 26411

SEQ ID NO: 66505 - DNA, 201 bp, Bos taurus; identical to SEQ ID NO: 26412

SEQ ID NO: 66506 - DNA, 201 bp, Bos taurus; identical to SEQ ID NO: 26413

SEQ ID NO: 66507 - DNA, 201 bp, Bos taurus; identical to SEQ ID NO: 26414

SEQ ID NO: 66508 - DNA, 201 bp, Bos taurus; identical to SEQ ID NO: 26415

SEQ ID NO: 66509 - DNA, 201 bp, Bos taurus; identical to SEQ ID NO: 26416

SEQ ID NO: 66510 - DNA, 201 bp, Bos taurus; identical to SEQ ID NO: 26417

SEQ ID NO: 66511 - DNA, 201 bp, Bos taurus; identical to SEQ ID NO: 26418

SEQ ID NO: 66512 - DNA, 201 bp, Bos taurus; identical to SEQ ID NO: 26419

SEQ ID NO: 66513 - DNA, 201 bp, Bos taurus; identical to SEQ ID NO: 26421

SEQ ID NO: 66514 - DNA, 201 bp, Bos taurus; identical to SEQ ID NO: 26422

SEQ ID NO: 66515 - DNA, 201 bp, Bos taurus; identical to SEQ ID NO: 26423

SEQ ID NO: 66516 - DNA, 201 bp, Bos taurus; identical to SEQ ID NO: 26424

SEQ ID NO: 66517 - DNA, 201 bp, Bos taurus; identical to SEQ ID NO: 26425

SEQ ID NO: 66518 - DNA, 201 bp, Bos taurus; identical to SEQ ID NO: 26426

SEQ ID NO: 66519 - DNA, 201 bp, Bos taurus; identical to SEQ ID NO: 26427

SEQ ID NO: 66520 - DNA, 201 bp, Bos taurus; identical to SEQ ID NO: 26428

SEQ ID NO: 66521 - DNA, 201 bp, Bos taurus; identical to SEQ ID NO: 26429

SEQ ID NO: 66522 - DNA, 201 bp, Bos taurus; identical to SEQ ID NO: 26430

SEQ ID NO: 66523 - DNA, 201 bp, Bos taurus; identical to SEQ ID NO: 26431

SEQ ID NO: 66524 - DNA, 201 bp, Bos taurus; identical to SEQ ID NO: 26432

SEQ ID NO: 66525 - DNA, 201 bp, Bos taurus; identical to SEQ ID NO: 26433

SEQ ID NO: 66526 - DNA, 201 bp, Bos taurus; identical to SEQ ID NO: 26434

SEQ ID NO: 66527 - DNA, 201 bp, Bos taurus; identical to SEQ ID NO: 26435

SEQ ID NO: 66528 - DNA, 201 bp, Bos taurus; identical to SEQ ID NO: 26436

SEQ ID NO: 66529 - DNA, 201 bp, Bos taurus; identical to SEQ ID NO: 26437

SEQ ID NO: 66530 - DNA, 201 bp, Bos taurus; identical to SEQ ID NO: 26438

SEQ ID NO: 66531 - DNA, 201 bp, Bos taurus; identical to SEQ ID NO: 26439

SEQ ID NO: 66532 - DNA, 201 bp, Bos taurus; identical to SEQ ID NO: 26440

SEQ ID NO: 66533 - DNA, 201 bp, Bos taurus; identical to SEQ ID NO: 26441

SEQ ID NO: 66534 - DNA, 201 bp, Bos taurus; identical to SEQ ID NO: 26442

SEQ ID NO: 66535 - DNA, 201 bp, Bos taurus; identical to SEQ ID NO: 26443

SEQ ID NO: 66536 - DNA, 201 bp, Bos taurus; identical to SEQ ID NO: 26444

SEQ ID NO: 66537 - DNA, 201 bp, Bos taurus; identical to SEQ ID NO: 26445

SEQ ID NO: 66538 - DNA, 201 bp, Bos taurus; identical to SEQ ID NO: 26446

SEQ ID NO: 66539 - DNA, 201 bp, Bos taurus; identical to SEQ ID NO: 26447

SEQ ID NO: 66540 - DNA, 201 bp, Bos taurus; identical to SEQ ID NO: 26448

SEQ ID NO: 66541 - DNA, 201 bp, Bos taurus; identical to SEQ ID NO: 26449

SEQ ID NO: 66542 - DNA, 201 bp, Bos taurus; identical to SEQ ID NO: 26450

SEQ ID NO: 66543 - DNA, 201 bp, Bos taurus; identical to SEQ ID NO: 26451

SEQ ID NO: 66544 - DNA, 201 bp, Bos taurus; identical to SEQ ID NO: 26453

SEQ ID NO: 66545 - DNA, 201 bp, Bos taurus; identical to SEQ ID NO: 26454

SEQ ID NO: 66546 - DNA, 201 bp, Bos taurus; identical to SEQ ID NO: 26455

SEQ ID NO: 66547 - DNA, 201 bp, Bos taurus; identical to SEQ ID NO: 26456

SEQ ID NO: 66548 - DNA, 201 bp, Bos taurus; identical to SEQ ID NO: 26457

SEQ ID NO: 66549 - DNA, 201 bp, Bos taurus; identical to SEQ ID NO: 26458

SEQ ID NO: 66550 - DNA, 201 bp, Bos taurus; identical to SEQ ID NO: 26459

SEQ ID NO: 66551 - DNA, 201 bp, Bos taurus; identical to SEQ ID NO: 26460

SEQ ID NO: 66552 - DNA, 201 bp, Bos taurus; identical to SEQ ID NO: 26461

SEQ ID NO: 66553 - DNA, 201 bp, Bos taurus; identical to SEQ ID NO: 26462

SEQ ID NO: 66554 - DNA, 201 bp, Bos taurus; identical to SEQ ID NO: 26463

SEQ ID NO: 66555 - DNA, 201 bp, Bos taurus; identical to SEQ ID NO: 26464

SEQ ID NO: 66556 - DNA, 201 bp, Bos taurus; identical to SEQ ID NO: 26465

SEQ ID NO: 66557 - DNA, 201 bp, Bos taurus; identical to SEQ ID NO: 26466

SEQ ID NO: 66558 - DNA, 201 bp, Bos taurus; identical to SEQ ID NO: 26467

SEQ ID NO: 66559 - DNA, 201 bp, Bos taurus; identical to SEQ ID NO: 26468

SEQ ID NO: 66560 - DNA, 201 bp, Bos taurus; identical to SEQ ID NO: 26469

SEQ ID NO: 66561 - DNA, 201 bp, Bos taurus; identical to SEQ ID NO: 26470

SEQ ID NO: 66562 - DNA, 201 bp, Bos taurus; identical to SEQ ID NO: 26471

SEQ ID NO: 66563 - DNA, 201 bp, Bos taurus; identical to SEQ ID NO: 26472

SEQ ID NO: 66564 - DNA, 201 bp, Bos taurus; identical to SEQ ID NO: 26473

SEQ ID NO: 66565 - DNA, 201 bp, Bos taurus; identical to SEQ ID NO: 26474

SEQ ID NO: 66566 - DNA, 201 bp, Bos taurus; identical to SEQ ID NO: 26475

SEQ ID NO: 66567 - DNA, 201 bp, Bos taurus; identical to SEQ ID NO: 26476

SEQ ID NO: 66568 - DNA, 201 bp, Bos taurus; identical to SEQ ID NO: 26477

SEQ ID NO: 66569 - DNA, 201 bp, Bos taurus; identical to SEQ ID NO: 26478

SEQ ID NO: 66570 - DNA, 201 bp, Bos taurus; identical to SEQ ID NO: 26479

SEQ ID NO: 66571 - DNA, 201 bp, Bos taurus; identical to SEQ ID NO: 26480

SEQ ID NO: 66572 - DNA, 201 bp, Bos taurus; identical to SEQ ID NO: 26481

SEQ ID NO: 66573 - DNA, 201 bp, Bos taurus; identical to SEQ ID NO: 26482

SEQ ID NO: 66574 - DNA, 201 bp, Bos taurus; identical to SEQ ID NO: 26483

SEQ ID NO: 66575 - DNA, 201 bp, Bos taurus; identical to SEQ ID NO: 26484

SEQ ID NO: 66576 - DNA, 201 bp, Bos taurus; identical to SEQ ID NO: 26485

SEQ ID NO: 66577 - DNA, 201 bp, Bos taurus; identical to SEQ ID NO: 26486

SEQ ID NO: 66578 - DNA, 201 bp, Bos taurus; identical to SEQ ID NO: 26487

SEQ ID NO: 66579 - DNA, 201 bp, Bos taurus; identical to SEQ ID NO: 26488

SEQ ID NO: 66580 - DNA, 201 bp, Bos taurus; identical to SEQ ID NO: 26489

SEQ ID NO: 66581 - DNA, 201 bp, Bos taurus; identical to SEQ ID NO: 26490

SEQ ID NO: 66582 - DNA, 201 bp, Bos taurus; identical to SEQ ID NO: 26491

SEQ ID NO: 66583 - DNA, 201 bp, Bos taurus; identical to SEQ ID NO: 26492

SEQ ID NO: 66584 - DNA, 201 bp, Bos taurus; identical to SEQ ID NO: 26493

SEQ ID NO: 66585 - DNA, 201 bp, Bos taurus; identical to SEQ ID NO: 26494

SEQ ID NO: 66586 - DNA, 201 bp, Bos taurus; identical to SEQ ID NO: 26495

SEQ ID NO: 66587 - DNA, 201 bp, Bos taurus; identical to SEQ ID NO: 26496

SEQ ID NO: 66588 - DNA, 201 bp, Bos taurus; identical to SEQ ID NO: 26497

SEQ ID NO: 66589 - DNA, 201 bp, Bos taurus; identical to SEQ ID NO: 26498

SEQ ID NO: 66590 - DNA, 201 bp, Bos taurus; identical to SEQ ID NO: 26499

SEQ ID NO: 66591 - DNA, 201 bp, Bos taurus; identical to SEQ ID NO: 26500

SEQ ID NO: 66592 - DNA, 201 bp, Bos taurus; identical to SEQ ID NO: 26501

SEQ ID NO: 66593 - DNA, 201 bp, Bos taurus; identical to SEQ ID NO: 26502

SEQ ID NO: 66594 - DNA, 201 bp, Bos taurus; identical to SEQ ID NO: 26503

SEQ ID NO: 66595 - DNA, 201 bp, Bos taurus; identical to SEQ ID NO: 26504

SEQ ID NO: 66596 - DNA, 201 bp, Bos taurus; identical to SEQ ID NO: 26505

SEQ ID NO: 66597 - DNA, 201 bp, Bos taurus; identical to SEQ ID NO: 26506

SEQ ID NO: 66598 - DNA, 201 bp, Bos taurus; identical to SEQ ID NO: 26508

SEQ ID NO: 66599 - DNA, 201 bp, Bos taurus; identical to SEQ ID NO: 26509

SEQ ID NO: 66600 - DNA, 201 bp, Bos taurus; identical to SEQ ID NO: 26510

SEQ ID NO: 66601 - DNA, 201 bp, Bos taurus; identical to SEQ ID NO: 26511

SEQ ID NO: 66602 - DNA, 201 bp, Bos taurus; identical to SEQ ID NO: 26512

SEQ ID NO: 66603 - DNA, 201 bp, Bos taurus; identical to SEQ ID NO: 26513

SEQ ID NO: 66604 - DNA, 201 bp, Bos taurus; identical to SEQ ID NO: 26514

SEQ ID NO: 66605 - DNA, 201 bp, Bos taurus; identical to SEQ ID NO: 26515

SEQ ID NO: 66606 - DNA, 201 bp, Bos taurus; identical to SEQ ID NO: 26516

SEQ ID NO: 66607 - DNA, 201 bp, Bos taurus; identical to SEQ ID NO: 26517

SEQ ID NO: 66608 - DNA, 201 bp, Bos taurus; identical to SEQ ID NO: 26518

SEQ ID NO: 66609 - DNA, 201 bp, Bos taurus; identical to SEQ ID NO: 26519

SEQ ID NO: 66610 - DNA, 201 bp, Bos taurus; identical to SEQ ID NO: 26520

SEQ ID NO: 66611 - DNA, 201 bp, Bos taurus; identical to SEQ ID NO: 26521

SEQ ID NO: 66612 - DNA, 201 bp, Bos taurus; identical to SEQ ID NO: 26522

SEQ ID NO: 66613 - DNA, 201 bp, Bos taurus; identical to SEQ ID NO: 26523

SEQ ID NO: 66614 - DNA, 201 bp, Bos taurus; identical to SEQ ID NO: 26524

SEQ ID NO: 66615 - DNA, 201 bp, Bos taurus; identical to SEQ ID NO: 26525

SEQ ID NO: 66616 - DNA, 201 bp, Bos taurus; identical to SEQ ID NO: 26526

SEQ ID NO: 66617 - DNA, 201 bp, Bos taurus; identical to SEQ ID NO: 26527

SEQ ID NO: 66618 - DNA, 201 bp, Bos taurus; identical to SEQ ID NO: 26528

SEQ ID NO: 66619 - DNA, 201 bp, Bos taurus; identical to SEQ ID NO: 26529

SEQ ID NO: 66620 - DNA, 201 bp, Bos taurus; identical to SEQ ID NO: 26530

SEQ ID NO: 66621 - DNA, 201 bp, Bos taurus; identical to SEQ ID NO: 26531

SEQ ID NO: 66622 - DNA, 201 bp, Bos taurus; identical to SEQ ID NO: 26532

SEQ ID NO: 66623 - DNA, 201 bp, Bos taurus; identical to SEQ ID NO: 26533

SEQ ID NO: 66624 - DNA, 201 bp, Bos taurus; identical to SEQ ID NO: 26534

SEQ ID NO: 66625 - DNA, 201 bp, Bos taurus; identical to SEQ ID NO: 26535

SEQ ID NO: 66626 - DNA, 201 bp, Bos taurus; identical to SEQ ID NO: 26536

SEQ ID NO: 66627 - DNA, 201 bp, Bos taurus; identical to SEQ ID NO: 26537

SEQ ID NO: 66628 - DNA, 201 bp, Bos taurus; identical to SEQ ID NO: 26538

SEQ ID NO: 66629 - DNA, 201 bp, Bos taurus; identical to SEQ ID NO: 26539

SEQ ID NO: 66630 - DNA, 201 bp, Bos taurus; identical to SEQ ID NO: 26540

SEQ ID NO: 66631 - DNA, 201 bp, Bos taurus; identical to SEQ ID NO: 26541

SEQ ID NO: 66632 - DNA, 201 bp, Bos taurus; identical to SEQ ID NO: 26543

SEQ ID NO: 66633 - DNA, 201 bp, Bos taurus; identical to SEQ ID NO: 26544

SEQ ID NO: 66634 - DNA, 201 bp, Bos taurus; identical to SEQ ID NO: 26545

SEQ ID NO: 66635 - DNA, 201 bp, Bos taurus; identical to SEQ ID NO: 26546

SEQ ID NO: 66636 - DNA, 201 bp, Bos taurus; identical to SEQ ID NO: 26547

SEQ ID NO: 66637 - DNA, 201 bp, Bos taurus; identical to SEQ ID NO: 26548

SEQ ID NO: 66638 - DNA, 201 bp, Bos taurus; identical to SEQ ID NO: 26549

SEQ ID NO: 66639 - DNA, 201 bp, Bos taurus; identical to SEQ ID NO: 26550

SEQ ID NO: 66640 - DNA, 201 bp, Bos taurus; identical to SEQ ID NO: 26551

SEQ ID NO: 66641 - DNA, 201 bp, Bos taurus; identical to SEQ ID NO: 26552

SEQ ID NO: 66642 - DNA, 201 bp, Bos taurus; identical to SEQ ID NO: 26553

SEQ ID NO: 66643 - DNA, 201 bp, Bos taurus; identical to SEQ ID NO: 26554

SEQ ID NO: 66644 - DNA, 201 bp, Bos taurus; identical to SEQ ID NO: 26555

SEQ ID NO: 66645 - DNA, 201 bp, Bos taurus; identical to SEQ ID NO: 26556

SEQ ID NO: 66646 - DNA, 201 bp, Bos taurus; identical to SEQ ID NO: 26557

SEQ ID NO: 66647 - DNA, 201 bp, Bos taurus; identical to SEQ ID NO: 26558

SEQ ID NO: 66648 - DNA, 201 bp, Bos taurus; identical to SEQ ID NO: 26559

SEQ ID NO: 66649 - DNA, 201 bp, Bos taurus; identical to SEQ ID NO: 26560

SEQ ID NO: 66650 - DNA, 201 bp, Bos taurus; identical to SEQ ID NO: 26561

SEQ ID NO: 66651 - DNA, 201 bp, Bos taurus; identical to SEQ ID NO: 26562

SEQ ID NO: 66652 - DNA, 201 bp, Bos taurus
atatagttagtttttgttgaggttatactggagtagcccctaatccaacatgactggtgtacacacgaggagaacgtcatgtgaacatgaaggcagaaatcgggttgatgcagcgtaagtcaaggaatgtcagagatagccagcaaaccaccagctgctaggagagaggctttgagtgggttttcctttgcactgtcgggg

SEQ ID NO: 66653 - DNA, 201 bp, Bos taurus; identical to SEQ ID NO: 26565

SEQ ID NO: 66654 - DNA, 201 bp, Bos taurus; identical to SEQ ID NO: 26566

SEQ ID NO: 66655 - DNA, 201 bp, Bos taurus; identical to SEQ ID NO: 26567

SEQ ID NO: 66656 - DNA, 201 bp, Bos taurus; identical to SEQ ID NO: 26568

SEQ ID NO: 66657 - DNA, 201 bp, Bos taurus; identical to SEQ ID NO: 26569

SEQ ID NO: 66658 - DNA, 201 bp, Bos taurus; identical to SEQ ID NO: 26570

SEQ ID NO: 66659 - DNA, 201 bp, Bos taurus
ttcatcatggatcccttcacatggatactttcttcacatgatcttctccaaaagacaaagctcttcattaatgtaaaacaacagtgattctcactaagacgaggcctatatgactgtaaagaatagagttcattataataattacttagtcccttattataacaattagtgcattattagaattactccttgtcaaccagg

SEQ ID NO: 66660 - DNA, 201 bp, Bos taurus; identical to SEQ ID NO: 26571

SEQ ID NO: 66661 - DNA, 201 bp, Bos taurus
atcaatggagttatcattatcatcctcattaaatatttgtgaaacatctccatatgcatagtggcaggtatttaagcatgatgagaaaatgaaaagaaatgtataattatgatgtgtgtcctcaggggccttgaacctgagttgtgcagacagatacattatttatgaaactgtgaatagctgtccacataggatactgtg

SEQ ID NO: 66662 - DNA, 201 bp, Bos taurus; identical to SEQ ID NO: 26572

SEQ ID NO: 66663 - DNA, 201 bp, Bos taurus; identical to SEQ ID NO: 26573

SEQ ID NO: 66664 - DNA, 201 bp, Bos taurus; identical to SEQ ID NO: 26574

SEQ ID NO: 66665 - DNA, 201 bp, Bos taurus; identical to SEQ ID NO: 26575

SEQ ID NO: 66666 - DNA, 201 bp, Bos taurus; identical to SEQ ID NO: 26576

SEQ ID NO: 66667 - DNA, 201 bp, Bos taurus; identical to SEQ ID NO: 26577

SEQ ID NO: 66668 - DNA, 201 bp, Bos taurus; identical to SEQ ID NO: 26578

SEQ ID NO: 66669 - DNA, 201 bp, Bos taurus
gttggtccccagtactgactgcactctaggcttgccaaacaaacgactgtaggtcactctacagtatttgcagtgagttttaccttccattcataatccctaagtctgtaccacactctctgaactagttattcactgaagctggtctcaatggcaggtgagaaagattaaggtgtcatgttgttcagtctcccagttgtg

SEQ ID NO: 66670 - DNA, 201 bp, Bos taurus
ctgtatctagagaactgagttattaaaactgttttcttcatgacccattatcaacctcagtccttatgagtcccctcttgctattttggtactttttccttttcattttctgtaccacctctttcctcctatgtggactcactctattatactttatgtctttgcaatttgtttttcctttgtttatttagataagtatat

SEQ ID NO: 66671 - DNA, 201 bp, Bos taurus; identical to SEQ ID NO: 26583

SEQ ID NO: 66672 - DNA, 201 bp, Bos taurus; identical to SEQ ID NO: 26584

SEQ ID NO: 66673 - DNA, 201 bp, Bos taurus; identical to SEQ ID NO: 26585

SEQ ID NO: 66674 - DNA, 201 bp, Bos taurus
gcatttcgttgtatttatttccctaatacggtattacatgaggactaaaatgtgtcatgtttttagaagtactcttaaagatgacagagctcatattcatcagtttcatgctttgaaatgaattaactataataacatgactctgtgttgagatgcttttaactaataatactttcaaataaataaaaggagttttttaaa

SEQ ID NO: 66675 - DNA, 201 bp, Bos taurus
cattattagtcattgagaatatgctaactgaaaacacaatgagatattacaacacattcactaaactggtcatgatcaaaaagagatcgtatcaaatgctgtgtaaaatatggagaaattagaacccttaacattggtggtaggaaggtatagccactttgcaacacagtttggcagtttcttaaaaagttaatttatcat

SEQ ID NO: 66676 - DNA, 201 bp, Bos taurus
gcaaagatatcatgtaaaactaatttttttctttattgaaaatacatctacaaagtaacgcttctcagtccacactgggtacaagtgatatgcagagcctgtgatgggctggcgagagggtcatctcagaggatctgctttccctaagagatggttagtattaaaaaagatcacactgtgtaaccgagttaatttgacatg

SEQ ID NO: 66677 - DNA, 201 bp, Bos taurus; identical to SEQ ID NO: 26588

SEQ ID NO: 66678 - DNA, 201 bp, Bos taurus
tgtcttgtagaggctgggggtgggggggtcttcctacctggaagctgtgctccctggagtcaaattcctaaggactagacttaggataatgtagaaggtgagagtggggacatttgctgggacattcaaggttataaaactcctggagaactggaggatcttacttcttttgtatggttgtttagtatatcaccacagcca

SEQ ID NO: 66679 - DNA, 201 bp, Bos taurus
tgttgcttatcaaattttgtgaaatgctttaagtaatataatttgcgtgtggtctcacattggtgtatctgaggcctctgatacgcaggaaggggcctggcattgatttactggttggctcagtttctgttgcactcatccactgggtccaagagtcgagctttgacttacagctcggcctggatctggtcattctttatc

SEQ ID NO: 66680 - DNA, 201 bp, Bos taurus
agcatcaaacatcagaaacgaactcagacttttgattacacctgggtaattgggagagaaaccaagttagtaagtagaagtacagaagactactgaatcacaaaactatttgtatatatcactttaaatcatgaagatgaatttttctaaaacagaatgagcagagactctggaaccaatcttgacacattatcttaaact

SEQ ID NO: 66681 - DNA, 201 bp, Bos taurus; identical to SEQ ID NO: 26589

SEQ ID NO: 66682 - DNA, 201 bp, Bos taurus
aacagtgtttaagaaagggctgtgttaaagtgtgtgtcttcttgggaatgcaaaggcctttgtgggaggaacttaatttccagtgtagtaaaacagtgtgcgcacggcaaggggatgtatgttatgaagaaagtaactatactcaaaaacacagttacaaacctgtattgcaaatgatttctttgcatgtctgtttcccac

SEQ ID NO: 66683 - DNA, 201 bp, Bos taurus; identical to SEQ ID NO: 26591

SEQ ID NO: 66684 - DNA, 201 bp, Bos taurus
acactttcgtagtctactcataggataagatttttaaatgcaacatgaaaatttttaattaaaaaaaattttaaactgttaaaaaaatttacaggcccaagctctgtcactgcaaatacatttaggtttcaactgaaggtctttacatgctgacaggttaaatatgaaggccatgtttctcagttttcaaatgagtagtct

SEQ ID NO: 66685 - DNA, 201 bp, Bos taurus
gaatataggtgccttcggccagagctgtaagcagaaaccctgctcctgggtgccaagcttaaagcactcttggaatcagctgagggacagcggcagctactaggaggaagcctagcagtctgtggccagaccaccggataaaccagtatatatgtcctcctgccacagcagaacactgctcactactaatactgtggatac

SEQ ID NO: 66686 - DNA, 201 bp, Bos taurus; identical to SEQ ID NO: 26592

SEQ ID NO: 66687 - DNA, 201 bp, Bos taurus; identical to SEQ ID NO: 26593

SEQ ID NO: 66688 - DNA, 201 bp, Bos taurus; identical to SEQ ID NO: 26594

SEQ ID NO: 66689 - DNA, 201 bp, Bos taurus; identical to SEQ ID NO: 26595

SEQ ID NO: 66690 - DNA, 201 bp, Bos taurus; identical to SEQ ID NO: 26596

SEQ ID NO: 66691 - DNA, 201 bp, Bos taurus; identical to SEQ ID NO: 26597

SEQ ID NO: 66692 - DNA, 201 bp, Bos taurus; identical to SEQ ID NO: 26598

SEQ ID NO: 66693 - DNA, 201 bp, Bos taurus; identical to SEQ ID NO: 26599

SEQ ID NO: 66694 - DNA, 201 bp, Bos taurus; identical to SEQ ID NO: 26600

SEQ ID NO: 66695 - DNA, 201 bp, Bos taurus
ctgagaactcagggtcatccaaagacgccagggatttatgttggaggaggccatgttaccagcttcttttgagccagaaccactggaaggggaccatgttcggagcaaatgttcccacgtgactgccgctttccctgtgcatgaatataagtctgggctataaaggaggtagggacagtgggaagccaaaactggttcccc

SEQ ID NO: 66696 - DNA, 201 bp, Bos taurus; identical to SEQ ID NO: 26601

SEQ ID NO: 66697 - DNA, 201 bp, Bos taurus; identical to SEQ ID NO: 26602

SEQ ID NO: 66698 - DNA, 201 bp, Bos taurus; identical to SEQ ID NO: 26603

SEQ ID NO: 66699 - DNA, 201 bp, Bos taurus
aaggatgccctcgtagccacagcaggtgcaaaagagaactggactgtttcagcgtaagagcaatgaaccgtctccagaataaatacagtaccgtgattaaccttttgaaacaatgaaccaagcagagtaacacaaatactaaattgggctgtcttccaggatgacctttctttaagaatgtaaagtaggcaaagatgtatc

SEQ ID NO: 66700 - DNA, 201 bp, Bos taurus; identical to SEQ ID NO: 26604

SEQ ID NO: 66701 - DNA, 201 bp, Bos taurus; identical to SEQ ID NO: 26605

SEQ ID NO: 66702 - DNA, 201 bp, Bos taurus; identical to SEQ ID NO: 26606

SEQ ID NO: 66703 - DNA, 201 bp, Bos taurus; identical to SEQ ID NO: 26607

SEQ ID NO: 66704 - DNA, 201 bp, Bos taurus; identical to SEQ ID NO: 26608

SEQ ID NO: 66705 - DNA, 201 bp, Bos taurus; identical to SEQ ID NO: 26609

SEQ ID NO: 66706 - DNA, 201 bp, Bos taurus; identical to SEQ ID NO: 26610

SEQ ID NO: 66707 - DNA, 201 bp, Bos taurus
atataagtacagataatacctggagagacccagatacaattcagaaagccattttggacttcaagatcagccagtttgaagggaaaaggtaatagtatgcgtgccagattatttgtgcttaggctaaacaaaacaaacatatttctgtgggaacttaaaacagaaaatctttcagagtttcatgttctgtaagtttgttga

SEQ ID NO: 66708 - DNA, 201 bp, Bos taurus; identical to SEQ ID NO: 26615

SEQ ID NO: 66709 - DNA, 201 bp, Bos taurus; identical to SEQ ID NO: 26616

SEQ ID NO: 66710 - DNA, 201 bp, Bos taurus; identical to SEQ ID NO: 26617

SEQ ID NO: 66711 - DNA, 201 bp, Bos taurus; identical to SEQ ID NO: 26618

SEQ ID NO: 66712 - DNA, 201 bp, Bos taurus; identical to SEQ ID NO: 26619

SEQ ID NO: 66713 - DNA, 201 bp, Bos taurus; identical to SEQ ID NO: 26621

SEQ ID NO: 66714 - DNA, 201 bp, Bos taurus; identical to SEQ ID NO: 26622

SEQ ID NO: 66715 - DNA, 201 bp, Bos taurus; identical to SEQ ID NO: 26623

SEQ ID NO: 66716 - DNA, 201 bp, Bos taurus; identical to SEQ ID NO: 26624

SEQ ID NO: 66717 - DNA, 201 bp, Bos taurus; identical to SEQ ID NO: 26625

SEQ ID NO: 66718 - DNA, 201 bp, Bos taurus; identical to SEQ ID NO: 26626

SEQ ID NO: 66719 - DNA, 201 bp, Bos taurus; identical to SEQ ID NO: 26627

SEQ ID NO: 66720 - DNA, 201 bp, Bos taurus; identical to SEQ ID NO: 26628

SEQ ID NO: 66721 - DNA, 201 bp, Bos taurus; identical to SEQ ID NO: 26629

SEQ ID NO: 66722 - DNA, 201 bp, Bos taurus; identical to SEQ ID NO: 26631

SEQ ID NO: 66723 - DNA, 201 bp, Bos taurus; identical to SEQ ID NO: 26632

SEQ ID NO: 66724 - DNA, 201 bp, Bos taurus; identical to SEQ ID NO: 26635

SEQ ID NO: 66725 - DNA, 201 bp, Bos taurus; identical to SEQ ID NO: 26636

SEQ ID NO: 66726 - DNA, 201 bp, Bos taurus
acctcttggttccatattgactcctgtttttttattcatttgatggtaatttattccttctatgagataagaaaacataggataacctcacttagaataggcagtttcaaaattttaaaaacaacaacaacaaaatctgttaagactttataaaacttgtcttatgatttataacctgctcctcggtaggtgatattttca

SEQ ID NO: 66727 - DNA, 201 bp, Bos taurus; identical to SEQ ID NO: 26637

SEQ ID NO: 66728 - DNA, 201 bp, Bos taurus; identical to SEQ ID NO: 26638

SEQ ID NO: 66729 - DNA, 201 bp, Bos taurus; identical to SEQ ID NO: 26640

SEQ ID NO: 66730 - DNA, 201 bp, Bos taurus; identical to SEQ ID NO: 26641

SEQ ID NO: 66731 - DNA, 201 bp, Bos taurus; identical to SEQ ID NO: 26642

SEQ ID NO: 66732 - DNA, 201 bp, Bos taurus; identical to SEQ ID NO: 26643

SEQ ID NO: 66733 - DNA, 201 bp, Bos taurus; identical to SEQ ID NO: 26644

SEQ ID NO: 66734 - DNA, 201 bp, Bos taurus; identical to SEQ ID NO: 26645

SEQ ID NO: 66735 - DNA, 201 bp, Bos taurus; identical to SEQ ID NO: 26648

SEQ ID NO: 66736 - DNA, 201 bp, Bos taurus; identical to SEQ ID NO: 26651

SEQ ID NO: 66737 - DNA, 201 bp, Bos taurus; identical to SEQ ID NO: 26652

SEQ ID NO: 66738 - DNA, 201 bp, Bos taurus
cttacaagatgaagaaggaatgctgcatttgaggagttgtcttgttgatgctgggagaatgttgcttttcatttaaagtgggtattcttgctgatggggaagtttggatgatgcataaagcagacacgcaatgcagggagaggggggagaggatgccaaagggcagagatttttatgtttaaatttttcttggctttctat

SEQ ID NO: 66739 - DNA, 201 bp, Bos taurus; identical to SEQ ID NO: 26653

SEQ ID NO: 66740 - DNA, 201 bp, Bos taurus; identical to SEQ ID NO: 26654

SEQ ID NO: 66741 - DNA, 201 bp, Bos taurus
tggtataggtttatttaagttgttataagcactcagataaaagagggccaattctttaaaggtggagaacagtagggaaatattttcatgcgagatttgttttaagcatgcgtgaatacttcccatatactcaggaaagtaaacgtgagtcccaggctctatacccaattgaagtgcccttcatatatggagatcacagac

SEQ ID NO: 66742 - DNA, 201 bp, Bos taurus; identical to SEQ ID NO: 26656

SEQ ID NO: 66743 - DNA, 201 bp, Bos taurus; identical to SEQ ID NO: 26658

SEQ ID NO: 66744 - DNA, 201 bp, Bos taurus; identical to SEQ ID NO: 26659

SEQ ID NO: 66745 - DNA, 201 bp, Bos taurus; identical to SEQ ID NO: 26662

SEQ ID NO: 66746 - DNA, 201 bp, Bos taurus
aaattgcttacatgtaagaacacaggtggtgggaggtggcctattagcagcacataatgaactagcttctgcacttcctgtttgattcccctccaagtcccgaggtggctagaaaggaaaaaaaagtcattctctacctattaagaataaaatctaggaggtaatggttgagtgttcaggtcaaggaaagcatgcatgaat

SEQ ID NO: 66747 - DNA, 201 bp, Bos taurus; identical to SEQ ID NO: 26663

SEQ ID NO: 66748 - DNA, 201 bp, Bos taurus
tcagcctggtctgaacacctgccccagagaggttctccggaagaagcttgtcatcccatctcttctgtccccttgagccgctccaatgtccagcccacagctgctccctggccagaaggtggtggagaatagcctggggacccccacttctcaacgtgtttcttcgcaatccatgactgagactggacgtcctctgggcaa

SEQ ID NO: 66749 - DNA, 201 bp, Bos taurus
ggatctcctgcactgcaggcagattactatatgagccaccagagagtcaggggatctaggtaaaaggcaaaattcagaaatcgtgcaggtagcatctagtgttcggcaagcctctgttggctgcagctggatcttgccactagcagtgagctcaggacctggcctcccagtcacaaggaggactggcaagatctaggaagg

SEQ ID NO: 66750 - DNA, 201 bp, Bos taurus; identical to SEQ ID NO: 26666

SEQ ID NO: 66751 - DNA, 201 bp, Bos taurus
agggtgggtgaggttgatgaccaggctagaagggtgtagtggtttttcctggtagggcagcaggcaggaactcagtgcaagctggatgggacctgagaaacatccaaatgaggccgaagcagggaagaaggggctggggcatatactggctgcaagagagacttttgtctgaaagcaagaggctttaagcaacggtgggag

SEQ ID NO: 66752 - DNA, 201 bp, Bos taurus; identical to SEQ ID NO: 26667

SEQ ID NO: 66753 - DNA, 201 bp, Bos taurus; identical to SEQ ID NO: 26669

SEQ ID NO: 66754 - DNA, 201 bp, Bos taurus; identical to SEQ ID NO: 26670

SEQ ID NO: 66755 - DNA, 201 bp, Bos taurus; identical to SEQ ID NO: 26671

SEQ ID NO: 66756 - DNA, 201 bp, Bos taurus; identical to SEQ ID NO: 26672

SEQ ID NO: 66757 - DNA, 201 bp, Bos taurus
cataggaatttcttgcaacttcttgatggacttgctgggcaacttcaaacaactcttgttaacaacttaatcagtagttcgtaagtataaaacagaaataaagcacgcaggttaagaacaggaatttttgccaggggtccccaacctccaggatctaatacctgctgatctgaggtggagctcatgtaacaataatagaaa

SEQ ID NO: 66758 - DNA, 201 bp, Bos taurus; identical to SEQ ID NO: 26673

SEQ ID NO: 66759 - DNA, 201 bp, Bos taurus
aaactagcatttgccatggtggattcaggagagcagtgtgccctcctcaatgcgggtgggccgtcatccaacccattgaggacctgaacagaacaaaaggacagaagaaagcaaaatttggcctttcctgcctcattttttgagctgggatgtagccagctgcaactcctggttctcaggtctttagacctggactgacct

SEQ ID NO: 66760 - DNA, 201 bp, Bos taurus; identical to SEQ ID NO: 26676

SEQ ID NO: 66761 - DNA, 201 bp, Bos taurus; identical to SEQ ID NO: 26677

SEQ ID NO: 66762 - DNA, 201 bp, Bos taurus; identical to SEQ ID NO: 26679

SEQ ID NO: 66763 - DNA, 201 bp, Bos taurus
acacaagaaacgctccgtcaacagtctggatgggagcctggggttaacactcagatgattaccccgggccaaaagtgccacgcgaccttggcctttctcgagcagtgcctgtgctcctggctcctgaatgtcactcgagctgtgggggtggttttatgtgacagagagattacaatgtccggctggaccgggccgtagaca

SEQ ID NO: 66764 - DNA, 201 bp, Bos taurus
caggctgcaagagaaggatacagtctaactcctattcactccttcatgtttttagatggaagcagtttttccccttcttccccttctacgggcctacatcgcaaatgaaatcaaacttgcttaaacatacgaatctaaaaaaggaacactatagaaaaaacatatgaaagcaaaaatgctttcatatcggccctcataatc

SEQ ID NO: 66765 - DNA, 201 bp, Bos taurus
tcgtttaaagatggtaccagcagaaatcataggggatggtgagggagaatgcgtccccacctgtcactgagcccgacgaggatgaggacacagcaaacagcgacggccacatattcacggctgggcccctctccatggagcttcaccagcagcttaggtaaaaaggcaagtctgggttaccaaatcctcagaactcatcgg

SEQ ID NO: 66766 - DNA, 201 bp, Bos taurus; identical to SEQ ID NO: 26683

SEQ ID NO: 66767 - DNA, 201 bp, Bos taurus; identical to SEQ ID NO: 26684

SEQ ID NO: 66768 - DNA, 201 bp, Bos taurus
ctgaagaccaggacccccatggccatctcctcgcaggggtcctcaggcgtgcacacagagcccagccctgccccacctggaggctccatgacataagctgtcaatttttgagaactggcctcaagaaatagaaacaaaccagccttgaaaccaaagattaactgtacttaaaatgatgctggtcagaccaccagtgaccaa

SEQ ID NO: 66769 - DNA, 201 bp, Bos taurus; identical to SEQ ID NO: 26688

SEQ ID NO: 66770 - DNA, 201 bp, Bos taurus; identical to SEQ ID NO: 26689

SEQ ID NO: 66771 - DNA, 201 bp, Bos taurus
acatctgatggttgtagtttatctttcttttgtcaattgctttacaatatacttaatgatgtcttctcttaaaaaatgttgttaggccaatctgggctgacaaaatacaagatacgttcaatagctttctgtgtccacacaagacaagtcatgcataagacagaactctccaaggaaatttagggtgtttagaaaccagaa

SEQ ID NO: 66772 - DNA, 201 bp, Bos taurus; identical to SEQ ID NO: 26691

SEQ ID NO: 66773 - DNA, 201 bp, Bos taurus; identical to SEQ ID NO: 26693

SEQ ID NO: 66774 - DNA, 201 bp, Bos taurus; identical to SEQ ID NO: 26695

SEQ ID NO: 66775 - DNA, 201 bp, Bos taurus; identical to SEQ ID NO: 26696

SEQ ID NO: 66776 - DNA, 201 bp, Bos taurus
cccaaattcagcagctgcaaaactgtaacattcttggaagttatttcaaccccaaactgcttgaaatccaaatgcagaaacttaacaaatgtgataaaagtgtaatctgttgagagactttgtgtaaatactgcacattgaaaagatgtaagttcttccacggcacgcttacaaattgaatacagttccatgtaaaaaaca

SEQ ID NO: 66777 - DNA, 201 bp, Bos taurus; identical to SEQ ID NO: 26698

SEQ ID NO: 66778 - DNA, 201 bp, Bos taurus
aatgtctccctctagccctgcgatggttctgagaggtctagggggtgagggtgggcatggagggcccaaacacccggcctccggcagccatgggctttcgattcatttcactgatgcccacacagtgcccaccgatgacacacatccagggcctcacgtggccctgcccaccaggcacctgggacattgctgtatctcttc

SEQ ID NO: 66779 - DNA, 201 bp, Bos taurus; identical to SEQ ID NO: 26699

SEQ ID NO: 66780 - DNA, 201 bp, Bos taurus
tatctatgtataaattatactagataattattgttgtatctacaaaaattatactatcatatgagtctataaattatatttgtgatgtgtaaatggtttgacacttcaatgagctgacttagaaaaagaaaatatcagaggcgggggagggttgttcgtagcgaagctgccacctgcccaccccatccacaggacgctgtt

SEQ ID NO: 66781 - DNA, 201 bp, Bos taurus; identical to SEQ ID NO: 26700

SEQ ID NO: 66782 - DNA, 201 bp, Bos taurus; identical to SEQ ID NO: 26701

SEQ ID NO: 66783 - DNA, 201 bp, Bos taurus; identical to SEQ ID NO: 26702

SEQ ID NO: 66784 - DNA, 201 bp, Bos taurus
agctgcacaggtctccctcctgctgtaggagacataagtgaccaatggcctgctttgttcactccccttattattcactcatcattataccaaggccatcgtttctgcaggttgcagccagcagatgactgggcatggctggacaccaaagcacaaggcagactcctccaatgggcaactttggctcagggttgcccatgg

SEQ ID NO: 66785 - DNA, 201 bp, Bos taurus
agtattcttgcctggagaatcccatggacagaggagcctggagggctacagtccatagcatcccaaggagttaggcaggactgaagggacttagcactcatgcagcctgtgtactagataatactatcccctcttctttacagatgaggaaagggtcacagggagatgaatcaaccctccccctcaagccacatagcaggc

SEQ ID NO: 66786 - DNA, 201 bp, Bos taurus
tccttttacatcattatttctggaagaaacaagagagaattagttttcctatcaaaatttcttacaaaaatgacaaaaatactaccaattgtgttgttttcctttcttaactgatatatagttacagggtataatttccagaacactgagagaattctgggtacttccaagtatttgagatatgtgtgtggaactaagaga

SEQ ID NO: 66787 - DNA, 201 bp, Bos taurus; identical to SEQ ID NO: 26704

SEQ ID NO: 66788 - DNA, 201 bp, Bos taurus; identical to SEQ ID NO: 26706

SEQ ID NO: 66789 - DNA, 201 bp, Bos taurus; identical to SEQ ID NO: 26709

SEQ ID NO: 66790 - DNA, 201 bp, Bos taurus; identical to SEQ ID NO: 26712

SEQ ID NO: 66791 - DNA, 201 bp, Bos taurus; identical to SEQ ID NO: 26713

SEQ ID NO: 66792 - DNA, 201 bp, Bos taurus; identical to SEQ ID NO: 26714

SEQ ID NO: 66793 - DNA, 201 bp, Bos taurus; identical to SEQ ID NO: 26715

SEQ ID NO: 66794 - DNA, 201 bp, Bos taurus; identical to SEQ ID NO: 26716

SEQ ID NO: 66795 - DNA, 201 bp, Bos taurus; identical to SEQ ID NO: 26717

SEQ ID NO: 66796 - DNA, 201 bp, Bos taurus; identical to SEQ ID NO: 26718

SEQ ID NO: 66797 - DNA, 201 bp, Bos taurus; identical to SEQ ID NO: 26719

SEQ ID NO: 66798 - DNA, 201 bp, Bos taurus; identical to SEQ ID NO: 26720

SEQ ID NO: 66799 - DNA, 201 bp, Bos taurus; identical to SEQ ID NO: 26721

SEQ ID NO: 66800 - DNA, 201 bp, Bos taurus; identical to SEQ ID NO: 26722

SEQ ID NO: 66801 - DNA, 201 bp, Bos taurus; identical to SEQ ID NO: 26723

SEQ ID NO: 66802 - DNA, 201 bp, Bos taurus; identical to SEQ ID NO: 26724

SEQ ID NO: 66803 - DNA, 201 bp, Bos taurus; identical to SEQ ID NO: 26725

SEQ ID NO: 66804 - DNA, 201 bp, Bos taurus; identical to SEQ ID NO: 26726

SEQ ID NO: 66805 - DNA, 201 bp, Bos taurus; identical to SEQ ID NO: 26727

SEQ ID NO: 66806 - DNA, 201 bp, Bos taurus; identical to SEQ ID NO: 26728

SEQ ID NO: 66807 - DNA, 201 bp, Bos taurus; identical to SEQ ID NO: 26730

SEQ ID NO: 66808 - DNA, 201 bp, Bos taurus; identical to SEQ ID NO: 26731

SEQ ID NO: 66809 - DNA, 201 bp, Bos taurus; identical to SEQ ID NO: 26732

SEQ ID NO: 66810 - DNA, 201 bp, Bos taurus; identical to SEQ ID NO: 26733

SEQ ID NO: 66811 - DNA, 201 bp, Bos taurus; identical to SEQ ID NO: 26734

SEQ ID NO: 66812 - DNA, 201 bp, Bos taurus; identical to SEQ ID NO: 26735

SEQ ID NO: 66813 - DNA, 201 bp, Bos taurus; identical to SEQ ID NO: 26736

SEQ ID NO: 66814 - DNA, 201 bp, Bos taurus
ctgtgtggcccagggcagcaagggcatttgttgacctgtggcaagcaaggcagtgtctccaaatggctgtctgtttgacctgggtgagaggcatgagctcgtgttggcccactggggtgtgttgctgggttatctgtgtgacttcctacatgatcagggggttgttggggctggtgcagcctgctggttgacagctaagcc

SEQ ID NO: 66815 - DNA, 201 bp, Bos taurus
tggtatgaaggccacatccacacatagtttcagtggaggtcacaggagggtcagtaacaagatgtccctctccttcccagctagggacgtatgagtagaaacctgctggcctctggtactcccacaaatagcctacagtaaggggtagtcatttccttaggcatcagtggaggccaggtaataaatctggatttttctcca

SEQ ID NO: 66816 - DNA, 201 bp, Bos taurus
gtcatactgcctgcccccggcccctgcaaaactgggaagagcaaaaagctacctccaaacacaaagacagtccttgtggagtcctcaccacatagtgtcacttttccccagaagtgggctgagttttcttggatggttcaggagactgactgtgctcatctcagcccaaacccatcttcagggacctcctgttgtagcttg

SEQ ID NO: 66817 - DNA, 201 bp, Bos taurus
aactgaagaaaaagcagaagtggacggaattcccaggggcataaaccccacggaaagctgtgctctcagggctccaggagctgtcggcatactgggactcatacacttctgtccacggatgttctcccacaactctggacatggggaaggctctctccatctgcagactgtcctagtattcaggaactgcctccttcctgg

SEQ ID NO: 66818 - DNA, 201 bp, Bos taurus; identical to SEQ ID NO: 26750

SEQ ID NO: 66819 - DNA, 201 bp, Bos taurus
tcaattttctatgtagagctaagccctttgtgctatcacccaggcatttttgtgccacgggcatctgagaagccagagactgcattactgagtattaaggcacttgcctaaggctagatgttcccataaatctagaaacaacctgaaactcccaatcccattaggctctttgcagcacaacagctggattcctgggactca

SEQ ID NO: 66820 - DNA, 201 bp, Bos taurus; identical to SEQ ID NO: 26751

SEQ ID NO: 66821 - DNA, 201 bp, Bos taurus; identical to SEQ ID NO: 26754

SEQ ID NO: 66822 - DNA, 201 bp, Bos taurus; identical to SEQ ID NO: 26755

SEQ ID NO: 66823 - DNA, 201 bp, Bos taurus; identical to SEQ ID NO: 26756

SEQ ID NO: 66824 - DNA, 201 bp, Bos taurus; identical to SEQ ID NO: 26757

SEQ ID NO: 66825 - DNA, 201 bp, Bos taurus; identical to SEQ ID NO: 26758

SEQ ID NO: 66826 - DNA, 201 bp, Bos taurus; identical to SEQ ID NO: 26762

SEQ ID NO: 66827 - DNA, 201 bp, Bos taurus; identical to SEQ ID NO: 26763

SEQ ID NO: 66828 - DNA, 201 bp, Bos taurus; identical to SEQ ID NO: 26765

SEQ ID NO: 66829 - DNA, 201 bp, Bos taurus; identical to SEQ ID NO: 26766

SEQ ID NO: 66830 - DNA, 201 bp, Bos taurus; identical to SEQ ID NO: 26772

SEQ ID NO: 66831 - DNA, 201 bp, Bos taurus; identical to SEQ ID NO: 26774

SEQ ID NO: 66832 - DNA, 201 bp, Bos taurus; identical to SEQ ID NO: 26776

SEQ ID NO: 66833 - DNA, 201 bp, Bos taurus; identical to SEQ ID NO: 26781

SEQ ID NO: 66834 - DNA, 201 bp, Bos taurus; identical to SEQ ID NO: 26782

SEQ ID NO: 66835 - DNA, 201 bp, Bos taurus; identical to SEQ ID NO: 26783

SEQ ID NO: 66836 - DNA, 201 bp, Bos taurus; identical to SEQ ID NO: 26784

SEQ ID NO: 66837 - DNA, 201 bp, Bos taurus
gtaaacattgtctgtagaatataaagccctgtataaatataatgtcatatcttatattttctgtcttctttccatccagttgcatagtgagaagttaggggtggtcctaaaaaattcctatgatcaatgaaaggtgagccaaagcaggacacatgcagaagatttaaaatccagttagtgattctttaccccttttaatct

SEQ ID NO: 66838 - DNA, 201 bp, Bos taurus
agactcccaggcactctcaggcaagtctggttcaatctcctgtggggtcactgctcctttctcctgggttctggtgcacaaaaggttttgttgtgccctccaagactctgtttccctggggttctcagtgcttttgccagatttccaggttgggaaacatgttgtaggccctagaacttttgcaacagtgtgagaacttct

SEQ ID NO: 66839 - DNA, 201 bp, Bos taurus; identical to SEQ ID NO: 26788

SEQ ID NO: 66840 - DNA, 201 bp, Bos taurus; identical to SEQ ID NO: 26789

SEQ ID NO: 66841 - DNA, 201 bp, Bos taurus; identical to SEQ ID NO: 26790

SEQ ID NO: 66842 - DNA, 201 bp, Bos taurus; identical to SEQ ID NO: 26791

SEQ ID NO: 66843 - DNA, 201 bp, Bos taurus
atgactaagagaaacccatctgttggatgaggagtcagggaaggccttcctaggggattgacatttgagtcaagacaagaatgatacaaaagagctgtcttcagatttctgtcgggccatcaggatgaggttcatcccctcctagagagggtccaaacaggaatttgtgttttgagaatatgaataaacacttacggaata

SEQ ID NO: 66844 - DNA, 201 bp, Bos taurus
taggtatggggccccctcacaccttgctgaggctggggacccctgacattccatactagatcagggacccctgacatacgtttgaagagcctcacaaatctgccttctcaggcctcttcagttgtaagtatcttaatcctttatctaattgggtgatgatagattaagattggtctttccaccagcctgtcatctccatcc

SEQ ID NO: 66845 - DNA, 201 bp, Bos taurus
attagagcagggattgcaagagggaataatggcagagaactgggctgtcaggaatacaagaggtaatttctagctacttctttggaaaaatagatttctgctaccttcagaaatctgctctcagaatatgaagcaaatagcttcacaataaaatatatttttttcttagactattcaccactgagacccccattcttcact

SEQ ID NO: 66846 - DNA, 201 bp, Bos taurus
caatctggtttatgttttggcatgtggcaatcattggcttgatagccgagaaaccttcatttccagaactttatggcctgtgtttcaactgcagacccagacagagcccctcacctctcctgcgtgtttgatcttctaattgcctcaagacacagccacgggcttgctgtgcgatgctgcaggcctcagcctgagctgagg

SEQ ID NO: 66847 - DNA, 201 bp, Bos taurus
gaccctcctggtcccccttcctcagttatacaatcagccttataacacctgttatctgcttggagcagccggggtctggcttaatgaccacctcttcctcctcccaccactctccaccttcaaaataaaaaggaatactaacactgatagaaatagtaaaaatgctgtcaatatagagcgccactaacagtgataatacat

SEQ ID NO: 66848 - DNA, 201 bp, Bos taurus; identical to SEQ ID NO: 26792

SEQ ID NO: 66849 - DNA, 201 bp, Bos taurus; identical to SEQ ID NO: 26793

SEQ ID NO: 66850 - DNA, 201 bp, Bos taurus; identical to SEQ ID NO: 26794

SEQ ID NO: 66851 - DNA, 201 bp, Bos taurus; identical to SEQ ID NO: 26796

SEQ ID NO: 66852 - DNA, 201 bp, Bos taurus; identical to SEQ ID NO: 26799

SEQ ID NO: 66853 - DNA, 201 bp, Bos taurus; identical to SEQ ID NO: 26801

SEQ ID NO: 66854 - DNA, 201 bp, Bos taurus
tgcctgcacctaccattgcaagatttttctaacatgtgcctatctgaaattgtgaaaggggattgatccattattctcttagcatgatagcttcagagtttttttcttatttattggaaatggtactttaaacaatctaataataatgctttctttgtatttttgttgtaaatctcttcacccagtatctagccttaaaaa

SEQ ID NO: 66855 - DNA, 201 bp, Bos taurus; identical to SEQ ID NO: 26802

SEQ ID NO: 66856 - DNA, 201 bp, Bos taurus; identical to SEQ ID NO: 26803

SEQ ID NO: 66857 - DNA, 201 bp, Bos taurus; identical to SEQ ID NO: 26804

SEQ ID NO: 66858 - DNA, 201 bp, Bos taurus; identical to SEQ ID NO: 26805

SEQ ID NO: 66859 - DNA, 201 bp, Bos taurus; identical to SEQ ID NO: 26807

SEQ ID NO: 66860 - DNA, 201 bp, Bos taurus
aaccccatggactgcagcctaccaggctcctccgtccatgggattttccaggcaagagtactggagtggggtgccagtcaggcagatgtaaattcaaatccgagttctactgtttactaggtatgtccctctagctttgcgtcgctctgacctcctccccttcctttgacagtgtgtcccagttaggtattactgcctaac

SEQ ID NO: 66861 - DNA, 201 bp, Bos taurus; identical to SEQ ID NO: 26808

SEQ ID NO: 66862 - DNA, 201 bp, Bos taurus; identical to SEQ ID NO: 26809

SEQ ID NO: 66863 - DNA, 201 bp, Bos taurus; identical to SEQ ID NO: 26810

SEQ ID NO: 66864 - DNA, 201 bp, Bos taurus; identical to SEQ ID NO: 26811

SEQ ID NO: 66865 - DNA, 201 bp, Bos taurus
atggcaacctactccagtattcttgcctggagaatcccatggacagaggagcctagtggctacagtccacagggtcacaaagagtcagacacgactgagcgtgcttgcacacacacgtacctgtggtaggtaatcgggtaaccaggaaagatgcgtgatcctcctctagagtgcagagtctgagggggaaatggctgccca

SEQ ID NO: 66866 - DNA, 201 bp, Bos taurus; identical to SEQ ID NO: 26812

SEQ ID NO: 66867 - DNA, 201 bp, Bos taurus; identical to SEQ ID NO: 26813

SEQ ID NO: 66868 - DNA, 201 bp, Bos taurus
cacccacacccaaagtcaggaagggaaagggggtcccagaggagcgggcagacacctcagggccttctccacgtgctctggccttttcacttgatgcacatgattgttatgcacacttgaagtgcagccattgagctctcatgattgatatagccaggcccagacggacacggtctctggttgtcagggctattattctga

SEQ ID NO: 66869 - DNA, 201 bp, Bos taurus
gcaaggaaaccagaggtcggaaaactgatagcgtttgcctgatgttgttcagtacaaggtaggtcagacgcccaggatggatgacggaatgaaaagccccggagtttccctctaatgtgtactgagtgcctaggtcacatcttcagcgggctttctcttattctgtctgtctccttctctctcctgtgacgggctgaagaa

SEQ ID NO: 66870 - DNA, 201 bp, Bos taurus; identical to SEQ ID NO: 26814

SEQ ID NO: 66871 - DNA, 201 bp, Bos taurus
cagtgggctacaggccatagggtcacagagagtcaaacataactaagtgacttagcatgcacgcagatactgaaagcccctccaggtcgaagaagttaataattggtgatgacaggtggcccacaagcatgtagaccccagactggttggacccgaaggctgctgatgctgactcctgcttacctcactgtcagcccatca

SEQ ID NO: 66872 - DNA, 201 bp, Bos taurus
ctacctgggacctcagaatgtgaccttatttggaaatggtctttgcagatataatgaactaattaagaatatttagattaactcatcctggacttaggactggccctgactccaatgatgctgtccttatctatagaggagagggcaccaagagacacaaaccaaaaaccctcgtgaagacagagctggattttggggtta

SEQ ID NO: 66873 - DNA, 201 bp, Bos taurus; identical to SEQ ID NO: 26815

SEQ ID NO: 66874 - DNA, 201 bp, Bos taurus; identical to SEQ ID NO: 26818

SEQ ID NO: 66875 - DNA, 201 bp, Bos taurus; identical to SEQ ID NO: 26819

SEQ ID NO: 66876 - DNA, 201 bp, Bos taurus; identical to SEQ ID NO: 26820

SEQ ID NO: 66877 - DNA, 201 bp, Bos taurus; identical to SEQ ID NO: 26821

SEQ ID NO: 66878 - DNA, 201 bp, Bos taurus
attttcatcattcaaaccacagtaaatctcagtttctttattgcactatctttgacatatgatgttgtgcaaatttaaggtgtagaacatgttaatttgacacatttatatattgtcatgtgattcaaacacctccttcagcactttcctacctaatcatttaaagccactatttccctcgagcgttccattctgctgttt

SEQ ID NO: 66879 - DNA, 201 bp, Bos taurus
tattttgcaactaaaagtaacaagtatacatttgaacccaggcaggatttttggtttctgttcaaattgtccataagacatttggtgcataccaaacggtccttgaaatttggccccatctaaaacactcatgagtatacttggtctatgccaagtggttttggatggaacgaaatatcaaggacctttctggtgtggacc

SEQ ID NO: 66880 - DNA, 201 bp, Bos taurus; identical to SEQ ID NO: 26827

SEQ ID NO: 66881 - DNA, 201 bp, Bos taurus; identical to SEQ ID NO: 26828

SEQ ID NO: 66882 - DNA, 201 bp, Bos taurus
tgatctagagtgggtgaattctcttgggcactcctcccacttgaactgaaacctttatctaccatcagatagttgtgtgtcatcagtttttctgtagttggagaaaatccgggaggaaagaacgactgcccagcagggaccgaagttgtgaaggactcagcaaatgtactttgacagaatatctgaccgatatctcagaca

SEQ ID NO: 66883 - DNA, 201 bp, Bos taurus
tggcactcactctggggcagagttgtttgtttttctctccctaaatgtataacaggaaattaggcagttcacctttgtgtatcactttcatacgtgtacatgagccagatggcacctctttgtgttaagaaatttaaaaggaaagactagaaggagaagtttatctccacttcctctgccctcctaaacacatcctggaat

SEQ ID NO: 66884 - DNA, 201 bp, Bos taurus
aacagcaggcccttgacccacttgggctttaccaggcacacatatgtagtgcagcccacccttaggagaaaagacagataaagaggtctgcgcatgtcctggaagtggactaagggccatttgggtaaggaattctggagcaggcaactgagactttacgtagaagtggcgtaagatggaggttgtggttccatagccctt

SEQ ID NO: 66885 - DNA, 201 bp, Bos taurus
tctcactatagtcaatgaattcaatgccttaggggccctgtttcctcttctaatgagaatgagactatcttgcttgtttagaggagcacagagaaaggtggaattggccgaattgtttaacatagcaacatggtaaagggaaaaagcaaagtttaagtttcagctctcattctgccatcaaccacatgtgggtcacacgca

SEQ ID NO: 66886 - DNA, 201 bp, Bos taurus
cacaccatccccgggccatgacagtagctcatggaggggcctgagagtaaacaaacttgtcaaaggcatgacattagcctattgttaccaagggtccaccgtgtggagagggcctgactgagagagaaatcaacaaatgcaaaagaaatcagagtatgagagagaaagatagagtgagttcatgacattatttgaacccct

SEQ ID NO: 66887 - DNA, 201 bp, Bos taurus
tccagcccctcacttgtccagtgttccagacacagagcccagcctctctccctgccatctgtgcttccctccctattcccagataggggtaggcagggagcagggcaagtggtcaggacttcagcctctcctcttgtaccttcctcattcctgctcaggtctgtggctctctgcatccctgccctaacctctgcatttccc

SEQ ID NO: 66888 - DNA, 201 bp, Bos taurus
tgttttaagacttctgcccgctggaaataattaacctcttgagattttttttttttaattgaagggagggcacactgtacacccgccttccactcagataattgaggcccaatgcctagttaccccggagaaggcaatggcaccccactccagtactcttgcttggaaaatcccatggacggaggagcctggtaggctgca

SEQ ID NO: 66889 - DNA, 201 bp, Bos taurus; identical to SEQ ID NO: 26833

SEQ ID NO: 66890 - DNA, 201 bp, Bos taurus; identical to SEQ ID NO: 26834

SEQ ID NO: 66891 - DNA, 201 bp, Bos taurus; identical to SEQ ID NO: 26835

SEQ ID NO: 66892 - DNA, 201 bp, Bos taurus
tgagtttgcccaaacttagaatggttcagaggaaccacagtcaccccaggaagccctttttcacagcattctgggtccagggcagttgaggagaggcctaaggatgctaactacaggtcagatggcaggagatgttctcagaaggctgtgttctcagtttggtcccgaggaccaaagagctgctcagcaacggccttgcca

SEQ ID NO: 66893 - DNA, 201 bp, Bos taurus; identical to SEQ ID NO: 26836

SEQ ID NO: 66894 - DNA, 201 bp, Bos taurus; identical to SEQ ID NO: 26837

SEQ ID NO: 66895 - DNA, 201 bp, Bos taurus
cctgccccctgcaatggaagcgtggagtcttaaccactgaacttccggggaaatcccaaggcaatcactttttaaatggcttgttttcagctcttctggtggttaccattcatggaacccacacttctgctgtcatttcaagccatctgtatactccccttttatttttatctgtttattggttttgcgaaggcgttctct

SEQ ID NO: 66896 - DNA, 201 bp, Bos taurus
caactctgaggaacagcccagcaaggaatgaccagagctttgtatatgtggcataactggccagaatgttgaagaatgttcagggcccatagatcaaaatcatagaaggcgatcttgatgtaggtcatttatgggtcaaaccttaagaaatgctgccattaagaatgaaatcacagggacttcactggtggtccagtggct

SEQ ID NO: 66897 - DNA, 201 bp, Bos taurus; identical to SEQ ID NO: 26840

SEQ ID NO: 66898 - DNA, 201 bp, Bos taurus
ctgtccttctcgaggtgcccacctctgtctagcttggtgatccccttcccctactctccttacctctgttgtcaattctctgttagcttgtgcgtgtgtgcggccagctggacagagggagttagcctttagacttagacagaagcaagttcctgaagatattctttttagagaaataaatctaagatgatgactgctggg

SEQ ID NO: 66899 - DNA, 201 bp, Bos taurus
agtgcaaggccgcactctgagccatcacaccggcctgcttccctagagaatggtgcaagtcagagaggggcttcttggccagccagggctctggggtgaagacacatggaacagaacaacccccaagctgacttaacagttagtgagataaaaatatacatttttaaaaattgtgaatggcctgtataagaggaaaagttc

SEQ ID NO: 66900 - DNA, 201 bp, Bos taurus; identical to SEQ ID NO: 26842

SEQ ID NO: 66901 - DNA, 201 bp, Bos taurus
cgtcagtagctgtaagcatacataatggcctgcctcagggaaccctgccctccgcctgatattaaactgaagtgcctttgttcagctcacagggagacactgtggccttgcccacctgtgagtgcctgcaggaggaagaaatgaacacatccccttccagtggttggctaaattaggcgatacttagcaagactcatggcc

SEQ ID NO: 66902 - DNA, 201 bp, Bos taurus; identical to SEQ ID NO: 26845

SEQ ID NO: 66903 - DNA, 201 bp, Bos taurus
tcatgttgctccttgccaggcctcagctaacctccagtccttgagggagtgaaaaacgggggtaaacactgcctgggaactttccagagctgaagatgatgccagaaaattcccaagcagggcctctcctttttctcctcccaccccaaaggctgtctcttacctttgtacagaatcattcaaaccaaacatatcaggagc

SEQ ID NO: 66904 - DNA, 201 bp, Bos taurus
agcttggggcttaaagtcttaacagatggggccatgatgccttcaaaagcaggctggggagtctgcaggtgacaggtggtgtttagccttgggaaaggactggcccatggctgggtgagccacacaagtagcccagccgctccctctggctgcatgtccatctgctggaaggcagacccattcccaaccaggcctggttag

SEQ ID NO: 66905 - DNA, 201 bp, Bos taurus; identical to SEQ ID NO: 26846

SEQ ID NO: 66906 - DNA, 201 bp, Bos taurus
gctctcaggtccccagcactgtaggtgcaggcatctttggatcacgaagcaagtttcccttataaaagagtgcctgacctgggaatcactgaaggcagctcccttcagaggagtgggcgacatgccccatccccatggacaggggagccactgactattgaactagtgtggcctatttcagtgaggacattggaagcactg

SEQ ID NO: 66907 - DNA, 201 bp, Bos taurus; identical to SEQ ID NO: 26849

SEQ ID NO: 66908 - DNA, 201 bp, Bos taurus; identical to SEQ ID NO: 26851

SEQ ID NO: 66909 - DNA, 201 bp, Bos taurus; identical to SEQ ID NO: 26856

SEQ ID NO: 66910 - DNA, 201 bp, Bos taurus; identical to SEQ ID NO: 26857

SEQ ID NO: 66911 - DNA, 201 bp, Bos taurus; identical to SEQ ID NO: 26858

SEQ ID NO: 66912 - DNA, 201 bp, Bos taurus; identical to SEQ ID NO: 26859

SEQ ID NO: 66913 - DNA, 201 bp, Bos taurus; identical to SEQ ID NO: 26860

SEQ ID NO: 66914 - DNA, 201 bp, Bos taurus; identical to SEQ ID NO: 26861

SEQ ID NO: 66915 - DNA, 201 bp, Bos taurus; identical to SEQ ID NO: 26862

SEQ ID NO: 66916 - DNA, 201 bp, Bos taurus; identical to SEQ ID NO: 26864

SEQ ID NO: 66917 - DNA, 201 bp, Bos taurus; identical to SEQ ID NO: 26865

SEQ ID NO: 66918 - DNA, 201 bp, Bos taurus; identical to SEQ ID NO: 26866

SEQ ID NO: 66919 - DNA, 201 bp, Bos taurus; identical to SEQ ID NO: 26867

SEQ ID NO: 66920 - DNA, 201 bp, Bos taurus; identical to SEQ ID NO: 26868

SEQ ID NO: 66921 - DNA, 201 bp, Bos taurus; identical to SEQ ID NO: 26869

SEQ ID NO: 66922 - DNA, 201 bp, Bos taurus; identical to SEQ ID NO: 26870

SEQ ID NO: 66923 - DNA, 201 bp, Bos taurus; identical to SEQ ID NO: 26871

SEQ ID NO: 66924 - DNA, 201 bp, Bos taurus
taggcttggtagggactccagggaacagactacagcgaaaacttggggcacccaaccctgaagagtccccagggcctttccgctcccagcgggccactccactcacagcactcagggaagcaggctttcctctggaccatgtttattccctactcaatctcaacctgcacagaagagcttggaagcaatttgccaaagcga

SEQ ID NO: 66925 - DNA, 201 bp, Bos taurus; identical to SEQ ID NO: 26873

SEQ ID NO: 66926 - DNA, 201 bp, Bos taurus; identical to SEQ ID NO: 26874

SEQ ID NO: 66927 - DNA, 201 bp, Bos taurus
ctcgaggccgccccctaactgttgtcagcccacgcaggggaccggcaccggcttcgctccctcccttctgcacatcacatcacttaccctacggctaccaaggcgcacccggggcctccctacagtagggtactttctccgagccctcttcctcagaaaagcaacaaacaccgaaccaagactatgccatgcggcaacggc

SEQ ID NO: 66928 - DNA, 201 bp, Bos taurus; identical to SEQ ID NO: 26878

SEQ ID NO: 66929 - DNA, 201 bp, Bos taurus; identical to SEQ ID NO: 26879

SEQ ID NO: 66930 - DNA, 201 bp, Bos taurus; identical to SEQ ID NO: 26880

SEQ ID NO: 66931 - DNA, 201 bp, Bos taurus; identical to SEQ ID NO: 26881

SEQ ID NO: 66932 - DNA, 201 bp, Bos taurus; identical to SEQ ID NO: 26882

SEQ ID NO: 66933 - DNA, 201 bp, Bos taurus; identical to SEQ ID NO: 26883

SEQ ID NO: 66934 - DNA, 201 bp, Bos taurus; identical to SEQ ID NO: 26884

SEQ ID NO: 66935 - DNA, 201 bp, Bos taurus; identical to SEQ ID NO: 26885

SEQ ID NO: 66936 - DNA, 201 bp, Bos taurus; identical to SEQ ID NO: 26886

SEQ ID NO: 66937 - DNA, 201 bp, Bos taurus; identical to SEQ ID NO: 26887

SEQ ID NO: 66938 - DNA, 201 bp, Bos taurus; identical to SEQ ID NO: 26888

SEQ ID NO: 66939 - DNA, 201 bp, Bos taurus; identical to SEQ ID NO: 26889

SEQ ID NO: 66940 - DNA, 201 bp, Bos taurus; identical to SEQ ID NO: 26890

SEQ ID NO: 66941 - DNA, 201 bp, Bos taurus; identical to SEQ ID NO: 26891

SEQ ID NO: 66942 - DNA, 201 bp, Bos taurus; identical to SEQ ID NO: 26892

SEQ ID NO: 66943 - DNA, 201 bp, Bos taurus; identical to SEQ ID NO: 26893

SEQ ID NO: 66944 - DNA, 201 bp, Bos taurus; identical to SEQ ID NO: 26894

SEQ ID NO: 66945 - DNA, 201 bp, Bos taurus; identical to SEQ ID NO: 26895

SEQ ID NO: 66946 - DNA, 201 bp, Bos taurus; identical to SEQ ID NO: 26896

SEQ ID NO: 66947 - DNA, 201 bp, Bos taurus; identical to SEQ ID NO: 26897

SEQ ID NO: 66948 - DNA, 201 bp, Bos taurus; identical to SEQ ID NO: 26899

SEQ ID NO: 66949 - DNA, 201 bp, Bos taurus; identical to SEQ ID NO: 26900

SEQ ID NO: 66950 - DNA, 201 bp, Bos taurus; identical to SEQ ID NO: 26901

SEQ ID NO: 66951 - DNA, 201 bp, Bos taurus; identical to SEQ ID NO: 26902

SEQ ID NO: 66952 - DNA, 201 bp, Bos taurus; identical to SEQ ID NO: 26903

SEQ ID NO: 66953 - DNA, 201 bp, Bos taurus; identical to SEQ ID NO: 26904

SEQ ID NO: 66954 - DNA, 201 bp, Bos taurus; identical to SEQ ID NO: 26905

SEQ ID NO: 66955 - DNA, 201 bp, Bos taurus; identical to SEQ ID NO: 26906

SEQ ID NO: 66956 - DNA, 201 bp, Bos taurus; identical to SEQ ID NO: 26907

SEQ ID NO: 66957 - DNA, 201 bp, Bos taurus; identical to SEQ ID NO: 26908

SEQ ID NO: 66958 - DNA, 201 bp, Bos taurus; identical to SEQ ID NO: 26910

SEQ ID NO: 66959 - DNA, 201 bp, Bos taurus; identical to SEQ ID NO: 26911

SEQ ID NO: 66960 - DNA, 201 bp, Bos taurus; identical to SEQ ID NO: 26912

SEQ ID NO: 66961 - DNA, 201 bp, Bos taurus; identical to SEQ ID NO: 26913

SEQ ID NO: 66962 - DNA, 201 bp, Bos taurus; identical to SEQ ID NO: 26914

SEQ ID NO: 66963 - DNA, 201 bp, Bos taurus; identical to SEQ ID NO: 26915

SEQ ID NO: 66964 - DNA, 201 bp, Bos taurus; identical to SEQ ID NO: 26916

SEQ ID NO: 66965 - DNA, 201 bp, Bos taurus; identical to SEQ ID NO: 26917

SEQ ID NO: 66966 - DNA, 201 bp, Bos taurus; identical to SEQ ID NO: 26918

SEQ ID NO: 66967 - DNA, 201 bp, Bos taurus; identical to SEQ ID NO: 26919

SEQ ID NO: 66968 - DNA, 201 bp, Bos taurus; identical to SEQ ID NO: 26920

SEQ ID NO: 66969 - DNA, 201 bp, Bos taurus; identical to SEQ ID NO: 26921

SEQ ID NO: 66970 - DNA, 201 bp, Bos taurus; identical to SEQ ID NO: 26922

SEQ ID NO: 66971 - DNA, 201 bp, Bos taurus; identical to SEQ ID NO: 26923

SEQ ID NO: 66972 - DNA, 201 bp, Bos taurus; identical to SEQ ID NO: 26924

SEQ ID NO: 66973 - DNA, 201 bp, Bos taurus; identical to SEQ ID NO: 26925

SEQ ID NO: 66974 - DNA, 201 bp, Bos taurus; identical to SEQ ID NO: 26926

SEQ ID NO: 66975 - DNA, 201 bp, Bos taurus; identical to SEQ ID NO: 26927

SEQ ID NO: 66976 - DNA, 201 bp, Bos taurus; identical to SEQ ID NO: 26928

SEQ ID NO: 66977 - DNA, 201 bp, Bos taurus; identical to SEQ ID NO: 26929

SEQ ID NO: 66978 - DNA, 201 bp, Bos taurus; identical to SEQ ID NO: 26930

SEQ ID NO: 66979 - DNA, 201 bp, Bos taurus; identical to SEQ ID NO: 26931

SEQ ID NO: 66980 - DNA, 201 bp, Bos taurus; identical to SEQ ID NO: 26932

SEQ ID NO: 66981 - DNA, 201 bp, Bos taurus; identical to SEQ ID NO: 26933

SEQ ID NO: 66982 - DNA, 201 bp, Bos taurus; identical to SEQ ID NO: 26934

SEQ ID NO: 66983 - DNA, 201 bp, Bos taurus; identical to SEQ ID NO: 26935

SEQ ID NO: 66984 - DNA, 201 bp, Bos taurus; identical to SEQ ID NO: 26937

SEQ ID NO: 66985 - DNA, 201 bp, Bos taurus; identical to SEQ ID NO: 26938

SEQ ID NO: 66986 - DNA, 201 bp, Bos taurus; identical to SEQ ID NO: 26939

SEQ ID NO: 66987 - DNA, 201 bp, Bos taurus; identical to SEQ ID NO: 26940

SEQ ID NO: 66988 - DNA, 201 bp, Bos taurus; identical to SEQ ID NO: 26941

SEQ ID NO: 66989 - DNA, 201 bp, Bos taurus; identical to SEQ ID NO: 26942

SEQ ID NO: 66990 - DNA, 201 bp, Bos taurus; identical to SEQ ID NO: 26943

SEQ ID NO: 66991 - DNA, 201 bp, Bos taurus; identical to SEQ ID NO: 26944

SEQ ID NO: 66992 - DNA, 201 bp, Bos taurus; identical to SEQ ID NO: 26945

SEQ ID NO: 66993 - DNA, 201 bp, Bos taurus; identical to SEQ ID NO: 26946

SEQ ID NO: 66994 - DNA, 201 bp, Bos taurus; identical to SEQ ID NO: 26947

SEQ ID NO: 66995 - DNA, 201 bp, Bos taurus; identical to SEQ ID NO: 26948

SEQ ID NO: 66996 - DNA, 201 bp, Bos taurus; identical to SEQ ID NO: 26949

SEQ ID NO: 66997 - DNA, 201 bp, Bos taurus; identical to SEQ ID NO: 26950

SEQ ID NO: 66998 - DNA, 201 bp, Bos taurus; identical to SEQ ID NO: 26951

SEQ ID NO: 66999 - DNA, 201 bp, Bos taurus; identical to SEQ ID NO: 26953

SEQ ID NO: 67000 - DNA, 201 bp, Bos taurus; identical to SEQ ID NO: 26954

SEQ ID NO: 67001 - DNA, 201 bp, Bos taurus; identical to SEQ ID NO: 26955

SEQ ID NO: 67002 - DNA, 201 bp, Bos taurus; identical to SEQ ID NO: 26956

SEQ ID NO: 67003 - DNA, 201 bp, Bos taurus; identical to SEQ ID NO: 26958

SEQ ID NO: 67004 - DNA, 201 bp, Bos taurus; identical to SEQ ID NO: 26959

SEQ ID NO: 67005 - DNA, 201 bp, Bos taurus; identical to SEQ ID NO: 26960

SEQ ID NO: 67006 - DNA, 201 bp, Bos taurus; identical to SEQ ID NO: 26962

SEQ ID NO: 67007 - DNA, 201 bp, Bos taurus; identical to SEQ ID NO: 26963

SEQ ID NO: 67008 - DNA, 201 bp, Bos taurus; identical to SEQ ID NO: 26964

SEQ ID NO: 67009 - DNA, 201 bp, Bos taurus; identical to SEQ ID NO: 26965

SEQ ID NO: 67010 - DNA, 201 bp, Bos taurus; identical to SEQ ID NO: 26966

SEQ ID NO: 67011 - DNA, 201 bp, Bos taurus; identical to SEQ ID NO: 26967

SEQ ID NO: 67012 - DNA, 201 bp, Bos taurus; identical to SEQ ID NO: 26968

SEQ ID NO: 67013 - DNA, 201 bp, Bos taurus; identical to SEQ ID NO: 26969

SEQ ID NO: 67014 - DNA, 201 bp, Bos taurus; identical to SEQ ID NO: 26972

SEQ ID NO: 67015 - DNA, 201 bp, Bos taurus; identical to SEQ ID NO: 26973

SEQ ID NO: 67016 - DNA, 201 bp, Bos taurus; identical to SEQ ID NO: 26975

SEQ ID NO: 67017 - DNA, 201 bp, Bos taurus; identical to SEQ ID NO: 26979

SEQ ID NO: 67018 - DNA, 201 bp, Bos taurus; identical to SEQ ID NO: 26981

SEQ ID NO: 67019 - DNA, 201 bp, Bos taurus; identical to SEQ ID NO: 26982

SEQ ID NO: 67020 - DNA, 201 bp, Bos taurus; identical to SEQ ID NO: 26984

SEQ ID NO: 67021 - DNA, 201 bp, Bos taurus; identical to SEQ ID NO: 26985

SEQ ID NO: 67022 - DNA, 201 bp, Bos taurus; identical to SEQ ID NO: 26987

SEQ ID NO: 67023 - DNA, 201 bp, Bos taurus; identical to SEQ ID NO: 26988

SEQ ID NO: 67024 - DNA, 201 bp, Bos taurus; identical to SEQ ID NO: 26989

SEQ ID NO: 67025 - DNA, 201 bp, Bos taurus; identical to SEQ ID NO: 26990

SEQ ID NO: 67026 - DNA, 201 bp, Bos taurus; identical to SEQ ID NO: 26992

SEQ ID NO: 67027 - DNA, 201 bp, Bos taurus; identical to SEQ ID NO: 26995

SEQ ID NO: 67028 - DNA, 201 bp, Bos taurus; identical to SEQ ID NO: 26996

SEQ ID NO: 67029 - DNA, 201 bp, Bos taurus; identical to SEQ ID NO: 26997

SEQ ID NO: 67030 - DNA, 201 bp, Bos taurus; identical to SEQ ID NO: 26998

SEQ ID NO: 67031 - DNA, 201 bp, Bos taurus; identical to SEQ ID NO: 26999

SEQ ID NO: 67032 - DNA, 201 bp, Bos taurus; identical to SEQ ID NO: 27001

SEQ ID NO: 67033 - DNA, 201 bp, Bos taurus; identical to SEQ ID NO: 27002

SEQ ID NO: 67034 - DNA, 201 bp, Bos taurus; identical to SEQ ID NO: 27004

SEQ ID NO: 67035 - DNA, 201 bp, Bos taurus
gacaaagggtccctgacctctgagaacaagaggcaggtgagagagtagggaagcgtctagtgccaggtggctctgggggagggaaggtggtcccagaagacagcctggtagagggccgtgcagggtccagcggggagcaggcagggggcggggctgggagaggagctgagcaccagcactggacaggggtcaggggtcaga

SEQ ID NO: 67036 - DNA, 201 bp, Bos taurus; identical to SEQ ID NO: 27007

SEQ ID NO: 67037 - DNA, 201 bp, Bos taurus; identical to SEQ ID NO: 27008

SEQ ID NO: 67038 - DNA, 201 bp, Bos taurus; identical to SEQ ID NO: 27009

SEQ ID NO: 67039 - DNA, 201 bp, Bos taurus; identical to SEQ ID NO: 27010

SEQ ID NO: 67040 - DNA, 201 bp, Bos taurus; identical to SEQ ID NO: 27011

SEQ ID NO: 67041 - DNA, 201 bp, Bos taurus; identical to SEQ ID NO: 27014

SEQ ID NO: 67042 - DNA, 201 bp, Bos taurus; identical to SEQ ID NO: 27022

SEQ ID NO: 67043 - DNA, 201 bp, Bos taurus; identical to SEQ ID NO: 27026

SEQ ID NO: 67044 - DNA, 201 bp, Bos taurus; identical to SEQ ID NO: 27027

SEQ ID NO: 67045 - DNA, 201 bp, Bos taurus; identical to SEQ ID NO: 27028

SEQ ID NO: 67046 - DNA, 201 bp, Bos taurus
aggactcttctagcccagcacccaacagtggccaagagcatgtcccaacaaaaatggtctcagtgctatcaatggcttattgatgtcatgttaatatcacgtatggatgtgagagttgggccataatttgtaaagtaattagcctccaattaagatacattaatttaaaaaattcaaaaagaagagagagagctgagtgcc

SEQ ID NO: 67047 - DNA, 201 bp, Bos taurus
acagtgggacaaaggtcagggtctcagagacagggactttccgaatgcagaagaagaatctggagtcaatggctacggcaagagaaagagacccctggccaccttgggtcactggaaacctcaccccttcttccctccttcttgtttagtcactcagtcttgtcagactcttttgtggccccgtggactgtggcccctcca

SEQ ID NO: 67048 - DNA, 201 bp, Bos taurus; identical to SEQ ID NO: 27036

SEQ ID NO: 67049 - DNA, 201 bp, Bos taurus; identical to SEQ ID NO: 27037

SEQ ID NO: 67050 - DNA, 201 bp, Bos taurus
tcacctagagaagacacttgcagagaaagcccgaggtctaaagcctccttctagtcatctgtaactggatatctgtgacgaggagccaagctttcgtctcaagcagtgagccgtgagcccaggccttgattgagagggaaggatgtagcccatccgtggcaccatgcctgctgtcatcctgagctgttctcaggccggggg

SEQ ID NO: 67051 - DNA, 201 bp, Bos taurus; identical to SEQ ID NO: 27038

SEQ ID NO: 67052 - DNA, 201 bp, Bos taurus; identical to SEQ ID NO: 27039

SEQ ID NO: 67053 - DNA, 201 bp, Bos taurus; identical to SEQ ID NO: 27041

SEQ ID NO: 67054 - DNA, 201 bp, Bos taurus; identical to SEQ ID NO: 27042

SEQ ID NO: 67055 - DNA, 201 bp, Bos taurus; identical to SEQ ID NO: 27043

SEQ ID NO: 67056 - DNA, 201 bp, Bos taurus; identical to SEQ ID NO: 27044

SEQ ID NO: 67057 - DNA, 201 bp, Bos taurus; identical to SEQ ID NO: 27047

SEQ ID NO: 67058 - DNA, 201 bp, Bos taurus; identical to SEQ ID NO: 27048

SEQ ID NO: 67059 - DNA, 201 bp, Bos taurus; identical to SEQ ID NO: 27050

SEQ ID NO: 67060 - DNA, 201 bp, Bos taurus; identical to SEQ ID NO: 27051

SEQ ID NO: 67061 - DNA, 201 bp, Bos taurus; identical to SEQ ID NO: 27057

SEQ ID NO: 67062 - DNA, 201 bp, Bos taurus; identical to SEQ ID NO: 27058

SEQ ID NO: 67063 - DNA, 201 bp, Bos taurus; identical to SEQ ID NO: 27061

SEQ ID NO: 67064 - DNA, 201 bp, Bos taurus; identical to SEQ ID NO: 27064

SEQ ID NO: 67065 - DNA, 201 bp, Bos taurus; identical to SEQ ID NO: 27065

SEQ ID NO: 67066 - DNA, 201 bp, Bos taurus; identical to SEQ ID NO: 27066

SEQ ID NO: 67067 - DNA, 201 bp, Bos taurus; identical to SEQ ID NO: 27071

SEQ ID NO: 67068 - DNA, 201 bp, Bos taurus; identical to SEQ ID NO: 27072

SEQ ID NO: 67069 - DNA, 201 bp, Bos taurus; identical to SEQ ID NO: 27074

SEQ ID NO: 67070 - DNA, 201 bp, Bos taurus; identical to SEQ ID NO: 27075

SEQ ID NO: 67071 - DNA, 201 bp, Bos taurus; identical to SEQ ID NO: 27076

SEQ ID NO: 67072 - DNA, 201 bp, Bos taurus; identical to SEQ ID NO: 27080

SEQ ID NO: 67073 - DNA, 201 bp, Bos taurus; identical to SEQ ID NO: 27083

SEQ ID NO: 67074 - DNA, 201 bp, Bos taurus; identical to SEQ ID NO: 27084

SEQ ID NO: 67075 - DNA, 201 bp, Bos taurus; identical to SEQ ID NO: 27085

SEQ ID NO: 67076 - DNA, 201 bp, Bos taurus; identical to SEQ ID NO: 27086

SEQ ID NO: 67077 - DNA, 201 bp, Bos taurus; identical to SEQ ID NO: 27087

SEQ ID NO: 67078 - DNA, 201 bp, Bos taurus
cctgctgaaagccttcagttaacggcaactttgtcccattggagaatataactggttgtttcttgccataggtaataaccactttgcactttgttttctgaaagtgtggaaggtatactggaagtttgaagtacatagtatttattttggagatctacagttctgctatgtctagaggaagttgaaagctgcatgaagatc

SEQ ID NO: 67079 - DNA, 201 bp, Bos taurus
tcaccagataaaaataaacactggaaattctgcagtgctgagaaaagagagcaagagagccctgggcctgcagctatacctgtacccgaggccaccacaaaggtgactagcgtctgctgaattcaagtctggaatcatctcataaaatcagtgacctaaatatagaagggtcgcaaacaaaacggcctgggaaagtcaggc

SEQ ID NO: 67080 - DNA, 201 bp, Bos taurus; identical to SEQ ID NO: 27088

SEQ ID NO: 67081 - DNA, 201 bp, Bos taurus; identical to SEQ ID NO: 27089

SEQ ID NO: 67082 - DNA, 201 bp, Bos taurus
tagtcctgcctcctgggtggacccggaatgctggcctgaggcctcctgcccgtgaccttccagcaatacccggacctggcccagactggcccctcaactgagagggctcagcctaccccccgcactgcccacggtgcttgtcatagccacgcgttccaggaaacaactcactcagaaggacaatgcagatagtggagtgca

SEQ ID NO: 67083 - DNA, 201 bp, Bos taurus; identical to SEQ ID NO: 27090

SEQ ID NO: 67084 - DNA, 201 bp, Bos taurus; identical to SEQ ID NO: 27091

SEQ ID NO: 67085 - DNA, 201 bp, Bos taurus
ttctccctgagccatcatttgagcctgcctttgtccttatgctagaagctgacttaaacgtaattggctgtgcacaactggcttccttttagtattagctgtggtaagatttgctatttccttccccagatctctgtgagatagaaagaaaacaagtttcagacagcattcttccatacatctaaaatctaaggcaagcaa

SEQ ID NO: 67086 - DNA, 201 bp, Bos taurus; identical to SEQ ID NO: 27093

SEQ ID NO: 67087 - DNA, 201 bp, Bos taurus
taagttagtcaattaaggcagaaaagaaggagagaggaaattgagagaaggcggtatggcctggctctgcgcttcacgggccatgtgacactttatgtatggacagaagctttttaaaacgtctattacttctcgcattgccgacagttatgataaatcaaaaagcacattctagatgcaggcccttcctaacacctgatg

SEQ ID NO: 67088 - DNA, 201 bp, Bos taurus; identical to SEQ ID NO: 27097

SEQ ID NO: 67089 - DNA, 201 bp, Bos taurus; identical to SEQ ID NO: 27098

SEQ ID NO: 67090 - DNA, 201 bp, Bos taurus; identical to SEQ ID NO: 27099

SEQ ID NO: 67091 - DNA, 201 bp, Bos taurus; identical to SEQ ID NO: 27100

SEQ ID NO: 67092 - DNA, 201 bp, Bos taurus; identical to SEQ ID NO: 27101

SEQ ID NO: 67093 - DNA, 201 bp, Bos taurus; identical to SEQ ID NO: 27102

SEQ ID NO: 67094 - DNA, 201 bp, Bos taurus; identical to SEQ ID NO: 27103

SEQ ID NO: 67095 - DNA, 201 bp, Bos taurus; identical to SEQ ID NO: 27104

SEQ ID NO: 67096 - DNA, 201 bp, Bos taurus; identical to SEQ ID NO: 27105

SEQ ID NO: 67097 - DNA, 201 bp, Bos taurus; identical to SEQ ID NO: 27106

SEQ ID NO: 67098 - DNA, 201 bp, Bos taurus; identical to SEQ ID NO: 27107

SEQ ID NO: 67099 - DNA, 201 bp, Bos taurus; identical to SEQ ID NO: 27108

SEQ ID NO: 67100 - DNA, 201 bp, Bos taurus; identical to SEQ ID NO: 27109

SEQ ID NO: 67101 - DNA, 201 bp, Bos taurus; identical to SEQ ID NO: 27115

SEQ ID NO: 67102 - DNA, 201 bp, Bos taurus; identical to SEQ ID NO: 27116

SEQ ID NO: 67103 - DNA, 201 bp, Bos taurus; identical to SEQ ID NO: 27117

SEQ ID NO: 67104 - DNA, 201 bp, Bos taurus; identical to SEQ ID NO: 27119

SEQ ID NO: 67105 - DNA, 201 bp, Bos taurus; identical to SEQ ID NO: 27121

SEQ ID NO: 67106 - DNA, 201 bp, Bos taurus; identical to SEQ ID NO: 27122

SEQ ID NO: 67107 - DNA, 201 bp, Bos taurus; identical to SEQ ID NO: 27124

SEQ ID NO: 67108 - DNA, 201 bp, Bos taurus; identical to SEQ ID NO: 27128

SEQ ID NO: 67109 - DNA, 201 bp, Bos taurus; identical to SEQ ID NO: 27130

SEQ ID NO: 67110 - DNA, 201 bp, Bos taurus; identical to SEQ ID NO: 27133

SEQ ID NO: 67111 - DNA, 201 bp, Bos taurus; identical to SEQ ID NO: 27134

SEQ ID NO: 67112 - DNA, 201 bp, Bos taurus
ctttgtggccagctagcccattacatacatatgaagctattattgataggaatttaacttctaacttctactcagggggaagatgaaagaaaatggaaccatggccttgcattcaaatcccctggcgagtccagaacataggctagacctgctaaatggaaatctgtgagtgaaggtcccaggaatcagtatttttgtaaa

SEQ ID NO: 67113 - DNA, 201 bp, Bos taurus
atctgctgcctcagcatcaccatcccaggtgctggcaactgctcttctccatttctataatttgtcatcttaagaatgttttataaagcaatggcaccccactccagtactcttgcctggaaaaccctatggacggaagaacctggtaggctgcagtccatgggatcgcgaagagtcggacacgactgagcgacttcactt

SEQ ID NO: 67114 - DNA, 201 bp, Bos taurus
aagcactcagagacacagagagatcaccacaaagtaagagaacacaggactgacagggaatcctctggcagtccagtgattaggactccaaactttcatgtccaagggcaccagttcatcaattcctagatctctgcaagctgcacagcgaggccaaaaaaaaaaaagactgacacttgaattttcacaatagaaggagcc

SEQ ID NO: 67115 - DNA, 201 bp, Bos taurus; identical to SEQ ID NO: 27135

SEQ ID NO: 67116 - DNA, 201 bp, Bos taurus; identical to SEQ ID NO: 27136

SEQ ID NO: 67117 - DNA, 201 bp, Bos taurus
tacaaagggaaatgttgtgaggtaagggcatgatttttttttgctagtgtgaaaatttcctcctcatgttctctaattcatgttacggcctggtctttacacctgtcgttggctgaactgttgattccctagctccgctggatcctggtggtgagtagtgtgtggcagtatctagttaaagaccttcaccggtgctgaggc

SEQ ID NO: 67118 - DNA, 201 bp, Bos taurus
ttggaaggtaaattacgtaggccttcagaacatacctctttagtactcaatgttaaaatcctagtgtagattccttttggaaaggggagggggaattcacgtttagaatattacaggccatggactccacttactgtatctggtggtcgcaggatcagaaggtgagatgtttctggttagtaagtaggctctcagcatatc

SEQ ID NO: 67119 - DNA, 201 bp, Bos taurus; identical to SEQ ID NO: 27137

SEQ ID NO: 67120 - DNA, 201 bp, Bos taurus; identical to SEQ ID NO: 27138

SEQ ID NO: 67121 - DNA, 201 bp, Bos taurus; identical to SEQ ID NO: 27139

SEQ ID NO: 67122 - DNA, 201 bp, Bos taurus; identical to SEQ ID NO: 27140

SEQ ID NO: 67123 - DNA, 201 bp, Bos taurus; identical to SEQ ID NO: 27141

SEQ ID NO: 67124 - DNA, 201 bp, Bos taurus; identical to SEQ ID NO: 27143

SEQ ID NO: 67125 - DNA, 201 bp, Bos taurus; identical to SEQ ID NO: 27144

SEQ ID NO: 67126 - DNA, 201 bp, Bos taurus
gtcagaacgtaagaattgtcaaagggcagtggtggtgcggcgtgggcaactaccacagtaactaggaaacgctggccttggggtctggatgcagaaggaaaccagtcaggtcaggaagtagaagaggatgaccagaagacacgcccttctcggcctcttatgcccactggttgtgggttcagtggtgccttctgcctctcg

SEQ ID NO: 67127 - DNA, 201 bp, Bos taurus
tcaggttcgaacctcacctccatcagtgccactactgtgaagccctggccaagtcacttaacctctctgagcctcatctgcaggctttcaggaaacagaagctgctacggtaggtcaagtcggccaaagcacttccaccctcaccctcctccccatatggcccaccccaaggccagacaggatatggagggtgcccttcca

SEQ ID NO: 67128 - DNA, 201 bp, Bos taurus; identical to SEQ ID NO: 27145

SEQ ID NO: 67129 - DNA, 201 bp, Bos taurus; identical to SEQ ID NO: 27146

SEQ ID NO: 67130 - DNA, 201 bp, Bos taurus
aaatgggtggatctatcctgaaatgaagaggcggtcgctgataaatgaggtatgccttgtcctgagttgtctgaagctaccccagggccccagagatgtgccttcaccctcactgaacagtggggggaaaactgagacccacgaaggtgaagcatttggccagggcagaaacaggattctttctgcccagccctaggctta

SEQ ID NO: 67131 - DNA, 201 bp, Bos taurus
ttgctgaaggcctggcttcagctgctgggttcaaaggtgcgctggtcaggacggtgtttcaggagagtctctgatgtgtcttgttaaacctgctgtgcttttcttcggtctggccgagagtttttacgccaccccttttatacttgaatgaactgagtttcgcggatccaggagcactctgggcatcgcccctcggcgcgt

SEQ ID NO: 67132 - DNA, 201 bp, Bos taurus
cctcgaccaagtggtccggctttgtggagtggaggaaacaggcaggatagaggccagcccactccccaacgccccttggcccctgctcagttaccctgcataaagcaaggatgtctgtgccaagtcccgtgccatcattctagccctacgtggaagctggtcttgggggaattccacccagtccctgaggcctgcgtggcc

SEQ ID NO: 67133 - DNA, 201 bp, Bos taurus
tattgcaagtctttctccatcaggctcaatctacactactcatgtcctgcctgtttgtcctggtaattcaccctcccttaataatcctgtctcacagaaccgggcttgtggcttagtggatggatgaactctcctggatatgtcattgtatcggagttcagtctcccctttcggtctgcaatgcccttccgttctgtgtgc

SEQ ID NO: 67134 - DNA, 201 bp, Bos taurus; identical to SEQ ID NO: 27147

SEQ ID NO: 67135 - DNA, 201 bp, Bos taurus
gcagattggcgagcaggcattctagaattgttctgccttcagggaacaggccagctcttggcactgaccaaggtagaaggaaaagaaagctagagagtcattgttttttaattaagttttgttggagtattattgacttacaatgttgtgttagttcctgttgtatagcaaagtgaatcagttatacatgaacatatattc

SEQ ID NO: 67136 - DNA, 201 bp, Bos taurus; identical to SEQ ID NO: 27149

SEQ ID NO: 67137 - DNA, 201 bp, Bos taurus; identical to SEQ ID NO: 27151

SEQ ID NO: 67138 - DNA, 201 bp, Bos taurus; identical to SEQ ID NO: 27152

SEQ ID NO: 67139 - DNA, 201 bp, Bos taurus; identical to SEQ ID NO: 27153

SEQ ID NO: 67140 - DNA, 201 bp, Bos taurus; identical to SEQ ID NO: 27154

SEQ ID NO: 67141 - DNA, 201 bp, Bos taurus; identical to SEQ ID NO: 27155

SEQ ID NO: 67142 - DNA, 201 bp, Bos taurus
acggtctccttagaatttgctgctgtgaagggagttttagatggtcagacactgggacactcatgtgcatgctttattttacttaaaaagtattgatttttctgctctgggtcatagttgtggcacatgggatctttagctgggacaggcaaactcttagttgtgggttgtgggatctagttccctggtcagggatcaaac

SEQ ID NO: 67143 - DNA, 201 bp, Bos taurus; identical to SEQ ID NO: 27156

SEQ ID NO: 67144 - DNA, 201 bp, Bos taurus; identical to SEQ ID NO: 27157

SEQ ID NO: 67145 - DNA, 201 bp, Bos taurus; identical to SEQ ID NO: 27158

SEQ ID NO: 67146 - DNA, 201 bp, Bos taurus; identical to SEQ ID NO: 27159

SEQ ID NO: 67147 - DNA, 201 bp, Bos taurus; identical to SEQ ID NO: 27160

SEQ ID NO: 67148 - DNA, 201 bp, Bos taurus; identical to SEQ ID NO: 27161

SEQ ID NO: 67149 - DNA, 201 bp, Bos taurus; identical to SEQ ID NO: 27162

SEQ ID NO: 67150 - DNA, 201 bp, Bos taurus; identical to SEQ ID NO: 27163

SEQ ID NO: 67151 - DNA, 201 bp, Bos taurus; identical to SEQ ID NO: 27164

SEQ ID NO: 67152 - DNA, 201 bp, Bos taurus; identical to SEQ ID NO: 27165

SEQ ID NO: 67153 - DNA, 201 bp, Bos taurus; identical to SEQ ID NO: 27166

SEQ ID NO: 67154 - DNA, 201 bp, Bos taurus; identical to SEQ ID NO: 27168

SEQ ID NO: 67155 - DNA, 201 bp, Bos taurus; identical to SEQ ID NO: 27169

SEQ ID NO: 67156 - DNA, 201 bp, Bos taurus; identical to SEQ ID NO: 27170

SEQ ID NO: 67157 - DNA, 201 bp, Bos taurus; identical to SEQ ID NO: 27171

SEQ ID NO: 67158 - DNA, 201 bp, Bos taurus; identical to SEQ ID NO: 27172

SEQ ID NO: 67159 - DNA, 201 bp, Bos taurus; identical to SEQ ID NO: 27173

SEQ ID NO: 67160 - DNA, 201 bp, Bos taurus; identical to SEQ ID NO: 27174

SEQ ID NO: 67161 - DNA, 201 bp, Bos taurus; identical to SEQ ID NO: 27175

SEQ ID NO: 67162 - DNA, 201 bp, Bos taurus; identical to SEQ ID NO: 27177

SEQ ID NO: 67163 - DNA, 201 bp, Bos taurus; identical to SEQ ID NO: 27178

SEQ ID NO: 67164 - DNA, 201 bp, Bos taurus; identical to SEQ ID NO: 27179

SEQ ID NO: 67165 - DNA, 201 bp, Bos taurus; identical to SEQ ID NO: 27180

SEQ ID NO: 67166 - DNA, 201 bp, Bos taurus; identical to SEQ ID NO: 27181

SEQ ID NO: 67167 - DNA, 201 bp, Bos taurus; identical to SEQ ID NO: 27182

SEQ ID NO: 67168 - DNA, 201 bp, Bos taurus; identical to SEQ ID NO: 27183

SEQ ID NO: 67169 - DNA, 201 bp, Bos taurus; identical to SEQ ID NO: 27184

SEQ ID NO: 67170 - DNA, 201 bp, Bos taurus; identical to SEQ ID NO: 27185

SEQ ID NO: 67171 - DNA, 201 bp, Bos taurus; identical to SEQ ID NO: 27186

SEQ ID NO: 67172 - DNA, 201 bp, Bos taurus; identical to SEQ ID NO: 27187

SEQ ID NO: 67173 - DNA, 201 bp, Bos taurus; identical to SEQ ID NO: 27188

SEQ ID NO: 67174 - DNA, 201 bp, Bos taurus; identical to SEQ ID NO: 27189

SEQ ID NO: 67175 - DNA, 201 bp, Bos taurus; identical to SEQ ID NO: 27190

SEQ ID NO: 67176 - DNA, 201 bp, Bos taurus; identical to SEQ ID NO: 27191

SEQ ID NO: 67177 - DNA, 201 bp, Bos taurus; identical to SEQ ID NO: 27192

SEQ ID NO: 67178 - DNA, 201 bp, Bos taurus; identical to SEQ ID NO: 27193

SEQ ID NO: 67179 - DNA, 201 bp, Bos taurus; identical to SEQ ID NO: 27194

SEQ ID NO: 67180 - DNA, 201 bp, Bos taurus; identical to SEQ ID NO: 27195

SEQ ID NO: 67181 - DNA, 201 bp, Bos taurus; identical to SEQ ID NO: 27196

SEQ ID NO: 67182 - DNA, 201 bp, Bos taurus; identical to SEQ ID NO: 27197

SEQ ID NO: 67183 - DNA, 201 bp, Bos taurus; identical to SEQ ID NO: 27198

SEQ ID NO: 67184 - DNA, 201 bp, Bos taurus; identical to SEQ ID NO: 27199

SEQ ID NO: 67185 - DNA, 201 bp, Bos taurus; identical to SEQ ID NO: 27200

SEQ ID NO: 67186 - DNA, 201 bp, Bos taurus; identical to SEQ ID NO: 27201

SEQ ID NO: 67187 - DNA, 201 bp, Bos taurus
acaaaagtaatagatgccttaacttgttgccttctacttttacatcctttgctgtctacttttgagctattgtgaataaaacatcaggaacatagactattatgtcacgtgaacgcgtaggagtcttttatctggaacacatgtcaaatgttttgttattctgaggaattagtctaaagactagtgttgaatgtttttcct

SEQ ID NO: 67188 - DNA, 201 bp, Bos taurus
ttatgtgaatatttgtaaaatcttctatgtaagctagcagtcgctttattaatgtgagagaaagtactttattattgatttccagtttatagagacctcaattttatggttaagttttttatctatatatttgtccgtttagtagaaaaatgacatacctattagccaaagctggtgtaatattgtgctgctcctaaaaaa

SEQ ID NO: 67189 - DNA, 201 bp, Bos taurus
ccactactaaaaatctatttttacattgtcgagaaacgtaaatcttgataggttatgcgacctacccaaggttccaaggctaaaaatggtaaagttaaatattgaggctctatttctgatgtcaaaagtctgtattcttgacaaccaaggcttattacttccattcagtcattgttttgattaagttaggctagtttaatt

SEQ ID NO: 67190 - DNA, 201 bp, Bos taurus
tgtgcttaattaagaaaaactggactgtggggaaagttttcttttttcctgctttactaaactaaacttgtcaaattaaagaaaaacaagcaaaacagattggtatagttcaaaactatatctaatctaataagatggtatttaagaaaatatatattaagtcttaggttttaaaactgatatacttattcagaataggaa

SEQ ID NO: 67191 - DNA, 201 bp, Bos taurus; identical to SEQ ID NO: 27202

SEQ ID NO: 67192 - DNA, 201 bp, Bos taurus; identical to SEQ ID NO: 27203

SEQ ID NO: 67193 - DNA, 201 bp, Bos taurus; identical to SEQ ID NO: 27204

SEQ ID NO: 67194 - DNA, 201 bp, Bos taurus; identical to SEQ ID NO: 27210

SEQ ID NO: 67195 - DNA, 201 bp, Bos taurus; identical to SEQ ID NO: 27211

SEQ ID NO: 67196 - DNA, 201 bp, Bos taurus; identical to SEQ ID NO: 27213

SEQ ID NO: 67197 - DNA, 201 bp, Bos taurus; identical to SEQ ID NO: 27215

SEQ ID NO: 67198 - DNA, 201 bp, Bos taurus
taaagtatgaagagttgctgtccctcgtgtgcttgttcattccaccgctacttatggagtgcttgcccacagcatgcacaggcctggaggccagggcacctcagtaagcgacgcagagccttatgcaatggacattctaatgagacagacagcaagcatgggagcacgtagatggtaaggccgttccgaactatgataggg

SEQ ID NO: 67199 - DNA, 201 bp, Bos taurus
agctgggcgctgggggagcgtgtgcaggggccacctggccctccagcccatcaggtccctgcttgggagccctgggggcagccgtgacaagaagcaaaagacaaaagggatcctggattgtggcctggaaacggagctttttacagaggcttaggcattgatgttttaacattcaggagaattaaatgctttcgtgatgac

SEQ ID NO: 67200 - DNA, 201 bp, Bos taurus; identical to SEQ ID NO: 27221

SEQ ID NO: 67201 - DNA, 201 bp, Bos taurus; identical to SEQ ID NO: 27222

SEQ ID NO: 67202 - DNA, 201 bp, Bos taurus; identical to SEQ ID NO: 27224

SEQ ID NO: 67203 - DNA, 201 bp, Bos taurus; identical to SEQ ID NO: 27226

SEQ ID NO: 67204 - DNA, 201 bp, Bos taurus; identical to SEQ ID NO: 27227

SEQ ID NO: 67205 - DNA, 201 bp, Bos taurus; identical to SEQ ID NO: 27228

SEQ ID NO: 67206 - DNA, 201 bp, Bos taurus; identical to SEQ ID NO: 27229

SEQ ID NO: 67207 - DNA, 201 bp, Bos taurus; identical to SEQ ID NO: 27230

SEQ ID NO: 67208 - DNA, 201 bp, Bos taurus
cggcagacttcgccccatactgggagatgcgccaccaggctacacccacccttttgctcccaagctcagctttctcgtacaatgtggcaggcgctaggccgagaaacccataaagagcatcgcttctctgatgtcctttttacactaacaccccagaaggcaagttcggatccacaccccggggccccaaaccttccagga

SEQ ID NO: 67209 - DNA, 201 bp, Bos taurus
cttggctgcgattatgtgggccctctttttggacggtaatgcacattttaaccatgaggtggcagtcaagcccttccaaatggcctctctgcactctgaacccctgggtataataatctcattgtagattccagacacctgagtgccaggagtaaggccatgcttctgtgtgtgatgtattttttccatccctgatttgag

SEQ ID NO: 67210 - DNA, 201 bp, Bos taurus
ttgtgtaaggccttaaatctactgtacttttgaaatagtaatgagcataaatggtatttcagcatatctgcaaaaactgaaatgtgagatgaaaatattcgtgatttcttttggtgataaaacctcaggtacctctgatactattacatttcattgccttatcattgggggaactgctagattgcagttcaagattagtgg

SEQ ID NO: 67211 - DNA, 201 bp, Bos taurus; identical to SEQ ID NO: 27231

SEQ ID NO: 67212 - DNA, 201 bp, Bos taurus
ttgttctcctgggtcactctgcaggaagccagccactacggtgtgaagacacctagcttcctttggaagggtgcatgtggaagggaacagagaccacctgtcaacagctctgtgaagggccgtcttaaaaccagcctccagcatcagtcgagtcctcagatcttggctgcaacagaagggaccccaagccagaaccaccca

SEQ ID NO: 67213 - DNA, 201 bp, Bos taurus
aaaacaggtcagatgctctggctgttactattggcatgttgttgctgttcggttgttaggtcgtgtctgactctttgtgaccccatggtctacagcatgcctctgtccttcaccatctcccagtgagcataacaaagagtattgttaaaaactgatactagatgaagggacaatttcgttttctaaaatggttatatttaa

SEQ ID NO: 67214 - DNA, 201 bp, Bos taurus; identical to SEQ ID NO: 27232

SEQ ID NO: 67215 - DNA, 201 bp, Bos taurus
acatccagaagatggctgaacctgcaggaataccagagtaagaaattaatgtctgacaacggagtgaaagttcaaagattctttgttgccgacactgccagtgaagctctggaggctgctaagagactaagtaagctaactcataatgggtggaatatgcttgccaaattagtgaattcacaggtagtggtttcccactag

SEQ ID NO: 67216 - DNA, 201 bp, Bos taurus; identical to SEQ ID NO: 27233

SEQ ID NO: 67217 - DNA, 201 bp, Bos taurus; identical to SEQ ID NO: 27234

SEQ ID NO: 67218 - DNA, 201 bp, Bos taurus; identical to SEQ ID NO: 27235

SEQ ID NO: 67219 - DNA, 201 bp, Bos taurus
gtaggatcacagctactgtgcttatacttgtcaggcctagaattccctaaaaggcaaaaagagaccgtggatttgcacaagggtctttgaggtagggccatgggatgtgatcatggtagttgttagcctatgggttaaagattcattcccagatcgggctgacacttgcccccgagcccttccatgtgacagtgcgttctc

SEQ ID NO: 67220 - DNA, 201 bp, Bos taurus
acccggctgagaagcctcctcccgcccccctttcgatttcccgcttttctcctgcgaacgcgctataggggcgatgttgaggccgtgtgcccagtgatggcgaaatacaccaagttgttgagaggctgtggattgtttgcccacctgcgttgggaagaggggcttgggttagctcggggaagcgcagagatttttccctgg

SEQ ID NO: 67221 - DNA, 201 bp, Bos taurus
gggagcctacatatatatacactgaataagaatggcaaaaaaaaaagtgctttggattcatatatatatttgtaatgtatgtgtgtgtatttttatgttttcttgcccttattcattttggagccatctgaagtatctgggtctttgtcactttgaacacatcacatttgcttaggttagctgcatttggatgaaatcttt

SEQ ID NO: 67222 - DNA, 201 bp, Bos taurus; identical to SEQ ID NO: 27237

SEQ ID NO: 67223 - DNA, 201 bp, Bos taurus
cttggaaaggaaggagcagataggggaataaatagttataataagaattattaaatacttgctgtatatctaccactatactgaggcctttatctagatctgtggttctcacagaagcaattttgcctcccatgggacctttgacaacagagacatttctgattgtcaggtctgggggtatggggtattgcactagcgtct

SEQ ID NO: 67224 - DNA, 201 bp, Bos taurus
aaagttctttgaagaccttctttgtagcaggcttccacataagctcacagggaattcaaatcctgaaccactttataactagaaggcaggccttctggccgtatgctattttaatagcaaggaccatagtacagcctgaataacataaaggtactgagctgaactgagggccgtgagagtttataaggatgattgttgcta

SEQ ID NO: 67225 - DNA, 201 bp, Bos taurus
tttcagagcctggtttgccttatctgatggtggtactggcctccctcttacagtttctcttctgttttcttcactccttcccgtcaacacagtgaggatcatgatggactggacactgaattagggcctgggaatgctgaaaggaagtagatggtatatagatgctgccttggaagaaactcaggcatgcgggggagggga

SEQ ID NO: 67226 - DNA, 201 bp, Bos taurus; identical to SEQ ID NO: 27238

SEQ ID NO: 67227 - DNA, 201 bp, Bos taurus
tctccgatgctttcacagctgtgtgctcctttgtcttggaggacaaagagcagatatgtttacccccatgtttcagatgaaaaaaatgaggccttggtgactaagcatgttgcctaatgtcatacaaaggtgcaattagcacagagtgatgactgcctggcttccagcccagtttgtactgttctcaaaagatttatatgc

SEQ ID NO: 67228 - DNA, 201 bp, Bos taurus; identical to SEQ ID NO: 27239

SEQ ID NO: 67229 - DNA, 201 bp, Bos taurus; identical to SEQ ID NO: 27240

SEQ ID NO: 67230 - DNA, 201 bp, Bos taurus; identical to SEQ ID NO: 27241

SEQ ID NO: 67231 - DNA, 201 bp, Bos taurus; identical to SEQ ID NO: 27242

SEQ ID NO: 67232 - DNA, 201 bp, Bos taurus; identical to SEQ ID NO: 27243

SEQ ID NO: 67233 - DNA, 201 bp, Bos taurus; identical to SEQ ID NO: 27244

SEQ ID NO: 67234 - DNA, 201 bp, Bos taurus; identical to SEQ ID NO: 27245

SEQ ID NO: 67235 - DNA, 201 bp, Bos taurus; identical to SEQ ID NO: 27246

SEQ ID NO: 67236 - DNA, 201 bp, Bos taurus; identical to SEQ ID NO: 27247

SEQ ID NO: 67237 - DNA, 201 bp, Bos taurus
caggaattatttttaattcagccctatagctgccaaaagactcttgcattgatggcatttactggatagatcatctgttagtgttttataggcccatactgaagtagtactcatgaagcagtcaggtcagttcagtcgctcagtcatgtctgactctttgtgatccctgaattgcagcatgccaggcctccctgtccatcg

SEQ ID NO: 67238 - DNA, 201 bp, Bos taurus
ttccaaatcgacttcattccgtgttgccaaaaatagctcactcttgtaacttcagattattttcttattgcctttgaattcatcagttaataatgcagccaagcaatacgtactttttaattcctctacatatgccaacatggtgtgtctttttcaatatgatacccccctccccaaataatgttctctggaaaggaaaaa

SEQ ID NO: 67239 - DNA, 201 bp, Bos taurus; identical to SEQ ID NO: 27248

SEQ ID NO: 67240 - DNA, 201 bp, Bos taurus
aatgctaatgaagctatgtctatacagtatgtactgaacccacaagaagagaatgattgttacaagcagtgcgactggaacacaggcgttttagggcattcgcaccaagccttctaccagaagaagttaagaatcacccagtagctacaaagcaggctctgagctcacttctgaaaatcatgaaaggacattggaggcccg

SEQ ID NO: 67241 - DNA, 201 bp, Bos taurus; identical to SEQ ID NO: 27249

SEQ ID NO: 67242 - DNA, 201 bp, Bos taurus
ttaaatcagtgcggtgtcttgttttataagacccagatcaacacactgccagaccatttgttaagccacccctgcatcctatttgtaaatgtgtgtggctgcacatatcaaagccagcaaaagctttgggtaaggaacaacgcgtctggtcattttttttttttaagagcttctgatctttcttcatcaaagacatggagt

SEQ ID NO: 67243 - DNA, 201 bp, Bos taurus; identical to SEQ ID NO: 27250

SEQ ID NO: 67244 - DNA, 201 bp, Bos taurus; identical to SEQ ID NO: 27251

SEQ ID NO: 67245 - DNA, 201 bp, Bos taurus; identical to SEQ ID NO: 27252

SEQ ID NO: 67246 - DNA, 201 bp, Bos taurus; identical to SEQ ID NO: 27253

SEQ ID NO: 67247 - DNA, 201 bp, Bos taurus
tttcatggaaaaaagagttaaagagaatgtttcaaacacatctgagatctgaatgcaaattcctgaattcattggtggcaagggccaagatttgagagaagcatggcatgtgcccaaaggaggtcagtaaggggaggctcaaggctgagcgaagccacaaagtctcaagagctgaggacggggttagggctcagcacccct

SEQ ID NO: 67248 - DNA, 201 bp, Bos taurus; identical to SEQ ID NO: 27254

SEQ ID NO: 67249 - DNA, 201 bp, Bos taurus; identical to SEQ ID NO: 27255

SEQ ID NO: 67250 - DNA, 201 bp, Bos taurus; identical to SEQ ID NO: 27256

SEQ ID NO: 67251 - DNA, 201 bp, Bos taurus; identical to SEQ ID NO: 27257

SEQ ID NO: 67252 - DNA, 201 bp, Bos taurus; identical to SEQ ID NO: 27258

SEQ ID NO: 67253 - DNA, 201 bp, Bos taurus; identical to SEQ ID NO: 27259

SEQ ID NO: 67254 - DNA, 201 bp, Bos taurus; identical to SEQ ID NO: 27260

SEQ ID NO: 67255 - DNA, 201 bp, Bos taurus
tgatgctctctgtctagacttcttgatggtgtatgtatgatgttccttagaatatgacccccaactttcacatccttgagcctggcatggcctgctcatgcaactcattttaagagacggattgttggttaatcaccttcatgaattaagccaatgtgggcagtaaccagggccagacagtgtcctaaaccaatgcaaaga

SEQ ID NO: 67256 - DNA, 201 bp, Bos taurus
tgactctatcgtgttctgtttaactccctcatcccctaggattgtaggggataatggtggctttttaaaacatattttgcacaagtattttgcttacagtcctgattgatgatgaatatttgcttggtgatgtctgcagaacctttggttagagtctgtatatagagttaagtgattagggtcagacagttattgggacta

SEQ ID NO: 67257 - DNA, 201 bp, Bos taurus
aagttatctgtttaaggcctttcaggccccaaatccaggattgaaacccaaatctgggcgaagctttgctatagtgtagatttttggatcacggtgaagggatacctagcaccctcaccttccaaacaggttggaaagtcatgttttcttgacttcttttgccagatatggccaggctttagatttaaaaacaagaatcaa

SEQ ID NO: 67258 - DNA, 201 bp, Bos taurus; identical to SEQ ID NO: 27262

SEQ ID NO: 67259 - DNA, 201 bp, Bos taurus
aagatgtcaaattcctgattaggagaactttttgttaaaatattacatatatatgcatgtatagtttatatactatttcttaaaacatgccttctctatagtagtttttcaatctaccaaatacatttggaagatattcagatggcttgtggttcgaaccacaccaatggtttgcagttccatataattagtagataatta

SEQ ID NO: 67260 - DNA, 201 bp, Bos taurus; identical to SEQ ID NO: 27263

SEQ ID NO: 67261 - DNA, 201 bp, Bos taurus; identical to SEQ ID NO: 27264

SEQ ID NO: 67262 - DNA, 201 bp, Bos taurus; identical to SEQ ID NO: 27265

SEQ ID NO: 67263 - DNA, 201 bp, Bos taurus; identical to SEQ ID NO: 27267

SEQ ID NO: 67264 - DNA, 201 bp, Bos taurus; identical to SEQ ID NO: 27268

SEQ ID NO: 67265 - DNA, 201 bp, Bos taurus
agtatttgcaaagcagggccacagaacacccatgtgttccatttgacaataacaaggaagggactttgcatcaaaacaaaagcactgggagcccagggcctctagcacaacccatggaagtcctgactggggcaatacagggcacgccaagatgaatggtgtcaagccacaaacaaagaggcctcagagatccacatccca

SEQ ID NO: 67266 - DNA, 201 bp, Bos taurus; identical to SEQ ID NO: 27270

SEQ ID NO: 67267 - DNA, 201 bp, Bos taurus; identical to SEQ ID NO: 27271

SEQ ID NO: 67268 - DNA, 201 bp, Bos taurus
attatagaagagatgctgaaaatgagaatgaatatgattaagccaaggaatagaagtttcatattctgagtgtcttttccagttcttattctcacacaataagctaagccatatgggtaaacttaacatatttttggacttaacatagtatatattattgctgcattttacatatttataattaatgcttttttttttgct

SEQ ID NO: 67269 - DNA, 201 bp, Bos taurus; identical to SEQ ID NO: 27272

SEQ ID NO: 67270 - DNA, 201 bp, Bos taurus; identical to SEQ ID NO: 27274

SEQ ID NO: 67271 - DNA, 201 bp, Bos taurus
acttcagggcagtgtggtaagtgttctaccacatgcctttattcatttctttattcactcaacaaacctggccttggggccttgctaaagattttggctgcaattctccaggaagtggaggttttggaaaagggatgtgacctgattggaatggtcttttcagaaggtcaagaactgagagagcaggttagcgaagtcagg

SEQ ID NO: 67272 - DNA, 201 bp, Bos taurus; identical to SEQ ID NO: 27277

SEQ ID NO: 67273 - DNA, 201 bp, Bos taurus; identical to SEQ ID NO: 27278

SEQ ID NO: 67274 - DNA, 201 bp, Bos taurus; identical to SEQ ID NO: 27280

SEQ ID NO: 67275 - DNA, 201 bp, Bos taurus; identical to SEQ ID NO: 27281

SEQ ID NO: 67276 - DNA, 201 bp, Bos taurus
gtgttcccttcagtggccccaggacctcctcaaagacagctgggagtcatcctcgttaatggaacgtctcagaggcccattttgggcccttggggaatacacatacaccaaacttggaaagaagtattttgaggctcacagacttccacaatgacacagcccaaggggcccacctcaagggcagtccacaaacgtgcactt

SEQ ID NO: 67277 - DNA, 201 bp, Bos taurus
ggccagggcccccatcacagcccaagttgatggggtaacattattgactgcatgtctctgtcacccacttggacagagagggctcctcaagggcacagatcagcttccaacccagccctgtctccccagggcctggcacccagtctttgaaagtcagatcctatataattaatgatgttaaagcctgtgcaagtggatttt

SEQ ID NO: 67278 - DNA, 201 bp, Bos taurus; identical to SEQ ID NO: 27285

SEQ ID NO: 67279 - DNA, 201 bp, Bos taurus; identical to SEQ ID NO: 27286

SEQ ID NO: 67280 - DNA, 201 bp, Bos taurus; identical to SEQ ID NO: 27287

SEQ ID NO: 67281 - DNA, 201 bp, Bos taurus; identical to SEQ ID NO: 27294

SEQ ID NO: 67282 - DNA, 201 bp, Bos taurus; identical to SEQ ID NO: 27298

SEQ ID NO: 67283 - DNA, 201 bp, Bos taurus; identical to SEQ ID NO: 27300

SEQ ID NO: 67284 - DNA, 201 bp, Bos taurus; identical to SEQ ID NO: 27301

SEQ ID NO: 67285 - DNA, 201 bp, Bos taurus; identical to SEQ ID NO: 27303

SEQ ID NO: 67286 - DNA, 201 bp, Bos taurus; identical to SEQ ID NO: 27304

SEQ ID NO: 67287 - DNA, 201 bp, Bos taurus; identical to SEQ ID NO: 27305

SEQ ID NO: 67288 - DNA, 201 bp, Bos taurus; identical to SEQ ID NO: 27307

SEQ ID NO: 67289 - DNA, 201 bp, Bos taurus; identical to SEQ ID NO: 27312

SEQ ID NO: 67290 - DNA, 201 bp, Bos taurus; identical to SEQ ID NO: 27315

SEQ ID NO: 67291 - DNA, 201 bp, Bos taurus; identical to SEQ ID NO: 27317

SEQ ID NO: 67292 - DNA, 201 bp, Bos taurus
tgttcatagtaatgaacttgggttgctcaaaaagcaacatatttttaagcagatttagtttgttctattaaagaatacaggaagattattgatatttttagtagggacttaaacttctggctttttaagagttgttaaattctgcttggtaaacaaaacgttaaagcttggtagatcaaatactactgccttgagtatgac

SEQ ID NO: 67293 - DNA, 201 bp, Bos taurus
acactgaggccccgacagcccatgaagagacggagtgcctggccagccgcctgctgcttcagcctggctctccgggctctggccactgtctgatcacaaccacatacgagacgcaagctgcaaccgcccagatgaacctttcccaagctcccaacccacagaaatcatggcaggttacacagtggttactgtcctaaggcc

SEQ ID NO: 67294 - DNA, 201 bp, Bos taurus; identical to SEQ ID NO: 27319

SEQ ID NO: 67295 - DNA, 201 bp, Bos taurus
ttaggcaacaggattgcagttacagtgtggtctcaagtccatacaggaagctgaccaaccccagggtctcctgcacctgccggggcctgctgggtgggccgggaaacatgagaatcaacagcacagtgcagacggatggaggcggcggcttcgggcagaacactgccgagctgtacttcccctgacagaagctggagctgt

SEQ ID NO: 67296 - DNA, 201 bp, Bos taurus; identical to SEQ ID NO: 27320

SEQ ID NO: 67297 - DNA, 201 bp, Bos taurus; identical to SEQ ID NO: 27322

SEQ ID NO: 67298 - DNA, 201 bp, Bos taurus
ctgtggagcacacggtcaggtccgcgtcttcggccacgcccagtgttacatcccaccagggatcctcgcggtctggccctcatactgtcctccacccccacgcgtctctgttctctacccaaagctggagggcaggggtaaggtcagggcagggcactcagaatccgtcaggaggtagatccaggctcaggcccagggacc

SEQ ID NO: 67299 - DNA, 201 bp, Bos taurus
gggctgcccatccccactgcccactccatagagtcacagaggctggcttgtggaccccctgtcttggcctgcttgctcccctggtcccgggccagtccctcagcccaggatcagctctcagagcctgggagttggacaatcagtctgcaaggctgctgtgtgccagtggcgggggaaggcctttgcagaagtttctggcag

SEQ ID NO: 67300 - DNA, 201 bp, Bos taurus
ccccatccacttaccaccattctgccaacagggccattcctctgggttgggggcatggtttgtcttcagctgccctcgtctctccaaaagtcatagcatcgttagcccatcttatagggccccggacaccctgggttcaaatcctgacccctagcgtataccagctgtgcagcttcaggaaagagactgaacctctctgag

SEQ ID NO: 67301 - DNA, 201 bp, Bos taurus; identical to SEQ ID NO: 27324

SEQ ID NO: 67302 - DNA, 201 bp, Bos taurus
ctgcagaagtctctgtgtccacatctctaaaatgagggcatgaaggattactttcttgtgtggttctcagcactgcgaagattaaataaggaaaccaccccacccctagcccagtgtgtatgtagaaagtctttgaaatatgacttttctttttctccattgcatttctagaccagagaatacacagagcaggattgtttg

SEQ ID NO: 67303 - DNA, 201 bp, Bos taurus; identical to SEQ ID NO: 27326

SEQ ID NO: 67304 - DNA, 201 bp, Bos taurus; identical to SEQ ID NO: 27328

SEQ ID NO: 67305 - DNA, 201 bp, Bos taurus; identical to SEQ ID NO: 27329

SEQ ID NO: 67306 - DNA, 201 bp, Bos taurus; identical to SEQ ID NO: 27331

SEQ ID NO: 67307 - DNA, 201 bp, Bos taurus; identical to SEQ ID NO: 27333

SEQ ID NO: 67308 - DNA, 201 bp, Bos taurus; identical to SEQ ID NO: 27334

SEQ ID NO: 67309 - DNA, 201 bp, Bos taurus; identical to SEQ ID NO: 27336

SEQ ID NO: 67310 - DNA, 201 bp, Bos taurus; identical to SEQ ID NO: 27337

SEQ ID NO: 67311 - DNA, 201 bp, Bos taurus; identical to SEQ ID NO: 27338

SEQ ID NO: 67312 - DNA, 201 bp, Bos taurus; identical to SEQ ID NO: 27342

SEQ ID NO: 67313 - DNA, 201 bp, Bos taurus; identical to SEQ ID NO: 27343

SEQ ID NO: 67314 - DNA, 201 bp, Bos taurus; identical to SEQ ID NO: 27344

SEQ ID NO: 67315 - DNA, 201 bp, Bos taurus; identical to SEQ ID NO: 27345

SEQ ID NO: 67316 - DNA, 201 bp, Bos taurus; identical to SEQ ID NO: 27346

SEQ ID NO: 67317 - DNA, 201 bp, Bos taurus; identical to SEQ ID NO: 27347

SEQ ID NO: 67318 - DNA, 201 bp, Bos taurus
cccctgatggcagacctggcccagcccgaatccagcgcctggaagcactctggagcgccctccagaaagcagacggtgggagtgaccctccaactctccctggtctgctctttgaggcccctgctgtccatcttgagtttctagaggctgcccccaccccccagctccagcccagccagcccctggcccctgccttcccgc

SEQ ID NO: 67319 - DNA, 201 bp, Bos taurus; identical to SEQ ID NO: 27348

SEQ ID NO: 67320 - DNA, 201 bp, Bos taurus; identical to SEQ ID NO: 27349

SEQ ID NO: 67321 - DNA, 201 bp, Bos taurus
aatcactaacagatactgctgtgcttcctcctgcccccgagcccaagacaaccatcaatccactctgcatctgttgattggcctattctgggcattttgtaaaatgaaatgatgtaatatctagacttccgtatctgacatttcactgagtgtgatgtttttgaggttcgtccgcgtcgtagcaggcctcaggacttcatt

SEQ ID NO: 67322 - DNA, 201 bp, Bos taurus
accccgggcttctgagctgggcgtcggccgggagcgccgagccggggctcggatggagccactgcccgactcctgcacagcgggggagaggctgcacagcatccagggaggcccatgggctttaaactcagaccagacggtccaccccagaacctgtgtgaccgtgggcgagtgactcagcatctctgagccgcctcggcc

SEQ ID NO: 67323 - DNA, 201 bp, Bos taurus; identical to SEQ ID NO: 27350

SEQ ID NO: 67324 - DNA, 201 bp, Bos taurus; identical to SEQ ID NO: 27351

SEQ ID NO: 67325 - DNA, 201 bp, Bos taurus; identical to SEQ ID NO: 27352

SEQ ID NO: 67326 - DNA, 201 bp, Bos taurus; identical to SEQ ID NO: 27357

SEQ ID NO: 67327 - DNA, 201 bp, Bos taurus
ggctcctgagtggcagagtgagaccccaggcctcgcggcgtctgacgcctgttcactgagctgcaggcgctgagcctggccgccaacctggttgggttggcgcagcccgagaatccagggaatgtggctggaaacagggatctattccagctgggagagccctgggtcccgggcctccgtgcggactcaggcttgaccccc

SEQ ID NO: 67328 - DNA, 201 bp, Bos taurus; identical to SEQ ID NO: 27358

SEQ ID NO: 67329 - DNA, 201 bp, Bos taurus
ttgctctgcagaggtgtggccaggtaagggatggtgggggctgccctcaaggacccggagtggagaggtgcagggggtaaagcaaacccagcctaaccccgtgcagggtgagtaagcaaggcggccaagagctggtcagttcaattcagttcagtcgctcagtcgtgtccgactctttgtgaccccatggactgcaacaca

SEQ ID NO: 67330 - DNA, 201 bp, Bos taurus; identical to SEQ ID NO: 27361

SEQ ID NO: 67331 - DNA, 201 bp, Bos taurus; identical to SEQ ID NO: 27362

SEQ ID NO: 67332 - DNA, 201 bp, Bos taurus
aatgtgcaaaactgaaaccatggagagtaggactgaggggtggaaacggagctttcttgcgatttctggagcttacttggctaactggttaccaggcccaagcaaagtgagcttacaggtgcgctttcagagaggaccgatacagcagtctgtaacaggaggtcagcagactgggcctcgtgtgtgagactcgggctgtgc

SEQ ID NO: 67333 - DNA, 201 bp, Bos taurus; identical to SEQ ID NO: 27363

SEQ ID NO: 67334 - DNA, 201 bp, Bos taurus; identical to SEQ ID NO: 27365

SEQ ID NO: 67335 - DNA, 201 bp, Bos taurus; identical to SEQ ID NO: 27366

SEQ ID NO: 67336 - DNA, 201 bp, Bos taurus
tcaccggccagctgagggaccggtgtgaccgcatcgaccaggccgttgggaaaagcacccagtatcaaagcctgctgagaagcctgtccgagaagctggccgacctggacgatcagctcagcagcagcgtggccggcagtgcacaccccgacgccatgagccagcagctggaaacggcccagaagctgaagcaggcggtgg

SEQ ID NO: 67337 - DNA, 201 bp, Bos taurus; identical to SEQ ID NO: 27370

SEQ ID NO: 67338 - DNA, 201 bp, Bos taurus; identical to SEQ ID NO: 27375

SEQ ID NO: 67339 - DNA, 201 bp, Bos taurus
cttaaaaaatataaattgacaaactgtttctgaaatgtatatggaagcagaaaagacctagcatggccaaaatgatcttgggaaaaggagaaacaaagacggaaagcttgtattattcaattcagagtttagtgtgaagttacaatgatcagggctatgtggtattggaagaagaactaagaaatagagtaaaggaacaac

SEQ ID NO: 67340 - DNA, 201 bp, Bos taurus; identical to SEQ ID NO: 27376

SEQ ID NO: 67341 - DNA, 201 bp, Bos taurus
ttctcctgtgctcagtgttggcatgtaggtgcttactaaatgtagttagtgcatgaatgattgtatgcatgcatgaacaaagtgtcagagtttccttgctcgagttttctatgttttgtttgactgatgtgtttttatgataggaattttttaaaatttatttttaattgaaggataactgttttacaatattgtattggt

SEQ ID NO: 67342 - DNA, 201 bp, Bos taurus
tggccccactcctggctgctcgggaggtttgcgttcctgtggcctgctccctgcaggacccctctcaccacctcccagccccctggcctggttagcatcatggctgccttccagccagggagcctctcttctgtattaacatcagttctcaagaatgagggcccctgccacgatttctttgcttggaatatgatgttttta

SEQ ID NO: 67343 - DNA, 201 bp, Bos taurus
gtagttgcggggagtaggcctagttgctcttaggcatgtggatcttagttccctgaccaggaatctcatccacgtcccctccattgcaaggccaattcttaactactggaccactgggcaagtcctggtccttgccatttagaggggggcggagagagaccaaggaaaggcccagggacttcttaccactttggagtgaag

SEQ ID NO: 67344 - DNA, 201 bp, Bos taurus
ataaatcacgcttattaatcatgttaataaatcatgtcatcctgttcgtgacgccagttgtctcgctgtatctcactgtgcacactgttcgttgaacgcgaggtagacgaggtgccagctcagaggcttgaagatgagcggagccataggaatgcagacaggtttattctctgctggccggcacagcagccatagcaatat

SEQ ID NO: 67345 - DNA, 201 bp, Bos taurus
gggaaagggagggaaataaaataaaggatagagatacatttttggagagtcttcacagttatttggaatgatgagatgattcagaaagctttgtaagttattgagttttaaaatggaaaaaaaagtttaattgcagtatttcttcactgcacatacatttgtaagtcttcagggagaagttgacgaccaaagtatgataaa

SEQ ID NO: 67346 - DNA, 201 bp, Bos taurus; identical to SEQ ID NO: 27379

SEQ ID NO: 67347 - DNA, 201 bp, Bos taurus
caactgtatctaactcgagcccagggccacctgcaatgacttagtcttcagactgttgatagtaaacagagaaacaagagccagtctcagcagtatcggttatgtgaaggaagcagcagaaaggccctaagggaagagcttccatatatatatatacatatatatatgtatatatatatatttagaacttacttttcaagc

SEQ ID NO: 67348 - DNA, 201 bp, Bos taurus; identical to SEQ ID NO: 27380

SEQ ID NO: 67349 - DNA, 201 bp, Bos taurus; identical to SEQ ID NO: 27382

SEQ ID NO: 67350 - DNA, 201 bp, Bos taurus; identical to SEQ ID NO: 27383

SEQ ID NO: 67351 - DNA, 201 bp, Bos taurus; identical to SEQ ID NO: 27384

SEQ ID NO: 67352 - DNA, 201 bp, Bos taurus; identical to SEQ ID NO: 27385

SEQ ID NO: 67353 - DNA, 201 bp, Bos taurus; identical to SEQ ID NO: 27386

SEQ ID NO: 67354 - DNA, 201 bp, Bos taurus; identical to SEQ ID NO: 27387

SEQ ID NO: 67355 - DNA, 201 bp, Bos taurus; identical to SEQ ID NO: 27388

SEQ ID NO: 67356 - DNA, 201 bp, Bos taurus; identical to SEQ ID NO: 27389

SEQ ID NO: 67357 - DNA, 201 bp, Bos taurus
tcattctatttgtatcctttagtgaagattaacttgtagagtactatacagacttctctagtatccacaagtaaggccctagataagtctctttttttccttcccaaagcttaacttttgaaggcatggttagaaatcatatgcatgtgatttgcacaattattttcctgcctgatccattttataggcctgaaggaacag

SEQ ID NO: 67358 - DNA, 201 bp, Bos taurus; identical to SEQ ID NO: 27390

SEQ ID NO: 67359 - DNA, 201 bp, Bos taurus; identical to SEQ ID NO: 27391

SEQ ID NO: 67360 - DNA, 201 bp, Bos taurus; identical to SEQ ID NO: 27392

SEQ ID NO: 67361 - DNA, 201 bp, Bos taurus; identical to SEQ ID NO: 27393

SEQ ID NO: 67362 - DNA, 201 bp, Bos taurus; identical to SEQ ID NO: 27394

SEQ ID NO: 67363 - DNA, 201 bp, Bos taurus; identical to SEQ ID NO: 27395

SEQ ID NO: 67364 - DNA, 201 bp, Bos taurus; identical to SEQ ID NO: 27396

SEQ ID NO: 67365 - DNA, 201 bp, Bos taurus; identical to SEQ ID NO: 27397

SEQ ID NO: 67366 - DNA, 201 bp, Bos taurus; identical to SEQ ID NO: 27398

SEQ ID NO: 67367 - DNA, 201 bp, Bos taurus; identical to SEQ ID NO: 27399

SEQ ID NO: 67368 - DNA, 201 bp, Bos taurus; identical to SEQ ID NO: 27400

SEQ ID NO: 67369 - DNA, 201 bp, Bos taurus; identical to SEQ ID NO: 27401

SEQ ID NO: 67370 - DNA, 201 bp, Bos taurus
cagcctctcttaccctacctccaaatgcttacctccctaggctgtcatctcttccacttcataccatctgtcaccccagccgctgtctctgtgaggactgtgtgtcctgggttgagcacattgctggtattcaggccacagaacacagagcctcgtggctgcatccgcagatgctgaggtacctccttagctgggtgtcac

SEQ ID NO: 67371 - DNA, 201 bp, Bos taurus
agatgtatgtcctgaacaaattcctaagaacctgttaaggtgcaaccactttaaaactccttgtgtgttttccacggggtattgactcagcccggccagcactcagtacttgctaggagcacccatgggaaatacaagagaagcggaagaggtgtggtaggcttatgtcaaaggaccaggaacctccttggaccatattta

SEQ ID NO: 67372 - DNA, 201 bp, Bos taurus; identical to SEQ ID NO: 27402

SEQ ID NO: 67373 - DNA, 201 bp, Bos taurus; identical to SEQ ID NO: 27403

SEQ ID NO: 67374 - DNA, 201 bp, Bos taurus
tggacgtgccagggcctcacaactgtgcctctggtgaactgaaccgcgtaccctcccggctcgtcctctagatccaagcagccttgatcagctctgaagtactcttccctcctcgtggcctctcgggttgtcttcctgggcctgtgtcctacggaaacctccttaggatggaagtcagaggtccggtcggtccgtcctccc

SEQ ID NO: 67375 - DNA, 201 bp, Bos taurus
agaagagattgatgtttgtgaatatgtgaagaaagctttcacgtaagcaagattagccaaaacaaactaaaagaaaaaatctcatttgctactgataacacaggttatattaaaactcagcttactgataatatttaaatagttcaatcttttcagcaaaaaaattaaccttacaaaacctgaatacatcacaacagtgta

SEQ ID NO: 67376 - DNA, 201 bp, Bos taurus; identical to SEQ ID NO: 27409

SEQ ID NO: 67377 - DNA, 201 bp, Bos taurus; identical to SEQ ID NO: 27411

SEQ ID NO: 67378 - DNA, 201 bp, Bos taurus; identical to SEQ ID NO: 27412

SEQ ID NO: 67379 - DNA, 201 bp, Bos taurus; identical to SEQ ID NO: 27413

SEQ ID NO: 67380 - DNA, 201 bp, Bos taurus; identical to SEQ ID NO: 27414

SEQ ID NO: 67381 - DNA, 201 bp, Bos taurus
gatcctggttctgctcaaaatgtcagttcccatctggccagaaccacgtgatttactcccacccacttcctcaggtaggactgaatgtcaagaattccccgttgttgacttagaattaagaagggccaatcaggattgaagtgaataagcttttatctttcctttactttactcagggtaagaaacaaccacttgtgttgg

SEQ ID NO: 67382 - DNA, 201 bp, Bos taurus
gggacagggcgtttacgtgccaggagtgtgagtccagtgcgtgcacacagggacatccccgtgctcggggtcagggccccaggaggccaggcctgggaaccgatttggactatcatgccccaccatgtggcagtgtgtgtcttgttagagatcatggcttaactcgctgtgctccagccagcctgcaggctcctagtggcc

SEQ ID NO: 67383 - DNA, 201 bp, Bos taurus
acacacacacaccatggtcaaattagagaaaaacttcaaatcagcccaaagacttggcacacatgcaaccaggtccagatccccaggccttggtaaattaatgggtccagcagccatgggtgaaataaacatcctacagacatgaagctggctggtggccatcttccagataaggaacgtacttttgaactgtgcctttta

SEQ ID NO: 67384 - DNA, 201 bp, Bos taurus; identical to SEQ ID NO: 27417

SEQ ID NO: 67385 - DNA, 201 bp, Bos taurus; identical to SEQ ID NO: 27418

SEQ ID NO: 67386 - DNA, 201 bp, Bos taurus; identical to SEQ ID NO: 27419

SEQ ID NO: 67387 - DNA, 201 bp, Bos taurus; identical to SEQ ID NO: 27420

SEQ ID NO: 67388 - DNA, 201 bp, Bos taurus; identical to SEQ ID NO: 27421

SEQ ID NO: 67389 - DNA, 201 bp, Bos taurus
agttctttattctgtatagaatggtggggaggacctggaggggagttttaactccaggctattttgagccgtgtagctttccttcacacttggtactaacttaccggggaatattgagtaaaaactcattgtactagaattacagtacttagacatggagtacttagaccttaaagctgctaaacccagggattgaggcaa

SEQ ID NO: 67390 - DNA, 201 bp, Bos taurus; identical to SEQ ID NO: 27423

SEQ ID NO: 67391 - DNA, 201 bp, Bos taurus
caataaatatgtaaaacatctagaaataaatgtgataaaactttacttggttaaatggcaacacattgttttccataagttaacgtatagatttaatgacgcttgaagcaagactccaaagagattttttttaaacagggtcacaaagagtaattttgaaatgcatgttggtcaaagaattaaatggggagcaaccatttg

SEQ ID NO: 67392 - DNA, 201 bp, Bos taurus; identical to SEQ ID NO: 27425

SEQ ID NO: 67393 - DNA, 201 bp, Bos taurus; identical to SEQ ID NO: 27426

SEQ ID NO: 67394 - DNA, 201 bp, Bos taurus; identical to SEQ ID NO: 27427

SEQ ID NO: 67395 - DNA, 201 bp, Bos taurus
ttccaggagcagaagctctgcgaggctggggagagagcccagggaggcatgaaaacacagcggtctggactgcaggccaggctctgccagcagttcacttcgaagattgccctggggcaaactgccaaaccctttctggatgccagcttcctcaaccataaaatggaaccgctggtgcttctggccctccctctttccagg

SEQ ID NO: 67396 - DNA, 201 bp, Bos taurus
gtgtgactagtgacagacccctcggatctctgaccacaggtcctgacacacctacctgactagtcctttttgtggtctaaatacttgtctgcatcttgatgggagaagaagtggtcacaggccaccatctgcttggaacttctctcctcttctctgccctctggtgctttcagtctgtatccccatttatagattccagga

SEQ ID NO: 67397 - DNA, 201 bp, Bos taurus
atcttcagcagtgagagaagggaggagcctggctttgctctctcttttctctacaaatgccctccaggtgatcccactgtgcggctggggctgagaaccccaggaaggcccactgcaattttaaagttccgattcttactctaaaatccctcggttttttagaagtactgtgtgttcttatcctctcccacagcccccaag

SEQ ID NO: 67398 - DNA, 201 bp, Bos taurus
cagaaccaacctcatctcctgcccatgtggccatgtccaccccattttgttcctgactagatctggggagcctggatccctctttgagacagactgggacctggggcccttcgctgcagtgcttgcacctggacaaatgtctcctcgagcaacggcatacaaagaagattcccttctccaggggatcttcctgacccaggg

SEQ ID NO: 67399 - DNA, 201 bp, Bos taurus; identical to SEQ ID NO: 27428

SEQ ID NO: 67400 - DNA, 201 bp, Bos taurus; identical to SEQ ID NO: 27432

SEQ ID NO: 67401 - DNA, 201 bp, Bos taurus
actgtcccgtcgggagcttgactagctctctctgcctcatccaccgccgagacgagttaggacgggtcctctcacttcttcccttccaggccatccgagccattaacccctgcagcgactcgaccatgaccgccgaggagttcaccgatacagtgttctccaagattgacgtcaatggggatggtgaggccgcgctggggc

SEQ ID NO: 67402 - DNA, 201 bp, Bos taurus; identical to SEQ ID NO: 27434

SEQ ID NO: 67403 - DNA, 201 bp, Bos taurus; identical to SEQ ID NO: 27435

SEQ ID NO: 67404 - DNA, 201 bp, Bos taurus; identical to SEQ ID NO: 27436

SEQ ID NO: 67405 - DNA, 201 bp, Bos taurus
ctgatcttatcctttaggacgctggcttagcgggagtaagggatgtatttcccgagacgctcaagaatgaggtagcatgtccaccaccttctcaagtgctcgtgtctagctggttccccaaccctaggacagatgcagtaggaacggggatcctattcccaaagctggaacagatcctggattctcatctcatttcagccc

SEQ ID NO: 67406 - DNA, 201 bp, Bos taurus; identical to SEQ ID NO: 27437

SEQ ID NO: 67407 - DNA, 201 bp, Bos taurus; identical to SEQ ID NO: 27440

SEQ ID NO: 67408 - DNA, 201 bp, Bos taurus; identical to SEQ ID NO: 27441

SEQ ID NO: 67409 - DNA, 201 bp, Bos taurus; identical to SEQ ID NO: 27442

SEQ ID NO: 67410 - DNA, 201 bp, Bos taurus; identical to SEQ ID NO: 27443

SEQ ID NO: 67411 - DNA, 201 bp, Bos taurus; identical to SEQ ID NO: 27444

SEQ ID NO: 67412 - DNA, 201 bp, Bos taurus; identical to SEQ ID NO: 27445

SEQ ID NO: 67413 - DNA, 201 bp, Bos taurus; identical to SEQ ID NO: 27447

SEQ ID NO: 67414 - DNA, 201 bp, Bos taurus; identical to SEQ ID NO: 27451

SEQ ID NO: 67415 - DNA, 201 bp, Bos taurus; identical to SEQ ID NO: 27452

SEQ ID NO: 67416 - DNA, 201 bp, Bos taurus; identical to SEQ ID NO: 27453

SEQ ID NO: 67417 - DNA, 201 bp, Bos taurus; identical to SEQ ID NO: 27454

SEQ ID NO: 67418 - DNA, 201 bp, Bos taurus
gtgagttggggaggtcggtgaagtccgtgatggcttgaaaggcctcctccgtgaaacactgagtcacagcccagtctctgtctatgcagcagagcaagaaaagtcctccatcttccgggatgtggccctgctgccccaggctcctcatcccaatgaagtaagaatctcccctcattcctgaggatacagaaacagacgtga

SEQ ID NO: 67419 - DNA, 201 bp, Bos taurus; identical to SEQ ID NO: 27456

SEQ ID NO: 67420 - DNA, 201 bp, Bos taurus; identical to SEQ ID NO: 27457

SEQ ID NO: 67421 - DNA, 201 bp, Bos taurus; identical to SEQ ID NO: 27458

SEQ ID NO: 67422 - DNA, 201 bp, Bos taurus; identical to SEQ ID NO: 27459

SEQ ID NO: 67423 - DNA, 201 bp, Bos taurus; identical to SEQ ID NO: 27460

SEQ ID NO: 67424 - DNA, 201 bp, Bos taurus; identical to SEQ ID NO: 27461

SEQ ID NO: 67425 - DNA, 201 bp, Bos taurus; identical to SEQ ID NO: 27463

SEQ ID NO: 67426 - DNA, 201 bp, Bos taurus; identical to SEQ ID NO: 27464

SEQ ID NO: 67427 - DNA, 201 bp, Bos taurus; identical to SEQ ID NO: 27465

SEQ ID NO: 67428 - DNA, 201 bp, Bos taurus; identical to SEQ ID NO: 27467

SEQ ID NO: 67429 - DNA, 201 bp, Bos taurus; identical to SEQ ID NO: 27468

SEQ ID NO: 67430 - DNA, 201 bp, Bos taurus; identical to SEQ ID NO: 27469

SEQ ID NO: 67431 - DNA, 201 bp, Bos taurus; identical to SEQ ID NO: 27470

SEQ ID NO: 67432 - DNA, 201 bp, Bos taurus; identical to SEQ ID NO: 27471

SEQ ID NO: 67433 - DNA, 201 bp, Bos taurus
ctttcagcaaccaggaagtggaaccaataggaatgaacacttacttggaaaaggaagctttaattaatatatatttctatctctaatatacacacagcagcgctagatctttatcttcacaataaaatgtgtgcaaatgctctctgcagagatgagtccccacctcagtcggtatagaaaagcatgataaaggttggaaaa

SEQ ID NO: 67434 - DNA, 201 bp, Bos taurus; identical to SEQ ID NO: 27474

SEQ ID NO: 67435 - DNA, 201 bp, Bos taurus; identical to SEQ ID NO: 27475

SEQ ID NO: 67436 - DNA, 201 bp, Bos taurus; identical to SEQ ID NO: 27476

SEQ ID NO: 67437 - DNA, 201 bp, Bos taurus
tgattttatccttgtttaaaaaacatattcaggtacttggagaattaccaactcctccataaatttggcttactataaataccaaaactggtacctggttggcaaaggaggaaagtggaacttgtttttatctttgatctttagcatactggtcctctctgccattattggaggcacgattccagtgttctctgcattggg

SEQ ID NO: 67438 - DNA, 201 bp, Bos taurus; identical to SEQ ID NO: 27477

SEQ ID NO: 67439 - DNA, 201 bp, Bos taurus; identical to SEQ ID NO: 27478

SEQ ID NO: 67440 - DNA, 201 bp, Bos taurus; identical to SEQ ID NO: 27479

SEQ ID NO: 67441 - DNA, 201 bp, Bos taurus; identical to SEQ ID NO: 27480

SEQ ID NO: 67442 - DNA, 201 bp, Bos taurus; identical to SEQ ID NO: 27481

SEQ ID NO: 67443 - DNA, 201 bp, Bos taurus; identical to SEQ ID NO: 27482

SEQ ID NO: 67444 - DNA, 201 bp, Bos taurus
agtgtgcttatagaagaagagaaaatacacagacacacacatatgggtgatgtgaagatggaggcagagaatgaagtgatgtggccatgagtcatggaaaggaaggatgcaaaaagccaccagaagccagaagaggcagggaagacttctcccaagagtgtccagaggcaatgcagcaccttaactttggacttcaggcct

SEQ ID NO: 67445 - DNA, 201 bp, Bos taurus; identical to SEQ ID NO: 27483

SEQ ID NO: 67446 - DNA, 201 bp, Bos taurus
tttaacattttttgtttgacattggccatggagctaacaatttgtccagtaaaaagagagttattagcaatcactagacaggctcaaagagacgaggtagccacaggtgctgcacaggcgcaggccataccatccttcaagtccatgaaattctccaaagcgggggagaggttttgaaaggtgtttgcatttctggtgtcc

SEQ ID NO: 67447 - DNA, 201 bp, Bos taurus
aatggttggtgtaaggaaccaatataagcatacaaagttggtgttttaatctgtagggtttattattatttatgtgtgataaggccaatagataagtagacgactacagtgaaaacatggtttgtaactcacaggtccccagaggacaggacataccatattaggcaaggtcacatggggaatcatgagggtctgggagaa

SEQ ID NO: 67448 - DNA, 201 bp, Bos taurus
cccaggtaagataccctttgtgattccctcatcctttgagaaaccctcaccgtcccattgtttcccagaaactgtgcagttcctcttatcctcaagcctcctccacctgagtgcctgtgtactcctctccccctttgacccctgatatgtgctccttctcccttgcccagtgaggggtttttaccccatgtccttgggcgc

SEQ ID NO: 67449 - DNA, 201 bp, Bos taurus; identical to SEQ ID NO: 27485

SEQ ID NO: 67450 - DNA, 201 bp, Bos taurus; identical to SEQ ID NO: 27486

SEQ ID NO: 67451 - DNA, 201 bp, Bos taurus
gcttttaacatgaagagtgctgtgagtgatgaaggcctacagggcaagattagtgagtctgataaaaagaaaatactgagtaaatgcaatgaggtcctttcgtggctggaggccaatcaactggctgagaaagatgagtttgatcataagagaaaggaattggagcaagtgtgtaacccaatcatcacaaaactctatcag

SEQ ID NO: 67452 - DNA, 201 bp, Bos taurus
cgttaggcatactattttgtgtaagagccaacctgtggagacactggggcctaaggatgtatatctcacactgagtctatggccacttattcttggttagaaaaccctaggttagaatgaaatggaggactcatttggattcgagagtgggtttcaggcaactctggttcctgggcacaggggagcagaggtgcctgaggc

SEQ ID NO: 67453 - DNA, 201 bp, Bos taurus; identical to SEQ ID NO: 27487

SEQ ID NO: 67454 - DNA, 201 bp, Bos taurus; identical to SEQ ID NO: 27488

SEQ ID NO: 67455 - DNA, 201 bp, Bos taurus; identical to SEQ ID NO: 27489

SEQ ID NO: 67456 - DNA, 201 bp, Bos taurus; identical to SEQ ID NO: 27490

SEQ ID NO: 67457 - DNA, 201 bp, Bos taurus
agtcctcatccttggggcttatgtactcctaagcctccgcttcaggcttctgaatcttttcttcattcagggcaattttattttggcccagagcctccacgtgtgcatatccacagccctctgtctgctggtccaccctaaaagaagtactagaggcctggaaatacagtgtaagtcgttcatttgtttttttctatttca

SEQ ID NO: 67458 - DNA, 201 bp, Bos taurus
aggccaattcaaaccctttgcaaaggcctttgccaggtctccccatctcctcagttgctggaaggtagatagccccaggatggagcctagtcacccttggtggccagaccaggcatggataaagcttaaaagagacagcatggaagagaaggtgtctgaccagccaaagccagtggaacctgtacagaagctgctccctca

SEQ ID NO: 67459 - DNA, 201 bp, Bos taurus
gctctctctctctgctttcatttcattctctctgctgttcattatgcagagtatctatttattaaacttctctgcttgcagttctgagcttgcagctgtgtacactaaggccatcggaaccagttaacccctgctctagtctagtagcttctgatctttgacgcgcatgtatagttaaagatgttgaatgtacagaggctc

SEQ ID NO: 67460 - DNA, 201 bp, Bos taurus; identical to SEQ ID NO: 27492

SEQ ID NO: 67461 - DNA, 201 bp, Bos taurus
aggtggcccccttttgaagaggtcccctgaaatattttcacctcctaaatgacctgagccctgcagcccaagtgtcctcatttgtaccaccccatggtcaccttgctcctcctccctcacccaaatctttggttttcagagttctgaattttggtgttacagggttgtgttgttttctttgaaattgtactctgcttcact

SEQ ID NO: 67462 - DNA, 201 bp, Bos taurus
tctttaacgctctggtacattctgtcatgactgcacgcctgaacttttgccactctcaagagctcaatcacttcttctgtgatgtcaagcccctcttggaactggcctgcagtaacacgctgctcaaccagtggctgctttttgttgtcacaggcagcgtatctatgggagctttcttcctgacgcttctctcctacttct

SEQ ID NO: 67463 - DNA, 201 bp, Bos taurus
aaaaaaggccctgggttttgtctgacttgatcttactcaagcctgttctgcctcttggaatgtctggttctaaacggctgtttaaggagatggagctgacgaggatttctaagtgacacttggccccaggacagactggagttaggaggagtttctgcaaaggtgttggaggaggtaatggaaatggtgagctagcagttg

SEQ ID NO: 67464 - DNA, 201 bp, Bos taurus
aagaagtaatacatgggggaatggaggcgatggtccaaggtagttatggtgataatgaggaggttgcctgtcaaggccagcaggtatgtcatcaaaaacagcagtgcgtgtaaaatctgaagcttacggtcagcagaaaaccccacgaggaggaatccactcactgaggtcaggttggccatgtcactctgaagatagcaa

SEQ ID NO: 67465 - DNA, 201 bp, Bos taurus
agtatgagtggtcctgtatcttaacagttagaacgttttttcctcctcctaacactctgattttttaaatacatattcattggcagttcagtaattgtccgtgtctgcaaaaatggagtttgtatatcttgatatgccaccctctcttacatgtatttttggctttgtgtgtaatgtgctcagtcgtgtctgattctttgc

SEQ ID NO: 67466 - DNA, 201 bp, Bos taurus; identical to SEQ ID NO: 27494

SEQ ID NO: 67467 - DNA, 201 bp, Bos taurus; identical to SEQ ID NO: 27496

SEQ ID NO: 67468 - DNA, 201 bp, Bos taurus; identical to SEQ ID NO: 27497

SEQ ID NO: 67469 - DNA, 201 bp, Bos taurus; identical to SEQ ID NO: 27498

SEQ ID NO: 67470 - DNA, 201 bp, Bos taurus; identical to SEQ ID NO: 27499

SEQ ID NO: 67471 - DNA, 201 bp, Bos taurus; identical to SEQ ID NO: 27505

SEQ ID NO: 67472 - DNA, 201 bp, Bos taurus; identical to SEQ ID NO: 27506

SEQ ID NO: 67473 - DNA, 201 bp, Bos taurus; identical to SEQ ID NO: 27507

SEQ ID NO: 67474 - DNA, 201 bp, Bos taurus; identical to SEQ ID NO: 27508

SEQ ID NO: 67475 - DNA, 201 bp, Bos taurus; identical to SEQ ID NO: 27510

SEQ ID NO: 67476 - DNA, 201 bp, Bos taurus; identical to SEQ ID NO: 27511

SEQ ID NO: 67477 - DNA, 201 bp, Bos taurus
acaatatttttttcagttttctttcaattttctgataaaagctgagtaactttgcttttcacgtttagttttagtgccacctaaattacaatttttgtacggttgaggtaggaatcaatttttaattgctccatctataggaccaattgtcttggcaacatgtatctttttcctattattttcaaatttcacctccactat

SEQ ID NO: 67478 - DNA, 201 bp, Bos taurus; identical to SEQ ID NO: 27515

SEQ ID NO: 67479 - DNA, 201 bp, Bos taurus; identical to SEQ ID NO: 27516

SEQ ID NO: 67480 - DNA, 201 bp, Bos taurus
gggactttcaaggtaagcattctatttttagttctatttgagattagctgaatatcttaacaccattctttgaaccacgttaaagggccaaaatctattacaaataatttttggtttctctttcttcaagataagggatttggccttttccttacctctctttctttctctgtgttagttaatttattctgggtttgtaaa

SEQ ID NO: 67481 - DNA, 201 bp, Bos taurus; identical to SEQ ID NO: 27518

SEQ ID NO: 67482 - DNA, 201 bp, Bos taurus; identical to SEQ ID NO: 27521

SEQ ID NO: 67483 - DNA, 201 bp, Bos taurus; identical to SEQ ID NO: 27522

SEQ ID NO: 67484 - DNA, 201 bp, Bos taurus; identical to SEQ ID NO: 27523

SEQ ID NO: 67485 - DNA, 201 bp, Bos taurus
tacagatacaagagcattatctttattcaccacgtgccaaatacttagcacaatgcacagcacacaacagaaactcaataaatacgaactgaattcaagagttcaatttgaggaatttaggcacaccgcacggagaaggcaatggcaccccactccagtactcttacctggaaaatcccatggatgggggagcctggtagg

SEQ ID NO: 67486 - DNA, 201 bp, Bos taurus; identical to SEQ ID NO: 27524

SEQ ID NO: 67487 - DNA, 201 bp, Bos taurus
ggagggccaacttcaaacttgttttaaattcgtggaaaagcagattttcggttggaattgtgactcatttaagtgatcatgaaagactgaaaagtcacctgtccagtgggccttccttcttgatcaacaaaatcaagaagagggcttccctaggctttctttcttaaaggtaaagcttagtcaagtgacttaactttgtaa

SEQ ID NO: 67488 - DNA, 201 bp, Bos taurus
ccagattcactatgtcaaagccctaacccttagtgtggctgtatttggaaatggggtccctaaggaagtaaagttaaattaagtcataagaccggggccccgatccgagaggattagtgttcttattaaaattggcaccagagtccactctctacccataaacatgtgcttaacaagaaaaggccatgtgaggacctagag

SEQ ID NO: 67489 - DNA, 201 bp, Bos taurus; identical to SEQ ID NO: 27525

SEQ ID NO: 67490 - DNA, 201 bp, Bos taurus
cagccccaggagtgagggaaagctcaggtcagcagaggtgaagccagggcatcagagttccccgcaccacgtggtcaccaccagagcagccccgaggcccacctgggagtcacagtcctgggacactaggtggtgattggaaagatttgcccagtgggcaggtgggactgaaacggatgtaccagccataactgcagacct

SEQ ID NO: 67491 - DNA, 201 bp, Bos taurus; identical to SEQ ID NO: 27528

SEQ ID NO: 67492 - DNA, 201 bp, Bos taurus; identical to SEQ ID NO: 27529

SEQ ID NO: 67493 - DNA, 201 bp, Bos taurus; identical to SEQ ID NO: 27530

SEQ ID NO: 67494 - DNA, 201 bp, Bos taurus; identical to SEQ ID NO: 27531

SEQ ID NO: 67495 - DNA, 201 bp, Bos taurus; identical to SEQ ID NO: 27533

SEQ ID NO: 67496 - DNA, 201 bp, Bos taurus; identical to SEQ ID NO: 27534

SEQ ID NO: 67497 - DNA, 201 bp, Bos taurus; identical to SEQ ID NO: 27535

SEQ ID NO: 67498 - DNA, 201 bp, Bos taurus; identical to SEQ ID NO: 27536

SEQ ID NO: 67499 - DNA, 201 bp, Bos taurus; identical to SEQ ID NO: 27537

SEQ ID NO: 67500 - DNA, 201 bp, Bos taurus; identical to SEQ ID NO: 27538

SEQ ID NO: 67501 - DNA, 201 bp, Bos taurus; identical to SEQ ID NO: 27539

SEQ ID NO: 67502 - DNA, 201 bp, Bos taurus; identical to SEQ ID NO: 27540

SEQ ID NO: 67503 - DNA, 201 bp, Bos taurus; identical to SEQ ID NO: 27541

SEQ ID NO: 67504 - DNA, 201 bp, Bos taurus; identical to SEQ ID NO: 27542

SEQ ID NO: 67505 - DNA, 201 bp, Bos taurus; identical to SEQ ID NO: 27543

SEQ ID NO: 67506 - DNA, 201 bp, Bos taurus; identical to SEQ ID NO: 27544

SEQ ID NO: 67507 - DNA, 201 bp, Bos taurus; identical to SEQ ID NO: 27545

SEQ ID NO: 67508 - DNA, 201 bp, Bos taurus; identical to SEQ ID NO: 27546

SEQ ID NO: 67509 - DNA, 201 bp, Bos taurus; identical to SEQ ID NO: 27547

SEQ ID NO: 67510 - DNA, 201 bp, Bos taurus; identical to SEQ ID NO: 27548

SEQ ID NO: 67511 - DNA, 201 bp, Bos taurus; identical to SEQ ID NO: 27549

SEQ ID NO: 67512 - DNA, 201 bp, Bos taurus; identical to SEQ ID NO: 27550

SEQ ID NO: 67513 - DNA, 201 bp, Bos taurus; identical to SEQ ID NO: 27551

SEQ ID NO: 67514 - DNA, 201 bp, Bos taurus; identical to SEQ ID NO: 27552

SEQ ID NO: 67515 - DNA, 201 bp, Bos taurus; identical to SEQ ID NO: 27553

SEQ ID NO: 67516 - DNA, 201 bp, Bos taurus; identical to SEQ ID NO: 27554

SEQ ID NO: 67517 - DNA, 201 bp, Bos taurus; identical to SEQ ID NO: 27555

SEQ ID NO: 67518 - DNA, 201 bp, Bos taurus; identical to SEQ ID NO: 27556

SEQ ID NO: 67519 - DNA, 201 bp, Bos taurus; identical to SEQ ID NO: 27557

SEQ ID NO: 67520 - DNA, 201 bp, Bos taurus; identical to SEQ ID NO: 27558

SEQ ID NO: 67521 - DNA, 201 bp, Bos taurus; identical to SEQ ID NO: 27559

SEQ ID NO: 67522 - DNA, 201 bp, Bos taurus; identical to SEQ ID NO: 27560

SEQ ID NO: 67523 - DNA, 201 bp, Bos taurus; identical to SEQ ID NO: 27561

SEQ ID NO: 67524 - DNA, 201 bp, Bos taurus; identical to SEQ ID NO: 27562

SEQ ID NO: 67525 - DNA, 201 bp, Bos taurus; identical to SEQ ID NO: 27563

SEQ ID NO: 67526 - DNA, 201 bp, Bos taurus; identical to SEQ ID NO: 27564

SEQ ID NO: 67527 - DNA, 201 bp, Bos taurus; identical to SEQ ID NO: 27565

SEQ ID NO: 67528 - DNA, 201 bp, Bos taurus; identical to SEQ ID NO: 27566

SEQ ID NO: 67529 - DNA, 201 bp, Bos taurus; identical to SEQ ID NO: 27567

SEQ ID NO: 67530 - DNA, 201 bp, Bos taurus; identical to SEQ ID NO: 27568

SEQ ID NO: 67531 - DNA, 201 bp, Bos taurus; identical to SEQ ID NO: 27569

SEQ ID NO: 67532 - DNA, 201 bp, Bos taurus; identical to SEQ ID NO: 27570

SEQ ID NO: 67533 - DNA, 201 bp, Bos taurus; identical to SEQ ID NO: 27571

SEQ ID NO: 67534 - DNA, 201 bp, Bos taurus; identical to SEQ ID NO: 27572

SEQ ID NO: 67535 - DNA, 201 bp, Bos taurus; identical to SEQ ID NO: 27573

SEQ ID NO: 67536 - DNA, 201 bp, Bos taurus; identical to SEQ ID NO: 27574

SEQ ID NO: 67537 - DNA, 201 bp, Bos taurus; identical to SEQ ID NO: 27575

SEQ ID NO: 67538 - DNA, 201 bp, Bos taurus; identical to SEQ ID NO: 27576

SEQ ID NO: 67539 - DNA, 201 bp, Bos taurus; identical to SEQ ID NO: 27577

SEQ ID NO: 67540 - DNA, 201 bp, Bos taurus; identical to SEQ ID NO: 27578

SEQ ID NO: 67541 - DNA, 201 bp, Bos taurus; identical to SEQ ID NO: 27579

SEQ ID NO: 67542 - DNA, 201 bp, Bos taurus; identical to SEQ ID NO: 27580

SEQ ID NO: 67543 - DNA, 201 bp, Bos taurus; identical to SEQ ID NO: 27581

SEQ ID NO: 67544 - DNA, 201 bp, Bos taurus; identical to SEQ ID NO: 27582

SEQ ID NO: 67545 - DNA, 201 bp, Bos taurus; identical to SEQ ID NO: 27583

SEQ ID NO: 67546 - DNA, 201 bp, Bos taurus; identical to SEQ ID NO: 27584

SEQ ID NO: 67547 - DNA, 201 bp, Bos taurus; identical to SEQ ID NO: 27585

SEQ ID NO: 67548 - DNA, 201 bp, Bos taurus; identical to SEQ ID NO: 27586

SEQ ID NO: 67549 - DNA, 201 bp, Bos taurus; identical to SEQ ID NO: 27587

SEQ ID NO: 67550 - DNA, 201 bp, Bos taurus; identical to SEQ ID NO: 27588

SEQ ID NO: 67551 - DNA, 201 bp, Bos taurus; identical to SEQ ID NO: 27589

SEQ ID NO: 67552 - DNA, 201 bp, Bos taurus; identical to SEQ ID NO: 27590

SEQ ID NO: 67553 - DNA, 201 bp, Bos taurus; identical to SEQ ID NO: 27591

SEQ ID NO: 67554 - DNA, 201 bp, Bos taurus; identical to SEQ ID NO: 27592

SEQ ID NO: 67555 - DNA, 201 bp, Bos taurus; identical to SEQ ID NO: 27593

SEQ ID NO: 67556 - DNA, 201 bp, Bos taurus; identical to SEQ ID NO: 27596

SEQ ID NO: 67557 - DNA, 201 bp, Bos taurus; identical to SEQ ID NO: 27599

SEQ ID NO: 67558 - DNA, 201 bp, Bos taurus; identical to SEQ ID NO: 27600

SEQ ID NO: 67559 - DNA, 201 bp, Bos taurus; identical to SEQ ID NO: 27601

SEQ ID NO: 67560 - DNA, 201 bp, Bos taurus; identical to SEQ ID NO: 27602

SEQ ID NO: 67561 - DNA, 201 bp, Bos taurus; identical to SEQ ID NO: 27604

SEQ ID NO: 67562 - DNA, 201 bp, Bos taurus; identical to SEQ ID NO: 27606

SEQ ID NO: 67563 - DNA, 201 bp, Bos taurus
tccaggagtaactcacctaccatcagagttagggcatctttcggctggcctgtctcccgtggagcacaagtcctccaatgctaactgctgagaagcacttagggatccggtaggtctgggcagggcctgagcatctaacgggacccccaggatgccagatgtgggggctgctggcccctggaccccactctgagcagcaga

SEQ ID NO: 67564 - DNA, 201 bp, Bos taurus; identical to SEQ ID NO: 27608

SEQ ID NO: 67565 - DNA, 201 bp, Bos taurus; identical to SEQ ID NO: 27609

SEQ ID NO: 67566 - DNA, 201 bp, Bos taurus; identical to SEQ ID NO: 27616

SEQ ID NO: 67567 - DNA, 201 bp, Bos taurus; identical to SEQ ID NO: 27617

SEQ ID NO: 67568 - DNA, 201 bp, Bos taurus; identical to SEQ ID NO: 27618

SEQ ID NO: 67569 - DNA, 201 bp, Bos taurus; identical to SEQ ID NO: 27619

SEQ ID NO: 67570 - DNA, 201 bp, Bos taurus; identical to SEQ ID NO: 27620

SEQ ID NO: 67571 - DNA, 201 bp, Bos taurus; identical to SEQ ID NO: 27621

SEQ ID NO: 67572 - DNA, 201 bp, Bos taurus; identical to SEQ ID NO: 27622

SEQ ID NO: 67573 - DNA, 201 bp, Bos taurus; identical to SEQ ID NO: 27623

SEQ ID NO: 67574 - DNA, 201 bp, Bos taurus
tctgacgagtgctagaacaaagcacaaggaggccagggtgccagtctgtgggtgtgtcctgcagccccaggctgcccctgggccatcccaggcagtctgccgtccttggggagaagctgggcactgaccatgctcttgcagactccaggaggtctgtcgtgcagagccctggggcaggactggtctgcgggctcgtctgac

SEQ ID NO: 67575 - DNA, 201 bp, Bos taurus; identical to SEQ ID NO: 27625

SEQ ID NO: 67576 - DNA, 201 bp, Bos taurus
tcttgagtccacagaaacaccataagtaacttctccatcatcagtaaattgcaggtatagtcaatatatgtgtgaattttaggatatcctctgatacattataagttcacagtcttggaaaagtaaattaaggccacccagtttgtgactgtggttcgatttttctggaagcacactaaaacctaaaagtgactgtttcag

SEQ ID NO: 67577 - DNA, 201 bp, Bos taurus; identical to SEQ ID NO: 27626

SEQ ID NO: 67578 - DNA, 201 bp, Bos taurus; identical to SEQ ID NO: 27627

SEQ ID NO: 67579 - DNA, 201 bp, Bos taurus; identical to SEQ ID NO: 27628

SEQ ID NO: 67580 - DNA, 201 bp, Bos taurus; identical to SEQ ID NO: 27629

SEQ ID NO: 67581 - DNA, 201 bp, Bos taurus
tgcatttgtagacaggcacccactgaggcctccctgtggagtcacggggtggtgagcgctgcctaactgcggatgtctgagcactcctgaaggcgttcatgctggcccaagaaacagagctccagcatcttcccttcatctttaacttcctcccacctgtgtttccatccactttagccttctgattaagaaggctgagta

SEQ ID NO: 67582 - DNA, 201 bp, Bos taurus
ggaggagggggaggccgtgggtccccttgcaggtgagtctgtggacagcagagcttgcccgcttcccttgttctggtgccagtcgctgtcactagccttatgagcagcggcccaaatacagagcaaaactgagcagttggagcttcagttttgtcactcttgggttttcttcccaggtatttgctgtaagtcagcatgagc

SEQ ID NO: 67583 - DNA, 201 bp, Bos taurus; identical to SEQ ID NO: 27630

SEQ ID NO: 67584 - DNA, 201 bp, Bos taurus; identical to SEQ ID NO: 27632

SEQ ID NO: 67585 - DNA, 201 bp, Bos taurus
agccagggagagagcagtgagccaaagagataaaggtctctggcctcatgggaagaaaaactgtaagttaaacctaatacaatggagccttgaatgacatgggtctaaactgcattgggccactgacacgtgggtttttcagtagtagatataacagtcatacaaatgcgagtttggatgagtctgcagatactggactgt

SEQ ID NO: 67586 - DNA, 201 bp, Bos taurus; identical to SEQ ID NO: 27641

SEQ ID NO: 67587 - DNA, 201 bp, Bos taurus; identical to SEQ ID NO: 27642

SEQ ID NO: 67588 - DNA, 201 bp, Bos taurus; identical to SEQ ID NO: 27643

SEQ ID NO: 67589 - DNA, 201 bp, Bos taurus; identical to SEQ ID NO: 27646

SEQ ID NO: 67590 - DNA, 201 bp, Bos taurus; identical to SEQ ID NO: 27647

SEQ ID NO: 67591 - DNA, 201 bp, Bos taurus; identical to SEQ ID NO: 27648

SEQ ID NO: 67592 - DNA, 201 bp, Bos taurus; identical to SEQ ID NO: 27649

SEQ ID NO: 67593 - DNA, 201 bp, Bos taurus; identical to SEQ ID NO: 27650

SEQ ID NO: 67594 - DNA, 201 bp, Bos taurus
aataggcaactggaaaaacatttaaacataatacaggagctcaaatacttatgatatgccaagtgaattaattggatattacgaacacagtctcaatttggatatcaaaattagaaacagtaataatcatacaaaatatatgactatttccattttgggggtcacaattttggttgtttctatctttgtcacatttgctct

SEQ ID NO: 67595 - DNA, 201 bp, Bos taurus
aatcttgaattttttacaaagacaattttatttgtgaatgtcctggttcaagcagcccaagttactagttttattaaatcctgaaactttgaatatgattatgaatttttggtatggcaaaatatgaagtgtagagcagttgtgctgaattctgaagagcgacatttttagagggaaagcacaaggagactaagtttaaaa

SEQ ID NO: 67596 - DNA, 201 bp, Bos taurus
ctaaaccggtggacaaaggcccaattccagtattataaagctgtaaagctccatagcaaggaaaaaccaccatattttattttcaccatttacaatattgccctggccagaaaagaaagaaatctctatttatcgccaccatttcttttggtggagaagattttattgcatttttgacacttattcagatcaagactttat

SEQ ID NO: 67597 - DNA, 201 bp, Bos taurus
caatggacatgagtttgaggaagctccaggagatggtgatggacagggaggtctggcttgctccagtccatggaattgcaaatagtcagacatgactgagcgactaaaaacccacaacaggcagtcaaatccttctttttctttgaacttttgacacccattctgtgcctagccaaagggagatctctgcttttaaagggc

SEQ ID NO: 67598 - DNA, 201 bp, Bos taurus
gtacatcaactctaagagccctattcatcacacgcaaggcttccgcagtcaggcggccttaattctctggttttgtattgcgagtcaggccacaagatacgtattatttcacaaggaaatactggagatggttggaggcgcttgcagacacacacacgggatggaataatgacgtctggcccgtttactccatgcacagga

SEQ ID NO: 67599 - DNA, 201 bp, Bos taurus; identical to SEQ ID NO: 27653

SEQ ID NO: 67600 - DNA, 201 bp, Bos taurus; identical to SEQ ID NO: 27654

SEQ ID NO: 67601 - DNA, 201 bp, Bos taurus; identical to SEQ ID NO: 27655

SEQ ID NO: 67602 - DNA, 201 bp, Bos taurus; identical to SEQ ID NO: 27656

SEQ ID NO: 67603 - DNA, 201 bp, Bos taurus; identical to SEQ ID NO: 27657

SEQ ID NO: 67604 - DNA, 201 bp, Bos taurus; identical to SEQ ID NO: 27658

SEQ ID NO: 67605 - DNA, 201 bp, Bos taurus; identical to SEQ ID NO: 27659

SEQ ID NO: 67606 - DNA, 201 bp, Bos taurus; identical to SEQ ID NO: 27660

SEQ ID NO: 67607 - DNA, 201 bp, Bos taurus; identical to SEQ ID NO: 27661

SEQ ID NO: 67608 - DNA, 201 bp, Bos taurus; identical to SEQ ID NO: 27662

SEQ ID NO: 67609 - DNA, 201 bp, Bos taurus; identical to SEQ ID NO: 27663

SEQ ID NO: 67610 - DNA, 201 bp, Bos taurus
aatatttggtcatcaccacagacacatgactaatgtacctattctttctgtggaattctcctattttaaatctttacgttctcatcttttcctccatccatgtattttcctatgtgttgtatttcatagtaaaggaaagtgaaaacatttgatttcatcagaaaaataactatttaagtttagacagacttctccattagc

SEQ ID NO: 67611 - DNA, 201 bp, Bos taurus; identical to SEQ ID NO: 27664

SEQ ID NO: 67612 - DNA, 201 bp, Bos taurus; identical to SEQ ID NO: 27665

SEQ ID NO: 67613 - DNA, 201 bp, Bos taurus; identical to SEQ ID NO: 27668

SEQ ID NO: 67614 - DNA, 201 bp, Bos taurus; identical to SEQ ID NO: 27669

SEQ ID NO: 67615 - DNA, 201 bp, Bos taurus; identical to SEQ ID NO: 27671

SEQ ID NO: 67616 - DNA, 201 bp, Bos taurus; identical to SEQ ID NO: 27672

SEQ ID NO: 67617 - DNA, 201 bp, Bos taurus; identical to SEQ ID NO: 27674

SEQ ID NO: 67618 - DNA, 201 bp, Bos taurus; identical to SEQ ID NO: 27676

SEQ ID NO: 67619 - DNA, 201 bp, Bos taurus; identical to SEQ ID NO: 27677

SEQ ID NO: 67620 - DNA, 201 bp, Bos taurus
aagctatagtccatgggtcatggagaatcagacacaactgagtgactgatcatgcaagcatgcagagtacaataataaatattggagagtgaagcagacacagtttagtctataaaagtgggaaatggttaaactacttaacatatccaaagcatatgctctttccattatactaggcagtgtgtgtgtgagtgcatgcat

SEQ ID NO: 67621 - DNA, 201 bp, Bos taurus; identical to SEQ ID NO: 27679

SEQ ID NO: 67622 - DNA, 201 bp, Bos taurus; identical to SEQ ID NO: 27680

SEQ ID NO: 67623 - DNA, 201 bp, Bos taurus; identical to SEQ ID NO: 27681

SEQ ID NO: 67624 - DNA, 201 bp, Bos taurus
ctgacactgctgagaatcttgaatcactaaatttctctcatccttcttaccaacagaaccagctccaatttcactgacaaaaatgtggccatcagttaaattgatagtactaaattatgtcacctgacagtttgtgcatgcctgggctttttaagcctttcctgcaacccctaactgtctccaggccaatagcagtagcta

SEQ ID NO: 67625 - DNA, 201 bp, Bos taurus
tatccagctcatctaactactaatatttccctgctgtttttagaaagcacttttgataagaaacatcatttttaagatggcttaaatatatgaacaggcatgacaagatctggccaaaatcaggcagcggataaaggtcacgattttccccacaagactctattggatttatatacagaactcacagattttacctctttg

SEQ ID NO: 67626 - DNA, 201 bp, Bos taurus; identical to SEQ ID NO: 27683

SEQ ID NO: 67627 - DNA, 201 bp, Bos taurus; identical to SEQ ID NO: 27684

SEQ ID NO: 67628 - DNA, 201 bp, Bos taurus; identical to SEQ ID NO: 27685

SEQ ID NO: 67629 - DNA, 201 bp, Bos taurus; identical to SEQ ID NO: 27686

SEQ ID NO: 67630 - DNA, 201 bp, Bos taurus; identical to SEQ ID NO: 27687

SEQ ID NO: 67631 - DNA, 201 bp, Bos taurus; identical to SEQ ID NO: 27688

SEQ ID NO: 67632 - DNA, 201 bp, Bos taurus; identical to SEQ ID NO: 27690

SEQ ID NO: 67633 - DNA, 201 bp, Bos taurus; identical to SEQ ID NO: 27692

SEQ ID NO: 67634 - DNA, 201 bp, Bos taurus; identical to SEQ ID NO: 27693

SEQ ID NO: 67635 - DNA, 201 bp, Bos taurus; identical to SEQ ID NO: 27694

SEQ ID NO: 67636 - DNA, 201 bp, Bos taurus; identical to SEQ ID NO: 27695

SEQ ID NO: 67637 - DNA, 201 bp, Bos taurus; identical to SEQ ID NO: 27697

SEQ ID NO: 67638 - DNA, 201 bp, Bos taurus; identical to SEQ ID NO: 27699

SEQ ID NO: 67639 - DNA, 201 bp, Bos taurus
tgtgcacagactcatataggaaaggaaatgtcataactttagacatttgatatgaatgatatccatcttctttttgtacagacaaaactgtttctttcccttcttagcaaaattattttccattcctttggttcctttaagtttttggtattaaaatgtattaatggtaattataaaaatatattgcatgtactttcagat

SEQ ID NO: 67640 - DNA, 201 bp, Bos taurus; identical to SEQ ID NO: 27700

SEQ ID NO: 67641 - DNA, 201 bp, Bos taurus; identical to SEQ ID NO: 27701

SEQ ID NO: 67642 - DNA, 201 bp, Bos taurus; identical to SEQ ID NO: 27702

SEQ ID NO: 67643 - DNA, 201 bp, Bos taurus
gcacccagggttggctggccacatttggagttagatgggactctcccaggctcacctccagaagaggaccatctgagggtgctcacagcaacattgccttccttcccaggctcatcaacaggcctgagatagcttcttttcacttctattaatcttgttaacaatttaatgccttgcatgtattcttttctgaccagatct

SEQ ID NO: 67644 - DNA, 201 bp, Bos taurus
tatccctcgcaggtcaagtcagttccagggtcctggatttggttttgcagctcgaaggcggtgtcctcgcacccgtgaaaaatggccacataatagcccacggtgcccagggcatagcagtcagaggacaccagcaagtagatgagcagtgtcacaggacctcccagcaagaggagggcagtgccaggcccagggctgccg

SEQ ID NO: 67645 - DNA, 201 bp, Bos taurus
aaaacaaagagtatccttatgttttatgtaataaaatcactgatcaccaatagagagcaaaccatgtttacttggggccctgagctctcaaaggatttatccatagcaataatacttacctacaggaaatgagcagcttctctgctttgccaactctggccagtaatgccctgtgcaaatgaatttagagattttctcagc

SEQ ID NO: 67646 - DNA, 201 bp, Bos taurus
atacatccaacaaagtaaaaagaaaaataagcatcctttccttgtttatgtgttgttttaagtgatttccttcgatgcttcgagcaccgtatttgtttccatggggcagatacgtgccctcccctttgtcttgatttgagatagagacagaaggatcactgcactctccttcttactcacatagcagacgatccacgtgtc

SEQ ID NO: 67647 - DNA, 201 bp, Bos taurus
ttttatctatcaacaggactgtaccatgggagcccaaacatttggccaaagatttttctgggtgtgtctatgaggatgtttctggatgagattaacatttcaataggtagactgactgaagcagattgccctctttaatttgggtgggtctcatccagtcaaaggaagactggaatagaacaaaaagactgaattagaggg

SEQ ID NO: 67648 - DNA, 201 bp, Bos taurus
acgtagatcaactcctaggaaatcagctatgttaaccattatgccaccaatgctgcatcataaatgcgttagaaaaaagcaaaaggcatcagaattgcaggcattctgtcaagtcaagaatttaagtcccaaagaagtgtctatccaagttcaccagctagtccctggcatgatcaggataaacctacttctaaacctgtt

SEQ ID NO: 67649 - DNA, 201 bp, Bos taurus; identical to SEQ ID NO: 27704

SEQ ID NO: 67650 - DNA, 201 bp, Bos taurus; identical to SEQ ID NO: 27705

SEQ ID NO: 67651 - DNA, 201 bp, Bos taurus; identical to SEQ ID NO: 27707

SEQ ID NO: 67652 - DNA, 201 bp, Bos taurus; identical to SEQ ID NO: 27708

SEQ ID NO: 67653 - DNA, 201 bp, Bos taurus
taagatggcccagctcacaccaaaaggtgcttttctgagatcttccctaataaatgcacagcccactctcttccatgatgctacacccaataggagccagaacaaggccttcccagttgcttgctgagcctccagacacagcgcccacacaaaatggttcaattttaaaggaaagaatggcctgatggcagaagggaaatt

SEQ ID NO: 67654 - DNA, 201 bp, Bos taurus
tggcagcaccagagagcacacgccccttgttcagactgcaccgccggccaagcctttagaatcttgctttgtgtccagactgttttcgctagtctgacttaatctggggaccactcctttggccacctggagctttccctgagcagtgaaagttcttcttgaaaatactttttctagacacaggctcagtctcagggtaaa

SEQ ID NO: 67655 - DNA, 201 bp, Bos taurus; identical to SEQ ID NO: 27709

SEQ ID NO: 67656 - DNA, 201 bp, Bos taurus; identical to SEQ ID NO: 27710

SEQ ID NO: 67657 - DNA, 201 bp, Bos taurus; identical to SEQ ID NO: 27711

SEQ ID NO: 67658 - DNA, 201 bp, Bos taurus; identical to SEQ ID NO: 27712

SEQ ID NO: 67659 - DNA, 201 bp, Bos taurus; identical to SEQ ID NO: 27713

SEQ ID NO: 67660 - DNA, 201 bp, Bos taurus; identical to SEQ ID NO: 27714

SEQ ID NO: 67661 - DNA, 201 bp, Bos taurus
tgtcacctacttaaacgcttccaggtgttgatcaaccagtcacctcccaaggcctttcctatgaccagtctgtctgtagaccccaggcctgtggccctccaatgggataccatcagaaccagattttcccaatgttgggggtgggggggaaatcacatcaactcagttaggagtgaggaacaagcccatttagtacaattt

SEQ ID NO: 67662 - DNA, 201 bp, Bos taurus; identical to SEQ ID NO: 27717

SEQ ID NO: 67663 - DNA, 201 bp, Bos taurus; identical to SEQ ID NO: 27718

SEQ ID NO: 67664 - DNA, 201 bp, Bos taurus
ccattctgggctgaaacagcttagcgtgaagctcactaaaactgggtcctgtacttcagagtttctttgggtaatctcttctttcctgaaggatataaaagcactgttaacttacagcgatgaaaaaaaacctctaagaacttgtaataataaagatcagtcactggaataacatatggagtggggtcagggtggagaccg

SEQ ID NO: 67665 - DNA, 201 bp, Bos taurus; identical to SEQ ID NO: 27722

SEQ ID NO: 67666 - DNA, 201 bp, Bos taurus; identical to SEQ ID NO: 27723

SEQ ID NO: 67667 - DNA, 201 bp, Bos taurus; identical to SEQ ID NO: 27724

SEQ ID NO: 67668 - DNA, 201 bp, Bos taurus; identical to SEQ ID NO: 27725

SEQ ID NO: 67669 - DNA, 201 bp, Bos taurus; identical to SEQ ID NO: 27726

SEQ ID NO: 67670 - DNA, 201 bp, Bos taurus; identical to SEQ ID NO: 27727

SEQ ID NO: 67671 - DNA, 201 bp, Bos taurus
atcacagccttcgaatctaacctgtggccagaagaaggtacccagatggtgaggaacttaaacaccttgacacattgagaagtcattgaaggagccagacgcatttagcctagaaaagagaggcctatatgatacaaaagtcttatttaacattaggactgactgtggaagacactgatttattatctagctagtccaaat

SEQ ID NO: 67672 - DNA, 201 bp, Bos taurus
gcgccggtggtttgcacggggtttgcccttcctgtcccgggcgccccacgcttggcagaatcctctgccatcactgtttcagaattcttgataatttagggacaagaggccccacattctcattttgccctgggctctgcaaattatgtagccagacccgcttctaatagatacattgttcgaattctgtcctattgaggt

SEQ ID NO: 67673 - DNA, 201 bp, Bos taurus; identical to SEQ ID NO: 27729

SEQ ID NO: 67674 - DNA, 201 bp, Bos taurus; identical to SEQ ID NO: 27730

SEQ ID NO: 67675 - DNA, 201 bp, Bos taurus; identical to SEQ ID NO: 27731

SEQ ID NO: 67676 - DNA, 201 bp, Bos taurus
ttcatgacaaatgatttctaaagtagaattttatactcaatcccattaacagtatgagtgttgattagcagcatattcaggaatatcagccaagaatcttactaacaaaatccacttgggttagtttcaataaatgggaaggtattacagtccatcatttagctctcagaacttttaggtggacaagaaaactgagctcag

SEQ ID NO: 67677 - DNA, 201 bp, Bos taurus
ttcttgtttaatcacacactattgcaaaacttttaaagacagcccagaaggggcctttttttttttcattgtaaaatgagttgtaatatttcagataaaataaggccacttgagtacacttgaggaagataatatttttaaaagttgctggcatcatttctttttcttaggaaaaaaaaacagacaataggaaaaatgttt

SEQ ID NO: 67678 - DNA, 201 bp, Bos taurus
taaagggttgtagctaaaagtgacatgcttacttctgggcctagcatttacctgctccatgcctgccccccaaccccaccaactttggtgtgggcacaaaaaatactggaaatagaggtggccccaacgtgtcccctagggatctccctggtgctctagtggttaagactctatgcttccaatgcagggatgtgcgtttga

SEQ ID NO: 67679 - DNA, 201 bp, Bos taurus; identical to SEQ ID NO: 27733

SEQ ID NO: 67680 - DNA, 201 bp, Bos taurus
atttctgtctttagactatgaggacattcataaacaatgactttaatcattaataaaaatacattcaacctgtgcatacatttttcacataccaaattacatgatcattctgggcttaaatgttcaaattatctataatgtgacacattttggggcaaagctatactatttaattttttcctactctaaaattctctccct

SEQ ID NO: 67681 - DNA, 201 bp, Bos taurus; identical to SEQ ID NO: 27734

SEQ ID NO: 67682 - DNA, 201 bp, Bos taurus; identical to SEQ ID NO: 27735

SEQ ID NO: 67683 - DNA, 201 bp, Bos taurus; identical to SEQ ID NO: 27739

SEQ ID NO: 67684 - DNA, 201 bp, Bos taurus; identical to SEQ ID NO: 27742

SEQ ID NO: 67685 - DNA, 201 bp, Bos taurus; identical to SEQ ID NO: 27745

SEQ ID NO: 67686 - DNA, 201 bp, Bos taurus; identical to SEQ ID NO: 27746

SEQ ID NO: 67687 - DNA, 201 bp, Bos taurus; identical to SEQ ID NO: 27747

SEQ ID NO: 67688 - DNA, 201 bp, Bos taurus; identical to SEQ ID NO: 27749

SEQ ID NO: 67689 - DNA, 201 bp, Bos taurus; identical to SEQ ID NO: 27750

SEQ ID NO: 67690 - DNA, 201 bp, Bos taurus; identical to SEQ ID NO: 27752

SEQ ID NO: 67691 - DNA, 201 bp, Bos taurus; identical to SEQ ID NO: 27753

SEQ ID NO: 67692 - DNA, 201 bp, Bos taurus; identical to SEQ ID NO: 27754

SEQ ID NO: 67693 - DNA, 201 bp, Bos taurus; identical to SEQ ID NO: 27755

SEQ ID NO: 67694 - DNA, 201 bp, Bos taurus; identical to SEQ ID NO: 27756

SEQ ID NO: 67695 - DNA, 201 bp, Bos taurus; identical to SEQ ID NO: 27757

SEQ ID NO: 67696 - DNA, 201 bp, Bos taurus; identical to SEQ ID NO: 27758

SEQ ID NO: 67697 - DNA, 201 bp, Bos taurus; identical to SEQ ID NO: 27759

SEQ ID NO: 67698 - DNA, 201 bp, Bos taurus
ttctgaaggcttttttttttttctagaatttgaacattttcatttcaaccactgagagaacagaaactcctgttggtggttagattggcaggcatgccaaattttagctctggagttgatccaaactaccccatttacagctcaaaagcaaggcttccgaaccattcttagaaataatcttaatgcgaagaaaatcagtcc

SEQ ID NO: 67699 - DNA, 201 bp, Bos taurus; identical to SEQ ID NO: 27762

SEQ ID NO: 67700 - DNA, 201 bp, Bos taurus; identical to SEQ ID NO: 27763

SEQ ID NO: 67701 - DNA, 201 bp, Bos taurus
tatttctactgatgcccatcatttcaatctagcacttgtcgaacatcccaatcttttttctctccgtgtttgttactgccttctcgagtagtgagccacccagcttcccttatcttcaatatatatactcagttgctgagtctagaacacacagtaagtagtttaaaaattacatactcatatcatcaggataagcagacc

SEQ ID NO: 67702 - DNA, 201 bp, Bos taurus; identical to SEQ ID NO: 27764

SEQ ID NO: 67703 - DNA, 201 bp, Bos taurus; identical to SEQ ID NO: 27765

SEQ ID NO: 67704 - DNA, 201 bp, Bos taurus; identical to SEQ ID NO: 27766

SEQ ID NO: 67705 - DNA, 201 bp, Bos taurus
ttgtctgtacaaaggccagcccttgcgaggatgcacatgtctggggtgctgctctgccccgggcagtaacctgcatgatatcagagtcacatcgttatacgcagtgtctgacggcccgacgacttgaaggctaacggatatatcacttaattcaaggctctgtatctgcccccgagccaatggttttctcttcctgtgccc

SEQ ID NO: 67706 - DNA, 201 bp, Bos taurus; identical to SEQ ID NO: 27768

SEQ ID NO: 67707 - DNA, 201 bp, Bos taurus; identical to SEQ ID NO: 27769

SEQ ID NO: 67708 - DNA, 201 bp, Bos taurus; identical to SEQ ID NO: 27770

SEQ ID NO: 67709 - DNA, 201 bp, Bos taurus; identical to SEQ ID NO: 27771

SEQ ID NO: 67710 - DNA, 201 bp, Bos taurus; identical to SEQ ID NO: 27772

SEQ ID NO: 67711 - DNA, 201 bp, Bos taurus
gggtggacacagaagacttgcaaggagggacatgggtacccacagctgatcaggcagcagaacacagacaagcagaagcgtgactagcacaaagcccagatagtccaaggatggttaagatccaagccaggcacacacttaactcctaagtattttactctttacccactgccttctggccttcagagtttctcacagaaa

SEQ ID NO: 67712 - DNA, 201 bp, Bos taurus; identical to SEQ ID NO: 27773

SEQ ID NO: 67713 - DNA, 201 bp, Bos taurus; identical to SEQ ID NO: 27775

SEQ ID NO: 67714 - DNA, 201 bp, Bos taurus; identical to SEQ ID NO: 27777

SEQ ID NO: 67715 - DNA, 201 bp, Bos taurus
caatgtagtatacacttgccagatcatgttttaatctataacaggataacagagcagctacatgtaatcaaaacatattttactagcagaggcaatcagcgctcaaaatcaaaacggttcttaaacgagtgttgctggtataacacagctaattgaccttttaagtatcatgtaaaccttttacctgacattctccgctct

SEQ ID NO: 67716 - DNA, 201 bp, Bos taurus; identical to SEQ ID NO: 27779

SEQ ID NO: 67717 - DNA, 201 bp, Bos taurus
agcatccagaattgtgtgaaataaatctttgttgttaataagccacccagtctgcggtattttgttaggctaccctgagatgactaagataatacctcactgtggttttgatttgcctttccttaataattaatgatggtgagcttgtctcatacgcttgttgcccattcttcacatctccatgatttttgacaattctgc

SEQ ID NO: 67718 - DNA, 201 bp, Bos taurus; identical to SEQ ID NO: 27780

SEQ ID NO: 67719 - DNA, 201 bp, Bos taurus; identical to SEQ ID NO: 27781

SEQ ID NO: 67720 - DNA, 201 bp, Bos taurus
aaatcttttaagtccagggtatccttccccggtaccctaaacctgctagtttattacatacaggattaaccaggaccctggcagaatcggtcaaggtcaccggggcaggtgccactaccccagaacctgacagcacgcttccaggcccatttccatcttcgctctcccacccccactctcactcccaccccccactccggg

SEQ ID NO: 67721 - DNA, 201 bp, Bos taurus; identical to SEQ ID NO: 27782

SEQ ID NO: 67722 - DNA, 201 bp, Bos taurus; identical to SEQ ID NO: 27783

SEQ ID NO: 67723 - DNA, 201 bp, Bos taurus; identical to SEQ ID NO: 27784

SEQ ID NO: 67724 - DNA, 201 bp, Bos taurus; identical to SEQ ID NO: 27785

SEQ ID NO: 67725 - DNA, 201 bp, Bos taurus; identical to SEQ ID NO: 27786

SEQ ID NO: 67726 - DNA, 201 bp, Bos taurus; identical to SEQ ID NO: 27787

SEQ ID NO: 67727 - DNA, 201 bp, Bos taurus; identical to SEQ ID NO: 27788

SEQ ID NO: 67728 - DNA, 201 bp, Bos taurus
acttactttgagaattaaacacatttttatattaatattcacaaataatcagattgccatcttaagttgcacttgtaccatatctctcccacttctcatccataactcctgttgcataacataaaacagtggttgaatttctttcctaatgctccccgactccacacacacacatatgacgttaatacacgatgcacaggc

SEQ ID NO: 67729 - DNA, 201 bp, Bos taurus; identical to SEQ ID NO: 27789

SEQ ID NO: 67730 - DNA, 201 bp, Bos taurus; identical to SEQ ID NO: 27790

SEQ ID NO: 67731 - DNA, 201 bp, Bos taurus; identical to SEQ ID NO: 27792

SEQ ID NO: 67732 - DNA, 201 bp, Bos taurus; identical to SEQ ID NO: 27793

SEQ ID NO: 67733 - DNA, 201 bp, Bos taurus; identical to SEQ ID NO: 27794

SEQ ID NO: 67734 - DNA, 201 bp, Bos taurus; identical to SEQ ID NO: 27795

SEQ ID NO: 67735 - DNA, 201 bp, Bos taurus; identical to SEQ ID NO: 27796

SEQ ID NO: 67736 - DNA, 201 bp, Bos taurus; identical to SEQ ID NO: 27797

SEQ ID NO: 67737 - DNA, 201 bp, Bos taurus; identical to SEQ ID NO: 27799

SEQ ID NO: 67738 - DNA, 201 bp, Bos taurus; identical to SEQ ID NO: 27801

SEQ ID NO: 67739 - DNA, 201 bp, Bos taurus; identical to SEQ ID NO: 27802

SEQ ID NO: 67740 - DNA, 201 bp, Bos taurus
ggggcatcttgccagctttagtgactgcttcgatgtgattcgctcgaggaaaaaggtgagcattgcccggatcaagccgtacttacagcgagagaggaaaatttgactttttcctcctcctcgcagtttaaaagagactgttaatcctctgcgccgctccccacttcccctgcaaagttggttttctagctgtgaactccg

SEQ ID NO: 67741 - DNA, 201 bp, Bos taurus
agcaggaatctggtctttcttgcttgctgctgtaactccgttaactagaacagtgcctggcatacagtaattacttgaaatatttatcaaatgaataagcgatcgttcccaagtatttccaggtgtcagaaaagaaaatttgatctggcctagcaagtataattcaatagtggatgtcactgagcagaatactagatttta

SEQ ID NO: 67742 - DNA, 201 bp, Bos taurus
tcaactacagatctttgagttgccccaggcagggagcactgtggaaagacagtttctccgcgtagatctactaactgttacttttctttagtgactttgcttagtcactaaaaacaaaactgcatttactgagaaaatgtactgacaaagtacaggtactttcagtgtggtttcttcattcatcgtgattacggaccatac

SEQ ID NO: 67743 - DNA, 201 bp, Bos taurus; identical to SEQ ID NO: 27803

SEQ ID NO: 67744 - DNA, 201 bp, Bos taurus; identical to SEQ ID NO: 27804

SEQ ID NO: 67745 - DNA, 201 bp, Bos taurus
tgggcccgctagccctgcagaggtgaccttgcagagaccttggccccaagcggtgactccagagcatcacacaaagctcgctcacaagctcctcatggggtagttaccaaggatgtgacagatgaagagtggatggcacaagaccattttcaggatgtggataaaaatgaatgctggttaccatgtgggaagccagggctt

SEQ ID NO: 67746 - DNA, 201 bp, Bos taurus; identical to SEQ ID NO: 27807

SEQ ID NO: 67747 - DNA, 201 bp, Bos taurus; identical to SEQ ID NO: 27810

SEQ ID NO: 67748 - DNA, 201 bp, Bos taurus
gggctatctgaggtcaatccgtgggccccagttgtttccaggtggtgctcctctaaagcacaggtctctagaatgtgtacccttgaagtgtggaaagatggtgcattgggatgcaaaaagaggggacataattaaaatatgaaaaaaaatcaatcctaagggcatcagtagcaatatatggagaatcccctgaaagcagat

SEQ ID NO: 67749 - DNA, 201 bp, Bos taurus; identical to SEQ ID NO: 27812

SEQ ID NO: 67750 - DNA, 201 bp, Bos taurus
ctttacacatcctgaaggatttgttacaatcagttgagtcatcatttggtatcacacttttcccttttcactgagatgtcttccttcattagaagaggggagagttgtcactcactaggactcacgtttgtatgagctttgtattgggtcgtgaaagcatctacactgttgtgtgttcttggcacattgtcccaagactgt

SEQ ID NO: 67751 - DNA, 201 bp, Bos taurus; identical to SEQ ID NO: 27813

SEQ ID NO: 67752 - DNA, 201 bp, Bos taurus; identical to SEQ ID NO: 27816

SEQ ID NO: 67753 - DNA, 201 bp, Bos taurus
tggctttgatttctattaaacatataacaagtagacaagggctaaagccattgtaccaagtaaagtgctgaggatattacagtgttaatgcttcctctatcaactcgatgtatttctttcatcatacaaacctgccagatgagttcatgggggtcagtagggtctggccacgcctccagatccactcaaaagatggttgac

SEQ ID NO: 67754 - DNA, 201 bp, Bos taurus; identical to SEQ ID NO: 27818

SEQ ID NO: 67755 - DNA, 201 bp, Bos taurus; identical to SEQ ID NO: 27819

SEQ ID NO: 67756 - DNA, 201 bp, Bos taurus; identical to SEQ ID NO: 27821

SEQ ID NO: 67757 - DNA, 201 bp, Bos taurus; identical to SEQ ID NO: 27822

SEQ ID NO: 67758 - DNA, 201 bp, Bos taurus; identical to SEQ ID NO: 27823

SEQ ID NO: 67759 - DNA, 201 bp, Bos taurus; identical to SEQ ID NO: 27824

SEQ ID NO: 67760 - DNA, 201 bp, Bos taurus; identical to SEQ ID NO: 27825

SEQ ID NO: 67761 - DNA, 201 bp, Bos taurus
agaaaagccctgtcttgatcacactctcatgctttaaagcgtcctactctgaccttcctctggccatgcccttccccatgggaataatagcccaggcccatgggacacttccacctggagcctggttcctccttcgagacatgcttcaagcacctcaggtcacagaatgtccttccaagtgtcctgcggctgcttcctggg

SEQ ID NO: 67762 - DNA, 201 bp, Bos taurus
tccagatgccctgtggccatctcatgtgcatatgagcacattaaggattgtttcttcctcttcttaaagaaatatgtttttccctctgactccatctagaaccaaggcccaggcagtcatgtaactgtccttgctcatccaggagtatattttacttgtaggcaggcatgtctaacgtgacccccactctgctttttcccc

SEQ ID NO: 67763 - DNA, 201 bp, Bos taurus
ccctggcacctcccctccagtgtccactccttctgttcctaacttatcctgtcttgacttttgttcccataattccctctctggtgagtgcccacaaggagaggaggcccttccttactgattcatggaaccaaaaagatccttcaaggacatccaatccatgatcatggttttgtagaggggaaaagggagtcacagaga

SEQ ID NO: 67764 - DNA, 201 bp, Bos taurus
gggagagtaccaagtggccagtgaggatggagagaggcaggtgaagggctgggacatcggccagagaggacaaggcttatgggtccaggagagccatgataggatctggggagggccatcaccgagaggggatgagaaggctccagacagagacagtgaggagcaggagacattggttctgggaatgttgctctccttgga

SEQ ID NO: 67765 - DNA, 201 bp, Bos taurus; identical to SEQ ID NO: 27826

SEQ ID NO: 67766 - DNA, 201 bp, Bos taurus; identical to SEQ ID NO: 27827

SEQ ID NO: 67767 - DNA, 201 bp, Bos taurus; identical to SEQ ID NO: 27828

SEQ ID NO: 67768 - DNA, 201 bp, Bos taurus; identical to SEQ ID NO: 27829

SEQ ID NO: 67769 - DNA, 201 bp, Bos taurus; identical to SEQ ID NO: 27831

SEQ ID NO: 67770 - DNA, 201 bp, Bos taurus; identical to SEQ ID NO: 27832

SEQ ID NO: 67771 - DNA, 201 bp, Bos taurus; identical to SEQ ID NO: 27833

SEQ ID NO: 67772 - DNA, 201 bp, Bos taurus; identical to SEQ ID NO: 27834

SEQ ID NO: 67773 - DNA, 201 bp, Bos taurus
gggaaaggagattcagacaacttattaagtcctcaaggcccactcctcctaataggcacacccggggctgccctaggcatggctccccttagatcctccagtttctctgctccagggctccttggccggatatgagagagtgagaacaattgccagtttgggctctcttcttgggccgagagcacagtccgagggtcaaca

SEQ ID NO: 67774 - DNA, 201 bp, Bos taurus; identical to SEQ ID NO: 27835

SEQ ID NO: 67775 - DNA, 201 bp, Bos taurus; identical to SEQ ID NO: 27837

SEQ ID NO: 67776 - DNA, 201 bp, Bos taurus; identical to SEQ ID NO: 27838

SEQ ID NO: 67777 - DNA, 201 bp, Bos taurus; identical to SEQ ID NO: 27839

SEQ ID NO: 67778 - DNA, 201 bp, Bos taurus; identical to SEQ ID NO: 27842

SEQ ID NO: 67779 - DNA, 201 bp, Bos taurus; identical to SEQ ID NO: 27843

SEQ ID NO: 67780 - DNA, 201 bp, Bos taurus; identical to SEQ ID NO: 27844

SEQ ID NO: 67781 - DNA, 201 bp, Bos taurus; identical to SEQ ID NO: 27845

SEQ ID NO: 67782 - DNA, 201 bp, Bos taurus; identical to SEQ ID NO: 27846

SEQ ID NO: 67783 - DNA, 201 bp, Bos taurus; identical to SEQ ID NO: 27847

SEQ ID NO: 67784 - DNA, 201 bp, Bos taurus; identical to SEQ ID NO: 27849

SEQ ID NO: 67785 - DNA, 201 bp, Bos taurus; identical to SEQ ID NO: 27850

SEQ ID NO: 67786 - DNA, 201 bp, Bos taurus; identical to SEQ ID NO: 27851

SEQ ID NO: 67787 - DNA, 201 bp, Bos taurus; identical to SEQ ID NO: 27852

SEQ ID NO: 67788 - DNA, 201 bp, Bos taurus
ttctttaaattggagtctctacacaaaacgttttttaaattagccttcgttccttcatttccaaagtctaacacacattaccactgttttacactagcatgttacatctgatttttaatttggaataatgtgtctttcaaccccatttattttatatgatttgttaagaacatcagtctcatcaaactaattatcgaaggc

SEQ ID NO: 67789 - DNA, 201 bp, Bos taurus; identical to SEQ ID NO: 27854

SEQ ID NO: 67790 - DNA, 201 bp, Bos taurus
ctggccatgccctccagtaaggacatctggcttattgatttcaatccttttgccaaaaaatgcctcctcatgtcacttttctttccagacaaatacccgaggaggggtgaagggcccctgttctgtgcgtaggtgaagggagcagtgactgcgactccccagctttgcctgaatccttttatccaaagcttccctgtgagc

SEQ ID NO: 67791 - DNA, 201 bp, Bos taurus; identical to SEQ ID NO: 27857

SEQ ID NO: 67792 - DNA, 201 bp, Bos taurus
aggttacattcacaataaccaccagtgggtatgtctctaagattcacatggcttaaatttcccatctgaaaagtggagatacaataactgctttctaatgaggatgtagataaagataaaacttaggcgaattatgggaaatcacaaataccatacagttatatgaatattgtcatttctgtcccaccccaccctcttttc

SEQ ID NO: 67793 - DNA, 201 bp, Bos taurus; identical to SEQ ID NO: 27858

SEQ ID NO: 67794 - DNA, 201 bp, Bos taurus; identical to SEQ ID NO: 27859

SEQ ID NO: 67795 - DNA, 201 bp, Bos taurus
acccagaataaatcttcatatcacagtcctggagttttgccatggtctactctgtacttggggcttgtagtgcatttctattcgcttggccaaaaaactcgttcagatttttctgtgccatcttatggtaaaacccaaacaaactttttggccgatcctactttgggaagctactctttcccccctgcagaatgtttactt

SEQ ID NO: 67796 - DNA, 201 bp, Bos taurus; identical to SEQ ID NO: 27860

SEQ ID NO: 67797 - DNA, 201 bp, Bos taurus; identical to SEQ ID NO: 27862

SEQ ID NO: 67798 - DNA, 201 bp, Bos taurus; identical to SEQ ID NO: 27863

SEQ ID NO: 67799 - DNA, 201 bp, Bos taurus; identical to SEQ ID NO: 27864

SEQ ID NO: 67800 - DNA, 201 bp, Bos taurus; identical to SEQ ID NO: 27865

SEQ ID NO: 67801 - DNA, 201 bp, Bos taurus
cccttcacggttccactgctttcttccttctcctgaaagctaaggagctgaatcgcacagctgagaccagagagtgagcccagggcttctgcccaccccacggccttacagaagcagagcaagttggcaggagccggtgtgacctcattggatgcaagctgcaaggctccggccccgtgatggcagccctgtggttacctc

SEQ ID NO: 67802 - DNA, 201 bp, Bos taurus
agaaaaaaatttttaagacaataaaattttaaataacagctaagatagagacagcgtgatcaaggcagaactacactaccccacttcctctgtgacaacactgcaggaaaatacagggaaacacaacaggtttacactgggagtgagggctagacataaaaggaatgtctcatttaggtgggtagaaagtatgaaggcagc

SEQ ID NO: 67803 - DNA, 201 bp, Bos taurus
ctgacacccggggtggactcagttctttgtttttcttatcgcaccttccactgtcctttatttgtaacaccactcatactgcatagtcatgtcattatttattagttagagccttgcaggaacatagatgaatgcggcataaatgaatgaaatactgggatggaattcaaaaaatcttcttttttttttccttcatatttt

SEQ ID NO: 67804 - DNA, 201 bp, Bos taurus; identical to SEQ ID NO: 27868

SEQ ID NO: 67805 - DNA, 201 bp, Bos taurus; identical to SEQ ID NO: 27869

SEQ ID NO: 67806 - DNA, 201 bp, Bos taurus
caccgtgatggccactctccagaaactctctagaactgagagacacgtaaatgaggtaagcagacacccatcctgtgctcactgggggctgatttggcgcgcgtgagggggcctcagcccagaagaatgaatggaggagatagaatcagaaggattatgctgagcagcgatccaaacggaaagaaaggtgcaggaaaggtg

SEQ ID NO: 67807 - DNA, 201 bp, Bos taurus; identical to SEQ ID NO: 27871

SEQ ID NO: 67808 - DNA, 201 bp, Bos taurus; identical to SEQ ID NO: 27872

SEQ ID NO: 67809 - DNA, 201 bp, Bos taurus
tcagggattcctgttgcgagtgttgcttagatgggaggacagttccgtgaagcagagatggttgtaggtaggttccctcacaggctgtgagctctcggcaacgtgggttttgctgcagatagtgactgttattaaattccatgctgtctagcctggtgctttttcacgtaggaattttttaagaagtattcattccacagt

SEQ ID NO: 67810 - DNA, 201 bp, Bos taurus; identical to SEQ ID NO: 27873

SEQ ID NO: 67811 - DNA, 201 bp, Bos taurus
atgggtagaggaaccctggtgggctacagtccttggggactcagagtcgaacaggacggagcaaataaacaatgaaagcggccttggttcagccttcactatgctggaagagggtgagggcagacaggcagggacacaggagcttgtccagtcatcaaggtgagagatgctggtggcctgaacaaggctgcagcatctaaa

SEQ ID NO: 67812 - DNA, 201 bp, Bos taurus
tagggaaaaacatggacagcttttacagataaggcctgagacagatatcatcaggttatacataggtcataaatgcattgcttagaaaagccatctcctcccctatgctgctggcctgtcttagagatggattgggatgagggtggtggagagtttagaaaagacctctggccttcatacggttttaagagtcatgggtaa

SEQ ID NO: 67813 - DNA, 201 bp, Bos taurus; identical to SEQ ID NO: 27874

SEQ ID NO: 67814 - DNA, 201 bp, Bos taurus; identical to SEQ ID NO: 27875

SEQ ID NO: 67815 - DNA, 201 bp, Bos taurus; identical to SEQ ID NO: 27876

SEQ ID NO: 67816 - DNA, 201 bp, Bos taurus
tgccctcctagttccagtttctccacaaacctattttaatattattttgttaattgattcactttattgagtttctccaaagcattcagtttagttatacatatttgtgaagtgaagtgaaagtcgctcagtcgtgtccaactgtttgagaccccatggtctatatagtccatgaaattctccagaatgctggagtgggta

SEQ ID NO: 67817 - DNA, 201 bp, Bos taurus
caagtgtgtgtgcacatatatatatatataacatgtttatatagagaccatttgcacttcaacaaacctgggacctgacctaccatcttacctccaccccccaccagctctttcttctgaattccttctcaatgagttgaatcttgggcttccaacaaccccagtcagaagtttgggaatcatcccggttgcatcttctcc

SEQ ID NO: 67818 - DNA, 201 bp, Bos taurus
ctgtctagcgcaacagtaccagggggaaaaaaaaacagctcacagatgttcttcaaaaatacaagcatcaatcacttcaactaaagtcacagcatgagaatccacagctaagaatcaattcttctatctttataaagatactctggacgcaagtttgcccagcagagcatcccaccaaacggtgtgcattgtaggttaggg

SEQ ID NO: 67819 - DNA, 201 bp, Bos taurus; identical to SEQ ID NO: 27881

SEQ ID NO: 67820 - DNA, 201 bp, Bos taurus
tgcccatgcgagtagccacaggcccccaagcactgccttcgagggaccctgtgcctggtgaccacagggatgatctcaggagcctgcgctccactcctacaattttaaacctcattacacgatggtcagagggaaagaactgggcagcattcctgccaagcgtttcttctgctaccagccagtcaaggaggcgatttgatg

SEQ ID NO: 67821 - DNA, 201 bp, Bos taurus; identical to SEQ ID NO: 27882

SEQ ID NO: 67822 - DNA, 201 bp, Bos taurus; identical to SEQ ID NO: 27883

SEQ ID NO: 67823 - DNA, 201 bp, Bos taurus; identical to SEQ ID NO: 27884

SEQ ID NO: 67824 - DNA, 201 bp, Bos taurus
tgactcagggaggtgcctggtgttctggctcctaagggagataggcagcagggcggacggccagccctgctccggcctccagccagagacaccctgggcccgccccggcacactgttacctcacaggagctgaaacggctctcgaagacactgcaaggtagagctcagtgtttcactttccggagtggcttactagtggcc

SEQ ID NO: 67825 - DNA, 201 bp, Bos taurus
ttcctgcctcccactggccagcttcctgttcctggtttgccctgggcaccaaccagacctggggcattgttcctatccgtccatgcccactgactctgcgcaggcttggtgtggctcccataggccctggacggcccagccccaccccgatcttgtgtgctcctcacctgtgccctgcaccctgcgtggctgccccttgcc

SEQ ID NO: 67826 - DNA, 201 bp, Bos taurus
cagtgcccattctgtggccagagaccagagggagcccagaggcccaggacacctgctcctcctggtccctgccctgtggggacccagaggcggaggagccggggggacatggggggccacagagcagcttgtctgagtgggctgattccacaggcacagctcgagaaataaacaggacgctaaagtgcaaaggagaccact

SEQ ID NO: 67827 - DNA, 201 bp, Bos taurus
ggccctgggcagtgaaagcgaggagtcctaaccactggaccaccagggaatttcctgcaaagacttgtttctaaataaggtcacattcccagggtcagaaacagacagtgcagggctgaggcaggcctttaatttaaccatcagtaactgggaccacccatcctcaccaggctgttctctgtgcccaacagcacctcctgc

SEQ ID NO: 67828 - DNA, 201 bp, Bos taurus; identical to SEQ ID NO: 27886

SEQ ID NO: 67829 - DNA, 201 bp, Bos taurus; identical to SEQ ID NO: 27887

SEQ ID NO: 67830 - DNA, 201 bp, Bos taurus; identical to SEQ ID NO: 27888

SEQ ID NO: 67831 - DNA, 201 bp, Bos taurus
gatagcacttgcatctcctttgtctcctgaattgcaggcagattctttactcctgagtcaccagggaagccttgtaattctttatgctatatgaaaaaacatgattattttcactgtttctatggtagccaaacccttctgcacatttgggaattgaacattattaaaaataaccctaaattccctaatttactaggtcat

SEQ ID NO: 67832 - DNA, 201 bp, Bos taurus
caaaagggttatagaagacgaatattaaacacagatggagatggtaaatttaatttcatggacttgttatattttactggttctaacaaacatttttgaccaggaaccatttaaatgtatttattccagacaaacatctaaaagaacttcataaatgttcattctacaaggaatagtacaaagtaataagacagttaacta

SEQ ID NO: 67833 - DNA, 201 bp, Bos taurus
cccacctcccatcctgccctcactccccctacagctgccacaatacacccgagctcgaccaagtccagcccctcggtcttccccttccacttcaagcatcaggccaattctaagcatccggccaattctaagcatccatcaagagctctacactgcccagcccagcttcctcctcctgggctcccaggtgctgggtatcgc

SEQ ID NO: 67834 - DNA, 201 bp, Bos taurus
agcagacaaagccgagggcatcagtcagcctttgtactgttgtggctctgaatgacaatgacttgaggatattatgtcttccacttgcttctaggacttattacaccttcaagaggacaggtatttatcaatggatatgaactttctaaagacatgcttcaaatccggaagagcatgggctggtgcccccagcatgatatc

SEQ ID NO: 67835 - DNA, 201 bp, Bos taurus; identical to SEQ ID NO: 27890

SEQ ID NO: 67836 - DNA, 201 bp, Bos taurus; identical to SEQ ID NO: 27892

SEQ ID NO: 67837 - DNA, 201 bp, Bos taurus; identical to SEQ ID NO: 27893

SEQ ID NO: 67838 - DNA, 201 bp, Bos taurus
cggcatggggtgggctcaggctgcagccctcccagagggcctgggttgtgcgggacatcagtggaaaaacacctgggtcccaggaaggccacccctaccccacacgttccacaaaccagctctggaggctggagcatgggcttgagcctggtcctggaacgtggactgtggaagtcaggcccgaggctgctctccctcgct

SEQ ID NO: 67839 - DNA, 201 bp, Bos taurus
ttaacctgtcatcagacactgaataaaactaggtagatcaaactgattatgactgccagagattactcctgggtgggaatttaaattaaatccacagttacaacatggttgtaggttgtcacactttgctctaatgtattatacatatgaccataaaaaagcctgaatgaggctcagccactcagacatctacactcccat

SEQ ID NO: 67840 - DNA, 201 bp, Bos taurus; identical to SEQ ID NO: 27894

SEQ ID NO: 67841 - DNA, 201 bp, Bos taurus
caccatcacactttcctcaccattactcttccctgttctctagttcagaacaaaacatgacacaggagagtgaagcaggaggctgttgcaacacaacacaactgtgctttccacacacccagtgtccccacatacaggttgggcaaacaccagtctgaatcatcggaagttccgaaaattcaagattgagcgccaccactt

SEQ ID NO: 67842 - DNA, 201 bp, Bos taurus
ctgccctgccatatgctctactcagatcagcacttcccacaaccctggatggaaactgtcctctttttacagaggagggaataaggcccagaggagagccactccgtcactaaggagctccatggggttgcagacgtgagactgcctgctctctccagtctcagaggccatttcaccaaggaatccccatttacaggatgc

SEQ ID NO: 67843 - DNA, 201 bp, Bos taurus
tgaccattcaggtactctgtgatgttgttgactccagtttggtttactttttcatattgacttcgtttatttaccataaaatgtctcctattatattacacattgtaaagccagtgaaatttagcagtattgttgatggtctggtctaacaatgttatatatgtttacagaatatgcattacatttattcataaatccttt

SEQ ID NO: 67844 - DNA, 201 bp, Bos taurus
ctcacaaactggaactcgatttgggattctcaggggaaattcagactgcaggccagggtcctcctaatttaaaaaatttaatcaagatggccatcgttccattgtgtcctctggaacatgacttggagctcagggaataggagggagaccagtttgggcactgggacaggagtctctgctttactggtggcctggacaatg

SEQ ID NO: 67845 - DNA, 201 bp, Bos taurus
gcactgtaatcgactacaaccctctaaccaccaataaaatccaataaatacttgtttaatgcacctgtgcctgaatgcttttggctgcggcccaggcatcggggacctggctggggagggaccatgcatggctgtcctgtgggtctgggtgtaattgcacgtggccagctccgcaccgtccatggctgacttgctttgtcc

SEQ ID NO: 67846 - DNA, 201 bp, Bos taurus
acaggggccctgtgcttggtttagtgttctgcgctgacatcttgagattcacaataattctgaacagaggcttttgcacgttattttgcattcagtcctgcaaattatgcagctggccttgcttgagccaggaggtgaatggtggccccgtttatgaagatagagggggccggaagagggacatctgggggaggatatgga

SEQ ID NO: 67847 - DNA, 201 bp, Bos taurus; identical to SEQ ID NO: 27898

SEQ ID NO: 67848 - DNA, 201 bp, Bos taurus
gggaaaaccatagcttgggtcttgtaagatgaaccagtttcagtgataatattgatggccacatttacaggaatgtgccatgctctgttctcagactttatgcatagtaactcatttagccttgcagtggccctctggggaaggtgctattgttatcctccttttatcagaggcagaaaccaaggcacagagaggctaggt

SEQ ID NO: 67849 - DNA, 201 bp, Bos taurus
attgtcttgttgtacctcagctgggaatgtgtcaggcaactcagatttttcttgctatgtgcagtcttgcacaaacatcacccaaagcgcttcatgtattgattctgaagttacaaagaaattttagcaagtaagctaattcacaaatacccacaagtagtgaggattgactctctgtgtgtgttaatgttagaggatgca

SEQ ID NO: 67850 - DNA, 201 bp, Bos taurus; identical to SEQ ID NO: 27900

SEQ ID NO: 67851 - DNA, 201 bp, Bos taurus; identical to SEQ ID NO: 27901

SEQ ID NO: 67852 - DNA, 201 bp, Bos taurus; identical to SEQ ID NO: 27902

SEQ ID NO: 67853 - DNA, 201 bp, Bos taurus; identical to SEQ ID NO: 27903

SEQ ID NO: 67854 - DNA, 201 bp, Bos taurus; identical to SEQ ID NO: 27904

SEQ ID NO: 67855 - DNA, 201 bp, Bos taurus
catgtcaagagagtaagggcttccctgatggcccagtgattgagactgtgctcccatggtggcaggtgtgggttcagtccttggtcaaggaactatcctatatgccgtgtggtgtggccaataaataaataaactttaggacttcgctggtggctcagtggtaaagaatccacctgccaatgcagggcacacaggttcgct

SEQ ID NO: 67856 - DNA, 201 bp, Bos taurus; identical to SEQ ID NO: 27905

SEQ ID NO: 67857 - DNA, 201 bp, Bos taurus
ttctcttccatgagctcccacctggagttaagaattgaacgtcttaaacagattcctattttgttttagtggtcagttcctggccagctctaactgtgagtatctggttccttaaggccaatctgtagatattctcagtgacccctacatctcctgacatcactgtattcatagatggcttctctaggaaaaccattatta

SEQ ID NO: 67858 - DNA, 201 bp, Bos taurus
ttgttcaagttcagcaaaggcgaggaaccagcctgaccgtcctcggtggaatttctggctcttggcttagatcaggctttgcacccaagaggccaagggaacagcttctggcagagtgagctgaaaggagaggatagaaagatgcaggagcaacccgtttcggttggaagatcttcatttctgaaatgcagacattgtgaa

SEQ ID NO: 67859 - DNA, 201 bp, Bos taurus
agagtttctgaagaatcatttcgtcactaagatatattgaatatgacagcagtgcttgcaaatcagtcattttggggaaaagactatagtcacatcctaaggaggagatggacccctttgttcggaatccatgtttgcagagtaggaaaaagtgttttaggactatctgtggcatggttagtagagctttggagcactcaa

SEQ ID NO: 67860 - DNA, 201 bp, Bos taurus
tctttattttatcaagagtcggctactagcattgctcttctctttcctctgattgcctggggtttgttttgggaagcaatcattaaagacactgctgagactcagagacacaatttctggatccgcttcactagagaacccagtggggagaggatgtcgggccaggcgaccttggtcactccctacaggcatccctgctgg

SEQ ID NO: 67861 - DNA, 201 bp, Bos taurus; identical to SEQ ID NO: 27908

SEQ ID NO: 67862 - DNA, 201 bp, Bos taurus; identical to SEQ ID NO: 27909

SEQ ID NO: 67863 - DNA, 201 bp, Bos taurus; identical to SEQ ID NO: 27912

SEQ ID NO: 67864 - DNA, 201 bp, Bos taurus; identical to SEQ ID NO: 27913

SEQ ID NO: 67865 - DNA, 201 bp, Bos taurus; identical to SEQ ID NO: 27916

SEQ ID NO: 67866 - DNA, 201 bp, Bos taurus; identical to SEQ ID NO: 27917

SEQ ID NO: 67867 - DNA, 201 bp, Bos taurus; identical to SEQ ID NO: 27918

SEQ ID NO: 67868 - DNA, 201 bp, Bos taurus; identical to SEQ ID NO: 27919

SEQ ID NO: 67869 - DNA, 201 bp, Bos taurus
ttcaggtaaaaaggacttgaaacacccagacacacgtggggccttccttgggtaatggagccaccatgatcctattatctctctccaaagctctcccaggggagcaggggcttttctaggccaagcagtaaagtctgcccccatctagacctgaaaatcagcagatacagaaggctttttctggtgaatcctagaaatcca

SEQ ID NO: 67870 - DNA, 201 bp, Bos taurus; identical to SEQ ID NO: 27920

SEQ ID NO: 67871 - DNA, 201 bp, Bos taurus; identical to SEQ ID NO: 27921

SEQ ID NO: 67872 - DNA, 201 bp, Bos taurus; identical to SEQ ID NO: 27923

SEQ ID NO: 67873 - DNA, 201 bp, Bos taurus; identical to SEQ ID NO: 27924

SEQ ID NO: 67874 - DNA, 201 bp, Bos taurus; identical to SEQ ID NO: 27926

SEQ ID NO: 67875 - DNA, 201 bp, Bos taurus
gtcaggtaatctgctcacctgaagtttggccacaccccatccctcctctgggctggggagccaaactcaccccagcacccgctcctcctggtccccactcccttcctgtctgcagaggccagcagttggtcaacaaaggattcgctgttcctggaacgtgcctggctgtgtttggagcttccctgcctgtccctggctctc

SEQ ID NO: 67876 - DNA, 201 bp, Bos taurus; identical to SEQ ID NO: 27928

SEQ ID NO: 67877 - DNA, 201 bp, Bos taurus
ggtgacccacctgacttcatggcgccccagaaggttcccagactgaagagccatactagttattactattcgaggcctgggatgcatttagcttgggagagtaagaactcctcattcgtatcccgagccccagaggtcaaagatgttttattagttgtgtgacctcgggcaagtcatttggcctctctgagcctcccttgc

SEQ ID NO: 67878 - DNA, 201 bp, Bos taurus; identical to SEQ ID NO: 27929

SEQ ID NO: 67879 - DNA, 201 bp, Bos taurus; identical to SEQ ID NO: 27931

SEQ ID NO: 67880 - DNA, 201 bp, Bos taurus; identical to SEQ ID NO: 27932

SEQ ID NO: 67881 - DNA, 201 bp, Bos taurus; identical to SEQ ID NO: 27933

SEQ ID NO: 67882 - DNA, 201 bp, Bos taurus
attttcaagtgatgtcatctactactcagagaaattggggctcactcctcaaccccagccagctgttgactcagtttgttgaaaactatggcatatgtgctctggccagattggggtgccttgggggtgcccttgtcaagctgtggtatcttgggggtgtcctagacaggctgcggtgggggacttggtgtttctggggag

SEQ ID NO: 67883 - DNA, 201 bp, Bos taurus
tcattgaagtcaaatttctactctggaggcgttgtcagtggtgggaggttcggtagagtcacttatagtgcacagtgtgccctgctcatggatggtcagagtttcaacacaacagcctgtgaaagggtacaaatctgtccttggtcagtagcccatttgtcttccctctgggtttgtatgagtgagtaccaagtcacatgt

SEQ ID NO: 67884 - DNA, 201 bp, Bos taurus
caagggcccatgtgtaagaagccctgccactcacaggagggtggcaagggtcgcgagctgggtgatctaatgcccagaaaagacccgatgtatagttggcattcacaggtgtgttaagggacttccctggtggtccagagattaagactttacctttcaatgcaggagaggcaagttccatccctggtggggagctaggat

SEQ ID NO: 67885 - DNA, 201 bp, Bos taurus
tcccacactggtcacggcggcgttcgagccgcacttgccctgtgcttgaccagagtttccaaagctttcctggatatgatccagcccattgtgcagaggatgaggcccagatcacatggagccgcgggcctggcaggcctcgcatcacccagagcagctccatcccatgctgcgggctctctgaaaatcccctctggtctt

SEQ ID NO: 67886 - DNA, 201 bp, Bos taurus
gggtgtgggtgtcctcgggaaccttagggccttaggtggacccttttggagctggtgccactcatcttttggaggttgtgtgtccccctctctaaagaagagaggtgactctggcctgcagggttgctgcagggagtaaaggagtgaacgggcgaatgccactgagctggcccacagggggcgctacagcagtggggacgg

SEQ ID NO: 67887 - DNA, 201 bp, Bos taurus
cctgaactggcaatggaccctccaagggcatggcccaaagtcaccagcaatgctaacagggacctgggacccagggaaggcagtgacggcgggagaggccgcctgggggtggactaggtgctcaacatgcagtgaactgaacccacaagactaggagttttaagcctggccctccaaaaccagggttttccccagtggctc

SEQ ID NO: 67888 - DNA, 201 bp, Bos taurus; identical to SEQ ID NO: 27934

SEQ ID NO: 67889 - DNA, 201 bp, Bos taurus; identical to SEQ ID NO: 27935

SEQ ID NO: 67890 - DNA, 201 bp, Bos taurus; identical to SEQ ID NO: 27936

SEQ ID NO: 67891 - DNA, 201 bp, Bos taurus; identical to SEQ ID NO: 27937

SEQ ID NO: 67892 - DNA, 201 bp, Bos taurus; identical to SEQ ID NO: 27938

SEQ ID NO: 67893 - DNA, 201 bp, Bos taurus
aatttgcagttcctgccaacctaatacttgaaatattgagatcaagcatgatctccacctctccatctttcctataaattaattcattcaccctttgctaattgagtgcttgttgatatctatagtaggtctgggacaagtaacaaaaatgatgaataagatgtgatccaagtctacttggaatggcacaccactatcttt

SEQ ID NO: 67894 - DNA, 201 bp, Bos taurus
cataaagacagtaaacaaaggatcagaggagtggcccaagcaccacaaggaaatgttctgtttctgcaggatgacttgctcaagaaggatgtgttcgattcactgggagcagatatggatcaaactcttgctgagaagtgagagggatctgagcgctgtgcttctgtgccctgctcttgactcttaaaataggctcactcg

SEQ ID NO: 67895 - DNA, 201 bp, Bos taurus
cagagcctccatgagaacattctgtgggcaaacaccatggccagtgtgcttggagccccatgtcctcactcagtcccaggtgattcactcctgggattggagctgggagctgggccaggttcctaaataggcaagggtaatggtgctcttggacagccttcaggtcactttgaaaagtaatcctttttccttaagaatctg

SEQ ID NO: 67896 - DNA, 201 bp, Bos taurus; identical to SEQ ID NO: 27939

SEQ ID NO: 67897 - DNA, 201 bp, Bos taurus
tgccaaacagggcacacgggttcgatccctggttcggaaagattgcacatgccgaggagtaattaagccacagcttagtccaccacagttactgagcccttgggccaaaactcgagagtaatccccacttgctgcaactagagaatgcctgcacacagcaacaaagactaagcacagccaaaactaaacaaataaatattt

SEQ ID NO: 67898 - DNA, 201 bp, Bos taurus
catctacagtggagtcacctctccctaaactcagtgggaactgtgcttccaaacagaaaagtacccaagatctcttttgccaaaagtcctcggaatgtctccaatcctgctacttggtgaggttccattagaatagtggtccctaacccttctggagccagggaccagtttcatggaagacaatttttccatggaaatggg

SEQ ID NO: 67899 - DNA, 201 bp, Bos taurus; identical to SEQ ID NO: 27940

SEQ ID NO: 67900 - DNA, 201 bp, Bos taurus
acaaggaaaagaaaaagtccttaacaaaaggtctggcctggccccaggatgtcggaaaagtggcttgaggtcgtcaaaggaaccctgaggtcaggtctgctgtttagaagccaggtggccttgggaacatcccacagctctccccatctgggtctcctcacctggagaagagagtcctgctccccagcctcccttacagtg

SEQ ID NO: 67901 - DNA, 201 bp, Bos taurus; identical to SEQ ID NO: 27942

SEQ ID NO: 67902 - DNA, 201 bp, Bos taurus; identical to SEQ ID NO: 27943

SEQ ID NO: 67903 - DNA, 201 bp, Bos taurus; identical to SEQ ID NO: 27946

SEQ ID NO: 67904 - DNA, 201 bp, Bos taurus; identical to SEQ ID NO: 27947

SEQ ID NO: 67905 - DNA, 201 bp, Bos taurus; identical to SEQ ID NO: 27948

SEQ ID NO: 67906 - DNA, 201 bp, Bos taurus
gttttgccccctgggggacatttggcaatatctggggacatttttggttgtcagaactgggagtggtactactggcatctattgggtagatgctaggaaccccgctaaacagcctacaatgcaccggacagcccctaatcaaaaattacctggcgccagctgtcagtagcgccaaggttgagaaactgggctatgagttac

SEQ ID NO: 67907 - DNA, 201 bp, Bos taurus
aggagctggccggagagacgggagccacaggcctccatccaggggattggagcagctcacgtggtgcaccccggggagtggggaagatttcctgcgaaagaaggtggactgttggccggcacttatagagtggatagagtttagagaagctggtggggggtcattccaggcgggggaccagtgagaacactggtccagtgg

SEQ ID NO: 67908 - DNA, 201 bp, Bos taurus; identical to SEQ ID NO: 27950

SEQ ID NO: 67909 - DNA, 201 bp, Bos taurus; identical to SEQ ID NO: 27951

SEQ ID NO: 67910 - DNA, 201 bp, Bos taurus; identical to SEQ ID NO: 27955

SEQ ID NO: 67911 - DNA, 201 bp, Bos taurus
ggggaggtgacagttgtgcgcagtagccaggcagcagccatacagctagaagccatgctttctggcagaaaagcgcatccagggcctcaggcaggtgtatccaaagcgtagttccaagaactgtagttctgtgcactttgtaaaggattacaaaacctccggaggcccacgcagcatgaagtgttctgtataacggtttag

SEQ ID NO: 67912 - DNA, 201 bp, Bos taurus
gaaggctccctggaggagctgttgcccacaccattgccctaaggtaagtgagggtggccaggagagtcagggatcaggggcatacaggccattcccaacatagagaacagagatgaagtgatggcttctatcaggaaatcacaagacatatgatattaatggtgatcagcaagagaagcagagaatggcgagagatgggcc

SEQ ID NO: 67913 - DNA, 201 bp, Bos taurus
gatactcccgacaacatggattaatctcaagctaatcatgagtgtgagagaaactgcacaaaaaagtgtacatgctctatggttccatttatataaatctctagataatataaactaatctatgacgacagacagcaaattagcagttgcacttcagtggagggtggtggctggggtggggagaagccaaggggagattag

SEQ ID NO: 67914 - DNA, 201 bp, Bos taurus
tgccatctgcatgctgagagccaagagatcattatcctccattggatctttgtgccaggaaagactgggcaaggatgatggatggctttccacaaatccatctgcaattggaggcataactcaaagctgtgtctggatttcttcttaggtacaaatttattcattcatccatcgtctcgcctattcactcactcacttatt

SEQ ID NO: 67915 - DNA, 201 bp, Bos taurus
ggagttaaaaaattttgtccacacaaaaacctacacacagatatttacagaagctttattcataattgccaaaacctgaaagcaaccaaaatgtccttccgtatatgaatggacaaagaaactggggtccatccagatactggaatattgttgttgttttagtcacaagtcatgtctgactcttttgcgaccctatggact

SEQ ID NO: 67916 - DNA, 201 bp, Bos taurus
ctgccatggcccacttcggagggcttcaaagactgggagagagagggaaatattgagacccgttttccatttcagagatttacgagggagcaaatgaaattcgcttctgctctcagacctggccccctgggaaaggaaacactgtccgaatcaagtaaataaggtcctttgtgtcagcaaaggctgtggtggatgaaatta

SEQ ID NO: 67917 - DNA, 201 bp, Bos taurus; identical to SEQ ID NO: 27956

SEQ ID NO: 67918 - DNA, 201 bp, Bos taurus
caaccggcacattacactttctggaatttctctctacagaatcatcaacatatgtgcctctgtggtgccagtcaccacggccatgcagctgaggaagtcccaactggcaaaaccaaagcaggatgagaggctcaaggctttgaaggagtgtggagagtaccacttctctactaagcacctactctgtatatagcccaggac

SEQ ID NO: 67919 - DNA, 201 bp, Bos taurus; identical to SEQ ID NO: 27957

SEQ ID NO: 67920 - DNA, 201 bp, Bos taurus; identical to SEQ ID NO: 27958

SEQ ID NO: 67921 - DNA, 201 bp, Bos taurus; identical to SEQ ID NO: 27960

SEQ ID NO: 67922 - DNA, 201 bp, Bos taurus
tgttgaggacacaaaggtggtcagacaggcccaacttgctccagagagatctagcacagctttggttcacagaagtaaggatgtgagaaagccactcacactggccagctagaacccccagttctttgaagcatgtccacagagcctcaagaaggattggggaggtatatagtcttactagaatgaactttgatcaggcaa

SEQ ID NO: 67923 - DNA, 201 bp, Bos taurus
attagttttgagtttgtgatttttgtttcatactttggagtgcatactgtttctttaaggttcaaatgtttctgaggccagtaaaaagctcaggcattctgcatgagtaaaacaactctgcagatgcagccccttggtccagtcaagggagagtctggccacccagtgttcatggagccactctgcttaccattgatgtga

SEQ ID NO: 67924 - DNA, 201 bp, Bos taurus
tggctggattctgcaccctgtggagccctgggcctgttactggttcactgataagtggagttggggtccagaagatcctgaggctgttgccgccacactggtgggtgaggccaggccctagagctagtgatggttcattagtaggcagagttagatcctatggtttggctgtaggacccagggatcccagagttactattg

SEQ ID NO: 67925 - DNA, 201 bp, Bos taurus; identical to SEQ ID NO: 27963

SEQ ID NO: 67926 - DNA, 201 bp, Bos taurus
cgggctctgcagatgctgggcctggtggggtcagggggctggctctgggacctgccacagctgtaatgtctgattaccttgggcccagacctcctacctctgtgtctttctcctctgtttcaggctgatgtccgcaatgcagaggctctgcaccgtaccttcgaaggggtggactgtgttttccacgtggcctcctacgga

SEQ ID NO: 67927 - DNA, 201 bp, Bos taurus; identical to SEQ ID NO: 27965

SEQ ID NO: 67928 - DNA, 201 bp, Bos taurus; identical to SEQ ID NO: 27966

SEQ ID NO: 67929 - DNA, 201 bp, Bos taurus; identical to SEQ ID NO: 27968

SEQ ID NO: 67930 - DNA, 201 bp, Bos taurus; identical to SEQ ID NO: 27971

SEQ ID NO: 67931 - DNA, 201 bp, Bos taurus
ggactctccactcctgggagtgggcacacgggaagcttgagccagaggagggtacctttgctgtgtgtgtgtgtgtgtgtgtgtgtattggggagagggcaccagttccctttgctgcctcctgcaggaaggggattgtcaagctcaatatctacttccaagaattcaactatcgcaccattgaagagtcagcagccaata

SEQ ID NO: 67932 - DNA, 201 bp, Bos taurus
tcctgtccgtggcctgagacacaaaactctggaattcgccatttggtactgtttcctctagcttaaagcaatgtaatacctcgggaaagagatatctggggaggcctcctttgtcataggattcaaaatttaaaaagcaaacaaaagcatcctttggttacactgtgcttaattttgccatttatctgttctcatccaggc

SEQ ID NO: 67933 - DNA, 201 bp, Bos taurus; identical to SEQ ID NO: 27972

SEQ ID NO: 67934 - DNA, 201 bp, Bos taurus; identical to SEQ ID NO: 27973

SEQ ID NO: 67935 - DNA, 201 bp, Bos taurus; identical to SEQ ID NO: 27974

SEQ ID NO: 67936 - DNA, 201 bp, Bos taurus; identical to SEQ ID NO: 27975

SEQ ID NO: 67937 - DNA, 201 bp, Bos taurus
gctctggacatttcttgggtccatggcatgtcaacaggggccagactcaaccctcattcacgagcacatcggacgtgtctttccgcaagtgtttatagcatatatcatgggagtgatgtccatggccagcactcaacagacatttattaaaaacaaaaatctgaacaagaggacagaatcttgtcaacagtgtcctatagc

SEQ ID NO: 67938 - DNA, 201 bp, Bos taurus; identical to SEQ ID NO: 27976

SEQ ID NO: 67939 - DNA, 201 bp, Bos taurus; identical to SEQ ID NO: 27978

SEQ ID NO: 67940 - DNA, 201 bp, Bos taurus; identical to SEQ ID NO: 27979

SEQ ID NO: 67941 - DNA, 201 bp, Bos taurus; identical to SEQ ID NO: 27980

SEQ ID NO: 67942 - DNA, 201 bp, Bos taurus; identical to SEQ ID NO: 27983

SEQ ID NO: 67943 - DNA, 201 bp, Bos taurus; identical to SEQ ID NO: 27984

SEQ ID NO: 67944 - DNA, 201 bp, Bos taurus
cctcaggcgtccgtcaatccggtttacatgtctccggtggacgcaccaccccgaaacctccacacccatggctgctagcctgaggaggccctctttcaccgcctgttcttcccctactgacacggacgacgagggcgtgcgcggcacttgcgaagatgcttctatatgcaagaggtgcctgcccggcgcggggttaggggc

SEQ ID NO: 67945 - DNA, 201 bp, Bos taurus
tgcaagggaggctgggaaatagtcttttggctaaggagctatgtacccaaataaaaacgagaattctattactaaaagtggaagaaagactaaagggcaacggacagttttggccacagatatgttgttgataacatcttgagcaaggtcatgtattgcacaaccagagaccttcccgaatatgactctgagtagatgatc

SEQ ID NO: 67946 - DNA, 201 bp, Bos taurus
actgagcgactaacactttcactttcaaggaacacttacaacgtggtattgactttagttgtgaatttgtctccctaagagattaaaagctccttgaagatagggaccatatcttattaattctctcagcttgaggacctagcatggtagcaggtgcttaataaaagcctgatacatatgctgaatttgtaaataggaaat

SEQ ID NO: 67947 - DNA, 201 bp, Bos taurus
aggatgaactgtattttgtacactgccctaaaaattctctctgctccacctattcatcccttcttcccactcaatctctggccactactgatctttttgtcttcacggtttgcctttttcagaatgtcatattgttggaattatgcaatatatagtcttttcaatatgacttctttcacttattaacatgtatttaagctt

SEQ ID NO: 67948 - DNA, 201 bp, Bos taurus
gtaaatgtgtcaggaagatgcctaccaggctgtaggtgcttataaagcttcagctgagcctggatgtgggtgcctagaaaccctctgatccaaaagtgatgatgatagaagatcaatggcccccagatcagggaggacatgggaagcatgctcagtcatcgaagaaaaccatagaaattctattacagttaaaatcctttc

SEQ ID NO: 67949 - DNA, 201 bp, Bos taurus; identical to SEQ ID NO: 27988

SEQ ID NO: 67950 - DNA, 201 bp, Bos taurus; identical to SEQ ID NO: 27989

SEQ ID NO: 67951 - DNA, 201 bp, Bos taurus; identical to SEQ ID NO: 27991

SEQ ID NO: 67952 - DNA, 201 bp, Bos taurus; identical to SEQ ID NO: 27996

SEQ ID NO: 67953 - DNA, 201 bp, Bos taurus; identical to SEQ ID NO: 27997

SEQ ID NO: 67954 - DNA, 201 bp, Bos taurus; identical to SEQ ID NO: 28001

SEQ ID NO: 67955 - DNA, 201 bp, Bos taurus; identical to SEQ ID NO: 28002

SEQ ID NO: 67956 - DNA, 201 bp, Bos taurus; identical to SEQ ID NO: 28003

SEQ ID NO: 67957 - DNA, 201 bp, Bos taurus; identical to SEQ ID NO: 28004

SEQ ID NO: 67958 - DNA, 201 bp, Bos taurus; identical to SEQ ID NO: 28008

SEQ ID NO: 67959 - DNA, 201 bp, Bos taurus; identical to SEQ ID NO: 28009

SEQ ID NO: 67960 - DNA, 201 bp, Bos taurus; identical to SEQ ID NO: 28011

SEQ ID NO: 67961 - DNA, 201 bp, Bos taurus; identical to SEQ ID NO: 28012

SEQ ID NO: 67962 - DNA, 201 bp, Bos taurus; identical to SEQ ID NO: 28016

SEQ ID NO: 67963 - DNA, 201 bp, Bos taurus; identical to SEQ ID NO: 28018

SEQ ID NO: 67964 - DNA, 201 bp, Bos taurus; identical to SEQ ID NO: 28019

SEQ ID NO: 67965 - DNA, 201 bp, Bos taurus; identical to SEQ ID NO: 28021

SEQ ID NO: 67966 - DNA, 201 bp, Bos taurus; identical to SEQ ID NO: 28022

SEQ ID NO: 67967 - DNA, 201 bp, Bos taurus; identical to SEQ ID NO: 28023

SEQ ID NO: 67968 - DNA, 201 bp, Bos taurus; identical to SEQ ID NO: 28026

SEQ ID NO: 67969 - DNA, 201 bp, Bos taurus; identical to SEQ ID NO: 28027

SEQ ID NO: 67970 - DNA, 201 bp, Bos taurus; identical to SEQ ID NO: 28038

SEQ ID NO: 67971 - DNA, 201 bp, Bos taurus; identical to SEQ ID NO: 28042

SEQ ID NO: 67972 - DNA, 201 bp, Bos taurus; identical to SEQ ID NO: 28043

SEQ ID NO: 67973 - DNA, 201 bp, Bos taurus; identical to SEQ ID NO: 28044

SEQ ID NO: 67974 - DNA, 201 bp, Bos taurus; identical to SEQ ID NO: 28045

SEQ ID NO: 67975 - DNA, 201 bp, Bos taurus; identical to SEQ ID NO: 28046

SEQ ID NO: 67976 - DNA, 201 bp, Bos taurus; identical to SEQ ID NO: 28049

SEQ ID NO: 67977 - DNA, 201 bp, Bos taurus; identical to SEQ ID NO: 28050

SEQ ID NO: 67978 - DNA, 201 bp, Bos taurus; identical to SEQ ID NO: 28052

SEQ ID NO: 67979 - DNA, 201 bp, Bos taurus; identical to SEQ ID NO: 28053

SEQ ID NO: 67980 - DNA, 201 bp, Bos taurus; identical to SEQ ID NO: 28054

SEQ ID NO: 67981 - DNA, 201 bp, Bos taurus; identical to SEQ ID NO: 28055

SEQ ID NO: 67982 - DNA, 201 bp, Bos taurus; identical to SEQ ID NO: 28056

SEQ ID NO: 67983 - DNA, 201 bp, Bos taurus; identical to SEQ ID NO: 28057

SEQ ID NO: 67984 - DNA, 201 bp, Bos taurus; identical to SEQ ID NO: 28058

SEQ ID NO: 67985 - DNA, 201 bp, Bos taurus; identical to SEQ ID NO: 28059

SEQ ID NO: 67986 - DNA, 201 bp, Bos taurus; identical to SEQ ID NO: 28060

SEQ ID NO: 67987 - DNA, 201 bp, Bos taurus; identical to SEQ ID NO: 28061

SEQ ID NO: 67988 - DNA, 201 bp, Bos taurus; identical to SEQ ID NO: 28062

SEQ ID NO: 67989 - DNA, 201 bp, Bos taurus; identical to SEQ ID NO: 28063

SEQ ID NO: 67990 - DNA, 201 bp, Bos taurus; identical to SEQ ID NO: 28064

SEQ ID NO: 67991 - DNA, 201 bp, Bos taurus; identical to SEQ ID NO: 28065

SEQ ID NO: 67992 - DNA, 201 bp, Bos taurus; identical to SEQ ID NO: 28066

SEQ ID NO: 67993 - DNA, 201 bp, Bos taurus; identical to SEQ ID NO: 28067

SEQ ID NO: 67994 - DNA, 201 bp, Bos taurus; identical to SEQ ID NO: 28068

SEQ ID NO: 67995 - DNA, 201 bp, Bos taurus; identical to SEQ ID NO: 28069

SEQ ID NO: 67996 - DNA, 201 bp, Bos taurus; identical to SEQ ID NO: 28070

SEQ ID NO: 67997 - DNA, 201 bp, Bos taurus; identical to SEQ ID NO: 28071

SEQ ID NO: 67998 - DNA, 201 bp, Bos taurus; identical to SEQ ID NO: 28072

SEQ ID NO: 67999 - DNA, 201 bp, Bos taurus; identical to SEQ ID NO: 28073

SEQ ID NO: 68000 - DNA, 201 bp, Bos taurus; identical to SEQ ID NO: 28074

SEQ ID NO: 68001 - DNA, 201 bp, Bos taurus; identical to SEQ ID NO: 28075

SEQ ID NO: 68002 - DNA, 201 bp, Bos taurus; identical to SEQ ID NO: 28076

SEQ ID NO: 68003 - DNA, 201 bp, Bos taurus; identical to SEQ ID NO: 28077

SEQ ID NO: 68004 - DNA, 201 bp, Bos taurus; identical to SEQ ID NO: 28078

SEQ ID NO: 68005 - DNA, 201 bp, Bos taurus; identical to SEQ ID NO: 28079

SEQ ID NO: 68006 - DNA, 201 bp, Bos taurus; identical to SEQ ID NO: 28081

SEQ ID NO: 68007 - DNA, 201 bp, Bos taurus; identical to SEQ ID NO: 28083

SEQ ID NO: 68008 - DNA, 201 bp, Bos taurus; identical to SEQ ID NO: 28085

SEQ ID NO: 68009 - DNA, 201 bp, Bos taurus; identical to SEQ ID NO: 28087

SEQ ID NO: 68010 - DNA, 201 bp, Bos taurus; identical to SEQ ID NO: 28088

SEQ ID NO: 68011 - DNA, 201 bp, Bos taurus; identical to SEQ ID NO: 28089

SEQ ID NO: 68012 - DNA, 201 bp, Bos taurus; identical to SEQ ID NO: 28090

SEQ ID NO: 68013 - DNA, 201 bp, Bos taurus; identical to SEQ ID NO: 28093

SEQ ID NO: 68014 - DNA, 201 bp, Bos taurus
ctacctcccacaccgccgggccaggccctgtcgtcacagtgacccacgctgggatgcacaggactgagcgcagagctcacctgccctgtgacaggctgaagggtgtggccgtgtgtcacctcacctgcaagtaagcgtcaccatccactgtggtggccttgagaacactgtgggtccagagggggctgtgcaagagcggag

SEQ ID NO: 68015 - DNA, 201 bp, Bos taurus; identical to SEQ ID NO: 28094

SEQ ID NO: 68016 - DNA, 201 bp, Bos taurus; identical to SEQ ID NO: 28095

SEQ ID NO: 68017 - DNA, 201 bp, Bos taurus; identical to SEQ ID NO: 28098

SEQ ID NO: 68018 - DNA, 201 bp, Bos taurus
atccagaaatggtttctgtaggcctgtcatctgttaatattttataaaactcagtgggaagaagactcaagtctggcccttcagcacatgtagaactcacggaagactgttttgtatatgacgtcagctctaccttacacccggttttagagaactaccagttttctcatggccgttgggaaactaccatacatgggtagg

SEQ ID NO: 68019 - DNA, 201 bp, Bos taurus; identical to SEQ ID NO: 28099

SEQ ID NO: 68020 - DNA, 201 bp, Bos taurus; identical to SEQ ID NO: 28100

SEQ ID NO: 68021 - DNA, 201 bp, Bos taurus
cctctcaccaggccgggcacaaacgccctggccccgcactcgggatccctgctgtttccctctggtttgttctccagactccactagcagtgtgctctgcgagtctctccccggccactctgcagcccctcacccgtgacccgtctggcccaggcagctgaggctgtgaggaggcactgtctcaccttcccagtgacagcg

SEQ ID NO: 68022 - DNA, 201 bp, Bos taurus
gctgccccctccccgagctggcagctcccaagaaggctggacccaacccccgggtgatcccagcgtcctgttggtaagggagggagaaattcagagatcccgtccagcggccccgctcccttggaggaggctcccctcatccctccaacattacttccaagtcctctcccttcacaggagaatgcctttgcccccagggtg

SEQ ID NO: 68023 - DNA, 201 bp, Bos taurus; identical to SEQ ID NO: 28104

SEQ ID NO: 68024 - DNA, 201 bp, Bos taurus; identical to SEQ ID NO: 28105

SEQ ID NO: 68025 - DNA, 201 bp, Bos taurus
ggtccccccacagcgccccacgacaccccccacgccacaccccggcccttctcccaaagtgctgtgggaacgccgtgctctgggaaacatttctggaagacattagaacccaaacatttttcaaccaaaattttagaaacccagaccacttccaaagacgaccgactttgaaacctgacacttcaaatccacttttcgaat

SEQ ID NO: 68026 - DNA, 201 bp, Bos taurus
aaccaccaccaaaaaaaaagcaactaaagaaaagttctgctaaggttatggtgaaaccagcacaatttttttggaaagtcatttggcaacacagataaaaggcttccaaagtgtgcatagctgacagcagaagagaggcttaatgacgaagctgaaacttcccgtctgagaccagggacagcacgcggatgctgccaccac

SEQ ID NO: 68027 - DNA, 201 bp, Bos taurus
agggtggggtggaaggcggggctacagcccagggctgcctaagacggtacttctagaagctccaggaaggccagggcccttcaaccctcaatgtaaattccgtcctctccttcttcggtgctgaaatatttaccagtgcacagaactcctgttcagcactcgctgaagaatgacccgttgaccccacgggtgtttttgggc

SEQ ID NO: 68028 - DNA, 201 bp, Bos taurus; identical to SEQ ID NO: 28107

SEQ ID NO: 68029 - DNA, 201 bp, Bos taurus; identical to SEQ ID NO: 28108

SEQ ID NO: 68030 - DNA, 201 bp, Bos taurus; identical to SEQ ID NO: 28109

SEQ ID NO: 68031 - DNA, 201 bp, Bos taurus; identical to SEQ ID NO: 28110

SEQ ID NO: 68032 - DNA, 201 bp, Bos taurus
gtgttctctgagtgacaatcataaatattggaatgtcagatgagtacataaattcttttctgggagtcatcagttaactagggccaggcagagggagagcgccaagatggatttcattgcccatgctccttgagagtggctccatcagccactagataagcaaagaggcctcttcagagaatgactgggtaaatgtgcact

SEQ ID NO: 68033 - DNA, 201 bp, Bos taurus; identical to SEQ ID NO: 28111

SEQ ID NO: 68034 - DNA, 201 bp, Bos taurus; identical to SEQ ID NO: 28116

SEQ ID NO: 68035 - DNA, 201 bp, Bos taurus
ttacatttggccttttgaaagaaatgtgtctgacatgacttgtgtagtatggttgttgttgttcaaccagtaagccatgtctcacttttttccaccccagaaacttcagcatgccaggcttccctgtccttctgtatctccctgagtttgatcaaactcatgttcattgagtcactgatgccttacaaccatcacattctc

SEQ ID NO: 68036 - DNA, 201 bp, Bos taurus
agaaaataccaaatgaacttttttgccaaaccaatagtataaatttgggaacagcatatgacagaatggtcagtgtgaaaagaatctacagaaggcaagagaatatatatctgtctgtttctcagacaaggagataaatagttggtgttcaatggagggagtaagtggtgacagtggaaagacagagtggctgggtttgaa

SEQ ID NO: 68037 - DNA, 201 bp, Bos taurus
tgacagtaaaatttccaagaacagggatttgcatctctgattctttgtgtcttccacacaacttacctgaggtttagatattggaaagattttgactggcagtatttaattcgaattgttagcaactttcacatctatatgccaagctgcaagtactctgtaaaaattaaaataaaaagtatcaattttatagtagattta

SEQ ID NO: 68038 - DNA, 201 bp, Bos taurus; identical to SEQ ID NO: 28118

SEQ ID NO: 68039 - DNA, 201 bp, Bos taurus; identical to SEQ ID NO: 28119

SEQ ID NO: 68040 - DNA, 201 bp, Bos taurus; identical to SEQ ID NO: 28120

SEQ ID NO: 68041 - DNA, 201 bp, Bos taurus
aaagtgaaaacaaaagtttattaaaaaatgaacataatttcatgtcacaatggaaattttacttatagaaattagtgattaaattaaaaacaactttattgggaatagggatctttgcaatttgttggaaatattcacagaacaaacatttgtaagcaaacacaaatgtgtttactgaagtatgggattattcatttcctg

SEQ ID NO: 68042 - DNA, 201 bp, Bos taurus; identical to SEQ ID NO: 28121

SEQ ID NO: 68043 - DNA, 201 bp, Bos taurus; identical to SEQ ID NO: 28122

SEQ ID NO: 68044 - DNA, 201 bp, Bos taurus
aacattgaacttttctttgaaaggcttaattgaaatcatgacaaaaatatttttagtttcaatctatttttctgagctaatttaagtagctggtatatcagtgagatcccaagagaaggggaatactgacctaataagactaaaatcaatgaactagtctgatgaatgtttaacagtacttgatgtaatgagagaagtaaa

SEQ ID NO: 68045 - DNA, 201 bp, Bos taurus; identical to SEQ ID NO: 28124

SEQ ID NO: 68046 - DNA, 201 bp, Bos taurus; identical to SEQ ID NO: 28125

SEQ ID NO: 68047 - DNA, 201 bp, Bos taurus; identical to SEQ ID NO: 28126

SEQ ID NO: 68048 - DNA, 201 bp, Bos taurus; identical to SEQ ID NO: 28128

SEQ ID NO: 68049 - DNA, 201 bp, Bos taurus; identical to SEQ ID NO: 28129

SEQ ID NO: 68050 - DNA, 201 bp, Bos taurus; identical to SEQ ID NO: 28130

SEQ ID NO: 68051 - DNA, 201 bp, Bos taurus; identical to SEQ ID NO: 28131

SEQ ID NO: 68052 - DNA, 201 bp, Bos taurus; identical to SEQ ID NO: 28132

SEQ ID NO: 68053 - DNA, 201 bp, Bos taurus; identical to SEQ ID NO: 28133

SEQ ID NO: 68054 - DNA, 201 bp, Bos taurus; identical to SEQ ID NO: 28134

SEQ ID NO: 68055 - DNA, 201 bp, Bos taurus; identical to SEQ ID NO: 28135

SEQ ID NO: 68056 - DNA, 201 bp, Bos taurus; identical to SEQ ID NO: 28136

SEQ ID NO: 68057 - DNA, 201 bp, Bos taurus; identical to SEQ ID NO: 28137

SEQ ID NO: 68058 - DNA, 201 bp, Bos taurus; identical to SEQ ID NO: 28138

SEQ ID NO: 68059 - DNA, 201 bp, Bos taurus
ccttctctctgtttgctcacatggcagacggagagagagtagagagttttcttgcatctctttccacaaggcaacaaattctatcacatcagagccccaccttcacaaccccgtttaaacttaattacattcttatgaaccctgtctcgaaacacactcacatgcttggagatggggagggtggagcttcaacacaggaat

SEQ ID NO: 68060 - DNA, 201 bp, Bos taurus; identical to SEQ ID NO: 28139

SEQ ID NO: 68061 - DNA, 201 bp, Bos taurus; identical to SEQ ID NO: 28140

SEQ ID NO: 68062 - DNA, 201 bp, Bos taurus; identical to SEQ ID NO: 28141

SEQ ID NO: 68063 - DNA, 201 bp, Bos taurus; identical to SEQ ID NO: 28142

SEQ ID NO: 68064 - DNA, 201 bp, Bos taurus; identical to SEQ ID NO: 28143

SEQ ID NO: 68065 - DNA, 201 bp, Bos taurus; identical to SEQ ID NO: 28144

SEQ ID NO: 68066 - DNA, 201 bp, Bos taurus; identical to SEQ ID NO: 28145

SEQ ID NO: 68067 - DNA, 201 bp, Bos taurus; identical to SEQ ID NO: 28146

SEQ ID NO: 68068 - DNA, 201 bp, Bos taurus; identical to SEQ ID NO: 28147

SEQ ID NO: 68069 - DNA, 201 bp, Bos taurus; identical to SEQ ID NO: 28148

SEQ ID NO: 68070 - DNA, 201 bp, Bos taurus; identical to SEQ ID NO: 28149

SEQ ID NO: 68071 - DNA, 201 bp, Bos taurus; identical to SEQ ID NO: 28150

SEQ ID NO: 68072 - DNA, 201 bp, Bos taurus; identical to SEQ ID NO: 28151

SEQ ID NO: 68073 - DNA, 201 bp, Bos taurus; identical to SEQ ID NO: 28152

SEQ ID NO: 68074 - DNA, 201 bp, Bos taurus; identical to SEQ ID NO: 28153

SEQ ID NO: 68075 - DNA, 201 bp, Bos taurus; identical to SEQ ID NO: 28154

SEQ ID NO: 68076 - DNA, 201 bp, Bos taurus; identical to SEQ ID NO: 28155

SEQ ID NO: 68077 - DNA, 201 bp, Bos taurus; identical to SEQ ID NO: 28156

SEQ ID NO: 68078 - DNA, 201 bp, Bos taurus; identical to SEQ ID NO: 28157

SEQ ID NO: 68079 - DNA, 201 bp, Bos taurus; identical to SEQ ID NO: 28158

SEQ ID NO: 68080 - DNA, 201 bp, Bos taurus; identical to SEQ ID NO: 28159

SEQ ID NO: 68081 - DNA, 201 bp, Bos taurus; identical to SEQ ID NO: 28160

SEQ ID NO: 68082 - DNA, 201 bp, Bos taurus; identical to SEQ ID NO: 28161

SEQ ID NO: 68083 - DNA, 201 bp, Bos taurus; identical to SEQ ID NO: 28162

SEQ ID NO: 68084 - DNA, 201 bp, Bos taurus; identical to SEQ ID NO: 28163

SEQ ID NO: 68085 - DNA, 201 bp, Bos taurus; identical to SEQ ID NO: 28164

SEQ ID NO: 68086 - DNA, 201 bp, Bos taurus; identical to SEQ ID NO: 28165

SEQ ID NO: 68087 - DNA, 201 bp, Bos taurus; identical to SEQ ID NO: 28166

SEQ ID NO: 68088 - DNA, 201 bp, Bos taurus; identical to SEQ ID NO: 28167

SEQ ID NO: 68089 - DNA, 201 bp, Bos taurus; identical to SEQ ID NO: 28168

SEQ ID NO: 68090 - DNA, 201 bp, Bos taurus; identical to SEQ ID NO: 28169

SEQ ID NO: 68091 - DNA, 201 bp, Bos taurus; identical to SEQ ID NO: 28170

SEQ ID NO: 68092 - DNA, 201 bp, Bos taurus; identical to SEQ ID NO: 28171

SEQ ID NO: 68093 - DNA, 201 bp, Bos taurus; identical to SEQ ID NO: 28172

SEQ ID NO: 68094 - DNA, 201 bp, Bos taurus; identical to SEQ ID NO: 28174

SEQ ID NO: 68095 - DNA, 201 bp, Bos taurus; identical to SEQ ID NO: 28175

SEQ ID NO: 68096 - DNA, 201 bp, Bos taurus; identical to SEQ ID NO: 28176

SEQ ID NO: 68097 - DNA, 201 bp, Bos taurus; identical to SEQ ID NO: 28177

SEQ ID NO: 68098 - DNA, 201 bp, Bos taurus; identical to SEQ ID NO: 28178

SEQ ID NO: 68099 - DNA, 201 bp, Bos taurus; identical to SEQ ID NO: 28179

SEQ ID NO: 68100 - DNA, 201 bp, Bos taurus; identical to SEQ ID NO: 28180

SEQ ID NO: 68101 - DNA, 201 bp, Bos taurus; identical to SEQ ID NO: 28181

SEQ ID NO: 68102 - DNA, 201 bp, Bos taurus; identical to SEQ ID NO: 28182

SEQ ID NO: 68103 - DNA, 201 bp, Bos taurus; identical to SEQ ID NO: 28183

SEQ ID NO: 68104 - DNA, 201 bp, Bos taurus; identical to SEQ ID NO: 28184

SEQ ID NO: 68105 - DNA, 201 bp, Bos taurus; identical to SEQ ID NO: 28185

SEQ ID NO: 68106 - DNA, 201 bp, Bos taurus; identical to SEQ ID NO: 28186

SEQ ID NO: 68107 - DNA, 201 bp, Bos taurus; identical to SEQ ID NO: 28187

SEQ ID NO: 68108 - DNA, 201 bp, Bos taurus; identical to SEQ ID NO: 28188

SEQ ID NO: 68109 - DNA, 201 bp, Bos taurus; identical to SEQ ID NO: 28189

SEQ ID NO: 68110 - DNA, 201 bp, Bos taurus; identical to SEQ ID NO: 28191

SEQ ID NO: 68111 - DNA, 201 bp, Bos taurus; identical to SEQ ID NO: 28192

SEQ ID NO: 68112 - DNA, 201 bp, Bos taurus; identical to SEQ ID NO: 28193

SEQ ID NO: 68113 - DNA, 201 bp, Bos taurus; identical to SEQ ID NO: 28194

SEQ ID NO: 68114 - DNA, 201 bp, Bos taurus; identical to SEQ ID NO: 28195

SEQ ID NO: 68115 - DNA, 201 bp, Bos taurus; identical to SEQ ID NO: 28196

SEQ ID NO: 68116 - DNA, 201 bp, Bos taurus; identical to SEQ ID NO: 28197

SEQ ID NO: 68117 - DNA, 201 bp, Bos taurus; identical to SEQ ID NO: 28198

SEQ ID NO: 68118 - DNA, 201 bp, Bos taurus; identical to SEQ ID NO: 28199

SEQ ID NO: 68119 - DNA, 201 bp, Bos taurus; identical to SEQ ID NO: 28201

SEQ ID NO: 68120 - DNA, 201 bp, Bos taurus; identical to SEQ ID NO: 28202

SEQ ID NO: 68121 - DNA, 201 bp, Bos taurus; identical to SEQ ID NO: 28203

SEQ ID NO: 68122 - DNA, 201 bp, Bos taurus; identical to SEQ ID NO: 28204

SEQ ID NO: 68123 - DNA, 201 bp, Bos taurus; identical to SEQ ID NO: 28205

SEQ ID NO: 68124 - DNA, 201 bp, Bos taurus; identical to SEQ ID NO: 28206

SEQ ID NO: 68125 - DNA, 201 bp, Bos taurus; identical to SEQ ID NO: 28207

SEQ ID NO: 68126 - DNA, 201 bp, Bos taurus; identical to SEQ ID NO: 28208

SEQ ID NO: 68127 - DNA, 201 bp, Bos taurus; identical to SEQ ID NO: 28209

SEQ ID NO: 68128 - DNA, 201 bp, Bos taurus; identical to SEQ ID NO: 28211

SEQ ID NO: 68129 - DNA, 201 bp, Bos taurus; identical to SEQ ID NO: 28212

SEQ ID NO: 68130 - DNA, 201 bp, Bos taurus; identical to SEQ ID NO: 28213

SEQ ID NO: 68131 - DNA, 201 bp, Bos taurus; identical to SEQ ID NO: 28214

SEQ ID NO: 68132 - DNA, 201 bp, Bos taurus; identical to SEQ ID NO: 28215

SEQ ID NO: 68133 - DNA, 201 bp, Bos taurus; identical to SEQ ID NO: 28216

SEQ ID NO: 68134 - DNA, 201 bp, Bos taurus; identical to SEQ ID NO: 28218

SEQ ID NO: 68135 - DNA, 201 bp, Bos taurus; identical to SEQ ID NO: 28219

SEQ ID NO: 68136 - DNA, 201 bp, Bos taurus; identical to SEQ ID NO: 28220

SEQ ID NO: 68137 - DNA, 201 bp, Bos taurus; identical to SEQ ID NO: 28221

SEQ ID NO: 68138 - DNA, 201 bp, Bos taurus; identical to SEQ ID NO: 28222

SEQ ID NO: 68139 - DNA, 201 bp, Bos taurus; identical to SEQ ID NO: 28223

SEQ ID NO: 68140 - DNA, 201 bp, Bos taurus; identical to SEQ ID NO: 28224

SEQ ID NO: 68141 - DNA, 201 bp, Bos taurus; identical to SEQ ID NO: 28226

SEQ ID NO: 68142 - DNA, 201 bp, Bos taurus; identical to SEQ ID NO: 28227

SEQ ID NO: 68143 - DNA, 201 bp, Bos taurus; identical to SEQ ID NO: 28229

SEQ ID NO: 68144 - DNA, 201 bp, Bos taurus; identical to SEQ ID NO: 28230

SEQ ID NO: 68145 - DNA, 201 bp, Bos taurus; identical to SEQ ID NO: 28231

SEQ ID NO: 68146 - DNA, 201 bp, Bos taurus; identical to SEQ ID NO: 28232

SEQ ID NO: 68147 - DNA, 201 bp, Bos taurus; identical to SEQ ID NO: 28233

SEQ ID NO: 68148 - DNA, 201 bp, Bos taurus; identical to SEQ ID NO: 28234

SEQ ID NO: 68149 - DNA, 201 bp, Bos taurus; identical to SEQ ID NO: 28236

SEQ ID NO: 68150 - DNA, 201 bp, Bos taurus; identical to SEQ ID NO: 28237

SEQ ID NO: 68151 - DNA, 201 bp, Bos taurus; identical to SEQ ID NO: 28238

SEQ ID NO: 68152 - DNA, 201 bp, Bos taurus; identical to SEQ ID NO: 28239

SEQ ID NO: 68153 - DNA, 201 bp, Bos taurus; identical to SEQ ID NO: 28240

SEQ ID NO: 68154 - DNA, 201 bp, Bos taurus; identical to SEQ ID NO: 28241

SEQ ID NO: 68155 - DNA, 201 bp, Bos taurus; identical to SEQ ID NO: 28243

SEQ ID NO: 68156 - DNA, 201 bp, Bos taurus; identical to SEQ ID NO: 28247

SEQ ID NO: 68157 - DNA, 201 bp, Bos taurus; identical to SEQ ID NO: 28248

SEQ ID NO: 68158 - DNA, 201 bp, Bos taurus; identical to SEQ ID NO: 28250

SEQ ID NO: 68159 - DNA, 201 bp, Bos taurus; identical to SEQ ID NO: 28252

SEQ ID NO: 68160 - DNA, 201 bp, Bos taurus; identical to SEQ ID NO: 28253

SEQ ID NO: 68161 - DNA, 201 bp, Bos taurus; identical to SEQ ID NO: 28254

SEQ ID NO: 68162 - DNA, 201 bp, Bos taurus; identical to SEQ ID NO: 28255

SEQ ID NO: 68163 - DNA, 201 bp, Bos taurus; identical to SEQ ID NO: 28256

SEQ ID NO: 68164 - DNA, 201 bp, Bos taurus; identical to SEQ ID NO: 28257

SEQ ID NO: 68165 - DNA, 201 bp, Bos taurus; identical to SEQ ID NO: 28258

SEQ ID NO: 68166 - DNA, 201 bp, Bos taurus; identical to SEQ ID NO: 28259

SEQ ID NO: 68167 - DNA, 201 bp, Bos taurus; identical to SEQ ID NO: 28260

SEQ ID NO: 68168 - DNA, 201 bp, Bos taurus; identical to SEQ ID NO: 28261

SEQ ID NO: 68169 - DNA, 201 bp, Bos taurus; identical to SEQ ID NO: 28264

SEQ ID NO: 68170 - DNA, 201 bp, Bos taurus; identical to SEQ ID NO: 28265

SEQ ID NO: 68171 - DNA, 201 bp, Bos taurus; identical to SEQ ID NO: 28268

SEQ ID NO: 68172 - DNA, 201 bp, Bos taurus; identical to SEQ ID NO: 28270

SEQ ID NO: 68173 - DNA, 201 bp, Bos taurus; identical to SEQ ID NO: 28271

SEQ ID NO: 68174 - DNA, 201 bp, Bos taurus; identical to SEQ ID NO: 28272

SEQ ID NO: 68175 - DNA, 201 bp, Bos taurus; identical to SEQ ID NO: 28273

SEQ ID NO: 68176 - DNA, 201 bp, Bos taurus; identical to SEQ ID NO: 28274

SEQ ID NO: 68177 - DNA, 201 bp, Bos taurus; identical to SEQ ID NO: 28275

SEQ ID NO: 68178 - DNA, 201 bp, Bos taurus; identical to SEQ ID NO: 28276

SEQ ID NO: 68179 - DNA, 201 bp, Bos taurus; identical to SEQ ID NO: 28277

SEQ ID NO: 68180 - DNA, 201 bp, Bos taurus
gcttcctgctactatacaatgccggcgagcaacagcaccttggccaactcttaaaacaggagtcggctgacttatttctacaaaaagccagatagtaaatattttagcctttacaggccatatagctactcaactctgccatcgtagtatgaatactgccgggagacaagacataaataaatgggtgtggctacagtccaa

SEQ ID NO: 68181 - DNA, 201 bp, Bos taurus
aaattcaagctacagaacaggcacttaaagcatgttacataagagaggagcagcttcatctggggcgtggacattagccaaaatgctggccttcagtgtccctagaccaggcaggtatcaagagcccatgtaaatccagcccagagtagggagacacactgtggtcaggctcactggcagcccttccaacctccagatacc

SEQ ID NO: 68182 - DNA, 201 bp, Bos taurus
gtggggtgagaagcacctctctgctagacgcacaaggccctgggcacacagggtgcctttcaccgcctgatgtcagacttgcttctctgtgccctcagcactcaacccctcatgcttcccaggcctgtaggattttctggtcatgtctgggcagatctttctctctgcgtctgctgaaacctggaagagtgagattcgcca

SEQ ID NO: 68183 - DNA, 201 bp, Bos taurus; identical to SEQ ID NO: 28280

SEQ ID NO: 68184 - DNA, 201 bp, Bos taurus; identical to SEQ ID NO: 28281

SEQ ID NO: 68185 - DNA, 201 bp, Bos taurus
agtggctgggtttccccccaagtggaggaagggggtgtatttgatgtagggcaagttcaaaaccccaaaagccttccacgctggtaggtcagatttcacttgcaaggtggggaaatacaacatgtgaaacgtgaaaaggaccaccaacccaggaagtcttattccgccgccgcgggccagcctgaactcttgctttgactg

SEQ ID NO: 68186 - DNA, 201 bp, Bos taurus
acacgactgagcgacttcactttcactttcctacagctttacagggaacacactatttctccgtccctaaacattgggctgagtcattgatttggccaatgcggacacaacacgaataagatataaatgtgcttgcacatttggcttgccacatgccatgaaaagaacctgccctatcaagtcactggtccaaggaggata

SEQ ID NO: 68187 - DNA, 201 bp, Bos taurus
gtggccacactgggagagaagtctcggggcgcccctttgctaccccagccttcaacacaccacctgccccaactcacacactctcagctcgataggaaattcgccactttatggcctcgcgtaaaagtgccattctgaataaacacaaaagcgatcaaatgctcttgagttgttggtcttaaatatcagtcatgcttcatc

SEQ ID NO: 68188 - DNA, 201 bp, Bos taurus; identical to SEQ ID NO: 28284

SEQ ID NO: 68189 - DNA, 201 bp, Bos taurus; identical to SEQ ID NO: 28285

SEQ ID NO: 68190 - DNA, 201 bp, Bos taurus; identical to SEQ ID NO: 28286

SEQ ID NO: 68191 - DNA, 201 bp, Bos taurus
catccttgctcaaaatccacgtgctttcagcagtagtgttactgtttcagaatgtcagctgctgagcaatagttttgtcatgctttgccttcaacattgtgttatttttagtatgaattatatgcagtggatttatgttatctttttgtgctatatgtttctagttattcaccaaacctttgacagtagtaagtcttcaca

SEQ ID NO: 68192 - DNA, 201 bp, Bos taurus
aagaaacatgcatggccccagagaagcctgctttcctcccagcttgctgcaccctggtgaaccagggcagccttgctgacactcccaattagcaagcaccggttcagaatgccaagaggccatggaaaatggaataggagatagaagatggcaccttcttccttataaggttgataattcatattttaaataatctaaatg

SEQ ID NO: 68193 - DNA, 201 bp, Bos taurus; identical to SEQ ID NO: 28290

SEQ ID NO: 68194 - DNA, 201 bp, Bos taurus; identical to SEQ ID NO: 28292

SEQ ID NO: 68195 - DNA, 201 bp, Bos taurus
cctccagtgggatgtaaccaatttccttctgctgaaactatatagaagtttctgtaaaagcccaaagcccttgttgtggcctcgagatcctacatgattgcatccctacctacctcccaagcttcatctattgatcatttttctctgactctccaaggccttttaaataaacttcttcaaataatccagcctccatcatgc

SEQ ID NO: 68196 - DNA, 201 bp, Bos taurus; identical to SEQ ID NO: 28293

SEQ ID NO: 68197 - DNA, 201 bp, Bos taurus; identical to SEQ ID NO: 28294

SEQ ID NO: 68198 - DNA, 201 bp, Bos taurus; identical to SEQ ID NO: 28295

SEQ ID NO: 68199 - DNA, 201 bp, Bos taurus; identical to SEQ ID NO: 28296

SEQ ID NO: 68200 - DNA, 201 bp, Bos taurus; identical to SEQ ID NO: 28297

SEQ ID NO: 68201 - DNA, 201 bp, Bos taurus
cttggcatctggcctaaactcactgctacctgaaagagtgccaacctgttcagcacatttgaatttgcaaataatctcttatttactctcagagtatccatgaagctgaagcttgtgatgggtttttattatgtggtaataagtactgttggggaagatctatctttgcaaagcccaattagtgtatttatttattaggct

SEQ ID NO: 68202 - DNA, 201 bp, Bos taurus; identical to SEQ ID NO: 28298

SEQ ID NO: 68203 - DNA, 201 bp, Bos taurus
gtggacatggagacaatgctgcctctgtttgtggcccgctgggctctgaccttgctggaggcaaagtggtgtcacagctgcacttgcaggacggtcagtgatggtggaaaaggggccaacgtggtcccctctcaccctgtctgcctgtctgcaggtgtggcgacctctatttgtatattttactgtatttgtttatttgcc

SEQ ID NO: 68204 - DNA, 201 bp, Bos taurus; identical to SEQ ID NO: 28299

SEQ ID NO: 68205 - DNA, 201 bp, Bos taurus
ctttctgacagaaaaggaccaccaggaactagactcaccgcttcacccttgctctggctatgctggtgggtggcagaagcgttttgtctgcatttggccttccatttactcgcaagcattcctgtctccagtcatagctccccacaacatcacatctgaacaacaactcctgaattgcatggctgtaatattgacaaacag

SEQ ID NO: 68206 - DNA, 201 bp, Bos taurus
gggcagctccctctcatatctggtcaacagtatgtgtttatgaaaactgcaggggttttgccatattgttttataaaaatgagtagaaaatggaatactgaatggactggtgtgtgtgtgtgcgcacacgcgcgctcagtcatgtgcaactttttcgacactgatctgtagccctccaggcccctatgtccatggtatttt

SEQ ID NO: 68207 - DNA, 201 bp, Bos taurus; identical to SEQ ID NO: 28300

SEQ ID NO: 68208 - DNA, 201 bp, Bos taurus
gctcagagaccacccagtcagcttccccagccgctctcagctgcacagtccccggaagcaggacgctgtgtggaaggctctgctctgcggcccctctggattcctctgagattccccctaagccttcaacatccacccacgtagagctgggtctcatactgcctccagtccccagaaaggcccagaaaaccaaaatctcac

SEQ ID NO: 68209 - DNA, 201 bp, Bos taurus
taacctttccctgaggaatacttggttcgtgttctgagtgcagcacacccccctacccccacccccaccacacacacacctgtgtcttggtttctggctccgggcagagatcaatctgtggccagtccccccccagacaaggtttctgaaaagatcgttggggctggaatgttttaggctggtcttgggaagctctctgtt

SEQ ID NO: 68210 - DNA, 201 bp, Bos taurus
caaaggagctcaggactcaccgtcctttctgggcgagggagcgcagaggcacgtattaactgggcatctcaagtctccaggcacaagcagccccaggggatttggtggctttgccagcccagggcctctagagggccctttgagcatggccgtccagccccaggttgcctccggccttcccctgctgccttcacaagatga

SEQ ID NO: 68211 - DNA, 201 bp, Bos taurus
gcactgagtaatctgcattcccttgccgcccaaccctgccccccgaccccaatgaaggacggaagcagctggcatcaggggtcagagccaagggccctggttttcaagaggaccaaaccttatgagcccagctggcacatagtcaccattgaaattaaactggttccctcagggcctaaccccagccagtccctcccaact

SEQ ID NO: 68212 - DNA, 201 bp, Bos taurus; identical to SEQ ID NO: 28301

SEQ ID NO: 68213 - DNA, 201 bp, Bos taurus; identical to SEQ ID NO: 28302

SEQ ID NO: 68214 - DNA, 201 bp, Bos taurus; identical to SEQ ID NO: 28303

SEQ ID NO: 68215 - DNA, 201 bp, Bos taurus
acaggacacatgacctacgacactggacaggtgagacagtgattagtcacatgcagtcccagtcccaggaaggaggacacagcatggcatgcatggccatttgagggttgcactcaggaatcgcatgggcaagaggggtgaaccctggtttccatggaaagatgtgataggcctgtttgaataattttgcaggccagaaac

SEQ ID NO: 68216 - DNA, 201 bp, Bos taurus
ttgcttccttgatctgccttttgaaatgtggttaaataggggaaagagtttccttgcttgggcagtgggtctcagccaccacttctacaatggccacaggacacctagctctgcctgacttcctgctattacccaaattctctccctaccccatgtcctgcaccccaggcctggcctaaaatacaagcagtttgatgaaag

SEQ ID NO: 68217 - DNA, 201 bp, Bos taurus
atatttatcatctggggcctcaactcaggtggctttctgagactatttgagttccacttaactactgtacattgatcatttgcaggagaccttttgcccgttggccccttgctctttattctactgagcaattgggaatacacttgactttcaaaggctcaacttgcgccattcaaaggaaaaatgtccacctcattttta

SEQ ID NO: 68218 - DNA, 201 bp, Bos taurus; identical to SEQ ID NO: 28304

SEQ ID NO: 68219 - DNA, 201 bp, Bos taurus
taaactgttcaaagaatttgcagattctgagcatggaagatcaaatgttgcaatcgaagggaatgaggatgtttaatctaaccggaaaagaaagctccacgttgcagaaccatcagaattcactgagtctttgcttctatgacaggaaaccaccaagtttaacattagaagcgttcattcagaaatccaaagtcttggttt

SEQ ID NO: 68220 - DNA, 201 bp, Bos taurus; identical to SEQ ID NO: 28305

SEQ ID NO: 68221 - DNA, 201 bp, Bos taurus
ttttattaatgtgactctccctgccccacttccacaccttggcctgaaaccgatgagcattctccatctgacatggcgagcctgctccacagcctccaaatgctgactgggttggccctgctaagagttcaaagccgactacaatgaccccattggtctttgcactgtaagcctccagctcatttagggaattatctgcag

SEQ ID NO: 68222 - DNA, 201 bp, Bos taurus; identical to SEQ ID NO: 28306

SEQ ID NO: 68223 - DNA, 201 bp, Bos taurus; identical to SEQ ID NO: 28307

SEQ ID NO: 68224 - DNA, 201 bp, Bos taurus
actaatccaccagctaactcgaacagcattggaactgcttacccatctgtttccccaatggaatggattccatagaggcctgaagcccaaaattggagtcagggctgggggatgcagtcgaagtttagcgggaacacatcagatgtgttctggcccaactatccatacctgggaagcaggcaggcacaagaccagaatctc

SEQ ID NO: 68225 - DNA, 201 bp, Bos taurus; identical to SEQ ID NO: 28308

SEQ ID NO: 68226 - DNA, 201 bp, Bos taurus
tgggtgaagaagagaggatttggaggcagtaaacaggccagagtgggatgtagccagtggtttctgagctatcagtggttcctgtggataacaagaacccgggagctgggttaaatggccctgaaattgtttcgaatttccttggtctaacttggagagttgtttctttctttctttttttttaatcttttcccttcttgt

SEQ ID NO: 68227 - DNA, 201 bp, Bos taurus
acaggagaggttctgccctccgatctggtggccctctttcttctaagaggtcagtctgcctgctcccgacagctgttagctctggctgttagctgttctgttcaaatgtccggccgcagaatacctttaggacccgaggctgagggaccctggcattccattggacggtgggtatccctgatgtctggttgaacaaaactg

SEQ ID NO: 68228 - DNA, 201 bp, Bos taurus
ctctcagaaagagctttgtgtgtgtagggaacttactgtaccctcttagcagtggctgtaatcgctacattacagatgagcgagttgcagctgcagggccagaaagcagcctgcaagagattccgcagccaacttggggcagaactgacccctgcccaggtctgacctcagaactgtgtgactctggacaagttattcccc

SEQ ID NO: 68229 - DNA, 201 bp, Bos taurus; identical to SEQ ID NO: 28309

SEQ ID NO: 68230 - DNA, 201 bp, Bos taurus; identical to SEQ ID NO: 28310

SEQ ID NO: 68231 - DNA, 201 bp, Bos taurus; identical to SEQ ID NO: 28311

SEQ ID NO: 68232 - DNA, 201 bp, Bos taurus; identical to SEQ ID NO: 28312

SEQ ID NO: 68233 - DNA, 201 bp, Bos taurus
tgggccaccctctgggctatgcgcaggcgcagtgcggtggtcagacaccccgcccccaccctcccagcctttacttaactttaggttcattcactcagtcgtggcccattccttccgacccaggaactgcagcacaccaggcttccctgtccatcaccaactcccagagcttgctcaaactcatgtccatccagtctgtga

SEQ ID NO: 68234 - DNA, 201 bp, Bos taurus
ccaggctgcacagtgtagccaaaaaaataaaaataatctataagaagatggacagggaagcctggtgtgctgcagtccatggggtagcaaagaactgtacctcaccgagcgactgaaatggtaagattatatctcaataaaactgaaaaacacacctcaaaatatacagggatggggagaaacataaaaatatacataaaa

SEQ ID NO: 68235 - DNA, 201 bp, Bos taurus; identical to SEQ ID NO: 28313

SEQ ID NO: 68236 - DNA, 201 bp, Bos taurus; identical to SEQ ID NO: 28314

SEQ ID NO: 68237 - DNA, 201 bp, Bos taurus; identical to SEQ ID NO: 28315

SEQ ID NO: 68238 - DNA, 201 bp, Bos taurus; identical to SEQ ID NO: 28316

SEQ ID NO: 68239 - DNA, 201 bp, Bos taurus; identical to SEQ ID NO: 28317

SEQ ID NO: 68240 - DNA, 201 bp, Bos taurus; identical to SEQ ID NO: 28318

SEQ ID NO: 68241 - DNA, 201 bp, Bos taurus; identical to SEQ ID NO: 28319

SEQ ID NO: 68242 - DNA, 201 bp, Bos taurus; identical to SEQ ID NO: 28320

SEQ ID NO: 68243 - DNA, 201 bp, Bos taurus; identical to SEQ ID NO: 28321

SEQ ID NO: 68244 - DNA, 201 bp, Bos taurus
agaatcagtccctcaggaaaatgagcacggctataaacagacggttaacagcgaggagacagcatctgatgaggaagcgaggaggcctctgccagagatatgggaacagggagacaccgcctccagccatccgattctcagcaaacggaaggtcgatgagagcacaggtagctgtgagcttgcagaacaggggtcccgctg

SEQ ID NO: 68245 - DNA, 201 bp, Bos taurus
ggagcccacacaggagcaccccacacccaggctacactgtggtgaaggctgtttctacaccaggtccctggggcgggggcgcagatggcctgcctgcacaaaggtgcggacgctgacgccaagcagctcacaaatgggaaatgaagcattctgcggtgtgtgttccggccagcacacactcaggacaggacttgtgaaacc

SEQ ID NO: 68246 - DNA, 201 bp, Bos taurus
aggctgctgcatctccagccagcgcaaactttccaggggtttgtcccgagtgacgaaaaccccttgcatcctgagttgtgtcctagcagcttgggcagaatggcctcacccgaaattcttcgagggatgatgagaacagagccgggggagggggtgaaagcaggaggaagtgaaccaggctccccggccgcagagacagga

SEQ ID NO: 68247 - DNA, 201 bp, Bos taurus
gggtcaggtcaccaaacaaaagaaacaggaatagaagctaatttttaatggcaaaccgccctgagcgctgggcacgctgtcacgttgtacagaaggcctcggtaaggctccaaggagaggataccggacgcccccgcccctccattcaacaccgtctctgcacaaacaaccgtaaccctttcaacagtgacgatggctgtg

SEQ ID NO: 68248 - DNA, 201 bp, Bos taurus
gagcattgagacacccatttatttacttttggaatgtgcttgggttggtatgatgaactctttcacggtagtgtattttaaagcttgtggccttgattcagttctgtgcgctgataaaggttttggcatattacatttaaaatctgaggcttagcataggtttggaactcatgacccaggtgtaggatatttgctgtaaat

SEQ ID NO: 68249 - DNA, 201 bp, Bos taurus
ttacaggatttcagaatgtgtattctttccactaggctatggtgcttcccagaaaatacaaaaggaaatgggcacacgagcaagagagatacaaagatgcatgtgctgtgggctgtgcttagctgctcagtcgggcccaactctgtaaccccatggactgcagtcctccagactcctccgtccgtgggattctccaggcag

SEQ ID NO: 68250 - DNA, 201 bp, Bos taurus
catagggtctcaaagagttggacatgaccaaagtgacttagcatgcacgcgcaaatgtttgtataaaataaatgaagaaatggataaacaagtgaacatacaaaatcttgtaagaaaaactcagctgacttctccctactctgttccccatcattctaaccagcttacttttggagatcccctgaatcagcacacactctt

SEQ ID NO: 68251 - DNA, 201 bp, Bos taurus
aggccacgccgatgagtaattaggcagcaggcagagaccgggcagagctttatgggcccattagtacttgcccagctgctttcaaggttccagcctgcaacttgggtgttaggtacctttagtgtcttcagttaaaaaaaaaaaaatgacctacgtgttttttgttgctgttgtttctgtccaaatgtttaaagacatgaa

SEQ ID NO: 68252 - DNA, 201 bp, Bos taurus; identical to SEQ ID NO: 28323

SEQ ID NO: 68253 - DNA, 201 bp, Bos taurus
attatattaacaatatagtatgttgttatgccaatattatctggcatattttaagcctggtgtgtacatgataccatttgttattggggggtttcaagtatcattttactggtgtagctcaatatagcactagtaaattgatttaaaaggaggcaccttcttcattgcctttaaggattaaacatgtatctaaggacacca

SEQ ID NO: 68254 - DNA, 201 bp, Bos taurus
attcttgctggttggcccagctgtaaacgtgagacaaatgtcctgtaaacgtttctcttacctctggttccccacagtcacattcctctccttcttcaacatatccgttcccgcacttctggcccccgaaggactgcttcacttccggcaggttgaacagacacatgcccatgcccttctgcaggctggcctccaggtcct

SEQ ID NO: 68255 - DNA, 201 bp, Bos taurus; identical to SEQ ID NO: 28328

SEQ ID NO: 68256 - DNA, 201 bp, Bos taurus; identical to SEQ ID NO: 28329

SEQ ID NO: 68257 - DNA, 201 bp, Bos taurus; identical to SEQ ID NO: 28330

SEQ ID NO: 68258 - DNA, 201 bp, Bos taurus; identical to SEQ ID NO: 28331

SEQ ID NO: 68259 - DNA, 201 bp, Bos taurus; identical to SEQ ID NO: 28334

SEQ ID NO: 68260 - DNA, 201 bp, Bos taurus; identical to SEQ ID NO: 28335

SEQ ID NO: 68261 - DNA, 201 bp, Bos taurus
ctggcagaggccgctgagtggaaggcagcgtccaagcctgcatgccccagtggtagttctgagaactggaagcagtcctggatgaaagtccaggaatacttgcagggcctttaaatatatatggtctaggggcattgtgagcagcaactcctgtgtgccctgaccctgcttcctcctgtggtcggagacacacagccaaga

SEQ ID NO: 68262 - DNA, 201 bp, Bos taurus; identical to SEQ ID NO: 28337

SEQ ID NO: 68263 - DNA, 201 bp, Bos taurus; identical to SEQ ID NO: 28338

SEQ ID NO: 68264 - DNA, 201 bp, Bos taurus
ggatcgtcctgcaggaccgccagtcacggaggcccccgtgtttcttttcctgggaaagtttctggtgtggtcgtgagttcacaccagtgagtggggaggtggggccagagggctcttgtgggaaacacacatgagcccaggcttccttctccaggttaaggaggcttttatgagccctagcaaggccgactcccccaggct

SEQ ID NO: 68265 - DNA, 201 bp, Bos taurus; identical to SEQ ID NO: 28344

SEQ ID NO: 68266 - DNA, 201 bp, Bos taurus; identical to SEQ ID NO: 28345

SEQ ID NO: 68267 - DNA, 201 bp, Bos taurus; identical to SEQ ID NO: 28350

SEQ ID NO: 68268 - DNA, 201 bp, Bos taurus; identical to SEQ ID NO: 28351

SEQ ID NO: 68269 - DNA, 201 bp, Bos taurus; identical to SEQ ID NO: 28352

SEQ ID NO: 68270 - DNA, 201 bp, Bos taurus; identical to SEQ ID NO: 28353

SEQ ID NO: 68271 - DNA, 201 bp, Bos taurus; identical to SEQ ID NO: 28357

SEQ ID NO: 68272 - DNA, 201 bp, Bos taurus; identical to SEQ ID NO: 28359

SEQ ID NO: 68273 - DNA, 201 bp, Bos taurus; identical to SEQ ID NO: 28361

SEQ ID NO: 68274 - DNA, 201 bp, Bos taurus; identical to SEQ ID NO: 28362

SEQ ID NO: 68275 - DNA, 201 bp, Bos taurus; identical to SEQ ID NO: 28364

SEQ ID NO: 68276 - DNA, 201 bp, Bos taurus; identical to SEQ ID NO: 28365

SEQ ID NO: 68277 - DNA, 201 bp, Bos taurus; identical to SEQ ID NO: 28366

SEQ ID NO: 68278 - DNA, 201 bp, Bos taurus; identical to SEQ ID NO: 28367

SEQ ID NO: 68279 - DNA, 201 bp, Bos taurus; identical to SEQ ID NO: 28368

SEQ ID NO: 68280 - DNA, 201 bp, Bos taurus; identical to SEQ ID NO: 28369

SEQ ID NO: 68281 - DNA, 201 bp, Bos taurus
ttaagaatctgagaaaatggagcagagaaacctagaatcttgaagcatcagaagtgcctgtggcatctgtggggaaattccagccacgctgatcagctgccccctttcagcccatccgctaggcatgtcctcacctggagatttcaggccataccacagagaaatttcatgccagtagcaattattctagtagtcatgtat

SEQ ID NO: 68282 - DNA, 201 bp, Bos taurus
aattcatctggagattcaagtgataaagcatgaaccctaggtccctcccaaagctgccccgtgcaacgtggggggacagccatggaccccacatgagtgtaatacctgcatctgcacttctctgccctactccctgtcaaggtgcccttgctcccatgtgagcacatttactcaaggagtttgttaaaggtttcagagcct

SEQ ID NO: 68283 - DNA, 201 bp, Bos taurus; identical to SEQ ID NO: 28370

SEQ ID NO: 68284 - DNA, 201 bp, Bos taurus; identical to SEQ ID NO: 28372

SEQ ID NO: 68285 - DNA, 201 bp, Bos taurus; identical to SEQ ID NO: 28373

SEQ ID NO: 68286 - DNA, 201 bp, Bos taurus
agatgaagtgcatgaagaatggatccagttttgacaggagcaggagatactaatcacaaaattattctagaataaacacaatgacagtctaagtgagtaacaagaagagactaggaatgtgttatttcttgaagaagctcttaggcaccttgtatgggtgctctcagctaaaagaactgcaacggagaaaaggccagacac

SEQ ID NO: 68287 - DNA, 201 bp, Bos taurus; identical to SEQ ID NO: 28374

SEQ ID NO: 68288 - DNA, 201 bp, Bos taurus
agaagtgggcctcagggtggattcttgtgactagcctcctgtatacatcccctgagacaagagacaggtgggctccagttaaagtgtttataatcagcctgcttttggccctccaaaatggaagtagcaacagaaacagggtaaataacaagactttgtctcttgcaaacaccttaagataatacttgtgacaatagtcag

SEQ ID NO: 68289 - DNA, 201 bp, Bos taurus
ccaactcaaagcagatcccttcagatttgcatatgtttactttttgagtctactatggtgcctagtttctttgtctttggccaaatattctgaatattgcatatttttatgagtgactcaatggatctgaattttagcaaactcccggagatagtgaaggacagggaagcctggcgggctgcaatccatgggcctgaaaag

SEQ ID NO: 68290 - DNA, 201 bp, Bos taurus; identical to SEQ ID NO: 28377

SEQ ID NO: 68291 - DNA, 201 bp, Bos taurus; identical to SEQ ID NO: 28378

SEQ ID NO: 68292 - DNA, 201 bp, Bos taurus; identical to SEQ ID NO: 28379

SEQ ID NO: 68293 - DNA, 201 bp, Bos taurus; identical to SEQ ID NO: 28380

SEQ ID NO: 68294 - DNA, 201 bp, Bos taurus; identical to SEQ ID NO: 28381

SEQ ID NO: 68295 - DNA, 201 bp, Bos taurus; identical to SEQ ID NO: 28382

SEQ ID NO: 68296 - DNA, 201 bp, Bos taurus; identical to SEQ ID NO: 28383

SEQ ID NO: 68297 - DNA, 201 bp, Bos taurus; identical to SEQ ID NO: 28384

SEQ ID NO: 68298 - DNA, 201 bp, Bos taurus
ggctggtttctcaggcacgtgaccctggccgaccttgtgcacagtgtcatagacactgagtgtaaaccgctgggcagtccccagcctgtctctgccctggggcagctacatggggccagagagacagccagctctgccgttgcaggccaagaacactccttagtaggatttttctgtgaagcctctgaaaaatcagagttc

SEQ ID NO: 68299 - DNA, 201 bp, Bos taurus
atatgaatgaggacagatgactgtaaatattgggatgcgtttatcatacacccacttcaaggcaattaactaatttattcttaaaaaaaaaaggtgtcgttgtgttctataccataaaataaaaaagtgagcacacagagattcagtatcttggaactaggatttggacccaggcaacgctccaaagcctgtgcttttaat

SEQ ID NO: 68300 - DNA, 201 bp, Bos taurus
gttatgatgaaaccattttatttttcagaaagtctttgccttctccccatcctagtcccatcagcagatgtggaagcaggactcatcagagagcaaatttgggagtggtacagggggctctctgggtttgggtcacaccggattttcctcaatggtcccaaacaggaatgtcaggacggtcacctcaaacaggagatgaca

SEQ ID NO: 68301 - DNA, 201 bp, Bos taurus
ccacatccatcaccctggatggaaggtggaaatcaccctgcttgctggccagcagcattcagcatccccatggcttgtgctggcccaggcttctggggacgaacagagagcatgggaacacccaagcttcttgtccgtctctggcaggtcactgggctggggccatagggatgccagggccattggggccactcacctgga

SEQ ID NO: 68302 - DNA, 201 bp, Bos taurus; identical to SEQ ID NO: 28387

SEQ ID NO: 68303 - DNA, 201 bp, Bos taurus
gataatgtggtatatatacaatgaaatattacttagacataaaaaatatggaaatatttccatgagtgtaccttgagggccttatgccaactgaaataagctcacttcagttcagttcagtcactcagtcatgtctgactctttgcgaccccatgaatcgcagcacgccaggcctccctgtccatcaccaactcccggagt

SEQ ID NO: 68304 - DNA, 201 bp, Bos taurus
ctagctaaatgaagcttattcgtttaaatctagaaagaggttttttttaacttgtatataacatgtataatagtatttgcttacattcttccatggatccaggtaatggtttcatcttaataactcaggatcattgctaccagcgttcagcattacatggagtcatagagcaagagtgaacagagaacggttaaggaagct

SEQ ID NO: 68305 - DNA, 201 bp, Bos taurus; identical to SEQ ID NO: 28391

SEQ ID NO: 68306 - DNA, 201 bp, Bos taurus; identical to SEQ ID NO: 28392

SEQ ID NO: 68307 - DNA, 201 bp, Bos taurus
agtcaaaaattagtcaataaatgaataagagtatttaaaatactagtccctcaactctggaaaaaaaaaaaaaggttgttctatgtcccttttgaagttcatatattggaataaactttaaagaccagaatattttgatcagggaaaatttatttaagccacaaggtagcctatatcaattccagcatctatcaattagtt

SEQ ID NO: 68308 - DNA, 201 bp, Bos taurus
gagccaagtataaaactggcccaaatctaagcagaatctcatttttaaaatgaatactaaactaaaactcttaagcatatgaattgcaaagatgcccttatggccacaggtttcatggatggggacagtgcagtggtttggaataaaatagttacatgtgacgtactttgctcatctcatgcacagtttgctggtaacaca

SEQ ID NO: 68309 - DNA, 201 bp, Bos taurus; identical to SEQ ID NO: 28397

SEQ ID NO: 68310 - DNA, 201 bp, Bos taurus; identical to SEQ ID NO: 28398

SEQ ID NO: 68311 - DNA, 201 bp, Bos taurus; identical to SEQ ID NO: 28399

SEQ ID NO: 68312 - DNA, 201 bp, Bos taurus; identical to SEQ ID NO: 28400

SEQ ID NO: 68313 - DNA, 201 bp, Bos taurus; identical to SEQ ID NO: 28402

SEQ ID NO: 68314 - DNA, 201 bp, Bos taurus
ttgagatgctccctggggggtctgttttataagggcactaatcccagagtattccacctaatcatttcacaaaggccacagttgctaattccatcacgagaggcagtcaggatttcaacatattaattttggtgtaatattcattccatagtacgccagaagcctttttgagcacaagggccattgctttgctcccatcta

SEQ ID NO: 68315 - DNA, 201 bp, Bos taurus; identical to SEQ ID NO: 28403

SEQ ID NO: 68316 - DNA, 201 bp, Bos taurus
gaaattcctcaataccctcctccctcattattgaagaggccagggttgtggttccagagagtatctaccatttataggccaattttcaatgaggtaattcgagtcataaatcttagtgggaaatgctactgttgaacactcttggtgttccattaattgagagggatggtgggcctgtgatgatgctgtactaacccaagg

SEQ ID NO: 68317 - DNA, 201 bp, Bos taurus; identical to SEQ ID NO: 28404

SEQ ID NO: 68318 - DNA, 201 bp, Bos taurus; identical to SEQ ID NO: 28408

SEQ ID NO: 68319 - DNA, 201 bp, Bos taurus; identical to SEQ ID NO: 28409

SEQ ID NO: 68320 - DNA, 201 bp, Bos taurus; identical to SEQ ID NO: 28410

SEQ ID NO: 68321 - DNA, 201 bp, Bos taurus
cttaaagcaactgaaacttgactttactatcattcctaattagccttcttccaaaagctcatattggccctgacatctgacttatgtcctagacccatgacttatgtcatattggccctgacatctgacttatgtcctagacttattaagcctgataccaatatcagtagactccttttttttaatataaactttgtcact

SEQ ID NO: 68322 - DNA, 201 bp, Bos taurus
ccctggagaagggaaaggctacccactccagtattctggcctggagaattccatggactgtacagtccatggggtcacaaagagtcagatacgactgagtaactttcacttcacatggttgtttttgtgctacagtggcagaactgaatagtagcgaaagcaaagcatcgctcagtcgtgtccaactcttcgcaaccccat

SEQ ID NO: 68323 - DNA, 201 bp, Bos taurus
gtggagagaaatttattaatctcttgcatttatttttatgtacccagttggggaatgattgatgtcacataagcacttaacaaatgtacagtgatttacccgtgtagatattagagagagtgctttttgaaagaaaattcaacatatttgcttgcattaatattatttatagaacaaaattggaaactgtagctatatata

SEQ ID NO: 68324 - DNA, 201 bp, Bos taurus
aagctacattaagggaaatccaatttctattaaaagctattggaaggattggtaaagagaaaaatggagtaatgaatcagcaggggtcagtgaaaaacatgcgtctttttaaatcagaaggggtcagtgaaaaaattcatctttttaaaataggattcatcaaaaagaagacaaaggtagggatttcaagatacatttcaa

SEQ ID NO: 68325 - DNA, 201 bp, Bos taurus; identical to SEQ ID NO: 28413

SEQ ID NO: 68326 - DNA, 201 bp, Bos taurus; identical to SEQ ID NO: 28415

SEQ ID NO: 68327 - DNA, 201 bp, Bos taurus; identical to SEQ ID NO: 28416

SEQ ID NO: 68328 - DNA, 201 bp, Bos taurus; identical to SEQ ID NO: 28417

SEQ ID NO: 68329 - DNA, 201 bp, Bos taurus
tctggtagaaggccatctaaatctggcttgacttgccatctcttttcatcagttggtcattgagattcgccacaaggccacgggcatcagctgaggtcactagtgtggctggtccgagcatgctggggtacgactgactggcttctgggcctaatctgtgccttcaggaacagttaggcatcaacctgtgtatatcatctc

SEQ ID NO: 68330 - DNA, 201 bp, Bos taurus; identical to SEQ ID NO: 28418

SEQ ID NO: 68331 - DNA, 201 bp, Bos taurus
tgccccggccccccaggcccgggacaccttccttcagacggcagcacagcagctgtatccccattgagagcagcgtcctgccccgctgaggaggcagaaaacagggcacagtggccgaagcccctgcaacaggctgtcggaagaggacacgagaggtctggctggggtccctgacgcctactccatgctcccagggaggct

SEQ ID NO: 68332 - DNA, 201 bp, Bos taurus; identical to SEQ ID NO: 28422

SEQ ID NO: 68333 - DNA, 201 bp, Bos taurus; identical to SEQ ID NO: 28424

SEQ ID NO: 68334 - DNA, 201 bp, Bos taurus; identical to SEQ ID NO: 28425

SEQ ID NO: 68335 - DNA, 201 bp, Bos taurus; identical to SEQ ID NO: 28426

SEQ ID NO: 68336 - DNA, 201 bp, Bos taurus; identical to SEQ ID NO: 28427

SEQ ID NO: 68337 - DNA, 201 bp, Bos taurus; identical to SEQ ID NO: 28428

SEQ ID NO: 68338 - DNA, 201 bp, Bos taurus; identical to SEQ ID NO: 28429

SEQ ID NO: 68339 - DNA, 201 bp, Bos taurus; identical to SEQ ID NO: 28430

SEQ ID NO: 68340 - DNA, 201 bp, Bos taurus; identical to SEQ ID NO: 28431

SEQ ID NO: 68341 - DNA, 201 bp, Bos taurus; identical to SEQ ID NO: 28432

SEQ ID NO: 68342 - DNA, 201 bp, Bos taurus; identical to SEQ ID NO: 28433

SEQ ID NO: 68343 - DNA, 201 bp, Bos taurus; identical to SEQ ID NO: 28434

SEQ ID NO: 68344 - DNA, 201 bp, Bos taurus; identical to SEQ ID NO: 28435

SEQ ID NO: 68345 - DNA, 201 bp, Bos taurus; identical to SEQ ID NO: 28436

SEQ ID NO: 68346 - DNA, 201 bp, Bos taurus; identical to SEQ ID NO: 28438

SEQ ID NO: 68347 - DNA, 201 bp, Bos taurus; identical to SEQ ID NO: 28439

SEQ ID NO: 68348 - DNA, 201 bp, Bos taurus; identical to SEQ ID NO: 28440

SEQ ID NO: 68349 - DNA, 201 bp, Bos taurus; identical to SEQ ID NO: 28441

SEQ ID NO: 68350 - DNA, 201 bp, Bos taurus; identical to SEQ ID NO: 28442

SEQ ID NO: 68351 - DNA, 201 bp, Bos taurus; identical to SEQ ID NO: 28443

SEQ ID NO: 68352 - DNA, 201 bp, Bos taurus; identical to SEQ ID NO: 28444

SEQ ID NO: 68353 - DNA, 201 bp, Bos taurus; identical to SEQ ID NO: 28445

SEQ ID NO: 68354 - DNA, 201 bp, Bos taurus; identical to SEQ ID NO: 28446

SEQ ID NO: 68355 - DNA, 201 bp, Bos taurus; identical to SEQ ID NO: 28447

SEQ ID NO: 68356 - DNA, 201 bp, Bos taurus; identical to SEQ ID NO: 28448

SEQ ID NO: 68357 - DNA, 201 bp, Bos taurus; identical to SEQ ID NO: 28449

SEQ ID NO: 68358 - DNA, 201 bp, Bos taurus; identical to SEQ ID NO: 28450

SEQ ID NO: 68359 - DNA, 201 bp, Bos taurus; identical to SEQ ID NO: 28451

SEQ ID NO: 68360 - DNA, 201 bp, Bos taurus; identical to SEQ ID NO: 28452

SEQ ID NO: 68361 - DNA, 201 bp, Bos taurus; identical to SEQ ID NO: 28453

SEQ ID NO: 68362 - DNA, 201 bp, Bos taurus; identical to SEQ ID NO: 28454

SEQ ID NO: 68363 - DNA, 201 bp, Bos taurus; identical to SEQ ID NO: 28455

SEQ ID NO: 68364 - DNA, 201 bp, Bos taurus; identical to SEQ ID NO: 28456

SEQ ID NO: 68365 - DNA, 201 bp, Bos taurus; identical to SEQ ID NO: 28458

SEQ ID NO: 68366 - DNA, 201 bp, Bos taurus; identical to SEQ ID NO: 28459

SEQ ID NO: 68367 - DNA, 201 bp, Bos taurus; identical to SEQ ID NO: 28460

SEQ ID NO: 68368 - DNA, 201 bp, Bos taurus; identical to SEQ ID NO: 28461

SEQ ID NO: 68369 - DNA, 201 bp, Bos taurus; identical to SEQ ID NO: 28462

SEQ ID NO: 68370 - DNA, 201 bp, Bos taurus; identical to SEQ ID NO: 28463

SEQ ID NO: 68371 - DNA, 201 bp, Bos taurus; identical to SEQ ID NO: 28464

SEQ ID NO: 68372 - DNA, 201 bp, Bos taurus; identical to SEQ ID NO: 28466

SEQ ID NO: 68373 - DNA, 201 bp, Bos taurus; identical to SEQ ID NO: 28467

SEQ ID NO: 68374 - DNA, 201 bp, Bos taurus; identical to SEQ ID NO: 28468

SEQ ID NO: 68375 - DNA, 201 bp, Bos taurus; identical to SEQ ID NO: 28469

SEQ ID NO: 68376 - DNA, 201 bp, Bos taurus; identical to SEQ ID NO: 28470

SEQ ID NO: 68377 - DNA, 201 bp, Bos taurus; identical to SEQ ID NO: 28471

SEQ ID NO: 68378 - DNA, 201 bp, Bos taurus; identical to SEQ ID NO: 28472

SEQ ID NO: 68379 - DNA, 201 bp, Bos taurus; identical to SEQ ID NO: 28473

SEQ ID NO: 68380 - DNA, 201 bp, Bos taurus; identical to SEQ ID NO: 28474

SEQ ID NO: 68381 - DNA, 201 bp, Bos taurus; identical to SEQ ID NO: 28475

SEQ ID NO: 68382 - DNA, 201 bp, Bos taurus; identical to SEQ ID NO: 28476

SEQ ID NO: 68383 - DNA, 201 bp, Bos taurus; identical to SEQ ID NO: 28477

SEQ ID NO: 68384 - DNA, 201 bp, Bos taurus; identical to SEQ ID NO: 28478

SEQ ID NO: 68385 - DNA, 201 bp, Bos taurus; identical to SEQ ID NO: 28479

SEQ ID NO: 68386 - DNA, 201 bp, Bos taurus; identical to SEQ ID NO: 28480

SEQ ID NO: 68387 - DNA, 201 bp, Bos taurus; identical to SEQ ID NO: 28481

SEQ ID NO: 68388 - DNA, 201 bp, Bos taurus; identical to SEQ ID NO: 28482

SEQ ID NO: 68389 - DNA, 201 bp, Bos taurus; identical to SEQ ID NO: 28483

SEQ ID NO: 68390 - DNA, 201 bp, Bos taurus; identical to SEQ ID NO: 28484

SEQ ID NO: 68391 - DNA, 201 bp, Bos taurus; identical to SEQ ID NO: 28485

SEQ ID NO: 68392 - DNA, 201 bp, Bos taurus; identical to SEQ ID NO: 28486

SEQ ID NO: 68393 - DNA, 201 bp, Bos taurus; identical to SEQ ID NO: 28487

SEQ ID NO: 68394 - DNA, 201 bp, Bos taurus; identical to SEQ ID NO: 28488

SEQ ID NO: 68395 - DNA, 201 bp, Bos taurus; identical to SEQ ID NO: 28489

SEQ ID NO: 68396 - DNA, 201 bp, Bos taurus; identical to SEQ ID NO: 28490

SEQ ID NO: 68397 - DNA, 201 bp, Bos taurus; identical to SEQ ID NO: 28491

SEQ ID NO: 68398 - DNA, 201 bp, Bos taurus; identical to SEQ ID NO: 28492

SEQ ID NO: 68399 - DNA, 201 bp, Bos taurus; identical to SEQ ID NO: 28494

SEQ ID NO: 68400 - DNA, 201 bp, Bos taurus; identical to SEQ ID NO: 28495

SEQ ID NO: 68401 - DNA, 201 bp, Bos taurus; identical to SEQ ID NO: 28496

SEQ ID NO: 68402 - DNA, 201 bp, Bos taurus; identical to SEQ ID NO: 28497

SEQ ID NO: 68403 - DNA, 201 bp, Bos taurus; identical to SEQ ID NO: 28498

SEQ ID NO: 68404 - DNA, 201 bp, Bos taurus; identical to SEQ ID NO: 28499

SEQ ID NO: 68405 - DNA, 201 bp, Bos taurus; identical to SEQ ID NO: 28500

SEQ ID NO: 68406 - DNA, 201 bp, Bos taurus; identical to SEQ ID NO: 28501

SEQ ID NO: 68407 - DNA, 201 bp, Bos taurus; identical to SEQ ID NO: 28502

SEQ ID NO: 68408 - DNA, 201 bp, Bos taurus; identical to SEQ ID NO: 28503

SEQ ID NO: 68409 - DNA, 201 bp, Bos taurus
ggaacatgacactctctattccttaggcaggggtggggccttctttttaaaggttacagtatggtcaggggaaagagaaaaaattctacagtggtgaaatatgacaaacactacctcagtcaggccaccggggtcaacttctgtgctatgaattcttaaattgcagtacagttgacttacagtactatattagtttcaggt

SEQ ID NO: 68410 - DNA, 201 bp, Bos taurus
ccatccagttaatccttaatacatgcagagtctatattgtaaagtgcatattgtatataaagctgttgtagaatactgagtttaagaacatagtgtcttctttgaacattattctgcttttgtcttaaaggctatttaatcagatcctatgaaaaatctattttctttggtgtgtttttgtttgagatatcactttatatc

SEQ ID NO: 68411 - DNA, 201 bp, Bos taurus; identical to SEQ ID NO: 28504

SEQ ID NO: 68412 - DNA, 201 bp, Bos taurus
ttgtcacgaatcaattatcagtgaacatggccattggtatttcattattgttaataacaagtattattattgccagttagttctcgttggagctagtagatgttaaagttactattcttagttttgtgcttggacagaatgaagcctaactctctttcagtcttcaagatactttcactacatgaatttttagaagattag

SEQ ID NO: 68413 - DNA, 201 bp, Bos taurus; identical to SEQ ID NO: 28505

SEQ ID NO: 68414 - DNA, 201 bp, Bos taurus
aatttggtgaattcacagagaggtcagggccctttcatttgaaaggtgttgtgtgtttgctgtgaagatgtaactggattttcattttgaattaaagaaaatcactcgggctgccacgtgggccagctgttgttactgttgttcagttgctaagtcgtgtctgactctttgtgaccccatggactatagacctctaggctc

SEQ ID NO: 68415 - DNA, 201 bp, Bos taurus; identical to SEQ ID NO: 28506

SEQ ID NO: 68416 - DNA, 201 bp, Bos taurus
cccagcagccagcccccagcctcacctctcctgcagggtcctgttcccaggcctgccctcccctcatggcctgggctttcccctccctgccacaccccctctcctcactccagccccccaaagacgtgcaggttagtgtttgtaaagtgctctgagggggaaaagagccaagtgctttccctccactgaaaggaaacaatt

SEQ ID NO: 68417 - DNA, 201 bp, Bos taurus
gtccactgaagtactttctgacaccgggagaaagacttgcagtctttacaagctgcttggtcacagcctaaggagacggagagcctgggtgggaccagagttcctcttcctgcaaagagaaaatcacaggcagcaatgccctgtgaaactgacaggcagtgtgtcccaacgtcccactggagcataagaaccctggaaaga

SEQ ID NO: 68418 - DNA, 201 bp, Bos taurus
caggcttcatcttttatcattttcccctccagacttttaggggggaacagttctaaacagttctaaggaaaagattacaactcccagtggttggccagaggaaagagccagctcctcaaacacaggtgagagcattgtatttcccttccctaaacccgaggggaaaggagccatctgtacaaacttccctgttctcccgcg

SEQ ID NO: 68419 - DNA, 201 bp, Bos taurus; identical to SEQ ID NO: 28507

SEQ ID NO: 68420 - DNA, 201 bp, Bos taurus; identical to SEQ ID NO: 28508

SEQ ID NO: 68421 - DNA, 201 bp, Bos taurus
tatatttttctgccgctcccatggtgtcaggtaggggaccacctgcaggtgagaagtgtgccaccctagatatgatagataccttctttctggcccactatttaagaactgtttgattttggacaagtcatgcatttgaaagaaatcaagacctgtttacatgttttccctcagttggctggggccccctcacaaggttgt

SEQ ID NO: 68422 - DNA, 201 bp, Bos taurus; identical to SEQ ID NO: 28509

SEQ ID NO: 68423 - DNA, 201 bp, Bos taurus; identical to SEQ ID NO: 28510

SEQ ID NO: 68424 - DNA, 201 bp, Bos taurus; identical to SEQ ID NO: 28511

SEQ ID NO: 68425 - DNA, 201 bp, Bos taurus; identical to SEQ ID NO: 28512

SEQ ID NO: 68426 - DNA, 201 bp, Bos taurus; identical to SEQ ID NO: 28513

SEQ ID NO: 68427 - DNA, 201 bp, Bos taurus; identical to SEQ ID NO: 28514

SEQ ID NO: 68428 - DNA, 201 bp, Bos taurus; identical to SEQ ID NO: 28515

SEQ ID NO: 68429 - DNA, 201 bp, Bos taurus; identical to SEQ ID NO: 28516

SEQ ID NO: 68430 - DNA, 201 bp, Bos taurus
attcaagctgatcctagattttgcttttctttgaaaattttcatattgtccaagcatcagccaatttcattctcagtgtctttgagttgttaagggtatggtcagacctgtcaatgtcctaaaatgaaggacctgacttagcacctaagattggggtgattggaaacctgaccttcagttagcagcctttaaagtatgcaa

SEQ ID NO: 68431 - DNA, 201 bp, Bos taurus; identical to SEQ ID NO: 28517

SEQ ID NO: 68432 - DNA, 201 bp, Bos taurus
aagatgcccttgtgattcagtcatccttcccttcctgatgcagagaaggagacacccttacaaatggaggttttatcaatttaaaattctttgcaaaaggatagcttctactgtggtttgcagagcttctcctgggtctgctgtttcttgaaatagtcaactcaaaataatccttctattagaaaaggatattttggtgca

SEQ ID NO: 68433 - DNA, 201 bp, Bos taurus
atggccagtacatggagggacttttcaatacggatctagaacctcaaatgtatccccatcctctcctcggactccacctcctggactggactccttgtagggagatagttccagaaggccatctgggagcacggtgcatgggaagggctgggttcaggctggtggtgagaaagtataaacccgatgatttacacggtttgt

SEQ ID NO: 68434 - DNA, 201 bp, Bos taurus
cagcaagctcctgcaggccagtccttgtcagcctggataaactggggatgatgacagggaaaccacttcctacacaggcgccagataagtgagcgcgatcagtggccccccagaggaaggcaaaccagtgtcctcaggcctctgatacctgccagatgttttcctaggttcatggattgtcacttaattctaataacagcc

SEQ ID NO: 68435 - DNA, 201 bp, Bos taurus
actaatcccctagaaataaatacaaagatataaagcttaggagactctagagaaaataaaacaggatgattaaaaagtatttgattaacccagaagtgaaggtacctatattaaaatcaaacaaaacagacttcaagacaaaaaggatttccagagataaagatgtttggtaataataaagagagaaactcattaggagaa

SEQ ID NO: 68436 - DNA, 201 bp, Bos taurus
cctacctgccaggcgaagagtaaggactccgccaggtgccaaggccagaaaagcccagatggtaggggggggtgggcccctggaactcagcctactccaatgccctcactgtacacatgaaactgcccaaagccacattgctgatgctcgggcactggcccagcttccatggttccaattcccactttccagctctatccc

SEQ ID NO: 68437 - DNA, 201 bp, Bos taurus; identical to SEQ ID NO: 28520

SEQ ID NO: 68438 - DNA, 201 bp, Bos taurus; identical to SEQ ID NO: 28524

SEQ ID NO: 68439 - DNA, 201 bp, Bos taurus
gaggaccctgaactcacatcttctcacgagcacaccaaaattacaattaactgctgaacaaccatcaattaaaaagaaaagtctggaatccacaaaaaaaaaaaaaagatattctacatccaaaggtgtacagaagaaatcacaagatggtaggaggtatgcactagcaatataatcaaatccataccacctggatgggcc

SEQ ID NO: 68440 - DNA, 201 bp, Bos taurus
gccaacagggccgttgcaggcaaggggcagcgggggaccaagtcaggcacatcctggtgcactggagccaggcaagctgcggaccagcatcagacaagccgcagcgggccggggcagggcgtggggagtgcctcgagatagtctactttgccagaatggggcttggagggtttgggggttttgggcattttggttcagcag

SEQ ID NO: 68441 - DNA, 201 bp, Bos taurus; identical to SEQ ID NO: 28525

SEQ ID NO: 68442 - DNA, 201 bp, Bos taurus; identical to SEQ ID NO: 28526

SEQ ID NO: 68443 - DNA, 201 bp, Bos taurus
gtggttcctggggttagaggctgtcactgtgggcatctcttcagctgggcgcttgtaagggcaggggatggaaatgctgggggcccgaggagacgcagaaaactgccggggagatgctgcctcatgcgtttcattaacttgctgacgagggtagttgtatttacggcctgaggccgacgggaaggttgctgcaggtcagtg

SEQ ID NO: 68444 - DNA, 201 bp, Bos taurus; identical to SEQ ID NO: 28527

SEQ ID NO: 68445 - DNA, 201 bp, Bos taurus; identical to SEQ ID NO: 28528

SEQ ID NO: 68446 - DNA, 201 bp, Bos taurus; identical to SEQ ID NO: 28529

SEQ ID NO: 68447 - DNA, 201 bp, Bos taurus; identical to SEQ ID NO: 28534

SEQ ID NO: 68448 - DNA, 201 bp, Bos taurus; identical to SEQ ID NO: 28537

SEQ ID NO: 68449 - DNA, 201 bp, Bos taurus; identical to SEQ ID NO: 28542

SEQ ID NO: 68450 - DNA, 201 bp, Bos taurus; identical to SEQ ID NO: 28543

SEQ ID NO: 68451 - DNA, 201 bp, Bos taurus
tccatttcctggtaaacaaagataatcctagaacttacatcatcgagttactgaaagggttaattgatataatgcaagataagcactttgcaccatacctcgcccacagtttgtgcacaacaaatattagttgtcattaaattattattaacaagaaatacataatggaggcacagctctgacaatgactcacgccaccca

SEQ ID NO: 68452 - DNA, 201 bp, Bos taurus; identical to SEQ ID NO: 28544

SEQ ID NO: 68453 - DNA, 201 bp, Bos taurus; identical to SEQ ID NO: 28545

SEQ ID NO: 68454 - DNA, 201 bp, Bos taurus; identical to SEQ ID NO: 28546

SEQ ID NO: 68455 - DNA, 201 bp, Bos taurus; identical to SEQ ID NO: 28547

SEQ ID NO: 68456 - DNA, 201 bp, Bos taurus; identical to SEQ ID NO: 28548

SEQ ID NO: 68457 - DNA, 201 bp, Bos taurus; identical to SEQ ID NO: 28549

SEQ ID NO: 68458 - DNA, 201 bp, Bos taurus; identical to SEQ ID NO: 28550

SEQ ID NO: 68459 - DNA, 201 bp, Bos taurus
agcagacagaagccaccactgctgtttcaactcttctgacgtttccactgggccacaagcaaggacctcactccttgccacagccgacgaggcctgtaggatgtggtccagccacacaggtctcacgtccagccacactgccttccagtgatgctgtgatccagttagactcacagcagagaaaaaagaatgtgaacattc

SEQ ID NO: 68460 - DNA, 201 bp, Bos taurus; identical to SEQ ID NO: 28553

SEQ ID NO: 68461 - DNA, 201 bp, Bos taurus; identical to SEQ ID NO: 28554

SEQ ID NO: 68462 - DNA, 201 bp, Bos taurus; identical to SEQ ID NO: 28556

SEQ ID NO: 68463 - DNA, 201 bp, Bos taurus; identical to SEQ ID NO: 28558

SEQ ID NO: 68464 - DNA, 201 bp, Bos taurus; identical to SEQ ID NO: 28561

SEQ ID NO: 68465 - DNA, 201 bp, Bos taurus
tgcgtcctggttattgggtgtggtgggacgcattctgaagattcaccttttgcttctgtttgtgtttgctttccttcgctctagggagaggggccagaaagtccctacctgcaggaagtcagggggttctggatggtagggaatcctggaagcacttggaagccctacacgtagaggtggccgggacgttgctgttcagga

SEQ ID NO: 68466 - DNA, 201 bp, Bos taurus; identical to SEQ ID NO: 28563

SEQ ID NO: 68467 - DNA, 201 bp, Bos taurus; identical to SEQ ID NO: 28564

SEQ ID NO: 68468 - DNA, 201 bp, Bos taurus; identical to SEQ ID NO: 28565

SEQ ID NO: 68469 - DNA, 201 bp, Bos taurus; identical to SEQ ID NO: 28566

SEQ ID NO: 68470 - DNA, 201 bp, Bos taurus; identical to SEQ ID NO: 28567

SEQ ID NO: 68471 - DNA, 201 bp, Bos taurus; identical to SEQ ID NO: 28568

SEQ ID NO: 68472 - DNA, 201 bp, Bos taurus; identical to SEQ ID NO: 28569

SEQ ID NO: 68473 - DNA, 201 bp, Bos taurus; identical to SEQ ID NO: 28570

SEQ ID NO: 68474 - DNA, 201 bp, Bos taurus; identical to SEQ ID NO: 28571

SEQ ID NO: 68475 - DNA, 201 bp, Bos taurus; identical to SEQ ID NO: 28572

SEQ ID NO: 68476 - DNA, 201 bp, Bos taurus; identical to SEQ ID NO: 28573

SEQ ID NO: 68477 - DNA, 201 bp, Bos taurus; identical to SEQ ID NO: 28574

SEQ ID NO: 68478 - DNA, 201 bp, Bos taurus; identical to SEQ ID NO: 28575

SEQ ID NO: 68479 - DNA, 201 bp, Bos taurus; identical to SEQ ID NO: 28576

SEQ ID NO: 68480 - DNA, 201 bp, Bos taurus; identical to SEQ ID NO: 28577

SEQ ID NO: 68481 - DNA, 201 bp, Bos taurus
acagataaaggaaccacacaaaacgagtcttcggggacaaacaatgcatattccgacaaacaggcccactatgtagcttcttaagagcaggatgtgcacttgaacctgtgagcaaggactttcaagttaatgacaccaggaaggtgagagtggaggtaaaacaacaggaaaatgtctttgtgacttactttacaatcttca

SEQ ID NO: 68482 - DNA, 201 bp, Bos taurus; identical to SEQ ID NO: 28579

SEQ ID NO: 68483 - DNA, 201 bp, Bos taurus; identical to SEQ ID NO: 28580

SEQ ID NO: 68484 - DNA, 201 bp, Bos taurus; identical to SEQ ID NO: 28589

SEQ ID NO: 68485 - DNA, 201 bp, Bos taurus; identical to SEQ ID NO: 28592

SEQ ID NO: 68486 - DNA, 201 bp, Bos taurus; identical to SEQ ID NO: 28594

SEQ ID NO: 68487 - DNA, 201 bp, Bos taurus; identical to SEQ ID NO: 28595

SEQ ID NO: 68488 - DNA, 201 bp, Bos taurus; identical to SEQ ID NO: 28596

SEQ ID NO: 68489 - DNA, 201 bp, Bos taurus; identical to SEQ ID NO: 28597

SEQ ID NO: 68490 - DNA, 201 bp, Bos taurus; identical to SEQ ID NO: 28598

SEQ ID NO: 68491 - DNA, 201 bp, Bos taurus; identical to SEQ ID NO: 28599

SEQ ID NO: 68492 - DNA, 201 bp, Bos taurus
ggctcagtcctggactccatcctcaccacaaatgcctggggaagacccctcagacccctgcctacacttgggtctcatccctccctactggatggccagggctctggattccacattacctggaaccgtctttgttcattccaaaaccatgggctcctccagcggtaagtcatcacaggaaggcctgaggatccacagagc

SEQ ID NO: 68493 - DNA, 201 bp, Bos taurus; identical to SEQ ID NO: 28603

SEQ ID NO: 68494 - DNA, 201 bp, Bos taurus; identical to SEQ ID NO: 28604

SEQ ID NO: 68495 - DNA, 201 bp, Bos taurus
acagccgtgtgaggtggatattactgctgtttccatttcacagatgatgaagctgaggcacatcagcagggagtctgtgtaactggcccaggtaaccatcctacccagtgctcggactcaggctcctgagcttgtgtttttaacagcatttttcacctggttcccagcatcattgaagggccattgcaatgtcatgaaaac

SEQ ID NO: 68496 - DNA, 201 bp, Bos taurus
cagggatggtcctgggttaggggaagtgaagaggacaatgtgcgtgacagaaattctgagaacacagatcattactacacatctcttaaggttcattgtggttttaaaaatgggtggaggacttgatcctaggttttggaagggcaagcctgactgaggggaagaaggagcaggaggtgaacagggaaaggcaggtcctag

SEQ ID NO: 68497 - DNA, 201 bp, Bos taurus
ggatatccagagcgcctgctgccacgtggctgtgggcttttccaaagttcacccgttggtccatttgcctgggctcccattgctcgaggctactaagaggggtatctctttctctcaggcccctagggtaccactccagggagcgaaggcccagcaaaagtacaaagagagggaagctcagtgttacaatctttctaggtg

SEQ ID NO: 68498 - DNA, 201 bp, Bos taurus; identical to SEQ ID NO: 28606

SEQ ID NO: 68499 - DNA, 201 bp, Bos taurus; identical to SEQ ID NO: 28607

SEQ ID NO: 68500 - DNA, 201 bp, Bos taurus; identical to SEQ ID NO: 28608

SEQ ID NO: 68501 - DNA, 201 bp, Bos taurus; identical to SEQ ID NO: 28609

SEQ ID NO: 68502 - DNA, 201 bp, Bos taurus; identical to SEQ ID NO: 28610

SEQ ID NO: 68503 - DNA, 201 bp, Bos taurus; identical to SEQ ID NO: 28611

SEQ ID NO: 68504 - DNA, 201 bp, Bos taurus; identical to SEQ ID NO: 28612

SEQ ID NO: 68505 - DNA, 201 bp, Bos taurus; identical to SEQ ID NO: 28613

SEQ ID NO: 68506 - DNA, 201 bp, Bos taurus; identical to SEQ ID NO: 28614

SEQ ID NO: 68507 - DNA, 201 bp, Bos taurus; identical to SEQ ID NO: 28615

SEQ ID NO: 68508 - DNA, 201 bp, Bos taurus; identical to SEQ ID NO: 28616

SEQ ID NO: 68509 - DNA, 201 bp, Bos taurus; identical to SEQ ID NO: 28617

SEQ ID NO: 68510 - DNA, 201 bp, Bos taurus; identical to SEQ ID NO: 28618

SEQ ID NO: 68511 - DNA, 201 bp, Bos taurus; identical to SEQ ID NO: 28619

SEQ ID NO: 68512 - DNA, 201 bp, Bos taurus; identical to SEQ ID NO: 28620

SEQ ID NO: 68513 - DNA, 201 bp, Bos taurus; identical to SEQ ID NO: 28621

SEQ ID NO: 68514 - DNA, 201 bp, Bos taurus; identical to SEQ ID NO: 28622

SEQ ID NO: 68515 - DNA, 201 bp, Bos taurus; identical to SEQ ID NO: 28623

SEQ ID NO: 68516 - DNA, 201 bp, Bos taurus; identical to SEQ ID NO: 28624

SEQ ID NO: 68517 - DNA, 201 bp, Bos taurus; identical to SEQ ID NO: 28625

SEQ ID NO: 68518 - DNA, 201 bp, Bos taurus; identical to SEQ ID NO: 28626

SEQ ID NO: 68519 - DNA, 201 bp, Bos taurus; identical to SEQ ID NO: 28627

SEQ ID NO: 68520 - DNA, 201 bp, Bos taurus; identical to SEQ ID NO: 28628

SEQ ID NO: 68521 - DNA, 201 bp, Bos taurus; identical to SEQ ID NO: 28629

SEQ ID NO: 68522 - DNA, 201 bp, Bos taurus; identical to SEQ ID NO: 28632

SEQ ID NO: 68523 - DNA, 201 bp, Bos taurus; identical to SEQ ID NO: 28633

SEQ ID NO: 68524 - DNA, 201 bp, Bos taurus; identical to SEQ ID NO: 28634

SEQ ID NO: 68525 - DNA, 201 bp, Bos taurus; identical to SEQ ID NO: 28636

SEQ ID NO: 68526 - DNA, 201 bp, Bos taurus
ggcccagtggttacaactccacgcttccactacagggggcatgggttcaatcccaggttggggaaactaagatcctacatgccatgaggccaaaaaataattatacaatgaaaataaaattgcctaagtgaggtcttgctgaaactcttgggttgataagtgcccttttctgaactctcataatatctcatgcaaaggcct

SEQ ID NO: 68527 - DNA, 201 bp, Bos taurus
aagggaaagctatgctgagagagtttaagtctttcctttgaaaacatggcaatctgcagtgtttatgcttacagtatggaacctgagatgaagtcagaacgtgggaggtgggccttaggtggaaataaaaactctcagttctttctgagccttgattttggaggccttgggttgtgatggagatattcaggagtgcagtgg

SEQ ID NO: 68528 - DNA, 201 bp, Bos taurus
cacaggaaggtgaagtgatttacccagagtcacacagcagtttagtaacaaggcagggaataaacagaactaaatttctgacattaacgctcctctggcaatgttataggttatatgttaatggcctattcagtagctgtttgcacttcacctcatgttctctcatcctgaaagaactaaaaaaattcataacaaaaaaac

SEQ ID NO: 68529 - DNA, 201 bp, Bos taurus
tgtagaatcttggtggctgtataaaatggactcacagtggtgagtgtccttgcacacatgaccatcatgttcagggtctcatctccatccgtgtgcagagggaaaaagtgggagtagaaaccacatgttgctggtcaatctagtggccctgtaaatgtccccctgcccccccaccgcctttcctttctcatgcctcgagca

SEQ ID NO: 68530 - DNA, 201 bp, Bos taurus; identical to SEQ ID NO: 28641

SEQ ID NO: 68531 - DNA, 201 bp, Bos taurus; identical to SEQ ID NO: 28642

SEQ ID NO: 68532 - DNA, 201 bp, Bos taurus
ctacatgtcttctctttgatgtttctgccaaagaagggaagagtatactgagatctgtcccggaacccgaaccatttatgcttaggtcaaagaaaaggctaaagctcttggctacaactgtgttgggtgatactggcagatttcattcattcttgctagttataggctgtgctcacacaattaagacagaaatgacaaggt

SEQ ID NO: 68533 - DNA, 201 bp, Bos taurus; identical to SEQ ID NO: 28643

SEQ ID NO: 68534 - DNA, 201 bp, Bos taurus; identical to SEQ ID NO: 28645

SEQ ID NO: 68535 - DNA, 201 bp, Bos taurus
gcttatttgtactccagagtcctaaatatacctctatatccccaacgtcctagaattcaccaggaatggttcactttaccagggaaaaccaaaattgcctgtatatgcctacagatcagctgtattcatatgggatagcaagatagttctaaacataaggatgttgatccagagttgagcaggatcataatactgcatgtt

SEQ ID NO: 68536 - DNA, 201 bp, Bos taurus; identical to SEQ ID NO: 28646

SEQ ID NO: 68537 - DNA, 201 bp, Bos taurus; identical to SEQ ID NO: 28647

SEQ ID NO: 68538 - DNA, 201 bp, Bos taurus; identical to SEQ ID NO: 28648

SEQ ID NO: 68539 - DNA, 201 bp, Bos taurus; identical to SEQ ID NO: 28649

SEQ ID NO: 68540 - DNA, 201 bp, Bos taurus; identical to SEQ ID NO: 28651

SEQ ID NO: 68541 - DNA, 201 bp, Bos taurus; identical to SEQ ID NO: 28652

SEQ ID NO: 68542 - DNA, 201 bp, Bos taurus; identical to SEQ ID NO: 28653

SEQ ID NO: 68543 - DNA, 201 bp, Bos taurus; identical to SEQ ID NO: 28655

SEQ ID NO: 68544 - DNA, 201 bp, Bos taurus; identical to SEQ ID NO: 28656

SEQ ID NO: 68545 - DNA, 201 bp, Bos taurus; identical to SEQ ID NO: 28657

SEQ ID NO: 68546 - DNA, 201 bp, Bos taurus; identical to SEQ ID NO: 28659

SEQ ID NO: 68547 - DNA, 201 bp, Bos taurus; identical to SEQ ID NO: 28663

SEQ ID NO: 68548 - DNA, 201 bp, Bos taurus; identical to SEQ ID NO: 28664

SEQ ID NO: 68549 - DNA, 201 bp, Bos taurus; identical to SEQ ID NO: 28665

SEQ ID NO: 68550 - DNA, 201 bp, Bos taurus; identical to SEQ ID NO: 28666

SEQ ID NO: 68551 - DNA, 201 bp, Bos taurus; identical to SEQ ID NO: 28668

SEQ ID NO: 68552 - DNA, 201 bp, Bos taurus; identical to SEQ ID NO: 28669

SEQ ID NO: 68553 - DNA, 201 bp, Bos taurus; identical to SEQ ID NO: 28671

SEQ ID NO: 68554 - DNA, 201 bp, Bos taurus; identical to SEQ ID NO: 28672

SEQ ID NO: 68555 - DNA, 201 bp, Bos taurus; identical to SEQ ID NO: 28675

SEQ ID NO: 68556 - DNA, 201 bp, Bos taurus; identical to SEQ ID NO: 28676

SEQ ID NO: 68557 - DNA, 201 bp, Bos taurus; identical to SEQ ID NO: 28678

SEQ ID NO: 68558 - DNA, 201 bp, Bos taurus; identical to SEQ ID NO: 28679

SEQ ID NO: 68559 - DNA, 201 bp, Bos taurus; identical to SEQ ID NO: 28680

SEQ ID NO: 68560 - DNA, 201 bp, Bos taurus; identical to SEQ ID NO: 28681

SEQ ID NO: 68561 - DNA, 201 bp, Bos taurus; identical to SEQ ID NO: 28682

SEQ ID NO: 68562 - DNA, 201 bp, Bos taurus; identical to SEQ ID NO: 28684

SEQ ID NO: 68563 - DNA, 201 bp, Bos taurus; identical to SEQ ID NO: 28686

SEQ ID NO: 68564 - DNA, 201 bp, Bos taurus; identical to SEQ ID NO: 28687

SEQ ID NO: 68565 - DNA, 201 bp, Bos taurus; identical to SEQ ID NO: 28688

SEQ ID NO: 68566 - DNA, 201 bp, Bos taurus; identical to SEQ ID NO: 28689

SEQ ID NO: 68567 - DNA, 201 bp, Bos taurus; identical to SEQ ID NO: 28691

SEQ ID NO: 68568 - DNA, 201 bp, Bos taurus; identical to SEQ ID NO: 28695

SEQ ID NO: 68569 - DNA, 201 bp, Bos taurus; identical to SEQ ID NO: 28696

SEQ ID NO: 68570 - DNA, 201 bp, Bos taurus; identical to SEQ ID NO: 28700

SEQ ID NO: 68571 - DNA, 201 bp, Bos taurus; identical to SEQ ID NO: 28701

SEQ ID NO: 68572 - DNA, 201 bp, Bos taurus; identical to SEQ ID NO: 28702

SEQ ID NO: 68573 - DNA, 201 bp, Bos taurus; identical to SEQ ID NO: 28704

SEQ ID NO: 68574 - DNA, 201 bp, Bos taurus; identical to SEQ ID NO: 28705

SEQ ID NO: 68575 - DNA, 201 bp, Bos taurus; identical to SEQ ID NO: 28706

SEQ ID NO: 68576 - DNA, 201 bp, Bos taurus; identical to SEQ ID NO: 28707

SEQ ID NO: 68577 - DNA, 201 bp, Bos taurus; identical to SEQ ID NO: 28708

SEQ ID NO: 68578 - DNA, 201 bp, Bos taurus; identical to SEQ ID NO: 28709

SEQ ID NO: 68579 - DNA, 201 bp, Bos taurus; identical to SEQ ID NO: 28710

SEQ ID NO: 68580 - DNA, 201 bp, Bos taurus; identical to SEQ ID NO: 28711

SEQ ID NO: 68581 - DNA, 201 bp, Bos taurus; identical to SEQ ID NO: 28712

SEQ ID NO: 68582 - DNA, 201 bp, Bos taurus; identical to SEQ ID NO: 28713

SEQ ID NO: 68583 - DNA, 201 bp, Bos taurus; identical to SEQ ID NO: 28714

SEQ ID NO: 68584 - DNA, 201 bp, Bos taurus; identical to SEQ ID NO: 28715

SEQ ID NO: 68585 - DNA, 201 bp, Bos taurus; identical to SEQ ID NO: 28716

SEQ ID NO: 68586 - DNA, 201 bp, Bos taurus; identical to SEQ ID NO: 28720

SEQ ID NO: 68587 - DNA, 201 bp, Bos taurus; identical to SEQ ID NO: 28725

SEQ ID NO: 68588 - DNA, 201 bp, Bos taurus; identical to SEQ ID NO: 28726

SEQ ID NO: 68589 - DNA, 201 bp, Bos taurus; identical to SEQ ID NO: 28727

SEQ ID NO: 68590 - DNA, 201 bp, Bos taurus; identical to SEQ ID NO: 28728

SEQ ID NO: 68591 - DNA, 201 bp, Bos taurus; identical to SEQ ID NO: 28735

SEQ ID NO: 68592 - DNA, 201 bp, Bos taurus; identical to SEQ ID NO: 28737

SEQ ID NO: 68593 - DNA, 201 bp, Bos taurus; identical to SEQ ID NO: 28738

SEQ ID NO: 68594 - DNA, 201 bp, Bos taurus; identical to SEQ ID NO: 28743

SEQ ID NO: 68595 - DNA, 201 bp, Bos taurus; identical to SEQ ID NO: 28750

SEQ ID NO: 68596 - DNA, 201 bp, Bos taurus; identical to SEQ ID NO: 28751

SEQ ID NO: 68597 - DNA, 201 bp, Bos taurus; identical to SEQ ID NO: 28752

SEQ ID NO: 68598 - DNA, 201 bp, Bos taurus; identical to SEQ ID NO: 28753

SEQ ID NO: 68599 - DNA, 201 bp, Bos taurus; identical to SEQ ID NO: 28757

SEQ ID NO: 68600 - DNA, 201 bp, Bos taurus; identical to SEQ ID NO: 28759

SEQ ID NO: 68601 - DNA, 201 bp, Bos taurus; identical to SEQ ID NO: 28760

SEQ ID NO: 68602 - DNA, 201 bp, Bos taurus; identical to SEQ ID NO: 28761

SEQ ID NO: 68603 - DNA, 201 bp, Bos taurus; identical to SEQ ID NO: 28762

SEQ ID NO: 68604 - DNA, 201 bp, Bos taurus; identical to SEQ ID NO: 28764

SEQ ID NO: 68605 - DNA, 201 bp, Bos taurus; identical to SEQ ID NO: 28765

SEQ ID NO: 68606 - DNA, 201 bp, Bos taurus; identical to SEQ ID NO: 28766

SEQ ID NO: 68607 - DNA, 201 bp, Bos taurus; identical to SEQ ID NO: 28767

SEQ ID NO: 68608 - DNA, 201 bp, Bos taurus; identical to SEQ ID NO: 28768

SEQ ID NO: 68609 - DNA, 201 bp, Bos taurus; identical to SEQ ID NO: 28769

SEQ ID NO: 68610 - DNA, 201 bp, Bos taurus; identical to SEQ ID NO: 28770

SEQ ID NO: 68611 - DNA, 201 bp, Bos taurus; identical to SEQ ID NO: 28771

SEQ ID NO: 68612 - DNA, 201 bp, Bos taurus; identical to SEQ ID NO: 28772

SEQ ID NO: 68613 - DNA, 201 bp, Bos taurus; identical to SEQ ID NO: 28773

SEQ ID NO: 68614 - DNA, 201 bp, Bos taurus; identical to SEQ ID NO: 28774

SEQ ID NO: 68615 - DNA, 201 bp, Bos taurus; identical to SEQ ID NO: 28775

SEQ ID NO: 68616 - DNA, 201 bp, Bos taurus; identical to SEQ ID NO: 28776

SEQ ID NO: 68617 - DNA, 201 bp, Bos taurus; identical to SEQ ID NO: 28777

SEQ ID NO: 68618 - DNA, 201 bp, Bos taurus; identical to SEQ ID NO: 28778

SEQ ID NO: 68619 - DNA, 201 bp, Bos taurus; identical to SEQ ID NO: 28779

SEQ ID NO: 68620 - DNA, 201 bp, Bos taurus; identical to SEQ ID NO: 28780

SEQ ID NO: 68621 - DNA, 201 bp, Bos taurus; identical to SEQ ID NO: 28781

SEQ ID NO: 68622 - DNA, 201 bp, Bos taurus; identical to SEQ ID NO: 28782

SEQ ID NO: 68623 - DNA, 201 bp, Bos taurus; identical to SEQ ID NO: 28783

SEQ ID NO: 68624 - DNA, 201 bp, Bos taurus; identical to SEQ ID NO: 28784

SEQ ID NO: 68625 - DNA, 201 bp, Bos taurus; identical to SEQ ID NO: 28785

SEQ ID NO: 68626 - DNA, 201 bp, Bos taurus; identical to SEQ ID NO: 28786

SEQ ID NO: 68627 - DNA, 201 bp, Bos taurus; identical to SEQ ID NO: 28787

SEQ ID NO: 68628 - DNA, 201 bp, Bos taurus; identical to SEQ ID NO: 28788

SEQ ID NO: 68629 - DNA, 201 bp, Bos taurus; identical to SEQ ID NO: 28790

SEQ ID NO: 68630 - DNA, 201 bp, Bos taurus; identical to SEQ ID NO: 28791

SEQ ID NO: 68631 - DNA, 201 bp, Bos taurus; identical to SEQ ID NO: 28792

SEQ ID NO: 68632 - DNA, 201 bp, Bos taurus; identical to SEQ ID NO: 28793

SEQ ID NO: 68633 - DNA, 201 bp, Bos taurus; identical to SEQ ID NO: 28794

SEQ ID NO: 68634 - DNA, 201 bp, Bos taurus; identical to SEQ ID NO: 28795

SEQ ID NO: 68635 - DNA, 201 bp, Bos taurus; identical to SEQ ID NO: 28796

SEQ ID NO: 68636 - DNA, 201 bp, Bos taurus; identical to SEQ ID NO: 28797

SEQ ID NO: 68637 - DNA, 201 bp, Bos taurus; identical to SEQ ID NO: 28798

SEQ ID NO: 68638 - DNA, 201 bp, Bos taurus; identical to SEQ ID NO: 28799

SEQ ID NO: 68639 - DNA, 201 bp, Bos taurus; identical to SEQ ID NO: 28801

SEQ ID NO: 68640 - DNA, 201 bp, Bos taurus; identical to SEQ ID NO: 28802

SEQ ID NO: 68641 - DNA, 201 bp, Bos taurus; identical to SEQ ID NO: 28803

SEQ ID NO: 68642 - DNA, 201 bp, Bos taurus
gattcaaatcaaagaacaaactaagaaggccaggccatttctgtttaaaaaaagaatgctcttaagcagagagagagatgtcaggaactgtcagtgacaatgccggtggggccccaggcaaaggccagccgtcctctcactcctctgggcgactccacattttcgtgctctcagccacaaccagcaacacctcaaaaacca

SEQ ID NO: 68643 - DNA, 201 bp, Bos taurus
caggcaagttgtctttgagttaaaccaaaattgggccagaggactgagaaattgttcaaggtctcacaggcatgatgcagtgctggcacgattgagacacgagttcctccaactcctaaacctgtgcttgtgaataacacgcaatgttgaggatgtttagggaccagccatgagcgtgaggacctgcacacaggaacaccg

SEQ ID NO: 68644 - DNA, 201 bp, Bos taurus
catcctgccatctctgacacctttcaagtctgcatctggcgttgtttacgcctttcttcccagatcagcccctctgcacacactcttcagggtgaaggccgtggttcaagtgtggcttgtgggtcattaacctgggaggaagtccccttcctgaatattccaggctccctcccctaaggcctgagggctgccgtgacaaag

SEQ ID NO: 68645 - DNA, 201 bp, Bos taurus; identical to SEQ ID NO: 28809

SEQ ID NO: 68646 - DNA, 201 bp, Bos taurus
cagggaggaatcccctcctggaggggctttgaggccaggcagggctgaagagggtggaaggacagaacagaacacagtagcacagacagaagacagacgtaggtgggtccacctgcggccggctgaggggtcagaaaacaaggaagccacagggacagccagaaggtggtgggcagggtagaaaggagtcaggaactcgct

SEQ ID NO: 68647 - DNA, 201 bp, Bos taurus
tcatatcagtcctcaaaagagagacacaggaagaatcagccccgaagatactgtgttgacagaagcagagactggagtcatgtgctttgaagacggaggaagaggccacaagccaaggaataggaatcctgaaagaggcaaggaaacagatcctccgtcttgacgtgggtcttgactttagctcagtgaaactcatttcag

SEQ ID NO: 68648 - DNA, 201 bp, Bos taurus; identical to SEQ ID NO: 28812

SEQ ID NO: 68649 - DNA, 201 bp, Bos taurus; identical to SEQ ID NO: 28813

SEQ ID NO: 68650 - DNA, 201 bp, Bos taurus; identical to SEQ ID NO: 28814

SEQ ID NO: 68651 - DNA, 201 bp, Bos taurus; identical to SEQ ID NO: 28815

SEQ ID NO: 68652 - DNA, 201 bp, Bos taurus; identical to SEQ ID NO: 28817

SEQ ID NO: 68653 - DNA, 201 bp, Bos taurus; identical to SEQ ID NO: 28818

SEQ ID NO: 68654 - DNA, 201 bp, Bos taurus; identical to SEQ ID NO: 28819

SEQ ID NO: 68655 - DNA, 201 bp, Bos taurus; identical to SEQ ID NO: 28820

SEQ ID NO: 68656 - DNA, 201 bp, Bos taurus; identical to SEQ ID NO: 28821

SEQ ID NO: 68657 - DNA, 201 bp, Bos taurus; identical to SEQ ID NO: 28822

SEQ ID NO: 68658 - DNA, 201 bp, Bos taurus; identical to SEQ ID NO: 28823

SEQ ID NO: 68659 - DNA, 201 bp, Bos taurus; identical to SEQ ID NO: 28824

SEQ ID NO: 68660 - DNA, 201 bp, Bos taurus; identical to SEQ ID NO: 28825

SEQ ID NO: 68661 - DNA, 201 bp, Bos taurus; identical to SEQ ID NO: 28826

SEQ ID NO: 68662 - DNA, 201 bp, Bos taurus; identical to SEQ ID NO: 28828

SEQ ID NO: 68663 - DNA, 201 bp, Bos taurus; identical to SEQ ID NO: 28829

SEQ ID NO: 68664 - DNA, 201 bp, Bos taurus; identical to SEQ ID NO: 28830

SEQ ID NO: 68665 - DNA, 201 bp, Bos taurus; identical to SEQ ID NO: 28831

SEQ ID NO: 68666 - DNA, 201 bp, Bos taurus; identical to SEQ ID NO: 28832

SEQ ID NO: 68667 - DNA, 201 bp, Bos taurus; identical to SEQ ID NO: 28833

SEQ ID NO: 68668 - DNA, 201 bp, Bos taurus; identical to SEQ ID NO: 28834

SEQ ID NO: 68669 - DNA, 201 bp, Bos taurus; identical to SEQ ID NO: 28836

SEQ ID NO: 68670 - DNA, 201 bp, Bos taurus; identical to SEQ ID NO: 28837

SEQ ID NO: 68671 - DNA, 201 bp, Bos taurus; identical to SEQ ID NO: 28838

SEQ ID NO: 68672 - DNA, 201 bp, Bos taurus; identical to SEQ ID NO: 28839

SEQ ID NO: 68673 - DNA, 201 bp, Bos taurus; identical to SEQ ID NO: 28840

SEQ ID NO: 68674 - DNA, 201 bp, Bos taurus; identical to SEQ ID NO: 28841

SEQ ID NO: 68675 - DNA, 201 bp, Bos taurus; identical to SEQ ID NO: 28842

SEQ ID NO: 68676 - DNA, 201 bp, Bos taurus; identical to SEQ ID NO: 28844

SEQ ID NO: 68677 - DNA, 201 bp, Bos taurus; identical to SEQ ID NO: 28846

SEQ ID NO: 68678 - DNA, 201 bp, Bos taurus; identical to SEQ ID NO: 28849

SEQ ID NO: 68679 - DNA, 201 bp, Bos taurus
ctttcctctggcctatcctccccacccctactcccagctcagttcctagtttctcctgggcgcccctctttcaccactgacttgcacataattctcatcttgggaggagggaacttcatctgggccaacttagggaatgtgattcactcacaaggaagctcattttcctcatctggaaaaggaaggttgtatcaactacca

SEQ ID NO: 68680 - DNA, 201 bp, Bos taurus; identical to SEQ ID NO: 28853

SEQ ID NO: 68681 - DNA, 201 bp, Bos taurus; identical to SEQ ID NO: 28855

SEQ ID NO: 68682 - DNA, 201 bp, Bos taurus; identical to SEQ ID NO: 28856

SEQ ID NO: 68683 - DNA, 201 bp, Bos taurus; identical to SEQ ID NO: 28857

SEQ ID NO: 68684 - DNA, 201 bp, Bos taurus
atctcttattttttctcatttagtatttggcctccttgatctatcggtcctaggaaacttgctatcattcagcatttttttaagcatacacgaaaatcaataattgtcttccttcttttaaaaataggaatatatctacctaaagaaactaaagacctatatatagaaaactataaaacactggtgaaagaaatcaaagag

SEQ ID NO: 68685 - DNA, 201 bp, Bos taurus; identical to SEQ ID NO: 28858

SEQ ID NO: 68686 - DNA, 201 bp, Bos taurus; identical to SEQ ID NO: 28859

SEQ ID NO: 68687 - DNA, 201 bp, Bos taurus; identical to SEQ ID NO: 28861

SEQ ID NO: 68688 - DNA, 201 bp, Bos taurus; identical to SEQ ID NO: 28863

SEQ ID NO: 68689 - DNA, 201 bp, Bos taurus; identical to SEQ ID NO: 28864

SEQ ID NO: 68690 - DNA, 201 bp, Bos taurus; identical to SEQ ID NO: 28865

SEQ ID NO: 68691 - DNA, 201 bp, Bos taurus; identical to SEQ ID NO: 28866

SEQ ID NO: 68692 - DNA, 201 bp, Bos taurus; identical to SEQ ID NO: 28867

SEQ ID NO: 68693 - DNA, 201 bp, Bos taurus; identical to SEQ ID NO: 28868

SEQ ID NO: 68694 - DNA, 201 bp, Bos taurus; identical to SEQ ID NO: 28869

SEQ ID NO: 68695 - DNA, 201 bp, Bos taurus; identical to SEQ ID NO: 28870

SEQ ID NO: 68696 - DNA, 201 bp, Bos taurus; identical to SEQ ID NO: 28871

SEQ ID NO: 68697 - DNA, 201 bp, Bos taurus; identical to SEQ ID NO: 28873

SEQ ID NO: 68698 - DNA, 201 bp, Bos taurus; identical to SEQ ID NO: 28875

SEQ ID NO: 68699 - DNA, 201 bp, Bos taurus; identical to SEQ ID NO: 28876

SEQ ID NO: 68700 - DNA, 201 bp, Bos taurus; identical to SEQ ID NO: 28877

SEQ ID NO: 68701 - DNA, 201 bp, Bos taurus
ttttacttgattatttatcttttgatttctccccttgaatcaagttctagatgggtgaaaacctacgtctgtctttccttttgtagccagtcttccttatacatagcagaagctcacaaacggtaatttaataggaataaaaggagtgtatctttgaaccggtatttcacaatacatacttacggtttatagaagtataaa

SEQ ID NO: 68702 - DNA, 201 bp, Bos taurus
cttatttgaaacttcaaagtccttgatgtgaggagtgctaggatccatttattcctgtatctgtgacctctagaggagtcatatggcaacatgaagttaggaaaaatcctttgcccaataaagcaagacgttatttgactatatagtatatccctcaccacaccgtgagaattaagtattgtctgaaaatgaagagggact

SEQ ID NO: 68703 - DNA, 201 bp, Bos taurus; identical to SEQ ID NO: 28882

SEQ ID NO: 68704 - DNA, 201 bp, Bos taurus; identical to SEQ ID NO: 28883

SEQ ID NO: 68705 - DNA, 201 bp, Bos taurus; identical to SEQ ID NO: 28884

SEQ ID NO: 68706 - DNA, 201 bp, Bos taurus; identical to SEQ ID NO: 28886

SEQ ID NO: 68707 - DNA, 201 bp, Bos taurus
taatcttctttaatcctggggaaatgtggactaaactgtactgcccctgcagcaactgctaatatttcatcacaagatcgaatgtttgcattaacactaatatggcctttaagcttcctatcccattgagtctcaaggaaatagaatcagggaaatgaccaagaaagtaagaatcaaaaagagaagttggtgctgcctagc

SEQ ID NO: 68708 - DNA, 201 bp, Bos taurus; identical to SEQ ID NO: 28887

SEQ ID NO: 68709 - DNA, 201 bp, Bos taurus
ctcacaagagtagagtcaaatttagtaacatattatcagagggtcattgattatttgcaaattcaataggatttagatgacagagcagttgagggcaatatcttcaaatattttggctatagctcagctggtaaagaacctgcctgccaatgcaagagatacatgagatgtgggtttgatccctgggttgggaagattccc

SEQ ID NO: 68710 - DNA, 201 bp, Bos taurus
aaaaaaagttatagtgaccttgctgggatatgctgaacaggtcttataagtcatatttcacagatgaaattggactttggagcatctatacatatatagagagtaagttgtatgtcaaagactcgaaccccaatatcctcgttctttctccttcattctttccaaaccccagagtattatgaagctattcaaatatctaca

SEQ ID NO: 68711 - DNA, 201 bp, Bos taurus; identical to SEQ ID NO: 28889

SEQ ID NO: 68712 - DNA, 201 bp, Bos taurus
ccttgctctttgggtaacacacaaattttctagcaggacaagaggtgtctggggaaactgctaaaaccattaggaataactgggatcttgttgttaggtcctgggaccttagcctattctgggtgttgatcacagagcagatggtctcgtgggaaaactggacccaggatgtggctcaggtaggagggatatggatactct

SEQ ID NO: 68713 - DNA, 201 bp, Bos taurus
agggccccacccggctcaggtgatcctgaccaagctgccagaatccaccatccaggcccatgtggaaccagattacatggagggcaccagaggcctcacaatcttgtccacgtgtctgggagaagacagaccgctccgtgtcgctgatgggtgtcacgtgggggcttggtgggggctgggaagcatgcccagcgggtgaaa

SEQ ID NO: 68714 - DNA, 201 bp, Bos taurus
taactacataatactaaatttggacctgtttttcaaggtcccagaccaatttctgcatctttcattatgcccttcctgactccttcaaccctcactcaagcctcctgcttccaaaatcctaatacaatattcagtactgaattatacactgtttgcagtcctttagagtttctcctttcatcctccataatacctttccag

SEQ ID NO: 68715 - DNA, 201 bp, Bos taurus
ggctgcccctaattgccgcctggaatggcaggaactgggagaggccttgccgtccacacattctgattccccacgcactaaagggaggccgtgtggttcccgggctaggggtagtcaggaaacactgagctagttcattacatagatgggaaaactatggccttgagaataggtggccctcatccgagggagacaccagga

SEQ ID NO: 68716 - DNA, 201 bp, Bos taurus
gtaatgcctgaaatgccagctgctaatatcaactcttcccaatttaataaaccttggcatcacaaagttggcaattagatttcctgtaaaaggctaaatgtggcggccttctgcttcctggattctatatttcagtaagaaaggcattagtgtgtggcagctgggataatcatttaattgatcttttccatctatggaagt

SEQ ID NO: 68717 - DNA, 201 bp, Bos taurus
catcatggagggagaaagagcaaaggctaggagtggccaaggccaagcctgagttgaacttctcacccctgctcggtgaggcctctcaaaggtatcccccgctcccggttctgctgttcagattccaggtgaccctggaaaagccatggatccctttcaggcctccgttttctcagctgcaaaataagggcctctcattct

SEQ ID NO: 68718 - DNA, 201 bp, Bos taurus; identical to SEQ ID NO: 28895

SEQ ID NO: 68719 - DNA, 201 bp, Bos taurus; identical to SEQ ID NO: 28896

SEQ ID NO: 68720 - DNA, 201 bp, Bos taurus; identical to SEQ ID NO: 28897

SEQ ID NO: 68721 - DNA, 201 bp, Bos taurus; identical to SEQ ID NO: 28898

SEQ ID NO: 68722 - DNA, 201 bp, Bos taurus; identical to SEQ ID NO: 28899

SEQ ID NO: 68723 - DNA, 201 bp, Bos taurus; identical to SEQ ID NO: 28900

SEQ ID NO: 68724 - DNA, 201 bp, Bos taurus; identical to SEQ ID NO: 28901

SEQ ID NO: 68725 - DNA, 201 bp, Bos taurus; identical to SEQ ID NO: 28902

SEQ ID NO: 68726 - DNA, 201 bp, Bos taurus; identical to SEQ ID NO: 28903

SEQ ID NO: 68727 - DNA, 201 bp, Bos taurus; identical to SEQ ID NO: 28904

SEQ ID NO: 68728 - DNA, 201 bp, Bos taurus; identical to SEQ ID NO: 28905

SEQ ID NO: 68729 - DNA, 201 bp, Bos taurus; identical to SEQ ID NO: 28906

SEQ ID NO: 68730 - DNA, 201 bp, Bos taurus; identical to SEQ ID NO: 28907

SEQ ID NO: 68731 - DNA, 201 bp, Bos taurus; identical to SEQ ID NO: 28908

SEQ ID NO: 68732 - DNA, 201 bp, Bos taurus; identical to SEQ ID NO: 28909

SEQ ID NO: 68733 - DNA, 201 bp, Bos taurus; identical to SEQ ID NO: 28910

SEQ ID NO: 68734 - DNA, 201 bp, Bos taurus
gtaaacggtgccgattcagtcatgacttctgtttctcagccttctgctttctcttctgtgctcattccctgctttccttcatacactcctgccttttcttgtatgctgtgtttctccatttaattattcttttctctgttttcagtctttcctgtttgctttgcctctcttcctccaaccctctttttttctatgtgtttc

SEQ ID NO: 68735 - DNA, 201 bp, Bos taurus; identical to SEQ ID NO: 28911

SEQ ID NO: 68736 - DNA, 201 bp, Bos taurus
atgtcatacttgagacattttgaaggacataccgttcctacagctaaagaacatgtcattaaatgagttcacgatagcagattcctattatctctagccacagtaccatatgttcactgatgggtcagtgaactgtcagagactgacagtgcctgaaccagtcatagttttcagtggtttacccatggtgaacctcacctg

SEQ ID NO: 68737 - DNA, 201 bp, Bos taurus
cgaagggccggcgtcccaggcctgggggcaggggcttgggagaccatggctggtgacatcgagccggagagcaggggccggcggctggggggcttggacctgggggtcctctacgccttccgcgtcctggctctgaatcatcgtacggctggccatccctctgaggtgaagacaccaggtgcctgggcttgcgtcgtggag

SEQ ID NO: 68738 - DNA, 201 bp, Bos taurus; identical to SEQ ID NO: 28915

SEQ ID NO: 68739 - DNA, 201 bp, Bos taurus
cctggagggtgggcacccgtgatctaagggacaccactgcaatgtgtggccctattctatactttcccagccctctgtgaattcagagtttttgattttatatcaacctgtcaatcaatctggcctcaaccaatcaactgatacattcttctgcacacctccagctatgaccctgaaccttttttctctctgcccttcaga

SEQ ID NO: 68740 - DNA, 201 bp, Bos taurus
ggtgggtgggcacccttcctgagatggatacaggccagccgggagatctagacaacctgttcctccctgagcagttacactcacaacatcacatgctgtatgttggccagttagtctgcaagatagcagaggccctggacttcaattgcccaggaggcctgtttgtggactgtgtggggagaaattttaaacatggtttca

SEQ ID NO: 68741 - DNA, 201 bp, Bos taurus
gcagacaagatcactgcttctctgtgcctttatatctgcaagacaaaggtattttgcatgcctctcaagttatctagcctacactaggtattaaaataaataaacttcctcaagcaattctacatgactcttctttgcacatttgaaaagcttcctgcatgtgtagcaccagaggagagtctcgctgaaaatccccagaga

SEQ ID NO: 68742 - DNA, 201 bp, Bos taurus; identical to SEQ ID NO: 28916

SEQ ID NO: 68743 - DNA, 201 bp, Bos taurus; identical to SEQ ID NO: 28917

SEQ ID NO: 68744 - DNA, 201 bp, Bos taurus
ctgcagctcccgacaggcagtgggccagtctggggactagtgacagggtgagtaatgctcgaggtcagagggcagctgctcctgggatcgagtctccttacatgaggaggccgcctcgctgtgatcacccagtggaataagttcccagagctgatggcaagataaagcacattaacaaaacgtgccctctttgattttatg

SEQ ID NO: 68745 - DNA, 201 bp, Bos taurus; identical to SEQ ID NO: 28919

SEQ ID NO: 68746 - DNA, 201 bp, Bos taurus; identical to SEQ ID NO: 28920

SEQ ID NO: 68747 - DNA, 201 bp, Bos taurus; identical to SEQ ID NO: 28921

SEQ ID NO: 68748 - DNA, 201 bp, Bos taurus
gtctggctctgtgtggccaggagcagaaccgagcttccctagtcagtagctgcaacaaggtcctgtcccaggaggcccagttccctggcaggtagtggcctcctggccacgcctgatgtcaagggagaatgatgcaccctcttaaatggatggggctgaactgggagaccaaacccttgtcagtcaagcaccaacagggca

SEQ ID NO: 68749 - DNA, 201 bp, Bos taurus; identical to SEQ ID NO: 28926

SEQ ID NO: 68750 - DNA, 201 bp, Bos taurus; identical to SEQ ID NO: 28928

SEQ ID NO: 68751 - DNA, 201 bp, Bos taurus
ctgccatcaggcctggctaggaggcagacacaggagaaagctgagtccaagtaccaggatggacaagtttaagatgttgcaggtggatggtgggataattttaggagtttcaggcagggaggccaaagcatctaaaccaagtaacaaggggcaactttagtgacttctggaaaactccagctggaattcatagatggacaa

SEQ ID NO: 68752 - DNA, 201 bp, Bos taurus; identical to SEQ ID NO: 28932

SEQ ID NO: 68753 - DNA, 201 bp, Bos taurus
aaactaagacagaaactaaaatcactcaaggccaaaaccctactcattccatcacatggggttgctgctgtcagtgacatggggacggcaggactctgataggaaagaggccattgagtcactggtgcaggaagggtcccatccttgatggacatcagagctggatggacagagtcagtataaagagagaatgaaaatgat

SEQ ID NO: 68754 - DNA, 201 bp, Bos taurus; identical to SEQ ID NO: 28934

SEQ ID NO: 68755 - DNA, 201 bp, Bos taurus; identical to SEQ ID NO: 28935

SEQ ID NO: 68756 - DNA, 201 bp, Bos taurus; identical to SEQ ID NO: 28937

SEQ ID NO: 68757 - DNA, 201 bp, Bos taurus; identical to SEQ ID NO: 28938

SEQ ID NO: 68758 - DNA, 201 bp, Bos taurus; identical to SEQ ID NO: 28939

SEQ ID NO: 68759 - DNA, 201 bp, Bos taurus; identical to SEQ ID NO: 28943

SEQ ID NO: 68760 - DNA, 201 bp, Bos taurus; identical to SEQ ID NO: 28945

SEQ ID NO: 68761 - DNA, 201 bp, Bos taurus; identical to SEQ ID NO: 28947

SEQ ID NO: 68762 - DNA, 201 bp, Bos taurus; identical to SEQ ID NO: 28950

SEQ ID NO: 68763 - DNA, 201 bp, Bos taurus; identical to SEQ ID NO: 28951

SEQ ID NO: 68764 - DNA, 201 bp, Bos taurus; identical to SEQ ID NO: 28952

SEQ ID NO: 68765 - DNA, 201 bp, Bos taurus; identical to SEQ ID NO: 28954

SEQ ID NO: 68766 - DNA, 201 bp, Bos taurus; identical to SEQ ID NO: 28959

SEQ ID NO: 68767 - DNA, 201 bp, Bos taurus; identical to SEQ ID NO: 28960

SEQ ID NO: 68768 - DNA, 201 bp, Bos taurus; identical to SEQ ID NO: 28961

SEQ ID NO: 68769 - DNA, 201 bp, Bos taurus; identical to SEQ ID NO: 28963

SEQ ID NO: 68770 - DNA, 201 bp, Bos taurus; identical to SEQ ID NO: 28964

SEQ ID NO: 68771 - DNA, 201 bp, Bos taurus; identical to SEQ ID NO: 28975

SEQ ID NO: 68772 - DNA, 201 bp, Bos taurus; identical to SEQ ID NO: 28977

SEQ ID NO: 68773 - DNA, 201 bp, Bos taurus; identical to SEQ ID NO: 28978

SEQ ID NO: 68774 - DNA, 201 bp, Bos taurus; identical to SEQ ID NO: 28979

SEQ ID NO: 68775 - DNA, 201 bp, Bos taurus; identical to SEQ ID NO: 28980

SEQ ID NO: 68776 - DNA, 201 bp, Bos taurus; identical to SEQ ID NO: 28981

SEQ ID NO: 68777 - DNA, 201 bp, Bos taurus; identical to SEQ ID NO: 28983

SEQ ID NO: 68778 - DNA, 201 bp, Bos taurus; identical to SEQ ID NO: 28985

SEQ ID NO: 68779 - DNA, 201 bp, Bos taurus; identical to SEQ ID NO: 28986

SEQ ID NO: 68780 - DNA, 201 bp, Bos taurus; identical to SEQ ID NO: 28987

SEQ ID NO: 68781 - DNA, 201 bp, Bos taurus; identical to SEQ ID NO: 28989

SEQ ID NO: 68782 - DNA, 201 bp, Bos taurus; identical to SEQ ID NO: 28990

SEQ ID NO: 68783 - DNA, 201 bp, Bos taurus; identical to SEQ ID NO: 28991

SEQ ID NO: 68784 - DNA, 201 bp, Bos taurus; identical to SEQ ID NO: 28992

SEQ ID NO: 68785 - DNA, 201 bp, Bos taurus; identical to SEQ ID NO: 28993

SEQ ID NO: 68786 - DNA, 201 bp, Bos taurus; identical to SEQ ID NO: 28994

SEQ ID NO: 68787 - DNA, 201 bp, Bos taurus; identical to SEQ ID NO: 28995

SEQ ID NO: 68788 - DNA, 201 bp, Bos taurus; identical to SEQ ID NO: 28996

SEQ ID NO: 68789 - DNA, 201 bp, Bos taurus; identical to SEQ ID NO: 28997

SEQ ID NO: 68790 - DNA, 201 bp, Bos taurus; identical to SEQ ID NO: 29000

SEQ ID NO: 68791 - DNA, 201 bp, Bos taurus; identical to SEQ ID NO: 29001

SEQ ID NO: 68792 - DNA, 201 bp, Bos taurus; identical to SEQ ID NO: 29004

SEQ ID NO: 68793 - DNA, 201 bp, Bos taurus; identical to SEQ ID NO: 29007

SEQ ID NO: 68794 - DNA, 201 bp, Bos taurus; identical to SEQ ID NO: 29009

SEQ ID NO: 68795 - DNA, 201 bp, Bos taurus; identical to SEQ ID NO: 29017

SEQ ID NO: 68796 - DNA, 201 bp, Bos taurus; identical to SEQ ID NO: 29027

SEQ ID NO: 68797 - DNA, 201 bp, Bos taurus; identical to SEQ ID NO: 29029

SEQ ID NO: 68798 - DNA, 201 bp, Bos taurus; identical to SEQ ID NO: 29030

SEQ ID NO: 68799 - DNA, 201 bp, Bos taurus; identical to SEQ ID NO: 29031

SEQ ID NO: 68800 - DNA, 201 bp, Bos taurus; identical to SEQ ID NO: 29032

SEQ ID NO: 68801 - DNA, 201 bp, Bos taurus; identical to SEQ ID NO: 29033

SEQ ID NO: 68802 - DNA, 201 bp, Bos taurus; identical to SEQ ID NO: 29034

SEQ ID NO: 68803 - DNA, 201 bp, Bos taurus; identical to SEQ ID NO: 29035

SEQ ID NO: 68804 - DNA, 201 bp, Bos taurus; identical to SEQ ID NO: 29038

SEQ ID NO: 68805 - DNA, 201 bp, Bos taurus; identical to SEQ ID NO: 29039

SEQ ID NO: 68806 - DNA, 201 bp, Bos taurus; identical to SEQ ID NO: 29040

SEQ ID NO: 68807 - DNA, 201 bp, Bos taurus; identical to SEQ ID NO: 29041

SEQ ID NO: 68808 - DNA, 201 bp, Bos taurus; identical to SEQ ID NO: 29044

SEQ ID NO: 68809 - DNA, 201 bp, Bos taurus
aggccagcacacggcatcactgttacgtcggagcccaaggatgaaacagacccgctgagttacaaaacacagacagacgcacagactggaaagcaaatgcatgctgcagtgcagtccagtgcaggccagttcaagccagtcgctcagtcgtgtccgactcttcatgaccccatgaatcgcagcacgcagggcctccctgtc

SEQ ID NO: 68810 - DNA, 201 bp, Bos taurus
tagcgtccacctccagagctcacggcccccacagccaggctgggcacaggaagagctcagagcctgaggtaggtgcaggggtgggtccgaggctcccaaagccccgccgtggccatgcagctgggcgggcagcccccattgcctcagcgaacttctgcgccagggagggacgtagcagctctatggcgaacccaggcccac

SEQ ID NO: 68811 - DNA, 201 bp, Bos taurus
aggacaaaatgctttaaactggagatatgtgatatttttaccttaggtttacagtaaaagtataatctttctcacaagtcaaaacttctgttcatgactaragggaaaaaaatgtacagtttgatatacagaattaattttgatcactgtttttaatatatgtagtacaactatttgaagaaatatgcattttctaaatca

SEQ ID NO: 68812 - DNA, 201 bp, Bos taurus; identical to SEQ ID NO: 29171

SEQ ID NO: 68813 - DNA, 201 bp, Bos taurus
gattatcaacaaaccatatcagctgagagattgatgtgcaagcagttcagtttatttttttaactataatatcacttcatgttaggttaggcagaaaactrgcagaaattcatcaaagttgagcatgctagctgagagcaattgctctgaaagcacgagagctgtactgaaaactggcgacagtgccaatccaaaatctca

SEQ ID NO: 68814 - DNA, 201 bp, Bos taurus; identical to SEQ ID NO: 29217

SEQ ID NO: 68815 - DNA, 201 bp, Bos taurus; identical to SEQ ID NO: 29218

SEQ ID NO: 68816 - DNA, 201 bp, Bos taurus; identical to SEQ ID NO: 29219

SEQ ID NO: 68817 - DNA, 201 bp, Bos taurus; identical to SEQ ID NO: 29220

SEQ ID NO: 68818 - DNA, 201 bp, Bos taurus; identical to SEQ ID NO: 29221

SEQ ID NO: 68819 - DNA, 201 bp, Bos taurus; identical to SEQ ID NO: 29222

SEQ ID NO: 68820 - DNA, 201 bp, Bos taurus; identical to SEQ ID NO: 29223

SEQ ID NO: 68821 - DNA, 201 bp, Bos taurus; identical to SEQ ID NO: 29224

SEQ ID NO: 68822 - DNA, 201 bp, Bos taurus; identical to SEQ ID NO: 29225

SEQ ID NO: 68823 - DNA, 201 bp, Bos taurus
acttggaagaaattgattttatttatgttttataaatgaacatttttactgtaacaaataggccttttctggggaggcttgttatggtcgaagtaatactktatgatggtagtttagccaatactgcagaaagacttagggaagaataattccatctgggttccaattgtgaggataattactacattaaaaaaagaataa

SEQ ID NO: 68824 - DNA, 201 bp, Bos taurus; identical to SEQ ID NO: 29226

SEQ ID NO: 68825 - DNA, 201 bp, Bos taurus; identical to SEQ ID NO: 29227

SEQ ID NO: 68826 - DNA, 201 bp, Bos taurus; identical to SEQ ID NO: 29228

SEQ ID NO: 68827 - DNA, 201 bp, Bos taurus; identical to SEQ ID NO: 29229

SEQ ID NO: 68828 - DNA, 201 bp, Bos taurus; identical to SEQ ID NO: 29230

SEQ ID NO: 68829 - DNA, 201 bp, Bos taurus; identical to SEQ ID NO: 29231

SEQ ID NO: 68830 - DNA, 201 bp, Bos taurus; identical to SEQ ID NO: 29232

SEQ ID NO: 68831 - DNA, 201 bp, Bos taurus; identical to SEQ ID NO: 29233

SEQ ID NO: 68832 - DNA, 201 bp, Bos taurus
aagactccttggagaagggaaaggctgcccactccagtattctggcctggagaattccatggactgtatagtccatggggttacaaagagttggacatgaytgagcaactatcactttagaaatgaaaattacaactttaagtttttttttcccattaaaaatatattataacttaaaaaaaattaagaccaatagtgagc

SEQ ID NO: 68833 - DNA, 201 bp, Bos taurus; identical to SEQ ID NO: 29234

SEQ ID NO: 68834 - DNA, 201 bp, Bos taurus; identical to SEQ ID NO: 29235

SEQ ID NO: 68835 - DNA, 201 bp, Bos taurus; identical to SEQ ID NO: 29236

SEQ ID NO: 68836 - DNA, 201 bp, Bos taurus; identical to SEQ ID NO: 29237

SEQ ID NO: 68837 - DNA, 201 bp, Bos taurus; identical to SEQ ID NO: 29238

SEQ ID NO: 68838 - DNA, 201 bp, Bos taurus; identical to SEQ ID NO: 29239

SEQ ID NO: 68839 - DNA, 201 bp, Bos taurus; identical to SEQ ID NO: 29240

SEQ ID NO: 68840 - DNA, 201 bp, Bos taurus; identical to SEQ ID NO: 29241

SEQ ID NO: 68841 - DNA, 201 bp, Bos taurus; identical to SEQ ID NO: 29242

SEQ ID NO: 68842 - DNA, 201 bp, Bos taurus; identical to SEQ ID NO: 29243

SEQ ID NO: 68843 - DNA, 201 bp, Bos taurus; identical to SEQ ID NO: 29244

SEQ ID NO: 68844 - DNA, 201 bp, Bos taurus
taattaccccaaaatcccatgtcaggttctccatgcctttgggctgggttttacaataatcttttatttttcaatcttgacctgttttgatccattctatktaataccatcaatgaatattcccaaatcatgaattttgcacagccaattatctactttgaaagaaagacaaaaagaataaaacttttctgcctatcttcc

SEQ ID NO: 68845 - DNA, 201 bp, Bos taurus; identical to SEQ ID NO: 29248

SEQ ID NO: 68846 - DNA, 201 bp, Bos taurus
caattcatgtagctatgtagaggtttactttgtaacagatgttcatggtagtttaagaagctgctatgcttgattacatatccacaatatgtatgtggatrtactacctacacttaggttatttggcaacaattttgaacttgaacaatttctattgaaaattcagttaattttaaaaaatccacccatgtaattatatcg

SEQ ID NO: 68847 - DNA, 201 bp, Bos taurus; identical to SEQ ID NO: 29249

SEQ ID NO: 68848 - DNA, 201 bp, Bos taurus
ttcctaatagagttattttggtccctttacagttttttggaaatatttaaaaagtaataaattaagagaaagtatattaaaaccaattttcatggcatatmttattattttctgttttttctgcatttcctttgaaggcatttagtagtgattacattcatatttcttaaaaatatttttaaaatgtgtgatatagtcaca

SEQ ID NO: 68849 - DNA, 201 bp, Bos taurus; identical to SEQ ID NO: 29250

SEQ ID NO: 68850 - DNA, 201 bp, Bos taurus
ggaaagttgtttcacactcttagctgatcacattttcttggccagggtatttccatattagattatagagctgtggtcctcaaactttagcaggtaccatmattacctccagggcctgttaaatctcaggttacaggggtctgaccccagtttttctgattgagtaggtctgggttggaaactaagaatgtatatgttaag

SEQ ID NO: 68851 - DNA, 201 bp, Bos taurus; identical to SEQ ID NO: 29251

SEQ ID NO: 68852 - DNA, 201 bp, Bos taurus; identical to SEQ ID NO: 29252

SEQ ID NO: 68853 - DNA, 201 bp, Bos taurus; identical to SEQ ID NO: 29253

SEQ ID NO: 68854 - DNA, 201 bp, Bos taurus
aaaatggtatctctaatacattctatagtactactctccaagtaagggatagaccataggagtgctaagctatgcaagtttaagttgggcaatctaaagcycctgagacaaaatataggaccatgtttagaatccaagtttctgggccccaatttagtctctattgcatgttttcattctactggaaattctcaaacttat

SEQ ID NO: 68855 - DNA, 201 bp, Bos taurus
taataatatatgaaattgagtagtcattgaatgaactataatgactatcacaaatacttttggaaccaataacaaaggacaataagatgtttgaggcatartggaatggctttcaaagagggctctgggcagttttagtaagatttatttttatactaatactgatgttacatgactacagtataataggctttataaatt

SEQ ID NO: 68856 - DNA, 201 bp, Bos taurus; identical to SEQ ID NO: 29255

SEQ ID NO: 68857 - DNA, 201 bp, Bos taurus
attagtaccaaaatatctaaataccataatatctaaaatggcaactgttttgcttcagatatactgttttccaaaaggattgtactgtacatagtactgtyatggaacatgaagaaacaagaaattaggaattttgttatgtattaagactgctgaataactgatgagattcttgactaaagattaataataataaaataa

SEQ ID NO: 68858 - DNA, 201 bp, Bos taurus; identical to SEQ ID NO: 29256

SEQ ID NO: 68859 - DNA, 201 bp, Bos taurus
gtttcattaaagtgattataataaataatttcagtaggctaactagtgattgaatcactcaatgacctgtatatgtgtctcaggaggtttaatcttaactrtatttagttgtacatttcttgtttgcacattcactcctggttttgaaaatgaattgtccatcataatttatatacaatacccaaacctggtctttctgtt

SEQ ID NO: 68860 - DNA, 201 bp, Bos taurus; identical to SEQ ID NO: 29257

SEQ ID NO: 68861 - DNA, 201 bp, Bos taurus
atccttacatctactctttctatttttgcctacactccctttctattgactcctactccttttctctaaaattgtatttgaaaattcatcagatgacttgmtctcagagtccctcacttgtaaaagcacaatttatttgtcagatctcatgtgaaagggaaaaatgagagtttggtagggaatctcacctattggtaatac

SEQ ID NO: 68862 - DNA, 201 bp, Bos taurus
aatattactgactccagtactcaagaacttttctatacctggcatttgttaggctatatgtcagatatttgacaaacatttccagacttcatctatatatytagcatccctctagatctttaaggatggcaaaatcagctctgactattgtgaaagcaagatcatacaaaagcttacatagaatagctgaaaatagcctgt

SEQ ID NO: 68863 - DNA, 201 bp, Bos taurus; identical to SEQ ID NO: 29261

SEQ ID NO: 68864 - DNA, 201 bp, Bos taurus
gaagcaatcactgtgttgaggagagtgtgataagagttttgcctgtctgatagtaagcacaccccatagctaggggaaaaagtggaaaggaggatactacrttggctgccacatgaggaccatagatttgtggaaggtaaggagtttactcaagaagtgaatgaggtagtgagatagagagctggctaggtaggtagacaa

SEQ ID NO: 68865 - DNA, 201 bp, Bos taurus; identical to SEQ ID NO: 29262

SEQ ID NO: 68866 - DNA, 201 bp, Bos taurus
tctgtagtcaggatatcagtactgagaaattaaagggtaacttggtcctcatgaaattgcgattgagagattcagaaagatgactttatagccttactagycagggcagaagctgctaatagatggggcttaacttctagaaaccctgattattgaaaatattatggtacttctgactgcataatcaaaatatattcatct

SEQ ID NO: 68867 - DNA, 201 bp, Bos taurus
atacagtccaggttatttctaaataaaatatatatttttttatttttgtcatcttttatatgccagtaacatgaaactatgctctagacacccctatatgwgctggaagagccacagacatattaataaatggttttaataaaccctggtattgttaaaaacatcagaaagaaaccttgtctttagacaatctaccaattg

SEQ ID NO: 68868 - DNA, 201 bp, Bos taurus
ttaattggatattgaataaaattgctgaaatgttttagggcacctatgcttcattcagtggttggcattctttcataaagggccaaaaaataaatcatttkgggagttaagtgataaaatagaggatagaatattggtacttatataatcttttgtagtgcatccatttaaaaatatgaaaaacattcttagcttgtgggc

SEQ ID NO: 68869 - DNA, 201 bp, Bos taurus; identical to SEQ ID NO: 29271

SEQ ID NO: 68870 - DNA, 201 bp, Bos taurus
ccacaactacagggttgtttcgtttcaagtcacggactctggataccaaccaaactggcagatgaaaaataactcagccggggccatttcacccaccagtratctctgtgtgtgagataattcctccctgaggtttctttctctcctccactgtgtttttaaaggcctaaggcagggcagcaggctggtgccactgtctaa

SEQ ID NO: 68871 - DNA, 201 bp, Bos taurus
gccattctcaacatcaataatgcaattggccctggaactgctaatgcacatgcagtgcagtgaagttttgcaaaggagaccagagccttgaagatgaggarcacaatggatggccattggatgttgacaataaccagttgcaagccatcactgaagctgttcctcttacaactaaatgagaagcttccaaagaactcaatg

SEQ ID NO: 68872 - DNA, 201 bp, Bos taurus
ggcgtgagtctgagtgaactccgggagttggtgatgcacagggaggcctggcatgctgcaattcatggggtcacaaagagtaggacacaactgagcggccraactgaacagaactgaagatagcctgctgcaactatttgaccatatgtgctgaacaagtcagatcactggctaaggtgctccttttcctctttagtgttt

SEQ ID NO: 68873 - DNA, 201 bp, Bos taurus; identical to SEQ ID NO: 29278

SEQ ID NO: 68874 - DNA, 201 bp, Bos taurus
attgtttcatcttttgcatgttttaaaaaaacttaattttacctttgtatttggaagatttttttttctttaagtatttgaaagaatttgcttaagtgtcktctcacattcattgtttctgatgagcattgtgctgtcatctttttttatagataatgtgtcacttttctctggctacttttaagacttttcttcatcatt

SEQ ID NO: 68875 - DNA, 201 bp, Bos taurus
aggcagtgtggtaatggcactaatggccacctctttcaaaggacttatgcgaggatgctgggcatctcaggactattgtagtcaatgtccttgaccatgtrgtaggccactgtggacccacacctccaccagcagctcccaagcacacacagacaagtctggctcaatattttgtggggtcactgctcctttttcctgggt

SEQ ID NO: 68876 - DNA, 201 bp, Bos taurus
aaaaacatgagtatctctcacacagatcatcacagaccatcaaattgggttttccaagtttccatttgccactagggacatacattgtaataaatatcatyggaaaacttaaaaagtgtttaccaatttgttaatcatgactgatctcaaatagcagcccctatatccctgcagaaatcctagtatcactaatcttcttag

SEQ ID NO: 68877 - DNA, 201 bp, Bos taurus; identical to SEQ ID NO: 29280

SEQ ID NO: 68878 - DNA, 201 bp, Bos taurus
gttagtattctgtgagaattgttctgcctgcagacgtatttttgacgtgtttgtgcagggaggtgagctgcatatcctcctattctgcaatctagattccytctcttcacaagaaattcttaaatactttaaatctgaaaatcaaacttgtatgtactccaggaatagaggcaagaatattctctgttatgattttttgag

SEQ ID NO: 68879 - DNA, 201 bp, Bos taurus; identical to SEQ ID NO: 29281

SEQ ID NO: 68880 - DNA, 201 bp, Bos taurus
aaaatgggagacattagaatgggccagtggctctgggagggatctaagaagtagggagtgtccacactggtagttccttgctctgcagaaaccctctcacycccagcttgctgggatgtctaggcccttgactctgtttttgaggtgtgttcacctgccaacttgctagcaatgagcgtggagagagaccaacactgacag

SEQ ID NO: 68881 - DNA, 201 bp, Bos taurus; identical to SEQ ID NO: 29282

SEQ ID NO: 68882 - DNA, 201 bp, Bos taurus; identical to SEQ ID NO: 29284

SEQ ID NO: 68883 - DNA, 201 bp, Bos taurus; identical to SEQ ID NO: 29285

SEQ ID NO: 68884 - DNA, 201 bp, Bos taurus
tgccctctctgaggtcacacagagttggacatgactgaagtaacttagcagcagcagcatatataaaggagtgtatgtgtgtgtatgtgaatgtgtgtgtrtgcatgtatatattttactaaaaacctacaggttaatatactgaagaaaaattttaaagtatcattctggattcttctttcatcaaaacaaggcccctct

SEQ ID NO: 68885 - DNA, 201 bp, Bos taurus
gtgaagttaaagtgctgggtgagtacacatttaacattgagagacagaataagaaagagccagcagattattagctcattcttctggcccagatggatgtkctgacctctcaccatggatgacaaatgtgaccaagaaaacagcaaactttcttatgaggccaggataaatttagcttggcagctcttttcatttgctttc

SEQ ID NO: 68886 - DNA, 201 bp, Bos taurus
tccacatacaatagctagagtatatcattcccagatgttgacccttcatcaaggatctggcattttcaaaatgctgctttcagagctttcctagtttatcyttttcattattgccatagatctaaaataagctgtactctcccatgtgagaaatctgagcttgcaactagagattatcgtactaagtaaggcaagtcagaa

SEQ ID NO: 68887 - DNA, 201 bp, Bos taurus; identical to SEQ ID NO: 29288

SEQ ID NO: 68888 - DNA, 201 bp, Bos taurus
tgcagttcactcactgtgacagtgctaccaatccagacctcagtcctcttttctcttggtgtctgtatatatttatgaaacctgacaaatactacttgtcrtatatagctttctaggaagtgtgcatttcctttcactctactgattttcttgagagaataagatatctctatcttcataatcttcccattaaccacaagg

SEQ ID NO: 68889 - DNA, 201 bp, Bos taurus; identical to SEQ ID NO: 29289

SEQ ID NO: 68890 - DNA, 201 bp, Bos taurus
agtatgtcatttttcttccctcagtgcaatgatggcatttaacagtaaccgttgtccttataattacctacaggaatgcaacacttataaaatcctggttyagcacaggtaagaatgttagtaattgagatactttagaatgccaggggattatcactacttactcactaccagcactgaattcttgttgccatttggcta

SEQ ID NO: 68891 - DNA, 201 bp, Bos taurus; identical to SEQ ID NO: 29292

SEQ ID NO: 68892 - DNA, 201 bp, Bos taurus; identical to SEQ ID NO: 29293

SEQ ID NO: 68893 - DNA, 201 bp, Bos taurus
cccattaggtcgagttattttcatttcataaatgagattgaaatacagaaagtttaaggtcatagtttgttatcttttacataaattcttaatgatatctratttctaacataaagttatttcagagagattgctgttatatcaaattaaaatgggatttgtttcattgagtttgtgctaaatatattttattatgattct

SEQ ID NO: 68894 - DNA, 201 bp, Bos taurus
gcccttcttaattcaaatgttactaaaatcttacaatctggttagtatcttactttggaaaccacagtctaaattaaacatctttggtagtaactaacttkcattgtcaataaggcacttctagttaaagagacatctttttggtcatatgtaatttccagtggaaagaaagaaagtactgaatattactgaagttaattg

SEQ ID NO: 68895 - DNA, 201 bp, Bos taurus; identical to SEQ ID NO: 29298

SEQ ID NO: 68896 - DNA, 201 bp, Bos taurus; identical to SEQ ID NO: 29299

SEQ ID NO: 68897 - DNA, 201 bp, Bos taurus; identical to SEQ ID NO: 29300

SEQ ID NO: 68898 - DNA, 201 bp, Bos taurus
ataattgaaaagccaaagaacaggtcgggtagtaaacataacaccaggtagttggaggggggaaataatctcatattcatggccaacaaagatgaatccgyttgctaaaatgaaagtgaaagattctcagtcgtttccgactctttgcgaccccaatggatccatggaattcttcaggccagaatactggagtgggtagcc

SEQ ID NO: 68899 - DNA, 201 bp, Bos taurus; identical to SEQ ID NO: 29301

SEQ ID NO: 68900 - DNA, 201 bp, Bos taurus; identical to SEQ ID NO: 29302

SEQ ID NO: 68901 - DNA, 201 bp, Bos taurus; identical to SEQ ID NO: 29303

SEQ ID NO: 68902 - DNA, 201 bp, Bos taurus
ttttttttgtaattgggaagagagattgggatcaactccaaacataacaactgggaatttatagcaaaggaacaaggaggccaggatggggggtgtgcaartcagtggatggaaaattactaagaggaaacataaggggtcgggggaacctggctaaatggacctaacagaattcttgctgaaggagggccaggtggtcag

SEQ ID NO: 68903 - DNA, 201 bp, Bos taurus
aactgccccggggaagacagaaagtgtttaaacgggacaagacttcataacatcgtagatctgagtgtggaagccaagtctggaagggaagtgtgggagayggtttttgatttctaagagcagagcaggaatcaggactctagcgaccactcctccccactcccccacagtgcttttgtttttggtcattaaacctgaggc

SEQ ID NO: 68904 - DNA, 201 bp, Bos taurus
gtaagtccacatactatttttatcaagaatattgcctgtagcataatatagcatgatattcaataacttataagtttaggaatatttgagtgtaacaaaamgcaatctcagagatcagccttggttgcattactattcctatcagtttttagtagaaggaagtagtaaaggaagtttttagtaggaggaaggcaaggagcc

SEQ ID NO: 68905 - DNA, 201 bp, Bos taurus; identical to SEQ ID NO: 29305

SEQ ID NO: 68906 - DNA, 201 bp, Bos taurus
ctagtctactatggatatacttgatcagagctgggatttattatagtaaaagtccacgcagtgctgaaagtccagattatgctcgaatgaatgtaactcaygtgaccttgctcccaaatgccctgggggctcaaaagcgctcctaggaggaaaacatgaattcaaaacagaaggctttataaggagagttacgaagacaac

SEQ ID NO: 68907 - DNA, 201 bp, Bos taurus; identical to SEQ ID NO: 29308

SEQ ID NO: 68908 - DNA, 201 bp, Bos taurus; identical to SEQ ID NO: 29309

SEQ ID NO: 68909 - DNA, 201 bp, Bos taurus; identical to SEQ ID NO: 29310

SEQ ID NO: 68910 - DNA, 201 bp, Bos taurus
cgaatagctgtgaatataagctttctggaattcagagacctacacctttatagatgtgagatatctagagaaatgtgacagtgtaattttatggatttccwatttttctctaaggaagttataggaaaggaggagagactgatagtatctagaaggatttctccatattagtgcatcaataatgatgagcatggggttttt

SEQ ID NO: 68911 - DNA, 201 bp, Bos taurus
aaaattcaagtccacctgtacaatgcagggactccattgtgctgtcatctcacagggagagtttagtggagatacatgagtccccagaggggcccccattraaacacatggctctcttacaagtaaacagtctgaatcatctatatcattttaatgaaactgtgaggaccaataatgcatagcctatcccaatgccatttc

SEQ ID NO: 68912 - DNA, 201 bp, Bos taurus; identical to SEQ ID NO: 29311

SEQ ID NO: 68913 - DNA, 201 bp, Bos taurus; identical to SEQ ID NO: 29312

SEQ ID NO: 68914 - DNA, 201 bp, Bos taurus; identical to SEQ ID NO: 29313

SEQ ID NO: 68915 - DNA, 201 bp, Bos taurus
ataactgctgagtttgctgatttttgaatctactccaagccttactcctcgagcatctgctgatggttggggtatctgaacgacgaaccagaaagattcayaattaatcttagttctagaaccaaaataggggctctatattttaaagtaatgaggaaaaaaaccctagacctttaaaggatttttaaatcttcatttata

SEQ ID NO: 68916 - DNA, 201 bp, Bos taurus; identical to SEQ ID NO: 29316

SEQ ID NO: 68917 - DNA, 201 bp, Bos taurus
ccctactgactcagaatcttttctaggctggggccagaaatctgcattttcaaccagcaccccaagggatacttatgtacattaaggtcctgggccagaartacagataatcacaatagctggttgagtagggagaacaagagtgggaagcaaatacccttccttggtggtgtctagctcgatactgtgagccccagttgc

SEQ ID NO: 68918 - DNA, 201 bp, Bos taurus
caaaccctgaccaaaagcaggttaatccaaaacacacagcatcctcagccaactcaagatcaacaaaacaaaattaggcctagggattagaggatgttaaytgtgaaacataatcccatgatatttatggctccagagactgaacacagctactcttgagcacagtgcagtactacttccactggggccattgcttatatt

SEQ ID NO: 68919 - DNA, 201 bp, Bos taurus
cccagccaagttatgaaatcctcgaagatcctgatgacctttcacccaactgaccatctgaattttcctgtactgtgagagaccctgatgaaaacagcatrtttggggtggccagctccctgcagggtgctgcgataagtcgtctgcatgcgctctctcactcacacctcagagtaatcccatgcaattgtactattttta

SEQ ID NO: 68920 - DNA, 201 bp, Bos taurus
attccagctaaatggttggggtagagaattagggaaggggcgggtggggagaggcaggaagtgaaggatgtggatggcctgggaggtgtgtgctgcttctmcagagtggatttctagtacctgtggcactaaatatagaagatcatgggtctggttgattcagaaaggtaatgtgccaagagggccttgatcttgacagca

SEQ ID NO: 68921 - DNA, 201 bp, Bos taurus
cctcacagctggtcccagcatcggcgttcctgagtctgtttcctgtgtctgctccatctctgctctgcgccctgaacctcctctccaaaccctgaactcasggcctgaacacacggccttgacacactcgaaggcctctgggtctaaaagtaactttcttgctatgatcctgtctttcattcttgacatcatctgcaccag

SEQ ID NO: 68922 - DNA, 201 bp, Bos taurus; identical to SEQ ID NO: 29320

SEQ ID NO: 68923 - DNA, 201 bp, Bos taurus
ctaacttggtggccatctactagctgggagggtaagctttggattctgtcaggttgtgtttaaatctgtggctttgtcatttattgaatttatgaggagaracaagtagcttgggcctcaggtttctcattatagtatcaggaggataataccactgcagtgctgctgctgctaagtcgcttcagccttactctgtgcaac

SEQ ID NO: 68924 - DNA, 201 bp, Bos taurus; identical to SEQ ID NO: 29321

SEQ ID NO: 68925 - DNA, 201 bp, Bos taurus; identical to SEQ ID NO: 29322

SEQ ID NO: 68926 - DNA, 201 bp, Bos taurus
tttcaccatttaatatcgttcacccttttgtttcctgaagacttaattttgttgggaaaataacttagattgactgacttaagctggagccacaaacttcrgtcactaaaggtagtttcttcttgtgctttgcagatcattaaaaagctgatagaaagaaaacaagcccagattcggaaagtctacccgggactttcctgt

SEQ ID NO: 68927 - DNA, 201 bp, Bos taurus
cattgcccatgtgaccagtaaaaagtgttctttggttatgttagtgctcatcagcctgagtgcccgcaggcggtttgaggatctgggccagtcagtaggtrtcttccaagtaggttttctgaacacaatcctccaactccatctctgcttttcttctaatcttaaaatctggcttgtgctggccaaatctggattagttca

SEQ ID NO: 68928 - DNA, 201 bp, Bos taurus
ttgttgcatctgttgttttaaatatggccaagagttctatgaagtgtcaggaggcatttcaaaggtggttctgtttgaccattgccatggccagcagcccygctgcagaaccccctgttgcagccatgctcctgcaggctctcttaggaaaagctgaccagtttttccagtgtcctgaagggatgtgtcccagtcattttc

SEQ ID NO: 68929 - DNA, 201 bp, Bos taurus
tttctttgatcttgcatttctgtagggggacacacatttcagatctgggttgctctctaatactgaagtgttgctaagagtatcttgcaccccctccctaratactatggaatttgaagtacaaagtaataaaaataatacagtgatgtgaaaagaagaattgctgtctttatagactagtggagttccatgctctttgcc

SEQ ID NO: 68930 - DNA, 201 bp, Bos taurus; identical to SEQ ID NO: 29324

SEQ ID NO: 68931 - DNA, 201 bp, Bos taurus
aagaggccactgtaaatctataaaccattcaccacacttaaattttattttcctgatcacaaagcatcaacacctccacttattcctatgttttctcttcyctagggtttaatccagttgggtgggccagatttacgctcatcaacacctcacaggcagacaataaggtgcaaatagagttcagcctctcttcaaccactg

SEQ ID NO: 68932 - DNA, 201 bp, Bos taurus
tgattgaatcactttgctgtatacctgaaactattaatagcacagcattgtaaatcaataataatccaataacatttaaaaaaaagacagatagtagacaytagatttaaccttgataaaaacaggattcttgcttctcaatatgaagaaaatagcccaattatcatctgttttttgtacatggatctcaagtgatacaac

SEQ ID NO: 68933 - DNA, 201 bp, Bos taurus
tttttttttttttctgtatgacttaagaaatttcacaaaggcctaatctgaagatataattacatcaagaatgctacagcataaacttcagcatgaaatcmaaggtaaggaaatgagagcctggcctgatccaggtttgtcccaggaggcccatttgctccgggggaatttagggatatattgggttggccaaaaagttca

SEQ ID NO: 68934 - DNA, 201 bp, Bos taurus
gaagtagtcggaataaagagggcattgagtaagaatacagttggaattcaatgccagccaaaaagaggaataaaagagccaaaggatacttcttgttattraaaagcctcattagatcatttgcttcaaagtaaagttcagttttgcacagtaagttggttcatgtggtgctcatgttcctccctctatactgatgaagga

SEQ ID NO: 68935 - DNA, 201 bp, Bos taurus
agtccttagcagccttgcctgaatttctcatctggcctcttatcaacttctattgattaaaaagtctgagaactctggttagtagtatcaccacccagggyagtaactactgaaggcccattaaccaaggtctgagaaaccccatagagagagcaacttcttacctgggaatcaatattttgtctcatcttgactaatgag

SEQ ID NO: 68936 - DNA, 201 bp, Bos taurus
ggaattatataggcatgaattgataagagtcctgctccaatttttcttttcttccatgatgtcaataaagtttgtaactgaaacccatctcacagaccttygactgccattttctcagcacaaatgttcctgctctattactctgctcttgcagaagagatgacgtgccactcacaggacaacttttacactgctatacct

SEQ ID NO: 68937 - DNA, 201 bp, Bos taurus
cataagtaagtatatcaagttttcttttttagaaactaaagaaaatcttgaaagacttctgtattttatttaactttgccactgattagttctgtcatagktcattatgaaatcagggcaagaactcttatgataggcagccaaggatgtcaactgactaaaaggtaaggtactgcttttattttagaagataattttaat

SEQ ID NO: 68938 - DNA, 201 bp, Bos taurus
tgtcccactctttgcaaccccatggactgcagcataccaactgccctgtccatcaccaactcctgaaccttgctcaaactcgaataaatcgaattagtgaygccctccagtcatctcatcctctgttgtccccttctcctcctgccttcaatctttcccagcatcagggcctttaccattgagtcagctcttcgcattgga

SEQ ID NO: 68939 - DNA, 201 bp, Bos taurus
actgcatgcaggctttctctacttgcagagagtggggggccactctctagctgcagtacatgggcttttcattgtggtggatcctcttgtggagcttgggytttaggtgagtggccttcagtagctgctgcacatgagcttagtgattgtggcgcatgggcttcgctgccctgagccatgcgggatcttcctggaccaagg

SEQ ID NO: 68940 - DNA, 201 bp, Bos taurus
cagcagacgagcaggaaagctttgtagtggaaaaaaagggaaggctgctggcatgtcctgattggaccatatcggcatgaggaagctgtctacaagctaaytaaaagggagccatcctgtgtcactggttaggggtgcctatgtggctttctctggtgggtcctaagttggaagcaggtataaaaattacggaagctataa

SEQ ID NO: 68941 - DNA, 201 bp, Bos taurus
gattgtgtttattttgtatttttgtattgtatatgaattcttttttaatgtgacagttaaacacatcttttaaagcatagacacacatagaaaaaacatayggtataatgatttccttgaagactacaatgttagatttggaggcagcttcagactgattggtggtaactacttgctgagctctttaaataagtaataact

SEQ ID NO: 68942 - DNA, 201 bp, Bos taurus
tgccatctatagggtcgcacagagtcggacatgactaactcgacttagcagctgcagccctttataaacagtaatactgtggctcatactaatgacacccyactctatgaacatgagccctgaccatgccttggtcagtggaatatgaacggacatgatgaatgtcatgtgttatcagaagctttaattccctgtcccctc

SEQ ID NO: 68943 - DNA, 201 bp, Bos taurus
tgtgacccaggtagatggccactgctcttaggtcacagagacgggttggggagaggttcaccgctgcctgaaggcccaggccaaagccagtgggtggccawggaaggggttctggagtcctgcaggacagagccccaagcctattccctgagtcccccagtttatccactggcctaaggcgagggagagggctgggatctg

SEQ ID NO: 68944 - DNA, 201 bp, Bos taurus
tacagagggtagggagagcatctattttggaattacataagtctgggttcatgtcatggttttactacttaatccctttttggccttgagcaaattacttragctcttagaatcttggtatccttatttataaaatggggaaaataacatcgcctccatggccagttgagagcatttgaaaagagctgcacattttctact

SEQ ID NO: 68945 - DNA, 201 bp, Bos taurus
ctaggacttctctaacggttgtgctctcacctccgacctccagtggatgatcctgtaagttattcaggtggcagaatcaaggccttatgaccctcaggggygaccactttccactctaattttggtatttccaccttctctgtctcactatccctggccccctattcctgtccctgaatcactttccaaataaactgtggc

SEQ ID NO: 68946 - DNA, 201 bp, Bos taurus
tatatattttagacattaatctcttaccagatatatggttttctcccattccacaagttgctttttcactctgttgattgtttcctttgctgtgcagaagmtttttagtttgatgtttcccttgtctatttttacttttgttacctgggcttttagtgtcataccgatgaaatcactgcatttgttacccatgattttaat

SEQ ID NO: 68947 - DNA, 201 bp, Bos taurus
ttctccactggctctttctagccttgtcagtctccgtttgatatccctccagtttgtccctttgcttgtatcccaggttctaattgctttgggcagatttmtcaaatgcaatgtgttcctttatttgtcgtgcattttcatcttgttctttctgctttactttgttttttttcttaatctacatgtcatcctcctaatgac

SEQ ID NO: 68948 - DNA, 201 bp, Bos taurus
caagcctgtggtgggggcagcactggcactagaaaggttgattgaccagatggccagggaatccctggtattaaaagataaaaactataaaagatgtggakctgtactacatatctgttagtcactcagtcatgttcgactctgcaatcccatgggctgtagcccagtaaactcctctgtccatagagttctccatgcaaa

SEQ ID NO: 68949 - DNA, 201 bp, Bos taurus
ggcaaattgagtttcaggcaaattgaaaggtatctaaattctttcagatcaccttggtaccgattagtgtcctggtgtgttaatttgccaaatggacaccyagggaaaagaaataattaagtcaataaagaaagtaagtaaacgcttacttatacataagaacatcctatactggtatgagctctttgatttgttgtatgg

SEQ ID NO: 68950 - DNA, 201 bp, Bos taurus
cttgctgcactcctcagagtcataacacactggctgcctcaaatagaaacccatgctctagtttggctccatggaaccaaatcattgcaacaggcagggayagccacttccctgaaagaagggaggatggaagctacaaaacaagagaaatgatttgggagacagcactaattggcacaattcaaatatctacccacctag

SEQ ID NO: 68951 - DNA, 201 bp, Bos taurus
tcattgaattgtgtaatcattggttcttgtgtaggaagtgttaagaatcagggtatctctattttccaaagtcttctgtaggctgtatccctatgagagtkagttggaaaatgaagatacccagaatatctgttacaaagactgtcctcatgcttgctctatttggcaaggttctgtacaggaaacctcccttaatggcgt

SEQ ID NO: 68952 - DNA, 201 bp, Bos taurus
atattatacatttatatatatttacctgacatatatatttatcagggtccttaagatcaaagtgtcatctgtctatgtagacaaacagacaaataggtcarattagagtaacttcagaaatacatagggaataaatcacattggtgcccaggttatagtgaaacagaaacaattgtatactacttgtttctgtgtgggcag

SEQ ID NO: 68953 - DNA, 201 bp, Bos taurus
aacactgaagtggacttaaatccccactgagggccaacagtctgaccatttaccagcagatttattagagctgtggagacagtttagcctggcaaattctrggcttgctataagtaccacatgtttcttggaagttttcgtgaattgatactgtgactgaacctcttagccataatttcagtgtccagtctcctcttcaca

SEQ ID NO: 68954 - DNA, 201 bp, Bos taurus
accattctgagtctgctttcgttaccttgtttagtctgagttttacccataaggtgactgtcatccttcaatgtataattatgtttctttgagacagaagytgtgtgagtttatcttgatctttcaagagctagtttacttttcatggttcacaccgtgcttcctggctgaccatcccaatagtgggtattagatgatagc

SEQ ID NO: 68955 - DNA, 201 bp, Bos taurus
ctcgtgaataatatatcttcaaagagatatttgtcagaagcagaatacatacttacttaccaagagtaggttaaacagaaatggtagctttggcctatccygtgccatataatcagatcagaacagatcagatcagtcgctcagttgtgtccgactctttgcgaccccatgaatcacagcacgccaggcctccctgtccat

SEQ ID NO: 68956 - DNA, 201 bp, Bos taurus
ggtgaaataaagttatgtgatgttgcttgatatatggatgagtgggaagctctaaaagatgggtttggaaagagggtatatggccatattttgtaagtgaygatttgagggcatgaaaagtcataaggagcttatttctccaggttaaatcacaattttacaattggccatttggcagtagacattgctacctagtcataa

SEQ ID NO: 68957 - DNA, 201 bp, Bos taurus
tttttttatgattcccactcactggttttagaatttaaaaaatatctttcccaaatgattgccattcaagcatctgtccaagcttatcaagttcttctcayggtatatatattcacattttttcttcactgcatggcttagtttcaagatactattctcacagacatcctaattttttaagggcttgtgccaagcttgagc

SEQ ID NO: 68958 - DNA, 201 bp, Bos taurus
ataactgagcctttgacattttcatactttctcttaaaatcacaaacacttccctgggacaaaggaagatcacaatatgtgggtaaaaaaaacattggaaygtgtacaaaaccactaaagagattacttttaagctcttgactctttaaggtactgcttatgattttgttattttgtttttcttggtttcatggaagacat

SEQ ID NO: 68959 - DNA, 201 bp, Bos taurus
acatgcctcttagagccatgtagccagaccgacccagcagcccttgttccccatgccaactttctgtctatcaccaccccaagatgagcaaaagtattacktgaagttctctcagtgagagtacaacctcactcagtgctggagagggatggagagaatgctcttacctgatccttcatgggatgcttgtagtaggtgtct

SEQ ID NO: 68960 - DNA, 201 bp, Bos taurus
atttgactgagttactgaacagcaacaacaatgtgtggtcaaattatagtaagaaatcatataagctagttccagaatggtttgagcgtatttactttcayaccttcattgataaaacatgtgaaagatcagaaccaagaggacctataatttatggagggctcacatataaaaataaattgatcacaggttaaaaaatgg

SEQ ID NO: 68961 - DNA, 201 bp, Bos taurus
ctcttattctttctctgactctttttgtccttttcattgtcattcccttttatgtaccaaccaacatcatatatctggctttctatctttcagcttatttrtagttaagatcaagaggcatatgtagtattgagttttgcttgcctgtttccaatcaatttatattatgataatttttcaacatattatttgttataaaca

SEQ ID NO: 68962 - DNA, 201 bp, Bos taurus
aattttgtcgatctgtaatgattcatttatgtttaagtcatccaaagttttaagcaaatatatcaaagtaattttagtagcagtaaagtattttggatagrtatgtttgtcctgtgtttcaaacagtatactaatccctacaaaaaggttccatgatataatacattcagctgattttcaaagagcagtttatgaaactac

SEQ ID NO: 68963 - DNA, 201 bp, Bos taurus
gcaggccataattttcagtttcatctttcactatagcaggacatatgaaaaggatttcctcccttcggcaagctctacctttcaggaaactattgtctcargtggcctgtgtctgctgctgctttttaaattttgttacaagctctttgaccctaaattgagccactggttcctgaacatacttctacatctgaatcactt

SEQ ID NO: 68964 - DNA, 201 bp, Bos taurus
gtcccagctccacataagtgagccccatactcaaaccagagcttatattagctgttttgtcccattcacatccattggcaacttcccttttgtagcacccyacacttttcctagataaagcctttctacaccttgagagtttgagtctgtcctttctctttcaaactaaacctgcagcttctacttggaaatccaagagaa

SEQ ID NO: 68965 - DNA, 201 bp, Bos taurus
caaactgaagttgtgggctgtgcatgagcagacatgtgtggaaccacatcctcaaggccaggggtaagagcctcaccttcaagcagctggccctggactcscccaagggcttcagcatcatcctgctctctggtcctcacaaaagcagggaggtatacaggcatttccttaaggcccggggagcagcatggccacaccaaa

SEQ ID NO: 68966 - DNA, 201 bp, Bos taurus
aatctacataataccttatcagctcacttagttttccaaaaataaacatcacagttaataataataatgatactatttgcctattttattttcttaatatytgccctgatgcttcaaaagcaaaagtgggtgaaactgctgatgcctaagcataaaatgaagcaataacatcaaataatattagtagtcattatattcttc

SEQ ID NO: 68967 - DNA, 201 bp, Bos taurus
aacacaagttctaaatattagatatgacttttcttgcaggctcaccattttttaagtccagaatcagataattgattttgttttcatgtttacatatactytttaactgtggtaactaaaggttcttaacagtgtagttgctacggtggccaaagttcacagatcagcctctatggcaatgcatcgaatcaggtttctgct

SEQ ID NO: 68968 - DNA, 201 bp, Bos taurus
ttaaaaaaaacctctcccacagagtgtgtaagagacgtacagaaacattttactatatgactcttattcttcaatattccttattaattgcatgcttctcrtagtataatctttcctataaggtgactttcgtagataatttgactcttgatcttttgtgacatatttttaattaggaaaaatttcaagatcttcagtgat

SEQ ID NO: 68969 - DNA, 201 bp, Bos taurus
tatttttgaattgaatcaatgaagaaaagaaagttttatggtatcctttaaggaagaaattcaaataaagtgtgcttcccactgaagcacagaaaaccatraggatgttctcttttttttttctttaaacaacatcaaatcattctcactaggaaagggggacttctaaaaggtcacggaatgcattgaagataagcagtg

SEQ ID NO: 68970 - DNA, 201 bp, Bos taurus
tctattagctctcagtgagccaaaaagtcatgagtcctgtccaagtttccatccagggataggggactcaaaaagaaggctcttttcttctgggatgtctrgttctttagactgaaagtcattgaacggacactacagcaaccaaacaattgctgatttagccccattattatttgtatacctaggcttaacaaaggaaaa

SEQ ID NO: 68971 - DNA, 201 bp, Bos taurus
ttctttcaatgataagctcttatctggcgttaacaggtatgttgataaaaacttcaaattacatacaaatttctagaaaaacaaaatatacataaaaccaygaaccccaacctgaaactataaaccgagtaacgtcctttggacatccatggataattctaaaagaaatccctgatatgatctgactcactgggaaattgg

SEQ ID NO: 68972 - DNA, 201 bp, Bos taurus
aagggagtaattagaaaatgggataaagcagaatattcacatcctaaaacaactgataaagtaaataggagcgagttaactaggtaaaaagggccaagaayggctttgtggaggaagacaggagggtggagggtatgagacttgaatccatctggctgggtgaagtggaggggaggcctgtctagccatggggttctcctg

SEQ ID NO: 68973 - DNA, 201 bp, Bos taurus
tttttttacatttaaagaaatgccaatgactgccaagggccccattcccagttatttggtttggttatttagggacggggcctggtaatcagtatttttartgctcttggatgattgtgatatgtagtctagcttgagaatcaccaatgtgatagttacagtggttataaactgtaaaatgaatcaaatattccagtatgg

SEQ ID NO: 68974 - DNA, 201 bp, Bos taurus
ccctcccactgccttgttaagcatgacccattattctagacggatgttttgtctcaggaactttccatcatttggacaagctttctctggacaaacaaaayttctagtctacaactacctatcctgtcctgctttcaccttttatctttcaaagggatttgcctcaatacatttcttgcatgtcttattccatatcggtgt

SEQ ID NO: 68975 - DNA, 201 bp, Bos taurus
tctcagtacctcagcagtagggcctgttgaggccaccaacaccacacagggtaggcccttaagcaataatttagacttgttatgatgacaaacagaaggaygaaacaatgtcttctcagttcagttcagtcgctcagtcatgtccaactctttgcaaccccatggagggcagcatgccaggcctccctgtccatcaacagt

SEQ ID NO: 68976 - DNA, 201 bp, Bos taurus
atctcaaaaaacctcaactatgtaaataaaatccacttcaaccccaaaaccattcttgcaaacaagccaaaatcaaagcaaggataggagacaaatgatamctacctccttccattgtattcaaagcattttcctacattatcaaatattattactatgagatttgaatcttcttttatattaacagaactcctggaaatt

SEQ ID NO: 68977 - DNA, 201 bp, Bos taurus
agtataagcaaaaggtcaaacagggaaggtgccagctccctcactgaaccacttttccccaaggatcagccccatgtcagggcctgggggataagaccagrtggagaatcatctcactgccaaccgagtccaagataaaaggctcttcaggtttttatgtacctgagggccaggaagaagagggagagggaagggttagaa

SEQ ID NO: 68978 - DNA, 201 bp, Bos taurus
ccagggaactagatctcatatgcctcaactaagagtttgcatgccacaactgagacccagagtagcatgccacaactgagacccagagtagccaaataaayaattttttttttaagagtgtgtccaaaagtcagtttctccatgaggctttccctgaccacctacttaaaatagaaaatttcccccagcatttcctatact

SEQ ID NO: 68979 - DNA, 201 bp, Bos taurus
aataacaaaaaaggagttagtctggtatcatcaaaagaatctttaaaaagtgttgacagtgtcagctgggagtaaaatggactaaataactgagtccaagkttagcaattatggtcagggtgctactataatggaatttcttattataaattaaaaagaatatagaatttttatcatagtagaataaccactctgacactt

SEQ ID NO: 68980 - DNA, 201 bp, Bos taurus
agctttaattacacctctccaacatatagacacaaactaaaatctacatcaatatccagtgactgccattcttaccagacatgctttaattatggaaatgrtcattcttgttgccagcatgtaaacttttttgttcagtatagccaccacctgaaacttccattgtgtcatattttctgaaatatctttttatagccacta

SEQ ID NO: 68981 - DNA, 201 bp, Bos taurus
atctgcttttagggtttgcgctcctgacagcaccctcagtctgcacatgtccaggtatccttttacattcccatgtacaaatgtcatattaatttataacrtaagagtgtagacacagaagtagtatgtttgggattagtgagagtagaaatgctgttctggaaatgccttacatccttgcaagagtatatatggcaagag

SEQ ID NO: 68982 - DNA, 201 bp, Bos taurus
gcatatgtaatagggagaggcacggagattggtgacttgtatcacaagtgagtgctcatcccactgagtgacttcatatatggacgggatccttggaggcygcatgcagttagtttttgaaaagtgtatgtcatcttatgaaatagttttattttaaatctaaaacatttgattcttacaaagcattcgttttacttaata

SEQ ID NO: 68983 - DNA, 201 bp, Bos taurus
agatttggagcaggggagtgcagtggtgagagcagcctttgaagagattcgcttgctggctgtgggggtggcagactgcaagggatccagttggttgtgayaactgagtctgtatcagagggaaaggaagggagtcagcaaccactccagccctgaacttgagtgtgtaggagaagggcttccagaagtttgccctgattg

SEQ ID NO: 68984 - DNA, 201 bp, Bos taurus
aaaaccaagatcacacaccttgtcaggacagcagatggccgggtgtcaccagcaggaggcactttgggtaagaaaaggaagtgcttagacagaaaggaccrgagcaagcaaggggccaccatggcctcagtggccagaaagtgactctaagccaactgtgagtcctccccgaaaagtaggtctgctctgtgggttctctct

SEQ ID NO: 68985 - DNA, 201 bp, Bos taurus
acgtctttcatgcggggaatggactgggttgactgatctctagaggctgaatgtcttgctggtggggcacaagctgtccaacacagtcaccaaacaaagcrtgtgacaagcacagagagatggaatacatttatggtgttcatgtagggttccctagagtcacatcaagtctcagtctccctaaaaagattgggaaccaaa

SEQ ID NO: 68986 - DNA, 201 bp, Bos taurus
ctatagggaccttcacaagtccacccatttcatgagttggaattttaaatgagtttgcaacagtgggttttgacactgaaatgaaacagattgaaaaccayggccccagattgttggggcctgtacaagtccccccgctaatataaggggccctaagagcacttgtctctgctcatcccgttggaagttttaatttttcag

SEQ ID NO: 68987 - DNA, 201 bp, Bos taurus
catgttggttcttgtggctacaatgtgccaagaagtgttagaaacagaggtctaatttcctgagatgtgtgtcttctgttgttttctgccagaaagtatgytgttttcctgccaaaacaacaagaccatctgaagacacagagagaacaactcccactgagggtggcagcaaaaaaagaaatgccaaagtgaagacaggga

SEQ ID NO: 68988 - DNA, 201 bp, Bos taurus
gagaacagaatatgaaataacaaacaagtccatagtagttaaatgaacaaaatctgaaattgccaaaggattttttgtcccaatgactttaacatcaaaaracactcacaattcattctgaggtttctagtaacccaccacactcttatagtaaagattttaatcaacaggataagggcaatttctactggacacaaaata

SEQ ID NO: 68989 - DNA, 201 bp, Bos taurus
ccccaacccgccaccgcccatttcccacctcagcgtgctctatcagctggtttgtgctggagaaggcaccaattcctggatttagttttcttccagacacrtagacaaaaccaacgttgtatgaatattttgatcagtaactggggatcctgggcagctgctccctgctgtggtcagtaactaagtatacattgtatagta

SEQ ID NO: 68990 - DNA, 201 bp, Bos taurus
cctgggcctctctgtcagcctaatatgctttcgaaaatgctttggtttctactgtaccactgagtattggcatttctggcattataattcaagaaaagatraagtaaacaattcaagataaagttcagcataatgtatacgcctatgagagtgaacagagtcaatttatcccaccaagaaatatgtaaggcagcaacagaa

SEQ ID NO: 68991 - DNA, 201 bp, Bos taurus
accttctgatctgaatgagaagagcaaatcctgagaagacatgtatacaagcattctgggcagaaaaatgaagagtgcagaggccctgaagcaggagcackcttagcaagttggaggtcctgccaaagacaagtgcggactgagcagaactagttggagatagcgtgtgggaagagagggctgcagtacaggagcctagag

SEQ ID NO: 68992 - DNA, 201 bp, Bos taurus
cacaggggccagagggaaactggagaaagccaggggatgggttggactcccctggaaggatggggcagacctggcagaacacacagatgttgcctttgagytcctgcagttggttatgtaaccgccggcactccatctcaagcccatggagatgttcttcccactcagccagtgagccctcccagactgcagccttctggc

SEQ ID NO: 68993 - DNA, 201 bp, Bos taurus
atatacacatagttataccacagatctccagagcttttccatcttacatgactgaaactctatacccattgaacagaaactccggatttttttcctccccrtcagccccttgcaaatattctactgtctgcttctaagagcttatataggacaattttcatagaagaaatagagaaagttatcaaaggacaacttcacaga

SEQ ID NO: 68994 - DNA, 201 bp, Bos taurus
tgtattttattttgtcttcatatgacctcacttgggaggagatccctagattttcttctgagagatgggaaatccttgttgttcaatcgctaagttgtatycgactctttgcgaccccacggactgcaacacaccaggcttccctgtccttcactatctcttggagtttgctcaaactcacgagtcagtgatgccatccaa

SEQ ID NO: 68995 - DNA, 201 bp, Bos taurus
ctgacctcaagtaacctcactcattaatgctactaatacatgatatgaaaacatctgaggaactgagacagtgggcttttatagaaaactatattcagtarccggacattttcaggaacacatagaacagttatgaaaattattgaccacattctaagccataaactaagccttggtatatgtcaaaaaagcagaattaca

SEQ ID NO: 68996 - DNA, 201 bp, Bos taurus
aaaaatcctaataaatcagagaaaaataattgattttctgctatagtatctgcattttaatgtttcatgatccaaaataaatcacacatttttaattactkgatgtgaccttagcattttaatttcttcagtcagtataaaaaggtatgctagctgttatcacactagctttgttgaaatatatttctgcctagaagaatg

SEQ ID NO: 68997 - DNA, 201 bp, Bos taurus
atatattttcaagttgtttttctgagaattatactcttgcccaaatgtttggattgctcatggcggtgctttcatttgaactctctcccagcttcctcctyatgtcctgcagagtagtaagcagccacgtttgactaagcaaactgctacgttcaacatgagcctctactgccctccagtgttcactacaagtgatccgtg

SEQ ID NO: 68998 - DNA, 201 bp, Bos taurus
tgggtggaggtgttgctgcttaatgggtcacaatgttggcagttactcagtgagaaagaacagaactctaaggaatttataaaaatgatgacaaagcccayaggcttgcagtctaaggatttcctggttggttgtaagttcctccaggtgggatctgaagctcattataaatccattaattgtttaaaaataaattctttt

SEQ ID NO: 68999 - DNA, 201 bp, Bos taurus
ccaaacccattagcagtccaatcagtgtaaaactgactcctttaccagttactatggtaagattttgttctcaggtagtaactctttgagaatctcaaatmacttcacaaaaccaaatgctattaccagcttattttcaataggctgaatgccaccaaaggcttagtacagtggttataaggaatatagtattctctcctc

SEQ ID NO: 69000 - DNA, 201 bp, Bos taurus
cctctctcctatttatttctactctcctgaaatactcttgctactttgcatcatttactgattcatttatttacttatctaacaaacactatgaccatctstctctggcctagtcaaggcagaaatacaaagaggactgagacgtagtcccttctccatagagcgttacattcaggaaaagtgataaatatccactgtatt

SEQ ID NO: 69001 - DNA, 201 bp, Bos taurus
cctgttcttattttgtaggtaaaaaaaaaaagtgcacagaactgtggtgacatatctcactttaaattttgtaaccagtaatctctcacatgggcctttgrctttgccaaggtcaactatatttctctaatcctttccttccatcactcttctagagaggcatttagtactctcccctttcacaaacctcacatagctcct

SEQ ID NO: 69002 - DNA, 201 bp, Bos taurus
gcgttcaagaaaatgcattgaggatgcctgaatgtcaaggttggtacaagacagtggcttaacctctttcagtcagtgctagtttttcttaagtgggcagrggagccctcaaaagaccaggaaccccattattgagaagtcctatgagctgctggggcttccctggtggctcagtgataaacaattcacctcccagtgcag

SEQ ID NO: 69003 - DNA, 201 bp, Bos taurus
atgtagatcacaaattgttagaggttgggtagtgggcaactttgggacagataaaagaagtagtggactgtaagggcaaaaggaggccattagatgctagyattttgtttattttatttttttttattttcaggtggcaccacacagcttgtgggattttaattccccaaccagggattgaacccaggcctgggccactgc

SEQ ID NO: 69004 - DNA, 201 bp, Bos taurus
tgttttgaagaggccagtagactgagatggggactgttttgggggcagcccttgacaaatgatgactgagaacccaaccagatgtttcagcagacgcctaygtggccagatgacagcaagcacaagatgcctcagcctgatgtctggggactgtatgaagcctctaataaactggatgcttttcctagagaactcaaaata

SEQ ID NO: 69005 - DNA, 201 bp, Bos taurus
tttcagataattttggaaagcatgccaggttttgtgtctagaaaatacagaatgtccttagggtattaatctagagagactaagtcagggcatgtagatayggccctgatgacagatgatggcagaaagtctcctgacatctctacagattgctgtcacttttttagtttctgttgtttgctaggtgggttattgttaatc

SEQ ID NO: 69006 - DNA, 201 bp, Bos taurus
cttttgaaaatgacttaaaggttaaaataatactgattgggatagctccataagggagagaaaattcacctttcaaagtattaaaacttttcaaagagctktagctaaattcaagactaagccagagatacaaaatagaagttctctcagcccagttattaccttttgctgatgctttctcggcggtcatgatgtgtatgc

SEQ ID NO: 69007 - DNA, 201 bp, Bos taurus
tcatatatataaaatgtggagaatccttgaagacaaataaaagtacatactcatccttagaaagacctagcaaaagatgtaatgccttcacccataatccktagcaaagtctgttctaaaaataaaaatttgaagatatactgaagtgtataataagatgcaaagaataagttagtcttcaaaagataaacatttgttttt

SEQ ID NO: 69008 - DNA, 201 bp, Bos taurus
ctctgggagtactgaaaaatgagagaacataataactgagctgaaattttaggaatgagttatagttaataggcaactgtgaacatgggaaaaacgtaacrtaggaggaaggcataagatgtgcaaaggactaatggcaagagagagcatgacttacaggaggaaatgtgaaaaggctgatttcctgaagagcaggaagga

SEQ ID NO: 69009 - DNA, 201 bp, Bos taurus
aaagtcaagtaaaaagtaattcattttgttgaaagaaacattctttatggtatatggtagggcatttataatctattgtatggaatattgatttcactgckagagataccctgcaataagacttagcaaaactggatgactgattataaatggtgcacaaagatgagggaggattcaaaaaaaaatgtctagttaggaatg

SEQ ID NO: 69010 - DNA, 201 bp, Bos taurus
agaggtcaccaccactgcccttttgagttgagactgtgatggtgatgtaaccccactttcttgagactacgcagtagatacgtagggattagaggataaarggtgggggaataagaggaacttcttatttctgaaaatgtgtttgaccacacgtgaacaaaaatgaatggatactatgttttaaacaaatgtacagaaacc

SEQ ID NO: 69011 - DNA, 201 bp, Bos taurus
ggagcctggcagggtacagtccatgggattgcaagagtcagacatgacttagcgactaaaccaccagtattcctcgccttgttggcctgataattggcacrgcagtacacatggaatttgggttaggctgttcttcacactgtatatctggtcatgtgcttcagtgtttccactccacttactgaataaagttccaagtcc

SEQ ID NO: 69012 - DNA, 201 bp, Bos taurus
attattttctgaagaattcagacatttttgtcctaagactttttcaaactggatgttgtagatttcattcccatggcaacatttagcacatttctccagcytcttgatttcccataaactgataattagttttagagacttcagcagattcaggttcaatttttagaaagaatagtatctaaggctatatttatttaaata

SEQ ID NO: 69013 - DNA, 201 bp, Bos taurus
gactttatagacccccagaggctggccaggcccccagaagcttaagaaatttcaagacccactccttttcttaaagtgctgcttgacttgctggcaataaytggtgtatttgcaggccagcatgtagttcagttagggtccaggcagggtcagaatccagtcagaggcctgctcttccacttctgaaccctgaacaagact

SEQ ID NO: 69014 - DNA, 201 bp, Bos taurus
accattctccccacaccttcatgtgttcatggcctgtaagctctttaaaccccatccttgtggatatttatggaagcttcattacacaagcaaaattgackaaatcactggcccctggcaacaggcaactgactcaacctccagcccttcttcactcctgggaagccaggaggatggaactgaaaggtttcaatcctctaa

SEQ ID NO: 69015 - DNA, 201 bp, Bos taurus
gtggtcaggtatgtttatgaagaaaggtgtgagaaaccaagaagcatgtgaaagaaaagaacttctggctatggagtcccagaatcccagagtgaagggtkggcagggtacatgcctttaagttgggggctctttgtgtggggctcgagttgctacggtggagagcaaatggcctaactcactgactggttacctctttgg

SEQ ID NO: 69016 - DNA, 201 bp, Bos taurus
attggtagatttggaggaacaaataaaagcaattggaatgattacagtttaggacttggaggagggggtctgtggaatgaaattcaggcctctgaggaggrggtcctgcctagctggtgttcatgtctatgatttcggaagttcattaacttgggacccaggcctttgaggggagggtgccagacagctgagctggtatct

SEQ ID NO: 69017 - DNA, 201 bp, Bos taurus
ccaatgccacccatcatatcaaaatgtcataacaaaatccagtcataaagtaggtagttaacagacctgaaagtctgggcattcttgcctgagctgctctrtgtctttcaccatggaacagatcactggtattagaaatgatgacacagttaaaacatgcaaaacttcgggttctggtaaagaattacttaagattacaga

SEQ ID NO: 69018 - DNA, 201 bp, Bos taurus
tttttttatcagttatctcttgcttcctgcaattctgtgttacttaatatttactaggaaggacagctaattccagtggtaccatgcattgaggcactcakattggggtgataaccaccaaattatctctccagtcactgtgcaacttcccccctgccctggttccctccatctgtggcacttttacaccctcccagtttt

SEQ ID NO: 69019 - DNA, 201 bp, Bos taurus
taatgcataaacataagtctctttattagagaaattgtacatattggtgaatatggtcaatggtcacatctatgggttaattccttaaaaatcagaaccartaattaggatagattctatactctctgttacatcgtgaagtgtcttgtgtagtcatattctattgttggaatgacagcttgtacaaatttcaagaaaatt

SEQ ID NO: 69020 - DNA, 201 bp, Bos taurus
actacttttgccctgggtcctggtatgcatgagaccttgtatgcatcctccaagaatggatctcgatttcccccagtcctatggtactcctgcgatcaagycccacgggccttcaaggccaaatgctctgggggctcctgctcgtcataccagacctcccaagctggggtgcctgccatgaccttagcactctactgtcac

SEQ ID NO: 69021 - DNA, 201 bp, Bos taurus
gaatatttcttgcctttaagtctgtttcagctgagagtggtataggaactccagttttcttgtgatgactgtctgcatggtgtatatatccattcttttayttttagcttctttgtctttttgtatctaagttgtgtgtctcttgtggacagagtatagttgggtctatttttatccagtttgacaatctctgtgtttaac

SEQ ID NO: 69022 - DNA, 201 bp, Bos taurus
tgatgtgcccgtccacgtgccctgcaaatggccatgacatggaactctgtacgtgacaagtagtctgcatactatcgagctgttctccagccccacactgyatttctaacctcctgggatcttttattaatatatgtatttaatagggttttttttttcccacactgtgtaatacttctgatttagcatttttaagttttt

SEQ ID NO: 69023 - DNA, 201 bp, Bos taurus
cattgtaaatcaatcatactccaataaaagctttaaaaaaatcagatactcattaggatataatatataatataatttgataatatctactaaagtagaakatgtgcagatctttctactaataatttctcttttaggtttatatcctagaaaaaattcagcacatatgctcagggatatatgtataaaaatattcattat

SEQ ID NO: 69024 - DNA, 201 bp, Bos taurus
ctttgctcccaactttacattcagtcagcctcacagaaatccactaaacttaataaacgctgcctacaggctctatgttatctttgagtgatatgatttgygcaaatttttacgtaagagaattccctttccttccaatttctattaggtctgttaatgtgtctaaaacatttcattagatgactgtttctatttttcctt

SEQ ID NO: 69025 - DNA, 201 bp, Bos taurus
aaagttacaaaaacataaacacgcactctctcacaaactcacatgtgcacgtccttaaattaatgcaaagaagagatatattcttttgttctagtggagtrcaaattatgaagactaataaatgaataagcaaagcgccgggcaaccaaatcaatgtctgctcaattctggtcaaggaggtgaagtgaggtttccctttga

SEQ ID NO: 69026 - DNA, 201 bp, Bos taurus
attgatggggtctccactcctgagatatatattttgagtttcaggcaaattatgagtcaatggtctctcagacacaacactcactactctctggggagaayacttcagaccccaacagaggattataactttaaataaactcagcctctggaaggatttaatggagcacatgtctctggtcccttgctccttgtaaggagg

SEQ ID NO: 69027 - DNA, 201 bp, Bos taurus
acagggttgatttcataacgggttacaaactgacattttttgaactgatgctgatatcagacttttggttaacctatcagttaagaagtatactttgtacrtgacacttttcttgcttgagcaattgactccaaatatcttacttttattttgcttttctcactttcctttctacttctatttaactatatcttctttatt

SEQ ID NO: 69028 - DNA, 201 bp, Bos taurus
agacctgctaagttatttctgtaaggggaagaaggggaaaatggagacgttttccatccatatggaggatatctgtaaagaccagaaatgagagtgaggtrtgtgctgaaagtatgaaaagaagttcagtatgattggagcatgggcttcccttgtggctcagctggtaaagaattcgcctgcaatgtgggagacctaggt

SEQ ID NO: 69029 - DNA, 201 bp, Bos taurus
agattctttaccactgtgccacctgggccttagcccaaatggaaaaatcaaagtatagccataggaacgtatggctcctatgctatagcctctgaaaacayaggcccttcttaaggagacagtacatacttcagagttccaaggagtgaccagtggcactttgaacagtggccagtaaatggtgaagagtgaatagtaaaa

SEQ ID NO: 69030 - DNA, 201 bp, Bos taurus
aatggagtatacagttttaggagttgatgagcctttcctaccagccacaaaatctttgccttaatatgacaaagtcaacttctctgaagaaatctttatcrtttgttaaagaaatttatgcacttgaatctaggtagtatgcaaatgatgaattctcccaagtaacttttaagcaatcaccctcccaaatgggcgtacgcc

SEQ ID NO: 69031 - DNA, 201 bp, Bos taurus
accttgtggttccttatggttgtaagactgagacacttactcttgttggctcttaggcagagtacactttgagatcttagaggccacccacaattacttaycacacaatctctttcataagtgcttaaaatctctgtaacttcaaaaaggacctactttcctttaagagttcacctaattgggtcaggcccacccataatc

SEQ ID NO: 69032 - DNA, 201 bp, Bos taurus
tagttaatagctctatgatttaaccccccccccccttttcttttttaactccaatgaccattgtctattatgatgtctccaagggcctaagttttggactkgttaaactgagattagaaaaaatatttagtgtttttatatcaagagcaatgtgctctaataagcacctgaaattattgtgggccagtatgacagagaaga

SEQ ID NO: 69033 - DNA, 201 bp, Bos taurus
gcaccattcaccttgctgctgcccacagtccagccctcggtcgccgcggctgtccatcggttcccgtgagcttccgaagcaggaccaaagaggtgtccccrtggtcggtacaggctctcagcgacatgaggcgaaggagtcaaaagagaaaccgaggcggctgcaaccgctcctgctgcggatgccaatgattccccgggc

SEQ ID NO: 69034 - DNA, 201 bp, Bos taurus
cccatgtttcttaatgtccagcccaggactccttcaccatattataggccttttccattgcttttgaaaaaaaaaagtctctctttttttttatgttctamaataaaatgcctgtttacaatttaaaacaaaaaattggggggagcaataagactggaacatgaatacaaaaagtatgtgaagtgcaccttaaaaacaact

SEQ ID NO: 69035 - DNA, 201 bp, Bos taurus
accccctccccccaattagggccgatctggttgaggatggtagagggaaacggtgatggcaggagagatccagagcccctcttctgcttctgttccttccmtctaaatggaccttctctggcctctgaagtatagtttgaaaaatacaaatttaaggaatttctctggtattaactttctacacatggacagcaaaatggt

SEQ ID NO: 69036 - DNA, 201 bp, Bos taurus
tggctttccacgtccccactctcccctctcctgaaccctgtctctcctcaccctcttcttaactccactctgaagtttcccttcctgtcctgctcacgtcygtgagtctgtcctctcccacccactggccctctttctctctgtgtggcaaacatttaaaaaaaaaaaaaaagcaggaacgatcccaagtcaaacagtgtg

SEQ ID NO: 69037 - DNA, 201 bp, Bos taurus
gggaccggatgccgggttggctgccgtctacggcgttgcacagagtcggacacaactgaagcgatgcagcagcagcagcaaggcctgagatggagctgaayataagcatcaggcatcccctgcatatgccccactgtcagaatctgataaaatacaacaggattagggtccaaaagagggccatgagagtgaaacaaaact

SEQ ID NO: 69038 - DNA, 201 bp, Bos taurus
gaacttgtggttttgtttcagtggtgatactctgatttttgcataagtttatatttaatagtaagggaatgatgttcaaattttccacgggagaaacttcracttggttctcctaagtgggctccctctttggcatacttactgaaaaggacgaggctggcgttggtcatccccagattgttggcagccacgcatgtatag

SEQ ID NO: 69039 - DNA, 201 bp, Bos taurus
acatcctgcagtgttcgagatatatggtgcattaaaatatgctgcaacatatatttcaaacactacaggctgttattattgtgggtaagtggaattgaagkgttgttttgtttaataaaagtattaatttaaagtaaactctagtaagtcaaaaatgtacattgccatgtttatggtaaccattaaaagaaggtttttaaa

SEQ ID NO: 69040 - DNA, 201 bp, Bos taurus
ctttgcagacaggtagggtcaaaagtgtgcgtcttggccaatgaattatgagtggaagtgaagttatgagctagtgacctaccgtgtccccgcctctcccygcatcacagtgatcttggaggccacgtttacagccatagggtggcagagctacacgatgaagaatgatacacatgggactgtaatattagggtgtggagt

SEQ ID NO: 69041 - DNA, 201 bp, Bos taurus
gttagtcctttattttgatgccttctgctttataactttaaccctacaaatgaaacccttaatgaagcaacaaaattatctcattttccactagaaagaargacacttggtctggaaattcatctggttcattctcagcattacagcgtgccattagcaaatgctctaagcagaggcaataaagtatcagaaatatcccaa

SEQ ID NO: 69042 - DNA, 201 bp, Bos taurus
atgtgtccaatagaagtacaaaattttctggtagcccaaatgaagaaattaactcagccagggtaatgacaggggtttggactgttttatggagtaagacrtaaaatcatgcctgaataaagtatattaaatgttgccaaaaatacaaaatcttaatctaagtgggttctttattgtggtcagtagacataaaagcaaaca

SEQ ID NO: 69043 - DNA, 201 bp, Bos taurus
acaccaagaaagtagagctattagggtaaatgaacctagctgggccttgatggatgtcaaatgggctcagagaagctgctgaactacccaaactagagagrggcctgtaccaatcagaagcatccttttgctacactagtcagaaattagcaagcaggggaaatgtatttaaccctgccccctctctgtgacgggctgcga

SEQ ID NO: 69044 - DNA, 201 bp, Bos taurus
cccagctatccagctcaaatagccttcttctcactgtggccacccatactatcaaagctgaagaccatttgcctcccagaaatcaagtgcacatttagccyccaaggggagggcctctggctctgttgtcagtgatatcttgcccagcacttaaatcaggcttcaggtacatcatttaatatattcaataattaccttttt

SEQ ID NO: 69045 - DNA, 201 bp, Bos taurus
agatggcagagggcaatgatacatttcaaaacaaatagactctaagagagtttatgaaaaaaaaaagtcatagtgggagtgtatggaatggagagacgcckaggggagttgattgttaaccctcaaacgtagcaaaggacagaaaaatgcaatccagtagtctggggaaggccgaaagaagaaaggaaattgcaatgtggg

SEQ ID NO: 69046 - DNA, 201 bp, Bos taurus
taattaaaaatatgttgctaatgatttcttttctcgtcctcttttggagaaactgcttcacagggctgacctaggttgtgtttctttggtacgcaccaaakttaaatgcagcaagagtgaggaatctctgcattctagttctgggtccctatgtccttctctcacggtcacagacaggatgacaatgttggatgggaatgc

SEQ ID NO: 69047 - DNA, 201 bp, Bos taurus
tcggtgattatcctgcatgggggactttctatgattgcaacccactgaaatactcctcagttcaggctgaatggctttcaaagacaatttatacactgaartcaggtggcacctacatccttggtaacctaaggaagtttaatagaagtctgaatgggaagctacaaactggagctgtctgggtaagctgatttacaccgg

SEQ ID NO: 69048 - DNA, 201 bp, Bos taurus
accaggatgccctacgctgaagatgcaaatccctcaatgagctctttttctagcaggtattggcatggaggccatggatgtagtctatcgatcgaatcatytaatttaggaaagaaaaagcaaataagccagtgtactttgaaacttacagttttccagggtagggagaagtaattatgagtccaggtagttgagttaact

SEQ ID NO: 69049 - DNA, 201 bp, Bos taurus
gctgtggcaccaaataaacaacaaaaggaaaggaacagcagccgagattatatcagtgcccctggttaccgtggcggggatggcccactccaaagtcttargaataaaggagagtgacattcaaaaaatctgtaaccaaacagaataattcctgcaagttttttgaggacacgctgggaaatgttgaggaaggccaggata

SEQ ID NO: 69050 - DNA, 201 bp, Bos taurus
tggcacaggcagtacattgctagccaaggagaggatggatcaatggaaaacatctaaatcaggtcagttcagcccactggcagcaaggcaagccagtccaygcagagccaaaggcagaatcagtctatccagaggaacacgagatgggcaatatccacagcatgggtttaacagaagcccaccaactggcaaaggcagcac

SEQ ID NO: 69051 - DNA, 201 bp, Bos taurus
aaaagagcaggaatgggaaacctttgtaagatttgccaaaaattatcatgaaaacacacagccaaaagattaataaatctaattacagtggccacacacasaggtctccttgtgactccatggcaaaagggattcaaaaatgagaatgcatacaaattcactttataacatgcacagtggtttcaactattacaatggcca

SEQ ID NO: 69052 - DNA, 201 bp, Bos taurus
tgtcttgttttatccacaacagcttgtgctcagctgagaaaaaccgaacagaagagaatgccacactagcccaaaacaaaagcaagatatgccctacaccrgtaagtaaacattgtcacaaatgatggagcgaggttaaactggctgttctgacactattattctgagcctcagctctctctccagttagtaaaccagaga

SEQ ID NO: 69053 - DNA, 201 bp, Bos taurus
gaatgtgaactgtaacaactgcgagtgctggtagcttttcactgtccatggcctccccatctctgtagcctagagatagatcaattgaaacagctagaccrtggtcgagatttcttcatagggcctcctgtctatggaaggatttgttctgtgttcatgaacttgatatatggctgtggaatccaaggcacacattcatca

SEQ ID NO: 69054 - DNA, 201 bp, Bos taurus
ctctcctgcctccagtttttacaaaagtagactaagacttccataactccagcagtgtgtccaaaaatatgccttagtccttctgattactaacatagtgytctatcttagcacataactaaaggtaagttttcccaccaaccttcttatataaaataaaactttctctcctgtagatggtatgattttcaaattatttat

SEQ ID NO: 69055 - DNA, 201 bp, Bos taurus
tcttttgtgagtctgttatggaaaacttaaatgtctttaaggcactgttaacagaagtctcattgtcttagataaggctgctgctgaggacattcaggaaygtgacctaaatgttattgaacactggaagaagggagatccttcttatatagtggtagaaagttcaacatggacaccatccatcatgttgaaagtaggaaa

SEQ ID NO: 69056 - DNA, 201 bp, Bos taurus
tgcccacacatgacttcctgcactcaggatcagcactgcacacaaggctcagatagaaaaccaactgggacataaagtaggaaataagtggcccaaagctkctgttgggtaggtcgtgagagagatcgaagaggtgagactgagatggcaagtaccacgttgtggagggccctgaacaccacatgcagaagtggaacatgc

SEQ ID NO: 69057 - DNA, 201 bp, Bos taurus
agtgttggttcaaaatagttttgccttttcaagagtacaagtgtttgtttgttaataacaaagagtcaccactctcttgtggcagcaaacccatcaaacarcttcattcacatcactaccaatgatagcagacctgaggacaacctggcaaaagtacatgcagatgactaatcatgctcttcttattggacaggctatgtg

SEQ ID NO: 69058 - DNA, 201 bp, Bos taurus
ccttggctgaggtaactgttgcttcagtttaaagttcttaattttggtgatttaggatcaagtaagcagggacatggggtgtcatcagagttactgagaayagggagaagtgaaaggggttcacctgcttccatgaggcagaagcaacacaatattccagatatggaagactggagttgggcatgaggagtggcctgcata

SEQ ID NO: 69059 - DNA, 201 bp, Bos taurus
cccagaccaggatcaaacccaggtctcctgcattgcaggcagactaccgactgagccaccggcttaaaggatcactaaaattaactatctactacctagtrttttgaaactgttcctatttcctggccagtaataccagttcaaggaatctatctcaaggaaacaatcaaagatgcaaagatttacaaagaattgtatcac

SEQ ID NO: 69060 - DNA, 201 bp, Bos taurus
cagcacagaagaatcctttgtgatctggcagaagaaggtatggagaactctggactgaagaaaggatcacaggaaactggagattattaggaagctagtgmaacagtccaggggaaaatggccaatacttaaaatcagcactagtaatggcgaaagggcagaaaagagtccagaaagctctcaagaggtacagaactgaca

SEQ ID NO: 69061 - DNA, 201 bp, Bos taurus
atcttattataatagtaatcaagtgttaatatattaggatataaatcacaaaatatgcataaagttttaagagaaaacatgagcctccttagacatttttkagctcaaggctgatgattttgtggaatggcctacacttcccatctcatgcattcactctgctttttagggaccctggaatcccttgctgggctccaggta

SEQ ID NO: 69062 - DNA, 201 bp, Bos taurus
ttatcccattattccaaactctgggacacgaaactcctttactcctttcaaggacaaatcagttaagagacctcacctttgatgatggttagacgctcttytacccaagacagacaaacagccacaaagagaggggagtctggagggcagaggcctcgtccacccccccagactcacctggtggatgacgtagatgccata

SEQ ID NO: 69063 - DNA, 201 bp, Bos taurus
gccacaggcagaggagcctgggggcctgtactgtcagagtgggcttcactgcaggggtgtccgagatctggctggtgagaagggagatgcaaggggactckgggaccaggcctggggctgagatgcagaggtgaggaaactactggtggcatgctataagggtggggcgcccacattctgctcacagtaccaatgcgcagt

SEQ ID NO: 69064 - DNA, 201 bp, Bos taurus
gtagtggtttcaaccactcatgttaaggctttccactaaggactggcacagtgtttatttgtatatgtatcagggctctagcttcaccttaaactagttaygagtcacaggaagcctatttatacaagggactgaggaatcttctgggaagattaatcgtcagaggagtcaggcccagggagcttgacttcgtaaggctat

SEQ ID NO: 69065 - DNA, 201 bp, Bos taurus
gctcatcacgagggcttgttgtgcatgcctgtgattgcctctcctgtcctgcttttccattttctgtctagacatccttgcaaacagctgctatgtggccmccccttgggcttaagggtgaacaaacagcagcatgtagtctgccctcgggagtctgaatcctgcgaagtggcccatgtagattttggaagtgggtttggg

SEQ ID NO: 69066 - DNA, 201 bp, Bos taurus
tactgaagtgggttgccatttccttctccacaacagtccccatatctttccacaaaaatctgccctatccttttacacataatttctggctattgaaaaaytagtcctacaattattgtcctttaaaaagttgttttgcagttggtagaacttctgcttctgttcatgaagcattaactgctattggaattgccttcctgc

SEQ ID NO: 69067 - DNA, 201 bp, Bos taurus
aaaaacaagtccagtgccttgtcttgggctctcaaagaaggctcctgcacaggaggcctcctggggctttcatggaaggggtttcagaaaggagccaggayataaatatttgtccggagtaagtttgggaggggaatctggtgatttttcattttcataggagttgtggttacactttgcactattctatgaaattaaaga

SEQ ID NO: 69068 - DNA, 201 bp, Bos taurus
gcaaggtctatctcctctttctgtctcagaggttcatgaaataccctagtagtcttccaataaatttttattattattattattttgcttaagatatcttragtggttctggcccttgtgaataaatggactcccatcaagccccctggcgggtctgtggtaacaggtgctctggggcatgcatgagctgtctcctctgag

SEQ ID NO: 69069 - DNA, 201 bp, Bos taurus
ttactctttccagtatatcctatagtaggccccacaatagcctctctgaggcagaaactaataagtattcactgaatcacaataacaacaataatatctakatctgcccgtgttcactagaggccaaaagcagtttgagtgctttcaacgcacggtctcattttgtgttgttttagtcagagtcgtgtccagttcttttga

SEQ ID NO: 69070 - DNA, 201 bp, Bos taurus
gaataatattcatagtttatggactgtagttaagggacattttaggagttgacttttccttcaaaaataaaaataaaaactgaagagggtataaatccctyttcctgcccttgtgcaggtcttagagttcaccttgcctattttcaaacagaaaacagtaatagggtgcagagctggaacctaaggagtgaagggtttagt

SEQ ID NO: 69071 - DNA, 201 bp, Bos taurus
atcaatttccttatttatagtttgtgaaaatattaaattctgtaagtcttattttcataattaagcacagccatgcattatattggtcccattagacttcrggcaacaaaataagaacacagtaatgaatgaaggataccacaaaataaaacttttctccttttttccttcaattcagttatgaacacttctgcagtgcat

SEQ ID NO: 69072 - DNA, 201 bp, Bos taurus
cacaaatatttattggatgcttctatggcctcagtataacaagaacttggtgaggaaatggatgaagtatgaaaccgatctctgatatcaaattgcagatmatctggccacaaaaggaagataattatgacttaagcttaaaacatattacaccttaattaagtgcagagttatgagtcagagtttaaataatgtgctaat

SEQ ID NO: 69073 - DNA, 201 bp, Bos taurus
gttaagaatccacctgccaatgcagcagacatgggttcagtccctggtcagggaatgtcccacatgccatgaggcaattaagtctgtgggccaaaactacygaaggctgtgtgcctgagagcccatgctcctcagcaagagaagccaccgtgatcagaagcctgcattctgtatgaagagtagaccccactcgccacagtt

SEQ ID NO: 69074 - DNA, 201 bp, Bos taurus
tactgtttagcagtttcttataacaggatatagctgaacatctgatgggagatgcatagggcaaggaatgtagggaggtacatgaagctacctcttccatrccttctccaggagtgtcactctccccacactgctacctgctccttaacccggaagctcttcaaaccaccaccaccccacctttgggtttttaatatggtt

SEQ ID NO: 69075 - DNA, 201 bp, Bos taurus
gaggtggacacaactgagtacataggtcttcagtctctcaggccccccttgcgtctcaaaaggctggctgaagagttaatgattagtaaacgtgaagacayagaaacaaagaataactgttggcctaggaaactgctaacaatttagagtataaataagctacaaagcagagtcactgaactctcagttccttgaaaggta

SEQ ID NO: 69076 - DNA, 201 bp, Bos taurus
ctaataaatatcagacagtatagaaaaaggatcttcttgcatgctctttcatttgtctgtttttaacccaaatatttggcccagtgttactctgatttccrtagaaatattgtaaaaactagggagtttcccccaaatatagctcagtactatacaatcagccctgtgactcttgctggagaggcctttccagacccatag

SEQ ID NO: 69077 - DNA, 201 bp, Bos taurus
tcacagaacaaaggattagagcagatcagtgtgtccaccagttctctctcctctttgggtagtgagagcaggcaggggacatgtgcaaaaggagaaaatarccaatcggtaaggattggggctggggaataggcacaaacggaattcaaacctggctgtcattctcaggcttggatttaaatattttgtcttctctatagt

SEQ ID NO: 69078 - DNA, 201 bp, Bos taurus
ctgtgcaaaactgtgggatttttacgaatttgttttcacagtctaagctggtgactgttctagtagaatttcgggcacttccatgtcggtacagttcagtycatttccttgtgtatcatgagtgtccaacattcaccctcctcagcttcagacaatttataggacccacattctacagaaaatgtggtaagccaaagacct

SEQ ID NO: 69079 - DNA, 201 bp, Bos taurus
cagagcaacaataaaaacagcaaaaatctccagtataccggtgaagtcttctgggaacaattcactctaggtttaaattctttctctatcatttgttacartgtgacttggccaagttgcttcccctttctaagtctcacaaaatttgtcctatgagtgagaaaaacatttgtggaaattgttaagaggatttaatgaaca

SEQ ID NO: 69080 - DNA, 201 bp, Bos taurus
tactggagaaggaggtgggctcctaaggggctggggctgtatatgaccatggttaagagcttggagtctgaaatcagacatttatgcatctaattataatraagtatgatcagtcttccaagactggaactccaagatacaagatataaaaaactgtaacaggtggacctacctaatctgagagaccctgaagagtcctct

SEQ ID NO: 69081 - DNA, 201 bp, Bos taurus
gtacactgcctgggggcacgctgcccgagtgcacgccgaagagctaacctccccgaatgccctggtgcttctcaagagctctgggaagcagccagaccacwctctgcctttgtcaggtgttctggtaaacagaggcttttaggagaacagtcttggataggtcctggcaaggtgatgatggcattctggccacaagtttct

SEQ ID NO: 69082 - DNA, 201 bp, Bos taurus
gtgtctgaacatcatctcctgtgacaatgtttccaacagcccgcaaggcaggagaaaccactttataatcattatgcctgcaaccataaaaagaaaagatrtcttatatccaacagtaacatctgcaaattcctttccttagagctaaaaccagaaaggtacaaggaaccctatcaggatgaggaaatgtttttggtgtat

SEQ ID NO: 69083 - DNA, 201 bp, Bos taurus
ctgctctcagctccatcatggtctctgcttccttgagctgacttcctagcacaagcttctttaccctcaacccctccctaagacctggagctaaaaactcratctctttcctggctagtagtaaagccagatacccaggctgtcctctcctgaacaggatgatagcatgatcagaacacaggcaaatccagaaaaacctaa

SEQ ID NO: 69084 - DNA, 201 bp, Bos taurus
ctcccctgcatccagctccaagtccagtcttgatggttcacactacctgaggctttgagcaacttggggctgggagtctgaagttgagagagcccctaccracctaggacaggtaattcagagtgtctacataccttgtttcagaaatctgggagctagaagtgattgaatcccaaagtgccctgaaaaaccgctcttaat

SEQ ID NO: 69085 - DNA, 201 bp, Bos taurus
aaagtggaattaccacgtggagaagcagaaatgcttttaagatacttgattaattgtgccaaatagcttttcaaaagaattgtactggcttaagtctttgycagcactatatgacagtcaggtgtcatattttaagagattcactaacagtgtttttcaattttttttaaaacctgtgatacaaaaatcaagattggtgtt

SEQ ID NO: 69086 - DNA, 201 bp, Bos taurus
tttaccaggtttcccccacatcctggttcgtgggtcgcagtgttcccacctttcctgctgccctgcacttcttccctgggcctctccattggctgctcatrgcttacggcagccaaatgcagaaggatgaggaggatggtccagccttcctagttctccagatgactctcagaagcccaggagagaagggccaaatgctgc

SEQ ID NO: 69087 - DNA, 201 bp, Bos taurus
taccattgctttatcactgaattcacctagacaggaacatggaagccacactcaggttattcccagataataacatggtggcctttgctgctgggcctctyctgcatgaataagaaacttttgcttgagtattatcatagattaaggaacccttagtatcaggctgaggcctgagaagataggatgagcaccacatttcct

SEQ ID NO: 69088 - DNA, 201 bp, Bos taurus; identical to SEQ ID NO: 29373

SEQ ID NO: 69089 - DNA, 201 bp, Bos taurus; identical to SEQ ID NO: 29378

SEQ ID NO: 69090 - DNA, 201 bp, Bos taurus
gaaccagtccctccagatagggtcaaggaaagttaaacaaagtgctactatttttagccaaatatgactattaaaaaacagagtaggtaaagtctgtgccrattaaaggaaaatactgaaggaaagcttctatttaatacatttagttctttagttctgtattttgtgttgtaagagacataaagaaattgcaaataaagc

SEQ ID NO: 69091 - DNA, 201 bp, Bos taurus
cggcgccgtcaccgcgggtcctgatgctcgggccagtgggatgcgcagcgaaccctcattcgcgcggattttgaagccgcgttgcacacccggagcgcggygggcccgccgtgaacccgccgtgaatacactgcccggaaccccgagccgttgatcctgggtctggggagcaggtcgccgagagtgccagtgactttggct

SEQ ID NO: 69092 - DNA, 201 bp, Bos taurus; identical to SEQ ID NO: 29379

SEQ ID NO: 69093 - DNA, 201 bp, Bos taurus; identical to SEQ ID NO: 29381

SEQ ID NO: 69094 - DNA, 201 bp, Bos taurus
gaacaaaaatggcttttgaatttttttatactagagttctgaacttttaatttttatattttattttctttttcttactattctagggcctaaaagaacayaagacaggtatttataaggatgaggaagcaagattaaaataaacttaataaatgtcatctttcccttctagtccatttacatatcatgaatttatttgct

SEQ ID NO: 69095 - DNA, 201 bp, Bos taurus; identical to SEQ ID NO: 29382

SEQ ID NO: 69096 - DNA, 201 bp, Bos taurus
tggaggctgcttcctaacagcatttaagattttctaattctttccactccttttgctacttttctggctcaaatcagcagtgtattttgactaatctgctrtgatagcctccctcctggtcctcatgttctgatcaggttttattctgtagagcagacaggacagttttcaaaaaatgggacttctgtttatagacatact

SEQ ID NO: 69097 - DNA, 201 bp, Bos taurus
cctcaaaccagctcatgtgaacctaccaatttctgctgtctcacaacctcaccttctacatcagccaacaaccatcctgtggccgatctgaatacagagtyatcttaatcacatctgctaaaatgacatagggatacactcactgtttctgaagtaaatgctggtgctgctgttgctgctgctgcctgtaggtttcaatcg

SEQ ID NO: 69098 - DNA, 201 bp, Bos taurus
accttcacccacataggctggccccagcctacctctcgagctgctgcctcctatccgcgaccacagcttcaggcagaatagcagagccctgtcttcaggcragcaaagcaggctggcctctgtgttcttagctccgctgctccactgcctctccggaaagtctgctctcttccccactgaaccatctgcctggtcatttgc

SEQ ID NO: 69099 - DNA, 201 bp, Bos taurus
aaatagtgagaaaactgaagtaagaaatcaagcttatttctccttctataggaattcaaggctgggtgtcttctgtgtcatcattcaggaacctctgcttmtatcttgtacctctcccagtctctgtggtctcaaagtcctctcacttcagccagcatagaggaaaaaagagggaatgtggaattatgcaatgcctttttg

SEQ ID NO: 69100 - DNA, 201 bp, Bos taurus
tcctggatctttaagaatttgccttctcgaacagattcatttcaggagctttctcttcattaaaactgttagatctgaaatggaagctaggaactgggctrtggggaagaagggattttcaccagctccctgggaagtccctctggtttctacattccatctctcagttcattttatgaagctcttaatacagctggtcct

SEQ ID NO: 69101 - DNA, 201 bp, Bos taurus
tcatcaaatgaattgggatctgttcaaaaaataaagttgtatgtccaaaccatggccattgccttcaccatatccatctaataatacatggccaaccagtkgtgaaattaatagacccatggtcttcactgttaaaaatgcaaatcacaacacaatagattcctcaggccagattgatctggctgcttctttttccgttca

SEQ ID NO: 69102 - DNA, 201 bp, Bos taurus
tgaggagcccatccataagcaattataatgtagtgggatctgtgctttaacctgggtaaacacaccatcctgcagatgcagaaggagggagcctgagatcygacacatcttgcaaggcattgtcagtccttcatgctctaactctagccttcctggcagtgtctaatccaagaaataattatcttcctgacagtacactat

SEQ ID NO: 69103 - DNA, 201 bp, Bos taurus
attctgacccttggtcaggtatattttgggtttctcttggcagggtcaagggaggcagagtggaggaagctgatatctaattgcttacaaaagtaggcctragacataaaagtagcagaaaccacaggcaccatgaagtgaaaagcttttattttcaggttggtcaaggtgaaaagaaagtgttgattttggatttctgtc

SEQ ID NO: 69104 - DNA, 201 bp, Bos taurus
aggccaaattgggatgtgacagagactgccctccatctgacatatgtatcactgaaatacactgcaggtcatgctgtgccctgagataatctctcatcccsttcgctgatccttcaaggccctctggaaagaatgatgtccccaccaagcaataaagccctccatgcattaaagccctccatagaataatcctgtttgctg

SEQ ID NO: 69105 - DNA, 201 bp, Bos taurus
ggtgggggcaggccaggtcctgctaggatgggaaatgggagaagtcaaggatatctgccagatggtaggattccattccaagattttacaagggcagggtytcatactgaggaggagcaagatgggccccgagaactaaatacaggcagaggaatcacagcgccagggccaaggtgtggagtcaccatgctgacctggtgc

SEQ ID NO: 69106 - DNA, 201 bp, Bos taurus
caaggtcgatcctgactgctgacccctccagtcacgtggggagttactgagaaacacgtgcagatcatttgagttgtaaagagaggacctatgccattgtygaacagctcttaacattggaagttccttccaggcactggcagaaaaaatgttggtctcttgtaaggatggtgcactcaaatgcctgcagatgcccagcag

SEQ ID NO: 69107 - DNA, 201 bp, Bos taurus
aatcttggtagatcattctactcttggggctgaaaactgaatttagaagctacagttctgtgtagttgtgtgtgtcatttaataagacttctgtttgggtytattaggtcaatgtttagcaaaggaaggtgaatgatgtttccacttgcccattaagtgaattagtttattgaaaaaagtagcaagcacatagtgggtaag

SEQ ID NO: 69108 - DNA, 201 bp, Bos taurus
tggttgcatgaagaatgctgtttgtacactgacactgcaagtaccaataacaggaactggaaagaatcaaaattaaaaatttttcacttgagatacacagrggtagagagagtagtgagggtagagagagtaaccacgattctccaggttttacttaatcctcttttgcctagattatcatctgtataaactacatttagt

SEQ ID NO: 69109 - DNA, 201 bp, Bos taurus
attgtaaatgtactttctcactcagtgctaccaaaaagagcaaaatgaaccctataattaaggctacttcttttagattttaagtatatgaagattgaaaraaatcctgcaagctcacataaaacttcttcatttccatgttcttatttgaatcttgtaactaaagcccagaggagacaattctcttcttttaacaagtta

SEQ ID NO: 69110 - DNA, 201 bp, Bos taurus
aataaaacagtaactactcaaacatgaattgtaggaactatgatgaaataaagtgctttaccagaacctttcttacttttgtcctaaaatctggcccttcwgattatcaagaaattttatattttctagaacttaacaatattctgcacagacaagggcctgtaatatttacaatagtatttaacacacacaattccatta

SEQ ID NO: 69111 - DNA, 201 bp, Bos taurus
actctacacaaacagactatgtaccgttgaacaacacataatacacagctggacttatggtaaaagaagaaaagttagaaatgatagctgctgataacagygagaaaactaacattaagaatacatctcctcatgatagtaagatttcacattttataggtccctgatgaagaaagtctcagacaaactgtcctatcttct

SEQ ID NO: 69112 - DNA, 201 bp, Bos taurus
ttatagtatttgactgagaaaggccctccagaggaaaagagatcagacttgctctgtgtcaactcagaaagcaataggcttaagaaggcagaatccaataygagagatatattttcagcgtatgattcaccgaacaaacaaacaggctccagggagtcatgaaacacttatcaccttggctgtatgagcattaatacagga

SEQ ID NO: 69113 - DNA, 201 bp, Bos taurus; identical to SEQ ID NO: 29383

SEQ ID NO: 69114 - DNA, 201 bp, Bos taurus
tctctcacagagaagacagaatctataaaagaagcagacaactaataagggcattacaaagctgcattggccaagtgcacacctgttcctacagctttgcrctggacacacccgaatttcttctccaacaacaaggacaagcagaggggaaagaccgtgagggtgcactcaaagcaatcctctccaccctcagcagaaagc

SEQ ID NO: 69115 - DNA, 201 bp, Bos taurus; identical to SEQ ID NO: 29384

SEQ ID NO: 69116 - DNA, 201 bp, Bos taurus
tcccaccactctgttcctgctggcctttcaaacttaggccttcttccctacatctgttggcatacgcctaacaggttcatctctatctgtcttttttccayttaggcaactcatatttggccctaaaggctctctttaggcaccactccttctggtagcttccctgaggttgaaccacttcagtgcaaccaaaacatagcc

SEQ ID NO: 69117 - DNA, 201 bp, Bos taurus
gaatggaccttctgatactgaactcagggttgtgttgatttacccatcttgccaccggcagtgctggacaagagtggcctcctacaagtccaaggccttgkctgccatgtttacactggagaagagcaatcgagaacatatactctgagggcagactgcaaagagagagaattggaaaaacgcacaggccacgaccccact

SEQ ID NO: 69118 - DNA, 201 bp, Bos taurus
gacatgactgagcatatatgcacaacacatttttaaggcctacataatgtaacgctgtataaatgaatacgtcatgtttttcaaaaagccaatttcttttygttggctatttgattttttcaaattactttggttgtgaaaaacatggtaagcatttttgtaaatgaatctgtgcacataacaattattacttccttacag

SEQ ID NO: 69119 - DNA, 201 bp, Bos taurus; identical to SEQ ID NO: 29386

SEQ ID NO: 69120 - DNA, 201 bp, Bos taurus; identical to SEQ ID NO: 29387

SEQ ID NO: 69121 - DNA, 201 bp, Bos taurus
caaaagatggcaagggtaactcatgatccatacctcatggaggtgcctgtggattagtcacacccaggctacaataagcattcagctccctagagttgggygcaaccattaagtatttataaaaaacacctgagtattacaaaaggcgctgctttccaattctcaggtggaaggaccctccttccatgcagtggggagaat

SEQ ID NO: 69122 - DNA, 201 bp, Bos taurus
gtctcgtactgccctctctccatcttccctggaaacatacacagctgcgatgctttctgtaaggatagtggtgtcccagaaggtttaacagagccacctcyccaggttctggctggggcggggcaagcccacacattctcagggggctgactgtgtaggaagcagattttaacaaacaggccccaggtggggaggagaggg

SEQ ID NO: 69123 - DNA, 201 bp, Bos taurus; identical to SEQ ID NO: 29390

SEQ ID NO: 69124 - DNA, 201 bp, Bos taurus; identical to SEQ ID NO: 29391

SEQ ID NO: 69125 - DNA, 201 bp, Bos taurus; identical to SEQ ID NO: 29392

SEQ ID NO: 69126 - DNA, 201 bp, Bos taurus; identical to SEQ ID NO: 29393

SEQ ID NO: 69127 - DNA, 201 bp, Bos taurus
cggttccttataacctgcaaccgggtcaagcgggatcgagtggcagccccagagctgagccaggcaaaagagcagaacgaaggatttcatggtggcttcaragaggccccggtgtgtcagcaggcaggcagctggaggcgtctggaccaacctaggtgctctgcctggtggagtgtcgaaaggctttatttatatgttgga

SEQ ID NO: 69128 - DNA, 201 bp, Bos taurus; identical to SEQ ID NO: 29397

SEQ ID NO: 69129 - DNA, 201 bp, Bos taurus
gtggtcaaccatctgagttcactggcttgtggcagtgggggcaggcagtgagaagcggtccacataagacatttgaaaatagtccaatatgttttgaaaargagggaaaacccacgtgctaacatttatcccgtggatctggttttcctgaagcagcatattcttcccttgaaacgaagtctacactagactggcttcata

SEQ ID NO: 69130 - DNA, 201 bp, Bos taurus; identical to SEQ ID NO: 29399

SEQ ID NO: 69131 - DNA, 201 bp, Bos taurus; identical to SEQ ID NO: 29403

SEQ ID NO: 69132 - DNA, 201 bp, Bos taurus; identical to SEQ ID NO: 29404

SEQ ID NO: 69133 - DNA, 201 bp, Bos taurus
agtatgtcttcaatacaaacatactgtgctccttgtagcactgactctgttcacttgtgattttttaaggagattgataaatagtatggtaaagaactgartgtacctttttatattccttcagcaacaccaatatttgtttctacttatgtacttacctgtttcttctttcctgttttccttcaagccaagaataattaa

SEQ ID NO: 69134 - DNA, 201 bp, Bos taurus
ctctggacatggcctggagcagtcccacttgctgctccacaggtgcgtgtcctttaacatccaggtacaagccccctgtgaagtctggaatcctatatcgyggcatggcgaaggccctgcatcctcacaactttactcaactggtgtaacctgccaggctgctcctctcagtgggattttccaggcaagaatactggagtg

SEQ ID NO: 69135 - DNA, 201 bp, Bos taurus; identical to SEQ ID NO: 29405

SEQ ID NO: 69136 - DNA, 201 bp, Bos taurus; identical to SEQ ID NO: 29406

SEQ ID NO: 69137 - DNA, 201 bp, Bos taurus
gtctgcgagcagtcgctctcaggttccacggagccctggcgcacaggccgggagaatctgtggccagtgaagaggtcctggaggtggggccccaggggcakctgcccagtcaggtctgcagggggagagaaagaagacagccctgctagccccatttcaattggcccacctggaagccacatcctcccggctcccagcctc

SEQ ID NO: 69138 - DNA, 201 bp, Bos taurus; identical to SEQ ID NO: 29409

SEQ ID NO: 69139 - DNA, 201 bp, Bos taurus; identical to SEQ ID NO: 29410

SEQ ID NO: 69140 - DNA, 201 bp, Bos taurus; identical to SEQ ID NO: 29411

SEQ ID NO: 69141 - DNA, 201 bp, Bos taurus; identical to SEQ ID NO: 29412

SEQ ID NO: 69142 - DNA, 201 bp, Bos taurus; identical to SEQ ID NO: 29413

SEQ ID NO: 69143 - DNA, 201 bp, Bos taurus; identical to SEQ ID NO: 29414

SEQ ID NO: 69144 - DNA, 201 bp, Bos taurus; identical to SEQ ID NO: 29416

SEQ ID NO: 69145 - DNA, 201 bp, Bos taurus; identical to SEQ ID NO: 29417

SEQ ID NO: 69146 - DNA, 201 bp, Bos taurus; identical to SEQ ID NO: 29418

SEQ ID NO: 69147 - DNA, 201 bp, Bos taurus
aaaaagaactaaacaaaactattaaacaatttggggagaaaattcttatctagaggatacatttaaaaacaattatttatgaattttataatttgttaagyatttaacacctgtgatatccctaatagaaaaagagaaactaccaacaaggatctactgtataacatatggaattttgcacagtgttatgtggcagcctgg

SEQ ID NO: 69148 - DNA, 201 bp, Bos taurus
tgccttcagggagcttgggcctcaaagccctaagacacaaagcaaaagacacaagctgtgagcacaattcctggtgtccagatggtcactgttaatgataraggctccagagacccaaaggccacagactgaagagttccactccaggccgttccttcatctcttccaattccagggcccttcgctgctttgtctccatcc

SEQ ID NO: 69149 - DNA, 201 bp, Bos taurus; identical to SEQ ID NO: 29419

SEQ ID NO: 69150 - DNA, 201 bp, Bos taurus
taacttctttcctttccaaacccttctctccttctctgtttcttgtgcctttattgctgtaagccctggcacaggggcatcaggatggatggaggggtggrccttcctggtctgactgcagacctcagtgaaaacacttcactgtttcaccaaaaggtataaggcgtggagaggaggaactcgtttgtagcaccatgtgtt

SEQ ID NO: 69151 - DNA, 201 bp, Bos taurus
ccagcaggaaagcagagcacatgcacctcctcaaagatggtttcaggactttgcaggcggtccagcggttactactccagtgcaggggacacaagctccayccctgatcaaggaacaaagatcctacatgccgtgcaatgtggccaaaagattaaaaaaaaaaagatggctgcaaaggggaaaatctagttttgaggaaga

SEQ ID NO: 69152 - DNA, 201 bp, Bos taurus; identical to SEQ ID NO: 29421

SEQ ID NO: 69153 - DNA, 201 bp, Bos taurus; identical to SEQ ID NO: 29422

SEQ ID NO: 69154 - DNA, 201 bp, Bos taurus; identical to SEQ ID NO: 29423

SEQ ID NO: 69155 - DNA, 201 bp, Bos taurus; identical to SEQ ID NO: 29424

SEQ ID NO: 69156 - DNA, 201 bp, Bos taurus; identical to SEQ ID NO: 29426

SEQ ID NO: 69157 - DNA, 201 bp, Bos taurus; identical to SEQ ID NO: 29427

SEQ ID NO: 69158 - DNA, 201 bp, Bos taurus; identical to SEQ ID NO: 29429

SEQ ID NO: 69159 - DNA, 201 bp, Bos taurus; identical to SEQ ID NO: 29432

SEQ ID NO: 69160 - DNA, 201 bp, Bos taurus; identical to SEQ ID NO: 29433

SEQ ID NO: 69161 - DNA, 201 bp, Bos taurus; identical to SEQ ID NO: 29435

SEQ ID NO: 69162 - DNA, 201 bp, Bos taurus; identical to SEQ ID NO: 29436

SEQ ID NO: 69163 - DNA, 201 bp, Bos taurus; identical to SEQ ID NO: 29437

SEQ ID NO: 69164 - DNA, 201 bp, Bos taurus; identical to SEQ ID NO: 29438

SEQ ID NO: 69165 - DNA, 201 bp, Bos taurus; identical to SEQ ID NO: 29439

SEQ ID NO: 69166 - DNA, 201 bp, Bos taurus; identical to SEQ ID NO: 29440

SEQ ID NO: 69167 - DNA, 201 bp, Bos taurus; identical to SEQ ID NO: 29441

SEQ ID NO: 69168 - DNA, 201 bp, Bos taurus; identical to SEQ ID NO: 29442

SEQ ID NO: 69169 - DNA, 201 bp, Bos taurus; identical to SEQ ID NO: 29443

SEQ ID NO: 69170 - DNA, 201 bp, Bos taurus; identical to SEQ ID NO: 29444

SEQ ID NO: 69171 - DNA, 201 bp, Bos taurus; identical to SEQ ID NO: 29445

SEQ ID NO: 69172 - DNA, 201 bp, Bos taurus; identical to SEQ ID NO: 29446

SEQ ID NO: 69173 - DNA, 201 bp, Bos taurus; identical to SEQ ID NO: 29447

SEQ ID NO: 69174 - DNA, 201 bp, Bos taurus; identical to SEQ ID NO: 29448

SEQ ID NO: 69175 - DNA, 201 bp, Bos taurus; identical to SEQ ID NO: 29449

SEQ ID NO: 69176 - DNA, 201 bp, Bos taurus; identical to SEQ ID NO: 29450

SEQ ID NO: 69177 - DNA, 201 bp, Bos taurus
gccttttgtgtagcttaaaatctttacagatatgtgtgcttttcatctaaccagattttgcacatctattatagcacaccctcaatcaaaagatgtttctrcattgcctaccaagtaaaggctaaatcaatataaaattatattcctcaaaaaatgcttttaattcttgtgggaagaagattacatacatagataaagata

SEQ ID NO: 69178 - DNA, 201 bp, Bos taurus; identical to SEQ ID NO: 29463

SEQ ID NO: 69179 - DNA, 201 bp, Bos taurus; identical to SEQ ID NO: 29464

SEQ ID NO: 69180 - DNA, 201 bp, Bos taurus
caacatatgtgggtcattggttaaatgttgagttaataatggagagaaatgtagattctttgcagagggagatggaggatagaggaaagtgtttttggccraaggactagagtgaggcaagaccctaatttaagacatgttcaagaggcaaagggtttccagtttgtctgggtcacagagttcctgcagggaagtgcagga

SEQ ID NO: 69181 - DNA, 201 bp, Bos taurus; identical to SEQ ID NO: 29467

SEQ ID NO: 69182 - DNA, 201 bp, Bos taurus
tagagaaggcaatcttgaattttaaatttcgtaaggactggttgggttctttgctctggatgatgggtactttgggttaacagactattacattgatgacrtgcattatttgcctctgttgcactgattaaagggtctctccaaagctattgctggaatgacggtgaatccactattactaactgtatgtgcgagtcttag

SEQ ID NO: 69183 - DNA, 201 bp, Bos taurus; identical to SEQ ID NO: 29468

SEQ ID NO: 69184 - DNA, 201 bp, Bos taurus
gtgtaggccagatgttcctctatggcttgtcatttgcaagccctgcccttggcagctctgtcccagggctttcacacattgcaaagaaaatcagtcacaayaaaaactgcctgatgagagactgttgcacactttgaatagagtgtgtgtgcatggtaaatcacttcagttatgtctgtctctttgcgactttatggactg

SEQ ID NO: 69185 - DNA, 201 bp, Bos taurus; identical to SEQ ID NO: 29473

SEQ ID NO: 69186 - DNA, 201 bp, Bos taurus; identical to SEQ ID NO: 29474

SEQ ID NO: 69187 - DNA, 201 bp, Bos taurus
taatttcagtcagatggggtcaagctgatgttgaagaatatcaaaggaatgtcataaaaacccactggttccagtttggaaacagtttatggtaaattgaygctataaattctgggagagcattgaatgtgctctttttgttttaaaaagtaaataactgaagcagtgtaggctcaccaatgactactttgcattcatatt

SEQ ID NO: 69188 - DNA, 201 bp, Bos taurus; identical to SEQ ID NO: 29478

SEQ ID NO: 69189 - DNA, 201 bp, Bos taurus; identical to SEQ ID NO: 29479

SEQ ID NO: 69190 - DNA, 201 bp, Bos taurus; identical to SEQ ID NO: 29481

SEQ ID NO: 69191 - DNA, 201 bp, Bos taurus; identical to SEQ ID NO: 29483

SEQ ID NO: 69192 - DNA, 201 bp, Bos taurus; identical to SEQ ID NO: 29484

SEQ ID NO: 69193 - DNA, 201 bp, Bos taurus; identical to SEQ ID NO: 29488

SEQ ID NO: 69194 - DNA, 201 bp, Bos taurus
tgtcaccccgactcctggtccctcccctgggggatgacagtgattttagtctgattctctttgtctcttctcctcaactccctatcaagcttttggctggrgtttagctcccagatgttagcctccactaactggcaactgattgctccagtgtttttgataatgccttggccacctcattcgaagagttgactcattgga

SEQ ID NO: 69195 - DNA, 201 bp, Bos taurus
gattgaacctgcaccctttgcagtgaaatgtggatttttaaccattgggcctccaggagagtcccatcacaggactcctttaaactgtcatcatgccttaraaagtgaaagtggtagttgcttggccatgtctgactcactgcaaccctgtggactatagcctgccagggtcctctgtccgtgggattctccaggcaagaa

SEQ ID NO: 69196 - DNA, 201 bp, Bos taurus
agtattttaaattgcagtattttgttggacaaaagtcctttgataggttacctgtccccagtattcccttgactactaggattcagatttattaagatackatcctttcctgcatgatgttttagactacttatgaatcaagtcatgctcttatacaacttaggaagttaatgtgcaagtccttttcaaggcatctttggg

SEQ ID NO: 69197 - DNA, 201 bp, Bos taurus; identical to SEQ ID NO: 29489

SEQ ID NO: 69198 - DNA, 201 bp, Bos taurus
ggactctcttactaccaaagtgttttgatattggtttaaattgtaaaccttcagacttgtcaatagctctgaaatatgtttagaaattatgaaacattaakaagtaaggctggtgttggaagtaatggtggtttatgaaactgtggctatcttttcaatgtgtctgaacagaaaatcaacttcaatatcttcaaaaataat

SEQ ID NO: 69199 - DNA, 201 bp, Bos taurus; identical to SEQ ID NO: 29490

SEQ ID NO: 69200 - DNA, 201 bp, Bos taurus; identical to SEQ ID NO: 29491

SEQ ID NO: 69201 - DNA, 201 bp, Bos taurus; identical to SEQ ID NO: 29492

SEQ ID NO: 69202 - DNA, 201 bp, Bos taurus; identical to SEQ ID NO: 29493

SEQ ID NO: 69203 - DNA, 201 bp, Bos taurus
tcgtggcatttcagaggtgactggaagtggatgtttgtgatattcttacttccttcacatcgttgtcagtaaatacataagagcatcagccccatttcacygtgacgtgatgaaaggtactccctaatgaaaggctcacaatcagaaaaaataaaatgtgtgtctttaaagccctctgataaattcaaaagccatgagctg

SEQ ID NO: 69204 - DNA, 201 bp, Bos taurus
ttgtttagataacaccttcggacacgaatgcagtttgagctgtgaggactgcatgaatggaggccgatgccaggaaggaaagagtgggtgttcttgtcccratggctggggaggcattctttgtaatgaaagtaagtaatactttggagcatgggtggggggtgatgaattctccttttactgctggtgaactactggtga

SEQ ID NO: 69205 - DNA, 201 bp, Bos taurus
atttatgaagtacaggtccctctatgacctagaaaatttcccagtccaaggtatgacaagtgctgataatttctgcattgcaaacaaaactgctgacttayattctagaaataaagcaactgatagtctatgagttatagttacacctttttcctaataatttattgagatatcttttgcaaatacaaattgtacatattt

SEQ ID NO: 69206 - DNA, 201 bp, Bos taurus
gcagagccccagaagcataaggcagttttacatcagtcttttaatgtcttcctgtcaagctacaggatgagaaggggggtggctgggggatcaggaaatargtgcttgtcaagaagaacacaattgaagtcagaaaccagaatcaactattaaaaacaattaaatcagaattttttatgttacaaggaaaatcattcatgc

SEQ ID NO: 69207 - DNA, 201 bp, Bos taurus
ctaagggccccagttgtgttcaggaaaactaactgataatgtacatttccaaggtggctggttatgttcaacaaaacatacaaccaaacaaacaaaaaaamcggcctgatattaaagattttacataagagctcatccttttgataactattttctaaaccactgagaagagctcatccttttgataactattttctaaac

SEQ ID NO: 69208 - DNA, 201 bp, Bos taurus
caatatgttcagaagatgatggaatgggtttcaatgagggaaaaaaaaaattgattcagatagctcaagtgcgtacagaagacccagatggactgacaatmtaatacctgccagccctgacatgcagcagagacaaggaaggcttctgccttatacatcagctgctttccagtgcagggtaaaggcaggctgtggagatga

SEQ ID NO: 69209 - DNA, 201 bp, Bos taurus
tacccccaaaaggagggtctggaaatttacttggctacttccagtggaagagagggaataaactaagataggtgggaggcatccaaaaggaaatggccaamgtatggagaagaccagtcaggaacagaggaggaggggaagggagactgggtgagacagagattcagttattcaccaaaccatggtcttaccagaaacatg

SEQ ID NO: 69210 - DNA, 201 bp, Bos taurus
gtacaaaggaaacgcacaagtgaagaagtgaagtgggaaacagaagtagccagtagaaaactcagagcagagtcagttctggaaacaaggcagcatcttgrgaaggaattttagcagaggaggccagattgcagtgggttaaatgatcaatgataaaatcattgatatgcatcaaagaactgttcttgagaaattaaaggt

SEQ ID NO: 69211 - DNA, 201 bp, Bos taurus
cctttgggttaaaatataaacatagtcccacttaagaaatgagaaccaaggacaagtcttggcatttgttgagtccttcatagaacaagaaaacacatgarattttgctataattcaagagccattcttgtcagtgctttcaagggtagaaattaagctatattaaagcttgtcttggcccaattatagaatgaaagtgag

SEQ ID NO: 69212 - DNA, 201 bp, Bos taurus; identical to SEQ ID NO: 29496

SEQ ID NO: 69213 - DNA, 201 bp, Bos taurus; identical to SEQ ID NO: 29497

SEQ ID NO: 69214 - DNA, 201 bp, Bos taurus; identical to SEQ ID NO: 29498

SEQ ID NO: 69215 - DNA, 201 bp, Bos taurus; identical to SEQ ID NO: 29499

SEQ ID NO: 69216 - DNA, 201 bp, Bos taurus; identical to SEQ ID NO: 29500

SEQ ID NO: 69217 - DNA, 201 bp, Bos taurus; identical to SEQ ID NO: 29501

SEQ ID NO: 69218 - DNA, 201 bp, Bos taurus; identical to SEQ ID NO: 29502

SEQ ID NO: 69219 - DNA, 201 bp, Bos taurus; identical to SEQ ID NO: 29503

SEQ ID NO: 69220 - DNA, 201 bp, Bos taurus; identical to SEQ ID NO: 29504

SEQ ID NO: 69221 - DNA, 201 bp, Bos taurus; identical to SEQ ID NO: 29505

SEQ ID NO: 69222 - DNA, 201 bp, Bos taurus; identical to SEQ ID NO: 29506

SEQ ID NO: 69223 - DNA, 201 bp, Bos taurus; identical to SEQ ID NO: 29507

SEQ ID NO: 69224 - DNA, 201 bp, Bos taurus; identical to SEQ ID NO: 29508

SEQ ID NO: 69225 - DNA, 201 bp, Bos taurus; identical to SEQ ID NO: 29509

SEQ ID NO: 69226 - DNA, 201 bp, Bos taurus; identical to SEQ ID NO: 29510

SEQ ID NO: 69227 - DNA, 201 bp, Bos taurus; identical to SEQ ID NO: 29511

SEQ ID NO: 69228 - DNA, 201 bp, Bos taurus; identical to SEQ ID NO: 29512

SEQ ID NO: 69229 - DNA, 201 bp, Bos taurus
taagttgtcagttttgtccaccaaataaaacataattctcaacttttatgttgcacattttttttcagttgacatgtataaccctaaagtgtgggaaagtkaatgcctttgagattctgaatcagtgggaaatgggacctaagggataaatgcttctccctttaatcttttgtataaacaccttgaaatgaatttcataaa

SEQ ID NO: 69230 - DNA, 201 bp, Bos taurus
ggttatttttttcaaataaattgaaacagtaatttacacacctttgttagagtattcattgttaattttctattcagagaagtattctgattctttctaaytctctagtggcatattcagcacagagggaaaaatgacaagagtatagactcattctctgtacagttatcttttcctgcaatttctcagtgtagctttgac

SEQ ID NO: 69231 - DNA, 201 bp, Bos taurus
gcctttgagaattattttaaaaactatttctggtatctttctaaaaaaatgtcagcgatatcaccattggctggcagaatgtgttgtcatccacatatcaytggggagtaatagcttctcactcaaagacttcaacctaagtgcatattcagaaagactcagggtcccaactttacagtattttttccagttgacaatttt

SEQ ID NO: 69232 - DNA, 201 bp, Bos taurus
tgatcaactcaatatccaattttttcagtctcaaattccaccctttgcattagttaaagtaaatttgtaaaactgaagcatcagtacatacatagagatgyatacaaattataagcatacagctcaaaaatatttttacaaaataaatttcacaagatggaataattcacaaatttgtgtgtcagcctgaaagagaagcat

SEQ ID NO: 69233 - DNA, 201 bp, Bos taurus
taaattctttataaatattttgacgaacataatgcttgtttaaataatagcaaaaatactctgtaatacttaaatgtttcaatgtctttttacaagatcayacagcttgataagtgcccactgccaagatgagtgcccattgccatgctatgatgatacatataaattaatttattgaagagctaacctctgacttagtac

SEQ ID NO: 69234 - DNA, 201 bp, Bos taurus; identical to SEQ ID NO: 29513

SEQ ID NO: 69235 - DNA, 201 bp, Bos taurus
taaagtgagtacctaagtcaacacaattctacctgcatacagtgacctctgcagcctgattgctgagtagaagttaaataacttcctccagcttaagttamatatctttgagataccgaagttaaatgtgcagctaatttcaggaggttgagtggtagattaggaatatttaaatgaggaagtcttctagaaataaaagac

SEQ ID NO: 69236 - DNA, 201 bp, Bos taurus
agtcaaatattcatgatgcacttttaccattgatgcagttttaattttgacattaggtgattttttttttgctgcatgcattagtaagaatttttccacaraagaatggttggcccttgtgcagctcattaatgtcagtgcttaaaacaaaatgaaagggtaggaactttatcatgttttccgtttgtgatattttccttg

SEQ ID NO: 69237 - DNA, 201 bp, Bos taurus; identical to SEQ ID NO: 29514

SEQ ID NO: 69238 - DNA, 201 bp, Bos taurus; identical to SEQ ID NO: 29515

SEQ ID NO: 69239 - DNA, 201 bp, Bos taurus
tccttaatgaaaaatcaaattataattgtgtctagagaaataagagatttgagcagaaatttcaaacagatgctcttgggagaaacacattgaaaataagktgaaagtgtaacccacttggactatctgaggagcaatatacagcccagttctaaatgcacttatgtatataaaagtgtatttatttggtgacaggttgtg

SEQ ID NO: 69240 - DNA, 201 bp, Bos taurus; identical to SEQ ID NO: 29516

SEQ ID NO: 69241 - DNA, 201 bp, Bos taurus
tacttctcagtaaattttatacaatcactgccttcagatgactgcttcaggaataacaaaaagcaattgaaactaaaacctcagtactaggagtggaactktattttgtattatgggttttgggggtattgacctttggtttattttcttgaaatatacttaccgtaaggaagtatgactctttatttgaattgtctttca

SEQ ID NO: 69242 - DNA, 201 bp, Bos taurus
aattggaagtcattgcctctgaaatgatttctaaccttaggtcaacagtttcatacagtctgcttgctggtgggtatgtcttagttgcctgattaaactayattacctagatacaccttggaagtgactgaacacttaaccctctggtgtttaaattgttttgcagaataatggactataaataaatatagccattattat

SEQ ID NO: 69243 - DNA, 201 bp, Bos taurus
atctcaaactctagatgagaaccacagtatggccaacaattatctggatcacagcattgtgtgagcctcagcataaaatccagtaatgctggacccagacyattggcctgcagagctgaagcactcagttatcttgtttcaagtcattaagtttgttacacactaacaaattatatacagtatataacagtaagttacata

SEQ ID NO: 69244 - DNA, 201 bp, Bos taurus
gactgtggcgatgcagtattgctggctgtgtctattgtaagaagcttttaggactatttaggctttctgaaatttgttcttaccttcctacagagtctgaragaaatagctggagtgatcctgattgaaggccacaggccccacgtttgccaggatccttttgaagttttaaagttttctgtgatacagtgagatgcttcc

SEQ ID NO: 69245 - DNA, 201 bp, Bos taurus
tacctaagaatattcaaataaatcttaaaatattttaccacatttaagtgtattccagaaacctaatttctttgatatgtattgtctaagataaactaatrtttatattattgactatttattgaaaagataattgaataatcaaagtaaaaatgatacaaaatattattcaaactgtaaagtagagtaacactgatttgt

SEQ ID NO: 69246 - DNA, 201 bp, Bos taurus; identical to SEQ ID NO: 29520

SEQ ID NO: 69247 - DNA, 201 bp, Bos taurus; identical to SEQ ID NO: 29522

SEQ ID NO: 69248 - DNA, 201 bp, Bos taurus; identical to SEQ ID NO: 29524

SEQ ID NO: 69249 - DNA, 201 bp, Bos taurus; identical to SEQ ID NO: 29525

SEQ ID NO: 69250 - DNA, 201 bp, Bos taurus; identical to SEQ ID NO: 29527

SEQ ID NO: 69251 - DNA, 201 bp, Bos taurus; identical to SEQ ID NO: 29528

SEQ ID NO: 69252 - DNA, 201 bp, Bos taurus
caccactgggcctgacccaaacgtgctcaaaatctgcagcaagaccagcttcagtagcccagtgagcagccgccggagctgacgccggtacagtgcagatyacgcgatagaagggttcgaaatcccgcgagtcgcgagacgagactcacagctgcgggtgggggcggaggaaggggaaggcgctggggaacgttgggcgga

SEQ ID NO: 69253 - DNA, 201 bp, Bos taurus; identical to SEQ ID NO: 29536

SEQ ID NO: 69254 - DNA, 201 bp, Bos taurus
caaaggtgttgccaggaaaaaaatggaatgtgaaattagaactcaactggcagctgtctaaaaaaaatatactttaaaaaaaaaaggtggatttcagagtrtactgaaaagcaatatgaagacaggcctcttgtttgaaatctgataacatgaaattgaagatgacaaaaagtatttttaatctacatttttctattatac

SEQ ID NO: 69255 - DNA, 201 bp, Bos taurus; identical to SEQ ID NO: 29540

SEQ ID NO: 69256 - DNA, 201 bp, Bos taurus; identical to SEQ ID NO: 29541

SEQ ID NO: 69257 - DNA, 201 bp, Bos taurus; identical to SEQ ID NO: 29542

SEQ ID NO: 69258 - DNA, 201 bp, Bos taurus; identical to SEQ ID NO: 29543

SEQ ID NO: 69259 - DNA, 201 bp, Bos taurus; identical to SEQ ID NO: 29544

SEQ ID NO: 69260 - DNA, 201 bp, Bos taurus; identical to SEQ ID NO: 29545

SEQ ID NO: 69261 - DNA, 201 bp, Bos taurus; identical to SEQ ID NO: 29546

SEQ ID NO: 69262 - DNA, 201 bp, Bos taurus; identical to SEQ ID NO: 29549

SEQ ID NO: 69263 - DNA, 201 bp, Bos taurus; identical to SEQ ID NO: 29550

SEQ ID NO: 69264 - DNA, 201 bp, Bos taurus; identical to SEQ ID NO: 29552

SEQ ID NO: 69265 - DNA, 201 bp, Bos taurus; identical to SEQ ID NO: 29553

SEQ ID NO: 69266 - DNA, 201 bp, Bos taurus; identical to SEQ ID NO: 29554

SEQ ID NO: 69267 - DNA, 201 bp, Bos taurus; identical to SEQ ID NO: 29555

SEQ ID NO: 69268 - DNA, 201 bp, Bos taurus; identical to SEQ ID NO: 29556

SEQ ID NO: 69269 - DNA, 201 bp, Bos taurus; identical to SEQ ID NO: 29557

SEQ ID NO: 69270 - DNA, 201 bp, Bos taurus
atttaaattgaaatagggaagtgccaaagctagcaggacaatccacactcacatgctctctggcttcctcagccaatgaagatcagatgggaagggaggayagggagcagaaaaactgtgggggtgggaagggcagaggtctaacagtctctagcctaaggttacggaacatctggacaggtaagaagacatctcagagtg

SEQ ID NO: 69271 - DNA, 201 bp, Bos taurus
tcatcttcagtacgtcacttacctagtctgggcccaggaatcctgtaacacagttttaatcagacttgtttatatagtcagggtcccacacccagggttgmacacaccctaggatggccctgccctacatagaacagctgtcaaagtggagtgtctgatggctctgggagcccaggctgcccaacccttctgagacaaagt

SEQ ID NO: 69272 - DNA, 201 bp, Bos taurus
gaatttgatcaaaggcaacaattctcccttttgctacagactattaacaaacaccttacagggaggtataaactccctgactgctttccaagttctcacayatactctcatttgctcatcacaacagcacacacaggacaagatcctcattttaagaaagtggaaataaaaacacaaatgggatgaatgacgttactatgt

SEQ ID NO: 69273 - DNA, 201 bp, Bos taurus
agcctctgctcaaagcagtgaagacccagcacaaccaaaaataaaaaaagttttgcatgctcctagtattgtcatagctgcaatgcatgagataggccccmgtttttacgtatctgttaaggggtgaattgtgctcccccaaatagaggtaccaaggtaaagtgaagtcattgagatgggccctagtcctatatgactggt

SEQ ID NO: 69274 - DNA, 201 bp, Bos taurus
gtggtaaatcatgattgtgactagttagttcaactgcataagagctgttgtgtccaaatgcttgtttgtgcagcagtgctggttaaaaatcagaagcactygggaaacttgaagaaaatatataggctctcggtttgacttcctcaaaattcagaaaaaatataaagtgcttggagttgaaatattttaaaaattgctctc

SEQ ID NO: 69275 - DNA, 201 bp, Bos taurus
tagaaaacattggttttctctgtttttaatgttttgtgcctctacactagatttatgttttgtggttaccatgcagtttatataaaatgtcttggtaaaakagtcctttttctgctgatggcatcttatgttcgtttatctatatgagttctatcctttccctccttcccctttgtgtcttgtctcaaattatttcttttc

SEQ ID NO: 69276 - DNA, 201 bp, Bos taurus
acctctgcctgcatcctcaaaagtatgataatgtgttaactgtgtttatgcttctgttaaataaaattattaaactgtgaactgaaatacatccattttayttacaagttctatgcaaaatagcctaaaacagagagaaaagggcttttactagaatgtagtactatcgatgagcatgtaatagcaatgggcctgcctaca

SEQ ID NO: 69277 - DNA, 201 bp, Bos taurus
taaaagatgcatgcaataaaatctgtgctagttattttgttcatatcctgagagagatgttactcagacttgctgattggtatatgtttggaggtttgaartattcacttacctgctttttgtcattagctggtttttttttttctagatgcattttatggttctccatctttaccatatgttaaatggatataatgcttg

SEQ ID NO: 69278 - DNA, 201 bp, Bos taurus
gtcttgggtgcagtctcatactcattttgccctgggcctgaaaattatgtagtcagccctgcttgtagatgctcaacaaaatacgcttattggaccgcaargtgagaggccagatatggcagagtgaaggtcaaagaaggcagtatctgcaaaactaggctttttatcaaaggttgcaagcctagaaagacagctgggagc

SEQ ID NO: 69279 - DNA, 201 bp, Bos taurus
ttgaccaatccctggatgaaaagtgctttgagtttgaggcccatcccccattccttttctttcaccatttggcctaaagtctccccaagaatcattaaaargggcaaaacatctgctcctccttcactggacttccagtgatggacccagaggagggtggctgaaagaatcccaaggtcatttatctttctctattcactg

SEQ ID NO: 69280 - DNA, 201 bp, Bos taurus; identical to SEQ ID NO: 29559

SEQ ID NO: 69281 - DNA, 201 bp, Bos taurus; identical to SEQ ID NO: 29561

SEQ ID NO: 69282 - DNA, 201 bp, Bos taurus; identical to SEQ ID NO: 29562

SEQ ID NO: 69283 - DNA, 201 bp, Bos taurus; identical to SEQ ID NO: 29564

SEQ ID NO: 69284 - DNA, 201 bp, Bos taurus; identical to SEQ ID NO: 29565

SEQ ID NO: 69285 - DNA, 201 bp, Bos taurus
agagaagaggaagtgaagcagaaggaacaaaagaatgaggacagcaaaagtaggattacactaaaacctcgtttgtggctttcttccaaatatttggccaktcctgtctcctttgcagactcatctttatctgcctgtcaattacatgttcatgttcctcagcacttcattctggggcctctttttctctctctctcccct

SEQ ID NO: 69286 - DNA, 201 bp, Bos taurus; identical to SEQ ID NO: 29569

SEQ ID NO: 69287 - DNA, 201 bp, Bos taurus
agctgccccacgcccagccccctgacagggtgccctcctgcgcctgccgcagctctgcccactgtggctgcagcccccaggtctgctccatctctccctcrtcctgccttcgaggggacggccttctgtgcacaagtgaggtcctgatggctggggcccctactgtccagatgagacccggtttctatcaggcgagggtgc

SEQ ID NO: 69288 - DNA, 201 bp, Bos taurus
ggaaagtcacaaatgaccctggatgcccatgtgaagactgcagcaaagttcaaactagctcacagagttgtagattctggtaatcattatcttactgctayccgccccctccaccccgttgtcccctgggagaaagcctatgtgtggtagaagagaatttagttaaataggaaaaagtaacaatgaaaaatgagaggggag

SEQ ID NO: 69289 - DNA, 201 bp, Bos taurus; identical to SEQ ID NO: 29571

SEQ ID NO: 69290 - DNA, 201 bp, Bos taurus
ccaatcccacagagggaagctaagggaccaaggaaaagataaatattattttacagttaagtttcctaccaaacttggttgtgaaaatttagaaaaaaaamaactaatcataaaatccagggtgaaactagtcttcccagaggaagtcacaaatcatagggaccactgtgttgtgtgtttttttttttttaaacctaagga

SEQ ID NO: 69291 - DNA, 201 bp, Bos taurus; identical to SEQ ID NO: 29572

SEQ ID NO: 69292 - DNA, 201 bp, Bos taurus
atatatctttctaaaacaacaatctcatcaaatcaccagtgcctcctgagtcaagcccaagcacatgataacacaacaccttccatgatctggccactgayctcctccaaacctcattacacactctttcatctctccacagcatttttcccaacaatacagcctgcgtatggcaacccactccagtactcttgcctggaa

SEQ ID NO: 69293 - DNA, 201 bp, Bos taurus
gaaaatatttaaaaagtaccttaacaaaagtatccccaatgatttttcttttctcctcaggacttgtagtcatatttaacgttttgctaattctctttcgkggagttctgtcttcatctgatattggtagagttgttgttccattgtagaaagaatgagcagcatttatcactggggaacaggagagaagcatattttaaa

SEQ ID NO: 69294 - DNA, 201 bp, Bos taurus; identical to SEQ ID NO: 29575

SEQ ID NO: 69295 - DNA, 201 bp, Bos taurus; identical to SEQ ID NO: 29576

SEQ ID NO: 69296 - DNA, 201 bp, Bos taurus; identical to SEQ ID NO: 29577

SEQ ID NO: 69297 - DNA, 201 bp, Bos taurus; identical to SEQ ID NO: 29578

SEQ ID NO: 69298 - DNA, 201 bp, Bos taurus; identical to SEQ ID NO: 29579

SEQ ID NO: 69299 - DNA, 201 bp, Bos taurus
acagaaggttagttcatctttacattctatacatcataataacttaacttctaaagggatcatagtagtgtttgttgaaccaacagatgtagtagatgtgrgatggttttcagcctgaggttcatatgccctgaagagccctcctcccagtctaaagggaaataaaagactgtgtggacttgctgctgggactttcctggg

SEQ ID NO: 69300 - DNA, 201 bp, Bos taurus; identical to SEQ ID NO: 29580

SEQ ID NO: 69301 - DNA, 201 bp, Bos taurus; identical to SEQ ID NO: 29581

SEQ ID NO: 69302 - DNA, 201 bp, Bos taurus; identical to SEQ ID NO: 29582

SEQ ID NO: 69303 - DNA, 201 bp, Bos taurus; identical to SEQ ID NO: 29583

SEQ ID NO: 69304 - DNA, 201 bp, Bos taurus
taaataggtccaatatacaagattttgattttgaaatcctatactagttgaatttcaagctcctctcaggaacacacagaagaagacaaataaagggctcrtgatttttgaatatttcagtcactcctcactggattatgttagcactttttctgcatatggtaagctacattctgccatgcttgcagtcattcatgtttt

SEQ ID NO: 69305 - DNA, 201 bp, Bos taurus
aaaatggactcctcaccagaacccctgcagtttgactatggttggaatgatgtagaccagcagttggtaacttgttctgcagaaaaagaaaaggggcaaayagtaaatattttcagctttacagaccatatggtctctgctgtaactattcagatctgctattatagcatgaaagcgaccagagacaacacagaaatgaat

SEQ ID NO: 69306 - DNA, 201 bp, Bos taurus
aagggaccagggtttcatgccatatccattaacagtggtggccaggctcacaaaagttccctattcagcccctatagcttcttctgggtcctgaataaagycaaaaggttaatttggggggcctctggcatctgtcactgcaggtctggggcttcagagtaggagaagggtgattatacgctcataatttattaaaagcag

SEQ ID NO: 69307 - DNA, 201 bp, Bos taurus; identical to SEQ ID NO: 29584

SEQ ID NO: 69308 - DNA, 201 bp, Bos taurus
ctgatgtttactcttttaggttttactctgtcttttattgcaactccttagccctagtctgtacagtttggtctttcttaaagggcaaatggagtaataayaataagaggaagactgttcagaaacaccctgataattggccaacttccagtctatatgcttgtcagagcataaatatactgcacgaccaatagcttaaat

SEQ ID NO: 69309 - DNA, 201 bp, Bos taurus
caagcaaaggcctaagcatgaggactggccagctggacaaagggatatggccaggcagcaacctggtgggaaccaaggatgaaggcctctgtgacagatayaggttctaaaatcagcaaatctcaagtgacccctgttggcagatgaggtctaggcatagtcaggatggctttgagactggcagaggccaagcctgtaggt

SEQ ID NO: 69310 - DNA, 201 bp, Bos taurus
accaggtagaaaagttattactagaagggtcctagggaccaaaagctggaactttgactgggatactacaccataactccattggctcagaaaggccaagmgagcatagagtctgaattcctcagcttttatggactcccatctagacatgagagaagagttttgactgtctattaaaaaactcaagatagcaagtccaaa

SEQ ID NO: 69311 - DNA, 201 bp, Bos taurus
ttttttaatgtttaaaacacacaaaattctcagaattcccgtggaacaggagtaatagagaagggatgctatcttattttaaagtagtaatcattcaaatracttacctgtgatcatgttgttgtttagttgctaagttgtgttcaactcttgcaaccccatggactgtagctcaccaggctcctccatccacgggatttc

SEQ ID NO: 69312 - DNA, 201 bp, Bos taurus; identical to SEQ ID NO: 29585

SEQ ID NO: 69313 - DNA, 201 bp, Bos taurus; identical to SEQ ID NO: 29586

SEQ ID NO: 69314 - DNA, 201 bp, Bos taurus
tctttgctctgtgctttagcagaagaaattttcacgaaacctctgtcatttgtgctgctatcacacacatctcccacattgggttccgctgctccctctcrgagcagatacattaccctcctactgcccaaaggcagaaaatgacatggaatcaaatcaaactcagggaaataagaaacctgaagttttaataatataact

SEQ ID NO: 69315 - DNA, 201 bp, Bos taurus; identical to SEQ ID NO: 29589

SEQ ID NO: 69316 - DNA, 201 bp, Bos taurus; identical to SEQ ID NO: 29590

SEQ ID NO: 69317 - DNA, 201 bp, Bos taurus
cttaatggtcatcacatcttttgctccattaaattcctcatttaaaacattttgctacagatgacttaggttttcccctattttttgccttctttctgtcygtggggctcatggatgaataagtattccctgaattcttttgttgttttttaagctaatacattcaaatccaaacaataaaatccactagaataggacact

SEQ ID NO: 69318 - DNA, 201 bp, Bos taurus
ggagcccacctatctcttgtctcaggaaatgcaaacagaaggctagctgtaaatgtctaacctggaaactatctcctacatcaaaattagaagttgaaatygctaccttaaaaagctgcactatttttttttcactcagaagtctagactttagtgatttcacccatcaaatgggaataaagctgctcttcctgtgaaaag

SEQ ID NO: 69319 - DNA, 201 bp, Bos taurus
gtgcggtttccacgattataaattatcctaaaagaaattgagtttttaggtggggagaaatgattctcggcagcaggattccagtgagtaaattgccaggyccaaaggtcagagagtcattctggtcatgttcctttttaaatgtcgttgttgttatggttcttcttccttctgtaagtcaccttttggtttggcaaagat

SEQ ID NO: 69320 - DNA, 201 bp, Bos taurus; identical to SEQ ID NO: 29591

SEQ ID NO: 69321 - DNA, 201 bp, Bos taurus; identical to SEQ ID NO: 29593

SEQ ID NO: 69322 - DNA, 201 bp, Bos taurus; identical to SEQ ID NO: 29595

SEQ ID NO: 69323 - DNA, 201 bp, Bos taurus
ttttccaagtcagtgaagctgttaacattactgcttcttcaagatgtgggaaacagtagtcaaatcatggactgggcagtcgaaatctcaattgtctaacyttgactacagtttgatgatgctgtttttggtgccagctacaatttgtaagcgcttactcattccccacaatgaaatccctttcaatggactttctccttt

SEQ ID NO: 69324 - DNA, 201 bp, Bos taurus
caattaataatttctattacttatcagaaaaagagaaatagttataatgaaggtataatatatgatagaattatccaggaatataagacagagatttatcmatactgcctaacttcatggcacagatgagatttgagttggacccaaatgaatgatcggagaaggcaatggtaccccactccagtactcttgcctggaaaa

SEQ ID NO: 69325 - DNA, 201 bp, Bos taurus; identical to SEQ ID NO: 29597

SEQ ID NO: 69326 - DNA, 201 bp, Bos taurus; identical to SEQ ID NO: 29599

SEQ ID NO: 69327 - DNA, 201 bp, Bos taurus; identical to SEQ ID NO: 29601

SEQ ID NO: 69328 - DNA, 201 bp, Bos taurus
cttacagttcatcaaggctaaaatatttaactggctcaacagagaaaaaaaattctgctgactctggtcacagagaaaaaactgaagaaagaggccagaakaggagagacaaacttgaaggaaagattaagaagatattaaatgaggtgtcttcaaataataagatagtatttgctaggtgaggagggctgcaaatagaga

SEQ ID NO: 69329 - DNA, 201 bp, Bos taurus
tatgagtaggctttgagacaataacctcacagaaaaggtcagattatggtcaacactgatggggaggtagagactcccaagacagggaaagaggagaagamgggagatcattcaagagcaggaatcagtatgaagaaaggcacggggttaaaggaaaggcatgcccctgtgaggcaacagttagcataaagaattcctgat

SEQ ID NO: 69330 - DNA, 201 bp, Bos taurus
gatgattttatttgcaaagcagaaatagagacacaaacctagagaacaaatacatggacaccaaggggattggatcaattgagaagctaccattgacttgyacatatagtactgatattatgtataaaatagattaactaatgagaatctactcaaagcacagagaaatctatgcaaagtaatgttctctggtgactgaaa

SEQ ID NO: 69331 - DNA, 201 bp, Bos taurus
agaggaacatacctctgtgcaatcctgagtaaaagggggcccctcctgaggacatgtgcggaggaggaacagaggagcagggctggcagaaggtcccctgyggccccactggacgcaccaaagctgctgcagttagtcgatcagacacacagtcaccctcactcttcaggaggcagcagaaaacccccatcattcgcagcg

SEQ ID NO: 69332 - DNA, 201 bp, Bos taurus
tgaagaaaaccacagagcaaaaaattattagaggcgccagggtggagctggcctccagggctcctctgaggtccctcaggattcacaacctggaacctaaygaaactgtgagctgagaaaattattttagaatcatataaattgggagtgtctaatgtactattaagaaaaacaagaaaaatgagatccagcctgaatatc

SEQ ID NO: 69333 - DNA, 201 bp, Bos taurus
accattgctaacatcattgtcagaggctgccttcgttttgagagcttcacggatggtgtcacctgcaatttacatctggccagatgaagacagatagggtygatgagacctaaatcattagatcagtggtctgtaaccctgctgtgctttagaatcacccagggagtcctgaaaactaccgatgccaaggccccatccctg

SEQ ID NO: 69334 - DNA, 201 bp, Bos taurus
atcggatttatccttgaacttattgcaaaagcaggtgctcaatgaagttttgtggatgagagaaggaagagggggagaaaggaatgaaccagctacagacyggcctctggcagaggataaacgccctgtgttgccagattatctgttttcttaaagtcccaaattcttgtttttcaatgggatttatctatttatttacat

SEQ ID NO: 69335 - DNA, 201 bp, Bos taurus; identical to SEQ ID NO: 29607

SEQ ID NO: 69336 - DNA, 201 bp, Bos taurus
gccatataccaggaaggggaggctgagcaggtggaaaaggcaatgggttcaggaatggatgtgtgagggttaggaatatggaaagttgttccattgatggygaatttgaatttgaggtttcagagggtgactggggctgagaagcctcttgtccagatttcctcaggtgagttctagtcttttgagatacaatttccttca

SEQ ID NO: 69337 - DNA, 201 bp, Bos taurus
ggaactcttttttgtctcctttaaaccacagaactgctaattcaaatgaaatgacatttccggaagaatagaaattcctggtttaagtgaggcccttttgygttcagatggatttgtgataaataagagaaagagactcttgttcccaaaccggctactcactgctgccccaagctgtagattaatggaactggcccagga

SEQ ID NO: 69338 - DNA, 201 bp, Bos taurus
actggttcagcatctaccaggaaaaatcactgcactgctcttatgtgcccgttcagggcactgtgtggagaggggagaaatcgggcaggttttcagacccyaggcagctgacagtctagctggagaatcatgaagaatacagacacaatcaggctgaaagcccctttctgacctgtgtgcagctgctctcccagcttggaa

SEQ ID NO: 69339 - DNA, 201 bp, Bos taurus
tacaagtctaaaaccagttgagccgggggcatctggagaatctaagatccacctgtctgattctgggggcacctggaagtgctgttaaggtttgaagtcgrgaaagtgtgtctgaacgtacatggatcccagaattttgtgtcttatcaactaagccggctgagaaatttccttagagttattctcacccagaattggaat

SEQ ID NO: 69340 - DNA, 201 bp, Bos taurus
ttcagctaatcccactgggagccctcggagtagaatggcccttcaaagttgtctttatcgaagcaagggtatattcctcctcctcagtcatcagaagtggrttgccctcaggcagggcctttcctgagctgaggcagcttcgttaggctgggagcaatgcccacagacatcctcagctgggaatggctgatgcgcccagca

SEQ ID NO: 69341 - DNA, 201 bp, Bos taurus
atgaagacttccaggagagtaacagaatgtattgtaagattacacagtatctgttaactttatcttatttttctcagtccatgaattatgctaaccttatycccttacatgaataagtagtgtattctaatctatgcccttggtaacaaagcatattgggtatgcaaatagatattcagctaaacaggtccaatcagaact

SEQ ID NO: 69342 - DNA, 201 bp, Bos taurus
cttaagcatttcttcccaatgagatccaagctgaacaatgacacgagctgatgttcagtggtggagatgcccgtgtatcctcgcctaacagctgtcacggkaggtccacactgctcctgaaagctagataattaactgccgtttgctttgaagtccagggaaagctgcttcctactgcggtgcatttacaacttctacaat

SEQ ID NO: 69343 - DNA, 201 bp, Bos taurus
attacaaaatattattactaaataatgagcttctattccaggagattaaaacaatgcctcttaatgtaacagggactgcattacagctccaaagtacagargcatgtacactattttatacttttgtatgtttcttttgtagcgctatccaacttcttttttttttttttttaagtaggcatgcaaattagataacagact

SEQ ID NO: 69344 - DNA, 201 bp, Bos taurus
gctttagtaagactatagacccagatgaagaggccaatcaggaagaaggcttacacgtaatatgtttagattagacatcagtcatgactttttgatggttmcatcagcacctgtgagaactcatccgagcattcagtcataagacaatatcagtgatagtgagattattacatgccagccctggagcacaatgcttgctct

SEQ ID NO: 69345 - DNA, 201 bp, Bos taurus
caccatattaatacatatttataaatttggtaagtagtgttttcttagaagttgcatgtcaccataagtaagttatcagtaaaacggagccacctacactrctagtaatttacttaatttattaaaaaatgcataagttcctaaaatttatgtataaaacttcagatacttgaatgatggacagtttctcggatcatgtct

SEQ ID NO: 69346 - DNA, 201 bp, Bos taurus
agaatgcaagagagatgttgactttttcctctgttaactctaacctctcgagtagctatataatacaggctggtttcagacacttaacaatatcctgattmgcaattacaactggaataaagcaaaatgccatcatagaatgatctccttcattacacagagaatcctgtaagaactcaattaggcacatatcgtttagtg

SEQ ID NO: 69347 - DNA, 201 bp, Bos taurus
gcagctgcctgatgcttattcaatgcctctctccacagctacaggatttcccagttaataactttaattgtgatcatttctatgtcatatgaatatgggayttttaaaaatgcatgtaattctatcatattattaattcattatttgtattctaagaatatggcctgatactgactctctaatcttacacttaaataaaaa

SEQ ID NO: 69348 - DNA, 201 bp, Bos taurus
tgagcacatgacatgaaaagaaacctaaaaacatttaaaaatcaaatttacatgctcatgtatttatagttattttataataaccatatgttaattttaastaaaggaaaaaattgatttctctcctggtatgcccatagttttaaccagcttaaaatacaaacaagggaaaatttgaaaaaaaaaaaaaagaaaagggtc

SEQ ID NO: 69349 - DNA, 201 bp, Bos taurus
taatgtgactccaacgtggaagcagctcacaaaatcatcaagttcaagtccattattttattagagtcagactcagacaagctacttgcaaaacatcccaygatttgtgaggtgacagaaaacttctttattagagttccctcctctatctcctatcaactcccagaaatatttgacaggggtttgagagccctctgacac

SEQ ID NO: 69350 - DNA, 201 bp, Bos taurus
gttgcggtttaggagtagcgcctcagtccagggaggactatattgactgcctcaccacagcatgcataaggcagaacggaagatggggcaggttgttaacragaccactgaaagtcaacacatcaatcgactggtcccagagtgaaaatcctggtgaaccttagaaaggaaaggatatgagttggcattggctttgcataa

SEQ ID NO: 69351 - DNA, 201 bp, Bos taurus
ccatacactttgttcaaaaaagatatagtggagccactcagagtcttttctgtttcctgtaaggggaatttggatcctgcctcacggtagtcataaaaatmttatctgcaaggtgaagttttctctagaggctgtactgctttcaccagggagaacaaatattgaacccacctcgcctgcttttcaaaaaaaagaaaaaac

SEQ ID NO: 69352 - DNA, 201 bp, Bos taurus
ttgattactttgcaaaatcacatgacgggattataaattaggtttttactcacttatctatgagaattttgtatacaaaattttgagatattgagaaaatraagaccttagttgtcattcaagttgtttattttcacttctagaactgtagatgacatgattttagacacccaaagtaaatttcctgtgtgtttaagaaag

SEQ ID NO: 69353 - DNA, 201 bp, Bos taurus
aaaataacatttcttaaggcaacatatttcagcattaagtgcttgacaactgcgcatttgactggacctaaaactaaacctatcagtttaaacattttacrgtacaaaacaaaaatatccccatttaagcaacactttcttaaaataatggaagataaatggtttagtcacaaaagctctctaaagagatgcatttatttt

SEQ ID NO: 69354 - DNA, 201 bp, Bos taurus
tctttccatagatcaaagaagtagaaataaagaataagtaattaacagatgaccaggtttctttcctacctcccccttcagtaatctggcaaacaaattgygtgaacaaaatagcatctaaaaaaagatcaggaagagtcacaaggcttcatactgtgggagctggcaatgctctgatcccctatctcaatgattaattga

SEQ ID NO: 69355 - DNA, 201 bp, Bos taurus
actggcactgatattttcttttctaacaaaacacaagtattcagtgaggtaaactgctatggtataataggaagcagcttattcttccctccacagtcttyctaccctctctcagatctcccttcccttgtttcttcacagcaactcaagcacattactaagatttccaataactttcagatgttaaaagtgtcttaattt

SEQ ID NO: 69356 - DNA, 201 bp, Bos taurus
cttcctattcacttcaaacactgagtttgtatgtaatttagcacttgtcacagcaattattggtcttatctttattctccaactgagataaaaatattttkagaggaaagactataaagatcacttcttgatctttgtcagagtttattttacaaaaatatttgtatataagttttagtgaatttatgctgatttttggga

SEQ ID NO: 69357 - DNA, 201 bp, Bos taurus
gatgccttcaaatacaaacatgtttgcagcaaaacagatacacgagggggaaagttgtaggaagagtttcaaatgatgccagtgagattttcacaacccarttcccttaatcttatactgcctggagctatcatttgtggcttgacataagacaaaattatttgaaatagttcaacatgctccatgatagtagtactctaa

SEQ ID NO: 69358 - DNA, 201 bp, Bos taurus
ctttatgatttttcattactatctgtgccttctcaggccacttaactatttttagaagtagacagtgtggctgataaagtagtaaatccaactaattcaayctctccaaattatattaaccaggccactgacttgttgagcaaaatctccatgggcattgagaaatatgagctggctagtcaaggttacagttattttttt

SEQ ID NO: 69359 - DNA, 201 bp, Bos taurus
ttatttgctacgtgatatttgctaaaaattgggataaattccttttttatagagagaaaacaacatctttcaaaaaataaccttgactctctacaccttgwggagattaggcagagactgagagggagaaagaataaatcagaacaggatttgcactttaatttggaagaaagctggaaatgccaaataaactttttaatg

SEQ ID NO: 69360 - DNA, 201 bp, Bos taurus
gagggtgggggccggggccccagcggcctagaaaagcgaccgccgaagctgagcagggactgaggccggggcccgggcgtcccagtcccatcctggccagyctcagagtctttccaaggtcaaggtatttccttcttgaaaccgccttgtaggttcgaattagcttagtccatctcttaacattggccacctcatgcgaag

SEQ ID NO: 69361 - DNA, 201 bp, Bos taurus
ggtcactatatgaaatctagtaactatacaaaaatattgctgtattattggctatattctttatgctgtatacctcatctatttctttattttatacctgraagtttatacttctcaattccctttatccaattcaccagcctcatgctgcttaccctctgccaaccagcagcttgttctctgtatctaaaagtctttttc

SEQ ID NO: 69362 - DNA, 201 bp, Bos taurus
aggaggagaagtttccacacagtaagaaactctctcaggggcatgtcttgggggttttggaatctcagagggcaacataactgggaagaagaagaagaagraaaaaaaaaaaaagaaacagagaatatgcacctaaccgcaactgccagcagagaagtagcccagatgctcacgtccgccaccagcaagtgggctgggcag

SEQ ID NO: 69363 - DNA, 201 bp, Bos taurus
atctatattcatcagtgatacctgtaattttgtgtgtgtgtgtgcgatatctttggtatcagggtgattgtggccttttagagtggtttcaaaagtgttcrtttctctgcagtttttttgaattaatttcagaattagttaaattttctctaaatgtttggtataattcacctgtgaagccatctggtcttgaagtttgtt

SEQ ID NO: 69364 - DNA, 201 bp, Bos taurus
aagactgtttttttttttctttctttcctggactccaaaatctctgtctggaagccctgcctcacaggttcaagaaagtgcctttcggattacaggccgcygtcgacttgctcttatctctatcctcacctcacaggagaacggagacaactaatatcttcctcattttttgcgcctggtctttttacttgctaacaggct

SEQ ID NO: 69365 - DNA, 201 bp, Bos taurus
aagaagagtctgtttcattaaaataattaaccttcatattattataaaatagttgatgtattcatgtctctcaaatataagcgtgagatttttccacaggrtatataatcctgaaaagcccagtctttcttctccatagcaagtccctgaatgcctctgtcacaccagtggcgacagcactatggcgggttacagtttatg

SEQ ID NO: 69366 - DNA, 201 bp, Bos taurus
cttatcaatttctgggtggccatgtaagttactgccaatagcgtgcaggactctgtctggggcacagatgtgtttagagaagtgaagtccaatctgttctrttggccactgagtgcattactggcagcctggggaaggatgggaattgtgagaagggtgacttgggctccagactatgaaaggtgtaggcaatggctcatc

SEQ ID NO: 69367 - DNA, 201 bp, Bos taurus
ttgactgttgataataatatgcttgaacagggaaatgcaaaaaaaaatgtatatgagaattaaacataataagaatgtctatatttgaaagcttggtacaygttggtggtatctcagatggataaaacaaccaattaacttttcacataaaatatccttgcttgacagttatcttcttatagcacaaaacaaatataacaa

SEQ ID NO: 69368 - DNA, 201 bp, Bos taurus
ttgatgatatcttttggattcagattgttaatctcatcattatacataggtgaataaaacaaaataccttttagctgctatggaaaaaaagaataaatccygtgacagcaggttcttataatgaaacagatcatgcatagaggactttgaaatttgatgctaaggcaataacagcttctgtcagatctgggtaacttcatt

SEQ ID NO: 69369 - DNA, 201 bp, Bos taurus
atgagagaagacatgcttacccatatcagcatattgttataatgattctgatggaattggctgtggttcgtgtccctggcttgaagagcttgaactccctygggctattagagtctgggatttgattagtgctggctgcagtctagtcccttatcagctatttctgcaacacatcagttctgtgtcattcagcaatatctt

SEQ ID NO: 69370 - DNA, 201 bp, Bos taurus
cagtacaccaagtaacatatagaatttggttcaatcatttgtcatctgaaaaaaatgcatagcatcaaagttgaaaattatgttttatttggtggacaaarcagaggacttaaatatgggacacagtacctcagatagctctgagagactgctctgaaaagtctcagaattatctggagaagccaggatatataggagttt

SEQ ID NO: 69371 - DNA, 201 bp, Bos taurus
agagatgctgttgttgcacatgttgtaagaaacatggaagatgaaggccagaatatctacagggattggatattatacagtatttccctcccagttttctrttgtccctccagaagactctaaaggcaacattgtggacccaggaggggctcaggaaaagagcatgaaacagggggcaggacacaacttttgaaagaatga

SEQ ID NO: 69372 - DNA, 201 bp, Bos taurus
tcttatcagatatgcataaggtatgataaattttctaaacagcaaaatgataagtattggtcttttgttgaggactgccattgtatgctccaaggatgtaygtatgctaagttgcttcagttgtgtctgactctgcgaccccagggactgtagcctgctgggctcctctgtcaatgggattctacaagcatgaatacagga

SEQ ID NO: 69373 - DNA, 201 bp, Bos taurus
ggaaacactgagactttttcttttttttttctttaactgtcattgtctgttataaggtgattgttaatgtgccttgttaatgaagtttaatcagttcttarcaactcaattctataaaatggtccaagtagaaacagctttggggagctggtaaggtaaggaatagtaaaggtcattctaatttcccccattctttgttca

SEQ ID NO: 69374 - DNA, 201 bp, Bos taurus
tattaaaggaactcttatgtatttcatctctatggttttacttttcacaataaaaatgggggttggggccagggaacagtatttcagggttggtgacaatrgactcataaaggatacaggtttgactcagaaaaacatgaaaatttggaagctactgttaaatttaaaatactggtcaagcactatgctaggtgcataagg

SEQ ID NO: 69375 - DNA, 201 bp, Bos taurus
agaatgtaagttccatatggtcaggtatgaagttagtacatcctttgtttcttcctccctttttttccttccttaatttcctatttgcagtctcttttttycccatgatttattccactttggtcatgtatattgatatgtattattaaattaaaacacaaaggaaaagttggataatttccaattataagtttgagaaac

SEQ ID NO: 69376 - DNA, 201 bp, Bos taurus
acctgacaggggcaactatgaatatgtcaacacctcctgggtaccaggtggacaggaagctctccagcccggcagtcccttcacttggagctatggagctrcacacgtaccaatcactgtcatgtgatgaggcactgaggaagtgacaaggtaatggctgtcagtgtttgttcctctctagagtaactttggattggggag

SEQ ID NO: 69377 - DNA, 201 bp, Bos taurus
acactttgtgatgaacttcacctttccagctgactttatgtagcaccatgttcattatccagaataatagtcatctttaatatgtcacaaatctgaacagygatgacatctgttcccaaagttcagcaaaatatattaacaaggcttagactttatgaagaaagaggttgtctaggtgattctgagagatttcttttccat

SEQ ID NO: 69378 - DNA, 201 bp, Bos taurus
aaaaagccaaccgccatatcacctgcatgaagcaaaaacccctggagtgaagacaacttcagtcttctatatccactttcaatttattttaactgctgatmaatctttctttgttactgaagttcttaaaagcatgctttgtatgatttatctagcagagaaggttacgttcaggtgtaaggtcagtcatggtgtctgatt

SEQ ID NO: 69379 - DNA, 201 bp, Bos taurus
taattcaatttttcactaattaatattaaaggcctgtaattaatttcttcacattttctattatagattatgttcataaaatagcagattacaggaatccygacaaaatggctgaaaaataactgttaaagtgaaaaagcttccacaagggcatgttctaagaaaatcattttattttagataatattttagaaactttct

SEQ ID NO: 69380 - DNA, 201 bp, Bos taurus
cctgactgagccacattgtgagtctgcaaaacttgacctcagtggccagaaccagctctccccgaccccaggtgcctgccacccatccctcttcaccttckttccaaatctgttcttcctagaggctctgacaaggtcattaaccctgaagtgtaaatgactcataagacagaaaatatcccctcccctaggtgtgttctc

SEQ ID NO: 69381 - DNA, 201 bp, Bos taurus
cttttatgcctcctgtttaggtcctaataggtctgtgaaatgatctacactcctaatatctgcagtcagcagactttaatctgagccactctagggctggragcctttatgtcaagttgggcatgaatatgcagatgccctagagaaacagttaaaaatgcagttccaatttttatggctggaaacagaactctgtgtaag

SEQ ID NO: 69382 - DNA, 201 bp, Bos taurus
gctttgcccttggccatgatattacttattatttggtgaaggaaactgacaacagtcatctgaaaagttttctggagattgtatgcaatggcctttctcaygatttttctcttgttttctaaaagctagtgttttccttttcattttatccaaaggttttaataaaaataatataatacaaaaaggccacagagtactaag

SEQ ID NO: 69383 - DNA, 201 bp, Bos taurus
tgtgctcggcaacaagaaaagccaccaaaatggcccatgcactgcaacaaagacccagcacagccaaagatagatagataaaatcatctgcaaaaagagaragaggccagggcaggtaagagtcctagccactctagacaaggcagttgaccaagggccaattaagtcacaagagacttgcttttaaagaaaagaccaccc

SEQ ID NO: 69384 - DNA, 201 bp, Bos taurus
tgcaagtgtcagatttagtccaagggctcctgactctgctcaggagctctgagcggcatcaggagccctgtggttctgctgactccaacagaaagagctayagaatgcttggcttggcctcctccaaatcctcaagaagactgcagaatctctatgtccagcgacactgtgctcacggccccaggccctggctgtagccct

SEQ ID NO: 69385 - DNA, 201 bp, Bos taurus
ccaattaccctcacattactaaccttggcagtcttccctcatcctattccctggccactccttctgtgaatactgcacactgctgctcagctctggtaatytgtataactttttttttttttttactttgcatttgggcaaagaatccagcgcctcatcctattttatactatttcccaggctcttttcacatatacccta

SEQ ID NO: 69386 - DNA, 201 bp, Bos taurus
aggaaccgagggtttggggacagagggcagacgagggacgcaggctgaagaagcacagtccctgtcaaaccaagcaggcctgtgctgtgtggtgtgagggygccgccaacagccccttcctgaggctcctgggggctagccttcctggctctgttctgaagtcattcagagcagaaatgcgcgtgcccggccccaagtccg

SEQ ID NO: 69387 - DNA, 201 bp, Bos taurus
aaaacttgagaaaaaatatatacacttaagcaactaatttgtttccatcattatgcctgtactatttttatggtaattaatttcagcgggttgtttgtaamaatgacttttgtattagcctacattatcatgtctaaaaacatggattagggacataatgcacagaaaaactgctcgtattggtggcaaacaagtggctgt

SEQ ID NO: 69388 - DNA, 201 bp, Bos taurus
gcggctctcaaattggcctgttctttctagcaaagtcttgttagttccattaaatgccgctccgttgagtatttatttttctaccaatacagacacgactstgtaagcctttggccccggtctgtaatctggggttggttgaagatgccttgtcagctagttttgttgtaaacgttgtcaggggttcaggctttgctgctt

SEQ ID NO: 69389 - DNA, 201 bp, Bos taurus
cggagggcctttgggttagcatcagctctctgtcacaccaagtgctgaacagctaaggagcaggagtgggactttgctcatgagggctcagggtgaggctytggcgtcatctctgggccttcctcggcttggaagacccaggctgagacagccaaaactcagaagaaacccattcctccctgggcagaggccctcacgcaa

SEQ ID NO: 69390 - DNA, 201 bp, Bos taurus
acttcagatatgcagatgacaccacccttatggcagaatatgactaaggaacatgaaggaagatttaaatgtcactttaggcagcactatttcctaagagycttggtaatatctccagggccatggacattcaagttccttgattcttaattattgtattgcaatcaacttctgataggaccatagctaccataggtaatt

SEQ ID NO: 69391 - DNA, 201 bp, Bos taurus
atctggggcaaaatggggactgcagcctgggatagagcacctcagataccttttagaaactgctccaaagaggcaggggaaggtcaagatataggtgatayggcgaagatggagtatgtacaatcaagcacgtactttttgcagaaggtttccgctagtcacaaagagcagtcatcaccaggaaggattttagtgttcttc

SEQ ID NO: 69392 - DNA, 201 bp, Bos taurus; identical to SEQ ID NO: 29619

SEQ ID NO: 69393 - DNA, 201 bp, Bos taurus; identical to SEQ ID NO: 29620

SEQ ID NO: 69394 - DNA, 201 bp, Bos taurus
gagaaacagtgggctactgcccctagcctgaaaggattgactaggggaaaacaagaagtctaggacagggtatgaggtaacaatgataccagggaggcccstaggcacctgggtgaggtggttgattgtcatcaggttctaagttccaaaggtctgtgcggcccacagcctgccttacgacagaattacacatccgtgcaa

SEQ ID NO: 69395 - DNA, 201 bp, Bos taurus; identical to SEQ ID NO: 29625

SEQ ID NO: 69396 - DNA, 201 bp, Bos taurus; identical to SEQ ID NO: 29626

SEQ ID NO: 69397 - DNA, 201 bp, Bos taurus; identical to SEQ ID NO: 29627

SEQ ID NO: 69398 - DNA, 201 bp, Bos taurus
gctttggtgacagtttttttccctggatttaaaagcactgtgtggtaccccacaatcacaggttggtgattctcagatgtgcacttggaaatctagtaaaytgtttctgtgagccagaagtaccagagttttatctgctgctctatgaatatgctcttcagtgtgtaccgctttaaactgaaaggatcaattccattttct

SEQ ID NO: 69399 - DNA, 201 bp, Bos taurus
tccagtccgttacaagaactggtggcaagctgaattgggcccatgattaatgtttcctcaacccttgctctggatcgtagcaggcttcctattaggaaaamccctcttatgtttgcacggccctgacacgccacttcctatactctgtacctacaaccccaaagtgaaataaaccattgatttgcttttcccaccacttgt

SEQ ID NO: 69400 - DNA, 201 bp, Bos taurus
tactggaaagggccgctttggtcctgatctggccttgccttccacatgggatgaagaatctacgtggcagtggagacatgcccacttagagacttacctcmatgcttcaggtacttggggccctgtaactccctgcctgagtgacctcaagaccattttaccttgggcccactcccctgtacagagatcacattaccggtg

SEQ ID NO: 69401 - DNA, 201 bp, Bos taurus
tggcccccagcactgccttttctgtgccattcttcatgaagtgggggaggagatgggatctgtttgtataacttggggtccagagaagaaagcctggaagraggccccctacaatagagagcaaaggcacaaaagtgcgggatgaacccttcagggtcttcacagggtggaagatgagagctgagtgggcaggaggaatgg

SEQ ID NO: 69402 - DNA, 201 bp, Bos taurus
cacccttagcagtggagtggagcagggctgaggctcaagggcaaaggctttaggttcagagaggccagttcaaggctggtgctgccatctgtcatctgatygactttaagagtgtcatgtgaacccttgaaacccggctgcagaaaatgcagctaagagtgcaggctgctgtcaacatgaaatgaactaagggctgcgatg

SEQ ID NO: 69403 - DNA, 201 bp, Bos taurus
atgcatagttttgtatgcctttaaaaaatttttatatttattgggttagaaatcttattctactattgttttttttttttttttttctgcccttatcactrttcttacatgatatgttcttacatgttgctatgcatgttgggttggatttcccagaaaacactatgagatagaagattagcctgaaagaagtttacttag

SEQ ID NO: 69404 - DNA, 201 bp, Bos taurus; identical to SEQ ID NO: 29628

SEQ ID NO: 69405 - DNA, 201 bp, Bos taurus
tgtgagaaaataaatccctgaaacctatctctgaaggttgaatcaagcccagggaagagagcctctctgcctagaacaggtctgaatgtggcagcgggctyatccctgctcacacgttggccttcaaaccagtacttcattatggactctggaagaattatagccactctgggttgtccccatgctcgtctgctcttttat

SEQ ID NO: 69406 - DNA, 201 bp, Bos taurus
aaactggccatctagctcatgtcaagcgagtgaagattcctcggcattcagggttgtcttccccggggacagccctgtggctgggatcaactgccccaagyctgccccagctcctggccaatttgtgaatacagcattgaactccatcatttacaagttttaaagaactgacaacaggcaggttagatccctaacactcag

SEQ ID NO: 69407 - DNA, 201 bp, Bos taurus
cttttccatctccctagtttctgactcagttgaagaaataccaggaaccgaagccgctgttaagacatctggagaagacccactgtctcctttcctgcagyggtgggatagccctctggaatctcatctccttctggacttccctgactctttttaggctgagttttacagtgtataccctgctgcttcagcttgcccttt

SEQ ID NO: 69408 - DNA, 201 bp, Bos taurus
tggtcatcaaagaagacaggaaagatttctgggaacagggggacctcagttggacatgaaaactgaactgtttgagaggaggctgtgtcagatatctgggmtcaccatctggtttatcactagcttctgccttgagttgcttgtgacagtctatattttttaaacaatgaaattcctactgctgctgacccagaagcatgc

SEQ ID NO: 69409 - DNA, 201 bp, Bos taurus; identical to SEQ ID NO: 29633

SEQ ID NO: 69410 - DNA, 201 bp, Bos taurus
ccaaacacccagcccagcctgcagatgtagattattgcaatggttcccagcctttctggaaccagagaccagttttgtggaagacagcttttgcatggccyggaagtggtggggatggtttcgggacaattcaagcaggttacatttattgtgcactgcacttctaatctaatgcctccactgatctgacagaaggtacca

SEQ ID NO: 69411 - DNA, 201 bp, Bos taurus
ccactcatctcacgggccaggactgatccacatgcttgttcctatttgctgacaaaaagatgagagcactatgtcagctaactgtggtctgcccaggagtrgggccagggtctcagcagtatctgagttacctgcatcactgaagaaaattaggattctctgaagaaggaagagagggagagatggctgttagaggggcag

SEQ ID NO: 69412 - DNA, 201 bp, Bos taurus
tttgctcagactcatgtccagtgagtcattgatgccatccaaccatctcatcctctgtcacccccttctccttcttaactggttcctataagttggtctcyagctcatagactggcagagcgccatttcagttccaaacactcagaactttccccctcgatatcttgaagtccatgaactttaaatgaagtgaggcagatc

SEQ ID NO: 69413 - DNA, 201 bp, Bos taurus; identical to SEQ ID NO: 29636

SEQ ID NO: 69414 - DNA, 201 bp, Bos taurus; identical to SEQ ID NO: 29637

SEQ ID NO: 69415 - DNA, 201 bp, Bos taurus; identical to SEQ ID NO: 29639

SEQ ID NO: 69416 - DNA, 201 bp, Bos taurus
tttgcaatccagctatgcctctctgaccttggaataaggtgtttattttctttctcagggtctgagcttcctgtttgtagtgtggggttggtaataactgmtgtactcaattctgtggaacaggctagtttaagactgaatggaaacatgtgctgagtcccaactcaaaggcaatctcatttatttctctgcttccccctc

SEQ ID NO: 69417 - DNA, 201 bp, Bos taurus; identical to SEQ ID NO: 29640

SEQ ID NO: 69418 - DNA, 201 bp, Bos taurus
aggaaggaccaagctgtctagttgttgctgttgcagtgcccaaactgtttgccctgcccactgtttattgatgccattacaatatcaaacttggagcaccktggaagttgttttcatcctttattgtagttctttcctattctgttctttgtaagtgttggggaatggttataacttcatcaatctgattccttttgtttt

SEQ ID NO: 69419 - DNA, 201 bp, Bos taurus; identical to SEQ ID NO: 29642

SEQ ID NO: 69420 - DNA, 201 bp, Bos taurus
cgttgctgacccccatcaatacacagaggggtcagctgcccagagggctgcttccctggctgggagcaggagcctcaaggccttctcttctgaatccagcrcatcctttctccatggattcctcttcagtgactgcttaaggctctctaagtagggctgtgctataaaactcagagaattgcctggtcattcagtgtttgg

SEQ ID NO: 69421 - DNA, 201 bp, Bos taurus
catggagacctcaggaagctgaaaagaacccatgggggtttaagaatggcctttggatctactccttaagagggctctagcatgttacctctgttttccartgccttgctcaatggctttgttggcctcacacatactgggaacaaacaccccatacattccctcactggcaaatgcaagcatgtgtcatctcctcatgta

SEQ ID NO: 69422 - DNA, 201 bp, Bos taurus
ggtgggggctggggattagggagaggcttaggacccccacgtgactggtgcttttgcttccatttgcttctttgtgaagttctgtaatgaatgggccttgrggagaatctctttcccccttgcatttccttttctttgctaatcttgccacaaagaggtcctcagtggagggccaagcactgaggggaaggagctggggag

SEQ ID NO: 69423 - DNA, 201 bp, Bos taurus
gctgaggtcttctttctgcatttgaagcaagttctggttcaagagaagtgtggcctcttgggggtgtcagcttcacgattactctgtcattgacattacaygcttaaccttattcttactctgggccccgctaaactttcccacatcagagttccactagaatgctgtgcccaggggacgacctgaatattaataagcaat

SEQ ID NO: 69424 - DNA, 201 bp, Bos taurus
ccagcccctgtcctggccccacatggttaaaaagggaatgattcagggctctgtagattaggacttcagggatgtgatggaagcaggaagcagaattgtaytagtcactaaggccccatgcctctgacaccaactccaagaacactagcagccagaattttccctcccaaccagggatgagaggagaaacaagatgccaaa

SEQ ID NO: 69425 - DNA, 201 bp, Bos taurus
agaccagactgagaaatattcttaaacgttttcgacagtgatccaaggcaaattttctcttaaaaagaatgccagtctatcaagaccttttattcagtggktttcaggaccagattggaatacagaattatgaaatctatattcatcttctaatatctggactttttataaacatataataatatagataatagatgccta

SEQ ID NO: 69426 - DNA, 201 bp, Bos taurus
ttacaatattgtattggttttgccatacatcaacatgcatctgccacgggtgtacacgtattccccatcttgaacccccctcccacctccctccccttacyatcatcaagcatggaaaaggcagtctttgaccataaaatgtatattatatatttacttctacatatttcctgcaagagaagatacattttcatttgaatt

SEQ ID NO: 69427 - DNA, 201 bp, Bos taurus
gtagctcactcttggccttcgcttgaattcttttcaccttcttggatggttcctggtgtcccttcctcccaggctctgccatagatgatccagtgttcacrtctgtttctccttggatgggcccattggtatctggatttgtggatactttttgccctgggatctcaattctctgttgcgttaaataaaagctatgatctt

SEQ ID NO: 69428 - DNA, 201 bp, Bos taurus
acatttttataaacaccagaaccactcagggtgtgggctcttttatcagaaaaggttattgagcctccaaagagttctttggcccacagacatagggtccrtcactgggagcctgagaagtcattgctgggacctccccactgcccccttctttggttgcttgctctcaaccaacgtgaggctggaacagcccccttcttt

SEQ ID NO: 69429 - DNA, 201 bp, Bos taurus
ctttgaaataagcatcagggtcaccagttgttgctaaaaacacctcttcatcatttttacttcgccacggcctttcctttccctttagtgaagtctcgttrttttatgttgcagcatttgtccaaggcttccgtttttcatctctggtgcctgcagccacctctttcccaccttgaactgcagaatccaggggtaaacagc

SEQ ID NO: 69430 - DNA, 201 bp, Bos taurus
ttacagctgtcatcttttcacagcaaatcagaccattttagagtcctcaagtcttttcaagctctctatacagaaccaagatcacagattactctctacarcaatttctccttctttaatttccccaagagtttgttgttttccccactgacctgtttaactattcttgtgttcctctgtctgggctcctgtaaaccttgt

SEQ ID NO: 69431 - DNA, 201 bp, Bos taurus
agaacaagttgactctggctcacttatttattttctcttttcagatttaattttgagattgaaagaatatttatttgtatttgagatgctaacaccatcastgaactttttattgaaatttaagcacacagtgtacacgtaggacaatattttataaaccactgtcctcaagtgaaaaaagatgttagcaaaatattttaa

SEQ ID NO: 69432 - DNA, 201 bp, Bos taurus
cattttatggttatttgtgtttgtgtgatgttttataacttcctacactgttttttctgccctcattcactcaataagtgtcattaaatagtctcgaagarcatatctttattggcttctgactaatttattttaaggataaactataagtattatgattcctttagtgtgtgtttacatttttagaatattttaaaactt

SEQ ID NO: 69433 - DNA, 201 bp, Bos taurus
atttctcgtcctgttcaacagaatgatgacgctttcttttttttttttttttttaaaccaagagctgagaatttgctgtttaggataatttgttaaaacarcagcaaatcactgttatcaatgaggctttacttttttaagcaagtagaattttaggactagctcatcaattttctttcatccattggatttccttggaga

SEQ ID NO: 69434 - DNA, 201 bp, Bos taurus
tgtcaccagaaaactgtgcacagcaggatgctgttcacttgttacatataactctgttcctggcacccctgaaggcactagcaataaaactatgaataagmcaccaacacccctggcctcatggagctcacagttcagtaagttagtcatagcataaacagatggacagaaggcagacctctgaagaagcaaagagcttaa

SEQ ID NO: 69435 - DNA, 201 bp, Bos taurus
atggggaaggtgacttccactgaataaatgtgtaaaggaaacagagagagacaaagccaagttgaatttcattgccaggtgtcgtgcttgttccacatacyatatggaaagcatttcgctaaatctaagatgccactgatactaaggaaaactatacttttagatgctgcttagaacaaaaaaaaaatttctatccataat

SEQ ID NO: 69436 - DNA, 201 bp, Bos taurus
aatttctgaaggttgagtttctaggtcaaagaccatggacatttttaagggtttcagtacatactgcagcctgtcctacaggaaggccgtgccctttcacrctcccccagtgagcaagccagtgcgcatctcttgtcaacttctattagatttgtagtttctgtctgagaggccttcctgctttgtgcaatcccatcgcac

SEQ ID NO: 69437 - DNA, 201 bp, Bos taurus
accgaaaagttggcctgaaactatgtttgccagggctatatgtgttggtagtgggcttcactgtagggaaaacaagcttggtcctttcactggggacccamctctcagtatttgttggcctggttgctttttcctgtgagacacctgccaacattttgcccaggatgcttcagccaggttacctgcattctgggagctgaa

SEQ ID NO: 69438 - DNA, 201 bp, Bos taurus
agcctggtattgaccaagtttcacacaagattaacttggactctgctctgagttacagttggagacgacccaggcatacctctacacctctattaacaaayagagcaattttatgaacacaggccatggtggaaattcttagccctttgtgtattccactgatcaacctttgtaaagttataaacatagacctaggtccaa

SEQ ID NO: 69439 - DNA, 201 bp, Bos taurus
taactcacttcagtcaggggaactcccggcaaggaaggccaccccacagtgcttccctcatcagggaaatggagtcctacagttacagtttgggcaacacrccacaagtcctttataagaggccaagggaaaggaaggaagacaggggtgtctactaggtgccaggcactacacctgtgcttcacacaggtattcccagtg

SEQ ID NO: 69440 - DNA, 201 bp, Bos taurus
gagccccaggccagctctgctgctgagaagtgtgagtccctctccggactacactcacccttttggtgaaatgaatggctaaaatggagtcaatggcccayctattcctctaacacatactcgcccttacagtcatccacctatcttctccctacttggcacgctcctttactaagcaggggcccagcaacacacacaggc

SEQ ID NO: 69441 - DNA, 201 bp, Bos taurus
cccaaggttgcctctagaggcttcttttgaccccaggctgggctggcaggctgccggcaacactttcatctttatttttttaacaccaggccttctgtgcrccgctcctccccgttccctgcagcctaccgctcctcctgcagtaggaaggcggagaagagggccccttcccctctgtccttgccccctaaggcatctctg

SEQ ID NO: 69442 - DNA, 201 bp, Bos taurus
ggttttggggggcatcagcatggtgtgggccacagaaggacaatgaatgggatgcaggacagggcatccactgttcccggaatgaatttcctgcagctccygcccctcttctggccaggaactggggattttctgaggctctcacaccgcaggcccctctgtgacatgcagcctgggctgaaagtctgcacacatgcttcc

SEQ ID NO: 69443 - DNA, 201 bp, Bos taurus
gagagcctgttcccagagtcccaattaaatcagaaccaatcaatactttctctggttcctgctgttctgctcaggaaataatgagaaaaacaagggccccmgccagcaagcgtgggatggcagccctttgaagtctggagaaatcacccctgctatcaagagtgtgcctggcagctgtggcacctgcaactaaactcagcc

SEQ ID NO: 69444 - DNA, 201 bp, Bos taurus
attccttatctacattcttttccttttatctcagctccctttcccattccagcgtctatatttcctgatccttcaagctggccagacaccctcaaatccaygtgcacctctcctacgtctgaaaataccccatagccagagaactgagaagaaaagtgtgtctcacccatcctggctggggagctctggccctccacagca

SEQ ID NO: 69445 - DNA, 201 bp, Bos taurus; identical to SEQ ID NO: 29646

SEQ ID NO: 69446 - DNA, 201 bp, Bos taurus; identical to SEQ ID NO: 29649

SEQ ID NO: 69447 - DNA, 201 bp, Bos taurus; identical to SEQ ID NO: 29652

SEQ ID NO: 69448 - DNA, 201 bp, Bos taurus; identical to SEQ ID NO: 29653

SEQ ID NO: 69449 - DNA, 201 bp, Bos taurus
aagcatttccatttcatgcttgaaatctaggttcatccaaggccacatatccagtcagtggcaaagcaggaattcccacaggtgtcagctcactccaaccycctccttcccatggccacagaatgcctctcagttccagatactcttgtccatgaacatttgggtctgagcttagtgatctctgaggtccttttaggttct

SEQ ID NO: 69450 - DNA, 201 bp, Bos taurus; identical to SEQ ID NO: 29654

SEQ ID NO: 69451 - DNA, 201 bp, Bos taurus; identical to SEQ ID NO: 29655

SEQ ID NO: 69452 - DNA, 201 bp, Bos taurus; identical to SEQ ID NO: 29658

SEQ ID NO: 69453 - DNA, 201 bp, Bos taurus
ttcatttatttattggcctgccctcctctctctcactccacttgggttttgtgaggttttacgacatctcttctttaatcaggaccaaatgacctgtgacrttgcgcatgcctttatgtttattggccaacaccaaaaggaggatattatactctgacatccctggtgtcatacatagattgatattcactccaggcacac

SEQ ID NO: 69454 - DNA, 201 bp, Bos taurus
ctaagacatggtttcctaaacatggttgttctctctatgaggaaaaagatttaaaactggcaaaatgcaactacatttacagtaagcttaatgtacatacstagttggaaaatgcaacattctggctaattgaaaaatctgttagctaagagtcagggtgtctccatggctgattcatatcaatgtatggcaaaaatcaca

SEQ ID NO: 69455 - DNA, 201 bp, Bos taurus
ctgctttttggaaatttgtctgtcacagaactacacaggcaaactcgggaagaagcattataggaataaaatccagggacataattgctgcagctccttgkacaattcaggtcagaactatccaatataagacagagtttgtaatatcctattttaggaatctttgaaattgcccagatagacttctgtcagtaattccag

SEQ ID NO: 69456 - DNA, 201 bp, Bos taurus; identical to SEQ ID NO: 29665

SEQ ID NO: 69457 - DNA, 201 bp, Bos taurus
aacctctgggctaaaatataaactgtgaacgatggaccctgaaggattatccaggggagatcaaattctagtgccaccatttgcctctttaggaaagacargtcaattcctgatatttttttaaatgaagtctgagatgctctctccctcacatctctggcctcttccagacatgtctggtttctaggggcaggaagctac

SEQ ID NO: 69458 - DNA, 201 bp, Bos taurus
tgggataagtggttacgataaatagatttggggcttaaagaacaataagcttaataatcttgaaaaatggtttatgccttgagggctctggatagctaggrctttgcttttgcagtaatctacattttgggctcaaattcagtgttaatgttcacattacctgctggtttgtttcttcacttttctgaataccactctctt

SEQ ID NO: 69459 - DNA, 201 bp, Bos taurus; identical to SEQ ID NO: 29666

SEQ ID NO: 69460 - DNA, 201 bp, Bos taurus; identical to SEQ ID NO: 29668

SEQ ID NO: 69461 - DNA, 201 bp, Bos taurus; identical to SEQ ID NO: 29669

SEQ ID NO: 69462 - DNA, 201 bp, Bos taurus; identical to SEQ ID NO: 29671

SEQ ID NO: 69463 - DNA, 201 bp, Bos taurus
acaaacccaggtgggtcccaggccttctggggctccctcctggtggtgtcactcggccattcccactgttagaccaacagctactgtttagggccaaatcytcacgtcttttctgactttgagattcctgatcccgccccagagcgtgcagctcctgggaagttgagtccgtctgcacactctacttcttctgtaagacaa

SEQ ID NO: 69464 - DNA, 201 bp, Bos taurus; identical to SEQ ID NO: 29674

SEQ ID NO: 69465 - DNA, 201 bp, Bos taurus; identical to SEQ ID NO: 29677

SEQ ID NO: 69466 - DNA, 201 bp, Bos taurus
gaatgaatctccaattgctttaccagttggggagagcagaaggcatctgctgcctgtctcaggctgtccttagcatgctctaccctgatgacttcatgcartgatggtgagacatgagaactaggaccaagcttgggttagatgtcttggaaaatgaaaggaaacactagagctgggagaaaggaagtttcaccggaaaca

SEQ ID NO: 69467 - DNA, 201 bp, Bos taurus
accacactgtctccaatattgtgtatcatttaaaaaattcttctatgattgaattagttgttgaattattaattggaagccaaaaagagtaacttgttgcrtttgagggtttattacccttttctgactctttccctgggaaagatgaagcgactgagcaggtatccgcagtgtcatcataacttttgtgttctgtgatgt

SEQ ID NO: 69468 - DNA, 201 bp, Bos taurus; identical to SEQ ID NO: 29680

SEQ ID NO: 69469 - DNA, 201 bp, Bos taurus; identical to SEQ ID NO: 29681

SEQ ID NO: 69470 - DNA, 201 bp, Bos taurus; identical to SEQ ID NO: 29682

SEQ ID NO: 69471 - DNA, 201 bp, Bos taurus; identical to SEQ ID NO: 29683

SEQ ID NO: 69472 - DNA, 201 bp, Bos taurus
tttctttcctccctcattgaatagcagtcatgagatgtgaatagaactgaccctcacttaagcctattcacctgggcacagtcactgaggcctcccaagcygaagttcatggtcatcctgatagcttacggtgaacggtgttggattattgatctccaaagaagaagatttagcttcaggaccaggggccaggcttgatca

SEQ ID NO: 69473 - DNA, 201 bp, Bos taurus; identical to SEQ ID NO: 29685

SEQ ID NO: 69474 - DNA, 201 bp, Bos taurus; identical to SEQ ID NO: 29686

SEQ ID NO: 69475 - DNA, 201 bp, Bos taurus; identical to SEQ ID NO: 29687

SEQ ID NO: 69476 - DNA, 201 bp, Bos taurus; identical to SEQ ID NO: 29688

SEQ ID NO: 69477 - DNA, 201 bp, Bos taurus; identical to SEQ ID NO: 29689

SEQ ID NO: 69478 - DNA, 201 bp, Bos taurus; identical to SEQ ID NO: 29690

SEQ ID NO: 69479 - DNA, 201 bp, Bos taurus
aagtaaaggacaattcagggcaatgcctatgaaaattctgtcttttttacaggaatggacaaactgattctaaaattcatatgggaatgcaaggggctaargctaaaggaaacaatctcaaaaaagcagcacaggacttccctagtagtccagtggttaagaatctgctgccaatgtaagggactggttccacccctggtc

SEQ ID NO: 69480 - DNA, 201 bp, Bos taurus; identical to SEQ ID NO: 29692

SEQ ID NO: 69481 - DNA, 201 bp, Bos taurus; identical to SEQ ID NO: 29695

SEQ ID NO: 69482 - DNA, 201 bp, Bos taurus
gtaaatatttgttgcaccatttacatagatgattaactaaaagttgaaacaaagaaggtttatgcataaaaacttcctccagttggaatgatttttctctrtacattaggatggaaaacaggagtcgagctactttggggttcctgctgggtatttgggaaaattggttacataggtgttgtcactacgctgccctgagga

SEQ ID NO: 69483 - DNA, 201 bp, Bos taurus
gttctggaggcaggatgctttgctggggggagagcagggccagggtgaagcccccgcaaagatgcctgaggtccagtgtctcctgggggctaccagccagyggcagactttcaagggccacaattgagaagtcgcagcagatggctagtgaaaataagagaaatgtttgctcctgtgtggtccccgtgcacttggaaagtt

SEQ ID NO: 69484 - DNA, 201 bp, Bos taurus
aattaggatgacagggaggaactccaggcactgcatgatgcagaggcagttgctaaccagccccaggaggaagctgacacctgtagggtttgacggctctycccaggccattatggagccttctggaactggcatagccatggaaacgtgccatactccctaaagtgtgtctaggagatggctgagagcttgcagggatat

SEQ ID NO: 69485 - DNA, 201 bp, Bos taurus; identical to SEQ ID NO: 29696

SEQ ID NO: 69486 - DNA, 201 bp, Bos taurus; identical to SEQ ID NO: 29697

SEQ ID NO: 69487 - DNA, 201 bp, Bos taurus; identical to SEQ ID NO: 29699

SEQ ID NO: 69488 - DNA, 201 bp, Bos taurus
tgttttgcaaacattcctttagaggcacattggaaaatggcctcagggtctcaagaaggacacaggaagacctttagggaattagcctgagtccagagggyaaatgagtaagacctggtttggccttgggatgaagacatttgtatggtataatataaggaaatatttaaaaggtgagatgatcagtcagaaatcctacta

SEQ ID NO: 69489 - DNA, 201 bp, Bos taurus; identical to SEQ ID NO: 29700

SEQ ID NO: 69490 - DNA, 201 bp, Bos taurus; identical to SEQ ID NO: 29701

SEQ ID NO: 69491 - DNA, 201 bp, Bos taurus; identical to SEQ ID NO: 29702

SEQ ID NO: 69492 - DNA, 201 bp, Bos taurus
aggaattgagagggggctcagctgggtggtcctggcccagagtctcttatggggctgcagaaacctgaagtctagaggggcgcttccaagctcactcactyggttgttggccagagccctctttccttgccatgtggagctcatcactaaccagcccaaatgttcacaaggcagggcactgatcacgccagaacaatgacc

SEQ ID NO: 69493 - DNA, 201 bp, Bos taurus
tgtctatcaagtcatcacccatgaagagctggcccctttatttccagccagcactctgggctgctaagaaggcactcaagaatgttcatcaaattccctcrtggagagacaggccctggggctaccctaagtggtctcaccagcagtggccccagaggctggcccctgcaggttctgccaggcttttcgccttcctttctc

SEQ ID NO: 69494 - DNA, 201 bp, Bos taurus
ttaacttacatgcagagtaacagtctaagtgatgatgctgtaaatgtgataagggtgctcttggctcatggaagtggcctgatcttgctccttcttttctraatcctcatccctgctccctagcctctcccctgagctggtggaagaggggtgagggcctggattcccttctgagggctttctgtttctctcctgcagcct

SEQ ID NO: 69495 - DNA, 201 bp, Bos taurus; identical to SEQ ID NO: 29709

SEQ ID NO: 69496 - DNA, 201 bp, Bos taurus; identical to SEQ ID NO: 29711

SEQ ID NO: 69497 - DNA, 201 bp, Bos taurus; identical to SEQ ID NO: 29712

SEQ ID NO: 69498 - DNA, 201 bp, Bos taurus; identical to SEQ ID NO: 29713

SEQ ID NO: 69499 - DNA, 201 bp, Bos taurus; identical to SEQ ID NO: 29718

SEQ ID NO: 69500 - DNA, 201 bp, Bos taurus
tgggacttcctcttcctttttcttctacaaacgtctatgtaccaacatgtcacctaagagacactgacatattccgaggccccagtaggtcctgtttcagrctgaccttgatgtgcacataaccaggcaggcgtcggcggcggttgaagggcgtctcctttcagctggccccggcgcactaatcaggcctggtcccctccc

SEQ ID NO: 69501 - DNA, 201 bp, Bos taurus; identical to SEQ ID NO: 29720

SEQ ID NO: 69502 - DNA, 201 bp, Bos taurus; identical to SEQ ID NO: 29722

SEQ ID NO: 69503 - DNA, 201 bp, Bos taurus
acgtaccatcagtgtggctgtcatttttcttcaactctttgaagatgttaaaacacaaaccattcttggtgtgggccttacaaaaagaggcagagagcggrtttgtctgagagccacagttttaagttttaacaccccagtgttatggggcagccacaggccatttaattcagtgaagggtgggctaaactagtttgcttc

SEQ ID NO: 69504 - DNA, 201 bp, Bos taurus
cagccggtccaggaactggaactgccagtaacctctgtttgcccctgcttgttcccgcctcgactgcttcctcctcctcatgaggtaaacacgattctgcmctcggtgttcattttttgtttcgtttctgggacttgatcttccccactccacattgcattcctgaggtttgtttacattctgtgagcagctgtcgatacg

SEQ ID NO: 69505 - DNA, 201 bp, Bos taurus
tgtggcctggaccagctgctttcaccagcaccctggggacagttgtgctggccacatctgcacaggcttcctgaggctccacaggcctgagaggagcaggmtgagccaagggactgcgcaaggcagccttgggaaagagggtgacattcaagcctggctaagggtgtctagaaagatcagagctgtatggtctcctgtcca

SEQ ID NO: 69506 - DNA, 201 bp, Bos taurus; identical to SEQ ID NO: 29724

SEQ ID NO: 69507 - DNA, 201 bp, Bos taurus; identical to SEQ ID NO: 29728

SEQ ID NO: 69508 - DNA, 201 bp, Bos taurus; identical to SEQ ID NO: 29729

SEQ ID NO: 69509 - DNA, 201 bp, Bos taurus; identical to SEQ ID NO: 29730

SEQ ID NO: 69510 - DNA, 201 bp, Bos taurus; identical to SEQ ID NO: 29731

SEQ ID NO: 69511 - DNA, 201 bp, Bos taurus; identical to SEQ ID NO: 29732

SEQ ID NO: 69512 - DNA, 201 bp, Bos taurus; identical to SEQ ID NO: 29733

SEQ ID NO: 69513 - DNA, 201 bp, Bos taurus; identical to SEQ ID NO: 29734

SEQ ID NO: 69514 - DNA, 201 bp, Bos taurus; identical to SEQ ID NO: 29735

SEQ ID NO: 69515 - DNA, 201 bp, Bos taurus; identical to SEQ ID NO: 29736

SEQ ID NO: 69516 - DNA, 201 bp, Bos taurus; identical to SEQ ID NO: 29737

SEQ ID NO: 69517 - DNA, 201 bp, Bos taurus
aagagcctgagcgcctccactagctggacagctgctgcagaggaggacgaccctgcagagcagactgagaagacggacgggaaaggaggtgacgacacagkggggaggccgagggccgtgaggcaagacctcctagagtctgcctgtgatctcgtcaccacggatgcagttacggacctcgcttttgtaaccactagtttg

SEQ ID NO: 69518 - DNA, 201 bp, Bos taurus; identical to SEQ ID NO: 29738

SEQ ID NO: 69519 - DNA, 201 bp, Bos taurus
ctgtggccggctgcgtggcggaagtccctccgcacatcatcttggcggcaagcggggcgggagcgtgcggacaccgggcggcggtcacgcgggagcggcartcacgcggaagcagcggacactcgccggagcagcggacactcgcgggagtggtcgagcggagtcgagcgcccagacctggcgcggcggtcatgtgccatg

SEQ ID NO: 69520 - DNA, 201 bp, Bos taurus; identical to SEQ ID NO: 29739

SEQ ID NO: 69521 - DNA, 201 bp, Bos taurus; identical to SEQ ID NO: 29788

SEQ ID NO: 69522 - DNA, 201 bp, Bos taurus
agggggagctccacggagaggctgaagaaggaaggaagcgcctcacaagagggagagaagcttccgtgtaagatggcccaaagaaaaagctcctcacaccrttccccgtggatggaggagcctggcgggctatagtccacggggtcacagagtcagacacggccgaagaaacttagcatgcaaacacaccccgttccccac

SEQ ID NO: 69523 - DNA, 201 bp, Bos taurus; identical to SEQ ID NO: 29789

SEQ ID NO: 69524 - DNA, 201 bp, Bos taurus
aaggacagaggggaggggatagttagggagtttgggctggacatggacacactgctgtatttaaaatggataaccaacagggcctgctgtataacatatgragctctgttcagtgctacgcagcagcctggatgggaggggagtgtgagggagaatgcgtacatgtgtatggctgagtcccttcgttggccacccgaaacc

SEQ ID NO: 69525 - DNA, 201 bp, Bos taurus; identical to SEQ ID NO: 29792

SEQ ID NO: 69526 - DNA, 201 bp, Bos taurus; identical to SEQ ID NO: 29793

SEQ ID NO: 69527 - DNA, 201 bp, Bos taurus
ttttcacttgttttgtttatcatccggcttttctgttagaccaattgttctcagcgggggttgatgtcctcccaggggccggttgtcccggtctggagacygtcttgaatctcatgaatgaccaaggatgctacaggcatctagcaggtagaggccaggggtgctgctaaacattctacgatgcacagacagccccataag

SEQ ID NO: 69528 - DNA, 201 bp, Bos taurus; identical to SEQ ID NO: 29794

SEQ ID NO: 69529 - DNA, 201 bp, Bos taurus; identical to SEQ ID NO: 29796

SEQ ID NO: 69530 - DNA, 201 bp, Bos taurus; identical to SEQ ID NO: 29797

SEQ ID NO: 69531 - DNA, 201 bp, Bos taurus
gtgtatatatgtatgatggaataatactcaatcataaaaagaatggaatgttgccacttgaaggtacatggatagacttggagaatattaatccttagttragtaagtctgactcattggaaaagaccctgatgctgggagggattgggggcaggaggagaaggggacaacagaggatgagatggctggatggcatcaccg

SEQ ID NO: 69532 - DNA, 201 bp, Bos taurus
aggcaattttcctttcactgctttgctttctttctttttaatgaggattgtttgcagtaaaagcaggaggcctcacccatggccgcaggttgctgaaagtraaagtgaacgaaagtggctcagttgtgtctgactctttgcaactccatggactgtggccagccaggctcctctgtccacgggattctccaggccagaaca

SEQ ID NO: 69533 - DNA, 201 bp, Bos taurus
ttctcctggagaaaatcacgagaaccatctaagaccccctgaggaaaattcacaggaaaattctcagtgtttgaaatatcaatacacccccttagaagaaytgaaaggactgttcaagaagggcccaggtaagtaactcttctaacacaacatgctcagatacatattactctatttttgtccttcttaatgtaataatga

SEQ ID NO: 69534 - DNA, 201 bp, Bos taurus
cttcagggcctttcaagtaaactttctgcaggggtcagaggagccccacagaagggttatagccccacttcgtcattgcggggagaactacagtggatgcrgtgagcacgccaagggtgggaacaacagcagctttgaacatgtcctcttattacggaatctctgcctttgcatccccaactcctggacatggaagggtaa

SEQ ID NO: 69535 - DNA, 201 bp, Bos taurus
atgtacctaacaaatcttactccacttggtacaaaaatttccaagagtaaccttatctttggatttgaatccaaagctatgtggcctctgacaacaacttyactttgctaaactgatatttcctctcttagccataaaaagtaactaatgatgctcataactcctggggctgcagaaaggtttacatgaggccctataaac

SEQ ID NO: 69536 - DNA, 201 bp, Bos taurus
gatgtttctatttctgtaggtgtggagaggaactccagcttatgtaataaacactcaaggaaaatcttgccgtgttcaaggggcctcactctcctgtcttygggggaagggagggtctccaactgtgtttaagtgttgtcagcctgttttgggaaaagagaaagtgaccttttccccaaaactcttgaacaatctgggagc

SEQ ID NO: 69537 - DNA, 201 bp, Bos taurus
tcccagacagatgcaaccggcctggagcatcagggcaggacctaaagttctgttttgtttttttttttatttggggcccagacaggttagaacgaaggccygtgaactctatgtccagacccacgaagtccgcacccaggacgagctcctgcagcagagggaggctctgctcaaactcatcggcgcctatgtccatggcca

SEQ ID NO: 69538 - DNA, 201 bp, Bos taurus
actgaggaaagagaacccaaagttacagtacacaacacccacctaatgaagaaacaaactaaaaggtccagaacaggaaacaaggcctctgccccctcggrgtagacgattcaccagtgagctgataacccgaagccactgatgcctcgtctgtgtccaacactgggtaacctggtgtggagaaaacagcagcataagggc

SEQ ID NO: 69539 - DNA, 201 bp, Bos taurus
aagagaaacatatgtttgcagctgcagaggcctcagaggccttggctgtaaatgaaatgacacatgtaaggcacctttcacacagtctggcctataaatgygaggttccaggttccctgtgtaaagtgcagggttggtgcgtgccttttcccctacctgccccaggctctctccaccatgtcaggacacctcccacatcag

SEQ ID NO: 69540 - DNA, 201 bp, Bos taurus; identical to SEQ ID NO: 29803

SEQ ID NO: 69541 - DNA, 201 bp, Bos taurus
agctagaacgtggcaggtgataccggaagccagtctcccccagcccaggccccacagttcataagttgtagccaccaagacccctgttccctccccctccrtctcccaacccgaaggcttatggccaacagaccgcctctgtcacagcacagcattcacagtcctttccagtcactttgtcctccgctcctcttcacctgc

SEQ ID NO: 69542 - DNA, 201 bp, Bos taurus
ctaaatcattagctcaatcacctttagtggcaccaatcatctccactctccctccttaacctgatgtttgaaagcactaacctatcgctgaaaccagttgmtgttcagtcgctcagtcatctccaactctttgcgactccatggactacagcatgccaggtttacatccttcaccatctcccggagcttgctcaaactcac

SEQ ID NO: 69543 - DNA, 201 bp, Bos taurus; identical to SEQ ID NO: 29804

SEQ ID NO: 69544 - DNA, 201 bp, Bos taurus; identical to SEQ ID NO: 29806

SEQ ID NO: 69545 - DNA, 201 bp, Bos taurus; identical to SEQ ID NO: 29807

SEQ ID NO: 69546 - DNA, 201 bp, Bos taurus; identical to SEQ ID NO: 29808

SEQ ID NO: 69547 - DNA, 201 bp, Bos taurus
ctctgtgaggatgagccctcaccttaggcctagactgcaggcttgctgttagacttgaaaactcagagtctgctgtctttgttcttggttttggggccacrttgtagtcagctcagcggttgtaacaaaaaaccacaggttgggcggcttaaccaatatgagatttattttctcctgttgctggacctcatttagccttaa

SEQ ID NO: 69548 - DNA, 201 bp, Bos taurus
gggctacgtctgcagacctgttagaatgtctgagatttaaagtgtcgaccatggcaagtgatgccagtgacgtggagcaactggaactctcatgttgcttrtagtgtcagcgggagtgcaagggctacagctgtcctggaaaacacttctgcagtttcatgtgaaaccaacacacacttgacggaatacctagcggtgtga

SEQ ID NO: 69549 - DNA, 201 bp, Bos taurus
ttatacaaattattcatttaatctttttctgtccttcccaataaataagttctgccaggcaagattccaggctgggtttgttcgccaacaagctggccaascccgagtgcctggagaaggctcattaacaatcatcgctaaatgaagaattcctccattgacccatacggccaccacccacgtcatgaccacactagaact

SEQ ID NO: 69550 - DNA, 201 bp, Bos taurus
tgaagaagttcaatgtgtatgaactcaggggattaggagtttctgtccgattcaggccagtggcttgagccaggagagctcacggccaggcagccccgaaragaagagaccagagatctgctggggagtggagaatgaaggctggcctcagagagagcggcccagagctgaagcagggtgcttgggctctggtcttggagc

SEQ ID NO: 69551 - DNA, 201 bp, Bos taurus; identical to SEQ ID NO: 29811

SEQ ID NO: 69552 - DNA, 201 bp, Bos taurus
ctcttaaagttgccacagtacttagagggagaagaagatgagaggggaaagttgtgattgtctgagcttcagcaaaggggccaggactgggctgttagtgrcgtgacagagtcagcagctggtgacctagggctggggggagacacttcacagagggcaccggggttgttcaacatcgagaacatccctcctaacctgtgg

SEQ ID NO: 69553 - DNA, 201 bp, Bos taurus
taatagttaaaatggtttaatgtttgttcttggaggaaatacagtgagttgcttaggcttttatttctattaatccatgctaatagattatatgaaatatraatagaattatttggaggttttcatattggggctgatagaattcctgatataatatgggtttaaaggatgtgtttgtctttggggtttttggtggtttgt

SEQ ID NO: 69554 - DNA, 201 bp, Bos taurus; identical to SEQ ID NO: 29812

SEQ ID NO: 69555 - DNA, 201 bp, Bos taurus; identical to SEQ ID NO: 29814

SEQ ID NO: 69556 - DNA, 201 bp, Bos taurus
agaacccaggcccaactacaaacaagcaacagtgcaaaacaccgaacaaaaagggccttgtcacgggtgacaagtcaaaacaggactcgagagagggtgargtcaaggtaaaccacatttttcagaaagatttcacggagtgtgcaggacatgagctccaagttaggaagaaagtacgcaagctttagaagagcatgttta

SEQ ID NO: 69557 - DNA, 201 bp, Bos taurus; identical to SEQ ID NO: 29817

SEQ ID NO: 69558 - DNA, 201 bp, Bos taurus; identical to SEQ ID NO: 29818

SEQ ID NO: 69559 - DNA, 201 bp, Bos taurus; identical to SEQ ID NO: 29819

SEQ ID NO: 69560 - DNA, 201 bp, Bos taurus; identical to SEQ ID NO: 29824

SEQ ID NO: 69561 - DNA, 201 bp, Bos taurus
gatgctcagctttacatctagaaaatgagggagtctcccaccagagttcttattgccctccaccaaaattcatcctacaataataataaatctccgtctcrtttcaaaaacccctgacagtatgccaggcatctcagaggaaaacatatgaccccatgaaagaaaaaaaaaaaaaaaagtgggtgggggggggttgaacca

SEQ ID NO: 69562 - DNA, 201 bp, Bos taurus
tggatgcagggtgctgatgaagccgggacagggcagactccatcggcatctctgcgtctgtctcttgctcggtctaactacaaaaacctgcagggcatgayggctacagcttcctctacacctttcaagaacctcatgcaaacttttggtcaacttccctctagcaccataagtggacggatattctggggaaatccttcc

SEQ ID NO: 69563 - DNA, 201 bp, Bos taurus
tgccctcggctgcctctggcccccgtgacaagcttccagttgtttttggtaagaacacaatgcaatgtctttttaaactctttctagaaaaataggctcaygattattcactcataggccagatattttttttataaactaaggacattttgcttatacagacgacttgttcaataataggagaataactctaatgagtta

SEQ ID NO: 69564 - DNA, 201 bp, Bos taurus; identical to SEQ ID NO: 29827

SEQ ID NO: 69565 - DNA, 201 bp, Bos taurus
atcctccctacaagtacctaggtaatgcgcctcacctgcctaaaattcttcaagcatgctacagactgaaaaataatatgtgtccaagtataactgaatcrcctttctgtgtgcctgaaaacatggtaagtcaactacacttcaataagatatatgtattaaaaaaaaaagaatgctacagacaatatttgtgtctccctc

SEQ ID NO: 69566 - DNA, 201 bp, Bos taurus; identical to SEQ ID NO: 29829

SEQ ID NO: 69567 - DNA, 201 bp, Bos taurus; identical to SEQ ID NO: 29830

SEQ ID NO: 69568 - DNA, 201 bp, Bos taurus; identical to SEQ ID NO: 29831

SEQ ID NO: 69569 - DNA, 201 bp, Bos taurus
tctggatttcctcttgcagatttttagatttctgtgaactgtttttctgcacacatgaagcttcttgcttgctgccttgacagaaaccaggggatagtagyccctgctggtttttcttactagcattctgtattattaatggctgacctgaggttcttaagtctacccaaactgagctggtatattactatgaaggtactg

SEQ ID NO: 69570 - DNA, 201 bp, Bos taurus
taaaaatggagagcagattacgttagcagatttaaggcttaatttaaattcattaacttctggatggggatccttggccctcccagtctctaggctttatrtgtctcctgtgttcctggtctgcctgccatcctgatgaacactatggggcctaaagcggacactgtgggctggggtttgcaacttcattaggattctgct

SEQ ID NO: 69571 - DNA, 201 bp, Bos taurus
caatcacctgagggtaaaactgaactccaatagcaaaaaacaacaataagacaaaaagtaaaaagccaggggagaggccttagccagggaagggcttaggkgaaggtggggtttaggtgggggcaaggtctagggtcaggacccatgccactggaaaggccttgggtgagttggagggcaaggcccaggctcagcccctcc

SEQ ID NO: 69572 - DNA, 201 bp, Bos taurus
ggaagcttatctcaggaaactcggcagagggattggggcctggacagagggctagcttccaggaccatttccctggagatgaaggcccagagaatgggtcrtctgggttggggaggaaatgtggagccactgtgagcagtgcggatattcacttggaaattggccttgctgagactcacgtgttaggggtgcagatccctg

SEQ ID NO: 69573 - DNA, 201 bp, Bos taurus
gcaatgttcatccatgttgagatgttatcaggggagtcctagtggacagtcaggattttcacagtcacccgatagcaacaaggccaacccctacctttttrgtttcagggagaaacaaggcacctctaccaccttgagaaggtgtggtacagcagaggccaagtggggtgcctgaactcacaacatttatcaacagagtca

SEQ ID NO: 69574 - DNA, 201 bp, Bos taurus
ttcaaggtcagatctttcccagttcctgagaatatggcctagaggtgagtctgagggaggttcttgagatgtacgtgagctcatccttagaatgggtgtaytgaaagttcactggcctagaaggtgtctcaactgtaccagtgaaatcgctgcatgcctcaaggcacagtacggctaatggcacaaatagccaacagttct

SEQ ID NO: 69575 - DNA, 201 bp, Bos taurus
aaaaaagaaggaaaaactggcatttgtagaaacataggtggacttgaaggacattatactaaattaaataagtcatacagaaaaagacatacagcatgatrtcatttatatatggaatctgaaacatacaacaaactagtgaatgtaacaaaaagaatcagacctacagaaatagagaacaaactaatggttaccagtggg

SEQ ID NO: 69576 - DNA, 201 bp, Bos taurus
tggccttgaattcaaagctgtgaccctgaacttgaaagcacaaagatagatgggagagaaacctccatgggctttgagggaggcaaaagaaaaatcctttktttctgtttaaatccagctctggccctgtttgtgctacattctgcccttgcagcagttcttggcccacaccccggggtggtctcccctggcaccttccat

SEQ ID NO: 69577 - DNA, 201 bp, Bos taurus
ggatatctggtctgtgagcatgaaaaagtaacccaagatttgactgatggctgactgaaagacaaggattccatccaaggagcagtgagctcaggccagartcaccaaccacatacggtcatgtgaatgtaattttaatgtaaaataaaataaaataaatttccttagtcacctcagccatgtttcaaattacaaaagcca

SEQ ID NO: 69578 - DNA, 201 bp, Bos taurus
agcacatcaagaaaaaacacaattggccttggatgattgactaaatggtgttccctgcacctaggctttgccagccttcagctgacgatgctacctttackgggtgagataagaaggcagggtaaaatgggcacaggccagtagagtcttgcaacaaagtcattaagcaatgccctcggtagactcagatgaagcacagta

SEQ ID NO: 69579 - DNA, 201 bp, Bos taurus
tcccatctccacctccaaaaaggtctccttaaaaggccatgtgtgaacattgtaagaagtgaccatctttaaaacttactacaaagataatcagactctgstattggcctaagattagacatatagatcagtaggaaagaatttagagtccagaaaaaagccattacatttactgtcaattgaattttgtcaaggatgcca

SEQ ID NO: 69580 - DNA, 201 bp, Bos taurus
cccagacataccctccccactgtatcctgtctggattcctgacccacagaatcatgagtcttactgatgggggtcatatgccactcagtttgggaggcctrtgatacaacacggtgactgcctcaggtacagaggtgggagagatgccactcttacacaagaacagccaggggcccaagcctggaaggaccacaacagaaa

SEQ ID NO: 69581 - DNA, 201 bp, Bos taurus
tggagatcaaccagcctgggcttcctgtttcagagaagatgtaaagaagggacatgcttgcttgtccccacatgggaccacaccaaaccccacagattccyagaacctagttgcaaaacccactcaggcccacgtggtcccttcactaaaagcagggagagggccctggcccgcccggtctgttgcttgtccaaggccata

SEQ ID NO: 69582 - DNA, 201 bp, Bos taurus
caggacagctgtgttattcagcttgatgatggccatggactctttgtcataagcacttccacttccatcttcctttagcccatatatacaagacacatcarttacaacatcaatcatgtcacagcaaagttcatatgactgcatatccacaggagaactgtctgttgcaatgtagattttgctgacaacattgaagagaaa

SEQ ID NO: 69583 - DNA, 201 bp, Bos taurus
ggggagcctggtgggctgccgtctatggggtcgcacagagtcggacacgactgaagtgacttagcagcagtagcagcaggataaatgatgcttagacatgyagttctatcaacttgcaaagcccctcaggtcagtcagtcggttaacaaacagtgccacttaacggcaagagtcagaccaagcagcatctctaacctgtgg

SEQ ID NO: 69584 - DNA, 201 bp, Bos taurus
cgatggcccttgctgatgggaacaaggcctgccgttccaggagctggcagagctccgggggtctgggacagctgagaagacagcttgaaacgagctcctcygaccagttccaatcaggccacctcaggatgactcagaatgtcaggccttctaaaattaatctgtgtccacatctaaaatcagcacctcacttagagtcac

SEQ ID NO: 69585 - DNA, 201 bp, Bos taurus
cttagaaaggtgggtggacattagaggccaggtggaggggatgtaggggagaagatatgcagacagcccaggatgtgccctatgaccctaggagagggggygaggggaaggaggggcccaatggcacaggtataggaaaccagctgctctttgctttcaaagcctgatttagaagagagcatgattcagcaggggcttccc

SEQ ID NO: 69586 - DNA, 201 bp, Bos taurus
gagccaggagcccggctggttcccctgggagcctgttgcttttctctttctctggttttctctccagctcccttctgcattctggattcttcttccacackgtctcctggcctccactcagcttctcgcctggctctgtggcttctggatggttcctgccaccttcccactgtgcctggaatcgaccgaagggtcgtgggc

SEQ ID NO: 69587 - DNA, 201 bp, Bos taurus
tgatgtcctgtgaatgcctttcagtgctgctgctcttctctgctccacgctagatacatgcacacagctcttccttaattccctagagtacagccaaggcractgaaatactcagcccttcacggacgcgttagggataattcaagcacaacatagaaagtgtcttataattcagctgccactaaaagtgactctctgctc

SEQ ID NO: 69588 - DNA, 201 bp, Bos taurus
aacccaatttccaagtaattatgctcacaatgataatcagacatcattttacttgatgtcttgtttcacgtctcttttacagatattaggccttctgattytgtgtgaatgtcagcaggcagtgttatagttcttaacactgaggaaattgagacttaggggttatggggtgagcccaccattccaccaccagtatgtaac

SEQ ID NO: 69589 - DNA, 201 bp, Bos taurus
atgaagcccttcatttgtatataagcgtttgctgttctaatcaaatgcaacttgagatagactttaattttaacacatttaagtgttaacacattttattrtatactggattattgcacatcataataattagacataaatactaactttgtatttttgtcttctcattttgccatttcttcaacatgcaaaaactaaggt

SEQ ID NO: 69590 - DNA, 201 bp, Bos taurus; identical to SEQ ID NO: 29833

SEQ ID NO: 69591 - DNA, 201 bp, Bos taurus
tggcccataaactgtgtagaaataaggactgtaatcatcatgtatattttctttttttttttttcattttcatttgcttccctgaggtctatcggtatccraatctaattatggactaggcctgtgtctggaagcaatgagaagcaatgggtttgactttgaggagattccttatcctctgacaaatcaactatcttgggt

SEQ ID NO: 69592 - DNA, 201 bp, Bos taurus; identical to SEQ ID NO: 29835

SEQ ID NO: 69593 - DNA, 201 bp, Bos taurus; identical to SEQ ID NO: 29836

SEQ ID NO: 69594 - DNA, 201 bp, Bos taurus; identical to SEQ ID NO: 29840

SEQ ID NO: 69595 - DNA, 201 bp, Bos taurus
atgtttataagtaatgtcttacctcagatcctctttcacctctgttacctcggggccccggtggtccaatgggaccagggtgtccacttgctccgtccttkccagggggcccgctaggtccaacaggtccctaagaaatgaacatgatatcacaatgctagaatacttccctgcagtgcaaaaatgttaaaacatggaact

SEQ ID NO: 69596 - DNA, 201 bp, Bos taurus
gactgattagaaggacaaacataaactgtttagaaccaaatgggtcccagatgacagacaaagcaacttccactagatcttgagcctgagtatacagtcaytgaagcacatcagcaagctaaatgacatacctggaaatgccctgactattctgaggtgaaccatcaaagaccaagaagtgggcagtgacccaattcctgg

SEQ ID NO: 69597 - DNA, 201 bp, Bos taurus; identical to SEQ ID NO: 29843

SEQ ID NO: 69598 - DNA, 201 bp, Bos taurus; identical to SEQ ID NO: 29844

SEQ ID NO: 69599 - DNA, 201 bp, Bos taurus; identical to SEQ ID NO: 29845

SEQ ID NO: 69600 - DNA, 201 bp, Bos taurus
tctccattccccctggcatccatctctctcctctttgtcaggatttaaagatactcgaatcttgactttgttaaaacaaaccaaccaaaaagctctttacycagcgcttctttactcctctagaccctcatttctctttctcttctctattgaagctgagctctttgaaggaggtattatatttcttgcctgtttacttca

SEQ ID NO: 69601 - DNA, 201 bp, Bos taurus
ctcctacccagcatcaagccacagtcactttccttgagtggacctctccactggactcctgatgtgtgttcacccctgcctcttacagctaatttctgttmaaagcttctttcacttcttgtcactctttctctcaaaactctctaaattgagtgtttctcaaattttacagtgaccaacgctggagaggtggaaatttcc

SEQ ID NO: 69602 - DNA, 201 bp, Bos taurus; identical to SEQ ID NO: 29846

SEQ ID NO: 69603 - DNA, 201 bp, Bos taurus; identical to SEQ ID NO: 29849

SEQ ID NO: 69604 - DNA, 201 bp, Bos taurus
gccacaacatgaagctgccattggatgagctctcaagttcagaagagaaataaagctacataagctgtatataaaattcatggggccaaccttgtatgcartcccatttaatttctcattcagttcagttcagtcgctcagtcgtgtccgactctttgtgaccccatgaattgcagcacgccaggcctccctgtccatcat

SEQ ID NO: 69605 - DNA, 201 bp, Bos taurus
tatatagtgatgtataccaattatttttcaataaaactggaaaaaatcttaaattgaaatagcatgctatataggaacatattcaatagtgaaagataaamgaccattatttttttaaaaataagattactgaatcaattatttttcttttgtagccctatctccttgacctcatttcatatcatatttacaaagttttca

SEQ ID NO: 69606 - DNA, 201 bp, Bos taurus; identical to SEQ ID NO: 29852

SEQ ID NO: 69607 - DNA, 201 bp, Bos taurus
acttgtgcaagttttgtttttttgtttttaatgtacagttttatatctttaagcttttgttttatctccaatatctagatcaaaacacctttgagaaatgygtcttattcaaatgcattatgccatcagctgatgcttgcttgttcataattctaggctttattttcttattggttgtacaacaactactttgccagaata

SEQ ID NO: 69608 - DNA, 201 bp, Bos taurus
aattataaggagattaagaaagatcctttgcaactggagcttttacttctacatataataatttatatttgtagtttaggataaatagcttacatttattkattgataatgaagaatattatgcatttccaaaaacgaaagagcttgtcattagatgtggaaaaccctagtctttttcaagatgcaataatccataaaaaa

SEQ ID NO: 69609 - DNA, 201 bp, Bos taurus; identical to SEQ ID NO: 29854

SEQ ID NO: 69610 - DNA, 201 bp, Bos taurus; identical to SEQ ID NO: 29856

SEQ ID NO: 69611 - DNA, 201 bp, Bos taurus
gatcaggaccttttcagtctccatttcctcaaatttgttccacatccaacttccagactcatattcccaaattgcctaattcttcactgcctggccaatargacagcctcctcagactgctgatcacatcctcttcaaacagcacttcccaccaagtctccatagggccctacattttagctccacctgcttagttctaag

SEQ ID NO: 69612 - DNA, 201 bp, Bos taurus; identical to SEQ ID NO: 29858

SEQ ID NO: 69613 - DNA, 201 bp, Bos taurus; identical to SEQ ID NO: 29860

SEQ ID NO: 69614 - DNA, 201 bp, Bos taurus
cagacttaggatataatgtaggcctgaccaaaactgtctttctaagctcaaataggaaaaaaattagtatttgtgtaacacacacacacacacctcttccmccaggcccagtactagaaactttatatacgttgtccaatttcatctcaatacaaacccgcaagacttcccccgttttaaggcaagaaaactgaggcaaac

SEQ ID NO: 69615 - DNA, 201 bp, Bos taurus
atatgattaacattatggcatttttttaagacccacagagctatacaacacaaagaatacactttaatgtagtttggactttaataacaatgcatctataytgattcattgattgtaacaaatacatccccctaatgcatgatgttaataacagagaaaactacatgagagtgagggagtaagttggaactctgtactgtc

SEQ ID NO: 69616 - DNA, 201 bp, Bos taurus
caaatgagagttattaaactgtattagataatcatttaataatagagaaaaagtgttaatgtcagcagttaacatcagccaagtcaaccagcattataackcaattctaacttaggctagatatgaaacagaagagacataaaaggaaaagtcatgtgctatgttgttgtttgggaagtcttgcccttaatttgaactctt

SEQ ID NO: 69617 - DNA, 201 bp, Bos taurus; identical to SEQ ID NO: 29861

SEQ ID NO: 69618 - DNA, 201 bp, Bos taurus; identical to SEQ ID NO: 29863

SEQ ID NO: 69619 - DNA, 201 bp, Bos taurus; identical to SEQ ID NO: 29864

SEQ ID NO: 69620 - DNA, 201 bp, Bos taurus; identical to SEQ ID NO: 29867

SEQ ID NO: 69621 - DNA, 201 bp, Bos taurus; identical to SEQ ID NO: 29868

SEQ ID NO: 69622 - DNA, 201 bp, Bos taurus; identical to SEQ ID NO: 29869

SEQ ID NO: 69623 - DNA, 201 bp, Bos taurus; identical to SEQ ID NO: 29871

SEQ ID NO: 69624 - DNA, 201 bp, Bos taurus; identical to SEQ ID NO: 29872

SEQ ID NO: 69625 - DNA, 201 bp, Bos taurus; identical to SEQ ID NO: 29873

SEQ ID NO: 69626 - DNA, 201 bp, Bos taurus; identical to SEQ ID NO: 29874

SEQ ID NO: 69627 - DNA, 201 bp, Bos taurus
aactcatagatcagtatgactatatatttgatattttctgtgatgcatttcagcctacaaatctgtttgtttctagttgcatttatgatatatttcaacartttttcaaaaatttgattagctaaaacaaaggataaaaatcacgtgataagctcagatgctgaaaagttacttaacagaatatctgtacataataaaaac

SEQ ID NO: 69628 - DNA, 201 bp, Bos taurus
caatctattcatttctttggcaaaggtctttctcttctattgcctacatgtttctcaaactattttttctcttctttatgccttaacttgtgctttgttawattctctgcatcttttttcctgatacaatgaaatagcctccagttaatcttcctgtaatatcctggccatgactaattcatcatccaccactgtcatatt

SEQ ID NO: 69629 - DNA, 201 bp, Bos taurus
actgtacatggacaatggcagcagcctagacctgattagagtctggtatggttcagaaatttgaggaaagaggatatggattagggctctggatgacactragatgagcagagtactagctgagggtgagggaagcttagaaggggagagagctttacttgcatccctgagaccagctttagtggtaagggctgttgttga

SEQ ID NO: 69630 - DNA, 201 bp, Bos taurus
tatcaccaacttaatggatatgagtttgagcaggctacaggagttggtgatggacggtgaagcctggcatgctgcagaccattgggccacatgcttggacrtgaccaagaaactgaaatgaactgagagttaattgaaaatatttagctaaaaaataatattagctgcaactttttcattgtaaatttggagttgctttag

SEQ ID NO: 69631 - DNA, 201 bp, Bos taurus
catatgcaaaagactgaattttttgtgatataatcataaggagagagattactaaaagtagtattattgatgaaaaaattttactgtctttgaaataaagyattctaacatatttcctgtgagataacatgtaagatatcttggtaggtactgagcaaccaatattttagtgatatgtcctggaagaaataagagaaagaa

SEQ ID NO: 69632 - DNA, 201 bp, Bos taurus; identical to SEQ ID NO: 29880

SEQ ID NO: 69633 - DNA, 201 bp, Bos taurus; identical to SEQ ID NO: 29881

SEQ ID NO: 69634 - DNA, 201 bp, Bos taurus
taggagttggtgatggacagggaagcctggcatgctccagtccatggggtcacaaagagtcagacatgactgagtgactgaactgaactgaactgaggttyttctaggctccatctaggatcctaggttcttattcttcctatttacagagttgtgcctatttggaactagtggttatttttcttaagttgaatggcaaat

SEQ ID NO: 69635 - DNA, 201 bp, Bos taurus
cctgggtatattgttaaatggcagattctgatttgcggtgaggctgagatcctcctcttctaacaagtttctacatgatgtggacatttctattctgtagrctacattcagaatatcagatagttctagatgattgtgttgaagtttggcagacttacggtttactgcatacatgtccagtatggctggattctatcagaa

SEQ ID NO: 69636 - DNA, 201 bp, Bos taurus; identical to SEQ ID NO: 29886

SEQ ID NO: 69637 - DNA, 201 bp, Bos taurus; identical to SEQ ID NO: 29887

SEQ ID NO: 69638 - DNA, 201 bp, Bos taurus
ttaccccttgcaacttttgttttaatatgtggcaccattgttttcccagatcctcaacacttacacttcatcgtccatctaccaataaactctttagtccrtccgccccaaccattcatcacaaatgtgatgaccacccttgtactggcatactcaatgccatgaacagggagggagtgaaggagtgaacagctgattgca

SEQ ID NO: 69639 - DNA, 201 bp, Bos taurus
atatcaaatatgaatttctataatgaatacatgtcatctatgtcaatatcaaaaaaagaaaaagaaaaacagaaaactacaggtagtttgtcttatattaraatctttttttgtgggtgggttctctagagacctgtctgatatcccagtatttgtttcagctccttgacagctacttgaacctcagcttcttcatttata

SEQ ID NO: 69640 - DNA, 201 bp, Bos taurus
ctcttctaaaaatgtctcccacagttttatcagtaagattttccaagactgaaaagctgaaggtgccatttccctgactatagcccaccagtgactacccrttacttgttggatatagtctgagctccctatatggcacatacaatttgacatttgttgattttccagctttatttcctgctactctccctcacacctata

SEQ ID NO: 69641 - DNA, 201 bp, Bos taurus; identical to SEQ ID NO: 29891

SEQ ID NO: 69642 - DNA, 201 bp, Bos taurus
aagaattatattttctcaagaaattggcctgtttaatcaccatattagagatgctttgtgaagaaattctaatcttccagaaagatcaagatctagaagtyatcacggcctcttgttcagacacagagaaaatagatttgacataggtctagtgctgtggattgattgacattaaatagactaactaagggttgaaaactc

SEQ ID NO: 69643 - DNA, 201 bp, Bos taurus; identical to SEQ ID NO: 29892

SEQ ID NO: 69644 - DNA, 201 bp, Bos taurus
ttaatctagcccctataaaaccattatcatgtaagtacaaatagggccctaaggatatgaatatgttttaaaaggtgggagagtggaaggaggaagagaayacaggaaattgaggttttggccatgggtaatgtgaactaatataaaggaagaagaaagagccagcaaccatgtacatggaaaacctctaacacatgccct

SEQ ID NO: 69645 - DNA, 201 bp, Bos taurus
actggaattccagactaccccacccaaaaggccccagcctgcttagtttcttccccagtccccaggcatgggttgttccatttgcatgaaacatccctaascctgagggaggcccaagaggcagctgtctacaggggctatgatatgcatatgtgagtagatgtggccacctgctactcttgagacctctcatcttataag

SEQ ID NO: 69646 - DNA, 201 bp, Bos taurus
ttatcaccaagatcatctttagtctttgtcaaaaccattgtttgccattcgtggcgtagaattgatgaagaacttgcattgtgagtggagcacataagccytttcaggatgaatacaaattgaacttgatagatttcccacaatatttgtgcctagaattagagtagtagtgacatgtgagtcagctgctggtaatttttt

SEQ ID NO: 69647 - DNA, 201 bp, Bos taurus
gtgaagaaagtctctgggtgagagatgggtaaattttctaagaggcagagaaatatccaagaagaaagtgattgaaacattgctctttcgaattcaacatyactaatacctcattgatggatttaagtgctcgtgactaaggcacaatggtaaaagggggaaaaaaagctttctagatgctccagactccttcaggaaaag

SEQ ID NO: 69648 - DNA, 201 bp, Bos taurus; identical to SEQ ID NO: 29896

SEQ ID NO: 69649 - DNA, 201 bp, Bos taurus
tcacagagagtcagacacgactgagcacgcatgcaaacatgcgatcaagctgcatgtttactttctccctaagtctgggagtgacatcaactggccactgyggcaacaagcattaggaggcttccatcctgactttcaaactcacctcatagtatttctattaatagctggcagagctcggctgagagctgtcataatccc

SEQ ID NO: 69650 - DNA, 201 bp, Bos taurus
ataacgtactatgaaagagagtcaaaacttgataggaaatctaactcatactctactttgggctattcaattaaaaaaaaaaaaaattcttcaaaatttgytattttcattcctactacattctggtagtgctggtagaatgtcaactagctctcagaccttcaaagttaaaaaaggggaggtctggaggtcaggcaggct

SEQ ID NO: 69651 - DNA, 201 bp, Bos taurus
aggttaagtttcactgaggttgggttaagttggggctcatgggtttatcagattcagacatttagaataagcagctttagaaagaaaaaagattagtcaayacaattttcttttttaaaatgacaagaaaagtatcatttgttggctgtatggaaatccctaactttttaatatcaaagcctgcaagaaaaaaatctctcc

SEQ ID NO: 69652 - DNA, 201 bp, Bos taurus; identical to SEQ ID NO: 29898

SEQ ID NO: 69653 - DNA, 201 bp, Bos taurus; identical to SEQ ID NO: 29899

SEQ ID NO: 69654 - DNA, 201 bp, Bos taurus; identical to SEQ ID NO: 29900

SEQ ID NO: 69655 - DNA, 201 bp, Bos taurus; identical to SEQ ID NO: 29903

SEQ ID NO: 69656 - DNA, 201 bp, Bos taurus; identical to SEQ ID NO: 29907

SEQ ID NO: 69657 - DNA, 201 bp, Bos taurus; identical to SEQ ID NO: 29908

SEQ ID NO: 69658 - DNA, 201 bp, Bos taurus; identical to SEQ ID NO: 29909

SEQ ID NO: 69659 - DNA, 201 bp, Bos taurus; identical to SEQ ID NO: 29914

SEQ ID NO: 69660 - DNA, 201 bp, Bos taurus; identical to SEQ ID NO: 29915

SEQ ID NO: 69661 - DNA, 201 bp, Bos taurus; identical to SEQ ID NO: 29916

SEQ ID NO: 69662 - DNA, 201 bp, Bos taurus
tcccaggcctaacaaccccatatgaaggaggaaaagagccatggcaaaaccattagaccgaaagttcttagagcttttgcttgtaggcaggacatgctacktaaactcacaattttttttggccagagcaagtcatatggacaaactgaagtctatgaggcatggaagtataattctctcagtgattacttggacacagta

SEQ ID NO: 69663 - DNA, 201 bp, Bos taurus; identical to SEQ ID NO: 29918

SEQ ID NO: 69664 - DNA, 201 bp, Bos taurus; identical to SEQ ID NO: 29919

SEQ ID NO: 69665 - DNA, 201 bp, Bos taurus; identical to SEQ ID NO: 29922

SEQ ID NO: 69666 - DNA, 201 bp, Bos taurus
ttaacaaaaattctttatattccaattttttttttaacctgcaagatttagtaggaaattataccatatcaaaactatggtgctgtggtgtggagacaatraacgactgataaattttcatggttttcttttgtccatttgttaataatttgaatatatgatgttactcctttctttaactgattaataacacttattaat

SEQ ID NO: 69667 - DNA, 201 bp, Bos taurus; identical to SEQ ID NO: 29923

SEQ ID NO: 69668 - DNA, 201 bp, Bos taurus; identical to SEQ ID NO: 29924

SEQ ID NO: 69669 - DNA, 201 bp, Bos taurus
gtaagatttaattctacatagttgatgcatataaaaacattctaaggggaccgctaccatcaccaaactgccaaagggagcatggcatataaagaaacccrtaataacttgatcatggtcacaaaactctttgaaaactcctgattgtatattttccaatacttaatgaataaagggtgttaagacaactgaggttaaatg

SEQ ID NO: 69670 - DNA, 201 bp, Bos taurus; identical to SEQ ID NO: 29927

SEQ ID NO: 69671 - DNA, 201 bp, Bos taurus
cccccacttaaattttcccaataaacaaagtgccatgttgtcgcagcctagcctttcacctcgttacggtggtagcggagtgtgatgtcacagttgacccrataccagcctgcccataaatgatacagcctgttccccctttgcttcctggctcaagcactgggaaggagcttagtatgaaattcatgccgtgttgacaga

SEQ ID NO: 69672 - DNA, 201 bp, Bos taurus; identical to SEQ ID NO: 29928

SEQ ID NO: 69673 - DNA, 201 bp, Bos taurus; identical to SEQ ID NO: 29929

SEQ ID NO: 69674 - DNA, 201 bp, Bos taurus; identical to SEQ ID NO: 29930

SEQ ID NO: 69675 - DNA, 201 bp, Bos taurus
aaattccactgtatcattttaggatgatgatagcacaaagggaagtggaggaaagaaataaaaaatgaatgagaaagggtgatgtggtcggtggatcagtmcatttagaaggtatcttaacatacattcagtggaggatctatcaagttctaaaataggaagtagttccagaccacacccaagaaaatagcttttctcttg

SEQ ID NO: 69676 - DNA, 201 bp, Bos taurus; identical to SEQ ID NO: 29931

SEQ ID NO: 69677 - DNA, 201 bp, Bos taurus
aaatgagtttccacagagatcagaattgggaccatatagatgtcctgcaggagagcacaagaagaagctcctggactataggtgatgtaaggtagccaccrtgggatgtccatagaaacaaaataccagaagaatctctcaaaactctatgatttcatatagaattgagagaggggtgtcagcatttagaagtcacacaaa

SEQ ID NO: 69678 - DNA, 201 bp, Bos taurus; identical to SEQ ID NO: 29933

SEQ ID NO: 69679 - DNA, 201 bp, Bos taurus
ttcaacaataaaagcataattgttttagacaagaatggatcagatttttcagcatgcatattatcaggtattgctctgatattatggcctcctatgcagtyggtttgatgtgtttgagttttaaaatatatattgtgttaagcaggatctagaaatagcttggtaaatattatttatggagttatctttttaattaactgt

SEQ ID NO: 69680 - DNA, 201 bp, Bos taurus; identical to SEQ ID NO: 29937

SEQ ID NO: 69681 - DNA, 201 bp, Bos taurus
tggctgaaatgcataaaaactaggtcattgacttaggcatgtattttttttttcagttttgcattctgacatttttttcatacacagacacatacatacaygtgcagactgtacacatttatacatagtgtgtatgcatatgtatatattttccacttgaactctcctttgtttaaatgtaaaatgtctctacttgcagaa

SEQ ID NO: 69682 - DNA, 201 bp, Bos taurus
atgaagggatgaggagggtgaagaaggagggcattccttcttaagtttttttattgggggtataccctgtcttccaccgaggctaactcagtgcacacttyaggtgttgggagttcaaatgtcaagcagccaacaaagaccagagtctatgatataggggtgtgaactgcatgggtttctagagtagagctcagacccaat

SEQ ID NO: 69683 - DNA, 201 bp, Bos taurus; identical to SEQ ID NO: 29939

SEQ ID NO: 69684 - DNA, 201 bp, Bos taurus; identical to SEQ ID NO: 29940

SEQ ID NO: 69685 - DNA, 201 bp, Bos taurus
gactttattgttttgtttttttaatgaattcgttaggtacacaagactataaatacagaatccttcttaggtacacacacagaatgtttatttgaacaaaytcatgccacacattaaaaaaaagaagaagaagaagaaaatgttcctcgagttctctaagtttgaattttgcaatacaagtaagaaaaagaaattctagag

SEQ ID NO: 69686 - DNA, 201 bp, Bos taurus
gaaggacagggaagcctggcatgctgcagtctatggggttacaaagagtcagacacagcgagctgaaaaaaaaatgatttctgacttttcaagatattgayaccattctaagtacagttgatttttgatgaacacaggtttgaactgcatgggttgacttacgtgaatttttttcagtagtatatacaatattactgcgtc

SEQ ID NO: 69687 - DNA, 201 bp, Bos taurus; identical to SEQ ID NO: 29943

SEQ ID NO: 69688 - DNA, 201 bp, Bos taurus; identical to SEQ ID NO: 29944

SEQ ID NO: 69689 - DNA, 201 bp, Bos taurus
gtctgggcttgaaattggctttcctcgtatccattagcaactctattctagcatttcttatacagctttatgattttttaaactttctttagacataaacratggaattctcaaatacagggacagtgtcttactcctatttatttctataaagtatagaccaaggtcccatcagtagttggtacttgatacatgtttggt

SEQ ID NO: 69690 - DNA, 201 bp, Bos taurus
tttgtagacttttaaataatggccattctgacctgtgtgaagtgatacctcattatagctttgatttgcgtctctctaataactagcagtgctgagcatcmtttcatgggcctgtggatcatatgtatgtcttcttttaggtctgtttaggtcttctgcccatttttttaaagatttatttatttttttggctgtgatggg

SEQ ID NO: 69691 - DNA, 201 bp, Bos taurus; identical to SEQ ID NO: 29945

SEQ ID NO: 69692 - DNA, 201 bp, Bos taurus
tgtccttcccctcttagcaacattccacaccagagtggtacatgtgttaccattgatgaacctcactgacacatcacccaatgtccataatttactgtagrgtacactcttggttctttaccttctatggatttagacaaatgtatgaagacctttgtccacagtatctcatagagttgtttcactaccctgaaaatcctc

SEQ ID NO: 69693 - DNA, 201 bp, Bos taurus; identical to SEQ ID NO: 29947

SEQ ID NO: 69694 - DNA, 201 bp, Bos taurus
gtatctattggtttcttaggctttcttggataagctcatcatatattcacaaaaagtatggatgttgacacatgagcatactttacacagctactataatkattgctgttcctacagatatttagttgtttatcaactctccatggaggtaatactgaatgatcatctgccgtactgtgagccttaggttttattttctga

SEQ ID NO: 69695 - DNA, 201 bp, Bos taurus
tgaaaactgaagcacctctcccttgctttgctatcttcctccttaatgcagagctggccataactaacactgcaggcctttctgttcaatatttgacattrtggattttcttacgtttcctttgtccatagacgcttttctagagctctatcgcctgcagggccacctggaaagtgaagaggaaggagggaccctccatcc

SEQ ID NO: 69696 - DNA, 201 bp, Bos taurus; identical to SEQ ID NO: 29948

SEQ ID NO: 69697 - DNA, 201 bp, Bos taurus; identical to SEQ ID NO: 29949

SEQ ID NO: 69698 - DNA, 201 bp, Bos taurus; identical to SEQ ID NO: 29951

SEQ ID NO: 69699 - DNA, 201 bp, Bos taurus; identical to SEQ ID NO: 29953

SEQ ID NO: 69700 - DNA, 201 bp, Bos taurus; identical to SEQ ID NO: 29954

SEQ ID NO: 69701 - DNA, 201 bp, Bos taurus; identical to SEQ ID NO: 29955

SEQ ID NO: 69702 - DNA, 201 bp, Bos taurus
cccattttaaattaagtgtagcattgtctaataaaaaaggcatagatcagttgcagtcaagggaaccaaattttcacttggattctgacactagactgtcyacattctactgagcaagtcattagcattattgcttcatggtaaatatggtttttccctctggttgaagagtaattttcttgaaggcggagataatgctca

SEQ ID NO: 69703 - DNA, 201 bp, Bos taurus
actaagtcagagccctgggctgatctcagcagactatctggtcttaacaagttatttgattctcttagtttcctcatatgcaaaactgataaccttgtatktcatggtttctaagatgcacgtttatttcttcaatatcactgcaatcgaggttgtatcacaactggtgtcattttaggattttcatcagtagccatttct

SEQ ID NO: 69704 - DNA, 201 bp, Bos taurus
ttaactgctattagggcataatcaatggttcagctgtccataggacggtctgacacaaaagcacccactatcagtcaaaccaatctaagctcgagcattayagctctctttccttaccaggtacagttttctggtcacagctggaactctgcttaaggttagtagccacacaagaagtagcctaaatgatccctgcagtat

SEQ ID NO: 69705 - DNA, 201 bp, Bos taurus
cctgttgtaggggtccactcttctcaactctccctgccgaggaagactctgaaccctccccaccggtgccaagtggaggatactatttcagaaaccagctrtgcttacatgccctggccccagcctctctctctctctctaagtctggaggttctcccgtattagtcagtgcccacaaactcactgtgctttgtgctcact

SEQ ID NO: 69706 - DNA, 201 bp, Bos taurus; identical to SEQ ID NO: 29956

SEQ ID NO: 69707 - DNA, 201 bp, Bos taurus
gaattcaaggaattaaatagaattcacttctatttccttaattctctcttagtctctttaaatttttcttctttttcggcccccacccacctttcatttgygtatgagaagcaagaagaatgtgaaattgggagtgtgtctgatagaaattcaaatcttaatttagccatgtacatttgtgtggccctgcagcttccctgg

SEQ ID NO: 69708 - DNA, 201 bp, Bos taurus; identical to SEQ ID NO: 29959

SEQ ID NO: 69709 - DNA, 201 bp, Bos taurus
tcattacctatcaagaggttaagtttgtgactggagcccccaaagcagcaagctgcgccccagtggtgagccccacctcccaaggctttctaaacctgctyacccttctccatctaggggtcttttgtaaccaaaaggacggctgggaattaaatccaggcagatttgaaggccgattaccttcctcactattccgcggag

SEQ ID NO: 69710 - DNA, 201 bp, Bos taurus
atttgatggatacaatatttgaagcatgctattgtctaatgtgaacattttttgaactatacttctattagagtgttacaaaagaaaaaaataccaacccycaaaatgcctcaataaaatatagtccaattggaggtaaaaagaagaagagtggaatttcaaacactttacattttgtttgtagtgcgacatggatttccc

SEQ ID NO: 69711 - DNA, 201 bp, Bos taurus; identical to SEQ ID NO: 29963

SEQ ID NO: 69712 - DNA, 201 bp, Bos taurus; identical to SEQ ID NO: 29965

SEQ ID NO: 69713 - DNA, 201 bp, Bos taurus; identical to SEQ ID NO: 29966

SEQ ID NO: 69714 - DNA, 201 bp, Bos taurus; identical to SEQ ID NO: 29967

SEQ ID NO: 69715 - DNA, 201 bp, Bos taurus; identical to SEQ ID NO: 29968

SEQ ID NO: 69716 - DNA, 201 bp, Bos taurus; identical to SEQ ID NO: 29969

SEQ ID NO: 69717 - DNA, 201 bp, Bos taurus; identical to SEQ ID NO: 29970

SEQ ID NO: 69718 - DNA, 201 bp, Bos taurus; identical to SEQ ID NO: 29973

SEQ ID NO: 69719 - DNA, 201 bp, Bos taurus; identical to SEQ ID NO: 29975

SEQ ID NO: 69720 - DNA, 201 bp, Bos taurus
atggcgccaggcggccagagaccgagaggccctgtgctggccgggtctttccttgcgccccagggtcaacacctggaggggctggcgtggctgtttttctyccgccttttcaagccaaccctcaggcaccctcctctctaatttatggtgtcctctttcctccaccccagtttctttttctttagggcaaaactgagttga

SEQ ID NO: 69721 - DNA, 201 bp, Bos taurus; identical to SEQ ID NO: 29976

SEQ ID NO: 69722 - DNA, 201 bp, Bos taurus; identical to SEQ ID NO: 29977

SEQ ID NO: 69723 - DNA, 201 bp, Bos taurus
tttctttttaccgtcaaggtgatgaaggtgtcttagtaaggtggaataaagaagcaaagctttatcagaataacaactagcagcagaggggttcatttgcyttaaaggaagaacctgaaaggttcaggcttcttcccctaagcatgaaacattatcctggcctcagagaccttgactgtatccttctgggatgggggcact

SEQ ID NO: 69724 - DNA, 201 bp, Bos taurus
tttcatagaaaatctgttttgttcagtgaaatgtgaaagtatggtttacaaccatactttgatttttaattttttatcttagagaaagtggttggaactcrcttagcataatcatgagaaacaacagaggccctgtgtgcctttcacacagagatgagagttcccctcctgggaatgagggtgaaggtctcaaattgcagg

SEQ ID NO: 69725 - DNA, 201 bp, Bos taurus; identical to SEQ ID NO: 29978

SEQ ID NO: 69726 - DNA, 201 bp, Bos taurus; identical to SEQ ID NO: 29979

SEQ ID NO: 69727 - DNA, 201 bp, Bos taurus; identical to SEQ ID NO: 29981

SEQ ID NO: 69728 - DNA, 201 bp, Bos taurus
agcaacagaggcagaagctacattgcaggagtgaagaacagacgagctgtaaaccacttccccccaaaactctaaaagggaaaaacagggtaaagagaaakggggtgcgatatggccaactgaaactttttctcaagataggaaaaaaacctagggctattttccagcaaagaataaagaaatataatatgaaaccaaagt

SEQ ID NO: 69729 - DNA, 201 bp, Bos taurus
cacacaatagaatttaataatgaagactattatttacttctttgttttgcagagagctgaatgaaaacctgacctccctgggccctggtagaatttctccrtgaatggttagacggttttgcgtttccagcacgttggcatccacttggtcctggaatggctgtgcatagctgggggccaaatgagttcaaatgactcctc

SEQ ID NO: 69730 - DNA, 201 bp, Bos taurus; identical to SEQ ID NO: 29984

SEQ ID NO: 69731 - DNA, 201 bp, Bos taurus
tatttttatgcagtatacattttattactttgtactaatacattctcatattacaaaggcaacttaatggaagaatgtttcttttgatagttgaataatcmgaaagaacacaaacagaactgcacattaaaaaacgtatttcgataacaaaagacaagttcaacaacaacaacaaaaaaatcttcttttcttacaggtaga

SEQ ID NO: 69732 - DNA, 201 bp, Bos taurus
actctctgagcatatacccagattattgccatggtatttaatctggatgcttaggcagttaaaccttctctgggaatcaaagactgtccagtgatgatgaktaaaagcaattaatccttcacctttggactgctaaagatggctggtccccatgaatcaaggttagcaaagggtaagaactgggaagagcagaaacaatta

SEQ ID NO: 69733 - DNA, 201 bp, Bos taurus; identical to SEQ ID NO: 29985

SEQ ID NO: 69734 - DNA, 201 bp, Bos taurus; identical to SEQ ID NO: 29987

SEQ ID NO: 69735 - DNA, 201 bp, Bos taurus
aaaatttaagttttagtctattctcctgaggcaactcctttattatttgatcattttgatatgattttagttctctggactgtccctaagttctttccttyggtagactgtatgagaagcgtacactttccagtatggcaccatgcttggagtgggagctgacatagactggttatgagcacattgcttgtgtttactgta

SEQ ID NO: 69736 - DNA, 201 bp, Bos taurus; identical to SEQ ID NO: 29990

SEQ ID NO: 69737 - DNA, 201 bp, Bos taurus; identical to SEQ ID NO: 29991

SEQ ID NO: 69738 - DNA, 201 bp, Bos taurus; identical to SEQ ID NO: 29992

SEQ ID NO: 69739 - DNA, 201 bp, Bos taurus; identical to SEQ ID NO: 29993

SEQ ID NO: 69740 - DNA, 201 bp, Bos taurus
ctgtttgagaataaaggactggtgaataaggaagggaagtgggaaacaatttcccagcctggaaccttgtaaattaggtcaaccaatcccaaatcaaatcrtatccacagtatttagtaatttcatttttacatggcccctttatcataattcacatgaaatcaagataattagcaaagcaccactatctcaatttcttta

SEQ ID NO: 69741 - DNA, 201 bp, Bos taurus
ggacatgaatttgagcaaactccaggagatagtggaggacagagaaacctggcgtgctgcagtccatggggtggcaaagagtaggacacgacttagtgacygaacagcaacaacaaagaaaagacaatctcaggccctcatcttacaggagtccatatggagcaaactgcaacccaattcaatttaggagaaacttgttgg

SEQ ID NO: 69742 - DNA, 201 bp, Bos taurus
gccattctacacaaggcacgtaactgagacatggaaccagatgcagatggacctgcaactctgcccagattaagaatgttcaaaaaagcccatcttgaggraaattgcagggcccccatctttaagtaaaaagaagcgcctaaattaatgccttagcttgcaggactgaaagagaaggaatcatagggtaataaacactcg

SEQ ID NO: 69743 - DNA, 201 bp, Bos taurus
tccataacaccatgtccgtatgtttgggggtcacaggactacagtatattcccacccagctggatttgattgtgcagctgcctatgggtgcagagaggaarattgagtcttgcctcctccgaccaaacaagtgctggcataccccagggaacatgtgtgaaatcctagtctgtcgtacaccaagaggagattatagctgcc

SEQ ID NO: 69744 - DNA, 201 bp, Bos taurus
ccgcttctctctgtacagagtggccacccacagacgccctgggcccaggtggacatgtttgtctcaggcaacacaattttcctccaactcggctgactagrtcagagatctaggcctggccatctctagactggcttgtggcaccagagataacttgcctgagagcctgtgtagtaactaaactaatcaaatcctctccct

SEQ ID NO: 69745 - DNA, 201 bp, Bos taurus
attcaattactgttgactgccatttcaacctgtgtcatgtcatttgtatctgagataactataagagtagatccaggttttatgtggcctgaatcttatayaagtttaggatccctattaaaaagaaaaggagataagactaaaagtccaaaattagatttgtatgtaatagactcacagaagtgacaggccttgaagctt

SEQ ID NO: 69746 - DNA, 201 bp, Bos taurus
tcattattgtagcgtctgccacgtgcctcccacttgtgcagcttcttaacctttctatacctgggggtgctttgaactctcagatcttccaaagacccacrgttgtttgaaatggcccagtctgcattcctgcttgaagttctgtgctgtaacttgccggcttgcctggtctccactttgcctgctcttaactcctgaacc

SEQ ID NO: 69747 - DNA, 201 bp, Bos taurus
cagagtctgcttctgaaagtcctctgaaacctcacgtgtttctccaaccatcctgttgactggaccctgggttaaaccaggcctagagctttgtgtatctrttgatgttttagtgtttttggtatttttaggactcttgacagggaaagcctcaatcttctggtagtcattcctcagttggccagtttcagtctgttgctt

SEQ ID NO: 69748 - DNA, 201 bp, Bos taurus
taaaaaaagaggagacttccttgatggtccagtggttaagactctgcacttccaaagaaggggtacaggtttgattcttgattggggaactaagatcccayaggcccagcaacatgatccccccaaaaacacccagactcgcatcttctcatacagagaaaagtgctaaattcattaacttaggatgtttgcttttacttt

SEQ ID NO: 69749 - DNA, 201 bp, Bos taurus
ttggttgagtccaaaatgaatactcctatgtcccaactttttactttattttattttttgccccaactttttaaagaaaatattcagtgtgccattatttratattcttagaagaaatattcttcagggaggggaaaagatgattcaggtcttgaatgcacatttccttatttctttagtttaacatatctcatttagaag

SEQ ID NO: 69750 - DNA, 201 bp, Bos taurus
tttatattagattctgatatgaatgcacattgtaatctgagaattattccaaagtgtactgtactggtctaaggggtacctaagaccatttagtgtgtccmtgaggatggtttgattttcataataagatgctatttgcccttttcactgagttggcattttatttgactgtgcggaggccatgacaagtaaaattgctag

SEQ ID NO: 69751 - DNA, 201 bp, Bos taurus
gaagagggaagtagacacacagagagacaccaagattgtgcacatggagagaaaagaccatttgagaacacagggagacagtggccgtctgaaagccaagragagatgccccacatgacaccaacctgccaccgctttgatcttggacttctggccaccaaaactgagaaaatagattgtggtttaaactactcagtttgg

SEQ ID NO: 69752 - DNA, 201 bp, Bos taurus
agtaacctcagagttcagaaataaaaaaggctataaaacaagcattaattcctttatgtccatttcttgcacaatttcactatagatatgtcatccatagrgcatagagaataataacatagggtgtccaacccagagaagctggcatgcaaccactaaaaagattgctttggctgggatgaccatatgcaagggacaagt

SEQ ID NO: 69753 - DNA, 201 bp, Bos taurus
ttttcctactggcttccgttgggcatggctccatgttcttagaagatagccacattccttgctgcgtggactcagccattttcaaaatgaagaatctccaygtcaaaccactcttctgttttgaatctctctcatcagcaaaaagttctatcccatttaagagttcaccagatccactaaggataacctctttaactaatt

SEQ ID NO: 69754 - DNA, 201 bp, Bos taurus
ttgtttgatttgttttgttttatctcgttctcttgcgtttcaggcttaccttcactattctttctcagcaagactggtaatggtggtggggcagtagagamaatttttgggcagagaaaaatattctttcacttgagtagacgtcttcaagaatacagtcattcctgcccacttcctaaataaatcctttcttatgttttt

SEQ ID NO: 69755 - DNA, 201 bp, Bos taurus
taatctggaacagactgagttctgagtttgttttgttttctctttataaatcaacccctattaccaaacaaacttggcccatagaaagataagttgcttcrcttttataccacacggacaaatttcttatcgctaccaccaaattgactactatggggttattggaattgcaacattggccaaaacttagccactgcttct

SEQ ID NO: 69756 - DNA, 201 bp, Bos taurus
gcctggacaggcacagctataaattattatcatatccatagaaacaaggaaacaagggaccctgctagtgaaccatgaggttgccatagagaagctcaagrgggcctacttaaaacccaggcaactttccttcatgttcctggaactcttctctgcctccactgccagttctaactcttaaccctggtgggagttcatttc

SEQ ID NO: 69757 - DNA, 201 bp, Bos taurus
tcttttagcttaactaatgctgttcacttatatcagctgaaaatctaactcatatgcaactttttttcactgggaattgtttgggagaaaaccacgccccrtgaaagagggggccctttattattcatgggtagatattctgtatttgtgatttaaccttgatctgaaagtcacctaagagtaagcagtttttcttttctt

SEQ ID NO: 69758 - DNA, 201 bp, Bos taurus
taatgttgactttgctgcaccctattcctctcagaacaatgagtctgatcctgccgtccaagatttgcatattaaatcaagatgataaataattgttgagycttagtagatagtaattaatgtagtctacttaaagtattcaaattgtctttttatttctaggctataaaacagattttagtactatcttggaaaatcttg

SEQ ID NO: 69759 - DNA, 201 bp, Bos taurus
ttctttgctttaaaagtctcattaagttgcaagttggcacaattcttggacagaatattttattacaggaactctgaaagcattatatgttccacttattkcaataagtgaagtttatcttctgggaaaagtaaacgcagatcttggcttaagttaccttcagcacaacagacactagtcacaattttcttgttctacttg

SEQ ID NO: 69760 - DNA, 201 bp, Bos taurus
ttcctatgtagttctctacctacaacccttcacttacccgtcatcagaatataggatatagaccaaactgcttaaggtgggggaaaagatttctataatckgaccaatttctctgcctcatctctcatctgtgcctcttgtgtacactttgctttcatcacagttctgaaatacatcacagttctgaaataatctctgtac

SEQ ID NO: 69761 - DNA, 201 bp, Bos taurus; identical to SEQ ID NO: 29995

SEQ ID NO: 69762 - DNA, 201 bp, Bos taurus; identical to SEQ ID NO: 29996

SEQ ID NO: 69763 - DNA, 201 bp, Bos taurus
acttccctggtggtccagtggttaagacttcatcttccaacgcagaggcaagggtgtgatccctgggcaagatccagtgtcgtggggtgtggccaaaaatkttttaaaaataaataaaaacacaacatttcaccttgactgtagccccattaatgaagaagcctccttggcctcaaagattttatatgacaaaggtgaaga

SEQ ID NO: 69764 - DNA, 201 bp, Bos taurus
cttacaggtcactggcttctcctgatacccctacaccagatccccgattccactcctacccacagcagggtagggccccatgcagagctttgtcctagcayagggtgccttcacctagcttcagggtcagagtccagcccgtactttctctaaggccctctctaccccatccagtttctgctgtggtgacggaggagggtg

SEQ ID NO: 69765 - DNA, 201 bp, Bos taurus
tctcaactgtcctcagtaattattttggctgaataaagtctgaagcaatgaaagaggtttcaaagttctattacagaatccatgagactcaatatagttcrtaagcagtgaagccttgggaagaatcatggcaacttatttagattaaaatctaacaactaataaaaacattattcttgttgtagtcatcatacacagccc

SEQ ID NO: 69766 - DNA, 201 bp, Bos taurus
aacattaaaataccctgagatacacaaggagctttaagccatctaatctgaaagagaattttccagtgactgcttttactgcattgtttgttgattatacrtctttatatgtaacagcacagttacaaagtcaccagtcctaagagacagcagttatctaaactataagtcaccttctgatgctgtttgttcttcttgtta

SEQ ID NO: 69767 - DNA, 201 bp, Bos taurus
aaaatagtgcattaagttggaaataccttttaggccaacagaatcatacaggcaggcagctgtatacttgatgtgttatgggccctgatttggcagtctcytcacagataaagctctcattgcttccagaacgagctggatgtgaatcaacacagaaagcaggccctaaatgatgatcctataattgtatcctatttatta

SEQ ID NO: 69768 - DNA, 201 bp, Bos taurus; identical to SEQ ID NO: 30004

SEQ ID NO: 69769 - DNA, 201 bp, Bos taurus
cctgacccgaggattaaggcagcacggttctggtagcacactaagacaggaaatggaatgttaaagcagcagagagtgctcatggtcaaatctgcatctcrtggtccagctgagttttccttttcagtgttctaatagcctgggttcaagtctcatcacctctcttctcaggaattcctttcttctcacagctggtccttc

SEQ ID NO: 69770 - DNA, 201 bp, Bos taurus
acaattatatctgtggataaacattatgggtgaataaaaatagcaattgtaaaatgatttaaaataggttaaatgattaagaaactgaggttctggactcrtaggggtaggtatgggcatttaaagatgttgatggtataatttgttttctatttcttcatatgtcagggtttttgtttgtccaagattttgataacacta

SEQ ID NO: 69771 - DNA, 201 bp, Bos taurus; identical to SEQ ID NO: 30005

SEQ ID NO: 69772 - DNA, 201 bp, Bos taurus; identical to SEQ ID NO: 30008

SEQ ID NO: 69773 - DNA, 201 bp, Bos taurus; identical to SEQ ID NO: 30009

SEQ ID NO: 69774 - DNA, 201 bp, Bos taurus
gattcaccagtctttttactgagcacctactatgtgctaagtaccatgctaaggctggagaaagaatgagagaataggacacactctggccttccttgccrttttcatttctcttgctcttggtgcttcttcctcaggattcagctcctccttctcttctgatcttcttggccgctgtcatttcactgaacatgcagacac

SEQ ID NO: 69775 - DNA, 201 bp, Bos taurus
ttcacctctgctcttgactttctggcttagttatacataactttacctacaaactcctttcttaatatttggaaagactgtggtacccaaggagataaagrgcaatagaaatgcaagaagctagtgatagtgtacttaacctttttattttgatcagttacatattgactcaacttccttagaattttccagaatttcttg

SEQ ID NO: 69776 - DNA, 201 bp, Bos taurus
aatcaggtagatgtctgtcttctctagctttagcagcagccatgttcttttgcgtctactagagctaacattctctgggctaaggtggttttcaagtaagygaatgtccattcgtatatattgtggcttttaatttcatctcatgatttagttcacattcaactatctagttgaattgatagcatttttctctgtgaattt

SEQ ID NO: 69777 - DNA, 201 bp, Bos taurus; identical to SEQ ID NO: 30012

SEQ ID NO: 69778 - DNA, 201 bp, Bos taurus; identical to SEQ ID NO: 30013

SEQ ID NO: 69779 - DNA, 201 bp, Bos taurus; identical to SEQ ID NO: 30014

SEQ ID NO: 69780 - DNA, 201 bp, Bos taurus; identical to SEQ ID NO: 30015

SEQ ID NO: 69781 - DNA, 201 bp, Bos taurus; identical to SEQ ID NO: 30016

SEQ ID NO: 69782 - DNA, 201 bp, Bos taurus; identical to SEQ ID NO: 30017

SEQ ID NO: 69783 - DNA, 201 bp, Bos taurus; identical to SEQ ID NO: 30018

SEQ ID NO: 69784 - DNA, 201 bp, Bos taurus; identical to SEQ ID NO: 30019

SEQ ID NO: 69785 - DNA, 201 bp, Bos taurus; identical to SEQ ID NO: 30020

SEQ ID NO: 69786 - DNA, 201 bp, Bos taurus; identical to SEQ ID NO: 30021

SEQ ID NO: 69787 - DNA, 201 bp, Bos taurus; identical to SEQ ID NO: 30022

SEQ ID NO: 69788 - DNA, 201 bp, Bos taurus; identical to SEQ ID NO: 30023

SEQ ID NO: 69789 - DNA, 201 bp, Bos taurus; identical to SEQ ID NO: 30024

SEQ ID NO: 69790 - DNA, 201 bp, Bos taurus; identical to SEQ ID NO: 30025

SEQ ID NO: 69791 - DNA, 201 bp, Bos taurus; identical to SEQ ID NO: 30026

SEQ ID NO: 69792 - DNA, 201 bp, Bos taurus; identical to SEQ ID NO: 30027

SEQ ID NO: 69793 - DNA, 201 bp, Bos taurus; identical to SEQ ID NO: 30028

SEQ ID NO: 69794 - DNA, 201 bp, Bos taurus; identical to SEQ ID NO: 30029

SEQ ID NO: 69795 - DNA, 201 bp, Bos taurus; identical to SEQ ID NO: 30030

SEQ ID NO: 69796 - DNA, 201 bp, Bos taurus; identical to SEQ ID NO: 30031

SEQ ID NO: 69797 - DNA, 201 bp, Bos taurus; identical to SEQ ID NO: 30032

SEQ ID NO: 69798 - DNA, 201 bp, Bos taurus; identical to SEQ ID NO: 30033

SEQ ID NO: 69799 - DNA, 201 bp, Bos taurus; identical to SEQ ID NO: 30034

SEQ ID NO: 69800 - DNA, 201 bp, Bos taurus; identical to SEQ ID NO: 30035

SEQ ID NO: 69801 - DNA, 201 bp, Bos taurus; identical to SEQ ID NO: 30036

SEQ ID NO: 69802 - DNA, 201 bp, Bos taurus; identical to SEQ ID NO: 30037

SEQ ID NO: 69803 - DNA, 201 bp, Bos taurus; identical to SEQ ID NO: 30038

SEQ ID NO: 69804 - DNA, 201 bp, Bos taurus; identical to SEQ ID NO: 30039

SEQ ID NO: 69805 - DNA, 201 bp, Bos taurus; identical to SEQ ID NO: 30040

SEQ ID NO: 69806 - DNA, 201 bp, Bos taurus; identical to SEQ ID NO: 30041

SEQ ID NO: 69807 - DNA, 201 bp, Bos taurus; identical to SEQ ID NO: 30042

SEQ ID NO: 69808 - DNA, 201 bp, Bos taurus; identical to SEQ ID NO: 30043

SEQ ID NO: 69809 - DNA, 201 bp, Bos taurus; identical to SEQ ID NO: 30044

SEQ ID NO: 69810 - DNA, 201 bp, Bos taurus; identical to SEQ ID NO: 30045

SEQ ID NO: 69811 - DNA, 201 bp, Bos taurus; identical to SEQ ID NO: 30046

SEQ ID NO: 69812 - DNA, 201 bp, Bos taurus
ccactgtgaggacataatgggctgcctatgacctagaacccactgcttactcttcaaagagacacgtgcgtctgatctctgtggaactaaagagtggtagygatgagcagttccattaaatgatagtagtgggcttcctttatgattttgtttgtatttcagaaaactctggtccaagggcttctaaaacttcatagaaac

SEQ ID NO: 69813 - DNA, 201 bp, Bos taurus; identical to SEQ ID NO: 30048

SEQ ID NO: 69814 - DNA, 201 bp, Bos taurus; identical to SEQ ID NO: 30049

SEQ ID NO: 69815 - DNA, 201 bp, Bos taurus
cagcctggaaagaaaagtcaacaagcagtcatcttcattgttgtgtgactgggacactcagggtgctgccgtgtacctttgctttcaaaggccctttaacrttaaaaccaaacatagcctacatgggaggaatggcatatagtggctgaccttggtgacattttgtgtacaaggcctttggcctctccttaaatcattcag

SEQ ID NO: 69816 - DNA, 201 bp, Bos taurus
aaggcaatgggaaatttaaaaaaaagaaagaaagaaatggatgacatgttcattccctttgagaacagcacccagttgttttatatgctattttcacttamacccaaatggccaaaactgagttgcatgatcatatttagcagccagagaagctaaaaaatgtaatatttgtgcttggcagctacatgttcatctgaggtt

SEQ ID NO: 69817 - DNA, 201 bp, Bos taurus; identical to SEQ ID NO: 30053

SEQ ID NO: 69818 - DNA, 201 bp, Bos taurus
tccgtccatgggattttccaggcaagagtactggagtggggtgccattgctaatagaggaatcgtgagcctcgattcttagctgctgtgtaatgctgtttmttcctttggcctggagggtccagcctccctgatgcttatggttgcctgatacctgaacagaatcggggatctatgagctagaaataagtgagaaatgctt

SEQ ID NO: 69819 - DNA, 201 bp, Bos taurus; identical to SEQ ID NO: 30054

SEQ ID NO: 69820 - DNA, 201 bp, Bos taurus; identical to SEQ ID NO: 30056

SEQ ID NO: 69821 - DNA, 201 bp, Bos taurus
taaggtgaatttgctctgggggatgttaataccacataatataggtaaagggacatgtggatgttttccagatcctgctaaagacaattctgagcttcaayaggtgaacatatttcagcatctggtttagggggccctctgtgatttttatttgggggaaaacctagacatgagatctaagtaatttaattcactgttcct

SEQ ID NO: 69822 - DNA, 201 bp, Bos taurus
acttctctttgtctgacttgctttacttagtatgataatctctacgtctatctgtaatgttttaaatgttaataattattttaagaaagcttatagagtaytgtagacttaatccattaattttcactcctccaggcaatgtaagaagaaagcttatgctattattacaattttataggttaggaccttaagaaatccaaa

SEQ ID NO: 69823 - DNA, 201 bp, Bos taurus
agcaaaatgcaagcaaaaattaaaaatacttctttagcaactttgcttttaaggttttcatatcagatcattccctcttgactgtaagctttatttctgcrttaataacattttatttctttctacttactaggctgtcttaagcaatatttggttttgctgctttattggattgtagggcatcagtttcagtttatttct

SEQ ID NO: 69824 - DNA, 201 bp, Bos taurus; identical to SEQ ID NO: 30059

SEQ ID NO: 69825 - DNA, 201 bp, Bos taurus
ctcctttcatcagccaagggtctttgttctctcttgtaagtgtcagtttcttctcttgataatgagggactttcaggcagcatttcaggttttttttactratctaatagtctatgaacttttccccctgttggggagttaaaaggtggatgaatgtgtgtacatctctgcagacaggctgcttttcctactgtagcattc

SEQ ID NO: 69826 - DNA, 201 bp, Bos taurus
attcatattagttgaaatacaagaaaaaaaatcttatcctggtgagattcattatatttgaaatattggtgtgactatgaaatatgaattctatatctgcyattgcaacccattttatccctaattttaactttttgtctaactgggaaaattagagtgtctattgctttttaaaaatttttctagcagttttctatcaaa

SEQ ID NO: 69827 - DNA, 201 bp, Bos taurus
gtgctgagatcctaacctatggtaacatttttcatttcaaagatggagtcaacaatactaatctggagaaaattaaagagatggggacagaaaaaatggcraacaggtgtaatgaaagtgaagtataaatgagagtaaactgggaggcaaagaaattaagtgacacaaagtgtaagaaatggaagattgaaaaataatgaa

SEQ ID NO: 69828 - DNA, 201 bp, Bos taurus
cccatatgccagttaccagacttctttatgcagaagaaaacttgaactctaccttgttgaaagcaatgaaattatgttatataaaatccattgagcctcarttgctcacaaaaatgttagagcaacaattaattttgtttgtaaagactactaaaaataatactgactcaagtgttctagctctgacaagtgcagactagg

SEQ ID NO: 69829 - DNA, 201 bp, Bos taurus
tggcaagcatcaaatacttatactattaaaatagaggacaaaaaataaatcagctaaaaatgactaaatgatggagttttaggggtattactgtgaagagragcgagaacagtgaaagggaagagttgatggtgttggtgtcaggccatgttgataaacttacttggctctgcaaagggagctctatctatgggtatcaga

SEQ ID NO: 69830 - DNA, 201 bp, Bos taurus
gaataagaataatttgctaatttcctatctttgaaagcaaagtgtccactttgtataaatttgggggcaaactattcatgtgttacatgtgagtatacccyctaagaaattccagaagtcactttgtaccctattttatcctgagagtcatttcttttcaagaaaaaagcaaacaaacaattgaaacacattaaacgcctc

SEQ ID NO: 69831 - DNA, 201 bp, Bos taurus
gtcctcgaagatcacaagtacagctgctgaaaccaatctaatttaaccctttactaaacattcccttgctagcgggacctctgcataaagaagaggtaaaytgtcttgtcttcctcatctaggaaaactatgtgttgttttgaagttcaggacaataatatccagaaataaaatttgctgtgtctatatttctaaataatc

SEQ ID NO: 69832 - DNA, 201 bp, Bos taurus; identical to SEQ ID NO: 30067

SEQ ID NO: 69833 - DNA, 201 bp, Bos taurus
atctttacatatgtaaaaccctcttttaatcactactcttataatcacactggagactaggctatctccagcacaacagaaggttctctttggcccctccrggtcaatattccccttcaaggataatcactattctaatctttatccccatgcatccatcatgtttgtctttgaacttttaaaaatatggaaccatgaaga

SEQ ID NO: 69834 - DNA, 201 bp, Bos taurus; identical to SEQ ID NO: 30068

SEQ ID NO: 69835 - DNA, 201 bp, Bos taurus; identical to SEQ ID NO: 30070

SEQ ID NO: 69836 - DNA, 201 bp, Bos taurus; identical to SEQ ID NO: 30073

SEQ ID NO: 69837 - DNA, 201 bp, Bos taurus
agggagaggtggggattgggagggaaaggtcatcatctaagtattacttatagttggcctcctctgttatttgcctgttgtcattaacaacaacaaaaackctataattcaagtgatagagtcatatgatggtacgaggcatctgaattcccacatgacgacgccctgttttccagccctgtttctctctttttctggctg

SEQ ID NO: 69838 - DNA, 201 bp, Bos taurus
taagctcaagactttctgagatagagaccagatatggtcttagtgtgatggagatcagtgaatatatgtggctaaagcaagtaatgtgggcaaggtattcygagactcaaatctctagaatattgcacacacacacacacacacacagagggctgaaaaattacagagccaaacattcataaaatctctcttagaaatata

SEQ ID NO: 69839 - DNA, 201 bp, Bos taurus; identical to SEQ ID NO: 30074

SEQ ID NO: 69840 - DNA, 201 bp, Bos taurus; identical to SEQ ID NO: 30075

SEQ ID NO: 69841 - DNA, 201 bp, Bos taurus; identical to SEQ ID NO: 30076

SEQ ID NO: 69842 - DNA, 201 bp, Bos taurus; identical to SEQ ID NO: 30077

SEQ ID NO: 69843 - DNA, 201 bp, Bos taurus; identical to SEQ ID NO: 30078

SEQ ID NO: 69844 - DNA, 201 bp, Bos taurus; identical to SEQ ID NO: 30079

SEQ ID NO: 69845 - DNA, 201 bp, Bos taurus; identical to SEQ ID NO: 30080

SEQ ID NO: 69846 - DNA, 201 bp, Bos taurus; identical to SEQ ID NO: 30081

SEQ ID NO: 69847 - DNA, 201 bp, Bos taurus; identical to SEQ ID NO: 30082

SEQ ID NO: 69848 - DNA, 201 bp, Bos taurus; identical to SEQ ID NO: 30083

SEQ ID NO: 69849 - DNA, 201 bp, Bos taurus; identical to SEQ ID NO: 30084

SEQ ID NO: 69850 - DNA, 201 bp, Bos taurus; identical to SEQ ID NO: 30085

SEQ ID NO: 69851 - DNA, 201 bp, Bos taurus; identical to SEQ ID NO: 30086

SEQ ID NO: 69852 - DNA, 201 bp, Bos taurus; identical to SEQ ID NO: 30087

SEQ ID NO: 69853 - DNA, 201 bp, Bos taurus; identical to SEQ ID NO: 30088

SEQ ID NO: 69854 - DNA, 201 bp, Bos taurus; identical to SEQ ID NO: 30089

SEQ ID NO: 69855 - DNA, 201 bp, Bos taurus; identical to SEQ ID NO: 30090

SEQ ID NO: 69856 - DNA, 201 bp, Bos taurus; identical to SEQ ID NO: 30091

SEQ ID NO: 69857 - DNA, 201 bp, Bos taurus; identical to SEQ ID NO: 30092

SEQ ID NO: 69858 - DNA, 201 bp, Bos taurus; identical to SEQ ID NO: 30093

SEQ ID NO: 69859 - DNA, 201 bp, Bos taurus; identical to SEQ ID NO: 30094

SEQ ID NO: 69860 - DNA, 201 bp, Bos taurus; identical to SEQ ID NO: 30095

SEQ ID NO: 69861 - DNA, 201 bp, Bos taurus; identical to SEQ ID NO: 30096

SEQ ID NO: 69862 - DNA, 201 bp, Bos taurus; identical to SEQ ID NO: 30097

SEQ ID NO: 69863 - DNA, 201 bp, Bos taurus; identical to SEQ ID NO: 30098

SEQ ID NO: 69864 - DNA, 201 bp, Bos taurus; identical to SEQ ID NO: 30099

SEQ ID NO: 69865 - DNA, 201 bp, Bos taurus; identical to SEQ ID NO: 30100

SEQ ID NO: 69866 - DNA, 201 bp, Bos taurus; identical to SEQ ID NO: 30101

SEQ ID NO: 69867 - DNA, 201 bp, Bos taurus; identical to SEQ ID NO: 30102

SEQ ID NO: 69868 - DNA, 201 bp, Bos taurus; identical to SEQ ID NO: 30103

SEQ ID NO: 69869 - DNA, 201 bp, Bos taurus; identical to SEQ ID NO: 30104

SEQ ID NO: 69870 - DNA, 201 bp, Bos taurus; identical to SEQ ID NO: 30105

SEQ ID NO: 69871 - DNA, 201 bp, Bos taurus; identical to SEQ ID NO: 30106

SEQ ID NO: 69872 - DNA, 201 bp, Bos taurus; identical to SEQ ID NO: 30107

SEQ ID NO: 69873 - DNA, 201 bp, Bos taurus; identical to SEQ ID NO: 30108

SEQ ID NO: 69874 - DNA, 201 bp, Bos taurus; identical to SEQ ID NO: 30109

SEQ ID NO: 69875 - DNA, 201 bp, Bos taurus; identical to SEQ ID NO: 30110

SEQ ID NO: 69876 - DNA, 201 bp, Bos taurus; identical to SEQ ID NO: 30111

SEQ ID NO: 69877 - DNA, 201 bp, Bos taurus; identical to SEQ ID NO: 30112

SEQ ID NO: 69878 - DNA, 201 bp, Bos taurus; identical to SEQ ID NO: 30113

SEQ ID NO: 69879 - DNA, 201 bp, Bos taurus; identical to SEQ ID NO: 30114

SEQ ID NO: 69880 - DNA, 201 bp, Bos taurus; identical to SEQ ID NO: 30116

SEQ ID NO: 69881 - DNA, 201 bp, Bos taurus; identical to SEQ ID NO: 30117

SEQ ID NO: 69882 - DNA, 201 bp, Bos taurus; identical to SEQ ID NO: 30118

SEQ ID NO: 69883 - DNA, 201 bp, Bos taurus; identical to SEQ ID NO: 30119

SEQ ID NO: 69884 - DNA, 201 bp, Bos taurus; identical to SEQ ID NO: 30120

SEQ ID NO: 69885 - DNA, 201 bp, Bos taurus; identical to SEQ ID NO: 30121

SEQ ID NO: 69886 - DNA, 201 bp, Bos taurus; identical to SEQ ID NO: 30122

SEQ ID NO: 69887 - DNA, 201 bp, Bos taurus; identical to SEQ ID NO: 30123

SEQ ID NO: 69888 - DNA, 201 bp, Bos taurus; identical to SEQ ID NO: 30124

SEQ ID NO: 69889 - DNA, 201 bp, Bos taurus; identical to SEQ ID NO: 30125

SEQ ID NO: 69890 - DNA, 201 bp, Bos taurus; identical to SEQ ID NO: 30126

SEQ ID NO: 69891 - DNA, 201 bp, Bos taurus; identical to SEQ ID NO: 30127

SEQ ID NO: 69892 - DNA, 201 bp, Bos taurus; identical to SEQ ID NO: 30128

SEQ ID NO: 69893 - DNA, 201 bp, Bos taurus; identical to SEQ ID NO: 30129

SEQ ID NO: 69894 - DNA, 201 bp, Bos taurus; identical to SEQ ID NO: 30130

SEQ ID NO: 69895 - DNA, 201 bp, Bos taurus; identical to SEQ ID NO: 30131

SEQ ID NO: 69896 - DNA, 201 bp, Bos taurus; identical to SEQ ID NO: 30132

SEQ ID NO: 69897 - DNA, 201 bp, Bos taurus; identical to SEQ ID NO: 30133

SEQ ID NO: 69898 - DNA, 201 bp, Bos taurus; identical to SEQ ID NO: 30134

SEQ ID NO: 69899 - DNA, 201 bp, Bos taurus; identical to SEQ ID NO: 30135

SEQ ID NO: 69900 - DNA, 201 bp, Bos taurus; identical to SEQ ID NO: 30137

SEQ ID NO: 69901 - DNA, 201 bp, Bos taurus; identical to SEQ ID NO: 30138

SEQ ID NO: 69902 - DNA, 201 bp, Bos taurus; identical to SEQ ID NO: 30139

SEQ ID NO: 69903 - DNA, 201 bp, Bos taurus
tctataattcaattaagtaattttaacaactggagatcactccaattgaaatcagaggaagtaaaaataaacctttgtgtgcagctttattttcaacattmgatacctgacaatagtcaagtgatctacattggtatgatacattgtgtaagcatttataatacttatgaagaattcatagcaagaaaaattgctcaggct

SEQ ID NO: 69904 - DNA, 201 bp, Bos taurus; identical to SEQ ID NO: 30140

SEQ ID NO: 69905 - DNA, 201 bp, Bos taurus; identical to SEQ ID NO: 30141

SEQ ID NO: 69906 - DNA, 201 bp, Bos taurus
ggtgggaatctttctatgacatatttaaggagcaataaaagaaaaaatttgcaagctaaaaatgaagaaaaaaaattttttggctaataaaaccataccayaagcaaattctgaaggcagataacaaagaagaaagtctttgaatgtatatcaaagataaaggattaacattcctaatatattcaggaacgtagtcttgag

SEQ ID NO: 69907 - DNA, 201 bp, Bos taurus; identical to SEQ ID NO: 30142

SEQ ID NO: 69908 - DNA, 201 bp, Bos taurus; identical to SEQ ID NO: 30144

SEQ ID NO: 69909 - DNA, 201 bp, Bos taurus
gtgttgctggcaaatgaaatggtctgttctcccactggacaatgccctacctagcatgggtgcctgatacttggacactaaaattctctcaccatcaatartaatgtgttagagcaaggctctggaatgactttgagttatctggtaaatgagataatgaatttttcatattgtttaaaccacttagaatgtgtgtcttat

SEQ ID NO: 69910 - DNA, 201 bp, Bos taurus
gggcaggcctgggagccgaaacaagtgcacacaagccagcaacacaaaggatgagcttaggcggctgacgatgagcttagcggggctgagggaagcaaacrtaagtcgaggccacagcagaaggatccacacaggcacctacctagcaagtttcagccagtagcgcagagcaggatggggaacagaagcacaggcaacgat

SEQ ID NO: 69911 - DNA, 201 bp, Bos taurus
gtttaatattgaaataatgttgaaaatctgcttcttaattttgccttcttaagcctagttgtttcttcgctaaattaaggccttatgcctaagttccactmtcttttaaagcatcctacttcagttcagttcagttcagtcactcagtcgtgtccgactctttgcgaccccatgaatcgcagcatgccaggcctccctgtc

SEQ ID NO: 69912 - DNA, 201 bp, Bos taurus
gtaaaagcaaccaactctcggagttttttccatggaggctgcctctgaaacatgccatccatagttgagtaaaaggttattaaaataattccatcagcacytctcaataataagccctagcctgcatcagcactaactagcactgcacagtgacccatacatataagacccaattgggtgggccatgacgtctgagaagag

SEQ ID NO: 69913 - DNA, 201 bp, Bos taurus
tccttggacatttccaggcattggacttttccatcttaggagtcttaactccaaatttttagtatcatagcataactggaatgcatataattcatcaggamactatgcagctcatttctgtatttcattgctgctaaatatttcaagaaactttttttgttttcttctctcttaagtgaggctcctacttataaacccctg

SEQ ID NO: 69914 - DNA, 201 bp, Bos taurus; identical to SEQ ID NO: 30146

SEQ ID NO: 69915 - DNA, 201 bp, Bos taurus
tatcaatacaatgaccagcaaagaatatgggctggtggagtggtggaaactcaggcaaggcagaggaatcagagtccactctgtgtcctcttgtctcattytgaatggcccaaatatttgtttaccagagatttgctttccatctccacgtgaactgccttcctcccatttgaactgccaaacccctacctctcttcctca

SEQ ID NO: 69916 - DNA, 201 bp, Bos taurus; identical to SEQ ID NO: 30147

SEQ ID NO: 69917 - DNA, 201 bp, Bos taurus; identical to SEQ ID NO: 30149

SEQ ID NO: 69918 - DNA, 201 bp, Bos taurus; identical to SEQ ID NO: 30150

SEQ ID NO: 69919 - DNA, 201 bp, Bos taurus; identical to SEQ ID NO: 30151

SEQ ID NO: 69920 - DNA, 201 bp, Bos taurus
cctaagatcccatataaggccattgcgctcgctacagtgctgtttttgattggcgcctttctcattatcataggctccctcctgctggcaggctatatcarcaaaggtgggggcagaccgggccgttcctgtcctgatcattggcatcctagtgttcctgccaggattttaccacctgcgcatcacatactatgcatccaa

SEQ ID NO: 69921 - DNA, 201 bp, Bos taurus; identical to SEQ ID NO: 30154

SEQ ID NO: 69922 - DNA, 201 bp, Bos taurus; identical to SEQ ID NO: 30155

SEQ ID NO: 69923 - DNA, 201 bp, Bos taurus; identical to SEQ ID NO: 30156

SEQ ID NO: 69924 - DNA, 201 bp, Bos taurus; identical to SEQ ID NO: 30157

SEQ ID NO: 69925 - DNA, 201 bp, Bos taurus; identical to SEQ ID NO: 30158

SEQ ID NO: 69926 - DNA, 201 bp, Bos taurus; identical to SEQ ID NO: 30159

SEQ ID NO: 69927 - DNA, 201 bp, Bos taurus; identical to SEQ ID NO: 30160

SEQ ID NO: 69928 - DNA, 201 bp, Bos taurus; identical to SEQ ID NO: 30161

SEQ ID NO: 69929 - DNA, 201 bp, Bos taurus
acctcaaggtggatggataatgatttgagatttagagatcccagacattagtgtcctgtgaggatggggaccaagggaccagagggagagagtgaggatakaagtggaaaatgtcagacaagaaggcagggaacatgaagaggggctgctggtgtcaacaatagtgtctggtgttcactacagtggccaagacatgttccc

SEQ ID NO: 69930 - DNA, 201 bp, Bos taurus; identical to SEQ ID NO: 30164

SEQ ID NO: 69931 - DNA, 201 bp, Bos taurus; identical to SEQ ID NO: 30168

SEQ ID NO: 69932 - DNA, 201 bp, Bos taurus; identical to SEQ ID NO: 30169

SEQ ID NO: 69933 - DNA, 201 bp, Bos taurus; identical to SEQ ID NO: 30170

SEQ ID NO: 69934 - DNA, 201 bp, Bos taurus; identical to SEQ ID NO: 30171

SEQ ID NO: 69935 - DNA, 201 bp, Bos taurus; identical to SEQ ID NO: 30172

SEQ ID NO: 69936 - DNA, 201 bp, Bos taurus; identical to SEQ ID NO: 30173

SEQ ID NO: 69937 - DNA, 201 bp, Bos taurus; identical to SEQ ID NO: 30174

SEQ ID NO: 69938 - DNA, 201 bp, Bos taurus; identical to SEQ ID NO: 30175

SEQ ID NO: 69939 - DNA, 201 bp, Bos taurus; identical to SEQ ID NO: 30176

SEQ ID NO: 69940 - DNA, 201 bp, Bos taurus; identical to SEQ ID NO: 30177

SEQ ID NO: 69941 - DNA, 201 bp, Bos taurus
tgaaaaccatgttaaattaatcccctggtgccctcagatgacaggtcagcacgcccagccaggggcaggcactcatcatgggcttccctggccaactcagmtgctgctaatggccttctgcctttagagaacaacatcctccctgcatggcagagccatgcgccaacagccaccttcctaatcctcacagcgtgcctggga

SEQ ID NO: 69942 - DNA, 201 bp, Bos taurus
cacaggctccctggcaaagccccaagccccagagaggcctgttttcaggttccaagcttttaaagcagagccctttcttgaatcataccagccatatcackgtagagtaaccagggcctcctcagacaaccaaatggcccatctctctctctctcttttttttttaaccccatacctggttcactccaagaagaatgtatt

SEQ ID NO: 69943 - DNA, 201 bp, Bos taurus
ttttgctcaaatcagagctaatgcctacaacacgcctgcaaaggaaccacaacctccctttccaggagaaggaaaagatgttcataatggtgtaaggacaktttatctgggaggcatgacatgtatggtatcaagggcccgatagcatacataaaaggaagcttttaggggccatgaaaatgctttcatgttttgtttgtt

SEQ ID NO: 69944 - DNA, 201 bp, Bos taurus; identical to SEQ ID NO: 30179

SEQ ID NO: 69945 - DNA, 201 bp, Bos taurus
ggaggaggtgatgataaactaacacgtccctttcttagagcctatgaaagtcatctctaaactcccaactcaatcacaagtaaggccgacttctgcctctmctgtcggcattactcacctttgcttaaggagcacagcccactgaatcactaactctaaggagaggcccagcattaaccctttcctccccagtagctcaca

SEQ ID NO: 69946 - DNA, 201 bp, Bos taurus; identical to SEQ ID NO: 30183

SEQ ID NO: 69947 - DNA, 201 bp, Bos taurus; identical to SEQ ID NO: 30184

SEQ ID NO: 69948 - DNA, 201 bp, Bos taurus; identical to SEQ ID NO: 30188

SEQ ID NO: 69949 - DNA, 201 bp, Bos taurus; identical to SEQ ID NO: 30189

SEQ ID NO: 69950 - DNA, 201 bp, Bos taurus
ttaaattctaaaagaaataaaaataaattggattgtaggaggggaatagggagtacttaataaaagtttaaaatggttctatagatcatgtagggaaaaamtgagaaatttttgaaaataaaaggaatagcaaatgatggcttactctaatattagaacggtatggacttaagtcatgtaaagcagtatggttattagtct

SEQ ID NO: 69951 - DNA, 201 bp, Bos taurus
gatcaggggccatcactcttctgatcctcatacacatagtgtacaaattccattataatagtatatcctgtctttcttagtcataggctcatggatctgtytggcccatttatctgatatacaccacaaaaggctctccttcaggacagatggagtatttactatttttatgtttgatagcaccaagcagatccaacatgg

SEQ ID NO: 69952 - DNA, 201 bp, Bos taurus
tgattgaagtcatatggttctcaattgaaataagagtgagcaaaaataatttttggcctctaatgactgttctttttcttttacaactctgggcaaccatkcacattgtacatacacatgactcttgctgtcaataatggccagccttgtaacttcgtattatgttatgagaatatgtctgtgttctaataaatgtctgtt

SEQ ID NO: 69953 - DNA, 201 bp, Bos taurus; identical to SEQ ID NO: 30195

SEQ ID NO: 69954 - DNA, 201 bp, Bos taurus; identical to SEQ ID NO: 30196

SEQ ID NO: 69955 - DNA, 201 bp, Bos taurus; identical to SEQ ID NO: 30197

SEQ ID NO: 69956 - DNA, 201 bp, Bos taurus; identical to SEQ ID NO: 30198

SEQ ID NO: 69957 - DNA, 201 bp, Bos taurus; identical to SEQ ID NO: 30199

SEQ ID NO: 69958 - DNA, 201 bp, Bos taurus; identical to SEQ ID NO: 30200

SEQ ID NO: 69959 - DNA, 201 bp, Bos taurus
tttctaagagctcagcatttaaaacccatttgtggattttcatcccaacgtgttaaattccagtattcctagtctgatatgtgggggtggcctcatcaatmtcgctcattcttccagcaacctttcatacattccatactccaccctgtgtgctcctgcacaagcttgccttgctggtcaccaatgtgtattttattttat

SEQ ID NO: 69960 - DNA, 201 bp, Bos taurus
cttcccccgaaaccctccaagaccagcaggtaggtctggctcaggtttgtatcaaattactgctgttgtccctgttctagtgtgcctgcggttttgtgtayacctttaagggtaaagcctctctttcccccagtcctgtaggcgcctacggtcttatggaaaaacctgaatgaactttctggccaatccaatatcttaacc

SEQ ID NO: 69961 - DNA, 201 bp, Bos taurus
aaagagttcccctgagaagccgtgcacattttttcctcaagagttggtgtcacttgccattagtgtcgacagtgcgtggccacgggctttcgcttctcctracttccccggtgtcaaggctacccaggctcttctccaggtgatagttcagactggcagttctgatgttctctttgattcctcccggccccacggacttaa

SEQ ID NO: 69962 - DNA, 201 bp, Bos taurus; identical to SEQ ID NO: 30201

SEQ ID NO: 69963 - DNA, 201 bp, Bos taurus
cgcattgtggccctgtcgaggctcaccaggctggagctgagagacgacttcctgcacaggctgcgaatgctgcaggccccgaagaacaagcacgtgatcaygctgctgggctactgcgagaacgataacatcatcctcacagagtaccatccctcaggctccctgggcaacctggaggccatgctgaatctctccaagtac

SEQ ID NO: 69964 - DNA, 201 bp, Bos taurus; identical to SEQ ID NO: 30203

SEQ ID NO: 69965 - DNA, 201 bp, Bos taurus; identical to SEQ ID NO: 30205

SEQ ID NO: 69966 - DNA, 201 bp, Bos taurus
tgagcctttttctgttcttatctaacaagaccattttaaagcatctaagaatcttgattattttaaaatgtgtactctcttgatttctgtgacaccataamctcttgcttctactagaacttctatactgtcctttcttcatttctttgatgaattttattatttttgttgttctgtttttgttttttcctacaagtgtta

SEQ ID NO: 69967 - DNA, 201 bp, Bos taurus; identical to SEQ ID NO: 30208

SEQ ID NO: 69968 - DNA, 201 bp, Bos taurus
aagaagagcattaactgttctctatcacacagcctgtgtacttctgcaatcaataagaatgagtgggctcagactgggcctcattgttttaccatgaaatytggaattgagcaatagagtcaatctcccattttctacatggtgttagaccgaagctcagttgacacagcatttaacaatatgcaaatgagtcaatggcct

SEQ ID NO: 69969 - DNA, 201 bp, Bos taurus; identical to SEQ ID NO: 30211

SEQ ID NO: 69970 - DNA, 201 bp, Bos taurus; identical to SEQ ID NO: 30213

SEQ ID NO: 69971 - DNA, 201 bp, Bos taurus
gaatattaatcctatcattttactatgcctgttatactttgatctactttagcagaatcatattattaaattatgattttaaaccagaagaatttgaagtyactcagaccattaccagctatatcattttccttggagctagaataggaatttcacctcatacgtttatgatacattcctgtttacatttactcttccact

SEQ ID NO: 69972 - DNA, 201 bp, Bos taurus; identical to SEQ ID NO: 30214

SEQ ID NO: 69973 - DNA, 201 bp, Bos taurus
tagagaggattgttcaaagcaaggaactacatcaggttgggggatggtggagtgggggtcttcactcgtgtaactgcttcctggtaacatcctactggtamttttatcttagatcatttcagatacttgttctgtaatatttatacaggcagcaaattctgttgttgtcactcatgcttgctatataagactgataaaatc

SEQ ID NO: 69974 - DNA, 201 bp, Bos taurus; identical to SEQ ID NO: 30215

SEQ ID NO: 69975 - DNA, 201 bp, Bos taurus; identical to SEQ ID NO: 30216

SEQ ID NO: 69976 - DNA, 201 bp, Bos taurus
agcgatggagattatagctcttttattgattattgctggccaagtcttttaaagaacatcttaactgtgttatttcatttaattcttacaacaaatcttgrttcagttattcatagattattgttgtgggaattatagcttagagagatttgagggccttgctcaaggtcacccacttaataaaaatagctttaatttagg

SEQ ID NO: 69977 - DNA, 201 bp, Bos taurus
aactacacaaaaaatgtgagcgtttttgattctctagtcaagttggaagtcagtgttgttaaatgcaatcctatctgccagatttatttttgcttaccatrgtcctaatccaagtagcctggccatgtaaaaaacaacctttaagactctcctgcagcttcacccagaaagatgcttacacagacacatttgcacagacac

SEQ ID NO: 69978 - DNA, 201 bp, Bos taurus; identical to SEQ ID NO: 30218

SEQ ID NO: 69979 - DNA, 201 bp, Bos taurus; identical to SEQ ID NO: 30219

SEQ ID NO: 69980 - DNA, 201 bp, Bos taurus
tcagtcactgtgatgagaggcaatggccttgacttctgtatgagcccaaagacctatgccagggaaaacatcaagaaaaacacattaaagaggctgtggastttaacttctgaaaactggattctggtttaggaagcaaaaaggacataaactcagatatagttttcagttctggttctaaaattactgcgtggtaaaccc

SEQ ID NO: 69981 - DNA, 201 bp, Bos taurus; identical to SEQ ID NO: 30220

SEQ ID NO: 69982 - DNA, 201 bp, Bos taurus
caagtgacagttttccatacccctccattctattatgacatccgagtttatataaatctaaaaatatcatactttatgaatgtgagttccctttattattytacaccaatctcatatgcagttgtctctcactcatgaaagtgaagtcaaatttagaagagctctgaaagctcatgtagcacttccagtatggtctgtgca

SEQ ID NO: 69983 - DNA, 201 bp, Bos taurus; identical to SEQ ID NO: 30221

SEQ ID NO: 69984 - DNA, 201 bp, Bos taurus; identical to SEQ ID NO: 30222

SEQ ID NO: 69985 - DNA, 201 bp, Bos taurus
ttactctaacagagaatacatagacacccaaatcagtgcatcagcactgacataaaaatagctacaacaatccttttaattagacatcttctgattttacrgatgagaataggcaaatttaattcagaagaccattatatctactactgtgggcaagaatcccatagaagaaatggagtagccctcctaatcaacaaaaga

SEQ ID NO: 69986 - DNA, 201 bp, Bos taurus
tttcatccttagtgaaattctttaaaacataggcacacatgcacacgtatgtacacgcacacacacacacacgtcatatcatgttagtaacaaagggcctwtagagacctttaacttacaaatggggaaacatccattatttttcaaatcaaatagttttattcacttacagtcacacacataataagaattattcagttt

SEQ ID NO: 69987 - DNA, 201 bp, Bos taurus
aaagagggatgacctacaaaatagaagcaaaacaaatggatgaggaagaggaagttgacaaagaagacagacttttgaataagtccaagagagtttgtaayactagctcaaggaaatttaaatcaaacacagtccattctaacaaaatgttagaatctatattggagataaacaaaggcaagggaaataaataattgctat

SEQ ID NO: 69988 - DNA, 201 bp, Bos taurus
aaattcaacaggaaggatagagtcataccccaaagtgtgactggtaacaaataatcggtcacttaattagactagtgaaaagtgtatgagcaccaaagatmcagaacctaagaatgtgaagcctttaaaatctttgaaaattatataaaagttgtagttaacatggactctgcaatctgaaggctatatcttgaaataagg

SEQ ID NO: 69989 - DNA, 201 bp, Bos taurus; identical to SEQ ID NO: 30226

SEQ ID NO: 69990 - DNA, 201 bp, Bos taurus; identical to SEQ ID NO: 30227

SEQ ID NO: 69991 - DNA, 201 bp, Bos taurus
cataggctggtgaaaatgtaaagaaactaaacatagggaagatccaggatcaaagccaagctatggatcttgtcagccactgtgccctgtgcactttcaayatgcacatgattatctggaatatgcatttacatcattatttgcttgatatacctatgttctagtgagtaagtgtggtagatggaatatagtcccccaaag

SEQ ID NO: 69992 - DNA, 201 bp, Bos taurus; identical to SEQ ID NO: 30229

SEQ ID NO: 69993 - DNA, 201 bp, Bos taurus
aagtacaggattcctgctcataggccctcatttgcagaaagggctatcagatcaggtggcctgggagttacccacagccatagacatgaggcccctgggayagaaggcgctgccaggaagtataagactcagccagcacctccagcaaccagggcagaattcattgaccaggtcacaagttattacctccacagaataagt

SEQ ID NO: 69994 - DNA, 201 bp, Bos taurus; identical to SEQ ID NO: 30231

SEQ ID NO: 69995 - DNA, 201 bp, Bos taurus; identical to SEQ ID NO: 30232

SEQ ID NO: 69996 - DNA, 201 bp, Bos taurus; identical to SEQ ID NO: 30233

SEQ ID NO: 69997 - DNA, 201 bp, Bos taurus
ctttccctggcatagagctttacaggactgtcttgatgatctgaattaattgctttgtctttatgtcccccaagagagggccaggagccatccaggatggrtttgaatgaaaggcagagctaggcttcctgaatttgtgaatagtgcgtcagctcagaacctgggcctcacaaggctgaggtcatggatggacttctggtc

SEQ ID NO: 69998 - DNA, 201 bp, Bos taurus
ggcttcctggaagcttccttgcaagtctctctagtgccacagtcggttttccaaaaagttcaaccactttcctttcaggccccttctggaaagctttattrtcactccaggtgacagcttcctgcttgactgtcacctcggcaaacttcaccatccagtgggccaagcccccaccctctccagcaagatctgaatctcagg

SEQ ID NO: 69999 - DNA, 201 bp, Bos taurus; identical to SEQ ID NO: 30245

SEQ ID NO: 70000 - DNA, 201 bp, Bos taurus; identical to SEQ ID NO: 30246

SEQ ID NO: 70001 - DNA, 201 bp, Bos taurus; identical to SEQ ID NO: 30247

SEQ ID NO: 70002 - DNA, 201 bp, Bos taurus
ggcaggggaccaggccactgacaaacagactgggaggtgatgagttgccttgggctttatgatattcagaatagggatggtttcctgtccacaccttcccytccctcacaaggccagccagtgaccccctggcccaagtagcactccctagttcccttacagccagaaaggcacctaaaaacagaaatgaattaatgcatg

SEQ ID NO: 70003 - DNA, 201 bp, Bos taurus
ctcatcagacaagagtggtcagaggggcaagtgggggccacatccttgctttctttatactagtcctctttccctgacactggccaggcctagaagtaggrcaggtggagaaaaggcagagagagccaagcaagaaggtagcttctctgctctcccaccactcacgccaggctgttctggatttcacccctgaagggccca

SEQ ID NO: 70004 - DNA, 201 bp, Bos taurus
caagtagggtcactgccccaaagcagagatgaggaacccaggccccaagaggcaaagtgacagacagggtgacagcagctaggatcccacctccaggctgmccgttggtggcagcaggcctggacgctaactccacatggtactgctcatgtcccaagccctgtgacatggccatcctctcccagccttggccttgctgtc

SEQ ID NO: 70005 - DNA, 201 bp, Bos taurus
gttacatgaggaccaggcagccaactgcaagccagggatggaggtcttcccagaatccaaccatgatctgggatatccagcctccaggcctacgagaagayaaatttccacggttcaagcccggcatgatgttcaagggagggcaggaggacaggaacaggagggtacaacttagattcatctatgaggccaagatgctgc

SEQ ID NO: 70006 - DNA, 201 bp, Bos taurus
gagtcttcagccagctacagacctcagaagcttgctcgggccctgaggcaaggagctgaggtaacgcgtcccacctttgggagaggaaccacccccacctyttccttgctgcccaggcctcgagactaatgtgctgcccttggtcctggcccaggacgaagccaccacggtcatcaccctgcccaagcaggattcctcgcc

SEQ ID NO: 70007 - DNA, 201 bp, Bos taurus
gctttgcaggcggattctttaccatctgaaccaccagggaagcccagcaagacccatatgggatttctgacgtagggaaggcctgaagcagggagctgggraacctaaaggcagttctaggggcaggaagacacaggaccaattggactgaattcttcacgggccaccaggacctcggggcagggaggaggcataaggcac

SEQ ID NO: 70008 - DNA, 201 bp, Bos taurus
cacttctgaacaggcacctgacacttcatgtatactcatctgcctctaccatatagttaagtgaaactgcatttaaaaaagatggacactcaaatatcaascgcaaaagaaagataagtaactcagtgagttgaagtttaaggcattttagtttacacaacactcagtgcaaatggaaatggaggtgtttgatccaaagtt

SEQ ID NO: 70009 - DNA, 201 bp, Bos taurus; identical to SEQ ID NO: 30249

SEQ ID NO: 70010 - DNA, 201 bp, Bos taurus
ggcctccccatctaagcccttataggacactcaggagtgctgactcagcagttgggttgtggaatccaaagcccaattgatgtggggcttgaggggaagtygtcttcccagcggtatggccagacctttgtgctcttgtgagatggaaggtgcagggtgtatgctgtggctattgcttgggatcggctgctgccaagcggg

SEQ ID NO: 70011 - DNA, 201 bp, Bos taurus
gggtgacaggcattcaggaagtccaccaatatagaccctgagtctgcagaagtgaggcctctgttggccctgcgttttctcatctaggccacccctgatascaggggaaagttaccaaagctcgaggctgagcccccaaaccactgtcaacgttggtagaggaggccttcaaggcctagaatgccaactgaaaattgtcac

SEQ ID NO: 70012 - DNA, 201 bp, Bos taurus; identical to SEQ ID NO: 30250

SEQ ID NO: 70013 - DNA, 201 bp, Bos taurus; identical to SEQ ID NO: 30252

SEQ ID NO: 70014 - DNA, 201 bp, Bos taurus
ttagctgtcacctggaagaatgtagtggagagaaatcatgggctttgggattgctcagatacaactcatactctaccaatcactaactccatgtcctgggragttaatatagctcttggcacctctgtgttcttatctgtaagatgggctcatcacactacctgcctggcaaggtgtgttaggggagctcatgcctgagga

SEQ ID NO: 70015 - DNA, 201 bp, Bos taurus
tgtgggcctgcaggcatgatcctccctgtcctgggctcctgcagcctgaacaaggagaaggctgggcatatgatttctaaggccccttcagctcaagagayatgagattgactgtcatctctgtccctcaggaagctgcatagactccggcaagacctttgaccttcagaggcctcagtttgcccagctataaaatgggag

SEQ ID NO: 70016 - DNA, 201 bp, Bos taurus; identical to SEQ ID NO: 30254

SEQ ID NO: 70017 - DNA, 201 bp, Bos taurus
ctcaaggcccagagcgctccgtgagatgagccgcagctgtcgggggtccagtgttgcagctgtcttctcccagcccactctgcagcctctctgccctcccrtggccctaggtcccaggacgctctctataaacagcctgctgggtaaacacagccccaggggagcccagctggcaacacccatccatggatgaagagggtg

SEQ ID NO: 70018 - DNA, 201 bp, Bos taurus; identical to SEQ ID NO: 30256

SEQ ID NO: 70019 - DNA, 201 bp, Bos taurus; identical to SEQ ID NO: 30257

SEQ ID NO: 70020 - DNA, 201 bp, Bos taurus; identical to SEQ ID NO: 30259

SEQ ID NO: 70021 - DNA, 201 bp, Bos taurus; identical to SEQ ID NO: 30260

SEQ ID NO: 70022 - DNA, 201 bp, Bos taurus; identical to SEQ ID NO: 30262

SEQ ID NO: 70023 - DNA, 201 bp, Bos taurus
ccaaaggtgctggggcaaccaggaatagtgtttatttatagtggaaaagcgtcagccatgcacgcaagagaactgggagagtcgtgcacggtggctgccakgcggaaatggccccttcagcagaatgatcctggggctgctgctgctgctgctggtaagtcgtttcagtcgtgtccgactctgtgcgacgccatagacggc

SEQ ID NO: 70024 - DNA, 201 bp, Bos taurus; identical to SEQ ID NO: 30263

SEQ ID NO: 70025 - DNA, 201 bp, Bos taurus; identical to SEQ ID NO: 30264

SEQ ID NO: 70026 - DNA, 201 bp, Bos taurus
tgtgttttctctacagtattaataatatgagtcatagcaggtaagatggattctgggagggagtttaatttgaatttggccttgagggatgtggtacaaaraagtgggggcacattccaggctttgaaaaaaaaaaaagatgatcagaataaaggtatgggaatggccacctaggtagaccagggctatatgttggaaaac

SEQ ID NO: 70027 - DNA, 201 bp, Bos taurus; identical to SEQ ID NO: 30265

SEQ ID NO: 70028 - DNA, 201 bp, Bos taurus
gttctggagagcaatgacaagtgttagaaaaagcatagaatatggtctaccatttgatgctgtgatagcagggaaatcataaaggccagaatcctgtcctraatcataaccatccctcttccaggtgagatatctatagaagacacacacaggatccaccctgctgatctcaggtaaactgagttaaagcatgtggggagg

SEQ ID NO: 70029 - DNA, 201 bp, Bos taurus
ggcattagccaggtacaagggaagcagtgctggtctctaagggaacagactgggctcaggaacaaccctgttattttactctgcatcattccagtgtgggrctgattcagctggagttctgcactcactagaagcttggtgagtcacctgcctgagtctcattttcatggatctataagatgatagtgacttctaggattt

SEQ ID NO: 70030 - DNA, 201 bp, Bos taurus; identical to SEQ ID NO: 30267

SEQ ID NO: 70031 - DNA, 201 bp, Bos taurus
agagttggacacaactgaagcaagttagaatgcacacacaagacgtaaaatgactccatttgaaagaaaatgatttccctctcacaaaagagttaaaaacygatatccctggacaaattgcaactttaatccctgtggttatgcacagacccaggttccattcaatcattaggatgatccctttgcactgtctatatccag

SEQ ID NO: 70032 - DNA, 201 bp, Bos taurus; identical to SEQ ID NO: 30269

SEQ ID NO: 70033 - DNA, 201 bp, Bos taurus
tgaactgatttgtccatggccatatataattatagtccaattggttcaggcagggaccatccaactgcccagacattcattttattataagccttgatttkagctttaattaaataataatttattcagtaccttcttcaaagaagtctgctgcgattaatacccatatatctctccaaatgtctatatatactgtggaaa

SEQ ID NO: 70034 - DNA, 201 bp, Bos taurus
acgggtctttgtgagacatgatttacatatatatatatatataaatcatatatataaataaatcaagaccaacaagtgctggccttatgttcactatctgktctcatggcttctttatcttttcctctctgcttcttccttctgccccaatgaccttcctgtgcttccactgggacgttagcacactcccacctttgcact

SEQ ID NO: 70035 - DNA, 201 bp, Bos taurus
gaccttttggacccagggatcaaactcgcgtctcccacttgacaggcaaattcttagccactgagccacgtgggaacccccattagctttgtcttggagtyggccaaatctggattcatattaaaagattacctgcctgctgagttgttgtgaaaagtaactgcaaattgtcacaaatcgatagcacagaatctcttaatt

SEQ ID NO: 70036 - DNA, 201 bp, Bos taurus
tctaggctacactgcctcattttgaagataatgttagcatagttatgattattaagaataaagaaataactagattttaaggatcatagaaaagaaagtgrattgggaggtcacagtgaaaaataactgtgcttatggatttttctggagtggtcctgacatgaaatttcctagcttacacggtcacctcgcatctgccct

SEQ ID NO: 70037 - DNA, 201 bp, Bos taurus
ttaaaaaatcaagacattggaaagtgcacacgcacaagaaaaggagatgaaaataaacactacatgcttcacacccagagaaaattatgaatcatatctcrtaccatatgcttcctaaacgttttttacacactgtcatgattatttagtggcacagtctttttaatatagcagtatgtttgaacttatttctatgacaat

SEQ ID NO: 70038 - DNA, 201 bp, Bos taurus
aataaagagtagtttcagaataattgtagatttcttggaaaaataatatctcctcgtacttgggcctccctgttttgagaagttaagagaggatagattckattgggaactgtggacatattggttactgcaatgttgattgattaaaaatatacttctagaactggcagctcagaatttctgctcgaatgtctcctccct

SEQ ID NO: 70039 - DNA, 201 bp, Bos taurus
tatagtgcctatatgggttacaaggtggcagttgggcaaaatggctgggcaaatgcaagatgacattatcatggtgcctctttgatgtcttagatatacargaccttctctcacccttaattatttgaaaaagattaagcaagactctgcatttaagggttgagttctaattgagtcgagctgtgtgctgttctacaggaa

SEQ ID NO: 70040 - DNA, 201 bp, Bos taurus
tataaaaagaaaaaaaaatccacatattttttagtgattatcattatgaatgtctacaatgtagctagacagtgggccaagaggaccaggtactcaatgcrtattaattcctttaaatttcaaactttactgtagtcttgtgtggtagatgtatcatcaccatttgacagatgcagaaactgagggccagagaaatcggac

SEQ ID NO: 70041 - DNA, 201 bp, Bos taurus; identical to SEQ ID NO: 30270

SEQ ID NO: 70042 - DNA, 201 bp, Bos taurus; identical to SEQ ID NO: 30271

SEQ ID NO: 70043 - DNA, 201 bp, Bos taurus; identical to SEQ ID NO: 30273

SEQ ID NO: 70044 - DNA, 201 bp, Bos taurus; identical to SEQ ID NO: 30274

SEQ ID NO: 70045 - DNA, 201 bp, Bos taurus
tctaagaagtagcaccttttactaaaagtgaaatgaagagatctaggtttgaactccaggtcaactgccatcagatcttgggacactagtaggaaagcaamtagcctaaatggacacattgtctttatttgcagaatgaaattgatgagtatggtaatggaactcttacaacttgtggatatgctatcatctccatgtgta

SEQ ID NO: 70046 - DNA, 201 bp, Bos taurus
gaaaaattaaactcctaatttcataattttgtgtatttttctgtggctgaaaaaaaggctgacattacatgatgcagagaaacaatgatgggtttggacaractaccatggaagaggggcggttggtctgcattttaatggggctctttttctatacgaacaactgttcagttaaaggtaagaggttgtggaatattttgt

SEQ ID NO: 70047 - DNA, 201 bp, Bos taurus
aagcctggtgtctagggcttactcaaaagaaaaaggtttgttcaatttccttccttttcctatctcttttaatctcatttaatgacttgacaaggccactrctatcctcagttctaagatcaacaaagctactttaccagctgagccaccagggaagcccttctccaggccagattacaaattttaggcatctaagcttga

SEQ ID NO: 70048 - DNA, 201 bp, Bos taurus
taaggatcctagggctggttttttcaaaacagtttttatgcccttgagtaataacagagatggtactaacctgacttccttcttttgttagactattgccyactacagggtagcaggagcaggatcagaacaaaagaagaaaactggtctgtacttcattcatggagtaattattacccaatactctaagggctgtgttgg

SEQ ID NO: 70049 - DNA, 201 bp, Bos taurus
gtttttctgtcctttatcttaagaaatcttcattttattctacagaaatctttagaaatggcagttctccccagacttgaattatcaaaaagccagtattmtatggagacagatactaaataatatactccaggaaatcactatccaattctatttagatgcctacctcccccacaggacactctgctctcccatctatac

SEQ ID NO: 70050 - DNA, 201 bp, Bos taurus; identical to SEQ ID NO: 30282

SEQ ID NO: 70051 - DNA, 201 bp, Bos taurus; identical to SEQ ID NO: 30289

SEQ ID NO: 70052 - DNA, 201 bp, Bos taurus
aaaaaggtgggaaatatgtaagtaaatctaaacgaaagctaaattgataaaacaataataataatgtcttgtgagcttagaaacatagtacaactgaaatratggacatcaacaccacatttataaaggagagctaaaattaaaatattcttgggttttgtattgtttaggaaaatgacaataatattaattaaattttga

SEQ ID NO: 70053 - DNA, 201 bp, Bos taurus
gactgtggagtaaggctctgccatcacctatggataactactctccttttgagtaatggcttttggaccactactgagtcttagtggagattgaatgcttractgggccaccaaactaccatctgacctaagctgccaatcacagcctaggtgttgtcagacccaccaaaatgtgaagtagggtgtatacagtaggattcc

SEQ ID NO: 70054 - DNA, 201 bp, Bos taurus
tcctctctgtgcacctacaccgccggttttgcagcgtgaaagaaatcctggctctcttagagcaaaagttatgcagccaggcacaaggaccactggcctgytgagggctgttctgtgaggcactgccttgacaactcccagatcctgacactccaggtcaggaagcggcccctcctttgccacctgggacatgcccaccag

SEQ ID NO: 70055 - DNA, 201 bp, Bos taurus
ttttgctaatttgacatctattccccctctgatagccttgtgcagttgcttttccaatcactttaaatcttgccacctcattaagaagaggcccaatgttyccggtgggaacttgatctggttagaggagcacatcagggcaaaagatgcagggctagcataccactgtcatcaccctccctgccagctaagaggcctggg

SEQ ID NO: 70056 - DNA, 201 bp, Bos taurus; identical to SEQ ID NO: 30294

SEQ ID NO: 70057 - DNA, 201 bp, Bos taurus; identical to SEQ ID NO: 30296

SEQ ID NO: 70058 - DNA, 201 bp, Bos taurus
atcgacaacctcaaaaaacgctttgaccacaatgagatatatgtgagtgtgcacggaatgtcatctggggagtttagactttgcattttatggtgcagagyaggcttctcttcctcagactcttcttttttctgtttattggagtccagaggtatttgttgataccctcaggaagaagtttgtgtttgctcacttggtgcg

SEQ ID NO: 70059 - DNA, 201 bp, Bos taurus; identical to SEQ ID NO: 30304

SEQ ID NO: 70060 - DNA, 201 bp, Bos taurus; identical to SEQ ID NO: 30306

SEQ ID NO: 70061 - DNA, 201 bp, Bos taurus; identical to SEQ ID NO: 30307

SEQ ID NO: 70062 - DNA, 201 bp, Bos taurus; identical to SEQ ID NO: 30308

SEQ ID NO: 70063 - DNA, 201 bp, Bos taurus; identical to SEQ ID NO: 30309

SEQ ID NO: 70064 - DNA, 201 bp, Bos taurus; identical to SEQ ID NO: 30310

SEQ ID NO: 70065 - DNA, 201 bp, Bos taurus; identical to SEQ ID NO: 30311

SEQ ID NO: 70066 - DNA, 201 bp, Bos taurus
caacccagcctctggcccttgcatcagctatagactcttgtcactgactatttgccaccactgtcatcacacttctgctgctgccatccaccctggtcccrtgctccacacttttatttgggtactaagctttttttttttttttgagaaggaaatggcaacccactccagtgttcttgcctggagaatccgagggacggg

SEQ ID NO: 70067 - DNA, 201 bp, Bos taurus
cagctggtgttttactttctatatctgtctcattgacttttgtattgttgttgtcttttccttcctttttttttttcttcatctcatgttaaaactgctgwttcttttcttctctttagggtgtctccatattactttcttttgaacattttctgtttcctcagtttctattacctactgctttgaagcagaacaacccca

SEQ ID NO: 70068 - DNA, 201 bp, Bos taurus
taatcccatggacagatgagcctggcagcctacagtccatagggtctcaaagagttggacacgaccgaagcaacttagcacacgtggcctatcttgcttaytttcataaagaaaaaacaagagttatactttatgtttctacaaaatacttccaatgaaaagttacccaaatcttaaaatatttggcctttttatcaatat

SEQ ID NO: 70069 - DNA, 201 bp, Bos taurus
gatcacaaagagtcgaacaggacaacatactgactcaacaagaacaaacagggtataagggtggagttgtcagccctctgatgtcaaaaggtcaccaagcyagatacttgcacatggccagttggaaggtcagggagcctacccagtcttaattagctcatccataaatagacacagctgattccaatctcctggaaaaca

SEQ ID NO: 70070 - DNA, 201 bp, Bos taurus
gctcacactaaacatatgatagctagtaatattgtcaaaatgcgacagatgagaaaactgaggcacaaagaatataggtgcccaagatcacacaagtgttrgtcgctcagtcatgtccgactctttgctcccccatggactgcagcccgccaggctcctgtgcccacataattctctaggcaaaaacactggagtgggtgg

SEQ ID NO: 70071 - DNA, 201 bp, Bos taurus
aaaaagccttgggtggtggtagagctttgaccaacaatgtggtaaaaaaaaaattttaaatcaaggttcctgatcatggccccactttctccactgaccaragctatgactttggacaacccagtaaatccccccgtgatttggtttgctcacctgtaagataagagattgccccttggccacttaagattctactctaaa

SEQ ID NO: 70072 - DNA, 201 bp, Bos taurus
acagagagagtggcacagatagagagtcattctaccccttttcttttaggccaagagtgccagcacaactccaaacccaataaaacttccaaaggtttccrttcaaagcataagctttccttaggccaaagagaccatgactaaaaataaagtaatgactattaaatattccttgagcctattttagtgtgaaatgagtac

SEQ ID NO: 70073 - DNA, 201 bp, Bos taurus; identical to SEQ ID NO: 30312

SEQ ID NO: 70074 - DNA, 201 bp, Bos taurus
ctttgagttattaggggacttttcacatataaatattgcagtgcatgccaggggatgtggtgtaaaaatgaattatgaagaagctaaagtagagcgaatcyacagagccaaaatttggctcttttagaagacttttttaaaaaatcgacaaaacttgggaagctggtaaagaaatcaaatgagaaagcataaatagacagt

SEQ ID NO: 70075 - DNA, 201 bp, Bos taurus; identical to SEQ ID NO: 30313

SEQ ID NO: 70076 - DNA, 201 bp, Bos taurus
ccagaaagagtggtcagacatgactaatattctgggagactgttttcctgagcattagtatgggtcgggcatttgtttttcaaaggtcatatattatagaycacatggatttaaatgggtaaggttttacgacatcaagtaaaattaaaaaatcatttagcatgagaggaagaaggcaataaaagattcattctcagtcat

SEQ ID NO: 70077 - DNA, 201 bp, Bos taurus
ttgaacaaatgggtttgttttccatattggagaaattggttggagggtgcatttttgaatggatttcaacacagagactgagtttcagttttaggaacagmaatttgttttaatggaaacatcatcaggcatgtgataagtgtctcctttatggaagacttcctgctacataatactgtatgttaaagaggaaagagagtc

SEQ ID NO: 70078 - DNA, 201 bp, Bos taurus; identical to SEQ ID NO: 30314

SEQ ID NO: 70079 - DNA, 201 bp, Bos taurus; identical to SEQ ID NO: 30315

SEQ ID NO: 70080 - DNA, 201 bp, Bos taurus; identical to SEQ ID NO: 30316

SEQ ID NO: 70081 - DNA, 201 bp, Bos taurus; identical to SEQ ID NO: 30317

SEQ ID NO: 70082 - DNA, 201 bp, Bos taurus
aaatatccctcaagtgtagtgcagaaatgctgtctaatgttctcaagagaaagaaagccatgatatatcttacaagagacagtatggcttctagataagcyttatccaggcacaagttatagtgctattggccatgagttcactgttgatgaacccacaacgtatatcacatagaatgtcttcaaacaggaatacacatac

SEQ ID NO: 70083 - DNA, 201 bp, Bos taurus; identical to SEQ ID NO: 30318

SEQ ID NO: 70084 - DNA, 201 bp, Bos taurus; identical to SEQ ID NO: 30319

SEQ ID NO: 70085 - DNA, 201 bp, Bos taurus; identical to SEQ ID NO: 30320

SEQ ID NO: 70086 - DNA, 201 bp, Bos taurus; identical to SEQ ID NO: 30321

SEQ ID NO: 70087 - DNA, 201 bp, Bos taurus; identical to SEQ ID NO: 30322

SEQ ID NO: 70088 - DNA, 201 bp, Bos taurus; identical to SEQ ID NO: 30323

SEQ ID NO: 70089 - DNA, 201 bp, Bos taurus; identical to SEQ ID NO: 30324

SEQ ID NO: 70090 - DNA, 201 bp, Bos taurus; identical to SEQ ID NO: 30325

SEQ ID NO: 70091 - DNA, 201 bp, Bos taurus
tgtgactcagtgcagccccatcctgactatgggactgggagtcagctgggggtgctcagctccatggttgctcattctgggatacaggccgcttctcatgscatgttcctcctatggcgatagcagcatcatagagagttagtcccatggtgtagagtatttcaggacttttgctcatgtaactcctgctaacatcccatt

SEQ ID NO: 70092 - DNA, 201 bp, Bos taurus
agtatggtgtactgatttcccagcactgctgtaatgaagtacctcatactgggtggcctaaaacaacgtgcttttctcatagttttggaggccagaagtaytgaaatcagggttggttgctcaggaggatgggttccatgcctgtctcctagcttctggtggatgccagcaatccttggccttccttggtttatagataca

SEQ ID NO: 70093 - DNA, 201 bp, Bos taurus
acaaagttgaaggtacagaggacagaagcagccttctggtccagagaagttcaagatcttgtccaaggagtctgactcagactgggcttgcatcaattaaytttactacttaaacagtggaattgccaaatgttaatggttacattgtgagagacttcagacaacatccagtcctattctgtcttttttttttatcagttc

SEQ ID NO: 70094 - DNA, 201 bp, Bos taurus
accttatctagttcttagagagggtatgaagctcaaatgagatagcaaatatgaaaaacctttgaaaagtgtgccccctgaccacagcgatatcattcatrtgagatgatggcctggagaaatcccagatttatacaagtcacagatgctgttgggcataagggccatgctgggaagctcagacataaaatgagaggctgt

SEQ ID NO: 70095 - DNA, 201 bp, Bos taurus
caactgtgaacttgaggaagctcttgaactctctggggcttggtttccatcagtataagggggcgttcatgggattgttgtgaggataaggtgagcaaacrtatttaaaatgaagggcctgatgatatgaaagatgttataattaaggtcatcaatttagagaagttcagaaaaatctctccaaggttccatctccctgct

SEQ ID NO: 70096 - DNA, 201 bp, Bos taurus
cacaacagatgctcctaattcaaaaagcagaagaaagaaatacaaagtaaccacatatctggggttctgaaatcctgctggccaggctggggagactccaygcagggtgagggtagttccttgattagcccaccaactcaatggacatgagtttgggtgaactctgggagctggtgatggacagggaggcctggcgtgctg

SEQ ID NO: 70097 - DNA, 201 bp, Bos taurus
gcaggtgtagaccctctttatttcttcagatgacctctgaatacccacagcagaatctgtcttggcttcttcaaaagtataaagcaaggatccccaccccstgggccacaggccagtactggtccttggcctttcaggaaccgggctgtacagcaggaggtgagtgacagagagcaggaggtgagtgacagagagcaggag

SEQ ID NO: 70098 - DNA, 201 bp, Bos taurus
aaaaattgggcatgatctctgagatatctgggtagagaggtaaggaggtaaagaaacatgttaagtgggaacatgaatgtaaatgaagcctgtttcttccrgagccctgaataatttagatgggagaaaggcagatttcaagattgaggagagagttggggtttctacagtttgaagggtacatgaagcccaaggaggaca

SEQ ID NO: 70099 - DNA, 201 bp, Bos taurus
tagcaccttctgggccaatcttaaaaattggattagtacatgaagtactttcttctttatattttgcacctcagttgaggctctacatctcagatactaarcattttaaataaggccaaatataaacctttctttcccacttgcttttgttttctaaaccattgttcatatttaaatgaaattctgtgttcctttttaaaa

SEQ ID NO: 70100 - DNA, 201 bp, Bos taurus
aatgacatggtttctgaatttcattacaactttaaaactctgtccagctttaaagtgttataagaaaagcctgttttactatacatctgcttttaaaggcraaggcagcataatttacaagaaatcactacaatataaatctgttttgttatactgcttgagttaatttaaaataaaatttcagcacattgaaagtgcagg

SEQ ID NO: 70101 - DNA, 201 bp, Bos taurus
aaatcctctgtcctaggaattacccatgaggaagggcatgccaactttaaccttggagcttcctgtgggtgttaaaaagcaggagagaaatgtgaacctgrgaaggtgtttttcgcttgatttagaacctttctgagttctttggggaaaaggcaaatattgctgagaggcactgacccattgaagggaagagacatctgg

SEQ ID NO: 70102 - DNA, 201 bp, Bos taurus
ttgagaggcggaagcggtcccagctgactggccaccgaatgctcttttcagaatctccaacccggcgtggcagctgtcccttcctgcctggacattagtgyaggcccctcatgtccacaccccagtgctttttgcacagtagtgacgagcttgcccctggagccaggaagaagctctgagctctgtaacctgaagctccaa

SEQ ID NO: 70103 - DNA, 201 bp, Bos taurus
gagagtgctgcggtcatgtcctctttctgtcattgaatccagtgctggtaatgggctcttgtttagggtcctgtcctcctaggacctcaccacagcctcargggccgctgaacttctcatcgttattccccaatcttcagcgtctttaggggactccattgccttccctggaaaaggccatactccatatgttcataaaaa

SEQ ID NO: 70104 - DNA, 201 bp, Bos taurus
ttccaggacagtccttcctggtttatgtctgttgtcctggaataattattaatatgcctctttctgtatcctgatttggatgataaatcatatggccagcyagtgcttcagccttggtgcttgctactgttcttctagacttttcctctagctctgctggtgaaggaatgctgtatgggcctcaggtccctccaaaagaga

SEQ ID NO: 70105 - DNA, 201 bp, Bos taurus
aggttcctagaagttatggccagtgctctaactggtagtcttcaccatatatcttctgaaaacctgttaaatgcagtgtgttcattttgctggatgaactrttttcccctggccctcattaatcagcttcttcaaaaggacatcattgatgatctgctgacgtcaggtaggatgtcagtgcgcagtgtgactgaaataagg

SEQ ID NO: 70106 - DNA, 201 bp, Bos taurus
cgtctggagatgtttctctgctctccctgcccccaatttccctgagtcttgaagaacttgctgttttctctctaggcacttactactcgaagtgtggtccrtggaccagcagcatcagtctcacctggcagcttgttaaaaatccaattctcgggcatcagaacttgagttttccttaagtaaagtgatgttcttaaaaat

SEQ ID NO: 70107 - DNA, 201 bp, Bos taurus
gaaagagatttggaataccctgggtatttagtactgtgaatgagaataggaaaaaatgtgataagtaaacatcatggagtattacttgacaactagaatcraaggattaaatatacacatgcttggtgaaaaaagttggaagcacaaagagatatacactacaatatcatttacaaaaattaaaaaaaattatatacactc

SEQ ID NO: 70108 - DNA, 201 bp, Bos taurus
acaaacccatgtctggtgcccaggacacctggagatcctaaggttaatgggtgagtcactcggcttccctcccaggcctgcctgcctctctatacctcctygttggcatggatgccacttctcggaacagagagaagcccttccccccacaaggctaaaggacgaaaaagaagaaaccacgtgcggccaacttgtaccact

SEQ ID NO: 70109 - DNA, 201 bp, Bos taurus
aacagtgggcccccatctcttgcattagagatgggagcagacactccagatgtcctgcaccatagcccccacctacatttatgcccattcaagcttactcycatggccacctctctctgcttttcagccttagggccctttctgaagctgtaggagcttcgcacaaggaaagctcaaacagaggagttaatgctcccctcc

SEQ ID NO: 70110 - DNA, 201 bp, Bos taurus
tctgagaggcagaactcagggtgcagccggcattatttatgttgtcacaactgcagtctagtgtccacagatgcagagtcgtggtgccactgaagaaagcygcagagggccatttacaaaggtccacgtctccaggcagcactataccagtacgggtaccacgggcacatctcctctctcttaaaccctctctgttaagca

SEQ ID NO: 70111 - DNA, 201 bp, Bos taurus
actcatctttctttaggttggtaaagacaggaagggccagtgcaaagaacagagcgtgatgcatgctgctcacaaactcctgtttctcagacactcccatsagtcttcaaggcccgtccaggggccttctggttcatgaccagttctccagacatgactcaactagcttacttcttaggtgtctgcttggatagcagttcc

SEQ ID NO: 70112 - DNA, 201 bp, Bos taurus
caagggccttggttcagaagagcaccagcatttctgtaagttatacacacgacatccataattactagttttgatgtcaatacccactcagacagcgattytgttcacctatgggccccctaaacaaaattgaggttcaacaaagtatttgttgaataaatgaatgacaggaaaggagcagggcacaacatttgaagaatg

SEQ ID NO: 70113 - DNA, 201 bp, Bos taurus
aatgcaaagtctatgttccttagtttttagttgtcagattttagcttggtaattacaaaaattattctaaagagaggacatgcaaggtcgtggggaggcayctatgtccgatcctgatgagattcagaatttgttctatgggagctgtaaatcaaccaaaacttgctatctcataacaagcactgtttgattcttggcagg

SEQ ID NO: 70114 - DNA, 201 bp, Bos taurus
gggacagccagagcttggggagaatgctagccgattatcgggccagaggaggaagaatccagcaaaaaaactcagacccttttgcttactcaaaggaggcrtcaagcacctcaagtggaaaatcaggaagcagaactgaaggtgatgaagaaaaagggttgattaccagtgatgcagtgtggtcgacaaaggtgagcaaga

SEQ ID NO: 70115 - DNA, 201 bp, Bos taurus
cagagtctaactgaatatagcatgaactgaacagtccatctttactggaagcaaagactcatagaaagtcagtgtaattaatagatttgatgttgcaagcycataggtgattattatttatgaaagacaaatatgtcatgctcaaatcatcaagctaacatagcaccattctttggtaagttttcagtacctgcaaatgct

SEQ ID NO: 70116 - DNA, 201 bp, Bos taurus
ggaaggaggccctacggcatagacagtttgatgacacaaactttggtctggctgaacaccacaggaaaaaactacaccctcccatcaccctactgcaggtkgctgcagacactgggccactatgagcacagctctgtctcctggttggagggagtctcagaaactgggtggctccattcttcctgtacatgatggactggc

SEQ ID NO: 70117 - DNA, 201 bp, Bos taurus
tttcttcagtggacccagtaagcacttattattactaaaattgctatctgggttaatacaagtgtttaaattttatttagtaaattgtgagcatgctggamagaatctattaaattatgtacttttatagaattttgcagtgtagaagctatcatatttttcctagaaaatatgtaaaatcaagcttatagaatattcagt

SEQ ID NO: 70118 - DNA, 201 bp, Bos taurus
catggagttacaaagagttggacatgacttagcagcaacatgctaaaaagcagcaacgacatcgtgataaggcattgtacttgttcctagcacaaattcamatccatgcatagtttgacccctcaacttcttttttgggactccattagcttcattgacataagagacaaaatacctttgcatttgatgaaaactagcatt

SEQ ID NO: 70119 - DNA, 201 bp, Bos taurus
aaaatggttcttaagtttcctgcgaatcagttctggaaggttgagtcacctttgacaggaaatgtatttttcgttaggacctagaaataagaaaggataarggatattcagcatcttagtcccctttgaaggactactaattatatttttaaaaataaattttcattttcaaagacactttgtatttataaactaaaatta

SEQ ID NO: 70120 - DNA, 201 bp, Bos taurus
tcttcttcctgacaaaagctgttttttctccctccaggaataaggctgggggaataaacaaaaataagggaataggagatatcttacttgattggagactrggcagcctgtgatttgcaggtggtttaagcagatttcttctctttttctgtgggcttccaatggtatacctccagcctctttctgctaattcttctgtcc

SEQ ID NO: 70121 - DNA, 201 bp, Bos taurus; identical to SEQ ID NO: 30335

SEQ ID NO: 70122 - DNA, 201 bp, Bos taurus; identical to SEQ ID NO: 30336

SEQ ID NO: 70123 - DNA, 201 bp, Bos taurus
ctgagctgttcttgacaatacttgccttgtgctccttctccagcctggcatgagaaacacttccttctgtagagcagacagatgcaggaagtgcgagtcarttaactattgtttgctctttctgcatggtaaggaaaagaaacttctttttccttcctttcacttcccccaccccttaatttttacttagcctggtttgcc

SEQ ID NO: 70124 - DNA, 201 bp, Bos taurus; identical to SEQ ID NO: 30337

SEQ ID NO: 70125 - DNA, 201 bp, Bos taurus; identical to SEQ ID NO: 30338

SEQ ID NO: 70126 - DNA, 201 bp, Bos taurus; identical to SEQ ID NO: 30339

SEQ ID NO: 70127 - DNA, 201 bp, Bos taurus; identical to SEQ ID NO: 30341

SEQ ID NO: 70128 - DNA, 201 bp, Bos taurus; identical to SEQ ID NO: 30342

SEQ ID NO: 70129 - DNA, 201 bp, Bos taurus
acaatacccaaacacaaaaaagtccagcaaatccagtataccagttttttccctcctgaccaagaagttatttgttctggcatcttgtcaatataacacaragagtccatacaatagcaccaaattgtataaatagactatgagtttgatctgtaatttgaatgcaaatatctccctacctgtattatagcagatgtaatt

SEQ ID NO: 70130 - DNA, 201 bp, Bos taurus
tttacctgcatcagccttgactgaatacttttattgtgggttgggtggggagatgccctacacatttataagtaacgctaagtagaatcttgcaaaacttyaagagtgtagtctgaattgtgggatttacgtatgaggtactggacagattgttcactgctatccattttcaaatagacaaatttcaaaagtactaaaatg

SEQ ID NO: 70131 - DNA, 201 bp, Bos taurus; identical to SEQ ID NO: 30343

SEQ ID NO: 70132 - DNA, 201 bp, Bos taurus; identical to SEQ ID NO: 30346

SEQ ID NO: 70133 - DNA, 201 bp, Bos taurus; identical to SEQ ID NO: 30353

SEQ ID NO: 70134 - DNA, 201 bp, Bos taurus
ggatggcccttcagagttgtcccaagtcaaagataggggatggtggctgtgacccctgcataaaccagtcattctgtgttgagtggccttaggaagggggmaaaatcttgagcaaggaagtttatttttagctgagagctatgcctgtacctgttcccaggtgtagatcctaaaatgccagtactcagcagctagggtagt

SEQ ID NO: 70135 - DNA, 201 bp, Bos taurus; identical to SEQ ID NO: 30354

SEQ ID NO: 70136 - DNA, 201 bp, Bos taurus
acttttcctaacttagagctcctcgatttttaagaatgttacttcagccttaccaagttaaaatagtaagtggaatcctgccaattgccttgtcactttgmatttgtataacaaactttatagattggacctatttccccccaggtactctacatataatgccagtaacagtcaccacataaagaataatgctgtaaggta

SEQ ID NO: 70137 - DNA, 201 bp, Bos taurus; identical to SEQ ID NO: 30355

SEQ ID NO: 70138 - DNA, 201 bp, Bos taurus
cattcattataataaggaaaataaacacaaaatggccttttgaaagtgaatcactgtaattcactccccacactccacttctgctcttatatgagaaaaasagaattccagaaggcctcagcttccacacgaaaacttgttctctactcggcaattttcctacatctcttttttaatgatgaaatatcaaggcatttaata

SEQ ID NO: 70139 - DNA, 201 bp, Bos taurus; identical to SEQ ID NO: 30359

SEQ ID NO: 70140 - DNA, 201 bp, Bos taurus; identical to SEQ ID NO: 30360

SEQ ID NO: 70141 - DNA, 201 bp, Bos taurus; identical to SEQ ID NO: 30362

SEQ ID NO: 70142 - DNA, 201 bp, Bos taurus
acactaaaacttgtatgcaaatatttatagcagaattattcatagtcatcaaaaagtagaaatgatccaagtgcccaacagttgatgaatggttaaatacyatatagtatattgatacagtagaatcttcagttcagttcaatcagttcaatcactcagtcgtgtccgactctttgcgaccccatgaatcgcagcatgcca

SEQ ID NO: 70143 - DNA, 201 bp, Bos taurus
aaacctgggatgaaggtgaggaaatagtgagactgaataaaacctttggcttttttatcacagaagcctggtgtcaagcccacatccggccatggatcatytctccaagcctagacttgttctaagcttcctgtgttagaaatgcctactcacatatttgctggtgaagccgaccttggcagctggatcacagtcatgatt

SEQ ID NO: 70144 - DNA, 201 bp, Bos taurus; identical to SEQ ID NO: 30366

SEQ ID NO: 70145 - DNA, 201 bp, Bos taurus; identical to SEQ ID NO: 30367

SEQ ID NO: 70146 - DNA, 201 bp, Bos taurus; identical to SEQ ID NO: 30368

SEQ ID NO: 70147 - DNA, 201 bp, Bos taurus; identical to SEQ ID NO: 30369

SEQ ID NO: 70148 - DNA, 201 bp, Bos taurus; identical to SEQ ID NO: 30370

SEQ ID NO: 70149 - DNA, 201 bp, Bos taurus; identical to SEQ ID NO: 30371

SEQ ID NO: 70150 - DNA, 201 bp, Bos taurus; identical to SEQ ID NO: 30372

SEQ ID NO: 70151 - DNA, 201 bp, Bos taurus; identical to SEQ ID NO: 30373

SEQ ID NO: 70152 - DNA, 201 bp, Bos taurus; identical to SEQ ID NO: 30374

SEQ ID NO: 70153 - DNA, 201 bp, Bos taurus; identical to SEQ ID NO: 30375

SEQ ID NO: 70154 - DNA, 201 bp, Bos taurus; identical to SEQ ID NO: 30376

SEQ ID NO: 70155 - DNA, 201 bp, Bos taurus; identical to SEQ ID NO: 30377

SEQ ID NO: 70156 - DNA, 201 bp, Bos taurus; identical to SEQ ID NO: 30378

SEQ ID NO: 70157 - DNA, 201 bp, Bos taurus; identical to SEQ ID NO: 30379

SEQ ID NO: 70158 - DNA, 201 bp, Bos taurus; identical to SEQ ID NO: 30380

SEQ ID NO: 70159 - DNA, 201 bp, Bos taurus; identical to SEQ ID NO: 30381

SEQ ID NO: 70160 - DNA, 201 bp, Bos taurus; identical to SEQ ID NO: 30382

SEQ ID NO: 70161 - DNA, 201 bp, Bos taurus; identical to SEQ ID NO: 30383

SEQ ID NO: 70162 - DNA, 201 bp, Bos taurus; identical to SEQ ID NO: 30384

SEQ ID NO: 70163 - DNA, 201 bp, Bos taurus; identical to SEQ ID NO: 30385

SEQ ID NO: 70164 - DNA, 201 bp, Bos taurus; identical to SEQ ID NO: 30386

SEQ ID NO: 70165 - DNA, 201 bp, Bos taurus; identical to SEQ ID NO: 30387

SEQ ID NO: 70166 - DNA, 201 bp, Bos taurus; identical to SEQ ID NO: 30388

SEQ ID NO: 70167 - DNA, 201 bp, Bos taurus; identical to SEQ ID NO: 30389

SEQ ID NO: 70168 - DNA, 201 bp, Bos taurus; identical to SEQ ID NO: 30390

SEQ ID NO: 70169 - DNA, 201 bp, Bos taurus; identical to SEQ ID NO: 30391

SEQ ID NO: 70170 - DNA, 201 bp, Bos taurus; identical to SEQ ID NO: 30392

SEQ ID NO: 70171 - DNA, 201 bp, Bos taurus; identical to SEQ ID NO: 30393

SEQ ID NO: 70172 - DNA, 201 bp, Bos taurus; identical to SEQ ID NO: 30394

SEQ ID NO: 70173 - DNA, 201 bp, Bos taurus; identical to SEQ ID NO: 30395

SEQ ID NO: 70174 - DNA, 201 bp, Bos taurus; identical to SEQ ID NO: 30396

SEQ ID NO: 70175 - DNA, 201 bp, Bos taurus; identical to SEQ ID NO: 30397

SEQ ID NO: 70176 - DNA, 201 bp, Bos taurus; identical to SEQ ID NO: 30398

SEQ ID NO: 70177 - DNA, 201 bp, Bos taurus; identical to SEQ ID NO: 30399

SEQ ID NO: 70178 - DNA, 201 bp, Bos taurus; identical to SEQ ID NO: 30400

SEQ ID NO: 70179 - DNA, 201 bp, Bos taurus; identical to SEQ ID NO: 30401

SEQ ID NO: 70180 - DNA, 201 bp, Bos taurus; identical to SEQ ID NO: 30402

SEQ ID NO: 70181 - DNA, 201 bp, Bos taurus
acatcagacctcacctgaatgaaacataaagccctgctacctgaagccactgaggttgttagggtacatttgtttctgcagcaggatctggcctgcctgaycaatatactggtagatgtagtattattcactttagttcacttcagtcgctcagtcgtgtccgactctttgcgaccccatggactgcagcatgccaggcct

SEQ ID NO: 70182 - DNA, 201 bp, Bos taurus
ggttttggcgccagctatgctgttgacaactgtcttcctgggcagaatgttcacttttgaccaaacaaacaaatgtccaaggcacatatagtcaaaaccaytggccagaggacatgtttatagaaagtcccaggggatatactttgctcattcaacagtgaatgaacttttgtgagcatctagaagactggtcctccgtct

SEQ ID NO: 70183 - DNA, 201 bp, Bos taurus
aagcacaggggagcatcagggcatctgataaacctgagaagaggaaaataaaacaaaaagtagacagatttccctgggaaatgcgaagggtccatttgaartccacaacttgaaagggtcatggctaccccagcagtggattcaaaaaaggagtttcccaaggattcttgaagaggctggggcagggcagcccctgtgaac

SEQ ID NO: 70184 - DNA, 201 bp, Bos taurus; identical to SEQ ID NO: 30403

SEQ ID NO: 70185 - DNA, 201 bp, Bos taurus
ggctttctctgtgtggacccattctcttgatggacaggatgtgctgatgtgaagcttgctgttggcttgttagctggctctcatgctgtcaaagggcaacmgcagcaacatgtcttctgggtgttggaagaaataactggaaaagaattgactcctttaggagggccgcagaggccgtgttcctgaggaccatgtgaggac

SEQ ID NO: 70186 - DNA, 201 bp, Bos taurus
ttgtttacatcagaggtggctgcacgaattgacctcagggccagaagacaggccatctgtgggaagctcccaatttaagcagaaaattcacagacccagarattgtgtgaacacatctagagaagcagcagcattcgtaacagtgcattgtctggaaagagcatcgggttggaagtctggagatcaactaacttgttgagt

SEQ ID NO: 70187 - DNA, 201 bp, Bos taurus; identical to SEQ ID NO: 30408

SEQ ID NO: 70188 - DNA, 201 bp, Bos taurus; identical to SEQ ID NO: 30410

SEQ ID NO: 70189 - DNA, 201 bp, Bos taurus; identical to SEQ ID NO: 30411

SEQ ID NO: 70190 - DNA, 201 bp, Bos taurus; identical to SEQ ID NO: 30412

SEQ ID NO: 70191 - DNA, 201 bp, Bos taurus; identical to SEQ ID NO: 30413

SEQ ID NO: 70192 - DNA, 201 bp, Bos taurus; identical to SEQ ID NO: 30414

SEQ ID NO: 70193 - DNA, 201 bp, Bos taurus; identical to SEQ ID NO: 30415

SEQ ID NO: 70194 - DNA, 201 bp, Bos taurus; identical to SEQ ID NO: 30416

SEQ ID NO: 70195 - DNA, 201 bp, Bos taurus; identical to SEQ ID NO: 30417

SEQ ID NO: 70196 - DNA, 201 bp, Bos taurus
tcttcacttctctgcccagaaactgctgattaaatcagtctgccccttccccatctgtccgtctgtcttcagtttcaggtgaaagccagaaaagagaatawcccaccttttttaatacaactagagaccttgtactttggtgaataaaagagactcactgggctatttataaaggttcccactggactttcatttctttgc

SEQ ID NO: 70197 - DNA, 201 bp, Bos taurus
taacaacaacaaaaacacacaaagaagctaaagatttcactatttctacccccaaagtaatgcaagattactttcaagactttggatgagacccaaaaaawtttttaaaaggccaataatatttttttcatataaaagtaaaagctaccataaaatgtcctttttttcccctcccccatcacactgattaaatttttctga

SEQ ID NO: 70198 - DNA, 201 bp, Bos taurus; identical to SEQ ID NO: 30421

SEQ ID NO: 70199 - DNA, 201 bp, Bos taurus; identical to SEQ ID NO: 30422

SEQ ID NO: 70200 - DNA, 201 bp, Bos taurus
gcataagtaatcaaaagtgtttatggttctgttaatttgctgaaaggggaacttaaatggatagcaaggaaggaaatccaaactatcaagcccaatatttscttgttaatttgctgaaaggggaacttaaatggatggcaaggaaggaaatccaaactatcaagcccaatatgcttaacctttacagtacttatgatgttg

SEQ ID NO: 70201 - DNA, 201 bp, Bos taurus
tcagtgtcaccctaagtgactctaacattcagtgggttcttaagtttcttccaacaactttaaatttagaaaaaaggacaagatggcacgagaatgaaagrtaagtagcaatgaaggactgaaaatggaacttctatttaaacattttactccatcttttccacttcaggctttttgaagattaaaacccaatagctccta

SEQ ID NO: 70202 - DNA, 201 bp, Bos taurus
gaatgtattctttgaaattaaatgcatcagagcaataatatagtctccatgatgttaggatcatccttagcaaaattctaatgggaaatgtaaataccagrtatttctgtttcccagtcatctctaagactgtataacacaagaaactggcttatttgacatggctgattagacagtcgtcttaggaaatacttattcatg

SEQ ID NO: 70203 - DNA, 201 bp, Bos taurus; identical to SEQ ID NO: 30425

SEQ ID NO: 70204 - DNA, 201 bp, Bos taurus; identical to SEQ ID NO: 30426

SEQ ID NO: 70205 - DNA, 201 bp, Bos taurus; identical to SEQ ID NO: 30427

SEQ ID NO: 70206 - DNA, 201 bp, Bos taurus; identical to SEQ ID NO: 30428

SEQ ID NO: 70207 - DNA, 201 bp, Bos taurus
gagaagatttttgatcagataacaagagcagtggaatgtctttcagcttcaacataaatacttctcagcatataccaaattctaatgtgtgaatcttttayttatttagattattagtgccaaattgacacccgtagtatttggtcagctggttcattatgttccatagtgtatctaggatcttcttaggattattgtggc

SEQ ID NO: 70208 - DNA, 201 bp, Bos taurus
cctctgtagggttcttttggactttgtcaaaagctcacaggtcctagctctccatgttctctctgcatccaagttcctgtcatttcttcctctccaaatayaatcctttaagtctataggtggtagcagcaccagtgaacttacggttgctctatatcctgtgtaccctttgcagtcagtctgtttgcgtataagtccttc

SEQ ID NO: 70209 - DNA, 201 bp, Bos taurus; identical to SEQ ID NO: 30433

SEQ ID NO: 70210 - DNA, 201 bp, Bos taurus; identical to SEQ ID NO: 30435

SEQ ID NO: 70211 - DNA, 201 bp, Bos taurus; identical to SEQ ID NO: 30437

SEQ ID NO: 70212 - DNA, 201 bp, Bos taurus; identical to SEQ ID NO: 30438

SEQ ID NO: 70213 - DNA, 201 bp, Bos taurus; identical to SEQ ID NO: 30439

SEQ ID NO: 70214 - DNA, 201 bp, Bos taurus; identical to SEQ ID NO: 30442

SEQ ID NO: 70215 - DNA, 201 bp, Bos taurus; identical to SEQ ID NO: 30444

SEQ ID NO: 70216 - DNA, 201 bp, Bos taurus
ccatttaatgaggtgactgactggggcagacctaccaaaatctaccttcagacccaacctgtcactggagtttcttgatgaggtttcatgcagttatcccrtttggtaaataatagaggcaaattatttaataaaagtagagggaaaatataggcttgctttcctttttcaagcacaaacgttgggtttaaagagcgagat

SEQ ID NO: 70217 - DNA, 201 bp, Bos taurus; identical to SEQ ID NO: 30446

SEQ ID NO: 70218 - DNA, 201 bp, Bos taurus
tctctgggtgcagtcgtgtgggctctaaagccacttggctctctggcagtcacttgttcagaactcatgtattgattataggtgaactcattgattgagamtaaatctctggtatgaaaagatttgttaaaaattaaatagcttttcattttctaacggtcatcaagagccttggaaagctgaagatcttgtttaagagct

SEQ ID NO: 70219 - DNA, 201 bp, Bos taurus
ggctcccgaacttcggccatagtctcttctcacccacaagtgtgatgtactaccaatgacttctacatctgtgaagtaagaaaaaggccatttcctgatcygtctcatagactattatgattattttcctatttacagaaaccatttttttaactctctttcctctaagtatactttattttatggagtatttacttttct

SEQ ID NO: 70220 - DNA, 201 bp, Bos taurus; identical to SEQ ID NO: 30448

SEQ ID NO: 70221 - DNA, 201 bp, Bos taurus; identical to SEQ ID NO: 30450

SEQ ID NO: 70222 - DNA, 201 bp, Bos taurus
ggagacaagcctctcttatctgggtgtgtctccttaggaatctgagagattgttgtaggtctatttctgtgactacagaagatcttttggatagcacctaytggaatttaaaaacatgcaggaaataaggtaagtgtgagtcgtttaatgacacctattgttattgttgtttagtctctaagtcatgtccgaccctttgca

SEQ ID NO: 70223 - DNA, 201 bp, Bos taurus
gaaaatgaacaaaaagtgaaaattatacacatgattttggtacagtttatttaatcagctgtaaacatgtcataaagactactggccatctttgtgtgttrgagaggaagtcatagtcttcatcatttttttttaaattgtagctatgggatgctgtaaatggaaaatgtgtggcaacattaacaggccatgatgatgaaa

SEQ ID NO: 70224 - DNA, 201 bp, Bos taurus
ttaaacaataaacatttttttccccacgattctggaggctgtaagtctgatatcaaggcaccaactgatcttgtgtctgttgagggaatacttcctgtttkcagatggccatcttccttctgtatcctcttatggtagacagagagagacatgacctcttccacagctctccttataaagggctatggtttttccagtggt

SEQ ID NO: 70225 - DNA, 201 bp, Bos taurus; identical to SEQ ID NO: 30457

SEQ ID NO: 70226 - DNA, 201 bp, Bos taurus; identical to SEQ ID NO: 30458

SEQ ID NO: 70227 - DNA, 201 bp, Bos taurus; identical to SEQ ID NO: 30459

SEQ ID NO: 70228 - DNA, 201 bp, Bos taurus; identical to SEQ ID NO: 30460

SEQ ID NO: 70229 - DNA, 201 bp, Bos taurus; identical to SEQ ID NO: 30462

SEQ ID NO: 70230 - DNA, 201 bp, Bos taurus
cttaaccacagaagggcttgatcttttaaatgtcaacactgctcctcaaaattattcaaataagtctaatgaacaaactgtgttacctaacacagcagccrctagtcaagcaacatactactattcaaatttatcagagttcaacacaattgaaaaaccagcctcttcatcacaatagccacatgtcaagtgctcgacagc

SEQ ID NO: 70231 - DNA, 201 bp, Bos taurus
aaagatcctgagagctgatagtttaggggcttctccctttagaaaccatttgaactttgctattgttcttgggggtagtagtggtggagaggcttcgttcycttaatcaaatttttcacccaaccaaaaagcagatatcttatagggaagggagacttgtattgcccttctaaggaaataagattttctccacactttagg

SEQ ID NO: 70232 - DNA, 201 bp, Bos taurus
gcaggccagcccaggagggagactgacatacagggctatgtctacataactgcctctttccaaactcacatagcagagtctttgcctgatgaagaggaggygagaaggccctggagaaatatgcaaactcaactaccctgcctaatttaaatgagaagaaaaacaccattcaaagttgagtttttagtgattgacaaaata

SEQ ID NO: 70233 - DNA, 201 bp, Bos taurus
aaaaaaaaacagtcgtccgcggcttgcgtgcagcctctctgtcagcgtgggaaggagggaaagaaaagactcagccaagtgtcccgaggaggagccggccrgggaggggagaaagggaggatttcttttccagggtagggtttaattacgggagattttgtacatcttatcgcgggcttttacgtatataccaaggccaag

SEQ ID NO: 70234 - DNA, 201 bp, Bos taurus
taagtgtggtaaacgctcccacatgactctgtgtatttgactcctcactagtctattgttttactttaaatattttgatggtattcatgactatatgactyaatgaatcttttccatttattgttatacagtgtttctctttatccctactaatgcttttaatattaaaatctctttttctgggtgctgatagtgtaatgt

SEQ ID NO: 70235 - DNA, 201 bp, Bos taurus
tcttgcacagagggtgctgagtgttccttcaggaagtggccaccctagagagtccccagcattctcggcaccctgaatcacagtgcgatactggctgtagrcaccacagaaggggccccaggtctgaagactcagggtgtagggagaaatcaaagtggagtaaatgtctggcttcacttctgttagatgctgggtatcggg

SEQ ID NO: 70236 - DNA, 201 bp, Bos taurus
agctcgtgggcaactctgagaacagtccctgaggttatactgacacacggagggacatacacaaagacacagagctgctgtgtcaatgggttgtttggttrggggccggggtgtgtgctgaggatccataggggtctttcttgtggctgtaaaatgtaacctattaagttttacaagtaactatgtgagaggcatgatcct

SEQ ID NO: 70237 - DNA, 201 bp, Bos taurus
gggaggagaggcctgccatccaactgagccttgagcaaggtgattgagaccaagaacaaaccaattctcccttgctaagaggaaaaagagaaggggaggcrgaggcccgagtcctgagcaaagattgagaatcagggaagaaacgatgaaggaccacggagaagttaggcagggatatttgtatgaacatctaagcagagg

SEQ ID NO: 70238 - DNA, 201 bp, Bos taurus
tttggtcagttttcattgttggttctttgtcatgtacagtgatgtaatcagtgttgttggctaaggaagattctctgtagatctcattgcgatagtaaggrtgcctctacaccacatgctcccaagaagactatacagattgaccacagataagcagctctgctgacctcatgggtgaggcgggagtaggcagcaggcgtg

SEQ ID NO: 70239 - DNA, 201 bp, Bos taurus
gctgcgtgctgagaaagcccaccactcagccccagccccatcggcccactcaggatcggggagctgccctgaacatactccgcgccctcacagagtcccaragacacttcaaggcagggccccttggtctggtctctctgaagaccccgcacctgggcactgaggtctctcgccacctctgctccggagggctctctctgc

SEQ ID NO: 70240 - DNA, 201 bp, Bos taurus
cccccgcccatgtagtggcctgagacagagccctttccaagccccagagcccatgcctggtgattgtgaggagagggtgctttctcaccagaccctctgcytctgtcaaattgctcttctggtgacaatttgggaaccagtgttgagatccacgctcactggcatcacatgtgttttaaatgacctcatttccaaacttgg

SEQ ID NO: 70241 - DNA, 201 bp, Bos taurus
caaaggggccaggggctgaggcccccaaacctgtggtctaaacaagcccctctcagccgggacagaccacctaggaccccacgtgcctggagaaggttgayggtggccacgttaacctgaaagccatccatgctgtagcagatccccgctgcagggctgttcctgtggtcaggaggctgcactttgtcctgtttgggaggc

SEQ ID NO: 70242 - DNA, 201 bp, Bos taurus
ctaaagttacatttgtaataaaaaaggggcaccacataagtaaaaagaggaaaaatacaatcccgagaacctttgaggctctctgttcattggaaatggtytgcactgactttttccctactgtggacattcttcgcataagtatgtcagcacttgcattgggcagagttttgtccttgtgaaagccatccagcattgcca

SEQ ID NO: 70243 - DNA, 201 bp, Bos taurus
gtccagctgtgcccagggtggcttggccgtcttgtgctgctgtgaggggtgggggcagggtggtggtgggcttccaggaagagaaccctagaacctttcayggctactgctctaaggcccagtggggtggcttatgctttctcaaactggcagagtgaacacctggcgtcttacctaattgtggatttgaattttctcagc

SEQ ID NO: 70244 - DNA, 201 bp, Bos taurus
ggcgcccactgcagacagcgatgattcaagatggcctcatcttctggctgattgacatcctgaaggagcccgactgcctgtctgactacacgctcgagtaytcggtggccctgctcatgaacctctgcctcaggagcgcaggtctcacagccctactcccctcccccagctctgggttggctttcatttttccctcttaga

SEQ ID NO: 70245 - DNA, 201 bp, Bos taurus; identical to SEQ ID NO: 30464

SEQ ID NO: 70246 - DNA, 201 bp, Bos taurus
gattccaggatcaggggccctctgaggcaggcctaaagagaagaaggatgtgtccccaacagaggcaaggacgacaaaagtagaggcaggcatggtgggtrctcagtgaggagggtggcccagcagctcaacctgcccggagtccagagcagaggagacagaactgccaggtggaccccaaatgctttcaacaaatatttt

SEQ ID NO: 70247 - DNA, 201 bp, Bos taurus
ggaaaagaaatggccgagaagcatttaggagaaggaatcaggaaattcctgactctacaagggatgcagtgagaaagctggcctgttacacagacctgccyggaggcagccatattgggcggaagcttcctagtgaggcgaagatgggaccggcgttcagacccaccccaccccaggccaggctgaatctgctttcaaggc

SEQ ID NO: 70248 - DNA, 201 bp, Bos taurus
acaaatctgtcaaagaaaaaaaaatataagtaaaatactttatagccttgaagttggagacatttctttaagcattgatctaaagcctataaatatatatktaagactgataaagattcattgtaagatttatctggcaaattaaatcatctggggaatgtaattgctacatatatgacagataaggagtaaatatgctaa

SEQ ID NO: 70249 - DNA, 201 bp, Bos taurus
aacagatgacatgtttgatagtcatggaaagttctcacatggctgtggtcagcacatggagcagcctatgtgaagcatctcccagggccagcttcacatgrgggcagcgccctcacctacaaacctgcccagactttcagccctcacacacatctctccttgactctggggcccatcagatgacagagggggcattcctcc

SEQ ID NO: 70250 - DNA, 201 bp, Bos taurus
ttgaggagaaggcctacaacaaggaactgcggcccgcagcgcacaaagagagcgtggagatctccctggctctcaccctctccaacctcatctccctggtragcggcccctcctggctggtgggggaagggcagcagccacagcttcctggaggtccagctgggatggccatggggaggaaggtcaaggccccagccccag

SEQ ID NO: 70251 - DNA, 201 bp, Bos taurus; identical to SEQ ID NO: 30466

SEQ ID NO: 70252 - DNA, 201 bp, Bos taurus; identical to SEQ ID NO: 30467

SEQ ID NO: 70253 - DNA, 201 bp, Bos taurus; identical to SEQ ID NO: 30468

SEQ ID NO: 70254 - DNA, 201 bp, Bos taurus; identical to SEQ ID NO: 30469

SEQ ID NO: 70255 - DNA, 201 bp, Bos taurus; identical to SEQ ID NO: 30474

SEQ ID NO: 70256 - DNA, 201 bp, Bos taurus; identical to SEQ ID NO: 30475

SEQ ID NO: 70257 - DNA, 201 bp, Bos taurus
ggaagaaggtaagaggtattgagaggcgatgagcaagtaccaagtcctgcctgtggggggctgtctgggccattctcgctgaagccttgagggacgtggcrcctcaggaaaggagggattaaacacggtgtttgcaggtgccaaggatagtctgagctacaagggggtgtttaccaagtctggtggcccgggtttaggcac

SEQ ID NO: 70258 - DNA, 201 bp, Bos taurus
tgttgggccagaaagcaaggacattgtcaaggaataaggggatcatgtccaaaggatgtacaggagccaaaaagaaaagcaagatatcgattgaaacacaytgactatataaacatttatatggccctattgatgctcagagaaagaaggcttcaaatcaaccaagtatcattaaataccattggaggtaaccagggcata

SEQ ID NO: 70259 - DNA, 201 bp, Bos taurus; identical to SEQ ID NO: 30481

SEQ ID NO: 70260 - DNA, 201 bp, Bos taurus
ccctctgttcttagtgccttcagggaggacaagcatcagatccctccctgccactgccccagctctccactcaagctgccgcctccttccccttgcccctrcttgcccacattcaccctcttgagaaaaaagggccccttgttctaaagctccccaggagagggtcttgaaggagagaaacactgagagctgctcagagcg

SEQ ID NO: 70261 - DNA, 201 bp, Bos taurus
aaactgtgccacattgctggtttgagtcctggtggtttagcaggttaccttggagagggaatctaaaagattttcagttgccgggtttctaaagaagaccrtgaaaaacaggtccacggttcagatgtcttacattctgacagagtaagaacctttctaggtatttgtacatgattttcagtagagctgtatctttcctgt

SEQ ID NO: 70262 - DNA, 201 bp, Bos taurus
accatagctgtcaaaacctccgtgcgcttagtagcaggaggtcacgattatcaaggggagaagctgagggcggtcaggaatcacggggcctctgtgtgcaragggaaagagaaagaactccttgtgctctgactgcagactctgtcagaacctttgcttcagtcctcatgaccttctgggctatcctgttggcccatttgc

SEQ ID NO: 70263 - DNA, 201 bp, Bos taurus
ggagagaagagactgagggcttcattcattgagccctggccccgagacaaatgtccaggctttatcttcatgaagtttaaaaacagttgaagtccagcacrgcgatccgagagcaggtggtgaaaaggatgagctggatgtgagtgcaggcgtcaccctgcctggacatagggtgtgatgcgtgcagggcctgcccaaata

SEQ ID NO: 70264 - DNA, 201 bp, Bos taurus; identical to SEQ ID NO: 30483

SEQ ID NO: 70265 - DNA, 201 bp, Bos taurus; identical to SEQ ID NO: 30484

SEQ ID NO: 70266 - DNA, 201 bp, Bos taurus; identical to SEQ ID NO: 30486

SEQ ID NO: 70267 - DNA, 201 bp, Bos taurus
tggactccacaatgaacctgaacttcaggagcgaagactctccaacctgggtgtgaattcagagcagtcctcagagagcaaccagccagagttctcatttyctgctggtcttagtctaaagctctctcctctaatgattggctgcttagcacttgttaatatgatggatctgatttgttggaattgattttctcataaaga

SEQ ID NO: 70268 - DNA, 201 bp, Bos taurus
atgaaaatatgatgccttgtttggcccactggtcacagaggaatgagagacccatggagtaaacttgagctgaacccatgatttgcagccaagcctagctyggcccaaccaagacaggcagagccatagctgccaaggctcagatatgggtgaaaataagtaaatgattattgtttgaagccaccaagtttggttggttta

SEQ ID NO: 70269 - DNA, 201 bp, Bos taurus; identical to SEQ ID NO: 30488

SEQ ID NO: 70270 - DNA, 201 bp, Bos taurus; identical to SEQ ID NO: 30489

SEQ ID NO: 70271 - DNA, 201 bp, Bos taurus
gttgcgtacatgtaccacacactcttcacccactcattggtcgatggacatttagtgtccttccacgccccggctattgtgaacagtgcggctctgaacaytgggatgcatgtatccttttgaattgcggttttctcagggtacatgcccagtagtgcacttgatagctaataagaagctgctgtatagcacagggagctc

SEQ ID NO: 70272 - DNA, 201 bp, Bos taurus
ccatctgtgggtgggtctggcagataggccgctcttatgctgtggtcgtccttcaatgacaggtgtgaagggtcttgcagagaatctgatgcacagcagayggtaacagtcacaaggcccccttctttaattcagctgcaaactgggccgttatagggcaagctccatgaacagatggggcatttctgggatgggcaagag

SEQ ID NO: 70273 - DNA, 201 bp, Bos taurus; identical to SEQ ID NO: 30491

SEQ ID NO: 70274 - DNA, 201 bp, Bos taurus
gaagctccaccctgactcctagggcctgggaacctcaagtcccgggctccaaccaggttcccaactgttccctctaggcctcagtaaattcgagtaagacmcaatgcattcattcatgcagaaagtttttactgagctcagacatgagtcctacgctgggcacctggggctctgggcttcctggaactggcctccagtggg

SEQ ID NO: 70275 - DNA, 201 bp, Bos taurus; identical to SEQ ID NO: 30494

SEQ ID NO: 70276 - DNA, 201 bp, Bos taurus; identical to SEQ ID NO: 30495

SEQ ID NO: 70277 - DNA, 201 bp, Bos taurus; identical to SEQ ID NO: 30496

SEQ ID NO: 70278 - DNA, 201 bp, Bos taurus; identical to SEQ ID NO: 30497

SEQ ID NO: 70279 - DNA, 201 bp, Bos taurus
atttttttcagcatctagttctcatttagctatttttcaataattttataatttcctccattaagactcaatacatcttaggccaacatagttttcttggyatcataaattgggtcttaaaaaatgacattttctgtttattgcttgtttataggaacatgattgattttttttttctttttggccacacttcatgggttg

SEQ ID NO: 70280 - DNA, 201 bp, Bos taurus
aagtgtgggatctcttttgattatcaagtgacagaaactttgacttctactggcttcaacaacatcaaaagaagagcccaggattacatgttttgacccarttgaatagagggattcaaacaatagtatagagacaaaagcgacatttaaaatacttaacaattggcattgtgttgtcactgaacagatgtcagaggaggt

SEQ ID NO: 70281 - DNA, 201 bp, Bos taurus; identical to SEQ ID NO: 30499

SEQ ID NO: 70282 - DNA, 201 bp, Bos taurus; identical to SEQ ID NO: 30501

SEQ ID NO: 70283 - DNA, 201 bp, Bos taurus; identical to SEQ ID NO: 30502

SEQ ID NO: 70284 - DNA, 201 bp, Bos taurus; identical to SEQ ID NO: 30504

SEQ ID NO: 70285 - DNA, 201 bp, Bos taurus
ggaagtgaccaggcagcaaaccaaaggagccagatttagtacccaaggaccagcaagaacgtgatcagagagggatgggccgggggctgccacaaaatgcrtccatcagcaagcagaagtcttgactgccactcgacctgtcaccctaaatgccaactagttggggccagcagaaacctagaatatcatttcttactcctt

SEQ ID NO: 70286 - DNA, 201 bp, Bos taurus; identical to SEQ ID NO: 30506

SEQ ID NO: 70287 - DNA, 201 bp, Bos taurus
gttacgtgaggcttccgaggtactcaggaaggggtggccagggaggagggaagacaaagtctctggttccttgtttgaggctgggaatgttaggacggcartcaatggctgtctggggccataaatgccaagctgaggagaataggtcctgaggctagcctctctccaccccctgccctgcgacactgaatttcacccccc

SEQ ID NO: 70288 - DNA, 201 bp, Bos taurus; identical to SEQ ID NO: 30508

SEQ ID NO: 70289 - DNA, 201 bp, Bos taurus; identical to SEQ ID NO: 30509

SEQ ID NO: 70290 - DNA, 201 bp, Bos taurus; identical to SEQ ID NO: 30510

SEQ ID NO: 70291 - DNA, 201 bp, Bos taurus; identical to SEQ ID NO: 30513

SEQ ID NO: 70292 - DNA, 201 bp, Bos taurus; identical to SEQ ID NO: 30514

SEQ ID NO: 70293 - DNA, 201 bp, Bos taurus; identical to SEQ ID NO: 30515

SEQ ID NO: 70294 - DNA, 201 bp, Bos taurus; identical to SEQ ID NO: 30516

SEQ ID NO: 70295 - DNA, 201 bp, Bos taurus; identical to SEQ ID NO: 30517

SEQ ID NO: 70296 - DNA, 201 bp, Bos taurus; identical to SEQ ID NO: 30518

SEQ ID NO: 70297 - DNA, 201 bp, Bos taurus; identical to SEQ ID NO: 30523

SEQ ID NO: 70298 - DNA, 201 bp, Bos taurus
tctgcttggggagacagggctggtgtctccaacctgcacgggcagcctgagggagacgggctggggagaaggtctgaggaggagcacacaggccgctgggytggttaatggacacggcgtcgtctggctggacgcgcagagggtagattcaagcacgacgtggggcttcagatcaggacacctcccggggcatctccgggc

SEQ ID NO: 70299 - DNA, 201 bp, Bos taurus
gtgatgccaggcagtgtgaggtggggtcaaccaaggaaggcttcctggaggaagagaatgttgagccagctctttaggagggctgaggcccagatgggcarggaggagggtggtggtgaaaatggcactccccttgaacacttggcacttccacaccatgcggaagcctgtcaaagcccagctgttggccctctgccctgg

SEQ ID NO: 70300 - DNA, 201 bp, Bos taurus
gctgtcactccagcgtgaaggatgtaaagaataacaggacagaccccgcccccgtttgtcgctagaattaaagtaaataaccggccaaagtgcttgacctkgaacctggcacttggaacgcgcccggatacaaccagtggtgtctggggctacgttcttaaattggccctgaactagttcgtcctgtttcaagtcccgtgt

SEQ ID NO: 70301 - DNA, 201 bp, Bos taurus; identical to SEQ ID NO: 30525

SEQ ID NO: 70302 - DNA, 201 bp, Bos taurus
cagaagaaagaacagcaatggaacaggggaaattattgagtctgaggaacagaaacaaaaaagatagaaaaaaaaataccatctatttggccatgaattartctcaatagattttttaaatatatatttttcagagtatcttctatgaccatgactaaatgaagttgtgaggcttcccaggtggctcagtgataaagaatc

SEQ ID NO: 70303 - DNA, 201 bp, Bos taurus; identical to SEQ ID NO: 30526

SEQ ID NO: 70304 - DNA, 201 bp, Bos taurus; identical to SEQ ID NO: 30527

SEQ ID NO: 70305 - DNA, 201 bp, Bos taurus; identical to SEQ ID NO: 30531

SEQ ID NO: 70306 - DNA, 201 bp, Bos taurus
caacacaggttagggcaaccagccctccttgtggtggaaaattcacttatacagggttcctccatatatggccattccatcttctcggattcaaccaaccrcagatcatatagtactgtctagtattactattaaaaaaaattaatgtgtaagtacaccagtgcagttcaaatgtgtgtgggttcaatggtcaactgtgat

SEQ ID NO: 70307 - DNA, 201 bp, Bos taurus
gccaaaaaacaaaacataaaacagaagcaatatgctacaaattcaatgaagactttaaaaatggtcagcaaaatggtcagcatcaaaaaaaatcttaaaaratagtatctcttcctgaaggccttttcttagctcccaggatggggcttctcggtgccccagaaatggccggtttccttgtctgttgtctgcacacgctcg

SEQ ID NO: 70308 - DNA, 201 bp, Bos taurus
ccacggggcagctaagcctttgcacctcaactgccagaggccgagcgcactagagcctgcgctccatgacaaaagaagccgttgcaataagaagccgctaygtgccgaaactagagaaaacccgggcccagcaatgaggacctagcacagtcaaaaaagtgataaatagacaaagccgaggtcccatctgcttactaccct

SEQ ID NO: 70309 - DNA, 201 bp, Bos taurus; identical to SEQ ID NO: 30532

SEQ ID NO: 70310 - DNA, 201 bp, Bos taurus
agccactattataggtctgggagggcccatcgaggatctgtctgacttatgaagtcactcgtgctcagggaatatgcattacttgccaggaacgttgaccygaggctccagggggcacagtggcctccggatctgaccaaatggcaaaggggttgtcttgggttctgaccaccgtgaacgtggtttaggtgtatggagtgg

SEQ ID NO: 70311 - DNA, 201 bp, Bos taurus
agctccgtgaccttggacttgttagttgaccactctcagcctctagttcagacattcccgtcatctaagagccggaacctctaacacaggggttggcaaartggcccactgcctgttttgtaataaagtgtcataaataaagttttattggcacacagccacacacattcctttgtctgtgaccgctttcccgctccagtg

SEQ ID NO: 70312 - DNA, 201 bp, Bos taurus; identical to SEQ ID NO: 30533

SEQ ID NO: 70313 - DNA, 201 bp, Bos taurus
gggggtcgatccagactggcctgacctggaaggccttctgtgggctgccctggcctctgatgctgacggcacctccctccaccccaggccaatctgctacytatgagtccacaccctcttcactccactgtcaagcttttgctcttggttatacccccgccgggaacactttctctgaaaagatggggccatggcaggcag

SEQ ID NO: 70314 - DNA, 201 bp, Bos taurus
acacccgtggggagggaggcttgagagacagtggaaggtggtggtggagggtgtggctcgggaatccaacaggaccccagtgtgtgacttcgggccagtgrctcaatctcccagaacctcagcttcgacatttgtaaaaagggggtaaatcacgtcttcaaaggattttggcctcagctttctcatttgtaaaatagagtt

SEQ ID NO: 70315 - DNA, 201 bp, Bos taurus
gagtctacagggtcgcaaagagctggacacaatggaagtgactgagcagaaggaaaccggacagccccagggaagggccagaaagggcctgctggctggaygggagaatctggtcctggagttcctgggcaagacgactcctaaagtggacggggtggtctctgaagcccccttgagcatcatctgaaacggccagcctgt

SEQ ID NO: 70316 - DNA, 201 bp, Bos taurus
atccgatcagatggcacctcaccaacgcagctgaccgcagagagggcagcagtgtggtccccctgccctgaggggaaggacagagttctccccacacaacyagccgtctgttaatcgggccactgcaagtgtggaagagcttattccattcccaggaaacggatatattcttgagcccaggaacacctgagtctggagccc

SEQ ID NO: 70317 - DNA, 201 bp, Bos taurus; identical to SEQ ID NO: 30535

SEQ ID NO: 70318 - DNA, 201 bp, Bos taurus; identical to SEQ ID NO: 30536

SEQ ID NO: 70319 - DNA, 201 bp, Bos taurus; identical to SEQ ID NO: 30538

SEQ ID NO: 70320 - DNA, 201 bp, Bos taurus; identical to SEQ ID NO: 30539

SEQ ID NO: 70321 - DNA, 201 bp, Bos taurus; identical to SEQ ID NO: 30540

SEQ ID NO: 70322 - DNA, 201 bp, Bos taurus; identical to SEQ ID NO: 30541

SEQ ID NO: 70323 - DNA, 201 bp, Bos taurus
tgggctgccagtctcctccctcacctctcaccttcgtgcagatgcccatggaagctccagtcccactctaggcctttggggacgtagggcctcacaggacycagccctcccttctaggttctcctaattaaggtgctgtgtgcatcagtagaaggaaatgtgggatgtggggacgggtcagggaaggcagaggacacagca

SEQ ID NO: 70324 - DNA, 201 bp, Bos taurus; identical to SEQ ID NO: 30542

SEQ ID NO: 70325 - DNA, 201 bp, Bos taurus
gacatttcatttgttttcccttttgtttttattattattactgctactacaaattgagattatggaataaaagtagttaaggattcactgtaattgttacrgaaatagcaattataggtgactattgacatatcagaatttgttttagttaaaaactaatctgagttttggagaaggcaatggcagcccactccagtactc

SEQ ID NO: 70326 - DNA, 201 bp, Bos taurus
gcccggcctgccatctggtggcaggttcgttacactggatccctttcatcacagaagtagcatagacttgctctcagtacaatagacatttattccagctmaggttttacattctctgctggccgtgcttctgctagcaacttcattggtagatttactgaatgtcttactaataaccatggtactatcatgcagagtgaa

SEQ ID NO: 70327 - DNA, 201 bp, Bos taurus; identical to SEQ ID NO: 30545

SEQ ID NO: 70328 - DNA, 201 bp, Bos taurus
ataacagcaacaatggtccgacttgagggcctgtgacattgtcctggtttcttcctgcctccacctcccggcgtccacaggccacccccatgaagaccctyatctgtgttccctttttgaacgtatgaaaggatttctctgggatccctgggtcaaagggcacacatcaaattccgccagactgcactgcaaggtgtctgg

SEQ ID NO: 70329 - DNA, 201 bp, Bos taurus
tttaagataactcatgtatgtggttactatggtgcctggccaggccaggcggtttcagtcagtggttcccctaacactcccacacccatgtctatggcccrtccacttcggttgggtgcctcctccaatgaactatgttcttccttcatttcagagctcacttttcaagaaaatcgaaaagtcatcactgtcatatggacg

SEQ ID NO: 70330 - DNA, 201 bp, Bos taurus; identical to SEQ ID NO: 30546

SEQ ID NO: 70331 - DNA, 201 bp, Bos taurus; identical to SEQ ID NO: 30547

SEQ ID NO: 70332 - DNA, 201 bp, Bos taurus; identical to SEQ ID NO: 30548

SEQ ID NO: 70333 - DNA, 201 bp, Bos taurus
ctgtgcttgggagctgaactgacccctcctctttctctctctctcgaggccactacgatgctcgggcccgcgtcctcatctgccacatggcctccctcctycgagcgcccttggaggagcttgacctcctggaagagaccttcctcgagagcctgaaggaaagcaaagaggaggactctgagtaagggacccctggccctg

SEQ ID NO: 70334 - DNA, 201 bp, Bos taurus; identical to SEQ ID NO: 30555

SEQ ID NO: 70335 - DNA, 201 bp, Bos taurus; identical to SEQ ID NO: 30558

SEQ ID NO: 70336 - DNA, 201 bp, Bos taurus; identical to SEQ ID NO: 30559

SEQ ID NO: 70337 - DNA, 201 bp, Bos taurus; identical to SEQ ID NO: 30560

SEQ ID NO: 70338 - DNA, 201 bp, Bos taurus
ggagttatcaggcctgcttcggtaggaaaaagaggctcagagaggttgagtaacctgcccacagtcgcacagtgcacagagcagatgtcccgtccaggccrgctggagtcaggttacctcgaggttcccggagtgtagacttatgcttcagcaggagctggtcaaggacataggtctgctcctgggggcccagcgctggtc

SEQ ID NO: 70339 - DNA, 201 bp, Bos taurus
gctgcccacccccattcatcccgcctgcgtttcctgagacctgctgtgtgcctcaggtggttccagatgccagagacgcagagggtagacgtggcccctgmgctcacgagagccaagctccatgagagatgggaaaggaggagcagtgtcagtgagaccccttcagaccaaggggcgcgccaggaagagtgggacaggggc

SEQ ID NO: 70340 - DNA, 201 bp, Bos taurus
cattttcagagagggaagaaaaatagcagaaggctggcgtggctttttttttttttttttttttttaggaggcattctcaatgagaaggggaatggaaaaragagagaaaaggagaaagccggcagacaccccactttaaagggaaaaagaacacatcacaaccacagccacaaatcctagatgggcgcccagacaaaacc

SEQ ID NO: 70341 - DNA, 201 bp, Bos taurus
gccagatatgacatttattgccaagccacactgtagccagagggacagcgtggacacaaaaacgagaaacagttcaaagtggctttggccctgagcctaakgtctgtgttcaaaccccgactctgccgttttccagctgtgtggctttcctcgctggtagaggcctgtctgccccagggagctgtccagataggtgactag

SEQ ID NO: 70342 - DNA, 201 bp, Bos taurus
agcagaggggatgaggctggaggccaggaggctgttaggaggctggggcgcaatcccaccccagagaagacaggcccgagggagggccacagaggggaggyggaagagagggtgagggcaagccgccccagttccttgcccacctctaagtgctgttaagtgccctgtcctgtgggactcagagaaaagccatcccaattg

SEQ ID NO: 70343 - DNA, 201 bp, Bos taurus; identical to SEQ ID NO: 30563

SEQ ID NO: 70344 - DNA, 201 bp, Bos taurus; identical to SEQ ID NO: 30564

SEQ ID NO: 70345 - DNA, 201 bp, Bos taurus
tggaatggtttagccatatgataacatttccaagaattaagtccagtgagtacaccattcagtgtaaccatatagtgacaaagagggtaccagctttaagyatcacctctgcccatctttgttggcaaggcgggtggtaggatggaactcaggaacctcatcatggcagtcctcccacaacaccttctttctctggatccc

SEQ ID NO: 70346 - DNA, 201 bp, Bos taurus
ccactcaaggggctccacggccccctcgccagcccccaagcgtgggtcactttcccaatttcagggttgcctagctggtctctgtccccacacttgttttrgagagggatggatggggccctctgcccggcacccagctctttggggaccctagaccccgcatgccccccgtgcccttccatttggggcctcggcagagtt

SEQ ID NO: 70347 - DNA, 201 bp, Bos taurus; identical to SEQ ID NO: 30567

SEQ ID NO: 70348 - DNA, 201 bp, Bos taurus; identical to SEQ ID NO: 30568

SEQ ID NO: 70349 - DNA, 201 bp, Bos taurus; identical to SEQ ID NO: 30570

SEQ ID NO: 70350 - DNA, 201 bp, Bos taurus; identical to SEQ ID NO: 30571

SEQ ID NO: 70351 - DNA, 201 bp, Bos taurus
cccttcttcctgtgtttcccatgacctgtcctctgccctacggtcccacctgccagatctgtgtcctgaaagactgccagactctcatcttggggctctcygacatatcaaagaaagttgcgtgtcctccgagggcgagtcacccactcatcttggggctctcagacaaatcaaagaaagttgcgtgtcctcctagggcga

SEQ ID NO: 70352 - DNA, 201 bp, Bos taurus
ggccacctcaaaccttcccatccaagacaaaagatatcacctccagccccacatgtggagggcatacaataagccaagcaccagaacgaagccgtatattrtaagagaacaaggctgggcccacattctcaaacacctttattctcggtgttcctctgggacggactcttggtaattaatcgtcccatttcagagatgaag

SEQ ID NO: 70353 - DNA, 201 bp, Bos taurus
ctgtctccacacagcactggttaagcatgtgagctcccgagccacagtcctgggttcagatcccagctcggccacttactagctgtgtgccccggggcctygtttctggtctgcgggatggaagtagcgacagcatctacccgtggggattaacaacgttgggaaagtcaaatgaggcagggcctggcaccgagcaagccc

SEQ ID NO: 70354 - DNA, 201 bp, Bos taurus
tattcccaccacggccctgctaggaagcctgccttatttcagaaaaggatactgatgctcaaacaagtcacatgactcaccccaagttacccaaaatgacmccccaaatgtgggccaccaacaccctcatcgcttccctggtggctcagatggtaaagaatccacctgcaacgcaggagatcctggttggatccctgggtc

SEQ ID NO: 70355 - DNA, 201 bp, Bos taurus
ccttggggcccggaactaccacctccttctatcagacaaacgagaccaacggagccccaagtcaggcagtgagcaggaagggggctccatccacccaccgygctgccttccacagaggccatgctcacaatccccaggctcgttgagaaacactgtctccagtggagacagagtcaccaaatccctgagtcttcaggggcc

SEQ ID NO: 70356 - DNA, 201 bp, Bos taurus
gcacgccagccggccgctctcagcccatttcccagcagcttcgggagcccaggatggcgcgagcacggtgaatcattaacctgcagagagaccagcagctrcaggatggccacccaccaccctagaggccctgccggcccaggcctccctgtgcccagcccacgcagccgagctgggctcgcaggtggcccctctggctgg

SEQ ID NO: 70357 - DNA, 201 bp, Bos taurus; identical to SEQ ID NO: 30574

SEQ ID NO: 70358 - DNA, 201 bp, Bos taurus
gctgggacaccctgcacccatccttatcttctctgagtctctttagcttattagaaccctgctttggtttgcaaactatgaagtcctagacattgtgaacrgggattgatgccaaaatcttggttccctgttcaccgacgctgaaaagaaataaggagacagattggagggaaaataaaaaaggaagagtggtttcattct

SEQ ID NO: 70359 - DNA, 201 bp, Bos taurus
tgatccagtgactgttggcaatttgatctctggttcctctgcctctttgaaaaccagaatcggaaatgctaagaaggggccagataacccatgctttgacragccctccaggtaatggttctgctgctgcagctgctgctcctgaactctgaggaccgctgtcccgaagctcgcattcatccctggccactgccccaggcg

SEQ ID NO: 70360 - DNA, 201 bp, Bos taurus
tactccacctctccgggcctcagtttcttaatctgtaaaatggggataaaagcagtccccgcttgacgctggtgaggaatgagcgaatccaagcgtgtcamacccttgaatgtgcctggcctgtgtcagccccctttgtggtggtggtttggggttttgtttttttgaccttgcagcttgcaggggatcttcgttccccga

SEQ ID NO: 70361 - DNA, 201 bp, Bos taurus
caactttgctcgctttcgtataaatgctatgtatgtaattacagggaagttattatatattatatataacaactacagggaagcctaccatgcttccatgytgccacacgtccatggggtcacagagtcggacacaccttggccaccgaacaacaaagtaactcctgttatattagctgttatcatccacactctacctcc

SEQ ID NO: 70362 - DNA, 201 bp, Bos taurus; identical to SEQ ID NO: 30576

SEQ ID NO: 70363 - DNA, 201 bp, Bos taurus
agcataaaatgtatttacatgaacaaaagaagaagaacgctcacaagaaaaatgaagacccaaagaagtgcccaggcctaagtgcctgtataccagctgarcaaagagtagtcgctgtagaagagtgcctaagtgacgtggtggcgatggttgttgctaagccatgtccaactcttgcgacctgatggacgtggcccacta

SEQ ID NO: 70364 - DNA, 201 bp, Bos taurus; identical to SEQ ID NO: 30577

SEQ ID NO: 70365 - DNA, 201 bp, Bos taurus; identical to SEQ ID NO: 30578

SEQ ID NO: 70366 - DNA, 201 bp, Bos taurus; identical to SEQ ID NO: 30579

SEQ ID NO: 70367 - DNA, 201 bp, Bos taurus; identical to SEQ ID NO: 30580

SEQ ID NO: 70368 - DNA, 201 bp, Bos taurus; identical to SEQ ID NO: 30581

SEQ ID NO: 70369 - DNA, 201 bp, Bos taurus; identical to SEQ ID NO: 30582

SEQ ID NO: 70370 - DNA, 201 bp, Bos taurus; identical to SEQ ID NO: 30583

SEQ ID NO: 70371 - DNA, 201 bp, Bos taurus; identical to SEQ ID NO: 30584

SEQ ID NO: 70372 - DNA, 201 bp, Bos taurus; identical to SEQ ID NO: 30585

SEQ ID NO: 70373 - DNA, 201 bp, Bos taurus; identical to SEQ ID NO: 30586

SEQ ID NO: 70374 - DNA, 201 bp, Bos taurus; identical to SEQ ID NO: 30587

SEQ ID NO: 70375 - DNA, 201 bp, Bos taurus; identical to SEQ ID NO: 30588

SEQ ID NO: 70376 - DNA, 201 bp, Bos taurus; identical to SEQ ID NO: 30589

SEQ ID NO: 70377 - DNA, 201 bp, Bos taurus; identical to SEQ ID NO: 30590

SEQ ID NO: 70378 - DNA, 201 bp, Bos taurus; identical to SEQ ID NO: 30591

SEQ ID NO: 70379 - DNA, 201 bp, Bos taurus; identical to SEQ ID NO: 30592

SEQ ID NO: 70380 - DNA, 201 bp, Bos taurus; identical to SEQ ID NO: 30593

SEQ ID NO: 70381 - DNA, 201 bp, Bos taurus; identical to SEQ ID NO: 30594

SEQ ID NO: 70382 - DNA, 201 bp, Bos taurus; identical to SEQ ID NO: 30595

SEQ ID NO: 70383 - DNA, 201 bp, Bos taurus; identical to SEQ ID NO: 30596

SEQ ID NO: 70384 - DNA, 201 bp, Bos taurus; identical to SEQ ID NO: 30597

SEQ ID NO: 70385 - DNA, 201 bp, Bos taurus; identical to SEQ ID NO: 30598

SEQ ID NO: 70386 - DNA, 201 bp, Bos taurus; identical to SEQ ID NO: 30599

SEQ ID NO: 70387 - DNA, 201 bp, Bos taurus; identical to SEQ ID NO: 30600

SEQ ID NO: 70388 - DNA, 201 bp, Bos taurus; identical to SEQ ID NO: 30601

SEQ ID NO: 70389 - DNA, 201 bp, Bos taurus; identical to SEQ ID NO: 30602

SEQ ID NO: 70390 - DNA, 201 bp, Bos taurus; identical to SEQ ID NO: 30603

SEQ ID NO: 70391 - DNA, 201 bp, Bos taurus; identical to SEQ ID NO: 30604

SEQ ID NO: 70392 - DNA, 201 bp, Bos taurus; identical to SEQ ID NO: 30605

SEQ ID NO: 70393 - DNA, 201 bp, Bos taurus; identical to SEQ ID NO: 30606

SEQ ID NO: 70394 - DNA, 201 bp, Bos taurus; identical to SEQ ID NO: 30607

SEQ ID NO: 70395 - DNA, 201 bp, Bos taurus; identical to SEQ ID NO: 30608

SEQ ID NO: 70396 - DNA, 201 bp, Bos taurus; identical to SEQ ID NO: 30609

SEQ ID NO: 70397 - DNA, 201 bp, Bos taurus; identical to SEQ ID NO: 30610

SEQ ID NO: 70398 - DNA, 201 bp, Bos taurus; identical to SEQ ID NO: 30611

SEQ ID NO: 70399 - DNA, 201 bp, Bos taurus; identical to SEQ ID NO: 30612

SEQ ID NO: 70400 - DNA, 201 bp, Bos taurus; identical to SEQ ID NO: 30613

SEQ ID NO: 70401 - DNA, 201 bp, Bos taurus; identical to SEQ ID NO: 30614

SEQ ID NO: 70402 - DNA, 201 bp, Bos taurus; identical to SEQ ID NO: 30615

SEQ ID NO: 70403 - DNA, 201 bp, Bos taurus; identical to SEQ ID NO: 30616

SEQ ID NO: 70404 - DNA, 201 bp, Bos taurus; identical to SEQ ID NO: 30618

SEQ ID NO: 70405 - DNA, 201 bp, Bos taurus; identical to SEQ ID NO: 30619

SEQ ID NO: 70406 - DNA, 201 bp, Bos taurus; identical to SEQ ID NO: 30620

SEQ ID NO: 70407 - DNA, 201 bp, Bos taurus; identical to SEQ ID NO: 30621

SEQ ID NO: 70408 - DNA, 201 bp, Bos taurus; identical to SEQ ID NO: 30622

SEQ ID NO: 70409 - DNA, 201 bp, Bos taurus; identical to SEQ ID NO: 30623

SEQ ID NO: 70410 - DNA, 201 bp, Bos taurus; identical to SEQ ID NO: 30624

SEQ ID NO: 70411 - DNA, 201 bp, Bos taurus; identical to SEQ ID NO: 30625

SEQ ID NO: 70412 - DNA, 201 bp, Bos taurus; identical to SEQ ID NO: 30626

SEQ ID NO: 70413 - DNA, 201 bp, Bos taurus; identical to SEQ ID NO: 30627

SEQ ID NO: 70414 - DNA, 201 bp, Bos taurus; identical to SEQ ID NO: 30628

SEQ ID NO: 70415 - DNA, 201 bp, Bos taurus; identical to SEQ ID NO: 30629

SEQ ID NO: 70416 - DNA, 201 bp, Bos taurus; identical to SEQ ID NO: 30630

SEQ ID NO: 70417 - DNA, 201 bp, Bos taurus; identical to SEQ ID NO: 30631

SEQ ID NO: 70418 - DNA, 201 bp, Bos taurus
attcaccatacggccaagaaagtccttatgtatttcttaattgaccatttcttcctctttactcaggcaaaagctagtcatttaatgtctcttagtgagayagaggcctgatacagtgactggcacatagtgaaaccagatataaatgaataagtgaatgactgaataaattaatgactgaataaatgaatggatgaagat

SEQ ID NO: 70419 - DNA, 201 bp, Bos taurus
aaatgcctttccccaaggtgctccgtccaaatgggaggtcttactatggctgagggttaggataccttgtaatatatgaggacagggaaaggaaaaccccrgagggcccacatgatgactgagtgaggaaatctttacgctggtggtggaaaattataatctagtctactcctgggtttggctggatgtcctgtttaaaaa

SEQ ID NO: 70420 - DNA, 201 bp, Bos taurus; identical to SEQ ID NO: 30634

SEQ ID NO: 70421 - DNA, 201 bp, Bos taurus
gaacacagtaaacttcaccctactgactttgtgacttgctccaactgatgccacgtgggcagaagtgacagcacactggcctggagcagtggctttacaargcatctcatcctttgtctctttagcactcagaacatccaagaagagaagagcaggcccccaggagctgttgcttctttttcagactcctggtttgagaga

SEQ ID NO: 70422 - DNA, 201 bp, Bos taurus
catctcccaccttactgtatttctgctcttctttggcagtgtggctctcatgtacctacgcttctctgccacctactccttattctgggatacagccattrctctggcctttgcagttgtgtccccatttttcaaccccattatctatagcttgaggaataaagagataaaggaagccataaaaaagcacatgagtcaagc

SEQ ID NO: 70423 - DNA, 201 bp, Bos taurus
tacagatgaagaaaccaggatctgaattgtgtagtgagttgcccaaggttaaccgattatttagatctgtttaacatagagttagacacatgaattctctygggggaaagtaaacactgggcttgaattcattccctgtcctgttttagtttgtgtgactctgaaaaattcctgaattatctttgagtcacacataagttt

SEQ ID NO: 70424 - DNA, 201 bp, Bos taurus
caaagacaggaaacccagaatttaggggaaaagcaagatacctcagcaaacatttggcagccccacagacccatacatagtagacaaccttcaaaagagcygtggacctggagtcagtgatactggaatgaaactaggctgatattctcgatctctaggttggggaaaccactctatacacacatgcataccacacattca

SEQ ID NO: 70425 - DNA, 201 bp, Bos taurus
aagacttaatggcacctgcagtcaggtaatggtcaggtatggtgtagcacagatgagaggagctgaagaagaggactaagagaggactttgacctttcctrtgtgaggtctgttagatgtaggaagaaagctcttgggacattaggatagatctcctttctccatcctcatccttaaaatatttttcagtaactttagaag

SEQ ID NO: 70426 - DNA, 201 bp, Bos taurus
cattacttgtaatggctaagaaaaggaaatggtctatcaatttataaataaatttatggataaacaaaatcaggtagggccataaaagtgtgtcagatcaratcagatcagtcgctcagtcgtgtctgactctttgcgaccccatgaattgcagcacgccaggcctccctgtccatcaccagttcacccagactcacgtcc

SEQ ID NO: 70427 - DNA, 201 bp, Bos taurus
cccatctctgggcctcagtttccttcacctgtaaaaggagaggaccaagctagatagacagtgctccagcttccctccagctctgatagtctgaggctctyaactaaacataactttggccttgcctttaaccaccccacagccagccccacaggaacccacccaccggctctggagacccatccacagacccttataaat

SEQ ID NO: 70428 - DNA, 201 bp, Bos taurus; identical to SEQ ID NO: 30637

SEQ ID NO: 70429 - DNA, 201 bp, Bos taurus; identical to SEQ ID NO: 30638

SEQ ID NO: 70430 - DNA, 201 bp, Bos taurus
ggagtataattcaaaaacttcttggcaaaactgcagcctcacccagttttgctcagtgttgcattttatgcgctgggactttatttgccaaaaactttgtrgaaaatttgagattcacatcacgtctctctcctcctggccaatcactttggggcctagtctttttccttttctttaagaatttgattcattgccttcact

SEQ ID NO: 70431 - DNA, 201 bp, Bos taurus
ttagaagagggccagccttttttgttctttccagctttcaattgattgatgaggtccacccatattaagaaggacagtctgctttactcagttggccaatkcaaatgctaatctcattcaaaaacaccttcacagacatacctagaacagtatttgtacaactgtctaggcaccacatggcccaatcaagttgtatgtaaa

SEQ ID NO: 70432 - DNA, 201 bp, Bos taurus; identical to SEQ ID NO: 30640

SEQ ID NO: 70433 - DNA, 201 bp, Bos taurus; identical to SEQ ID NO: 30641

SEQ ID NO: 70434 - DNA, 201 bp, Bos taurus
agagaaaacagagggccacgctgggttcccaagaggggcttgaagaggagcaccccctcactccttgaaaggctgagaagtgaccacagggccgctggggrtcttctctttgaaggtgccctaaacaggctcacctgttcacagtccctgtcaggacgcaggaataggacaggacaggatgaagagccagagcagaggcct

SEQ ID NO: 70435 - DNA, 201 bp, Bos taurus
cactccctcttttacctcctccccacctgggtggcccacttgccccatcctgcctcagccctctcctgcctgatgagcttgcacatcccaattgccaccayggcacccgcactcctgggtggccagctcaccctgagcactgcacccccctcccacctggatggacttgtgtgttccagcagcctccagagcagaaagctg

SEQ ID NO: 70436 - DNA, 201 bp, Bos taurus
tacccacagctgaatgtgatgtggtttccggctgtcagggtcacaccaaggccattcaagcatcctctttctgcaccctctccactctcaagctccatcgytgatgctaagggcacatttgcaaggccacagcccaaggctaacctgaagatccaggacaactctggcccttccagagaaaggccccaggacagatcttat

SEQ ID NO: 70437 - DNA, 201 bp, Bos taurus
tgcactgggaggctccccttctgtttggggcttgatgacttttgttgtagttggagctttggtgttcctgctgatgtcatttccatccacatacccccgayctgatccactcagtgttgtcaccagatccgatttgtaacccactgagaggccagagggaaataatcgccctctcccaacctctttctagtggtctatttg

SEQ ID NO: 70438 - DNA, 201 bp, Bos taurus
cgccctgccgccggctgctgccagagtcccagaggaaatcaaaggcctgggctttgggctctggccaagggagctcagagtgcggcctcttaaagagcccyttcagcctcatgtctatgcaggaacccagtctagggtgggacaggggggtctgtccagggtcctctcagaaagtgatgccggaggcctcggttttcccat

SEQ ID NO: 70439 - DNA, 201 bp, Bos taurus
accactgttttaaatgaaatccactatttttaaatagcagagcactctacacaagaaattgtattatttttattgttataaattccaaatggttaatggartaggaaaattagaaactgcctaggcctgaagattaggaaatactatcagcctaaagaaaaactctaagagacagacagaaaaataatattatgttaggga

SEQ ID NO: 70440 - DNA, 201 bp, Bos taurus
agctctttgtggctgtggagatgctctcagctgtggtcctgatcaaccgggctctggaagccaaggatgctagtggcttctggagcagtctggtgaacccygccacgggcctggccgaggtggacagggagaacgctcagcggtaagaaaggtgtagcagcatgctgagggaggggatgggtgatggagagagtgtagcca

SEQ ID NO: 70441 - DNA, 201 bp, Bos taurus
ccgagcctggggagaccagagggccgggagagaagtaagggcagatggggagtgagaggtgctttgagcaggggcagcctggcaccgccgctggatctagrctgactggggattgagggccatttctgtcacctcccagtctgaattgagcaagtcacttaaccttgctaaacctgtttcctcatcagttacgtaggaata

SEQ ID NO: 70442 - DNA, 201 bp, Bos taurus
ctggaggaaagtgtccaccatggtgtcgaaaagcttcaccctcgaaatgttagtgccggggcgcgcaggttcctgagacaattcctcgggccctttttctkcacagccgctgcctacgttgacgctgctcgcttcagccatgttgaaatagaaccgccaaaaccgactgacccggccgccccgcccaccgaagcctccgat

SEQ ID NO: 70443 - DNA, 201 bp, Bos taurus; identical to SEQ ID NO: 30642

SEQ ID NO: 70444 - DNA, 201 bp, Bos taurus; identical to SEQ ID NO: 30643

SEQ ID NO: 70445 - DNA, 201 bp, Bos taurus; identical to SEQ ID NO: 30644

SEQ ID NO: 70446 - DNA, 201 bp, Bos taurus
gcaaaaggtagacaacctaggaaggccactctttcaagaagacctggtctcttgttaaatttcttcttttatctttttgtattgctattgctcttccctcratggcctcacttttatctcaataactcctttgagcattttccttggtggttctgtataccatagatgccacacttactgctggcttttctttttacttgt

SEQ ID NO: 70447 - DNA, 201 bp, Bos taurus
ttgagttaagtttcctggagaacgctggatgatcatttggtatcagggttagagaattcacaatattaagtttgtcacaaaattaagtatttgagaaaggyctgtgatggatgtgcattcatgtgggaatagtaaatgggttttaaacagatgacattcttggtgtttttgatcagctgttctgtgttgtttctcagtttg

SEQ ID NO: 70448 - DNA, 201 bp, Bos taurus; identical to SEQ ID NO: 30646

SEQ ID NO: 70449 - DNA, 201 bp, Bos taurus; identical to SEQ ID NO: 30647

SEQ ID NO: 70450 - DNA, 201 bp, Bos taurus
aaatgctgatgaggaactaattataattccatttcaaaccatcaggccctgagatactgtctgcccccacctcagctgcgggggaaagaaaagcacaagaraccttctcccacactcaggcctagaaaaaacggaattttgaaggcacttgggtttctagagtttgagctagaagaggagggtcaagacataagcgacttg

SEQ ID NO: 70451 - DNA, 201 bp, Bos taurus; identical to SEQ ID NO: 30648

SEQ ID NO: 70452 - DNA, 201 bp, Bos taurus; identical to SEQ ID NO: 30649

SEQ ID NO: 70453 - DNA, 201 bp, Bos taurus; identical to SEQ ID NO: 30650

SEQ ID NO: 70454 - DNA, 201 bp, Bos taurus; identical to SEQ ID NO: 30651

SEQ ID NO: 70455 - DNA, 201 bp, Bos taurus
cttctccgggggatcttcccaacccaaggatcaaacctagttctcctgtattatgaaagattcttcaccatttgagccactcaagaagccccaataggccmtgtacctaaactcttttaggcagttaaagagagaggcaaaaacaaacaaactccagaaaagaagctcttcctgagtcagctaggccttgattaccttcag

SEQ ID NO: 70456 - DNA, 201 bp, Bos taurus; identical to SEQ ID NO: 30652

SEQ ID NO: 70457 - DNA, 201 bp, Bos taurus; identical to SEQ ID NO: 30653

SEQ ID NO: 70458 - DNA, 201 bp, Bos taurus
attgagcagtccattgacaacatcccagaagcctaggggaggggcttgcaaaggctgtgatgagaatgcttgggaggtacttgatacagtacttaatttgrgggctctggagtcaagtagaactgagctcaaatcctgcctgttattgtcaactttataacttattgataagaataggtaccacctattgcccaatttcta

SEQ ID NO: 70459 - DNA, 201 bp, Bos taurus; identical to SEQ ID NO: 30656

SEQ ID NO: 70460 - DNA, 201 bp, Bos taurus; identical to SEQ ID NO: 30657

SEQ ID NO: 70461 - DNA, 201 bp, Bos taurus; identical to SEQ ID NO: 30658

SEQ ID NO: 70462 - DNA, 201 bp, Bos taurus; identical to SEQ ID NO: 30659

SEQ ID NO: 70463 - DNA, 201 bp, Bos taurus; identical to SEQ ID NO: 30661

SEQ ID NO: 70464 - DNA, 201 bp, Bos taurus; identical to SEQ ID NO: 30663

SEQ ID NO: 70465 - DNA, 201 bp, Bos taurus; identical to SEQ ID NO: 30664

SEQ ID NO: 70466 - DNA, 201 bp, Bos taurus; identical to SEQ ID NO: 30665

SEQ ID NO: 70467 - DNA, 201 bp, Bos taurus; identical to SEQ ID NO: 30666

SEQ ID NO: 70468 - DNA, 201 bp, Bos taurus
gatggacactggttaagtggccaacatgttgctacagcttttgaaaagaaaggaaaatagcaatgaaatattttaggaagcataatctagcaaaggtatgytagcagatagaaggcctggaaatagacccagttatatatatgtatgtatgtatatatatataaaagttattctaagtctagatgtgaccctagtataaat

SEQ ID NO: 70469 - DNA, 201 bp, Bos taurus; identical to SEQ ID NO: 30667

SEQ ID NO: 70470 - DNA, 201 bp, Bos taurus; identical to SEQ ID NO: 30669

SEQ ID NO: 70471 - DNA, 201 bp, Bos taurus; identical to SEQ ID NO: 30670

SEQ ID NO: 70472 - DNA, 201 bp, Bos taurus; identical to SEQ ID NO: 30671

SEQ ID NO: 70473 - DNA, 201 bp, Bos taurus; identical to SEQ ID NO: 30672

SEQ ID NO: 70474 - DNA, 201 bp, Bos taurus; identical to SEQ ID NO: 30673

SEQ ID NO: 70475 - DNA, 201 bp, Bos taurus; identical to SEQ ID NO: 30674

SEQ ID NO: 70476 - DNA, 201 bp, Bos taurus; identical to SEQ ID NO: 30675

SEQ ID NO: 70477 - DNA, 201 bp, Bos taurus
gactgtccacagggctggtaatagaccaaactccctatgtgaccttgagcaagtcacaacacctccctgcgcctcactgtccttatcttaacatgagagcrttggattaaatcaggtctgaggccccctccagttctaaaattatattatctctctaatactgttagactggctgccttccaaagtgtcactgcttatcat

SEQ ID NO: 70478 - DNA, 201 bp, Bos taurus; identical to SEQ ID NO: 30679

SEQ ID NO: 70479 - DNA, 201 bp, Bos taurus; identical to SEQ ID NO: 30680

SEQ ID NO: 70480 - DNA, 201 bp, Bos taurus
gcctccaaaccctccagaacacaaacttgaaacccacacccttggggcgccaggacagtctccgcctcttgagagagaggaacgtcttacctcagcgacakgggcctcaacaagttccccctccccagggccggcgcgccgggtagctggagcagcgggcttcccctctgggaatcccatttctcccgcgtccgccggccg

SEQ ID NO: 70481 - DNA, 201 bp, Bos taurus
ccactgtcctctatctaatgccagttccagtgagttcctggaagccccctgcacattagcaaagttctgcccaccaaggcctgaggggaaacaagactcargtcagtccagcacttctacctatgacccaggttcttatttagtttttgtaatcaggcctctttttcctcagtttcagcacttcttattcaggtggagaag

SEQ ID NO: 70482 - DNA, 201 bp, Bos taurus; identical to SEQ ID NO: 30683

SEQ ID NO: 70483 - DNA, 201 bp, Bos taurus
atctgaaaaggaaaattaggatgcagcttctttgggccaaattgtatagccagaacaatagctttaattcaatgtaaggtaaagtcagttctcccaagaayagatatatcttcagtctttcagtggaatccaagcttattttttccattaaggtaggaaaggaaagagtcttggccaaatctgttaacagagtgttacaag

SEQ ID NO: 70484 - DNA, 201 bp, Bos taurus; identical to SEQ ID NO: 30685

SEQ ID NO: 70485 - DNA, 201 bp, Bos taurus; identical to SEQ ID NO: 30686

SEQ ID NO: 70486 - DNA, 201 bp, Bos taurus
cgcggatgccctccggtggctcttccaggtaatgacaacacaaaactgcccagagagtagagggtaggctctttattgggaggtgattgctgtaccacagraagataggagtcagaggagacacaagcagtgtcagccccagaaatgtggatctcctctcccagggaatatgtttcttcagaaaatcccacgaggctagga

SEQ ID NO: 70487 - DNA, 201 bp, Bos taurus
gatgccgtgaagcgaatattctcgggcattcagcctacaggaatcccccacctcggcaactatctgggagccattgagagctgggtgaggttacaggacgrgcatgactccgtgctgtacagtattgttgacctgcattccatcactgtcccccaggacccaaccatcctccggcagagcatcttggacatgactgctgct

SEQ ID NO: 70488 - DNA, 201 bp, Bos taurus
tcaagaatttgggacttttgaacatgctaagcagaaacacagtgaggaatcaaaggatgaactattcatggtttggagagccagcattttaaatgttggcrtatcatgctttatgcctaggtgcagggtgataatgagatggctccttaagaagcagaaagtctttctatgtggaaagccacaaggaatgatgaacaactt

SEQ ID NO: 70489 - DNA, 201 bp, Bos taurus
cagaacagtaacagcaaagccacatcagcggtcatgcagcttagaccagtgccccttaaagagggtttttctggagggcctcagctctgccctgtatttakaatttgttctgagaggaaggtagtcatgtgttttctactgctattggcagatacctcagtggtccagtgtggtactcatttaaactatctttgtggccaa

SEQ ID NO: 70490 - DNA, 201 bp, Bos taurus; identical to SEQ ID NO: 30690

SEQ ID NO: 70491 - DNA, 201 bp, Bos taurus; identical to SEQ ID NO: 30691

SEQ ID NO: 70492 - DNA, 201 bp, Bos taurus; identical to SEQ ID NO: 30692

SEQ ID NO: 70493 - DNA, 201 bp, Bos taurus; identical to SEQ ID NO: 30693

SEQ ID NO: 70494 - DNA, 201 bp, Bos taurus; identical to SEQ ID NO: 30694

SEQ ID NO: 70495 - DNA, 201 bp, Bos taurus; identical to SEQ ID NO: 30695

SEQ ID NO: 70496 - DNA, 201 bp, Bos taurus; identical to SEQ ID NO: 30696

SEQ ID NO: 70497 - DNA, 201 bp, Bos taurus; identical to SEQ ID NO: 30697

SEQ ID NO: 70498 - DNA, 201 bp, Bos taurus; identical to SEQ ID NO: 30698

SEQ ID NO: 70499 - DNA, 201 bp, Bos taurus; identical to SEQ ID NO: 30699

SEQ ID NO: 70500 - DNA, 201 bp, Bos taurus; identical to SEQ ID NO: 30700

SEQ ID NO: 70501 - DNA, 201 bp, Bos taurus; identical to SEQ ID NO: 30701

SEQ ID NO: 70502 - DNA, 201 bp, Bos taurus; identical to SEQ ID NO: 30702

SEQ ID NO: 70503 - DNA, 201 bp, Bos taurus; identical to SEQ ID NO: 30703

SEQ ID NO: 70504 - DNA, 201 bp, Bos taurus; identical to SEQ ID NO: 30704

SEQ ID NO: 70505 - DNA, 201 bp, Bos taurus; identical to SEQ ID NO: 30705

SEQ ID NO: 70506 - DNA, 201 bp, Bos taurus; identical to SEQ ID NO: 30706

SEQ ID NO: 70507 - DNA, 201 bp, Bos taurus; identical to SEQ ID NO: 30707

SEQ ID NO: 70508 - DNA, 201 bp, Bos taurus; identical to SEQ ID NO: 30708

SEQ ID NO: 70509 - DNA, 201 bp, Bos taurus; identical to SEQ ID NO: 30709

SEQ ID NO: 70510 - DNA, 201 bp, Bos taurus; identical to SEQ ID NO: 30710

SEQ ID NO: 70511 - DNA, 201 bp, Bos taurus; identical to SEQ ID NO: 30711

SEQ ID NO: 70512 - DNA, 201 bp, Bos taurus; identical to SEQ ID NO: 30712

SEQ ID NO: 70513 - DNA, 201 bp, Bos taurus; identical to SEQ ID NO: 30713

SEQ ID NO: 70514 - DNA, 201 bp, Bos taurus; identical to SEQ ID NO: 30714

SEQ ID NO: 70515 - DNA, 201 bp, Bos taurus; identical to SEQ ID NO: 30715

SEQ ID NO: 70516 - DNA, 201 bp, Bos taurus; identical to SEQ ID NO: 30716

SEQ ID NO: 70517 - DNA, 201 bp, Bos taurus; identical to SEQ ID NO: 30717

SEQ ID NO: 70518 - DNA, 201 bp, Bos taurus; identical to SEQ ID NO: 30718

SEQ ID NO: 70519 - DNA, 201 bp, Bos taurus; identical to SEQ ID NO: 30719

SEQ ID NO: 70520 - DNA, 201 bp, Bos taurus; identical to SEQ ID NO: 30720

SEQ ID NO: 70521 - DNA, 201 bp, Bos taurus; identical to SEQ ID NO: 30721

SEQ ID NO: 70522 - DNA, 201 bp, Bos taurus; identical to SEQ ID NO: 30722

SEQ ID NO: 70523 - DNA, 201 bp, Bos taurus; identical to SEQ ID NO: 30723

SEQ ID NO: 70524 - DNA, 201 bp, Bos taurus; identical to SEQ ID NO: 30724

SEQ ID NO: 70525 - DNA, 201 bp, Bos taurus; identical to SEQ ID NO: 30725

SEQ ID NO: 70526 - DNA, 201 bp, Bos taurus; identical to SEQ ID NO: 30726

SEQ ID NO: 70527 - DNA, 201 bp, Bos taurus; identical to SEQ ID NO: 30728

SEQ ID NO: 70528 - DNA, 201 bp, Bos taurus; identical to SEQ ID NO: 30729

SEQ ID NO: 70529 - DNA, 201 bp, Bos taurus; identical to SEQ ID NO: 30730

SEQ ID NO: 70530 - DNA, 201 bp, Bos taurus; identical to SEQ ID NO: 30731

SEQ ID NO: 70531 - DNA, 201 bp, Bos taurus; identical to SEQ ID NO: 30732

SEQ ID NO: 70532 - DNA, 201 bp, Bos taurus; identical to SEQ ID NO: 30733

SEQ ID NO: 70533 - DNA, 201 bp, Bos taurus; identical to SEQ ID NO: 30734

SEQ ID NO: 70534 - DNA, 201 bp, Bos taurus; identical to SEQ ID NO: 30735

SEQ ID NO: 70535 - DNA, 201 bp, Bos taurus; identical to SEQ ID NO: 30736

SEQ ID NO: 70536 - DNA, 201 bp, Bos taurus; identical to SEQ ID NO: 30737

SEQ ID NO: 70537 - DNA, 201 bp, Bos taurus; identical to SEQ ID NO: 30738

SEQ ID NO: 70538 - DNA, 201 bp, Bos taurus; identical to SEQ ID NO: 30739

SEQ ID NO: 70539 - DNA, 201 bp, Bos taurus; identical to SEQ ID NO: 30740

SEQ ID NO: 70540 - DNA, 201 bp, Bos taurus; identical to SEQ ID NO: 30741

SEQ ID NO: 70541 - DNA, 201 bp, Bos taurus; identical to SEQ ID NO: 30742

SEQ ID NO: 70542 - DNA, 201 bp, Bos taurus; identical to SEQ ID NO: 30743

SEQ ID NO: 70543 - DNA, 201 bp, Bos taurus; identical to SEQ ID NO: 30744

SEQ ID NO: 70544 - DNA, 201 bp, Bos taurus; identical to SEQ ID NO: 30745

SEQ ID NO: 70545 - DNA, 201 bp, Bos taurus; identical to SEQ ID NO: 30746

SEQ ID NO: 70546 - DNA, 201 bp, Bos taurus; identical to SEQ ID NO: 30747

SEQ ID NO: 70547 - DNA, 201 bp, Bos taurus; identical to SEQ ID NO: 30748

SEQ ID NO: 70548 - DNA, 201 bp, Bos taurus; identical to SEQ ID NO: 30749

SEQ ID NO: 70549 - DNA, 201 bp, Bos taurus; identical to SEQ ID NO: 30750

SEQ ID NO: 70550 - DNA, 201 bp, Bos taurus; identical to SEQ ID NO: 30751

SEQ ID NO: 70551 - DNA, 201 bp, Bos taurus; identical to SEQ ID NO: 30752

SEQ ID NO: 70552 - DNA, 201 bp, Bos taurus; identical to SEQ ID NO: 30753

SEQ ID NO: 70553 - DNA, 201 bp, Bos taurus; identical to SEQ ID NO: 30754

SEQ ID NO: 70554 - DNA, 201 bp, Bos taurus; identical to SEQ ID NO: 30755

SEQ ID NO: 70555 - DNA, 201 bp, Bos taurus
ttttagttgggtatttaatttgtaatacaaactatcactctgctgaatgccatttttcagtttgtccctgacttacaaagatgtttatttcttgtttcctytcttgttttccagtttgaacaaattctgcatccagaatgaaatcaggcatttttccatgatcatacttatcattttttaccacatttttcattattattt

SEQ ID NO: 70556 - DNA, 201 bp, Bos taurus
agttgcaagcagaagggctgaaactctcagggccactaatattctctaaggcattaatatgcaaattaggaaattaatatgcaaaccaggagagctccccrctcctacccggccaggtcagtgcacagcttgggaaggtggactgcacttttgtgcagagagaaacttcgtccagacagaagcagccctatgctagggtgc

SEQ ID NO: 70557 - DNA, 201 bp, Bos taurus
cttaaatgacctccacaagttttagaagatacaggggttatttgaattattatgattcatgaacaattagatcacatttataatcagcaatgcaaaatatmttttagtgtatagtcctattttaatgatgcttcatcaagttgaaaataattagtgttaaatagttatttgttccgaatgattaaagacacatcaagttaa

SEQ ID NO: 70558 - DNA, 201 bp, Bos taurus
gtaattttggacaaattctgagaccctgactttgagataggcataattataggaaaaactttcctaaaattatttgacatatttccctaggaatttaatgrtctagtaaatatttaaaaatgaccatttcctcaaagggctctaattaggcatatttatttaattggtatttcagcttcataggttatcattaatgttgtt

SEQ ID NO: 70559 - DNA, 201 bp, Bos taurus
gatcaggatttcaaaaagagccttgtcctccatctgcttatgaagggaatatggtttccagaggagaatgaagggctgggaatcatcatttatatctagayacataatgagatttttcatgtaataatcctaacaaattttgcaggacaaatgggttctgataaagatctacaacaaaattttttagatttaagatacttt

SEQ ID NO: 70560 - DNA, 201 bp, Bos taurus
ggtattacttttgatgaatgagtcaaagcagacaattatgaaaataataaaagtagcataagcatgcatcagactttttgttttaactgaaaacatactgrgatacattcattattggagaaaggcttcttttttgagcatgagtttacttatttcaatttccccaagttctgtcttacaaagacaactaaaatgcaatgt

SEQ ID NO: 70561 - DNA, 201 bp, Bos taurus
taaactcccggagttagtgatggacagggaagcctggcatgctacagtccatgaggccacaaagacttgtcagacacaactgagtgactgaactgaactgmactgatacagtttagtaatattactatcaaaatcacttaattctctttcaatacttaagtcattaaacctgagaagaatgggaaacaatatcatgaatta

SEQ ID NO: 70562 - DNA, 201 bp, Bos taurus; identical to SEQ ID NO: 30811

SEQ ID NO: 70563 - DNA, 201 bp, Bos taurus; identical to SEQ ID NO: 30929

SEQ ID NO: 70564 - DNA, 201 bp, Bos taurus; identical to SEQ ID NO: 30930

SEQ ID NO: 70565 - DNA, 201 bp, Bos taurus; identical to SEQ ID NO: 30931

SEQ ID NO: 70566 - DNA, 201 bp, Bos taurus; identical to SEQ ID NO: 30932

SEQ ID NO: 70567 - DNA, 201 bp, Bos taurus
ccctaataattttatggtttgcaagtgggaaaaaaacaaatatttgaagagagtattctttcctaccaagttatagagctatgtttttcctttggtaaatmtataagtagcagctttgctttagctggaaatttcattatgatttagttacatgacacaaaagaattagcaaaatgaataaaatattcaagattgagagag

SEQ ID NO: 70568 - DNA, 201 bp, Bos taurus; identical to SEQ ID NO: 30936

SEQ ID NO: 70569 - DNA, 201 bp, Bos taurus
atctcgaccccactttgaagaggcagcgaactcaaaatgatgaagtgacttggctgagctctagaactagtgcagagcgaagtctgggacccagatcttcracgccaaagcttctgtgtttatgacagttcagtgccaccttcagataaagtatgacacaactaaagcatttcaaataatagttacaatcataacatcttt

SEQ ID NO: 70570 - DNA, 201 bp, Bos taurus
gtttgttccagacagcgacggtgggcccatctgacagacttcccaacgctgtccagcgctgacctttcaagcccttcaagcaagcagcttgagagcaaaayatgctgctggccactgccaagcccctgccaaggcatggcatcaggctggctccgctagacagtggaaccgaattttagcccctgggctgagcaggcactt

SEQ ID NO: 70571 - DNA, 201 bp, Bos taurus; identical to SEQ ID NO: 30938

SEQ ID NO: 70572 - DNA, 201 bp, Bos taurus; identical to SEQ ID NO: 30940

SEQ ID NO: 70573 - DNA, 201 bp, Bos taurus; identical to SEQ ID NO: 30941

SEQ ID NO: 70574 - DNA, 201 bp, Bos taurus; identical to SEQ ID NO: 30943

SEQ ID NO: 70575 - DNA, 201 bp, Bos taurus
gaaccgtttaacttgttttatataaaaaaaataatccaatatttaaagggcaagaacatatgctttttaagttgacagacttcttgaaataaccttcaatrgacaaatacagaaaaataaaataaattttgcaatcttaaagatctgtttttagagagtcttaaggcttttccttttgaccagttgatttctggttatgtt

SEQ ID NO: 70576 - DNA, 201 bp, Bos taurus
tttgtggaagtgaggtgtgtgtttgtgtgtaagaaagaaaagtggtaaagaggatgaattttacactctgattgtcatggactagatagaggcagcaagtrctgacatagcccctgaaatgagaggccaccttgaagatccaggccactgagaattcagagaggcatatggacttacactgtctgagactggggtcaggat

SEQ ID NO: 70577 - DNA, 201 bp, Bos taurus
tttagctgtttgagaaggaatttgacaagtctcaaaacggccctttcctgacataaagaacaaaacagggaaagaggatggcacccctagaaaaagtaagragtaattcgtgaggcaatggggcccattggttaagaacacaaactctggatcaagctacaagcgttcgatatcagtttagacccagagggatggtatggg

SEQ ID NO: 70578 - DNA, 201 bp, Bos taurus
ggataaactctactgatatgtcattgataccaagttctgaaggtcataataaggtattttgtccttcataaagttttctgttgaagcctcgtcttttatcyaaaaggaaatagcatcatttattcattcagaaattacttgttaaacacccaaagtatgttttacacatggcaaaatactttaagagattagacaatcagg

SEQ ID NO: 70579 - DNA, 201 bp, Bos taurus
aggtcatggtccctgtttggtggttggctgcccatctgatccactacagcttcctgattcccagccaaacctttacatctgagaagtatgctagcacatcratgagatgtgctgaaaactgcaattcctgcagccagtgttagtcaacagaaggggcccaattcttctccataacaacaaaagttgaacaaattgggctac

SEQ ID NO: 70580 - DNA, 201 bp, Bos taurus
ctcatggaagcaattttaagcccattaaatattgtagattcagtgatttgtgaaacttctgaaactttgggcttgctgaaacaatctcagtaagaaccctrggaaaaggcaagtgaaaaaaggttaaaattgaggaatgagttctaaaataaatctgaagattatatggatatgcaaattgttaaaagggcattgcctgaa

SEQ ID NO: 70581 - DNA, 201 bp, Bos taurus
tcaaagaatgcatagtctgagagctataacctagatgtcaagtctttaagtaagtaagataagctgtgtgaagtgtctatcacatggcctagtgcacagtrcttacatagaattagttctcctttgaagtttcccagcctcctacctactcctacctactttggccttttgtatcacttaccctttccagaatacatcctg

SEQ ID NO: 70582 - DNA, 201 bp, Bos taurus
atatggtgcatcctaccaataggagctatccaacaatggagggctgtcagcatatgaagagtgctggagctgcttcagttaaaggagaatggccccctgtyagggagacatggagaaggagggtagaccctatcagtatgtgttcccaattaaattatagggaatgatggccaggtgttatagttactggtattgttttaa

SEQ ID NO: 70583 - DNA, 201 bp, Bos taurus
tttgcagcagtacaagaacttctttggtattattgttctacagtttgtgggttgcctactcttcaggtattggattttattttaatgtgattttgcccctyctgccatctcgttgtggccttgaatgtgggatatctttttttagtagcttccaacgtcctcctgttgatggttgttcaacagcaagtttccattttggtg

SEQ ID NO: 70584 - DNA, 201 bp, Bos taurus
tggtgagagagttgctgctgagaaaatgacatgttcatgattgtgtcccaaagagcagtaattccagtaattgctgacttctacatttttatttttgtttytccacttcactccccatgtgttaatgtatgtagatggttaggactgactccttcctgagaagatctttgagttactgtttttctttcaaatgtaaggctt

SEQ ID NO: 70585 - DNA, 201 bp, Bos taurus
tttctactttcatttcctagtggctaatgatggtgagcatttttcatgagtttattgtgcatttgtttatgttctttggttaaaaatctatccagatcttktgggcattttctgatttttttttgtttattaattgtctgagctacttacattttctgaatacaggttgtcatattcatggtttataggtaatttctcttt

SEQ ID NO: 70586 - DNA, 201 bp, Bos taurus
tatatatatattttacaaaatatgtgctaggttttttgtttgactctgaagaagcaacattcagtcaatagatatttactgattacgtatatactatgagrttctgttctaagtcctggggatacaacttgaagtctttttactcatgaaaatggcattctagtgggtgagacacacagcaaaacaacatatactatgata

SEQ ID NO: 70587 - DNA, 201 bp, Bos taurus
tgctggcctgtggaccaggttcaaggcatttattgccatcggggattacaacggacatgtcgatctgggtaacgagtgttctaaagaagtacccactgccrtctgtggagccatcatcctggccaagctgtccatcgtccctgtgtgaagaggctactggaggagcaagatcggcaagccccacgcagttctttgcaaggt

SEQ ID NO: 70588 - DNA, 201 bp, Bos taurus
ctccttccaggcaagggctggcccctgtgaacacctgctgtgggcctgatactagctgcttttcgtagagaaaaccacctcaggagtagacaggatcatcrgatgaggacgcgggcccagagaggaaatgaatgtctcagacaacaggagagactgataaagatttggagttaggagagatgctggcttattcgggaacca

SEQ ID NO: 70589 - DNA, 201 bp, Bos taurus
ttctgtgccctggacccactctgtgcaggccctggtgaggactcagctcatggagaggtggcagacctccctccaggagacgggggagatgagatgtgtcyggggacagggtgcagattgcaggcctgtacttgtctcgtgtcaggtcatccctaaacacctccttggtgccaaggaaacggtgtgggtttgaaatgaggc

SEQ ID NO: 70590 - DNA, 201 bp, Bos taurus
tggggctaatctaccaatgggcatttattgggcatctgctgtgtgcctggctctgtacagcaggagaaatagcaatattgaacctttagttgtggtttgtytgatgcaggtcatcatggccacgtgaggtcggcacagggcagtgaggtcggccacccagcttccatttccaaactctgccacttttccttctcttcctcc

SEQ ID NO: 70591 - DNA, 201 bp, Bos taurus
atgtctgtggagactgctccccatctctgtcccttcaagtagcctttcaaagttagagttgatagtgagttgattttaataattgattctacagtgaagayaggcctctgtgggacagttacccagaattaggggctggggagtccggaggagcaaaacattgtgatggaatcaagaacttcatggctcccagtcttagtt

SEQ ID NO: 70592 - DNA, 201 bp, Bos taurus
tttatttaccatgtgtgctaattccaacaaaagcccaggccatgctaaagccacatggagcatttcccagcactgaactctacaggaaagctctcactccragacccacgttgggagaactggcctgtgacctcttaagccttccttcggcagatgccagcaccggtgtcaggaggttgctgctcacggcatcccctgggg

SEQ ID NO: 70593 - DNA, 201 bp, Bos taurus
gttcacctagaaacttcctccaccctctgagtcatccctgtggagccctgaccccgtgtcacttgggtcttcctttgcctcaaaaatcatgaatgccctcycactccagccacacagagttctgatccccacccctcagctcccctaacttcctctcagcttccagttagagtttcttcacatcctttctaaaccactttt

SEQ ID NO: 70594 - DNA, 201 bp, Bos taurus
gctgtccctattgttttctcttgcctatagggaaaaatagcagtttcattatagcccctgctttatcgcttctgagatttgctgcttgttttgtgtctgcmgtatttaaaatgctttcacgtgaagatttgaagcctgagaataaatccttcagtgtctgtgagtgagagactccctgcctcagtcatcaggagagcttgt

SEQ ID NO: 70595 - DNA, 201 bp, Bos taurus
gagacatttcaagccagaatcacctagttcagcctctttcagattgctgacccttagaaactatgtgacataataaacgtgtaatgatgttttaaactgcyaagtaacatgctttgcaacaatagataactaataaataagcatagtggatatcatcaataaaagtatgtttgctgaaaaagtcatccacttaattcatag

SEQ ID NO: 70596 - DNA, 201 bp, Bos taurus
ggtgttaaaaactgaatgtgtaaattttgagtttatataactaaaatttctctgagtctgtatgactgattgatgctataccactgattactatgtcttcygccttcctgagttttctgaacaagtgtaaggaaaaaagttccagataatggaatatgttttattgctaaccagggatatggactgaaatctctgatcttt

SEQ ID NO: 70597 - DNA, 201 bp, Bos taurus
gtaggcatgcaggctgcctctgggacccggcgctgagcgtggaactgtcgcagtgctgaccccacttcccgaagcgccaggccccattgctgccagctccrtgctcatctgctagtcagtcacaaccagactggactttgaggtgctcctggcttcattcctttcctgtaatgattaaacaggcccgagcgccattggccg

SEQ ID NO: 70598 - DNA, 201 bp, Bos taurus
tgtgtttctgtcattttttcaccatatatcaggtaatctcccaaagtctcctgatccatctcttcctcctttcagaaaagtctagaatgtatgatggcctytttctctcagaaagtctaaagtatttgatgtcataagcagtcacttctgttactcatcttgcatggtctgaagttcctaaggccaaagtcattctccaac

SEQ ID NO: 70599 - DNA, 201 bp, Bos taurus
cagggcaagaggggagccaacagacatcaataagctcagagggagaggtttttgaatctttaggcagagtgttcattcatttgggggaagttatgtattaytagatcccaacctggtctagatcaactacaagatgcccgtgaaatgccttaagtttcctgtcccaaacctgtcgccatcctcccaccctcttgccttctg

SEQ ID NO: 70600 - DNA, 201 bp, Bos taurus
ggggattttgattggggtctgtgagtgttctggaaggaaacatgcaaatgtgcatgtgaacaagctcttcaactctcagtgctggaaagagcttagggagyattgcagccatccccgctcctgctttaccgccaaagtctggtcagagggggaacaaggtggtggctggcctgaaatgagaattcgctggaccagggctca

SEQ ID NO: 70601 - DNA, 201 bp, Bos taurus
aatttcttgtgtagttttaagaggatcagcttcaatgatggctctcaattggtcgctgtcaacttttgatggccagccactgtgctcctcatcttcaaggytctcgtctctttgtgaaacttcttgaaccaccactgtactatatgttcattatcagttcctgcgccaaatgcgttgttgatgttgtgagttgtctccact

SEQ ID NO: 70602 - DNA, 201 bp, Bos taurus
ctttttacataaattaggaaagagacaaaaagataatcattctagctcccatgatagagaccaccagaactaaggattccacataggaaggagtctgggtrcaaaacttcattgtatacttatagcaatttgtagtaacttttctttgactccctggagaatttgactacaagggctcagtacttagtgtcttgcactgtg

SEQ ID NO: 70603 - DNA, 201 bp, Bos taurus
tgcctcactccatgttaagcaagagttctacagggtatggtatcctataatattccaaatggaaactcagatacagggttatctatattcagaattccttrtaaatatctaaggtttttatatacccttatcaatttacccattccctagacagtgtaataagagactataagatgatgcagttactttctgttaatcata

SEQ ID NO: 70604 - DNA, 201 bp, Bos taurus
aaaggagttggatgaagcagaagagagagaaggggagggaataacagcggggaggaggaggggagacagcacctgctctatggggccgagaccctagcaargacagtgtgtccagcccccctgcagcttcacactctggagtcactcaagccccacaccctgcctggcgcctgaggctcccatgacagctgagtcagaaga

SEQ ID NO: 70605 - DNA, 201 bp, Bos taurus
attgttaggagacaatcacaggttgaacagatctgaggcctctctttctctgcagcacgattagagcagagtggagacaaagagaagaactagaagtagcycaagccccatgcaggctggcccagtacctctctcccctctccttcctaatctcctgcaccttgggtgtctcaaggtcctctccacctgcctgtgcattcc

SEQ ID NO: 70606 - DNA, 201 bp, Bos taurus
acctcggcccggaggtcttcatctgatagcttgatgccttcttcatcctgggtcaggaaagcacaatgggacagcccaaggcatgtgaggtaggttccaayaaggcctcacaagagtagctgtcaaatgaaggtctgggagagggagggaaattccttttcagactaggggttcggagcgtctctttgattcctatctgtt

SEQ ID NO: 70607 - DNA, 201 bp, Bos taurus
cttcaatacttcccctgcccatgtgtctgacattattggtctcctctcttttctaacacatttgctcctaacacaattttccctcctatttctcagatgarccccctaattcccacaagtgctaaatattgaaggatccacagggttcagtctttggaacttttcttctatttccactcatcccattagtcatctcatcca

SEQ ID NO: 70608 - DNA, 201 bp, Bos taurus
attagtactcattgcctataccaacctctgttcctgttaacagaatcagcacaccttgaaggagagcaatggaagcaaccagatcattccatcaccttctrctatatctgaacttgacaataaaacccacagtgagaatttgaaacaggtacttttgattctgtttaactcccttgtgaccacactataatctgaaggtga

SEQ ID NO: 70609 - DNA, 201 bp, Bos taurus
ccaagaagaactccaccacaggggtgaccaggttgtctttagatcctgcagacttcacccatgacactataggcctcatggcccaggagctggagcccccrtatgacattttcaccagagtgtacacagcctgaagaattcttaacaaatggcagccccaacctgaacttcaggcctgaagaccagccccattttgacaca

SEQ ID NO: 70610 - DNA, 201 bp, Bos taurus
gccgggccatggattgggtactgctggtggcagccaggcggctgaggaggaaaacgcgagtggacgacctgggcacgatagtgagtgtgaaagaggaaagkgagagctctgggggtaggcctgcctgcctgggcctaggaggccttgggcctgacagactgctggagcgagggggtggggccggaggcctgggctgaagtt

SEQ ID NO: 70611 - DNA, 201 bp, Bos taurus
aaggatattaaaagatatgaatgaatagccagatgaacagacacacagagggaggaagtctggaagagcggtgaacactggagcttctggcccagaggagyttcgagtgtgcctcttcctgacttcctgctcactaaccaggaagttctccaaaccctcccaaaccttttgtgtttctaaggaggcttttgacacaggtag

SEQ ID NO: 70612 - DNA, 201 bp, Bos taurus
ttgcattgtgtcaaccacaaatgtcttcagacattgtctgatagcctctagggagcagatcgccccctgttgagaaccactggtttagacagatgcatatrgtcgattcactaccacaaccatgaaaatacagaatagttgtattatcctaaaaacgtccctcatactgcacctgtgtaatcaacaccctcctccatccca

SEQ ID NO: 70613 - DNA, 201 bp, Bos taurus
tctttcccttacacaggagtgggggtggtggacaggaatgaaacaccttaagctcgtctcaatgggcttttcccactgccaagaaatggcccaaaagagamtgtagttcggtttactcatttactcatgagtaaatttttactcattttactccgtgtcctggtgtgccccagagggccagttttagctacaataattagt

SEQ ID NO: 70614 - DNA, 201 bp, Bos taurus
agtttagtcaatctcttcccttttcttttctcttctaaactagagcttcttgggccttgtgggtattgttaatgagacttttcttgacaacctaaggcctragtgtcactggctttatgtcatttatcttctgtcacttaatgattatcatcagtcataatattggtttgtgatttttgtttaaaaattatttttacctaa

SEQ ID NO: 70615 - DNA, 201 bp, Bos taurus
ggagagcaggatgggtgagcagagttcatccccacctcaccttggggacagaccttcagctgaagccacagggcccccttggtgcaaagcctagactcttyccgggggcccagagagcacacaagctaagccaagccagacttatctgtgaggcgaggcagccatgagaggccttcctagttagggccaatggctgatacg

SEQ ID NO: 70616 - DNA, 201 bp, Bos taurus
tgtattagataaagggtaggcaaactacatacagcccataggccaagttcggtctgctgggtttttgtaaatacaggtttattggaacacaatcatgcttrtttgtttgagtgttttctatggccaccctttttcagtactggcagagttaagcagttgcagcaggaatcccatggttcacaaagctacaatatttactgt

SEQ ID NO: 70617 - DNA, 201 bp, Bos taurus
ggccagggcacactctgctttattcacaaaggtctccaggtcgtagtctggctgctcagccatctcggagagctccagccagcctggcccttgctgcagcracacaagacggaccttgtcaggtcaataatgaccaaaccaatttagcaaatcattcccagggctctaccatctgcaatgcggatgcctgttcctctagcc

SEQ ID NO: 70618 - DNA, 201 bp, Bos taurus
ttccttttgtgccaaaaatcaatagagtaatcagagcaacaaggggaactgatcaagaagagtcccatggtatgagaataatgaaacctctagaactttaraggttaaaaccattaaattggagatgcttacatatgccagggtctccaacatattaccgtagacataccaccactatagaaaaagaagccgtcccttaaa

SEQ ID NO: 70619 - DNA, 201 bp, Bos taurus; identical to SEQ ID NO: 30944

SEQ ID NO: 70620 - DNA, 201 bp, Bos taurus; identical to SEQ ID NO: 30946

SEQ ID NO: 70621 - DNA, 201 bp, Bos taurus; identical to SEQ ID NO: 30948

SEQ ID NO: 70622 - DNA, 201 bp, Bos taurus
atgtggtgcctcccctgccccctccccaggccccccctccacaggctgcagtttcctggtggtccctcatcaggatgggcctcccaaggctctcactgtgrctcctcactagtgctccctgaatgggaacaagcatttgctgtgtccgggtccgggccctgttgaaacttcaagtgaaagccgaacggcccttctttattc

SEQ ID NO: 70623 - DNA, 201 bp, Bos taurus; identical to SEQ ID NO: 30950

SEQ ID NO: 70624 - DNA, 201 bp, Bos taurus
tttatcaccgctactattcaaatggtatcatttactttctctaattcaaaaagagaaggaaagcaataagaggtataaacattagaaaagaagaggcaaaytgtgattatttgcaaatgacactatcgcttacatagaaaaactcaagaaaatcaattgacaaactattagaattaataagaaaattcagcaaggtgacca

SEQ ID NO: 70625 - DNA, 201 bp, Bos taurus
aagtgcagttctcccccacatccctgttgaaccttgatcttgacctagggtttcgatcccttgtggtgacagagggaccttagcatggcccataatcttgytaatttaatttaatttttttttaacgtcaagaggtccaggtaagagtggcaatactcttcatctcccggatccacaggagcccccgcatcaggtgaccca

SEQ ID NO: 70626 - DNA, 201 bp, Bos taurus
ctctggaatcagaagccaggaaaataccccaagggcagtccttgtattccttctctggggatattgcctcaagaaccagtgagactgggcagctgccctgraggaagccagtggctaaacatggcccttcccttggcccctcccttccccacatggattctcctgttgctgttctcattcactgaaagactgattgaccta

SEQ ID NO: 70627 - DNA, 201 bp, Bos taurus
ctcttaggggaaattttgttttctatttccgtctgcttggtgaagttttttggtaggtcaactatcctgttcaaagtttgacttttgttttaaataaagcyatcttaaggggaaatcttaacagagagaactccaaaccactcaggagacaacagactgccttctttgattgatatgcagaagtttctaaaagacaatttg

SEQ ID NO: 70628 - DNA, 201 bp, Bos taurus
cacaggcctctaacgcagtgcctcacacatccaccgtctcatacgaaacacacacggcatcagacacacacaagcaacagaggccatgccaccctcatccytgctcacgcctacaaccactcatggctgtgcccacagctctccccttctcaggacaagtgacctgatggctcttgtggcgcgaggcggcctgagcctgtg

SEQ ID NO: 70629 - DNA, 201 bp, Bos taurus; identical to SEQ ID NO: 30955

SEQ ID NO: 70630 - DNA, 201 bp, Bos taurus; identical to SEQ ID NO: 30956

SEQ ID NO: 70631 - DNA, 201 bp, Bos taurus
ggcatgctgcaatccatggggtagcaaagagttggacacaactgagcaactgaactgaactgaactgaaccgcatccagtgatcacacagatgtttaatcytttcgataaccaccagggtgagctgtttccttaatgaagagacacaggtttgttacattcagcaactcatgtgaagtcactcagccaggaaaccttaaga

SEQ ID NO: 70632 - DNA, 201 bp, Bos taurus; identical to SEQ ID NO: 30957

SEQ ID NO: 70633 - DNA, 201 bp, Bos taurus; identical to SEQ ID NO: 30959

SEQ ID NO: 70634 - DNA, 201 bp, Bos taurus; identical to SEQ ID NO: 30960

SEQ ID NO: 70635 - DNA, 201 bp, Bos taurus; identical to SEQ ID NO: 30969

SEQ ID NO: 70636 - DNA, 201 bp, Bos taurus; identical to SEQ ID NO: 30971

SEQ ID NO: 70637 - DNA, 201 bp, Bos taurus; identical to SEQ ID NO: 30972

SEQ ID NO: 70638 - DNA, 201 bp, Bos taurus; identical to SEQ ID NO: 30973

SEQ ID NO: 70639 - DNA, 201 bp, Bos taurus; identical to SEQ ID NO: 30974

SEQ ID NO: 70640 - DNA, 201 bp, Bos taurus; identical to SEQ ID NO: 30975

SEQ ID NO: 70641 - DNA, 201 bp, Bos taurus; identical to SEQ ID NO: 30976

SEQ ID NO: 70642 - DNA, 201 bp, Bos taurus; identical to SEQ ID NO: 30977

SEQ ID NO: 70643 - DNA, 201 bp, Bos taurus
atggcccctttaggtggcctggccgtcccatgcccagcaccctgggatctgggttcagccccagtctgccttgcaactttgtctccactggtcctctgggkgctctacagggcctgagcacagcctacatgatgtggctgtaactgtggctgtaggcacaggccagctgactgtatccatgttctctgcacctgtctttca

SEQ ID NO: 70644 - DNA, 201 bp, Bos taurus
tgaaataattggtccctagattggcctctcatgtgaaactcttgccttgacaactgccttgcagctctgtctggtacccattatcctctggaactgatggrggcctgttggaactgagatcattgattgcctactcaacattaactcccttgttcctaacagaagtctgtgtgtgttcaaggaatcccctttcctaaatgg

SEQ ID NO: 70645 - DNA, 201 bp, Bos taurus
agggatccagcagagtgagccaggacagagaggccttggtgcagtgtggggtggagccagctcagactggctctggagcgcttgttgttcagtgatgccaygttagaagcttgaaactggccatggagggagaatatataccgcagttagcaaatgctgcaaatcagggctccacatccctgaaagcccattgtcgagcat

SEQ ID NO: 70646 - DNA, 201 bp, Bos taurus
gcatagagggtagcctcaaataccacactgaaagaaaattcagtagatttttagaatctcagagtttggaagaggccttaaaaaatctaccttggcctgcrtttcaaaattccaacactttgtatttcttgtaaaatgtcttgtcttaaactttccccaaagttgttagggacttaaaacctcctcaagcaactcactcat

SEQ ID NO: 70647 - DNA, 201 bp, Bos taurus
tatattgtcccacattgaggccctctcactgtgtctcttcaccgccactggcagcagctccccaaggtcccgtggtgactgacgctgattaatcacaggaygcccaggagccagaggaggccgtcttgggaacacctggcccagagggccaggcatccaccatgctgagaactggcacatccgcagtcttgtgtctatttt

SEQ ID NO: 70648 - DNA, 201 bp, Bos taurus; identical to SEQ ID NO: 30981

SEQ ID NO: 70649 - DNA, 201 bp, Bos taurus; identical to SEQ ID NO: 30986

SEQ ID NO: 70650 - DNA, 201 bp, Bos taurus; identical to SEQ ID NO: 30988

SEQ ID NO: 70651 - DNA, 201 bp, Bos taurus; identical to SEQ ID NO: 30989

SEQ ID NO: 70652 - DNA, 201 bp, Bos taurus; identical to SEQ ID NO: 30990

SEQ ID NO: 70653 - DNA, 201 bp, Bos taurus; identical to SEQ ID NO: 30991

SEQ ID NO: 70654 - DNA, 201 bp, Bos taurus; identical to SEQ ID NO: 30992

SEQ ID NO: 70655 - DNA, 201 bp, Bos taurus; identical to SEQ ID NO: 30993

SEQ ID NO: 70656 - DNA, 201 bp, Bos taurus; identical to SEQ ID NO: 30994

SEQ ID NO: 70657 - DNA, 201 bp, Bos taurus; identical to SEQ ID NO: 30995

SEQ ID NO: 70658 - DNA, 201 bp, Bos taurus; identical to SEQ ID NO: 30996

SEQ ID NO: 70659 - DNA, 201 bp, Bos taurus; identical to SEQ ID NO: 30997

SEQ ID NO: 70660 - DNA, 201 bp, Bos taurus; identical to SEQ ID NO: 30998

SEQ ID NO: 70661 - DNA, 201 bp, Bos taurus; identical to SEQ ID NO: 30999

SEQ ID NO: 70662 - DNA, 201 bp, Bos taurus; identical to SEQ ID NO: 31000

SEQ ID NO: 70663 - DNA, 201 bp, Bos taurus; identical to SEQ ID NO: 31001

SEQ ID NO: 70664 - DNA, 201 bp, Bos taurus; identical to SEQ ID NO: 31002

SEQ ID NO: 70665 - DNA, 201 bp, Bos taurus
gccccctcccggtaacggccggggggcggtgcacggaagacgtcattgccacattttaatcaaaggaagtcctttctggggtccagcctcgacttctcccrcgggggccgtttgcaggaagaaaggtcatagggagctcaatagtcctgttgccggctaggctggacaccaccttgaggcccaaatggaaggaaccacctg

SEQ ID NO: 70666 - DNA, 201 bp, Bos taurus; identical to SEQ ID NO: 31004

SEQ ID NO: 70667 - DNA, 201 bp, Bos taurus
ggagactgggatgagggcgaggattttaattaatgtagggaagacagagacaaacagttctgttgtggaaagaagctggtgggaccaatgatgcagcccartggagcccaaggaggcagatagccctctgcactgtaattccattttacttcccctaaggcttcagcaaaattttgttaaatgttgcaatctggtttacaa

SEQ ID NO: 70668 - DNA, 201 bp, Bos taurus
agcagaggaattcaggctctgaacatgggcagtctggctacagaagaagtgcatgactgtctcttcagtttcatggtacctatttttctttagagcagtgytttcaaagagtcatccccagacctgcagcatcagtgctaacttaggaacctgttagaaaaacacattctcagtctgcactctgacctcctgaaccagaag

SEQ ID NO: 70669 - DNA, 201 bp, Bos taurus
gacccaggatgacaaaagggtgcccatccctgaagcaaaaggcaggtcacagcatcttgagaagcactgaggcctggccctggaagttggtacaggtggaytttgccgaggggaggatgctgttaagtgagaagtggggatgcgggaggcctcccctcctcctgcctcccattcaggaaggtgacaaagatcaggcgaggg

SEQ ID NO: 70670 - DNA, 201 bp, Bos taurus
tttaatccttcactggggaataagaccctgaaggccgtgtggagggaccaaaaacaagacagacaaacagattcctttttaaggctgagtaaacgaagatygtggcatctggccctgtcacttcatgggaaatagatggggaaacagtggaaacagtgtcagactttattttggggggctccaaaatcactgcagatggtg

SEQ ID NO: 70671 - DNA, 201 bp, Bos taurus
ggcctctgcttgggcaggcagctgcacccctgagcctcagtttcctccttcacctcttggatctgttggaaggactcagggaggaagtctgtgtgaagtcyaggctacagggccaggcacagagtggtccccagataaggtttacttccttgaggctgagtaagcccatggccccatagagtcaggactgatcccaaggaa

SEQ ID NO: 70672 - DNA, 201 bp, Bos taurus
aatccagtccccagtaagctcaggtttaatacagtaagcacagtgagtgttctggagaaaacctctgcttctgtccacaagcagggccctgaacgtccctkaagattgacccctgaccgtggtcacagaggttatctctgtctagcacagggtgcatcatatatgttgacctggggtttaaatgcctttgaggcctggctc

SEQ ID NO: 70673 - DNA, 201 bp, Bos taurus
tccctttgggacaggcctagtggctttcatgcagattcagagccctcaaagattcccggtcacacaaaagcaggcgaatggcccactcttcatgcaacaarttcaatgaatatctgcaggatggacatttgccactcatcccaactctgcactctgcccccctccttccacagtaagcacggggtcccaccaggccaggca

SEQ ID NO: 70674 - DNA, 201 bp, Bos taurus
cactgaaaacttgactcaacaaatttgtcattattgtctgagcaagctatagcctttgattgaatttgtcaaacatgataattttattgagcaagccaaaktacataaggttgcatttgcactcctaaattaagagagtgactttagatatgaaaagggtgctacaaaaataagaattgcatatgtttcgaattttcccga

SEQ ID NO: 70675 - DNA, 201 bp, Bos taurus
cacctgaccttgagctggatttatcagtccccaggaggccagtcacagacaggaccggctggtgctggctttcctggacccatccagccatcagaccatgrgagccattagaaagtttcgggcctggtagtgaatgcctctggctgtcccagtgctgcagggatattagccgtatggtgggacccgggacagttgaagcac

SEQ ID NO: 70676 - DNA, 201 bp, Bos taurus
aggggccccatcctgcactctccggggagagggagagaggggatggaaatactaggtcgggggaagaagaccactgacaggcccacggagaagcccttagkataactcgtcaggaaactggagtgggattagggcaggatgcatgatcaagaaaaggtggcattagagttgatacagcaccgcacgccactaacagggcca

SEQ ID NO: 70677 - DNA, 201 bp, Bos taurus
gttgacggtgactgatagagccggcaggagagaatggccagggagatcctccagagccactcggtaagccctctcatgggagaggatcagttgcagagtcygtggctttcggtccagctttgggccaggcttctctctggttttgcctgagtcagcgcctgggaaaagggcagcttcccttcctcatcttccctcttctca

SEQ ID NO: 70678 - DNA, 201 bp, Bos taurus
caaacgagcataaaaatctcaagttacagattttacactctaggtcataatacttctaaaaattaacttttagttattaataccattcacttgtaaaaaarcacctagaaacatctgaaacctgctttactcttttaactaacgatgattttaaaatgaaatcattaaatagggaaaaaaagaaacacatagatacatact

SEQ ID NO: 70679 - DNA, 201 bp, Bos taurus
gaaagaaaagtgggcctggaggaatcaggctccctgacttcagactacactacaaagctacagtaatcagacagcatggtactgacataagacaaatacamatcaatggaacagggtagaaaggccagagataaacccccacacctatggtctaatctatgacaaaggaaacaagaatatacaacggagaaaaggcagtct

SEQ ID NO: 70680 - DNA, 201 bp, Bos taurus
aacaataaaagcaaaaataattcatactaatagctgcagaagcacaattctacagaggtatgaggagccagttccaactgtgtcccaatctacagttctayaacttccctgttattcgttctaattctaaatttctgtgataccattgttatatataaaatacaatgttttaattttcatcttctctcccttcttgccaca

SEQ ID NO: 70681 - DNA, 201 bp, Bos taurus
atagtttcaggtggacagcaaagggactcagcaaaaggcccagtttataatgtaatagctaacacacttggatgttgaaactgcttggcctttagaaacayatgggacatttcagtcttcagccagccggttgtgggtagatagaaaaccagatccaagcagcttggctaacaggaaatggaagcagcaggagaatttgag

SEQ ID NO: 70682 - DNA, 201 bp, Bos taurus
cagaatggtctcccaggtaggcctggccctggccctactcctgtctccaccaccccagctggcaccctggcagccaggcctgtctgtgcttatcagctccygtgttgactcaggatgggtacgagcctcctgtccccccttggaaaacaagaaaacatgttttgccagtggcggggtggaatggggtggcctctctggctc

SEQ ID NO: 70683 - DNA, 201 bp, Bos taurus
cccccggtgttggtggctactgcggagagaggatgatggtcatttcccacgtttagagagcactccctctcctggtttatagaaccgggtcattaactttratcctcatggccatggcagagctgggctctatcctcgtcccctttacagacgggggaaccaaggttcagaggggttatgcagggtcacagctgatcaggt

SEQ ID NO: 70684 - DNA, 201 bp, Bos taurus
ttggaaaaccaggccaaagcattcaggttaaatacagtgggcatggctaaccatgtgtggttttcaagcagaaatgtaatgcaatgatagtatgctttctrtttgtctttagatggctctgatcagacaaagcaactaatttcctgaacttccacagctaaaacatatgtacacattcacacttaccatttgtttttgaac

SEQ ID NO: 70685 - DNA, 201 bp, Bos taurus
gatgctgtgtttgcctcctcgaggccacaggagtgaagtgagccatggacatggctggattccaaataagcagaaaaggggaccttaaagcaaaggttctmtagtgtggccacttgccctgcccctcttgctatttatatcagaatgggaaaaatccttcaaatggttcaacaagaagtcaagtttttagctccaccccaa

SEQ ID NO: 70686 - DNA, 201 bp, Bos taurus; identical to SEQ ID NO: 31005

SEQ ID NO: 70687 - DNA, 201 bp, Bos taurus
ctattcccagttgacatctgagcacgtcgttgagccggtattgtggttctgtcgagcccacctttcctcttcttgtgcatttatacctcattgaaacctgrgtactccatacctgccacattttcctgattttcccaactggtaagtcttttgagacgggaatgaaggtaatgagggtactcttggagagagaataccact

SEQ ID NO: 70688 - DNA, 201 bp, Bos taurus
tggcaggttctgagccgaggatggcctgatctgatctgcaaaggagggcgagggtgtgggcagggagactggtgggagttggctgcagcgatgcaggtgayagatgaggggccctagacaattgcagtagcagtgaagggcatgacgagggggccagttccaggtagattttgcaggtggagcccgcagagttggctggtg

SEQ ID NO: 70689 - DNA, 201 bp, Bos taurus
ccctgaggccaccagctctgcctgaatcagctacttggcagcctctgatagtgaccgcatagcagtcctgaggatgtgagcttaaggtgcatgactccagscttggtaacgtcaaggccacccccacccctgctgtgtgtatacggcttggagtgctggttctgtgagaagccaggacagcacagaggagtccaaatgtga

SEQ ID NO: 70690 - DNA, 201 bp, Bos taurus; identical to SEQ ID NO: 31008

SEQ ID NO: 70691 - DNA, 201 bp, Bos taurus; identical to SEQ ID NO: 31009

SEQ ID NO: 70692 - DNA, 201 bp, Bos taurus; identical to SEQ ID NO: 31010

SEQ ID NO: 70693 - DNA, 201 bp, Bos taurus; identical to SEQ ID NO: 31011

SEQ ID NO: 70694 - DNA, 201 bp, Bos taurus
gccaagcactgggtctgggaatatgtcaaccagctcccccacattctgaaggcaacttgacttgaccctcagcctccatagactgggaggcaaccagaacyccatgttcccatccaggcaggggcccaggaaaaagaggtgctggaggaagcttagagtgccatcagggagtaggtaatctgtatagagccctatgaagaa

SEQ ID NO: 70695 - DNA, 201 bp, Bos taurus
ttccaataaccattttgccttttttcatttctttctcttaggaattatatgtaatatatacttacatgtaagtaaattaggtccttgttactatatctctrtataaattgaggccctgtggggaaagtaatattaggaagcaaagggagcctcaccacctcctggtgggacaggtggcccagtccatgcttcccaagggca

SEQ ID NO: 70696 - DNA, 201 bp, Bos taurus
tgttggtgggtccagctgaggcctgtcgggggacctgctcggcctcggagttggggttttgagagcaggagccctccagggctagcctggggtctgggccrcacaccccagcaaccatcaagcagcaggaccaggggcttccttgaggttccagggaccaaggcaggaggggggtgtccacggcctgtgagccgggcggaa

SEQ ID NO: 70697 - DNA, 201 bp, Bos taurus
ggctgctctggaaagcagacaataaaatgactgtctctcctggaaaggcattgagaggatagccaatcctatcaaagctcttccctgccccaggatcttcrtacttatcctggcttctgcctcagactctgtcccctgacgtcaccacatagccaactgcccccatgtcactcccaggtctcctcatctaaaggcatgccc

SEQ ID NO: 70698 - DNA, 201 bp, Bos taurus
tctgggcgggtgtagagaattagtacttgatcttaccgaagtggggtggaagtgagcacagggggatgagttccattttgagctggaggtgtaatatctayagccatcaggcgaggttgagcaggctcaggaaagaggcctgaagttaacgggattgattagttaacagaattctggttatgacggtattcagatcaggta

SEQ ID NO: 70699 - DNA, 201 bp, Bos taurus
gacacagggggcgcggggtggattcaggagtcgaaggagaggtttgcccacagaaggacattcggcagtcggagctgttttggcccatgacagtgaggagyggggggcggttgttgagggtgtgcccctggtgtgtccgtgggtgctcgccaacaccccgcagctctgtggggtccgtcctgtgacaaagacataccgggc

SEQ ID NO: 70700 - DNA, 201 bp, Bos taurus; identical to SEQ ID NO: 31012

SEQ ID NO: 70701 - DNA, 201 bp, Bos taurus; identical to SEQ ID NO: 31013

SEQ ID NO: 70702 - DNA, 201 bp, Bos taurus; identical to SEQ ID NO: 31014

SEQ ID NO: 70703 - DNA, 201 bp, Bos taurus
agtggggaagccttgataaatatttgtccatggacatggtcacggatgctgcagaatccagggtgtggactgctcaggatggagggctgaagctagccccyggaaccttccgagatgtcccccagtgggagtgggacagacccatttttagggatgcagagaaaaacaaaaataaatcgagaggctcaggtgaacgctggt

SEQ ID NO: 70704 - DNA, 201 bp, Bos taurus; identical to SEQ ID NO: 31015

SEQ ID NO: 70705 - DNA, 201 bp, Bos taurus; identical to SEQ ID NO: 31016

SEQ ID NO: 70706 - DNA, 201 bp, Bos taurus
ggagtttacagagggagcagcttggggagatggaagggagccagggcagggcccttgcacacctgctgacatctgggctctgtttcgtggcctctgtacayctcctataggaagcctccgtaccaggggtggggactggggaggagggcaggacagccctgctttgaagatgggtactttcggggacacgactggccgaga

SEQ ID NO: 70707 - DNA, 201 bp, Bos taurus
tcacacggagggaggcgcggccagacacaacaacactgagccttacttgcctttctgaaccccacttgccctcgattccggggttccctcccagatgtgtracgctgggaggccaagctgtggaagggcaagaggcgaattggacccaactcaagagatctggtcattgctaccttgaccttccaagcatcttcttgcctt

SEQ ID NO: 70708 - DNA, 201 bp, Bos taurus
gtgaaggggtgatgacagcttggtggccacgagcctgccacctctcacgacaacaggcagctctgcacttagtgggcaccatggggaagctttctgtgaartcctggccccatcaaagagccaaggatgaagctctgagtaaagggtcacccccagctttcaggccctgagctgactggtaatgtccaatttttcctcatc

SEQ ID NO: 70709 - DNA, 201 bp, Bos taurus
agaacacagggcagataaggagtcagcagcttgcagctctggaggttgcagcagaagattgctgccacggaggtgagcacagggatggaggtccaccccakcctatgatggtggccttcctggaagaggaggctgcgtctttaagcagagaggaaacagtgcagcctgaagctgcagcatttccttcacctgagctgcctg

SEQ ID NO: 70710 - DNA, 201 bp, Bos taurus
cattctgtggccttcgaaaggggaagcaggctccaggaaaccctgtcctggatattcccaacagagctggggcttctgtctacccgtcagaacagctcccrctcagacaaggccccccggagaagagcccagtaactcagttctggggagacaaggaggcgtcccagccctggtggcctctatctgcctgggtctttgaaa

SEQ ID NO: 70711 - DNA, 201 bp, Bos taurus
tctttcttgtcccaggagggcctctgtgtctaaaaagtcacagaaaccagcacaatattgtaaaacaattatcttccaatttaaaaaaaagaagaaaaaartaatgaagaaagctgctggaaaaaaaatcacacaagtgtaaaaggaagcactttgttttgctgtgttgtgggagccccaccaccctcaaagaagctgagt

SEQ ID NO: 70712 - DNA, 201 bp, Bos taurus; identical to SEQ ID NO: 31019

SEQ ID NO: 70713 - DNA, 201 bp, Bos taurus; identical to SEQ ID NO: 31020

SEQ ID NO: 70714 - DNA, 201 bp, Bos taurus
gggttcaaggaccaggattgcatgcgcgtgttcacgagcatttgccatgtgctgtgtggggcatggtggacccaggccaccactggccttctggagctgcygcttctggtcaggaggacacagaccgaggatgtgcagctcaataagtgctgccaggggatgtgtcagggacatgcccaggatggccagtgatcccgttga

SEQ ID NO: 70715 - DNA, 201 bp, Bos taurus; identical to SEQ ID NO: 31023

SEQ ID NO: 70716 - DNA, 201 bp, Bos taurus
cagaacaacaaaagactgtttgtcgtgctaacgggctctgcctggcctgtgacccgggagacaacgctgttttctctgcccgataaaggaagcgcctttaygtaatgactccgactctggcctctcctgagttgcatggattaggaatcaaatgctcagtgaatgatgcccctcttaatctcaaattctcaggaatttact

SEQ ID NO: 70717 - DNA, 201 bp, Bos taurus
gctattctgcatataatgattcatgtcaagctctgggccaggcctgtgagccaggcctctcaccgcagcaggtggtgaaggcaatggtagtagaaacagtyagctgctacggtctgctcgcactttccctccctgtcaccctgacccaaataaccctctggcagaagtggtttttttcgcccttgtggcttcagaaatcag

SEQ ID NO: 70718 - DNA, 201 bp, Bos taurus
tctctagctgcagcaggcggggctactctctagctgcggtgcgtggttttctcattgtggtggcttcacgggccctaggatgcgcgggcttcagtggctcyggttcccgggccccagaacacaggctgtagagttgtggcacacgggcttaattgccctgcggcatgtgcgatcttcctggatcaggggttgaacccacat

SEQ ID NO: 70719 - DNA, 201 bp, Bos taurus
ttaacgaagaatattctttctctttgtgtgagttttgatgacattaagacaagagcgtggtggaacacagaaccaggggaaggagagtgtggtgagccaakgaggtcctgagagccattggggaagggaagggtggtctgggacaggggtcagcatgccttctctgcaggaggccacagggtaagtactcgaatccttgca

SEQ ID NO: 70720 - DNA, 201 bp, Bos taurus
aaggtggcagaaccagtctaacacagcagcatgcccagaccattgcaggctttgtgcaagtgtggaatacacgccatccctgtgtgggccccagctgtagrtggctttgactgttcaccctagagcgatttccagaccacggatgttctcacttgcatagcctgaagggttcggttcgattggtttcctctgggattttga

SEQ ID NO: 70721 - DNA, 201 bp, Bos taurus; identical to SEQ ID NO: 31026

SEQ ID NO: 70722 - DNA, 201 bp, Bos taurus
ccccttcaaacctaaccaggtcctgtgactcagaaaccccagtcagggagctccaaagagactggtcactcacctttcagaggaccaataagaaaaaagcratctctgtgacgtcccatatacgtggcatctgaaaagagatggatgtgagagttggactataaagaaagctgaccaccgaagaattgatgcttttgactg

SEQ ID NO: 70723 - DNA, 201 bp, Bos taurus
ccaccccaaacctgctgaatctgaaattctggagttggagcccaagcgcactggagtttggaaaccatcactgtccatatcacattaaaatttcccaaccktttgctccaggccaacgttccttgtgagcgctagacccgcactctaaactgccctgtgagacgtctcctttcctgatgtccaccaggggcctgaactcca

SEQ ID NO: 70724 - DNA, 201 bp, Bos taurus; identical to SEQ ID NO: 31027

SEQ ID NO: 70725 - DNA, 201 bp, Bos taurus
aacatatcgatgaatgaatgagtgaatgaacaggtggatggacggacagatggatgcatgaacaaagaagcaagccacttggggcccgaaggacaaatggkgcactgcaagaaggggacaccgttaggaagagactgaacgggagctcagaatttcttcttgtagtaagaacccaaacctatgtctatactgcttgtgaag

SEQ ID NO: 70726 - DNA, 201 bp, Bos taurus
actccccatgatgtagtcatcagctgttgttaccgtgtgttttggtaagaaagcctttcatctgtttctctttgctggaggttcttggcctttgagggtcraactcattgcatcctccgtccttcccggatgggacgtttaaacattaaaaaggagggacgtgtagatggatgatgccctaagagtcacattgaacgtctg

SEQ ID NO: 70727 - DNA, 201 bp, Bos taurus; identical to SEQ ID NO: 31029

SEQ ID NO: 70728 - DNA, 201 bp, Bos taurus
aaaggctgaagcccaggaccaaacaggcagagaggacaaattatcccttcccctgccatcttgttctgttgggttggcctaaaggttcattcaggcttttycataaaatgctgcagaatacgggaaagagctttttggtcaacccaatatttgggtcctcaatggattggacgaggcccccgcacattggaaagggccact

SEQ ID NO: 70729 - DNA, 201 bp, Bos taurus
cattaatacattcatgtgcccatgaagtcctgaaaatattgagggctttaaagcattttcaagtgctaagaaaatgagagttaaaaactagataatgatckcggttttgttgtgaatgacagcctttcaaagcctccacacgaaacgagtccttggcaaggacagtggtcttggtgaaggagatgagtgataatgaaagct

SEQ ID NO: 70730 - DNA, 201 bp, Bos taurus
gggacctgcgggctaggggtgtgacctggaataatctgtggaccttagagagacagtctggccactgcacttgcagaagagcctcagggcctgtctttccrtggggcttggtgcacggacaagcctatagctgctgggtgctctccgtctgatttactgtgacgatggacagcaaaatatgcgatttcacacgggtgtgca

SEQ ID NO: 70731 - DNA, 201 bp, Bos taurus
cctggctctcctgttcatggggcctccaccctctgacctctttccctcccaaagcccccacctccaagaccatcacttggattagaagacctcaacatggrcatcttgggggccaagtcattaaatccataacaccagccaagttgggctgggggcccgccctgacccagtgtgacctcagcatagcctgatcacatctgc

SEQ ID NO: 70732 - DNA, 201 bp, Bos taurus; identical to SEQ ID NO: 31031

SEQ ID NO: 70733 - DNA, 201 bp, Bos taurus
atattgtcctatggaggctccaagggccctgggagtgtaggatgttagaagacacgatgctctgagatttcccaaagtctttgcttcccacgctctgggakaggtggtggtaggccctgggatcatgagacttgcagcccagggtgtctgacccaccaggactgtggaggacacactctggtctctgatggccccagtgtc

SEQ ID NO: 70734 - DNA, 201 bp, Bos taurus; identical to SEQ ID NO: 31035

SEQ ID NO: 70735 - DNA, 201 bp, Bos taurus; identical to SEQ ID NO: 31036

SEQ ID NO: 70736 - DNA, 201 bp, Bos taurus
tgttcatgtggttgagtcactgtattacagaaccaggagtcatctttcccacactgtgcaagaccagcatgtgtgtgggtaacacgttagtcatgactggygggccccataggcagattccacttaaactatcaaaagttatatatccttcctcttcattcttactctgatattctgtgtgagttagtatgagttgaaatc

SEQ ID NO: 70737 - DNA, 201 bp, Bos taurus; identical to SEQ ID NO: 31039

SEQ ID NO: 70738 - DNA, 201 bp, Bos taurus
aggtcacacggcgggcggcgtctacaacctgggcttcctgcagctggtttccctcatttgaaccgtcaccttcactcgcttctccccagcgagtttgcctrtttgaagctggccagtggatgcaggccgtttggactggaggatgaaatctatccagtgtggccgcggtttgggactggggtggtgtcagagcccctcctt

SEQ ID NO: 70739 - DNA, 201 bp, Bos taurus
cagttgctcacttgtgtctgacacttagtgatcccgtggatttcttcaatttccttaatcaacatttaataatttttagcatacagctcttttaccaccayggttaagtttcatcctaggttttttgttttttttttttgatgtgattttaaacaggattttttttttaaaggttattttcctgatattttcttattaaag

SEQ ID NO: 70740 - DNA, 201 bp, Bos taurus; identical to SEQ ID NO: 31046

SEQ ID NO: 70741 - DNA, 201 bp, Bos taurus
gggtcagcagttcacaggatcactgtgtgatctgtctgatttgactctagaaacaattagcattttcccccaagggcccttaaagtctaagctgacttcayatatcatccagctcagtgggcagtcatggggcatcctggggatgggggtgcagcctgggggtggcttgcacgttgtcctcagggctgggccctgactgtg

SEQ ID NO: 70742 - DNA, 201 bp, Bos taurus
gctcagcatcaccccagacggcatcagaggtgtcccagaggtggcccccgactgcaggaccctgcccccatccctgggtgcctctggtgcccgagaaagcrgaggtccctgagagctctgtggccagggtggtccctccgcctaggggtggggaccccaggtggcggtctccacaatgcggatctctgcagtgctcagctg

SEQ ID NO: 70743 - DNA, 201 bp, Bos taurus; identical to SEQ ID NO: 31050

SEQ ID NO: 70744 - DNA, 201 bp, Bos taurus; identical to SEQ ID NO: 31051

SEQ ID NO: 70745 - DNA, 201 bp, Bos taurus; identical to SEQ ID NO: 31052

SEQ ID NO: 70746 - DNA, 201 bp, Bos taurus; identical to SEQ ID NO: 31053

SEQ ID NO: 70747 - DNA, 201 bp, Bos taurus; identical to SEQ ID NO: 31054

SEQ ID NO: 70748 - DNA, 201 bp, Bos taurus; identical to SEQ ID NO: 31055

SEQ ID NO: 70749 - DNA, 201 bp, Bos taurus; identical to SEQ ID NO: 31056

SEQ ID NO: 70750 - DNA, 201 bp, Bos taurus
gaggggcctctgaagacctccagaaccgtctgcccttgtagatgcccctccctgacaggagcctggaggcttattcctgcctggcccttagcatccgaatygagggcgtccacgagtctgtgactgtctccccgactctgtgcctcacgccaacctcaggcctctcgtcacccgtcccccatcccatgacactgtccattt

SEQ ID NO: 70751 - DNA, 201 bp, Bos taurus; identical to SEQ ID NO: 31057

SEQ ID NO: 70752 - DNA, 201 bp, Bos taurus
gggcacgttatggcaaaaccataaacacagaagaaaacgcagatgatgatctcatgacctggcaaaattataggcagaaacggaacagccgggcactgggrgcaggaggagacctgctccagagggaccgggtgcatgttcggggctgacgggactattgggacccttgaccgcggtagtcatcacacagcaccatgcttg

SEQ ID NO: 70753 - DNA, 201 bp, Bos taurus; identical to SEQ ID NO: 31063

SEQ ID NO: 70754 - DNA, 201 bp, Bos taurus
ctttggtgcagacgaccctgtggatggtcgacagggcgtgggtgtctccagcagaggggcttcagcccgagaaatcgtggctcgcagagggtttcctcccrcccggaggtcagaagatgacatcgcagaaacaaaattggcagcaaagtggctgaaatgagatcttttcttagatcttggcagaggagaggctgcccttgg

SEQ ID NO: 70755 - DNA, 201 bp, Bos taurus
gagggggtcatggggttcccagtccccagccccatccggcagggccgccccgcctctggggtggacgggcacacacggatttagaagccgcgctggccctyggacgtcggctttctaacctcaggctgcccaacttggctgacttgaagctggcttcccggtgtgggaggtaggggatggggatgcggcacacagaaagga

SEQ ID NO: 70756 - DNA, 201 bp, Bos taurus
aagtttctagagatgaagaacataatatctggattaaaaagaaaacactggacggtgttcacagcaggttagacgctgcagaaggaaaggtcaacggcctygaagagagaaatgggaacgattcgacaagcagcccagagagggtgacacggagggcagcagtgagggggggcctgtgcagggacgccgcgcgcccagcag

SEQ ID NO: 70757 - DNA, 201 bp, Bos taurus
tgcatggggctcttctgcttggaatgcagaggccaaccctcgagagccctcctcgttttccagtgcctgtccccaagccctgaccaggcagcctctgtgcygcggccactgcctgcctcctgacggcatggcacggcagggcgggagctgcaagcaggccagtcagtggcgctgccagggaggggcagagctggccttgcc

SEQ ID NO: 70758 - DNA, 201 bp, Bos taurus; identical to SEQ ID NO: 31065

SEQ ID NO: 70759 - DNA, 201 bp, Bos taurus; identical to SEQ ID NO: 31066

SEQ ID NO: 70760 - DNA, 201 bp, Bos taurus; identical to SEQ ID NO: 31067

SEQ ID NO: 70761 - DNA, 201 bp, Bos taurus
ccccaatagttgggatgatcttcccactcattaacatatgaattcacccagcttgcaaaaactagccacaccacattccatggcctaagcacttgccctckgtaatggcccatatcctttagagtgtgcttctctctgaatcctaacaaatccacctcttacctatcgctgtgtctctaactgaatttttgcagtgagaca

SEQ ID NO: 70762 - DNA, 201 bp, Bos taurus
aactaaactacagtctttacaagggcctcccttccccatactggacagtaagtcattgtccaactttgaggtttcagcctaaagtgaagagttcagaaacyctttatggccttcacgtttgggcaggttctagattccagtctctttcctcctggtctatacagattgtcattctttgtatccaatctcttactcttgcag

SEQ ID NO: 70763 - DNA, 201 bp, Bos taurus
catcatcattctcctggttccaggcagtctggggtatttgtgcttgtgggaggcatctagttaacttcttccacctggtggggatctgcaaaatatcacamagacatggctcagaatattattcatagtctctgaggaagagctaaatgtccttgactttgtttaatgactaaatattattttgtcttggttgattgtttt

SEQ ID NO: 70764 - DNA, 201 bp, Bos taurus
atccactgccaacttccaataaaattctcttttctcaaattgtatagcatttcaaaaattatggaaacctatgttcttgtgtttccagaaaattagtcaaygtgtgatctttctgatccaagaatatgactttttgacgtgagtttcctttaagagctctttaagatatagaataaacttatttcaaccccagacctccca

SEQ ID NO: 70765 - DNA, 201 bp, Bos taurus
cagtataaattaaccttgtgctgaaattcatttaaatgaagtcattccctgaggtttataagtgtgtctcattaagattatttcacacaatagatggtttwaaattcaatggctttcaagaagattacaaaactaattcacttatgtgaataaattatttattcatatatggcatccctcaattagagtacacacgcactt

SEQ ID NO: 70766 - DNA, 201 bp, Bos taurus
tgtgtggcctctctaaactctggaaatccacacactccatgatctttatgccttgaacactctactgaatacacaatgcccaagttctaacctgccaattyccattcatccaccaggcctcagcttagattcttccatatgaacacagagagccttacttcactctcaaatgttaggtattttcctacatcagctacattt

SEQ ID NO: 70767 - DNA, 201 bp, Bos taurus
acccatgaaacttggccacaggtaagaacgaagtccttcaaaaactgtagaagcaaggtaaccccagatttagagggagagagctgtccatggttcagaayccatgccagaggccataaagagagccagctcagggagcgggtgaatgaggcctgaggtggcgctgcccctctcttcagcctgggcagaggagggcacaca

SEQ ID NO: 70768 - DNA, 201 bp, Bos taurus; identical to SEQ ID NO: 31070

SEQ ID NO: 70769 - DNA, 201 bp, Bos taurus
ggttagagaactggatgtggccatctgtgactcttttggtcctggtgtaactcagcccaagctgcaaacctgtgaaagagggctcttcactcaccagtaaygggtcaggtcctccctgttggccagaaaccctagatggaaaattttaccaagaatatgttgagcggtggaggcaaaagtaagaagatttatactttctag

SEQ ID NO: 70770 - DNA, 201 bp, Bos taurus; identical to SEQ ID NO: 31071

SEQ ID NO: 70771 - DNA, 201 bp, Bos taurus
agtttcagaaacagaggtcagagcatgtgcgttgctagaggaaaagcatatttttatgttccctttttcaacttggcaagcagatggctggagccttagakgagtgccaggaagaaacagctggcaaatcaaaacatactgaaagtggttagaagtgcttatgagcatttggaagaaacaacatttttgaaaaaaggggaa

SEQ ID NO: 70772 - DNA, 201 bp, Bos taurus
tctttacctgtttttctataataagtggaccaaagcccctaaaactgtctcttcaattagatcatgagtccaagaggtgaacaatttaaaacattgcaaakatcatggaggcattttcctaaccaactgccctaatcctgactcctcttttcttcggggcgtctcttcctcatatgttccttcatataaaaaatgaaatat

SEQ ID NO: 70773 - DNA, 201 bp, Bos taurus
caagacctggctcccttggcactaacctggccatggcagctctgccatctgtctgtcagcagctacaacagtgtatctgcaaacacgagcaggccctagakagcagtcatggtgatgcatcttcagatgtgacctccaccaaccttttcaaatttcatatgcaattggagggccccaaattttcatgttgatggcttccag

SEQ ID NO: 70774 - DNA, 201 bp, Bos taurus
tgttcaatccagtagatattgtggagtctctactgggtgcctggcttgggatcctggtccgtagtcaggaagatacaatgtagtgatggagtgggtacttkatgaaatagggagagttcagcatagcttagatatctggtccctgcattcaaggagcttgggatagagatatcaaaatctcaataactcctattaaaaata

SEQ ID NO: 70775 - DNA, 201 bp, Bos taurus; identical to SEQ ID NO: 31072

SEQ ID NO: 70776 - DNA, 201 bp, Bos taurus; identical to SEQ ID NO: 31073

SEQ ID NO: 70777 - DNA, 201 bp, Bos taurus; identical to SEQ ID NO: 31074

SEQ ID NO: 70778 - DNA, 201 bp, Bos taurus
gctgcagaagtgaagtggtcacaggcctcgccttgccccaccccagcagccttgggagaagcaccagtcgaggacctgggttccctccctccagagcactyccaaggccagtggcttctgtcggtgtccactctctcctcctggacaaacaatgccccagggaatcaggtccacactaaggtgtcaggagcaagagtgggc

SEQ ID NO: 70779 - DNA, 201 bp, Bos taurus; identical to SEQ ID NO: 31075

SEQ ID NO: 70780 - DNA, 201 bp, Bos taurus
aggagcagccctgaggtcacaggttcagacactccactcagagactgaccagaccttccccattctcctctggtttcccagcatgaacatagtcagttttycccaggactcaactttggccaaagatagatgtatgtgacaaaaagagcctatgcctgccggggaaggcagacacagacacagacaccctagatgatggtg

SEQ ID NO: 70781 - DNA, 201 bp, Bos taurus; identical to SEQ ID NO: 31077

SEQ ID NO: 70782 - DNA, 201 bp, Bos taurus; identical to SEQ ID NO: 31079

SEQ ID NO: 70783 - DNA, 201 bp, Bos taurus
agccgaaacctgcttccagcggaggccagagacccacttgtcctgctgcccctgtcaccaagctgttacccagtccaagcctactctgctcgctgcactayaggccaattaactgagagacctgctgttgaggcaaggaatgtatctttattgggaaagctggctggccaagaagatggaagaataatgtctcagccttct

SEQ ID NO: 70784 - DNA, 201 bp, Bos taurus
ggtttcaggagctgggtgccagaaccagggacaaaggctaactacttattttttttattataccatgcctcccccactgcaggggcccagggctctggagrttaatgtgtgttgcaggctagggaaggggcatgcacattctgggtgggggtgttaggaagggtgtcagggagcagtaggccccaactgagctgggaggag

SEQ ID NO: 70785 - DNA, 201 bp, Bos taurus; identical to SEQ ID NO: 31080

SEQ ID NO: 70786 - DNA, 201 bp, Bos taurus
gaataatgtattgatccctttaaaagaagaaatactctcacaggcccccaatgtttgcttcagttcttttcattgtagaaaatgtatgcaaatagaaaacrctacaaactcttaggcctttagcttgtaagtacctatttaaaaagcacctataaatttactgataggatataaaataaactacaaatccaatggaactga

SEQ ID NO: 70787 - DNA, 201 bp, Bos taurus
aagtagaaaagagcgtaaatgctttgccaaacaaagggggccacagtagactaatgccctcaaaactgtgtccagacctggagggggcaaggaggagtttyacagtctcgattcaaagagggcctaatcagctagtggacattcttttgattggttggtggtgaggtaatcaggaatcagtatcattaaccctttggttaa

SEQ ID NO: 70788 - DNA, 201 bp, Bos taurus
gtactgtttaggggcaaagcaagatggagtcttgtaatgagataaatttccttgaaattaagggttggttgtcaccccttattcatccaatcaaccattcrtagagcctcactcaggcccacatccaggtgcaggcaagccgaacagtggttggtgtgagccttgtcctttaggaagagtcttaacaaacctctcaaaggt

SEQ ID NO: 70789 - DNA, 201 bp, Bos taurus
atttatctcttctcagccatcttatgtgttggtgagatttaaagtcagcatgcacctagttttaaaacctcattgctgtgaaaacagggtggttctatgargtgttgcctacaattttgaccatgatggtgttttctactgagtgagttgcccaacgtacaccacagaggaaggtaatcttgtccttggcattgtgaaaag

SEQ ID NO: 70790 - DNA, 201 bp, Bos taurus
gttttagcatccaaactagtcaaattggttgaaatctcttcatttcattctccaaaagaagcaaccaggcagagagtcgatgatgcatacaagcagctcaratttaatcctcagggggatctcagttattttagctgatacttcaccttctttttgcagtgcccagtaccctaattactttgctcctgagtccttttttag

SEQ ID NO: 70791 - DNA, 201 bp, Bos taurus; identical to SEQ ID NO: 31084

SEQ ID NO: 70792 - DNA, 201 bp, Bos taurus; identical to SEQ ID NO: 31086

SEQ ID NO: 70793 - DNA, 201 bp, Bos taurus
ggtgtccaagcaagcgggagacagtgaggcaggaagaggaggggtgttcagaggatgtgggggaccccaacctgccatcttcacagtgtcctccaggcccrctggcaccggggtaccatttctcacatctgagctggaccagactgaggctggaaggagaggaagatgctcttctcactagatcctggaacttatgcaaaa

SEQ ID NO: 70794 - DNA, 201 bp, Bos taurus
taataatttaaaatttgatagtagcaataaagatatctttactttccttgtgaatctgtcacagctccttgtcactctggtaagccatccaaagaggtgcytttcttaagctatttatttatttttccttattaagttattgggcctcttgcaaaatccaggtgctgttagctgtggtgaaggcatagctcctggccagta

SEQ ID NO: 70795 - DNA, 201 bp, Bos taurus; identical to SEQ ID NO: 31087

SEQ ID NO: 70796 - DNA, 201 bp, Bos taurus; identical to SEQ ID NO: 31089

SEQ ID NO: 70797 - DNA, 201 bp, Bos taurus
cgggtcgcaggtcagcctccccatgggaggccgcgctatgggaccaggtaacagaggtggtcgcagcctgtggatgcactgttcactgtcagatggccagyttcatgtcacgtgcccgtgtccctcagggagttacttttcagtggctgtccttactcttctgtcctcagccaccgggccgcgcttacccgaggatgaggt

SEQ ID NO: 70798 - DNA, 201 bp, Bos taurus
gtgtgattctatttgtggttcttcttttggttaactccaagtctttgaacaatatggctttttctctttttcatgatttattgacttgagatattatctayctgctccccatcatgaaaactgaaaaatgtatcttgcacgatccatatttctttttgtttttcactgttacaggatattattattttgctattttagaat

SEQ ID NO: 70799 - DNA, 201 bp, Bos taurus
tctaaattccatatgcatcatctgcaagcagctcactcttgagcctgaagatgtgcaagctgtcagtttcactcaccttcagggggatggactaaagcagmgttccactcaggactgagagctagcttgcagatttggggcagggaatccttgggtccgtggtacccagagtgtgacctagagggatgtgaaaagcttcta

SEQ ID NO: 70800 - DNA, 201 bp, Bos taurus
cctaatagaacagggaaaaggaggggggaccaggcgtgagtggtcagagaagatgagggaggttctctgtctgattcttctgttttctttctggtgttcarggcctaggacagagtaatatagttacatcatccccagtaattccaacatcttatcgtaatattatgttagctgtaaatcaaaatatgatttaatttataa

SEQ ID NO: 70801 - DNA, 201 bp, Bos taurus
aggggcaggaatagagacgcagatataggtaatgcacttctagataaagaaggggaaggagaggtggggacacattgagagagtagcattgacgtgtataygttatcatgtgcaaaaccgatagctagtgagaagctggtgtgtaacacggagccagcctcgtgccctgtgatgacctacaggcgtgggatggggtgggga

SEQ ID NO: 70802 - DNA, 201 bp, Bos taurus; identical to SEQ ID NO: 31090

SEQ ID NO: 70803 - DNA, 201 bp, Bos taurus; identical to SEQ ID NO: 31093

SEQ ID NO: 70804 - DNA, 201 bp, Bos taurus
tttttttttttctccattcctgccttgggagtgactgtgaagatcatttgctggaatgattggcaggttagaggattcgatcagatgagttcctcttagcrcaggtcaaaaaggctagttagcaggagctgtcgaaaaatgccagcagcattcgaaatgggaaatgtcatgacttcgaggcagggggtgccacctggaaca

SEQ ID NO: 70805 - DNA, 201 bp, Bos taurus; identical to SEQ ID NO: 31095

SEQ ID NO: 70806 - DNA, 201 bp, Bos taurus; identical to SEQ ID NO: 31096

SEQ ID NO: 70807 - DNA, 201 bp, Bos taurus
cctgcattggcaggtggattctttaccatgagtgctacctgggaagcaccatccattaaagtaacaaatgtgaaagtttctgcctactagctggccaactkgggcatggtcttgctgaggtgttttcaatccttctaattcttctgttctgcattgacggcatcagccctgatcagtggcagggctcggacagcacacagc

SEQ ID NO: 70808 - DNA, 201 bp, Bos taurus; identical to SEQ ID NO: 31098

SEQ ID NO: 70809 - DNA, 201 bp, Bos taurus; identical to SEQ ID NO: 31099

SEQ ID NO: 70810 - DNA, 201 bp, Bos taurus; identical to SEQ ID NO: 31100

SEQ ID NO: 70811 - DNA, 201 bp, Bos taurus
cattgtgggttttgcccacccacttatagtcaccaagaatctctacttgatccactaattatggtgtatgcagttgtgacgacatgtgatatgtccactakgctaaaccccactacatccttcaaagtcaggaagtcttctcttgattttcatttcctcttagcacagggctttgtttagcacatggtaaaggtttactgt

SEQ ID NO: 70812 - DNA, 201 bp, Bos taurus
cctcagctcatccacgcttgtggtttcaaataaacatgcgtgtaaaatgaccgccaagtggaaccctcctgttaggtaactgtcaccagcccctggccagrttgattcctttatacagtcaacgttaagagctggctgctgtgcttggcactgggaatacagcagtgaatgagaaaactgcgaggccctgtggaaggagca

SEQ ID NO: 70813 - DNA, 201 bp, Bos taurus
ctgtgttgtggcataaaagtgtatattacagcttaagaaggaatttcaatgatgattggtggcaaattactagcaactcccaagaaagcctcctttggccwtggttcagacttgttagaaaactagttctgatgatattatcatagctatagttaagttgagatggaaaatgtctttgaagagacttgtttgttatttcca

SEQ ID NO: 70814 - DNA, 201 bp, Bos taurus
cgatgccaggacgctcacgtaacccgtcacaaaaactcacgtgaaggagggtagatgtaacacaactgcaaattgctagactggctttcagattgtaaatmaattttgaataagattacaatgtagggtttccctcttttttctttttttctcccctctctttttgaagttcagtttacattacttcgcattcatgaaaga

SEQ ID NO: 70815 - DNA, 201 bp, Bos taurus; identical to SEQ ID NO: 31101

SEQ ID NO: 70816 - DNA, 201 bp, Bos taurus
atgacttttcaagtgcttccaagggccgctagggtgcagcactgccctttctctacgccaaagtgaagaaagccttcggaggaaactgaacagcatgaccygacacaaggccagaagtcaagaaggaaaacctaaaggcacaaaacgtatcgcgcgtcacggcttcttttctgcggacaacctagatctcaggccctggcc

SEQ ID NO: 70817 - DNA, 201 bp, Bos taurus; identical to SEQ ID NO: 31105

SEQ ID NO: 70818 - DNA, 201 bp, Bos taurus
ttttttgtacagttcttctgtgtattcttgccacctcttcttaatatcttctgcttctgttaggtccataccatttctgtcctttattgagccctctttgygagaaatgttcagtacttgttaactacaaatgtaaataaaataccagggaactctaaaatattccacttctacatcacttaccttttttcaaataccgct

SEQ ID NO: 70819 - DNA, 201 bp, Bos taurus
gtaagttgagaatgcatgacctagatgtgcatgtactgtttgcctggattcctccttacttcacccaccctgttggttcagtcctgctattgcatatgaayttcttgggccaactgtttcctcaagcagtcctgtagaaaacggaaccagttatgtctgtccacctgagggggtagactctgccagtgaattctgatgttt

SEQ ID NO: 70820 - DNA, 201 bp, Bos taurus; identical to SEQ ID NO: 31106

SEQ ID NO: 70821 - DNA, 201 bp, Bos taurus
gttcttcacacacaccatacagctggtgcatatggtgattcctttctttggatcagaaccctgactcttctgtctttcagaggtctcagctgaaatattayctctgcaggtaggcctcctctgaccaccctgttatcctttatcctattgctctcctctactgtatttattatatgcttacatattccttgcccagtagct

SEQ ID NO: 70822 - DNA, 201 bp, Bos taurus
cagacatgccatgacccctgcctcttacacttctctctctagccctcttcatgagaaatctcatttgtgatccaataatacacttcttcttttcagaaacsctcaatggccttatactgtctgctgatagaggtagaaacttctcagcttggcttcgtggttccacctgaaaccaccatgttggatattgttcccattgta

SEQ ID NO: 70823 - DNA, 201 bp, Bos taurus
atgctgttttaatggatttgtgctgtaacagcccactgtaaattcttgtgcctaatttgttctgctgcttggtgaactactttctaggccaaaagtcaagmacaaatgctaagtcaccaggtattactacattctaccgtcttaccagtggaacaagggtgagataagaaatgttctgggtaaaatggcctttgactccga

SEQ ID NO: 70824 - DNA, 201 bp, Bos taurus; identical to SEQ ID NO: 31115

SEQ ID NO: 70825 - DNA, 201 bp, Bos taurus; identical to SEQ ID NO: 31117

SEQ ID NO: 70826 - DNA, 201 bp, Bos taurus
ggcggcccttcatgaactgtagatctgaactgtcagatccaaagaaccacgtttaccctacaacactccaagaagcagtatatgaaagaataagctttackggccacaatgctatttaagtaaatgtgttacttacttggaacacaaaagcatacattcatatattacaggaagtgcttaataaaaatctcattaaataaa

SEQ ID NO: 70827 - DNA, 201 bp, Bos taurus
cccaggagggggaactagatcccacatgccacactaagagcttgcacgccacaactaataatctcataggctgcaactaagacctggcacagccaaataayattttttaaaggtcaatctagaattttgcttaaatgggaagaaaactctgatacactaccataaggatgaatcggagaatattaggctaagtgagatagc

SEQ ID NO: 70828 - DNA, 201 bp, Bos taurus
ccaaataagcccttgatgggtatttttgtttggaacataaaataagaccaaaaagaggtttcaaacaaggtggaagattgcttgtgaagtttactttcagrcttgagaggggccttctaggatgaggctaggcttctgaggactgcgctctatccagtcttccacagattaagtgtgatatggtcagtagacaagtcagtg

SEQ ID NO: 70829 - DNA, 201 bp, Bos taurus
gaaagcttcccacagtaaaatttctagatagaagttaaagtttctgtagactgagctgctcagattaaaagagtatagcaattcttttatactccttataraagaaagtacaaacacatggtgaaactatttttcttgccatgtcagcattcctttgagaggaaagaaagaaaatgttttgttgggagttcttcagtttag

SEQ ID NO: 70830 - DNA, 201 bp, Bos taurus
ccgtactgtcctgctatgaaaagtgtggaccgtggaccagcagcatcaactgtcagattattagaaattcggaatctcaggcccaatcccagacccacagyatctgaattttagcaaaactcccaggtgatgtacattcacattaaagtagatcactgaaagagctgactgtcctccgaatatattctagtcatagacggg

SEQ ID NO: 70831 - DNA, 201 bp, Bos taurus; identical to SEQ ID NO: 31120

SEQ ID NO: 70832 - DNA, 201 bp, Bos taurus
gaaggcctcctactgtcgggggagtgtgtaatttccttggttctgtctcgtcgcaacagaaatatgaagtgatggatggaccagcgttacagccctgggaygggccggagtttcagctccgtgttacagctcagttttatttagaaagtaaaggaaaatacatcctcaaggtgtgagggaatgccgacccaaaagatgtga

SEQ ID NO: 70833 - DNA, 201 bp, Bos taurus
agaaagatgatgaagccactgcctttgtccagaagaggtcgtaggaaagaattcaaagtgtatacctagacgaatctcaaaagaataagaattcactaggyggggaggagggaaagacatgttaaactcagcagaatatgttagaaaagaaatgaaaatgtgtgaaagagctcttgccaacacccaaatggggagactgga

SEQ ID NO: 70834 - DNA, 201 bp, Bos taurus
ctcctgttttaagtctcccactgtctgactgcaagattttatttattaatatattaaaaaaaaatttggccttgcagccaagatgtaggctattagtttcscaaccagagattgaacccacaccctcagcagtggaagtgtggagtcgtaaccactggacatcagagaattttcatctaagattttaaattaccccatgga

SEQ ID NO: 70835 - DNA, 201 bp, Bos taurus
tcacctccccagcctcatcccaagctcctctcattgcaggtgacaagtcaatgattctgaatatatttaagcctttggaatgcaccatggatcattctcamctccagatctttgcacattgtccctaacgcctggagcactcttctccctgacctcctaacctctccttttaggtagtctagataacagtacactattttc

SEQ ID NO: 70836 - DNA, 201 bp, Bos taurus
ttacattgaatgggtaaagactagcaagaatcttttttttttttttttcctactaatgtctcccgttgagaagggggtttcttagcatggccatgtaaatkaataccgagttatttctttgaattcaaaggctatttatccaggtctaatttctttagaattaacgtgataactgagcccaacttagcaaccaaaaccagt

SEQ ID NO: 70837 - DNA, 201 bp, Bos taurus; identical to SEQ ID NO: 31130

SEQ ID NO: 70838 - DNA, 201 bp, Bos taurus; identical to SEQ ID NO: 31131

SEQ ID NO: 70839 - DNA, 201 bp, Bos taurus
atggctctaacagaaatgtatagaacatcccggcccatccctcagaagctgggtgcatgttctgaagtacatgtgaacactcttaagtacactttaataartttaatcctataaataatgttgagcaaagcagaataaatatcataccattccacttcaacaaaattaaaatcaggatagggttacctttggtgggaaggt

SEQ ID NO: 70840 - DNA, 201 bp, Bos taurus
aacagagacctttcttagagaaataaaaaagggaatgatgctgagtagtcaagtaaacaaggtcacttaccaccatttataaatattcccttggccactcytcaaccaggaactcttcacagtactcttgctcctgtctgttggcatttgaagccagaaggcaggagagcagtgaggccctcattttcaccctctggattc

SEQ ID NO: 70841 - DNA, 201 bp, Bos taurus; identical to SEQ ID NO: 31133

SEQ ID NO: 70842 - DNA, 201 bp, Bos taurus; identical to SEQ ID NO: 31135

SEQ ID NO: 70843 - DNA, 201 bp, Bos taurus
tcattttaatgtggtttgaagggagaaatatgttttgaatatgtaaatgacacaagtaaatatgataatccagaacagatttataaatactagactgacarccctagcaagatatgatataaagtactaaaattaaaaaaacaaacaaacactgaaagtctaggattttagggactttattatgaatttcaccgactttct

SEQ ID NO: 70844 - DNA, 201 bp, Bos taurus
cccacaattccagagcatcctttggtttctgacttccagacactttcctcataattcattaccctgaaccttgcttatattatagacaagctctttgaacytgagctcctgtctcccctggacagatgccaatgatcaagtacattggctcatgtgctcagacttagcttttcccagaagcgcagagccacgttgctccca

SEQ ID NO: 70845 - DNA, 201 bp, Bos taurus; identical to SEQ ID NO: 31138

SEQ ID NO: 70846 - DNA, 201 bp, Bos taurus; identical to SEQ ID NO: 31142

SEQ ID NO: 70847 - DNA, 201 bp, Bos taurus; identical to SEQ ID NO: 31144

SEQ ID NO: 70848 - DNA, 201 bp, Bos taurus; identical to SEQ ID NO: 31145

SEQ ID NO: 70849 - DNA, 201 bp, Bos taurus; identical to SEQ ID NO: 31146

SEQ ID NO: 70850 - DNA, 201 bp, Bos taurus; identical to SEQ ID NO: 31147

SEQ ID NO: 70851 - DNA, 201 bp, Bos taurus; identical to SEQ ID NO: 31151

SEQ ID NO: 70852 - DNA, 201 bp, Bos taurus; identical to SEQ ID NO: 31152

SEQ ID NO: 70853 - DNA, 201 bp, Bos taurus
aattcattctgagaaatatcaccctccgtcccttccttttcagtacctgaggcaaaaataattgactagtattttgaggcttagagtttagggtttttttktgtgtgttttttttttaatgtgttaacaatatgggagaactatcaggacaaaaattacaaataaacaagggtgatatgaccaggtttccaaaaatgtaca

SEQ ID NO: 70854 - DNA, 201 bp, Bos taurus
tggcaacccactccagtactcttgcctggagaattccatggactgaggagcctggtaggctacagtccctgggatcgcagagagtcggacacgactgagcracttcactttcactctgtataaaacagataagcaatgtcttactgtacagcacagggaacggtaatatcttttaataaactataatggaaaagaattata

SEQ ID NO: 70855 - DNA, 201 bp, Bos taurus; identical to SEQ ID NO: 31154

SEQ ID NO: 70856 - DNA, 201 bp, Bos taurus
gtcactgtcattcaaggttattttcgataaggttaacttgcttgcttgctcggccttgaagcaaaactcacttcccgtgaggcctcgaactggcttaaggyggaccagaacccggtctggtttcccagtcggacccaggctgaccccggacccagtccagcttccaagtcggaatcgcttggactcccgctggtttccggg

SEQ ID NO: 70857 - DNA, 201 bp, Bos taurus
aggaaaacacttgactggtatcatggctttgaaatttggcctttgatacatggtactgggatgctaaaggttattctcaatctttttattttcttgactgytttctctcaggccatactctgattttattaattcttaatcttatccctttcagtctgtttcatgatggtgtataggttggaagaaaagactgttgcttgg

SEQ ID NO: 70858 - DNA, 201 bp, Bos taurus
caatggactctggcctttatgtgagtgtcatgttgattgggagccaatcctatgtattaatctaggaagggtcttattttctgtaaaatagaccaattctmttaaggaattgacttatatgaaacagaatcaaaatgtcaaggccttctggcaaaatcttgtggttgaatctcaacagcagcctcaaaacagatgcacatt

SEQ ID NO: 70859 - DNA, 201 bp, Bos taurus; identical to SEQ ID NO: 31157

SEQ ID NO: 70860 - DNA, 201 bp, Bos taurus; identical to SEQ ID NO: 31158

SEQ ID NO: 70861 - DNA, 201 bp, Bos taurus; identical to SEQ ID NO: 31159

SEQ ID NO: 70862 - DNA, 201 bp, Bos taurus
gacatatttagagttcctatcctttaaaagaacttagaagttaatggagtatactgaacatcagaggacttaaatatataatgtacatgctcaattgctcrgttgtgtctgattgtctgtgatccagggactgtagcccaccaggattctctgttcatggaattttccaggcaagaatactggagtaggttgccatttcct

SEQ ID NO: 70863 - DNA, 201 bp, Bos taurus
gtattgatacctggggcaatgtatgttatgcaaaatattcactttagcagctgaaatgagaatcctcactttaatatagtttccagaggcttagaccatgrtttgaactgtaattacctgcagggaaaaatttaaagatcaaaaatgtccatttgcttccttaacccaaatctactattttctctgttggaaactgacttt

SEQ ID NO: 70864 - DNA, 201 bp, Bos taurus
tcattggatctaaatccaagcataaggaaggaaggaaggtgtctactatatctattctctttaccaaggcagtgaaagatttctgagataaatccctaagrggcttctttttatatgcaattaaccagaactgtatcacttggccattcatcacgtaaagagagactgtgaaaggaatcatgcaactttctcagcccatgt

SEQ ID NO: 70865 - DNA, 201 bp, Bos taurus
agcacaatttagagcaatcgaggaaaaaagtatttgactagaagagaagatgtgtttttatcttggttttatttctttactagtttaccttgggtaagtcmcttaacctctctgagcctcaattatcttacatgtaaaatttggagataatcacacttgatctgccaatatcacagggtagttatgggagaatcatttggc

SEQ ID NO: 70866 - DNA, 201 bp, Bos taurus
tgtaaatgatgttttcagaatatttgatatccctagaaaatagtatacattgtttaaaacacttgagattcaaacactaattattagggcaatttttattmttttatctctagatgagtagataagacatgtagagtcaagttatttacattctggtgaaagacaaaagcatacacagtttacaaatgcagtaaacttggg

SEQ ID NO: 70867 - DNA, 201 bp, Bos taurus; identical to SEQ ID NO: 31161

SEQ ID NO: 70868 - DNA, 201 bp, Bos taurus
ttgcctgggaaatcccatgaacagaggagcctgacaggctacagtccatggggttgcaaaagagtcagacatcacttagcaactaaataagaacaataaakatggatcattaagaattttcattttggtcatgatatctcctggtcatgatagtaacctgagtttagtgatcagattttttatttataggaatcacctgtg

SEQ ID NO: 70869 - DNA, 201 bp, Bos taurus; identical to SEQ ID NO: 31162

SEQ ID NO: 70870 - DNA, 201 bp, Bos taurus
tagcaaacagcttaataatagtaagaggttttcaattagtcactttttattgagttttttattctactaggaaatataaggagaaaatgaacaaatctttycctatttgagtccactcagtgccgtgttagaatgagttcaacatcagctctcaagagctaattcttctcgcatttttccaaccttcgattgaaaatacaa

SEQ ID NO: 70871 - DNA, 201 bp, Bos taurus; identical to SEQ ID NO: 31163

SEQ ID NO: 70872 - DNA, 201 bp, Bos taurus; identical to SEQ ID NO: 31164

SEQ ID NO: 70873 - DNA, 201 bp, Bos taurus; identical to SEQ ID NO: 31165

SEQ ID NO: 70874 - DNA, 201 bp, Bos taurus
aaaacaaaaatttcctaactctatgtacctttttctggttttgtttgtttgggccagtctcaacttaatgatgaataaacaagagatactcgagttttcamgaattatggctttcaatctttctcctctgccactgaatgcaccttaggcacgtcatgaatcttgccagttcagttcttaaaagtctgtctagttcaaaac

SEQ ID NO: 70875 - DNA, 201 bp, Bos taurus
taagggatgtcacctgaatggcctatctatattctatattatatatattctatattctcttagttgaatatttgggttattttcttcaacaatctgcagawgtttccattttcctattggccttacttgactccctactattcactaaaaggctcaagttctaagactaaatacttacttaaattttaatatttgacaaac

SEQ ID NO: 70876 - DNA, 201 bp, Bos taurus; identical to SEQ ID NO: 31167

SEQ ID NO: 70877 - DNA, 201 bp, Bos taurus
gtcagtcatgaagatatgtggaagaatgtgtcagtgagagggagtgataagtccaaaggtcctgagggagaagcaggctggcctttattaggaacagtaamgcttccactagagaacactggaaagtaatgacctatggaggaatggtggatgagttcagtgagagaggagtctcagattatacacagtcttctaagctat

SEQ ID NO: 70878 - DNA, 201 bp, Bos taurus; identical to SEQ ID NO: 31168

SEQ ID NO: 70879 - DNA, 201 bp, Bos taurus; identical to SEQ ID NO: 31170

SEQ ID NO: 70880 - DNA, 201 bp, Bos taurus; identical to SEQ ID NO: 31171

SEQ ID NO: 70881 - DNA, 201 bp, Bos taurus
tgaagaggttccaggagagttcacccaggatgatttagcagaagatgatgtcatgctgttagatgcttgggaacaggtaaaactgtattttgttcatggcragagagtgtgcttatacttgagagctgatacaaccttctttgagaaatggcaagtttaataataaatagacccatggatttaggctatatttataagaaa

SEQ ID NO: 70882 - DNA, 201 bp, Bos taurus; identical to SEQ ID NO: 31172

SEQ ID NO: 70883 - DNA, 201 bp, Bos taurus
ttcctccagatttatagcaggccaaatgatttgtccacagctatacctttcatcattctttctacttactccaccttttttaaatcccctcatttgttccrcacactgaaataagtgacagagtaactcattaaaacccacatttttaattagttgtgttctcttaaagctccagttaggactctgaactcccatgccagc

SEQ ID NO: 70884 - DNA, 201 bp, Bos taurus; identical to SEQ ID NO: 31173

SEQ ID NO: 70885 - DNA, 201 bp, Bos taurus; identical to SEQ ID NO: 31174

SEQ ID NO: 70886 - DNA, 201 bp, Bos taurus
ggcatgacttagccaagtcattatcctagcataggagggactgatagttagacaaggctacatacactgcattggatattttaattttacattgatgatartgcagttacatttgtatatgtgtggcaatatacttttcgatatgtgttgttaagtagaattgagtcttggctgaagaacctggccagaggagcaaaagga

SEQ ID NO: 70887 - DNA, 201 bp, Bos taurus; identical to SEQ ID NO: 31178

SEQ ID NO: 70888 - DNA, 201 bp, Bos taurus; identical to SEQ ID NO: 31179

SEQ ID NO: 70889 - DNA, 201 bp, Bos taurus; identical to SEQ ID NO: 31180

SEQ ID NO: 70890 - DNA, 201 bp, Bos taurus
attaggggcctgccaatgaaactgtaattttgagaagttacttaatacaagtgtctgactgtcttttttttttttttttaattatatatttattttcattrgaggataattggccttctctcatagctcagtcagtaaatcacctgcctgcaattcaggagacccaggtttgattcctgggttgggaagatcctctggaga

SEQ ID NO: 70891 - DNA, 201 bp, Bos taurus
ggcattgggcaaagattgtgacataatagtttaagatcagtagacacattaaggtaaggatctaaaggtaccctggggtccagctctgcagactttcttgktatgaacaccaagtgttgaaaaaaaaacaatttttacacacttaggagaaaaatagactctctatattttaccataagtttaaccagttttatggcactg

SEQ ID NO: 70892 - DNA, 201 bp, Bos taurus
atcaccttatactgcatttaaaaatattccatccatccctaagctttgtttgttcacattttgaagcttttgttttccacaggccgaactttaaagcaaaytggttttacacacaccttgcattatagcttcagaggttagagatgataaaattaagctggggttaaggatgtgcaggagaattagacaagcctctcacgg

SEQ ID NO: 70893 - DNA, 201 bp, Bos taurus; identical to SEQ ID NO: 31184

SEQ ID NO: 70894 - DNA, 201 bp, Bos taurus
tctgtataccatctagagtaccagtttttacattttgtggagtcatgatattcctcacgagggtgatgaaatccataggcacataaatttcctccagtatyggtggaattcattgcctttgctctcagcaaatgctatactgggataaaacagaaagcacaccataatatttaaggaaaagtagaaagaatattaaaatgg

SEQ ID NO: 70895 - DNA, 201 bp, Bos taurus
aagggaggatagatgttatttactaaagcaattactgagacactatcaggcttttatcattgatctagacaacatgaggataccactgggccacacatgayaaaggaagtaatgctgagtgtctacattgcctctttcagattgcattacataaacatgctgttctatattattttctattagtttatgattccaattgta

SEQ ID NO: 70896 - DNA, 201 bp, Bos taurus; identical to SEQ ID NO: 31186

SEQ ID NO: 70897 - DNA, 201 bp, Bos taurus; identical to SEQ ID NO: 31189

SEQ ID NO: 70898 - DNA, 201 bp, Bos taurus; identical to SEQ ID NO: 31190

SEQ ID NO: 70899 - DNA, 201 bp, Bos taurus
ttttttaaaaacccattaaaaaaataatcacttgagcctcttaatttgactgatattttatgaattaaattaacaaacagtaaaattaaagattttcctaytggtttgtaattatatgaattttatgtagctcaatgcctacatgttgtggtaggcagaatagtggacccccatacttacagactttatgaacccttatct

SEQ ID NO: 70900 - DNA, 201 bp, Bos taurus
tcttgttttatgtctcctaaattaaaaacattttaagtttctatgattagcattattatgacatttatataaaatttatattaaaataatcactaaaaacrgttaaaccacaactaatttaagagtttctatgaaatatatctttttcattaaatagggatttaacacagttaaatggttgaatataaaccaggaatctac

SEQ ID NO: 70901 - DNA, 201 bp, Bos taurus
ttgagtatttttttcagatgtttgtatttaaacttttatctaaatgataatgtcactttgcatgagaacagcagagtgcaaaagcagatgaattttcaagrgttaaaaagaatggatgagatcaagtttaattctaggacttaaatttgaagattagatttattcatctagttggcctgaaatctaagtgatatttttttt

SEQ ID NO: 70902 - DNA, 201 bp, Bos taurus; identical to SEQ ID NO: 31192

SEQ ID NO: 70903 - DNA, 201 bp, Bos taurus
atgctttggatgtgtttaatccttgtcacatgtaatgtatatctcaaagaatctaatctacacttcatcctggtatttttctactttctgatgggttctaraataaataagaaaacctattatggggaaatattggcaaacctactagttttaacacatattgttctggcttccctaagtaaaatctttggttttactgat

SEQ ID NO: 70904 - DNA, 201 bp, Bos taurus; identical to SEQ ID NO: 31194

SEQ ID NO: 70905 - DNA, 201 bp, Bos taurus
ttgcattcaatacctgttacactctaaagatcagaagcagaaaataagattttacattacaacaaagctctctaatgttgttcttttagcccctgctgtartcaaggcatagagctcagaaataatgtcccctttctgaacttgtcaactatttatttcacgttcttaatttttgtttcatcttgtttcaagactgcctaa

SEQ ID NO: 70906 - DNA, 201 bp, Bos taurus; identical to SEQ ID NO: 31195

SEQ ID NO: 70907 - DNA, 201 bp, Bos taurus
attctatggagatctcggttgggtaaggctggggacgggggccctctctcaccatattttcaggccaatactgctgatccctgtggtaaatgaagagaaamagtggaaactctactttctggtcacactttattataagagaaagtcagaggccactctttataccaaggtgaaaggagtaaagtcaaaatcaagtgcctg

SEQ ID NO: 70908 - DNA, 201 bp, Bos taurus; identical to SEQ ID NO: 31196

SEQ ID NO: 70909 - DNA, 201 bp, Bos taurus; identical to SEQ ID NO: 31197

SEQ ID NO: 70910 - DNA, 201 bp, Bos taurus
agaattctttatggaaaagataataacttttaacaatcctccattccacacctactgccaaactactgttttgatctctcatgttacattaaatttccttygcatagctaaaactgtgttaaaatagttggctttttatagagatgctacccagagcgattctgggtaatataatggaaaatgtttttctgaaaattccac

SEQ ID NO: 70911 - DNA, 201 bp, Bos taurus; identical to SEQ ID NO: 31199

SEQ ID NO: 70912 - DNA, 201 bp, Bos taurus; identical to SEQ ID NO: 31200

SEQ ID NO: 70913 - DNA, 201 bp, Bos taurus; identical to SEQ ID NO: 31204

SEQ ID NO: 70914 - DNA, 201 bp, Bos taurus
gaagtcgttcatgtctaatagccaagaaggaaagaattgggaaaaaattaaataattataacattgaattttaaaccataaaataaatatttatgtccccrtactaatataagtacaaattttataaatgtgtatggagggacaaaagctcttccatttggatttgcaagtaaatatagaaaggatgagggaaaattctgt

SEQ ID NO: 70915 - DNA, 201 bp, Bos taurus
attcttagaaaaggaaaggacagtgctgggcacgttgacattcagttctgtatttattttcttggtggcacgtatcctgacctttccaacttgatacctckggttgataggctgtgtgcagttttcttttattttcctttactttggcaagtcttccagggaagaaaggatgacttcttccagtatccagtgaggcttttt

SEQ ID NO: 70916 - DNA, 201 bp, Bos taurus; identical to SEQ ID NO: 31205

SEQ ID NO: 70917 - DNA, 201 bp, Bos taurus
tctttaattccaggtcaagacctgccttctccaaaaaaaatgctgcatatcctattgtacagaccagtggcttctcttgtgtgaaaactcccaggttttckttccagtagccattctttatttccttgagtatattcccacttagacttgttggtgctcttcttggatttttaaatcattcatattatgaatgaagtttca

SEQ ID NO: 70918 - DNA, 201 bp, Bos taurus; identical to SEQ ID NO: 31206

SEQ ID NO: 70919 - DNA, 201 bp, Bos taurus
tgaaggtgaacaagttggagaaaagtatgttcctacttcatttatacaagtatggcttaaatgaaacacaaaacttaaatatagacataattccaactttycaagtgaaagattgtgccttgggaaaaattcatgatgctatacctctgcacaattatttacagaaaatactttacatgaaaatgtaaaatacatgtaatc

SEQ ID NO: 70920 - DNA, 201 bp, Bos taurus
tagaatttaaagaactggtggaatatgaagactaatgaaaacatccatgcaaacacacacgatcttacatgaattactgggaaaatagtgggataaaccaytttcctttggttttaaggaaaaaaaatgtagtatatatacagtattatcaacaactttttattctctgaaccagaatcatctttgggatctctcagagta

SEQ ID NO: 70921 - DNA, 201 bp, Bos taurus
tcatttctaatgagtcacttctagtggggagcgggacacaattcaacccccagcaccacatgtgaaatgactcagcaagggaatgaagagaagcacttggraaggccagcttccactcagcgcactgacatttgtcgcacatacaacggaagcaagctccaaggtgtgaggactaaaaccgtgctctgtgttgctggtgga

SEQ ID NO: 70922 - DNA, 201 bp, Bos taurus
agcacctaattagttaaacatttctcgtttgtcaagatacaaaccacctttttttctttttttttctgaaagtataaggcacagagctaaaaatctgcccsctggacacacttaaataatgcagctttgatctgcatgaactgctgcgctcctaggtaaattattgccaggggttctgtgtggagagtaatgagcatagct

SEQ ID NO: 70923 - DNA, 201 bp, Bos taurus
gctcttaaaattgtgccttatagttttatagtttctgtatttgttcttactgtgatgtgcacattgaggatgatattctttcactggaaatgaactatacktgaaaatgtttatagagcagttgtaacaccacattttgattttattactctttgccctaaattgagaaagaaatcaattgtattccaaatagcttgagaa

SEQ ID NO: 70924 - DNA, 201 bp, Bos taurus
catttagttacttttttataatatgccgtctgaaggcccatgccagcttgaaaaggggtaaaacaatgaaaatggcccataaccaaagcaactgggcagcwtttaactaaagtgtggataaagaaaggttttcaagcaaatagactatatctacaaaaggcgaggtctggtctgaaagaaggtactataatcatagagtag

SEQ ID NO: 70925 - DNA, 201 bp, Bos taurus; identical to SEQ ID NO: 31210

SEQ ID NO: 70926 - DNA, 201 bp, Bos taurus
gctctaaactgaaggactcaggagcctaaggaaatccactttcctttctcttctgtctttgatttttttcatacaccaaacaagatagaagcggatgctcrggggtgaggtcacgaaaaccctatccactcctcttggcaggaacaattgttaaaatcagtgtctgcatccacacagtgaagacagccaacactggcttct

SEQ ID NO: 70927 - DNA, 201 bp, Bos taurus
taatgatagggagacagtaatccaaaaagacacatgcagtccatgttcactgcggcactgttagaaaagccagcgtatgggaacaacgtacattacccatygacagataaatggataaagaagatgtaatacacatacgtgcacatacttatcacagcaaaatagttgtgatactactcagctataaaaagatgaagtttg

SEQ ID NO: 70928 - DNA, 201 bp, Bos taurus; identical to SEQ ID NO: 31211

SEQ ID NO: 70929 - DNA, 201 bp, Bos taurus
ctgagaatttgggggcagcatgtctaacggatggggttttactatttttaatcacacagctcttaggatttatcctaaaacctctcactcaagactcatcycaaagcactttcttctgatgtagttttttaggatgttaatattctctgagtggtacattgccatgaataatgtctttttattaattatgttactatatat

SEQ ID NO: 70930 - DNA, 201 bp, Bos taurus; identical to SEQ ID NO: 31214

SEQ ID NO: 70931 - DNA, 201 bp, Bos taurus; identical to SEQ ID NO: 31215

SEQ ID NO: 70932 - DNA, 201 bp, Bos taurus; identical to SEQ ID NO: 31216

SEQ ID NO: 70933 - DNA, 201 bp, Bos taurus; identical to SEQ ID NO: 31217

SEQ ID NO: 70934 - DNA, 201 bp, Bos taurus; identical to SEQ ID NO: 31218

SEQ ID NO: 70935 - DNA, 201 bp, Bos taurus; identical to SEQ ID NO: 31219

SEQ ID NO: 70936 - DNA, 201 bp, Bos taurus; identical to SEQ ID NO: 31220

SEQ ID NO: 70937 - DNA, 201 bp, Bos taurus; identical to SEQ ID NO: 31221

SEQ ID NO: 70938 - DNA, 201 bp, Bos taurus; identical to SEQ ID NO: 31222

SEQ ID NO: 70939 - DNA, 201 bp, Bos taurus; identical to SEQ ID NO: 31223

SEQ ID NO: 70940 - DNA, 201 bp, Bos taurus; identical to SEQ ID NO: 31224

SEQ ID NO: 70941 - DNA, 201 bp, Bos taurus; identical to SEQ ID NO: 31225

SEQ ID NO: 70942 - DNA, 201 bp, Bos taurus; identical to SEQ ID NO: 31226

SEQ ID NO: 70943 - DNA, 201 bp, Bos taurus; identical to SEQ ID NO: 31227

SEQ ID NO: 70944 - DNA, 201 bp, Bos taurus; identical to SEQ ID NO: 31228

SEQ ID NO: 70945 - DNA, 201 bp, Bos taurus; identical to SEQ ID NO: 31229

SEQ ID NO: 70946 - DNA, 201 bp, Bos taurus; identical to SEQ ID NO: 31230

SEQ ID NO: 70947 - DNA, 201 bp, Bos taurus; identical to SEQ ID NO: 31231

SEQ ID NO: 70948 - DNA, 201 bp, Bos taurus; identical to SEQ ID NO: 31232

SEQ ID NO: 70949 - DNA, 201 bp, Bos taurus; identical to SEQ ID NO: 31233

SEQ ID NO: 70950 - DNA, 201 bp, Bos taurus; identical to SEQ ID NO: 31234

SEQ ID NO: 70951 - DNA, 201 bp, Bos taurus; identical to SEQ ID NO: 31235

SEQ ID NO: 70952 - DNA, 201 bp, Bos taurus; identical to SEQ ID NO: 31236

SEQ ID NO: 70953 - DNA, 201 bp, Bos taurus; identical to SEQ ID NO: 31237

SEQ ID NO: 70954 - DNA, 201 bp, Bos taurus; identical to SEQ ID NO: 31238

SEQ ID NO: 70955 - DNA, 201 bp, Bos taurus; identical to SEQ ID NO: 31239

SEQ ID NO: 70956 - DNA, 201 bp, Bos taurus; identical to SEQ ID NO: 31240

SEQ ID NO: 70957 - DNA, 201 bp, Bos taurus; identical to SEQ ID NO: 31241

SEQ ID NO: 70958 - DNA, 201 bp, Bos taurus; identical to SEQ ID NO: 31242

SEQ ID NO: 70959 - DNA, 201 bp, Bos taurus; identical to SEQ ID NO: 31243

SEQ ID NO: 70960 - DNA, 201 bp, Bos taurus; identical to SEQ ID NO: 31244

SEQ ID NO: 70961 - DNA, 201 bp, Bos taurus; identical to SEQ ID NO: 31245

SEQ ID NO: 70962 - DNA, 201 bp, Bos taurus; identical to SEQ ID NO: 31246

SEQ ID NO: 70963 - DNA, 201 bp, Bos taurus; identical to SEQ ID NO: 31247

SEQ ID NO: 70964 - DNA, 201 bp, Bos taurus; identical to SEQ ID NO: 31248

SEQ ID NO: 70965 - DNA, 201 bp, Bos taurus; identical to SEQ ID NO: 31249

SEQ ID NO: 70966 - DNA, 201 bp, Bos taurus; identical to SEQ ID NO: 31250

SEQ ID NO: 70967 - DNA, 201 bp, Bos taurus; identical to SEQ ID NO: 31251

SEQ ID NO: 70968 - DNA, 201 bp, Bos taurus; identical to SEQ ID NO: 31252

SEQ ID NO: 70969 - DNA, 201 bp, Bos taurus; identical to SEQ ID NO: 31253

SEQ ID NO: 70970 - DNA, 201 bp, Bos taurus; identical to SEQ ID NO: 31254

SEQ ID NO: 70971 - DNA, 201 bp, Bos taurus; identical to SEQ ID NO: 31255

SEQ ID NO: 70972 - DNA, 201 bp, Bos taurus; identical to SEQ ID NO: 31256

SEQ ID NO: 70973 - DNA, 201 bp, Bos taurus; identical to SEQ ID NO: 31257

SEQ ID NO: 70974 - DNA, 201 bp, Bos taurus; identical to SEQ ID NO: 31258

SEQ ID NO: 70975 - DNA, 201 bp, Bos taurus; identical to SEQ ID NO: 31260

SEQ ID NO: 70976 - DNA, 201 bp, Bos taurus; identical to SEQ ID NO: 31261

SEQ ID NO: 70977 - DNA, 201 bp, Bos taurus; identical to SEQ ID NO: 31262

SEQ ID NO: 70978 - DNA, 201 bp, Bos taurus; identical to SEQ ID NO: 31263

SEQ ID NO: 70979 - DNA, 201 bp, Bos taurus; identical to SEQ ID NO: 31264

SEQ ID NO: 70980 - DNA, 201 bp, Bos taurus; identical to SEQ ID NO: 31265

SEQ ID NO: 70981 - DNA, 201 bp, Bos taurus; identical to SEQ ID NO: 31266

SEQ ID NO: 70982 - DNA, 201 bp, Bos taurus; identical to SEQ ID NO: 31267

SEQ ID NO: 70983 - DNA, 201 bp, Bos taurus; identical to SEQ ID NO: 31268

SEQ ID NO: 70984 - DNA, 201 bp, Bos taurus; identical to SEQ ID NO: 31269

SEQ ID NO: 70985 - DNA, 201 bp, Bos taurus; identical to SEQ ID NO: 31270

SEQ ID NO: 70986 - DNA, 201 bp, Bos taurus; identical to SEQ ID NO: 31271

SEQ ID NO: 70987 - DNA, 201 bp, Bos taurus; identical to SEQ ID NO: 31272

SEQ ID NO: 70988 - DNA, 201 bp, Bos taurus; identical to SEQ ID NO: 31274

SEQ ID NO: 70989 - DNA, 201 bp, Bos taurus; identical to SEQ ID NO: 31275

SEQ ID NO: 70990 - DNA, 201 bp, Bos taurus; identical to SEQ ID NO: 31276

SEQ ID NO: 70991 - DNA, 201 bp, Bos taurus; identical to SEQ ID NO: 31277

SEQ ID NO: 70992 - DNA, 201 bp, Bos taurus; identical to SEQ ID NO: 31278

SEQ ID NO: 70993 - DNA, 201 bp, Bos taurus; identical to SEQ ID NO: 31279

SEQ ID NO: 70994 - DNA, 201 bp, Bos taurus; identical to SEQ ID NO: 31280

SEQ ID NO: 70995 - DNA, 201 bp, Bos taurus; identical to SEQ ID NO: 31281

SEQ ID NO: 70996 - DNA, 201 bp, Bos taurus; identical to SEQ ID NO: 31282

SEQ ID NO: 70997 - DNA, 201 bp, Bos taurus; identical to SEQ ID NO: 31283

SEQ ID NO: 70998 - DNA, 201 bp, Bos taurus; identical to SEQ ID NO: 31284

SEQ ID NO: 70999 - DNA, 201 bp, Bos taurus; identical to SEQ ID NO: 31285

SEQ ID NO: 71000 - DNA, 201 bp, Bos taurus; identical to SEQ ID NO: 31286

SEQ ID NO: 71001 - DNA, 201 bp, Bos taurus
caaaggaaggcatggtatactgtcccttagaaggttggagaattcacaggagagaattaacctagatcctggaatctgagtagattcacatggtaagttcrggtggaagatggcaaccattgggaaacagaagacattctaagcagtggtgactatagagtgtaggccactggggtgactggtagccattctgttaataca

SEQ ID NO: 71002 - DNA, 201 bp, Bos taurus; identical to SEQ ID NO: 31287

SEQ ID NO: 71003 - DNA, 201 bp, Bos taurus; identical to SEQ ID NO: 31288

SEQ ID NO: 71004 - DNA, 201 bp, Bos taurus; identical to SEQ ID NO: 31289

SEQ ID NO: 71005 - DNA, 201 bp, Bos taurus
tgtggtatcaattactacaaaattttattttcttcagcattttttacatatagatgcacctgctctaagtattgtgtaatttgtttatgtaaagagattcyaaataagctacttgagtaatttgttatgggatgctatttcagtctcagtataagttgaaagtcaggtcaatatgtaaattcgaagtcagattaactggct

SEQ ID NO: 71006 - DNA, 201 bp, Bos taurus; identical to SEQ ID NO: 31293

SEQ ID NO: 71007 - DNA, 201 bp, Bos taurus
tgattgacaaactttatgaaggactattaaggaatatctctttggtagaattgttgcaggttgttgtaggggctttaattttaggtaaaagaaactatgtmttataaaaggatttattacacaagagctctcaactaaggacagtgaaaaatcttgatggaccttaacagaaaagcctaggaaggttaaaatacccattta

SEQ ID NO: 71008 - DNA, 201 bp, Bos taurus
tacttagagggtgtaatcactgtgcctgccctgcctttattctgtaaacaaaccctttaacttcccacccttccctacagaacagttctctgaccatggtmctgaaaccactcctgctttatggtaacctaacaattttcattaaagatactggaaatatgaaaaatcttgatgtaggtgtaggcttttatcccctacttc

SEQ ID NO: 71009 - DNA, 201 bp, Bos taurus; identical to SEQ ID NO: 31294

SEQ ID NO: 71010 - DNA, 201 bp, Bos taurus
agaagagtaagaaaggagaggatgaaggaaagtagaagaaggagaaaagatgaagggagggaaagtaaggagtctggaagagaaagtaaagagaatgagayagaagagggtagagtaaggaagaaaaaaggaaaatgcacactcttttgtcatgaacatatacaagattcacaatgttttacaaagccattgttattaata

SEQ ID NO: 71011 - DNA, 201 bp, Bos taurus; identical to SEQ ID NO: 31295

SEQ ID NO: 71012 - DNA, 201 bp, Bos taurus
acctcattttaagtttataatttattagttttcctgtgaaactttctactccttaagggcttggactgtattctgttcatctgtgtatccataggatatgwtaagatgttgagctcttggtaaacactcaaaaaatgaatgtacaaaaaacttattgaatgaaccagttaatatatgacatgacatattccttaacttttt

SEQ ID NO: 71013 - DNA, 201 bp, Bos taurus
taagaaaacatgaatttgaaaataacagaaattatagtgatttaaatataatcaaataaaaatttaatgatgtcaatggttattccagggtttatgattgmagaggaaagtgtaatatggggttaagcattctcctctcttacactagagtcagatgatgaatttttgttgggctgttactaagcacacttgtatatatga

SEQ ID NO: 71014 - DNA, 201 bp, Bos taurus
gtttaacatgacatttctagattagaattaagaatttaatgatcaaatctgaggtattatttcccaatagaagctcatttcattgtgatattaatgggggycatcattgtttaataaagatttcccccaaacaagggttcatggtggtccttgaaatttgaacttaactacactgaagaaatcgatgtcatttaatttccc

SEQ ID NO: 71015 - DNA, 201 bp, Bos taurus; identical to SEQ ID NO: 31296

SEQ ID NO: 71016 - DNA, 201 bp, Bos taurus
acaaaaatgctgatttttttaaaaaaaatcactttattagtctgcctggaggactgggcagatgcatagttattacttagtagacacttgtcaaccaagartaaatacagatggaggtcaaaagcggggcaggcaagcacagcgctccaaagagggtgtgtggaaagggaaatctggcagagtgtttcaatggccaggttt

SEQ ID NO: 71017 - DNA, 201 bp, Bos taurus
tggaaaccgtgtcccctgcactggcagctgattcttcactgctgagccactggggaagccccttggcttcagttacttagaagcagttaagttctgctacrtggaaacaacacactgttaaaagtcatcaaattctcatatcttaccatacagtcttaaagtttatgcccatttttggttatttattattcatttctattt

SEQ ID NO: 71018 - DNA, 201 bp, Bos taurus
caatcacccctgattatttacactgccttttataaaaaattctaggtcagccgacttgaaagtcctgtaataaataataatgactcattttctccaagagkgtttacagagaatttattgccctatacatcactgcctgtaccatttttttccccggtgtaacaacataatatgacctcttaaaaagcaaaataattaaat

SEQ ID NO: 71019 - DNA, 201 bp, Bos taurus; identical to SEQ ID NO: 31299

SEQ ID NO: 71020 - DNA, 201 bp, Bos taurus
tctagaaatgtgaaaagttaattaactcattgcttcattataaaaaaaaagatgtagcagaaaaaaataaaaaattgtaagccagttttactttatgaatrataatgaaaaattgaatgaaaagatttccaagcaaagtagcaatgaaagaataatgcctggaaacaaaacaactgactcgataattgagtattttagatg

SEQ ID NO: 71021 - DNA, 201 bp, Bos taurus
gtatattttcaatcaccgtgtagtatttcaaagttttatgagtgatagttgttcagttgtaaagttgtttagttgaaagaaggttatgcagtttcagttcwtgaaagtaaatctgttattctttttctattctaaaagcaagtaagcctaagatatctgttaaatatatacttacctaagctggaacttttcacatttctc

SEQ ID NO: 71022 - DNA, 201 bp, Bos taurus; identical to SEQ ID NO: 31302

SEQ ID NO: 71023 - DNA, 201 bp, Bos taurus; identical to SEQ ID NO: 31303

SEQ ID NO: 71024 - DNA, 201 bp, Bos taurus; identical to SEQ ID NO: 31304

SEQ ID NO: 71025 - DNA, 201 bp, Bos taurus
ttcactaaataaatgtccttacataatttaactgagactatgctgatatgctgtagtagttactacattcaaatcaatagctaaaactgaagatacttctygattgagtttgagagcatcctctaatctacaagaagccatataatttttattaaggaaggacttatgaactaaatgaggcttgtatgggaaccaccacca

SEQ ID NO: 71026 - DNA, 201 bp, Bos taurus
agcattgtgttttggttttatcctatgtaattcataatacaaaaatacttcttacaactttaacaggcaattttactgagaattcaattagaggcacagtrtatccaatctcactatttgatatttgttatagacctgagacacagaatggtttatttgatatttctgttatagacctgagacacagaatggtttatttga

SEQ ID NO: 71027 - DNA, 201 bp, Bos taurus
agctccgccctttcaggcacttagagggctcccttgcctggggttcttctctgttgttcagcgcaccaggcacataaagggccccgggcccagcccccccmactccccctgctgtctggggtcctattctgtagattggcacatcaggctcttaaaggggcaccttgggtggggtcctgctctgtagttcagtgcttcaag

SEQ ID NO: 71028 - DNA, 201 bp, Bos taurus; identical to SEQ ID NO: 31306

SEQ ID NO: 71029 - DNA, 201 bp, Bos taurus; identical to SEQ ID NO: 31307

SEQ ID NO: 71030 - DNA, 201 bp, Bos taurus; identical to SEQ ID NO: 31391

SEQ ID NO: 71031 - DNA, 201 bp, Bos taurus; identical to SEQ ID NO: 31393

SEQ ID NO: 71032 - DNA, 201 bp, Bos taurus; identical to SEQ ID NO: 31396

SEQ ID NO: 71033 - DNA, 201 bp, Bos taurus; identical to SEQ ID NO: 31397

SEQ ID NO: 71034 - DNA, 201 bp, Bos taurus; identical to SEQ ID NO: 31399

SEQ ID NO: 71035 - DNA, 201 bp, Bos taurus; identical to SEQ ID NO: 31401

SEQ ID NO: 71036 - DNA, 201 bp, Bos taurus
tttagcatcagtgcttccaatgaatattcagggttgatttcctttaggattgactggtttgacctccttgctatccatccagtcttacatttagatctttrgtcagtactgaatctgagttttggttatctaaacaagtaaaactattgaagccattttcagctgcataaactaacccattaaattcagaatacagataaa

SEQ ID NO: 71037 - DNA, 201 bp, Bos taurus
gattaaactcatgaatgatttggcttgaactcttgaaagagatcaaaattgtgtagcatagcagtgtttacaggtttatagatctgcctgggccatctgaygcccttgaccatgatttattattacaggacagagattatctcagactgggctggaaatggatcttggctgagttatttactcaccggatgcaatgtgtga

SEQ ID NO: 71038 - DNA, 201 bp, Bos taurus
cacacagagccagaataaatgagtaagccctggggagcagggtagggagcagtcactccagaggaaggattcactcactcacaggatggaaaggatggagsgtgcaagggagggagggctcactgggaggaattctgcatctgtgggcacagtaccagaggctctggggttgatatctaactccaacatttacaatgagaa

SEQ ID NO: 71039 - DNA, 201 bp, Bos taurus
gcctttgatactcaaatgggcaagaatgaagaaactaataaaaatgaattacagatggtaataacaaccctttccttgtctaatgtagaatcaacattcarattttctccttaatgctagtttcctaaaatatgagctttttccaagaagaaaattcaagaaaatagggatatatatatttatatatgtgtttatgtataa

SEQ ID NO: 71040 - DNA, 201 bp, Bos taurus
ctcaggcctacttaaaacactcagttctcagacgaaagcactgtgtggccaagcaaagcactcatctttaccagtgagatgtccacagacggccacatccrtgctggctgctacggctcacagagccagtgactggaggaagctactgtttccatgctgccgctgggcggagcccagaatccaaacctgaagcgcaggccc

SEQ ID NO: 71041 - DNA, 201 bp, Bos taurus
tccagccagggcctccgcttggctgaacccacaggaagctagagggcaaatgtcaacggatacatggagaaaacagcagcggggcagagaaggtgggagaygaagtgtgggtaatggccactggaggaaaagcagcatagtccacctgctgttctgtgccagaaccacagtgttctaattattgcggctttgggaagatcc

SEQ ID NO: 71042 - DNA, 201 bp, Bos taurus
tttttcatttcatagcacagttttttgatgaccaggccagcttctcaaatcgtttttgggtttctttaatgagcagtcagtggcagggagcatgcacacayagagcaggtgtgatgataaaataatcagactcattttgtgggtggttatgggaatcattctcattgttttatagtcacaagctacattgtgcacagtata

SEQ ID NO: 71043 - DNA, 201 bp, Bos taurus
gggatgtgtgttgtctgagaaggggtgtttgtagcaggaaaccctgggcgttggagtcacacgaagacgtactgtgctggccaagcaagtcagttagcttygctgagcctcagtttccttctcagagtaaatggggctggggtgaaccttcctcctgggtggacccggccaggggagtgaagttccatgcatagtgcctgc

SEQ ID NO: 71044 - DNA, 201 bp, Bos taurus
gagtgctgtagaatgccttgctgtttccaagtcatgctttctttagggaaggggagatgtccttagatttcacttacagtatagctcaatattcatggaartatttctttttcttttaaaattgatcaggggagaaaagtttggggactcagatcacagatttttaatcaaaggaagagttgttctctggaaaatgcttgc

SEQ ID NO: 71045 - DNA, 201 bp, Bos taurus
ggataatgtagatccaaattctatcttctttcgccagcatgaccctatttgagaggttcagcactgtcgggaagagcgggaaatcagaagaacattgagaytcaactcttgtccacaaaatgtttataatctacttcttccaggggttggcatactctttctataaaggatcagatagtgaatgttatacgttgctgccat

SEQ ID NO: 71046 - DNA, 201 bp, Bos taurus
tgcctataaatgtacagttatctctctgtgccaacagttccacaactaaggattcaaccaaccacaggttgtgtagcactgcagtatgtatttattggggraaaaaattgtgcataagtgatttgaacacacaaaattcaaacccatactgttcaactagagtttgcttctaagagagattccagagcgcttacttgagcc

SEQ ID NO: 71047 - DNA, 201 bp, Bos taurus
ctctctcctgcccgactgtggcgcaccagagctgccctcgccctggggtcagcggtcagcctggtgtttactgggagaggaggccctctggggtggagctytggggagctgtgtgcccctaagcacacctaagtgtctgtaaatacaggatggagtggacgtgaggcagggaggcagcatggtggcgacgggcccagcctg

SEQ ID NO: 71048 - DNA, 201 bp, Bos taurus
tgcccattccatttcaggttataagaattcacctttataaagcacttcatgtaatataatacctgtattttagcttatgaggtatttcattgcattatgaycaattcagatgtgtctggtctcacaagcagcttggtgctgggaaaagagagccctcatgtggttgtccttggagctgtatggctggtacatggtaccctg

SEQ ID NO: 71049 - DNA, 201 bp, Bos taurus
actcttggggttcaattccaagcttctggttctacctgactggatgtgagaataccctgtcctctctaaattctgatgtccatgcagtgccctaggaaaasgaggcctggattaaaccaccaagctctccagcccatgaaacctccctcccttccgcaaaatcaaatttcaaaatgttccatatgaaggatggctgccttc

SEQ ID NO: 71050 - DNA, 201 bp, Bos taurus
acctgcatgaagttctatgcactttgtgtaagttatcaatccgcaaaaaagtcaaaagaaaatcacgtctgaaatccatcgggccaccaggtagtgatgaytgtgtgtccaggaaacatcaggcacagtgcgctctggtactctgccttgcctttagtcctccgcccagggggcctccaggcgctgctcagggtggagctg

SEQ ID NO: 71051 - DNA, 201 bp, Bos taurus
acagctgtgaggatccagactccctctatgatcgtattagcacccgcctgttctcaatgttatttaagaacagacgagtgttgatgcgatcatagaggtcrtcttgcacatactgcttgaagagcatggctgccttctcagatgctttttctgctgctttctagaaagacagacagttctgtgcagaacgaagccagattt

SEQ ID NO: 71052 - DNA, 201 bp, Bos taurus
tgttcacaagttcctatgttctgttcttttataaagaagttttcttttcaccagatctcaatcggtctaacggttgggtaggcctgcagtgtggctctacrtttaaaattcatgcagaatccaatctcttctcaccatcgaagtttgactcaaaaaaatgaaaccctcatctcttatctggatcactgaagtggcctccta

SEQ ID NO: 71053 - DNA, 201 bp, Bos taurus
ctttaaaatgtgacacgtggaccccactgcagagctctcgattgaattggtccagggagggacccggaaaacaggtattgctaacaatgctccatgggtgrtactgacatgcacaacacccaaacgtggcctccttcagagctgcccagtggcagagtaaacacacccaaatttacaccattgagggctctggagcaagtc

SEQ ID NO: 71054 - DNA, 201 bp, Bos taurus
cacttgttaaagtttattaatacaaagaaatgaatctgcagagggaagatcaataaatataaaatacacgggaaacactgggagagtcacagaccacagcrctggggagattcctcgaggatgggaggggcactctgtttgagtttgtggtccagaggtgaagtatttgtcctgccgcaagagttcaaagggcaggaattc

SEQ ID NO: 71055 - DNA, 201 bp, Bos taurus
actttagcattaataaacatatatttataaattctagactgtaaggaagttgactgttcttctctagtgaaaatcctacatgtttttttctagagcgaatkatgttttggttttcagatcttttctaggctgtattgtttattctttgtgtgtatttaactgactttcaaaatcacaacctgtactttatgatttttgaac

SEQ ID NO: 71056 - DNA, 201 bp, Bos taurus
cctggtgacctccaaacctgctgtgtcctgggcctttgatggcacaacacgcccagctgctgctccaattgttctccaggaacagatggccactcaattcragagacccaaaaaggccagaggactgctgcctgtcctacaattcatctccttcatccacaacagtgttcatcccaaactgaaggactgtggggtctccaa

SEQ ID NO: 71057 - DNA, 201 bp, Bos taurus
gaaaataaagtggaaaattatttcacatgcgtgaaatctgtttaccaactgcaaaagtctaaactgatgttgaatcctgttgctactcttacattgtttayagcacaggttccggagatcagtaaacaagcaatctatggaataatttctgaaattaatttcataaaagaaatgatgccgggcatgaccgttttaattaaa

SEQ ID NO: 71058 - DNA, 201 bp, Bos taurus
aatttcaaaaaagaatgacatgacaccaaatcatttacagtcacaaaagaatttctgcatattttgtattctttatttaattctgaggaacttgactttaktcatacaagtaaatcttaacattttggccttttggaaaagtcaaaaagaaatttagaatgttgcaggaaaaaatattagtctgtacttacgtaagaacgt

SEQ ID NO: 71059 - DNA, 201 bp, Bos taurus
tagagctacatgggcagcagaggcagacagtggaaaaagtggggccctccccctgttttttcttgcttgtcgttccagaggccacacccatgccaccacgygtaagaatcaccatgtcaaacttctggcatctttaatagggtactaacaactcagaaaactgtggccaggaggggtagcaatttaagggaagagtttcac

SEQ ID NO: 71060 - DNA, 201 bp, Bos taurus
tccccacacgcctcacttcatttcccttagtggaagtgtcaggccctttgctctcaccatcagaagagtatggagaactcaggcctgccccaggctgagakatcattcactgtgttatttcccttgcacccctcacccccaccgtttggaattaggcgactttatcctgccctggcttccaggtggcccaatgtgacacct

SEQ ID NO: 71061 - DNA, 201 bp, Bos taurus
ccgataaaatacacactcttctatctctgaaaaaggcaaatgaggggttttattgccaggtcttataacaagacaacttgagtgataacatcactggaagktatacttttttagcatttgtactaatttccaatagagaaaaaaaatgtttagaaatgtcagacgagtcattcatttatcagatgtctttttatgtaccta

SEQ ID NO: 71062 - DNA, 201 bp, Bos taurus
cctaaattcccaacagaggtaccatcaaaaaaaaaaaaaaaaagaccagatgtagagacatagaggtagcatgcttggaaaagatcacgaaaggaggtcartagagatgggtcctgaaccaccagagggcagcatgtggtggccgtcccagggaatgaaatgtattttagggtcccccattttccccaacagctgcctgga

SEQ ID NO: 71063 - DNA, 201 bp, Bos taurus
tgatgtaggaaatacacaaacactagacacattgtaaacaaaaattcttttcaaggtaacattactagaagtcaccttgaatacattttggaagagaacartcagacagcaaatgtttcaaaatgcatgaaagaaatcaaaagtggcctgcagttctgctagggaaattaagaaaaaaaacacacacaggacttctgcagg

SEQ ID NO: 71064 - DNA, 201 bp, Bos taurus
ttaccaagtctggctggcctggagcctaaggaagggtctttctcattgttattttaagcttaattattcacgaaagccattcccaggtcttcatctcaacmaatagccacagatgatgggccatcttcaattttcaggctgaaaacttgacatccccacctagatttccaagtgtttgctgtactctcaccaattcagctt

SEQ ID NO: 71065 - DNA, 201 bp, Bos taurus
agatcatgactgagggaacagacctaacaaaataaaatttcacaaacaccagagatgaaaaagcttctcagaagaaaccattttcacctaaattttccccygctttagtttagatttctctgcatgtccttggccttcttcttttccttatgtcctgcaatataccttgctctccatttactgttgttctgagacataaag

SEQ ID NO: 71066 - DNA, 201 bp, Bos taurus
aagatttctctggaagcaaaccacttaaaacaatccacattgaaacttacacaaaaaggagctcatccgtggttcaaagaattatcttctaaaaccttcaygttttaatttgtattaatgacatcttcttaaacatgttttgcagcgtgcagcagcacaccaataaaaaccacttgctgccctttgaactctgaatgttcc

SEQ ID NO: 71067 - DNA, 201 bp, Bos taurus
cttaaaagcaaaacaaatctcctggctaattgggaaccaagacaatgcctaaaaagaaaatgacaggccttggttaaccactagaactcctaggccttgtyccatctgctaggaaggaccagcattgatacccaagaaccactaaagatcctgccgcttgccatgcatcatcactggcctcctcagctgctaaaggccatg

SEQ ID NO: 71068 - DNA, 201 bp, Bos taurus
aatttctaacttattacacaaagcctctaaggcagcaacatcaatatcacctggaagtttcttagaaatgcaggatctcaggcccagcccagattataagrggattatttcccaacaggctttggtcaattctgaattttgctctcatacaccctagactagagtgagctgattcctcccctcatacactttaaaggaaat

SEQ ID NO: 71069 - DNA, 201 bp, Bos taurus
cctcactggtgttcccagggtgaagggggccttgatgggcctggtgtggctccaggctgaggctagagcagagtggcactgtggtagcacagagaccctayaaaagccacaggactctccagggaaagctgccaggagcagacattgatactggtgggaatggaagatgttctagggctctcagcgatcccctgtctcagt

SEQ ID NO: 71070 - DNA, 201 bp, Bos taurus
ctgcctattctgcatatttcatgtaagttgaatcccgtatctggtctttgtgactggctcctttcacttaacataatgttctcaaaggttcattcatgtckctgcatgtatcagaactttattcctttttatggcagagtcatgctccattgtataagtaaatcacattttgtttactcatctgtcagtggatatctgggt

SEQ ID NO: 71071 - DNA, 201 bp, Bos taurus
tagatgcacaggttggcttctttacccacgtgcctgggctcctggtgggatagctggagcggcaaggggttggtctctcttaatgggtcggattctgcacrgtcactgctctctccacaccctaccacggcaatctcctagttgctggcatgcctctagaaggcaaagtgaagggcttcctcaccctgcatgcaggaacta

SEQ ID NO: 71072 - DNA, 201 bp, Bos taurus
agccggggctaccagaagctaggagaggcagaggaggctcttcctgtggagatagcatggtggtgcctacaccttgatttcgtccttctggcctccagagytgtgagaataaggttctgtgttttaagccaccacgcttatgggaacttgttgcggcagccacaggaaaccaatactgcaagagttttgggaacctggaac

SEQ ID NO: 71073 - DNA, 201 bp, Bos taurus
catttattatttatttatttggctgcaccggatcttagttacagcatgcgttccctgacaagggatcgaacccaggtcccctgcattgggagtgcagagtyttcgccagtggaccatcaaagaagtcccttgagtctagaaagataagcaggagttaggcaaagaagaaagagaaggagatttcttaagaaggaatgccca

SEQ ID NO: 71074 - DNA, 201 bp, Bos taurus
taagagctcaatagaagaccgagtggaagcagcggcattgcatttgcgttaggttaactatgatctgcatgaactttttcctgaaagattcttccttggcrgatcaagtttattttcctttgggttataaatgatgcagtttgttagacacttgcagagtgtggaacttttacacaattttcttagtcaaaaggttagctt

SEQ ID NO: 71075 - DNA, 201 bp, Bos taurus
tttataggcaacgtccattgtcaaattctgatttgctgctgaaagttgtatctgacttatttcttgggggaaccgattttaaaggagaagcaaatctcccyggcctacccaatactctacttccactttaatttaaaaaagaaaagcgttcatccctttgcaaacacccagcccttctctttgaaatggggactttccctg

SEQ ID NO: 71076 - DNA, 201 bp, Bos taurus
gattatcctgtattatcagtgtgggcccattgtgatcaaaagggtctataaaatggatacaggagagaagcagaagttggagtgatgtgcttcaaagatgraggggccacaaaggaatataggtggccactaaaagctgataaatcagggaaatagattcgctctcagaacctacggaaggaaccagtcctgctcatacct

SEQ ID NO: 71077 - DNA, 201 bp, Bos taurus
ccaccgcctctcaatgtggtctctcccagatgtatagacgtggtggcacttccaaaaggacatgatccttgtgtgtgcaggggaggagagggaggtgttckgtctggggccccggcggatgggccattctcagtgtccactaggagactaagcagtgctgctctgaaggcacaagggactgcagcccctcattctaactga

SEQ ID NO: 71078 - DNA, 201 bp, Bos taurus
atatgatggaatattgtcatccttaaaaggggaatgaaattctgatatatgccacatgccacaacatggataaactttgaagacattagactaagcaaaayacatcagatacagaaagacaaatattgtattattccatttaaatgaagtaactagaatagtcaaatttatagagacagaaagtaaaatagtggttaccag

SEQ ID NO: 71079 - DNA, 201 bp, Bos taurus
agatgaattgtttcttagaagggtaccccactgttgtctctgcatccaagccactgataccttttgtgtaagattgatgctgggcctttaaattttttttwaatttaaataacattaaatttaccatttcaaccatttgtaagtgtatacttcagtgtgttaaatgcattcacactgttgggccactatcaccgtcatcca

SEQ ID NO: 71080 - DNA, 201 bp, Bos taurus
tctatctgcaacccaaccatttctcccacctcctctgctaccactcgagactaggttacttttgtctcttaactagttacttcagttagtgaggattctgrgccaagttccaatgtgtgtgtgtcagggctggggcagtgcatgggaggggtgatgagtttctccacagattccacaaaaactctgcttcatcagttatgt

SEQ ID NO: 71081 - DNA, 201 bp, Bos taurus
cccttctccctacccttccggagccagatgcgtgttcctctcttttgaacactagttgctctttgattctctaactgtcttacggaatttatctttctctracttgcactcagatcaatcccattccacaagtgtgtgtgtgctcagtcactcagttgtgtctgattctttgctaccccatggactgtagcctgccagtct

SEQ ID NO: 71082 - DNA, 201 bp, Bos taurus
ggctcgtacaggactgcctagcccccctcccctgcccaagctgctccctctttcaaacatcacacatggcaggcaccagaaacagagagcttctttctttycctggctgggaaaaatagtctcaaattttgtgatgtatatgaagcgcgaggtgggggggggtacttttaatttttatttttttaccctctttaaatattt

SEQ ID NO: 71083 - DNA, 201 bp, Bos taurus
tggagggagacttcttttgttcccaacctcagccccttgattcttagtcccatcttcctcctctctccaagtacctccccaggccctgttatgttgacttmtgcaggctaagttgcttcaggcgtgtccaactctttgcaacctagtagggtagcctgccaggctcctctgcccagggaaatctccatgcaagaatactgg

SEQ ID NO: 71084 - DNA, 201 bp, Bos taurus
ggagtagggttttagatgaagaaatagaagatggcccaactcaacccctcatgtccttgagaaggtaacagagacctcagaaaggatgtgtgttgtccacrtgtttcaggtaatacgatgacagagtcatcacagagtcaggcactggcccagggccctgcctctctttccagtcacctcccacagggtcaccctctcacc

SEQ ID NO: 71085 - DNA, 201 bp, Bos taurus
aaggctcacggccttttgtgaagtttgcatcagcgcaagactctttttattttataaaactgcattagtgcacagaacagggcatgtcacccagggagacrtaagttgaggccacttccatacccacagaaaagtctcatgttgaggtgaaatgcatgtattttaaaacaactgtaatttacacagctattaatcttccaa

SEQ ID NO: 71086 - DNA, 201 bp, Bos taurus
gagggaagtgggtgcataacccatgcacaggaaaaccatgggcagaggcctagaggcaagagaaagctcatctctttggaagaatagaaagaagtctgtcrtaagacagagttactaggaacttaatgagagatagtgctggagaaataagcaggaaacagatcctaaaaaatggacttagggattccaagggaatcccta

SEQ ID NO: 71087 - DNA, 201 bp, Bos taurus
gtctctgtgacaaaaacaagatataatgaaaagaaatgtaatgacttttgttcataccaatatcaaattaataagacatggggtcgccttgccctggcctytgacctggagctaaatacttatcagcagattattctctcagaaagaatgtagataaagcagttagcagagggcccggcatgtgttttgttatcattgtag

SEQ ID NO: 71088 - DNA, 201 bp, Bos taurus
aattttacaactccagatgctggaatactaatgctatgtttcaaaattctggggtgtagctctagccttattcatagtaaaatgcaatcagacataagacrgatctttggggacggttatacaaagggagttcagccactaaaatagaaaagtgttctggccactgggtgtttttcatgtattgaacttgaggacaacaca

SEQ ID NO: 71089 - DNA, 201 bp, Bos taurus
tggccctatcctgagtgcagcattgtggccatgagagcagggaggctgcaaagagcatcccaaagcactaggatgctgagcccagcgccttcacaacctcygcacccatcctggccatccagttatcagtgagctgtggagcccgccctacacttccgtaccaactcccacccagaatgcagcatgccagagggtctgtgg

SEQ ID NO: 71090 - DNA, 201 bp, Bos taurus
tttctactctcttgttctttcatgtggtagaataagacattcaagctcagggcctggcttgggaccacgtgctgcactaataattttgtttggagcaatgrtgcttagtgatgaataaagtaaggccagtcaatcctaaaggaaatcagtcctgaatattcattggaaggactgatgctgaagctgaaactccagtgcttt

SEQ ID NO: 71091 - DNA, 201 bp, Bos taurus
agtggaataaagctgatagagagtatatgctagctgcctatcaagcacaattaaatctaaatttggaggaaaacgttcctattattgctcctttgcagggrctcaaggaatacaaaagcaaagccaactctctcgcccccatcatttgcgagatttcctcaaagattttctggtgttgtgatatcagactgtaggcagcaa

SEQ ID NO: 71092 - DNA, 201 bp, Bos taurus
gggttgtttcacttgggaacactgcttcagcatgaccatccattgtctgcagtactgctttcctggagaaaaagggctcctaggaattagaaatattttgygagtataggacaaacatctttttttcccttaatgtgcatttgttaaacctaaatagctcagtattgataaaactatgcaaccagtcaaaaatttgttcca

SEQ ID NO: 71093 - DNA, 201 bp, Bos taurus
catctatgttgttgaaaatgcaaaatttcatcctgtgtatatggtgaatcagttacttttcccagtgttggagaattggccttttgtagtattctagtagytctggtcatcacagctatgtgctataggggttctccctatgtgggctgtgtgggtgcttctgatgtagtgggctgactactgtgggcatgctgcttgaca

SEQ ID NO: 71094 - DNA, 201 bp, Bos taurus
ggagtagcctggtgagttacagtccatggggtcacaaagagttggacacaactgagcaactaacagtttcattttcataattaacaaagtgccttcccatraattagatcatttatgcctcacaggaagcctgtaaaataagaattacagaagttcctctgcttacaaacttccagttatgaacttttcctaatccaaatg

SEQ ID NO: 71095 - DNA, 201 bp, Bos taurus
actacttttcctaaggaaatcctggttttattaaatgaacaacctggcagtataaaactctcctaatttttctcttaacgctcctgtaaaaggcattcaartggcttgaatgaacaggtttcattttatgtcagtttttttgcttcattcaaatagaatctactttcagtgcactttgttatgaagctgtaatactattat

SEQ ID NO: 71096 - DNA, 201 bp, Bos taurus
acgtgggttatctttcagaacaatgtgggttatcttctttcactttcatccaaattttctatccttcccactctttcacggtcttcacagttattgctggrtaatgtgaactaacttgcttattaatgctctattatattgtacatatagacaatgttttattttttgcagatctttttttgttttgttgatttaaaattt

SEQ ID NO: 71097 - DNA, 201 bp, Bos taurus
ttacagcctttcctacatactgctactgtaataacaatcacatatcatatcatatgccatatttcattttacacatatttgcctccaactttaggttgcarccaactgaagggttgtatttttccctgaaatagtatactcttagaacacattactgtgtggtgacagcttctcattgatggttgagagaatgaatgagaa

SEQ ID NO: 71098 - DNA, 201 bp, Bos taurus
agccttgtgattgtctatccacaaataatcctggttcgtttggtcattttttctgcttcaagttcattaacatcattgacacccctgtttatagttttcaytaaatgcagcccacaggccagctggtaatgaggggaagctgttttctcctagaatgtttaattagctctttcagcctgggaaagtatgggcaaaaagaca

SEQ ID NO: 71099 - DNA, 201 bp, Bos taurus
gaaatctattgtcctttgaacatttttgtaagtaatgggccatttctctcttgctgatcctaggacttttctgtgtttttagttttcaaagtttgaatatkatgcattttggtatttggcctttttagttcattcagcttattgagtctttggctgtattatgtcttggacaaaactgaaaagttttaatccatttttttc

SEQ ID NO: 71100 - DNA, 201 bp, Bos taurus
aaaaaactttattgggaagatgaaaggcagagatctatcttctgtaacttcttcagcctgacgaggggctatctagttgcggtcattgagctctggccctrtctcattaaaggggctcccaggtgacttctgttgttattgcaacaggatctgttgtggggagtgactggagtccctgcatcacctttgccctgtgatgtt

SEQ ID NO: 71101 - DNA, 201 bp, Bos taurus
atttacatttttatatttgatcagtattgctcactgccaatccactatatgcttgtaaattcctccagggctggttttgttcaccactgggaacattatgygtaagcttagcatatggtaagtaaatgaactcagtcagttgttgaaggaaatgagggagagatgaaggaaaataggtcatcagaggatcaagatttgagc

SEQ ID NO: 71102 - DNA, 201 bp, Bos taurus
agagagatgaaggaaacccaagaaggtgctgggaactctgagaggatttgagtactgaggcttgggctaagtatggtgttttcccctataggcatcagaaytgcatttagctttaccgtgtctgcagagactggcagcaagagaatctttttcctgtcttgcagtttctatagcgggaaaaaaaaaatgtggccaaggaat

SEQ ID NO: 71103 - DNA, 201 bp, Bos taurus
actgctaattatagccttctttgtggatgcagatctctggctaattaaaatttgttatttttaaacaattctatctccttggcctttttcctttagatacrtaggtttagttgctcagtcgtattcaactctttgtgaccccatggactgtagctggccacgctcctctctccatgggattctcagccaagaatactggag

SEQ ID NO: 71104 - DNA, 201 bp, Bos taurus
ctacttctgtcccaatactcagataatatagaatattaaacacaaattcagactcttctctgcttatggttaggtttatctcagaggtctcattggccttytacttcatattgctgtcattcgtcttctgtttcatcctgtaggtttcagtacacacaaaatttcagagaaagataagaatcttttgacaaagctgatctg

SEQ ID NO: 71105 - DNA, 201 bp, Bos taurus
ctgaaaactatacaaatgaaatctatcagttcttttagcagtttatatcagtttatattaactaatcttaaataataatatgagtgagatttatcagctcrtttatattcagatggcccatttgtaaatgtctttctacatgactgtgagtactaggtgagggttaacacagtgagtgatatttcaaagatcaatgaagat

SEQ ID NO: 71106 - DNA, 201 bp, Bos taurus
tcagtgcctaatttataatgaataatatagaaaaaaattagttaatagatcaaggaattggatgacaaaggtatgaactaacacttgacaatagaagagcygaatccattgctagacaaatattgatagggaagctgtccaagcatcttttataaaatgaggccttttcttaaaataactttccaagacttatttattttt

SEQ ID NO: 71107 - DNA, 201 bp, Bos taurus
ctgtgaagacaatgggtagagctctgctgtagccactgccccagaatgcaagagtctttggcagccttacagccctggcctagaaataaactttctgtggyttacctggcccagacaactgttgccgtaaaggtgtctcacccacatcagcaccccgatgtcctctacagttctctgagcagcattcctgcaacctgagga

SEQ ID NO: 71108 - DNA, 201 bp, Bos taurus
tgttcatctaaatgatactggttatttgcccttttttaggttgttttgtgtatcgcaacatgtagccttggatacagaacacaattttctatacactctgkgaacgactagttccaagcccattttatctggtcatgcattttgattgtgccatcactgtgaataacaggactcacaggaggctaacaacacagggatttg

SEQ ID NO: 71109 - DNA, 201 bp, Bos taurus
aataaatgtgtaagatgtctgctcttttgtaatacggttactgaagtgaaggtatctctctccgtgttagtgttggacctggtgggattgagatccttgtygaagtgagatgagtcttgttgggagggaaaaaggggcatgtcaaaggtcaccagaagagcagagaaatcagttcatttgagaatgttgctgtcttgactg

SEQ ID NO: 71110 - DNA, 201 bp, Bos taurus
gagtcagacatgactgaggaacttacactctattgtatttaaaagctgctagagagtagattttaaaagttcttatcacaagaaaaagttcataaccatayttggtgacaaatgttaactagacttgtgatcatttttcaatatatacaaatatcaaataattatgttgtacacctaaaactaatataatgttttatgaca

SEQ ID NO: 71111 - DNA, 201 bp, Bos taurus
gttggcagggctggctccttctgaaggctcaaggggagacgccattccttgcctttgtcagcttctattagcagccagcattccttggcttcctgggcccktcccaagaggtagcaaaggaccacccctctcacctctacttttgtcatcacttctctgaccctctcctgcctctcctttccttataaggaccctgtgatt

SEQ ID NO: 71112 - DNA, 201 bp, Bos taurus
atggcaactcaccccaatattcttgcctggaaaatcccatggactgagaagcctggcaggctacagtccatgaggtctcaaagagttggacacagctaagkgactgagcacacacacatggaaaagcaaagataataatatacacaataaaaatgagaaagggaaaaacctttaaggaaagtgaatgaatcataaaacatt

SEQ ID NO: 71113 - DNA, 201 bp, Bos taurus
gaggatgtgatggggccaggcctactgcaaagtgactttaaagctgtgaagatcatcacaggagtgcactccaagtccaggagattgggtttggacaaagmaacccttctgtgggccctgacgaggctggggatggacagtgttcacagctgtagcttcagcatctttcccagggcctggaaaccagaaagagatgggaac

SEQ ID NO: 71114 - DNA, 201 bp, Bos taurus
gaaggagaaggtaagaataaaataaattcagataagcaaaaaggaactcaaactcggcaccagcctctgctgatggtgtctaaacgggcaggagtcatgcrgggggccagtagtggtcttgccttttggttgctgtgctactttttacatctgtgctgtaaattacaagcttactctgggtaaaacatgagcatattgctg

SEQ ID NO: 71115 - DNA, 201 bp, Bos taurus
tatatataaacacgagcagagtagttactgggcctgcttgagatgtcaactagcacctgttccccctgagcggacacgaaggaaaaagaaagacaaaagcraggccacttgtgccatgactctgtgagtcctgccttctccacttctgttttaccttggtgggcaggtgacaggcaggaatatgtgtctatcccagcaggt

SEQ ID NO: 71116 - DNA, 201 bp, Bos taurus
ctaaatccttctccagattaactcatttgtggctgtttcccatcactggcttctttgagccccaaacagaaaaaccctgctagtttctggcccaccctctktccagcagatggcggtctctgaccaggaatctcatggaccagcccccatgggaaactgcttcctctaaagagcagttttcctgggaatgtccaagaaaac

SEQ ID NO: 71117 - DNA, 201 bp, Bos taurus
ttagctgtgtattatgtggtgctgccaagattggagacttacatctgcaaaatgtgagcaacaatcctacattagacaggagttttaagttcaacttctgmgataagaccaggaatattaatagtatgcttgtatagaatataactttgaacttccccatcaaaagtatagactaactttatttttcaccttggtggcata

SEQ ID NO: 71118 - DNA, 201 bp, Bos taurus
ccatctgggctccttcagccacactctcctttggatggtaatgtttagggatacttctttgccctaaccccatccttcaagttcaagagtaagaagcatgycatgcaaaagtcataaatgaatcttagaaggaggttgaagaatctcattattctcagacgtttctcaggccatcaaagggtgtctcaaacaagtttgtta

SEQ ID NO: 71119 - DNA, 201 bp, Bos taurus
ggataagagttctataaaatgccattttcattaggtatggactattgatatttaaggaataggctttacttagcaattaggattttgtgatgataataatygaagtaaaatataatgtttggatgcaatgcagaataaaagaatataagaaatagtaaaaaacaaacaaacaaacaaaaaaacaccacttgtggttaccaa

SEQ ID NO: 71120 - DNA, 201 bp, Bos taurus
atctttcccttccaacctcaatgttctaagagctctgagaagtccacagtggttccaggtagaagagatcggaaagaggcccaagcaggaggcacagatcrggataaagtttggtaattggggtgaacatcctgagaaccagtcaaatcaagctggtccctctgtaggcattcagatagactctggccagggggcagaaga

SEQ ID NO: 71121 - DNA, 201 bp, Bos taurus
tgactcaggctgagagcctcgtccacagagaaacccaggaactcactagtgtacgggcccaggtgaagacagggagcaaccccagctcaacaagtttctartcagcagactggaacacagggccccaggcagacgctggcaatgcctggccagcggctctggcgggagcagcgtacctaccccatggccttcgtgtacccg

SEQ ID NO: 71122 - DNA, 201 bp, Bos taurus; identical to SEQ ID NO: 31485

SEQ ID NO: 71123 - DNA, 201 bp, Bos taurus; identical to SEQ ID NO: 31486

SEQ ID NO: 71124 - DNA, 201 bp, Bos taurus; identical to SEQ ID NO: 31488

SEQ ID NO: 71125 - DNA, 201 bp, Bos taurus; identical to SEQ ID NO: 31489

SEQ ID NO: 71126 - DNA, 201 bp, Bos taurus; identical to SEQ ID NO: 31490

SEQ ID NO: 71127 - DNA, 201 bp, Bos taurus
agcagaggaaatgggaggaaagagtagaaaggggaacgtgcatgtagattatcaggaggctgaagtatgcagagaaaggagatggtgagatatgcccagcrgaggggtgggcaacaggtttctagaatgtctaaaattccatttcagttgtcttgctgtgccctgctgtcttgaatttttgataaaatgcactatatattc

SEQ ID NO: 71128 - DNA, 201 bp, Bos taurus
tctgacttcagattcagtgtagaaaaaaattatattctgattgagaaaaggaagtttaggaccaggcagtcattaccctggtatattcgacgtgtagacartgctttctatttgagaactttgagtgtgcctaaaatgactctctttgtaaaatcattcttctcgcttttaattatccattaactttgtttttcatgagtt

SEQ ID NO: 71129 - DNA, 201 bp, Bos taurus
ggcctggattctgtatttttatattatagcaagaagatttttgatttgcatatgctttaatagccatattagaacattttgtatatccaatctcttcctgytccttaatttggcacttgttctataaaacaattttgaaaatgcaaattactttacattaaaaatataaattcttatggcatattttatacagtcttaatg

SEQ ID NO: 71130 - DNA, 201 bp, Bos taurus
agaacaaataatcctaaaatttatatggagctgtaagagacccagaattgtcaaagcaatccttagaaagaagaacatagtggatggcagacttcagacamtactacaaagctacagtaatcaaaacagcatggaattggcacaaaacacatatatatcaatgaaacagaatagagagtatagaaataaatccacacacct

SEQ ID NO: 71131 - DNA, 201 bp, Bos taurus
ctctgtcttccgagtatgtacctctctaaataaacctgctttcactttactatgtttcactcttgaattcttttcctgcccaaagccaaagactctcacgyggtgggccgtcccagggactcactcgagacctcaccatcctctcatatgtcatttttcctagaacaacataagtgagctaaaattggcaactctgaagtt

SEQ ID NO: 71132 - DNA, 201 bp, Bos taurus
attttgcttctctcaaaatgcttgaattttgattggggttgcattgaatcttccatcaattttagggtatgctgaaatttttaccatgttggaagtgtatrttcttcctttttaagtctttattagcctcaacaatgttttagatactgtgaaggacttttgaataccttttgttatgtttattcctgtgtatcagatgtt

SEQ ID NO: 71133 - DNA, 201 bp, Bos taurus
cttgagtcttaaagctgaggtattaactgtgctgagtgtaggaacccgtgttaagaacctgattttgtgattccacagcctggccttttctattgtgccarcccctattttgtgagtaaacatttccagccacagtgttaagtaggtgaaatttgattgtcggggcctgtgacaatggaaatgaaatgcaaaattaagagt

SEQ ID NO: 71134 - DNA, 201 bp, Bos taurus
tgatggtaggttttttgaagtttcttagacaggagagatggagacttgtggtacagtggatggcacccagctcatgaaacaacctctggctccttccttaktatacactgtggccttggctggtcctcagaagggaccgtgctaggtcctctgtgggcagagagtgaagctgacctttttatactcactttctttcccttg

SEQ ID NO: 71135 - DNA, 201 bp, Bos taurus; identical to SEQ ID NO: 31492

SEQ ID NO: 71136 - DNA, 201 bp, Bos taurus; identical to SEQ ID NO: 31496

SEQ ID NO: 71137 - DNA, 201 bp, Bos taurus; identical to SEQ ID NO: 31497

SEQ ID NO: 71138 - DNA, 201 bp, Bos taurus; identical to SEQ ID NO: 31498

SEQ ID NO: 71139 - DNA, 201 bp, Bos taurus; identical to SEQ ID NO: 31499

SEQ ID NO: 71140 - DNA, 201 bp, Bos taurus
attgaaagtaaaattcttaaagtcctccatgcctctctagtttgtctggctatctgcatgtgtgcatttatataaccacactcccatgaaccctcaaaatygtaatctgcaaacaggcctgatccaacatctcctctggaagcccactctccctgaccttgacccatctggggactgacatgctgaacagaagtcctactg

SEQ ID NO: 71141 - DNA, 201 bp, Bos taurus
accctgtagaatcaagtggttgatttcttcatgtgctgctgtattatttcagttgggcagcagtgggcccacatgcctcacactagaccacctcagatcakgtatgccttttcctttgggaactaagcaagaatcatgccggaagagcttgaaaacacaagctgtagctttatttgaagtgccactgtccagagagaagta

SEQ ID NO: 71142 - DNA, 201 bp, Bos taurus
aagccagtgtcagtggtgttgacatgcattgacaggacatggacaatcatttgctccaggatggaacaggtgaggtacaggtgaaatctggcatccgaatrgagatctgctgtggtggaggactgctccccgaggggatccaccagattctaactgtggggtgcaggggttataggtgttcttttcagggtgtgcgggagt

SEQ ID NO: 71143 - DNA, 201 bp, Bos taurus
gacactccaaatttcttcaagttgatgcaccatatatttggattatttctcttaaaaaatttttttagtgccattaaagttcagtcctctgaatttccaayatctcttagattcatggacacttgaaaagtatttgcagtatctggaatgcttgtgtattgtgcaagactttctctggtttcaaacattgtctggacctgg

SEQ ID NO: 71144 - DNA, 201 bp, Bos taurus; identical to SEQ ID NO: 31504

SEQ ID NO: 71145 - DNA, 201 bp, Bos taurus
ggccagaggggcaggatcagattggtttttttcaatctccaagtgtgtgggaggaattttcccagaaaaacgagagattagaacaacaaaagaggtaagtratatagaagaatgtaaggccaattaggtgctgtattcatagtatttcttattaatttcaaagggagtagctgtcagaaacaaaccaatttattaaagtag

SEQ ID NO: 71146 - DNA, 201 bp, Bos taurus; identical to SEQ ID NO: 31506

SEQ ID NO: 71147 - DNA, 201 bp, Bos taurus
tccaaagtccagcaaaagagcaattgtggttatgttgcatatgtcagtgtttcctaaactaatataaaacagtaaaggtttttaacagagcaaatattaayatcctctaaactgccatcatacaaaacagactgagaaagtaggttgtagtcacgtggaaacttgtcttcttgaatgttgaactcaacaaaatgaagggaa

SEQ ID NO: 71148 - DNA, 201 bp, Bos taurus
tgtagggtctctgactggatattaaatgctttgtcctaagaatgacataccctctgttcacattttgcccagatcaagtcacatggtcccattcccactayaagaaagccaggaagtacagttctatcatgttaccaggaggcaggaagctgagaatatttggtaaacagcactgctgactaccacatgaccttatttgca

SEQ ID NO: 71149 - DNA, 201 bp, Bos taurus; identical to SEQ ID NO: 31507

SEQ ID NO: 71150 - DNA, 201 bp, Bos taurus; identical to SEQ ID NO: 31513

SEQ ID NO: 71151 - DNA, 201 bp, Bos taurus; identical to SEQ ID NO: 31514

SEQ ID NO: 71152 - DNA, 201 bp, Bos taurus; identical to SEQ ID NO: 31515

SEQ ID NO: 71153 - DNA, 201 bp, Bos taurus
ccctgaaactttgcttcctacataaaccttccattgcctttatggtgaaagcaactttaaaccacattcaacattcagagcacttgtccactatagagaayaggggtcagtggataacaccctataggacacagagacacagtgggttaccttgtagattttgcaatggcagagtcataatgcctccggctgcagctgctg

SEQ ID NO: 71154 - DNA, 201 bp, Bos taurus
tcatccccgggggagcacaacataatgattgatcccagtgaagttgcactcttaggaaagacaactccttgcataatttaaatgaataggccaaggatgayttaaagaaatagaaataaaggatggcactgtggttggttaatattaatgagaaaggggagggggcccataactaaggcagagttggaaactgagctcact

SEQ ID NO: 71155 - DNA, 201 bp, Bos taurus
ccccttttgcgttatctgggagctatttattgccaagttcatgcctaaatggttcctgagcaggaaacaggtgaccagtgccagagcaggtggggccacargctccctgtcccatcattacattggttgtggtttgcctgtggttatttttttttaatgtattcatgcctgaaaagtgaatttgatatgacacatgataat

SEQ ID NO: 71156 - DNA, 201 bp, Bos taurus; identical to SEQ ID NO: 31516

SEQ ID NO: 71157 - DNA, 201 bp, Bos taurus; identical to SEQ ID NO: 31517

SEQ ID NO: 71158 - DNA, 201 bp, Bos taurus
tggcaagatggcggccagcagctctaggcaagagcatgtcactatttatggataactcaggatagccctaaccagcccaaattggggcttgtttctcaccytggaagaaagaaatctctggccaagggccagggccatgagttggattgggccttagtcacaggcttctatggaagctgggatgaagaaatgtcccttaga

SEQ ID NO: 71159 - DNA, 201 bp, Bos taurus; identical to SEQ ID NO: 31521

SEQ ID NO: 71160 - DNA, 201 bp, Bos taurus
cttttagagggagaaggatacttaacacagagagatgggaatatttctcagagattgggaggggcagatgtctgtgggtttgggaatggttcatttttccrtgtggggattgcagagaggcatcaggtccttatgactagggttcccatcatccctgaaggttcccaaatcccaaatgtggtgtggatgaagcagaggcca

SEQ ID NO: 71161 - DNA, 201 bp, Bos taurus; identical to SEQ ID NO: 31523

SEQ ID NO: 71162 - DNA, 201 bp, Bos taurus; identical to SEQ ID NO: 31524

SEQ ID NO: 71163 - DNA, 201 bp, Bos taurus; identical to SEQ ID NO: 31525

SEQ ID NO: 71164 - DNA, 201 bp, Bos taurus; identical to SEQ ID NO: 31526

SEQ ID NO: 71165 - DNA, 201 bp, Bos taurus; identical to SEQ ID NO: 31527

SEQ ID NO: 71166 - DNA, 201 bp, Bos taurus; identical to SEQ ID NO: 31528

SEQ ID NO: 71167 - DNA, 201 bp, Bos taurus; identical to SEQ ID NO: 31529

SEQ ID NO: 71168 - DNA, 201 bp, Bos taurus; identical to SEQ ID NO: 31530

SEQ ID NO: 71169 - DNA, 201 bp, Bos taurus; identical to SEQ ID NO: 31531

SEQ ID NO: 71170 - DNA, 201 bp, Bos taurus; identical to SEQ ID NO: 31532

SEQ ID NO: 71171 - DNA, 201 bp, Bos taurus; identical to SEQ ID NO: 31533

SEQ ID NO: 71172 - DNA, 201 bp, Bos taurus; identical to SEQ ID NO: 31534

SEQ ID NO: 71173 - DNA, 201 bp, Bos taurus; identical to SEQ ID NO: 31535

SEQ ID NO: 71174 - DNA, 201 bp, Bos taurus
attttgtctattagcccattttttctttgcttttctgatgaaagatgtgatattgtcaggctaaatattgatgataaatctgaaaaatacaacatagagtmatttcaatatttaaaacagtgtgcccagagttagttgctgggccctaattccaatggagtgctgaaatagaaactctgtaactgcaatagagactggagt

SEQ ID NO: 71175 - DNA, 201 bp, Bos taurus; identical to SEQ ID NO: 31537

SEQ ID NO: 71176 - DNA, 201 bp, Bos taurus; identical to SEQ ID NO: 31539

SEQ ID NO: 71177 - DNA, 201 bp, Bos taurus; identical to SEQ ID NO: 31540

SEQ ID NO: 71178 - DNA, 201 bp, Bos taurus; identical to SEQ ID NO: 31541

SEQ ID NO: 71179 - DNA, 201 bp, Bos taurus; identical to SEQ ID NO: 31542

SEQ ID NO: 71180 - DNA, 201 bp, Bos taurus; identical to SEQ ID NO: 31543

SEQ ID NO: 71181 - DNA, 201 bp, Bos taurus; identical to SEQ ID NO: 31544

SEQ ID NO: 71182 - DNA, 201 bp, Bos taurus; identical to SEQ ID NO: 31546

SEQ ID NO: 71183 - DNA, 201 bp, Bos taurus; identical to SEQ ID NO: 31547

SEQ ID NO: 71184 - DNA, 201 bp, Bos taurus; identical to SEQ ID NO: 31548

SEQ ID NO: 71185 - DNA, 201 bp, Bos taurus
agaggataagattggcgcagggtaaaataggcagtgatgaccctctattgtgtttgactaaaatggtacaggcatagacatcagagcttgctggtcctctkctggttaagggtccacagtcctgtagctgattgatgtgtaaagttctctggtgacatctcatggcagtgtatctctgtgcttatctctctttttttggtt

SEQ ID NO: 71186 - DNA, 201 bp, Bos taurus
aaagagatgcaaaaatgaggcttgaagaccataacttttaggggtggggaaggggaggaaccagaaaagaagactgaaaagcagcagggagaggcaaagakgaagaaagaaaatttggagtgtgtagcatcacaaagccaagaaagaagaggagtagtggttaaaatatgtgtaatgtgactgacaattagactaaggtga

SEQ ID NO: 71187 - DNA, 201 bp, Bos taurus; identical to SEQ ID NO: 31552

SEQ ID NO: 71188 - DNA, 201 bp, Bos taurus; identical to SEQ ID NO: 31558

SEQ ID NO: 71189 - DNA, 201 bp, Bos taurus; identical to SEQ ID NO: 31559

SEQ ID NO: 71190 - DNA, 201 bp, Bos taurus
ctccctaaatgttaatactcttcactgtcttatcattaatcttcttgcttgttaagttgaagtatttcatccatgttcatggttttaaattgtcctctcaygctgtgttccccagtacctgtctgtggtccagacttcttaatgcctctcagattcatatttttgattgcctaaccaacttccatggaaatctcagtctgc

SEQ ID NO: 71191 - DNA, 201 bp, Bos taurus
ttgaatgtggagattcttacaaataatatcatcctgagaatccgtggttgagcaactaatcacacactatgtgtctgacatctccaacaagcaccaccagmtccatatatacaacttagcaagaaatactggactcttctccttcctggatatacacaaacacacatacactccccccacaagatacagctgactcctttc

SEQ ID NO: 71192 - DNA, 201 bp, Bos taurus; identical to SEQ ID NO: 31560

SEQ ID NO: 71193 - DNA, 201 bp, Bos taurus; identical to SEQ ID NO: 31565

SEQ ID NO: 71194 - DNA, 201 bp, Bos taurus; identical to SEQ ID NO: 31566

SEQ ID NO: 71195 - DNA, 201 bp, Bos taurus; identical to SEQ ID NO: 31567

SEQ ID NO: 71196 - DNA, 201 bp, Bos taurus; identical to SEQ ID NO: 31568

SEQ ID NO: 71197 - DNA, 201 bp, Bos taurus; identical to SEQ ID NO: 31569

SEQ ID NO: 71198 - DNA, 201 bp, Bos taurus; identical to SEQ ID NO: 31570

SEQ ID NO: 71199 - DNA, 201 bp, Bos taurus; identical to SEQ ID NO: 31571

SEQ ID NO: 71200 - DNA, 201 bp, Bos taurus; identical to SEQ ID NO: 31572

SEQ ID NO: 71201 - DNA, 201 bp, Bos taurus; identical to SEQ ID NO: 31573

SEQ ID NO: 71202 - DNA, 201 bp, Bos taurus; identical to SEQ ID NO: 31574

SEQ ID NO: 71203 - DNA, 201 bp, Bos taurus; identical to SEQ ID NO: 31575

SEQ ID NO: 71204 - DNA, 201 bp, Bos taurus; identical to SEQ ID NO: 31576

SEQ ID NO: 71205 - DNA, 201 bp, Bos taurus; identical to SEQ ID NO: 31579

SEQ ID NO: 71206 - DNA, 201 bp, Bos taurus; identical to SEQ ID NO: 31580

SEQ ID NO: 71207 - DNA, 201 bp, Bos taurus; identical to SEQ ID NO: 31581

SEQ ID NO: 71208 - DNA, 201 bp, Bos taurus; identical to SEQ ID NO: 31582

SEQ ID NO: 71209 - DNA, 201 bp, Bos taurus; identical to SEQ ID NO: 31584

SEQ ID NO: 71210 - DNA, 201 bp, Bos taurus; identical to SEQ ID NO: 31585

SEQ ID NO: 71211 - DNA, 201 bp, Bos taurus
gtccccaagaaatgaaatatgtagtgtaccataatcacttaagaaaatttatacttacaattttaattaaaaggcagaaaaatattaaaagtggtctgttyatgtcctcacaaaaatatgagtagtgatcttttcagagggtgatggaaagtgttaagagaggatttttgtgagaggataaagctttatagagaagctata

SEQ ID NO: 71212 - DNA, 201 bp, Bos taurus; identical to SEQ ID NO: 31587

SEQ ID NO: 71213 - DNA, 201 bp, Bos taurus
ggtcggggtccttggctaaggggagactctgccttgggcccaccggtgtaataaactgcactccactatctgcattgtccttctgagtgagtttgtttccyggaactcgtggctacaacaaaaattggaaaggagcagagaattactgctgtaaaatgagtctggaactttttaactttttctgtgttcaaatctgatctc

SEQ ID NO: 71214 - DNA, 201 bp, Bos taurus
tgcaacatataagcaaaacttaataaaaagaatataaagaatgtcaggagcttctttacctcaaaaaatcaaaatgttgccatctttgggcatctgagatrgggacattctgagccgctcagagaggaatagctctgatctcagtctgcagtgcttgagagtttgacctcaggcaaagaaaacacatgctacttcttgaga

SEQ ID NO: 71215 - DNA, 201 bp, Bos taurus
cagtattcttgcctggagaatcccatggacagaggagcatggtgggctacagtccgtggaatcacagagtcggacacaacttaggtgacttagcatgaatrcactcaaactattatagtatctgtttgagagttggctttatacagaacacatattgtaacaccctctcaggcaatgagctgccttttgtactaacacata

SEQ ID NO: 71216 - DNA, 201 bp, Bos taurus
acgggtacaaaattcctgacacaagctgttttaaaagtagcttaccttttgaagaggggttatagaaaatttgtgaatttttcaaggtatcagtcaaaatktgagtaattcagtcatttgaattttctaggacttagtctccactctcattaatgaactttgtgaattctttaataagccaatttggcaactttgcttgag

SEQ ID NO: 71217 - DNA, 201 bp, Bos taurus
agttaaacatcagtaaactgtatatagaagtaatcttcctcatccttttctctgttaaatactagcatattcaacagtgaaaggctaaacactttctaagrtcagaaacaaggcaacaatatctattcttacttattctgattaatatcatagccaatgaaataaggcaagaaagtgagataaaatacaaaattattggaa

SEQ ID NO: 71218 - DNA, 201 bp, Bos taurus
tcctgacccctttctaaaaattgttcttctcattattttcttgtttccatccttgatacatttctttgagaatctttttggctacttaacagctgccaatkaggattttaatttcaccatcatgatttcaattcctctcaggccttttctcactcttttaatcatttcattctctctttatttcagttttgttgcatctac

SEQ ID NO: 71219 - DNA, 201 bp, Bos taurus
attatttatgtgctttccttattgtgtttcttccccttcaatatgtccccagggcatccatctttctgggggtttcattaggtttccctgagaatagttakagtaagacatgaactaacattttgcttttggcattcaaaataggattttgcagtgaaacaatgaccctcctagcaaggacattttcttgagagaagattt

SEQ ID NO: 71220 - DNA, 201 bp, Bos taurus; identical to SEQ ID NO: 31589

SEQ ID NO: 71221 - DNA, 201 bp, Bos taurus; identical to SEQ ID NO: 31590

SEQ ID NO: 71222 - DNA, 201 bp, Bos taurus; identical to SEQ ID NO: 31591

SEQ ID NO: 71223 - DNA, 201 bp, Bos taurus; identical to SEQ ID NO: 31592

SEQ ID NO: 71224 - DNA, 201 bp, Bos taurus; identical to SEQ ID NO: 31593

SEQ ID NO: 71225 - DNA, 201 bp, Bos taurus
gactgaaaagtttatatggtggccttaatggtgttcagacatgtattcagtccagatggtctcagtaacacattactctctcaaggctgcctccttagaayagttgctagtgtgggaacagtgggcagatgtccattccaaagacgggagggagtgaggagccttcagttgtctgagtcaagctacaggtcacctggcatt

SEQ ID NO: 71226 - DNA, 201 bp, Bos taurus
caagcaagatttaatgggcaactttcactttcaatgacaaagcaagatttaaagaaagtgcaaaagaatgatgcagtcttctgtcgctattgaccatattyagcgaatctaatgtagcaccttagattagacgataagccattcttttatgccgttatgggggaaaaaatactaccaagtcaactggaacttggttccttc

SEQ ID NO: 71227 - DNA, 201 bp, Bos taurus
gtgcttgatgtatggtaaatactacaagtttagctttatagtaattattattgtaaataggaattcatgtgctactattgatcatttagggatttttctakattgtttagttatatcacaatagcatctctaaggatatgggatttgagaatggttgtttcgttagttgcttttacttccacaggtttacttccttagaac

SEQ ID NO: 71228 - DNA, 201 bp, Bos taurus
cccctcggccccagccataggtctgtgtgggtctaattctagtcctcaggcccaagggaaggaaccctcttcccttccaggcccctgggtttcaggccacktgacaataacctcacagttaccttcttctctcttgctgaagttctccatgggtcataggctaggaagcccaggtcataactatgacctccagagaagtac

SEQ ID NO: 71229 - DNA, 201 bp, Bos taurus
atcagtagtgtgaagttgccacaagaaagtgatatgcgtgtgcgtgcgcccacacacacacacacagaggggctacatttccctaccttccttccatctargatccagccagagccatgtgtctactctttgtagaatgaatgaacagaaatgatacagatcacttctggcccaaggaaatcaagaagaaaatgcttcctc

SEQ ID NO: 71230 - DNA, 201 bp, Bos taurus
gttgcatataatattgttaaaactttcacagcttaagtctagtgagacacttataataatttcatcatgaggcaacttttaatactctttaaaattattayagggatacatctaaatgacagggttgcactggggatcagaggatggacagtacatgatctaagcgcaaagtgaggttttttgggaaacagtggtggtact

SEQ ID NO: 71231 - DNA, 201 bp, Bos taurus
acaaataagtgacaagggctgataaatagtgggaaaaatgaagttaatgaattgtcagtgaacaagggatccaggctgataggaagatggtgatcagagtrgaatgacggataaggtgttagctcaggtcctccttcaggtcctcctagaagctgggaaagattgagggcaggaggagaagggtgacagaggatgagacgg

SEQ ID NO: 71232 - DNA, 201 bp, Bos taurus
ttcaaggacatggttcacagaattttcagactctctttgatgtccgccaatgggtgttttagtcaaaacccaggggaaagaatttcagtccaagaccctgygtctcatcaagtgtgctttctccaggaactagctgactattcagaacaccacaccaaaggaagcaggaacacatgctaataaacttaattaactcattta

SEQ ID NO: 71233 - DNA, 201 bp, Bos taurus
gaacgctgtgcagagtctctggaaagccttggcggaaagttagcacaaaacacgagggttgtgaagcaaggccagatcttccgtggccaaggactattctycatttgaaaaacagctcctggtaccactgagacctcatagaacttgactgatcttgggccatcaactgactgtacaagtgactatgagaactgcccacta

SEQ ID NO: 71234 - DNA, 201 bp, Bos taurus; identical to SEQ ID NO: 31602

SEQ ID NO: 71235 - DNA, 201 bp, Bos taurus; identical to SEQ ID NO: 31603

SEQ ID NO: 71236 - DNA, 201 bp, Bos taurus; identical to SEQ ID NO: 31604

SEQ ID NO: 71237 - DNA, 201 bp, Bos taurus; identical to SEQ ID NO: 31605

SEQ ID NO: 71238 - DNA, 201 bp, Bos taurus
aaggaaccaagggttctagatctggggcaaagcagtaactagatgattactagttacctttttctgtgaggaaataaagatgtgctccagtggccaaagtygtaacatttaaagcatcaaaaggataacttaagcaaagaccctgaatcaatgaaactcatgggcccataatacaccataaagagaaagtcaaggagaaaa

SEQ ID NO: 71239 - DNA, 201 bp, Bos taurus; identical to SEQ ID NO: 31607

SEQ ID NO: 71240 - DNA, 201 bp, Bos taurus
gaccttgagaaaccagatggattagaaatactgaatgtcagaactggaaggaaccagttctcaccttccacagtgccctcttacctacctccctcttattktgtaataaggaaactgaagaagagagtactttaggtgacttgccaaaacctaataaaactgttagtgacaagccaagaatagagggcagggtcacattgc

SEQ ID NO: 71241 - DNA, 201 bp, Bos taurus
catccctccccttagactgaagcgggatttgggacgtattcaggaaccaggatttggggggcagaggtctgtgatactggggaaactgacactgcagtggrgcaggaagcggagactagagctccccgaaaaaatctctatttgggagggggtgggggctgagggacaccaagtgagaagtagagctaacctgctaaagct

SEQ ID NO: 71242 - DNA, 201 bp, Bos taurus; identical to SEQ ID NO: 31609

SEQ ID NO: 71243 - DNA, 201 bp, Bos taurus
gtttcaaaatgatcagtttggaaggctatattgtggttatttggttttaaggttcatttttcaaagtaatacattcctataagaaaagttcaaatagaagkatttataataaaaaatcagtggccttttgccacactcttcacctgcacctagtcccactgttcagagacaagttactttaactgtttctgtttatagttt

SEQ ID NO: 71244 - DNA, 201 bp, Bos taurus; identical to SEQ ID NO: 31610

SEQ ID NO: 71245 - DNA, 201 bp, Bos taurus; identical to SEQ ID NO: 31612

SEQ ID NO: 71246 - DNA, 201 bp, Bos taurus
ttttcatgtcatcacgtttcccacaatgattttttacaaacatcaaaggaagttcctcttgttagccagaatttaagtttacattaaaggaaggggacccmaaaaaaaaaaccccacgttaaatgaaaagttaatctacagcaccactgtctacacctccttcttctcaaccacatcaagtacaggaagaggaacagacaa

SEQ ID NO: 71247 - DNA, 201 bp, Bos taurus; identical to SEQ ID NO: 31613

SEQ ID NO: 71248 - DNA, 201 bp, Bos taurus
caaatctatatagtagtatcaaactgggcttcactggagtcagagggttgataaacactagaaaatcaagagcagctctctgcttaaggacatgtgatgtyattacgtatttttttaaatgagttaaaaaaatatatatttaaaacattttactggggcgggggccagtgggtaggttgtagagcttttaaagtaaatatg

SEQ ID NO: 71249 - DNA, 201 bp, Bos taurus; identical to SEQ ID NO: 31615

SEQ ID NO: 71250 - DNA, 201 bp, Bos taurus; identical to SEQ ID NO: 31616

SEQ ID NO: 71251 - DNA, 201 bp, Bos taurus; identical to SEQ ID NO: 31617

SEQ ID NO: 71252 - DNA, 201 bp, Bos taurus; identical to SEQ ID NO: 31618

SEQ ID NO: 71253 - DNA, 201 bp, Bos taurus; identical to SEQ ID NO: 31619

SEQ ID NO: 71254 - DNA, 201 bp, Bos taurus
tatttatttatttatttgtagttgcactgtgtcttcattgctgtgggagccttcttccagtggcaacaagtaggggttactcttggttgcaacatgctggyttctcattgaagtggcttctgtggttgtggagcactggccctaggagcgtgggcttcagtagttgtggtacatgggcttagttgtcctgaggcatatggg

SEQ ID NO: 71255 - DNA, 201 bp, Bos taurus
tctctgatgactgacaggtcctaactcaattaggcaaacgcagcttatgactcactcctaatgttccccaggtagggccactcagagtcctgtcactgtcrtttggcattccaaaaggccttaagctctcaggaacaaaagcaatagctcccacagagaggaagagaacttttattagtcaagggtaagagtgggatgcaa

SEQ ID NO: 71256 - DNA, 201 bp, Bos taurus
aaagttaaaaaaaatgcagttagtaatatttaagaactttatgaaaaaacaaaacagaaacagacctgatatggagtcaaacttgttcttccctattatartatcagcccatgatgaaaatttggtagaagctccaagaccaagggttcagtcactgcacctcacagtccccctgttggcagttatcccagctttgttcgt

SEQ ID NO: 71257 - DNA, 201 bp, Bos taurus
gctctccaaggccagtaccacgtgttgagaattcagctggcagcacctctaaactacacgtggccaaagaggtaacctataaattcccatcaacactttamgttgcacgatatttcctttggattgatagcactcctcaagtgaggccactcccccactattgattcaaccttctagtctgtttctctgtccttgttgcct

SEQ ID NO: 71258 - DNA, 201 bp, Bos taurus; identical to SEQ ID NO: 31621

SEQ ID NO: 71259 - DNA, 201 bp, Bos taurus; identical to SEQ ID NO: 31622

SEQ ID NO: 71260 - DNA, 201 bp, Bos taurus; identical to SEQ ID NO: 31623

SEQ ID NO: 71261 - DNA, 201 bp, Bos taurus
ttccatgcactttagaaacttcactaattagagtctgagggttttttttttttctttagtttttttttttaattagaatagaaatccttacattcattgayagccttgcaataatactcaagctatattagttatgctattttatctcacgcctcagttttttcatctgagcaacttcaacatatgcaccaaacactcatt

SEQ ID NO: 71262 - DNA, 201 bp, Bos taurus
agtatgtgcactgagccaaaggaagtcacacggtgctatttcccccatggctagactgcacagcggtggggcggaggatggccccagggactcagtcatcrgactcacacctgatggcactgggaccctaatgctgaaggacaaggaggctaagaaaggagccattacactggcaaggatcatcgacccagatggccacag

SEQ ID NO: 71263 - DNA, 201 bp, Bos taurus; identical to SEQ ID NO: 31630

SEQ ID NO: 71264 - DNA, 201 bp, Bos taurus
cttggtgatagtaccatgagtgcatggtattggtggaggccatgaagggactcccaatcaaaatcagctcttaagcttctcaggagacaacttacaccatyctgggagcaaagccagcccttcccctgaattaacagtgctgtgggaaacaaagcctaccaaacactactggtatggtgtggttcattctcatggtcaatg

SEQ ID NO: 71265 - DNA, 201 bp, Bos taurus; identical to SEQ ID NO: 31632

SEQ ID NO: 71266 - DNA, 201 bp, Bos taurus
tgttatattggtcaattaaaacatttgttctgtttgaaaaatcaggaactgagctcctgtaaatgcctcttattattttgctggccctgaaaataggggcrtgtgtgtataaaatcccttactggaaggagttaatgatctggtaggcatacatactgatatacagatgataagcagcatatgatagctaatagaactgtg

SEQ ID NO: 71267 - DNA, 201 bp, Bos taurus
cactttcaacttatatatgaatcccgtgaaatgagggggtccaaatgggatctcagtgttccttattcttcactggccatatcagcattttcttgcttacytcagttcagttcagttcagtcacttagtcgtgtctgactcttttcgaccccatgaatcgcagcacaccaggcctccctgtccatcaccaactcctggagt

SEQ ID NO: 71268 - DNA, 201 bp, Bos taurus; identical to SEQ ID NO: 31635

SEQ ID NO: 71269 - DNA, 201 bp, Bos taurus; identical to SEQ ID NO: 31636

SEQ ID NO: 71270 - DNA, 201 bp, Bos taurus; identical to SEQ ID NO: 31637

SEQ ID NO: 71271 - DNA, 201 bp, Bos taurus
atgcaatatgattgcttatataatatttttgatatatacgtatgcagaaaatagctacagttattggctttatatagtagagatgatgaattttatgggtkatctctgactctttatacttttaatgtttttcaaattccttaccatgaacacatattaattttattttataaatatgatgatatctttaaatatagcaca

SEQ ID NO: 71272 - DNA, 201 bp, Bos taurus
tcttttaatttggctgcattgggtcttagttgccaaatgtgagactcagttccctggccaaggattgaacccaggccccctgcgttgggagcactgagccrtacccactgaactgctaggaagttcctacaagtcagttttggtaactttccttcatactgcgtgccaatcaggaaccagttctgactctaccaacagctc

SEQ ID NO: 71273 - DNA, 201 bp, Bos taurus; identical to SEQ ID NO: 31638

SEQ ID NO: 71274 - DNA, 201 bp, Bos taurus
ttgtgtcttatataaatttcaggtctccgtgatatcagggagtgtatgccccgatgggatggtgtgttgtggagctgcgctctgccacccgcacagcattrtcagtcttcttggtttaatttgctgctgtttatgctggtttaaaatgacctcctcctaggtctctctggctccagtaaattacgcacaggttgccgaggc

SEQ ID NO: 71275 - DNA, 201 bp, Bos taurus; identical to SEQ ID NO: 31639

SEQ ID NO: 71276 - DNA, 201 bp, Bos taurus; identical to SEQ ID NO: 31640

SEQ ID NO: 71277 - DNA, 201 bp, Bos taurus
tattgtaaataatgctgtaacaaaattaagaatttgaaaatacttaactgaaattctaaaatgatggtcataagaggttataagtggaagttagttttatmcctgctatcattactattgtttttcacaactattatagtaataaggaaaaggtgaacagagtagtttgaaactgagctttaagtgaggaaatgaagaaat

SEQ ID NO: 71278 - DNA, 201 bp, Bos taurus
ccaatattctggcctagagaattccatggactgtatagtccacggggtcacaaagagttggacacgactgagtgactttcacttcatttatataaggcagmgtctctgatggattgcaaaaatggccagaaattgctgcaccacttatatttaaagctttcaacatcacttcataccagctcccattaagaagaatctttg

SEQ ID NO: 71279 - DNA, 201 bp, Bos taurus; identical to SEQ ID NO: 31643

SEQ ID NO: 71280 - DNA, 201 bp, Bos taurus
gaaggaggcttacagtaaggctgatggagcctaagtttcaggacctttcacttgatggggtctctcccacgtctctggggagagccccagcaatgtgttayggccatttgtgtttgcaaggttggtaaaagtaagatatttaagtgcagttgggatgactgtctcttcatcctgctttgtcctcttttggtgtcaggcagt

SEQ ID NO: 71281 - DNA, 201 bp, Bos taurus
aaaagcataactgcaaattttaaaaaaatgctttgtagaggatggtttccatttgtaattattactgaaaagcatgtggtcttgtgggccctctcatagcygttcacaagggggtggacctgtgaagaggtctggacagtgtacctggttttaaaccaggccctgtggggatatgagcggacactgccatcagctgggaac

SEQ ID NO: 71282 - DNA, 201 bp, Bos taurus; identical to SEQ ID NO: 31649

SEQ ID NO: 71283 - DNA, 201 bp, Bos taurus
atcttaaataacgacagagaagacggttcacacaaagtccgtattgggactaagtctgtcagtcaaggtgaacctgatcattcaaatggaaacagagggckttgaaggcagagaagcaggatgtctatgacaactggtcagctctccaaatcggctttactctctgaggtatctattccatgcagcatcaggctcccaaag

SEQ ID NO: 71284 - DNA, 201 bp, Bos taurus
ctatgaagagtggctcagagcagtccagctgggttggtgaggaaagagctatgaaccagtgtggcaagtggggagggagaaagagagagagagaaggcccrgaagtaacagagagagagatctggagaaggaggagactaagtaagaaaggaggaagggaagaaaaaaggatctagaaatagaagcaaagagcacactgtt

SEQ ID NO: 71285 - DNA, 201 bp, Bos taurus; identical to SEQ ID NO: 31651

SEQ ID NO: 71286 - DNA, 201 bp, Bos taurus; identical to SEQ ID NO: 31652

SEQ ID NO: 71287 - DNA, 201 bp, Bos taurus; identical to SEQ ID NO: 31653

SEQ ID NO: 71288 - DNA, 201 bp, Bos taurus; identical to SEQ ID NO: 31654

SEQ ID NO: 71289 - DNA, 201 bp, Bos taurus; identical to SEQ ID NO: 31655

SEQ ID NO: 71290 - DNA, 201 bp, Bos taurus; identical to SEQ ID NO: 31656

SEQ ID NO: 71291 - DNA, 201 bp, Bos taurus; identical to SEQ ID NO: 31658

SEQ ID NO: 71292 - DNA, 201 bp, Bos taurus; identical to SEQ ID NO: 31659

SEQ ID NO: 71293 - DNA, 201 bp, Bos taurus
ataatgtcttttatatgcttaaacattaaaaagaaatgtcttactggcctgaaatttcaagcttagcttgagattcttagttcttttttttttttttgcartaggagttatactcagtaaaaggccaaacccattggaataggagaatcctttcagaagtccagttttaaatatatttgaaaacattttcacagtatttcc

SEQ ID NO: 71294 - DNA, 201 bp, Bos taurus; identical to SEQ ID NO: 31660

SEQ ID NO: 71295 - DNA, 201 bp, Bos taurus; identical to SEQ ID NO: 31661

SEQ ID NO: 71296 - DNA, 201 bp, Bos taurus
aatgtctgtatccttaaataagagacacctccttccccatttgggagaagcaaccagaatggatcctagaactcaacagctaccaagacgcccagacctcwgccgtttgtgcagcacatgcaacatatatccaagtacacagaagccaaaggactgctttccttctttatggcttgatacacttaaaaagtttcaagctag

SEQ ID NO: 71297 - DNA, 201 bp, Bos taurus; identical to SEQ ID NO: 31664

SEQ ID NO: 71298 - DNA, 201 bp, Bos taurus; identical to SEQ ID NO: 31665

SEQ ID NO: 71299 - DNA, 201 bp, Bos taurus; identical to SEQ ID NO: 31666

SEQ ID NO: 71300 - DNA, 201 bp, Bos taurus
cagtaattattaatcacctccctttggaggtggtgtgggagggagtgtgtttattctgtggcgctatggagaactggggacacagcctcatattttgcatrtttgattcccttttattcccacacctttctctctggtcccttcctgttcccaaaagacaaccattccattgtgcttaatgtgtgttttgggaggggggtg

SEQ ID NO: 71301 - DNA, 201 bp, Bos taurus
acagcctagcccggcagaagggcgtggaccctgtccctcaggagcaggcccgcgcatgctcagtgcctcctttccgcgccagggcctgatatgggagggcktgtagagctggagtgggtatgcagtcatgtcacctggggaactctgcaagctattgctgtctgggccccacatggagacgaaattggtttggtttggaat

SEQ ID NO: 71302 - DNA, 201 bp, Bos taurus; identical to SEQ ID NO: 31672

SEQ ID NO: 71303 - DNA, 201 bp, Bos taurus; identical to SEQ ID NO: 31675

SEQ ID NO: 71304 - DNA, 201 bp, Bos taurus
ctcgccctgatgttctcagagagagcaatcgtcagagtggggtgtagcttaggaagagccaacaggtcaagttcaaaaacaaagacctggctaggcctgaytgttggggaaaacaatgggagtgttggtcacgaaatagggaaggagaaccacagagctccttggatctactttaagcccgctaaatcctaatgacaaata

SEQ ID NO: 71305 - DNA, 201 bp, Bos taurus
ctctaagtacgattcctcggccaagttcccatcatctgggaacttgccaataacacaaattaccaggctccattccacttcaactgaatcaaaaactctgsggctgggcccagacatctgtctgcactgcacccctacaagtgattctgatacacattcaaatcttacaaccatgggtctagggtaactgcttagcagttg

SEQ ID NO: 71306 - DNA, 201 bp, Bos taurus; identical to SEQ ID NO: 31677

SEQ ID NO: 71307 - DNA, 201 bp, Bos taurus; identical to SEQ ID NO: 31678

SEQ ID NO: 71308 - DNA, 201 bp, Bos taurus
cgttggtggggttcgtatggcctcagtagagtcttacctgaagacagggacttttcacttcccaaccccttccccagtgagggtcactagttgtccacttrggcctgcccaacctcagggagaatcatgcttgttgctggtcccgtgagtgaacagactcgcagtcttcttagagctgaactttggctggaccagcataga

SEQ ID NO: 71309 - DNA, 201 bp, Bos taurus
tgcccgtggtcacatggttgaactccagagagaggaagaaatagcaacactgcagaggctgccaaacctaattcaggcaccacttggccttgatgcctttwgtactgaaggatattaacataaagagactggctgactagcaagtgaggctgagcctgggcctcagcttggcaaatccagaaatttgatgtaacggctcac

SEQ ID NO: 71310 - DNA, 201 bp, Bos taurus; identical to SEQ ID NO: 31692

SEQ ID NO: 71311 - DNA, 201 bp, Bos taurus; identical to SEQ ID NO: 31693

SEQ ID NO: 71312 - DNA, 201 bp, Bos taurus; identical to SEQ ID NO: 31694

SEQ ID NO: 71313 - DNA, 201 bp, Bos taurus
gagtctggggtatgaaaccgcagggacaggtgcgctttgatcagcttccctgtgatctcacggctgtgtcctcacggacgtggccttgtgagtcctcctgytcatctctattaatacatcaccacaccgaacatattattacacatataacattatgaaacatctgcagtgtgtcaggtactgcgctaggccaaaatgatt

SEQ ID NO: 71314 - DNA, 201 bp, Bos taurus; identical to SEQ ID NO: 31696

SEQ ID NO: 71315 - DNA, 201 bp, Bos taurus
tttcattgtctgaagagtgagtaattagccactttatactgagttgtgtcccctcaaagttaatatatagaaaccagggccccagagtacatataaatgtracttttcagagataagatttatggaggtaattatattaatgtgaggtatttatagtggccctaattcgaagtgaccaatgtccttataaggagatagaat

SEQ ID NO: 71316 - DNA, 201 bp, Bos taurus
caagagagttatgagaattgtttgttttgaactgatgggtaaaatacaaactttggtaggtctcaaacattatatttagtatcaataaggttatactgtayagcgaaaggaattgtattcaatccccagggataaaccataatgaaaaataacatttaaataaaggatttatgtgtgtgtaactgagtcacttttctgtac

SEQ ID NO: 71317 - DNA, 201 bp, Bos taurus; identical to SEQ ID NO: 31698

SEQ ID NO: 71318 - DNA, 201 bp, Bos taurus
tcaccattttagcttctgtgggctctaatgtctgtgtcgcaactatttaactctgtcatgatacaagaaagtggctgcagaaaatagggaagcagtagtayggcactgctacgttccagtaagtgtcacttacacgcggcgggcctgcagcctgcagtctgccaactcccgctctgggccgaaagtaagactcaacagatt

SEQ ID NO: 71319 - DNA, 201 bp, Bos taurus
cccccgcaccctgctcagtatctgatggggctcctcctcctccaccatccccctggtgataaagggtcactctggccagccttcggcaagaatcctgtcargtcggtttagccagaatccccccgttgccttctgatatttcttcttcgtaattttccatccacagacccctaacctgctcctcggccataaattcccact

SEQ ID NO: 71320 - DNA, 201 bp, Bos taurus; identical to SEQ ID NO: 31699

SEQ ID NO: 71321 - DNA, 201 bp, Bos taurus; identical to SEQ ID NO: 31701

SEQ ID NO: 71322 - DNA, 201 bp, Bos taurus; identical to SEQ ID NO: 31702

SEQ ID NO: 71323 - DNA, 201 bp, Bos taurus
tgttccgaggaagatggatcgttttagaaagaagccctgtagtccactgtactctcgaatagcaacagtcgtgagagtaggtcttcagaactggattcctygttgtaacccagagtgcacattgtttaaaaaatttattttgaaatgtagattacagattcacagaggagttgcacagataatatgaagatctcttatgta

SEQ ID NO: 71324 - DNA, 201 bp, Bos taurus
aagaagttggcagatgcttaatttggagaaattgcttacttttgcataaaactaatttttgtaagagccaggaaaatattagaagaaattatttatgtgcytaaaaattcaaacattttggttttgaacagaggcataaagagaatacatctcatatactttggaagaaagcctcagatgtatgaaactcaaaaggaatga

SEQ ID NO: 71325 - DNA, 201 bp, Bos taurus; identical to SEQ ID NO: 31706

SEQ ID NO: 71326 - DNA, 201 bp, Bos taurus; identical to SEQ ID NO: 31707

SEQ ID NO: 71327 - DNA, 201 bp, Bos taurus; identical to SEQ ID NO: 31709

SEQ ID NO: 71328 - DNA, 201 bp, Bos taurus; identical to SEQ ID NO: 31710

SEQ ID NO: 71329 - DNA, 201 bp, Bos taurus
gagctaaatgtagtgctttgaaatgcaagcagaatactttttaagtaggcatttaattttagtggaatttgcatttggcagtcccaattcatctgtttcarcatctgagtgaaatagccctctttgaattctaatggaatgaatacagtgaaattaaccttttaccacaaaaacatactactattctaggcgaaagctttc

SEQ ID NO: 71330 - DNA, 201 bp, Bos taurus; identical to SEQ ID NO: 31711

SEQ ID NO: 71331 - DNA, 201 bp, Bos taurus; identical to SEQ ID NO: 31713

SEQ ID NO: 71332 - DNA, 201 bp, Bos taurus; identical to SEQ ID NO: 31714

SEQ ID NO: 71333 - DNA, 201 bp, Bos taurus; identical to SEQ ID NO: 31715

SEQ ID NO: 71334 - DNA, 201 bp, Bos taurus; identical to SEQ ID NO: 31718

SEQ ID NO: 71335 - DNA, 201 bp, Bos taurus; identical to SEQ ID NO: 31719

SEQ ID NO: 71336 - DNA, 201 bp, Bos taurus
gcatctcactaaagtttaaattagctattctcatatcaggcccgagtgatgacgagcacccccctcccagtaaaatgtacaaattgctgattttcacaatratgaaagcgggaaagcatagattcaattcaggagaagcttgtaaaatgtaatttcgcttttccaacctccaccccaacatgctgacaatagaaactcaag

SEQ ID NO: 71337 - DNA, 201 bp, Bos taurus; identical to SEQ ID NO: 31722

SEQ ID NO: 71338 - DNA, 201 bp, Bos taurus
cattgtggggtcctgggtcccagggcctgctctctgtcagggtgcatttaccgagggacatgagagtccatggaataataaggcttgtcccagcattgtcygggtgttggccacttggacatttatttgttgtgtgctagaagaaacttaaaaagaacgttaaagatgcatggcccaaagattaatagaagtagagaagct

SEQ ID NO: 71339 - DNA, 201 bp, Bos taurus; identical to SEQ ID NO: 31724

SEQ ID NO: 71340 - DNA, 201 bp, Bos taurus; identical to SEQ ID NO: 31725

SEQ ID NO: 71341 - DNA, 201 bp, Bos taurus; identical to SEQ ID NO: 31726

SEQ ID NO: 71342 - DNA, 201 bp, Bos taurus; identical to SEQ ID NO: 31727

SEQ ID NO: 71343 - DNA, 201 bp, Bos taurus; identical to SEQ ID NO: 31728

SEQ ID NO: 71344 - DNA, 201 bp, Bos taurus; identical to SEQ ID NO: 31729

SEQ ID NO: 71345 - DNA, 201 bp, Bos taurus; identical to SEQ ID NO: 31731

SEQ ID NO: 71346 - DNA, 201 bp, Bos taurus
ttgctctttctggacatttcctttgccttttttcctttgagtttgtctaactgttacgtaggtcaagtaatgtagaccttttgaagaccagcgaaacagcrtgttagttgtgcttgtgtataagttttaccagctcttctccgcgcactctaataagcaaaatgattttgaactaagcgtctacatacgcatattacacag

SEQ ID NO: 71347 - DNA, 201 bp, Bos taurus; identical to SEQ ID NO: 31732

SEQ ID NO: 71348 - DNA, 201 bp, Bos taurus; identical to SEQ ID NO: 31733

SEQ ID NO: 71349 - DNA, 201 bp, Bos taurus; identical to SEQ ID NO: 31736

SEQ ID NO: 71350 - DNA, 201 bp, Bos taurus; identical to SEQ ID NO: 31737

SEQ ID NO: 71351 - DNA, 201 bp, Bos taurus
gcagcgctgggttatagacccaggcgctctcactccttggcccactttcttttctttttctttgtttttacgatttatttatttcattgtttctggctgcrgtgggccttcgttgctgcacacaggctttctttaattgtggccagcgagggctattcttagttgcagagcacaggctctagggtgtgtaggctcagtatt

SEQ ID NO: 71352 - DNA, 201 bp, Bos taurus
tttcactaaacagagtcagcggcataactgcacacctgcaacaactatttaaaacgtgtaattaatttaaaaatctcatccacaatagaaacaacgagcakgagaaaagcgttaaagccttattcaggcacacgcagaaggcgacaataaacgagtcttcctgtggataagggggctccatattgcaatgacaggagttct

SEQ ID NO: 71353 - DNA, 201 bp, Bos taurus; identical to SEQ ID NO: 31738

SEQ ID NO: 71354 - DNA, 201 bp, Bos taurus
ggtgtctgtcatttgtgatgaagccctggggccaggggaccccccctggtcagtcctcccattccatgcactcattcagtataaactgagcaccttctccrtctcgggcccaggcaggcaggacccccccacccccactccctggagctttatatctcgagcagaacttcatgaacttggaaatcttctcttccattggat

SEQ ID NO: 71355 - DNA, 201 bp, Bos taurus; identical to SEQ ID NO: 31739

SEQ ID NO: 71356 - DNA, 201 bp, Bos taurus
cagcgtgggagacacagcctcagggcctgtccccagagagacagacaggagagagggcgagggagagtcccaggacctgctcagcaggaagaaaggcagcraacgcaggcctccctttctacttctcgccccttctgactcagacagttcagttaattggctcctgcctccttggccctaggaaacagggccggtggtgct

SEQ ID NO: 71357 - DNA, 201 bp, Bos taurus; identical to SEQ ID NO: 31742

SEQ ID NO: 71358 - DNA, 201 bp, Bos taurus; identical to SEQ ID NO: 31743

SEQ ID NO: 71359 - DNA, 201 bp, Bos taurus
ccgtctcctgcctccggtggcaagtggggtggggcctcgggtttcagggccagcggaggggtggcggtgggggggaacaggcccagttgaacacaggtctyatacttctgaatctcacctgccccctggctgagggaggggcagcaaagtttctgggagcccaggaggtcaggcttgtccaggcatacaagggccccctca

SEQ ID NO: 71360 - DNA, 201 bp, Bos taurus
taaatagggcccacccaccaaactgcataagctgtgggtctcagcacacctgaatctgcctctggagagtgaaagcttttccagcttctaggggttaaagktcaacagggaggcctgtttggactaattagaaacaggattgtttgaatacacctcacctctcctgagaggtgagtctcctatggaggattggagatccct

SEQ ID NO: 71361 - DNA, 201 bp, Bos taurus; identical to SEQ ID NO: 31746

SEQ ID NO: 71362 - DNA, 201 bp, Bos taurus; identical to SEQ ID NO: 31747

SEQ ID NO: 71363 - DNA, 201 bp, Bos taurus; identical to SEQ ID NO: 31748

SEQ ID NO: 71364 - DNA, 201 bp, Bos taurus; identical to SEQ ID NO: 31749

SEQ ID NO: 71365 - DNA, 201 bp, Bos taurus
tccagtattcttgccttgagagtcctatggacagaggagcagggtggcctaaggtccacggggtcagagtcagacacaagtgagcacacacacacactacrtagcacagggacctatgttcaacggcctgtgacaaaacccagtggaaaagaggatgaatacacaggtgcgtgtaactcagtgtttgctgcacaccagaaa

SEQ ID NO: 71366 - DNA, 201 bp, Bos taurus
aaggagacggacggctaggggactgacaacccggggtgggctccgtgtcagggggaagaggccagggaagcactgagtcagatgcaacaagaccaagcgtyggggaggtcagatctcgaaatggtgactgtggggacagagggggccactgggagaagaataaaaaggtttagagaagaatgaaggaggggagatagagac

SEQ ID NO: 71367 - DNA, 201 bp, Bos taurus; identical to SEQ ID NO: 31750

SEQ ID NO: 71368 - DNA, 201 bp, Bos taurus; identical to SEQ ID NO: 31752

SEQ ID NO: 71369 - DNA, 201 bp, Bos taurus; identical to SEQ ID NO: 31753

SEQ ID NO: 71370 - DNA, 201 bp, Bos taurus
aatgaagtagaagaagctacagctgagtaaacacactgggggaggccaagtcgcttgaggtgcatcgttcccaggttcagaccctgcaaaagacttctcayggcagacaggatacatccaaacgccttcccttgttcacaaggcctgcgtccagctgcatgtgctctgcaccatgcacctggcagacaccgagctccagca

SEQ ID NO: 71371 - DNA, 201 bp, Bos taurus
tatgtatagcctcaatattacaaataaaaagcagaagattgtcaggttagatttttttttgttgtgctactgcaagaaacatgctctaaatattaaaatamgaatagggtaaaataaaaggatggaattacatataccgtatttacattagtcaaaagaaagctgggatgggtatgttaacatcaaagtagctttcagagt

SEQ ID NO: 71372 - DNA, 201 bp, Bos taurus
acgttgaggccccacctccagacggcacagcgtgactgtattgggagatacggcctttaacaaggtgaccgggttacaatcaggtgtcagggcgggccctsatccagcatggtggatgtcatttcgggagaaggagccaagacacagaccacacacgggacgacccggtgaggacgcagtgagaaggcggccagccacaag

SEQ ID NO: 71373 - DNA, 201 bp, Bos taurus
ctgctaacccatcagttaattaattaatgagcaatcggcaaatggcctccagtgggggaagcgtgacttggcttccaaatgctaactattagcccccttamggagctgagacagggagggccgatcactccaggctcccagacgagctggcacacacacaccgcaaggaggctgattctcatctgcaccagcatgcttgcc

SEQ ID NO: 71374 - DNA, 201 bp, Bos taurus
taaccagtttctttaaatgaggaaaggtctgaatctctaaacatcataaccacttcaaaaaaatgtctctctaaattaaatgcaaaaacctaaatgtgatycaaataattcagtgtatgagattattattttcagtacagagggataggaattaaacagatggataaacagagaagtaaacatggacacataattagatta

SEQ ID NO: 71375 - DNA, 201 bp, Bos taurus
ataaaggggtctgagtcattggtgctcttgccagtgtttgttttaataaaggttttggttttgccaggaaggtgaggagggaaggcctcatagtggttagyacctacacctgttaatggtctcttcgtgttggttgtggggatcattgcttgcagcatattactgccgcccggtacccacgtgactctgtgacagaggcct

SEQ ID NO: 71376 - DNA, 201 bp, Bos taurus
catgacagtgcctgcctggggactgacagcattcctcggggtgggggggcgggggacagactggttcttcaggtcattaacatgaagctgacattggtgcyctttgcaaccgttgacaaccaatgccgctgtgcacagggagccagactgcacttactgtgtgaggtctgatttgcggtttaaaaccatagacttaaaata

SEQ ID NO: 71377 - DNA, 201 bp, Bos taurus
agaattttgactttcttctcaagatgcattctgtgctaggactctctttagtacctgtgtaagaattcctctggcgggctgcttcatctgcctcttatcaycctttagggccaccggagtcacccccagctggggtgccaagcacacagggattcacacgtgtcttgtttttctgccatggagggagacagtaggataggc

SEQ ID NO: 71378 - DNA, 201 bp, Bos taurus; identical to SEQ ID NO: 31754

SEQ ID NO: 71379 - DNA, 201 bp, Bos taurus
ttgcagttggcttgaaatcccaaaggtggggaggccttgccaagaggatcccagcagcagcgtgggaagtgaagcagtatcagggttgcctcattacccgmaaagcccctccccaccattgctgatggctactgctccggcgcgaacacatgggcttgcttaactgttcttgcagcagtttctgagctccaagggcagaac

SEQ ID NO: 71380 - DNA, 201 bp, Bos taurus
ttaggtagtgagggcagagtctcattagtggggtcagtgccctcattacagaagcccagggaagtccatttgtccctctgccatgtgaggacacggagagraggcccatggaccaggaagacagctctcactgtacaccaagtgtgctggtaccttgatcttgcgcttcagcctccagaaccgagagaaataagtatctgt

SEQ ID NO: 71381 - DNA, 201 bp, Bos taurus; identical to SEQ ID NO: 31756

SEQ ID NO: 71382 - DNA, 201 bp, Bos taurus
agataatttctgactctgacagaatgaactgtgttaaaaagttacaaaactagtgtcacaaaccagtgttcttattttatatgtttaagatgtaaattccrgatggagggagttaatgtcctttcctatatcttttaacaagaaaaaatgaatcttttgggccttccctggtggctgagatggtaaagaacctgcctgcaa

SEQ ID NO: 71383 - DNA, 201 bp, Bos taurus
tgattttccctactttcttcaatttaagtctgagttaatgacaagtatatctcttacttcccacacagatttttctgtgtatttatctttcctttgactckgtcaggacctcaggtaccattacacagcagtatttctggtgaggattgctcagtattttagcatgatgaagatatgtactggtgccatttactgagagag

SEQ ID NO: 71384 - DNA, 201 bp, Bos taurus
ggggaccttcccaacccaggaatctaacctaggtctcctgcactggcaggcagattctttacccctgagtctcaggggtaactccaaagtgtatgggatgyttaaatgtatttattctagagtttacagttccttggatttccttccaatcacctccagcatgtggtgcagttatatggatatgttgtgattgtgcattta

SEQ ID NO: 71385 - DNA, 201 bp, Bos taurus; identical to SEQ ID NO: 31758

SEQ ID NO: 71386 - DNA, 201 bp, Bos taurus
caggaggccttctgcctgtggccttgtcccagagaaaccatcctccagcgttgttttctgttcgacagacctcaggtgacttcccaagaactctgttggaygccaaaggcccgagtagagatcgtctgacatttcttctcgttttacctatggccgcctctccacaatgctcatgtgtgctcaagtccagatgaagccatt

SEQ ID NO: 71387 - DNA, 201 bp, Bos taurus; identical to SEQ ID NO: 31759

SEQ ID NO: 71388 - DNA, 201 bp, Bos taurus
cctgaagctaaaatgcatatctgattgatattgagggataaagaatggagggcaggaaaaagaccttctctttcctgaacttgcaaaatcaatgcaaagcrggctttctctcacctattaatgctggctggagcaggaggtctgtggagccgtgctgcctgaaatcctggcgtggcccctgggagtctccaggcagttaca

SEQ ID NO: 71389 - DNA, 201 bp, Bos taurus
gagacaagcatgctgttcattttggaaaccacatcagactttctttaggacagcagcattcagtggatagagaatggaaaatatcaattaacctattaatkagcccagagaaactattagccagggaggtcatcaaatcgcatctgaaaagattgcctgaccgcagagaaaccgcacaaataattccttctgccagaatcc

SEQ ID NO: 71390 - DNA, 201 bp, Bos taurus; identical to SEQ ID NO: 31760

SEQ ID NO: 71391 - DNA, 201 bp, Bos taurus
agatgagccgtggggcccgggtgtctccctcagggccgctctgatgtccggtcaacagcaccttttgggtgagtgctcgtgctcctggcatggcttctccyttgagcctcagcaagcggggccgtggttccagcatccccatcttgccaatgtccacgccctcgaaaggacagacgcgccattgaatctgtgggagcctcc

SEQ ID NO: 71392 - DNA, 201 bp, Bos taurus
aggctgcagtccacggggccgtgaagagtcggacatgactgagggactgagctcacactaatcttgccgaacgagcagcagcgtgggcaggtgtaaggtgygtggggccacagacgtgctcactggtgactctcccccaagcctgggctgcggccagggatgctctgggtctgggtctggtttgtgcagcagggcatccgt

SEQ ID NO: 71393 - DNA, 201 bp, Bos taurus
ctcaggccagggctctggttcaaggcgggaatcattacatggctgggtggactgctattgtttctacctttcgatgtctggaatctttagtaaagtacccmgtctgtggccatctgctggcccttctggaacattttcccgtttgggacttaaacaactgacttttaaagataaggaaacttatggatctgccactttacg

SEQ ID NO: 71394 - DNA, 201 bp, Bos taurus
cagccatccttctgcagagcaaacgccccgagaaggagctgggaggcctcagtaccgtttacagcctgtgcagaagtatcgggccatcatttctgaccccrtcggggtcactgagttaggacccagccctcctcctctcctcgtgcctccaccactgcgccatcctccacgccccttgcagggcctcactttcccatttga

SEQ ID NO: 71395 - DNA, 201 bp, Bos taurus; identical to SEQ ID NO: 31766

SEQ ID NO: 71396 - DNA, 201 bp, Bos taurus; identical to SEQ ID NO: 31767

SEQ ID NO: 71397 - DNA, 201 bp, Bos taurus; identical to SEQ ID NO: 31768

SEQ ID NO: 71398 - DNA, 201 bp, Bos taurus; identical to SEQ ID NO: 31769

SEQ ID NO: 71399 - DNA, 201 bp, Bos taurus; identical to SEQ ID NO: 31770

SEQ ID NO: 71400 - DNA, 201 bp, Bos taurus
tgtcatgtctgtgcaggtttggggagcagagcactgactgccctttgttcctgtcttttcaaggaaagacgtgtctgtctctggagcaaggggcgggcctrctttctgttcatgatgacagtgccctgaacgcaggtccccccacaacacagctccctctgtgcagggtcagctgccctctttgtctggtagcccgccggg

SEQ ID NO: 71401 - DNA, 201 bp, Bos taurus; identical to SEQ ID NO: 31771

SEQ ID NO: 71402 - DNA, 201 bp, Bos taurus
ctggctgtgatgtctgcttgctctttcaacagtcaggcaccagaaactgcgcgttcgctcgaacttcagacacattgctttcaatatcactcgcgcccctrtagtggtgggccgtgtggagacacccctgagcagtccatctcgggtccaggcatttcctcccaactcagtgttaaaaagacaggagtaaccacagacgca

SEQ ID NO: 71403 - DNA, 201 bp, Bos taurus; identical to SEQ ID NO: 31773

SEQ ID NO: 71404 - DNA, 201 bp, Bos taurus
cacgagaagcggtgtcacccgctgcagagacactggcaggcatcagagaaggactgtcacggagaccggggtcaggcccatccctgtcattgggcaagaarcaccgacgttgcagggagcacagcagggctgctggaacgtcccgggccaccctcagaggccgcagtggggggcctggagagtagctccttggacacgagg

SEQ ID NO: 71405 - DNA, 201 bp, Bos taurus
aaaatatgaagacttcgatctctcaggtgagatgatgttctccattggagcccctctctccccaaagccaggaaataagtcaaaagatgtttatagatgcmaagtctagtataagtgaacagactgagtatcctacattatggaggcccacctgcccccgtggaacccgagaggatgcgaccgtttctaacacttcttgtt

SEQ ID NO: 71406 - DNA, 201 bp, Bos taurus
agactctggaaataagtgacaacttcctcccccgtcggcctcccccgaggatccctgcctcaccctgcagcagtggccataccccagggctccttctggaygcccccctctagagcaccccaaattcacgttcaagctgctcccaaaggcctgccgggtttccaataaaggggccgctgtcatgcacttcctgacggtccg

SEQ ID NO: 71407 - DNA, 201 bp, Bos taurus; identical to SEQ ID NO: 31774

SEQ ID NO: 71408 - DNA, 201 bp, Bos taurus; identical to SEQ ID NO: 31775

SEQ ID NO: 71409 - DNA, 201 bp, Bos taurus; identical to SEQ ID NO: 31776

SEQ ID NO: 71410 - DNA, 201 bp, Bos taurus
accatgttgctgataagcggcgatccccagtgaggctgggggggtgccttaggggggcgtcacacctgtgtgggcacccgggccgctgacatctttcccargtacatcaattacagttagagagtcataagaacgccaaaacggacttctttagcgctttggtacggaggcccttgcgtttaaaatcaaagccgttaattg

SEQ ID NO: 71411 - DNA, 201 bp, Bos taurus
tgaacacggactgtgtctgagctggcacgaggcagctccggttcccctgcgagctcggtacccgctgaggtgtgcagtctggcggtggcctgctttctggrcgtcgcctccctgctgtgtttcgcttctctctctctgtgagctgactgcgctcagggcagccttcctcccggccttccacagcctgtctccccttctctg

SEQ ID NO: 71412 - DNA, 201 bp, Bos taurus; identical to SEQ ID NO: 31777

SEQ ID NO: 71413 - DNA, 201 bp, Bos taurus; identical to SEQ ID NO: 31778

SEQ ID NO: 71414 - DNA, 201 bp, Bos taurus; identical to SEQ ID NO: 31779

SEQ ID NO: 71415 - DNA, 201 bp, Bos taurus; identical to SEQ ID NO: 31780

SEQ ID NO: 71416 - DNA, 201 bp, Bos taurus; identical to SEQ ID NO: 31781

SEQ ID NO: 71417 - DNA, 201 bp, Bos taurus; identical to SEQ ID NO: 31782

SEQ ID NO: 71418 - DNA, 201 bp, Bos taurus
tccgcgtctctgaccgcccagccccatgtggccgagctctgccctggcgtcagcaaaggaaggaaagatgaccagccgtgccaggcagatccgacctccckgctggcctcggcatgagttcagggctctctccccgcacctgctcttctgggtgggcacatggagtctctgcacagaaatatctgcatgtctgtgtcccag

SEQ ID NO: 71419 - DNA, 201 bp, Bos taurus; identical to SEQ ID NO: 31784

SEQ ID NO: 71420 - DNA, 201 bp, Bos taurus; identical to SEQ ID NO: 31785

SEQ ID NO: 71421 - DNA, 201 bp, Bos taurus; identical to SEQ ID NO: 31786

SEQ ID NO: 71422 - DNA, 201 bp, Bos taurus; identical to SEQ ID NO: 31787

SEQ ID NO: 71423 - DNA, 201 bp, Bos taurus; identical to SEQ ID NO: 31789

SEQ ID NO: 71424 - DNA, 201 bp, Bos taurus
gcgtagataagttactttagcctttctggactttctttcaagtgatacttgttaaaggtatcacttgaccacatgtccgtgaaagagtgatggtgtctgcrttccctgcaagtagaggtttctgtaaggtgtagattcctctgggtcagttgaggagatctttttggaggtgatggagctgtaatgttcctgactgtatag

SEQ ID NO: 71425 - DNA, 201 bp, Bos taurus
atcatatctatgaagaaaatattttagaattgatagagtttactaaatatgtgttctgttttctataggtaatgtggactgaactaccatgtaaaaatttycatcttcttctctgttgtgctattctggagtcagaaaaacaacaaataatggaaaaacattatggctttaatgaaatacttaaggtagttttttaattta

SEQ ID NO: 71426 - DNA, 201 bp, Bos taurus; identical to SEQ ID NO: 31801

SEQ ID NO: 71427 - DNA, 201 bp, Bos taurus; identical to SEQ ID NO: 31802

SEQ ID NO: 71428 - DNA, 201 bp, Bos taurus
agaaaatatttaagtattgagtaaagcttgtaatttttatgttcatagatttgtcaaaaagatgttatcttcccagcagcattgtgttatcaaagatgcamaccttaaatcaacagctgttacacctccagcaagttatgaatttttcctgatttatagcaatcattctttttatttcttttctcagtcaagcagggaaat

SEQ ID NO: 71429 - DNA, 201 bp, Bos taurus; identical to SEQ ID NO: 31806

SEQ ID NO: 71430 - DNA, 201 bp, Bos taurus
acttagcaactgaacaacaagatatttaacctgagtttccgtatccttacacagtacttaggaagaacacagtagctcctggaatttaggagattaaaggygataactaatatgaattaaaagatctggtaaattgtagccaggtcatctatttcacattccttacatttccttcccagaccttgatgaagcgtgttccag

SEQ ID NO: 71431 - DNA, 201 bp, Bos taurus
tggtaactgtcaaatgcagccaagtttgaaatataaggcaaaaatatagagcttggattatctgataactcatgggcttgagttatattttaatgtatttycttgtcccctagtcaggtgacttattcatttgccagtcaaggtgattcagtcttcggaagattcctatgatcctagaattgcttagttatttagagactg

SEQ ID NO: 71432 - DNA, 201 bp, Bos taurus
ctgtagccttcaagtctctgctgttttaaaaattatctggagagattaaaaaatacagatgttaagatgcgatggagtctaagatacagatgttaatgagrtcaagtaattgtgcattctcgcccattgccatgtagctagcggtgctcctgccagaataatgcatatgctccctcccagtgaaggtggatttgtcccggt

SEQ ID NO: 71433 - DNA, 201 bp, Bos taurus
tcaatttactttcccctgaggcttgcatggtaaaagtgtttgcaaaggtggggcttctaaattagaacagattctcatgaataaggttgtcttttatttaytacaaatggaagaagcagcaagtctgatagctgtctacttcaagttccggacaagaataatagtatggaagaaaaggcatgtttaattttgaacaatagg

SEQ ID NO: 71434 - DNA, 201 bp, Bos taurus
aggcagggttaggtaacagactgggtcaaggtgttattttagactagagagagagaaagatcgcacaccagctgtattctccctgaggggaatagagaaakactgtatttctttaccaagttttctagtgtcaatcaacctgagcccatacttcccccagtaattgtagatttgctttgattctgaaaataaaaggcatct

SEQ ID NO: 71435 - DNA, 201 bp, Bos taurus
tgaattatttgaagtgaggtgaacatgagtatgcaaatagagttatttatgtgaggagagagtgtgttgtatatttgggaagaaaagtgctgacagttacytagctctccaaaatgttggactgcgcagacggactgacaaaaagaatataaagcggtatgcagcttctgggaacttcccttaagagacagtaaggacaag

SEQ ID NO: 71436 - DNA, 201 bp, Bos taurus; identical to SEQ ID NO: 31814

SEQ ID NO: 71437 - DNA, 201 bp, Bos taurus; identical to SEQ ID NO: 31815

SEQ ID NO: 71438 - DNA, 201 bp, Bos taurus; identical to SEQ ID NO: 31816

SEQ ID NO: 71439 - DNA, 201 bp, Bos taurus
aatgcaacagaagtaatttcttactgctagcaatgaagttcaagtggacgaacaccatgaatatggatcaaataaggatattacggaaaagggaagtgatyattttatataacagtaaagctaatattttccttatctgaacttagaacatattaacagtctcctatttaatgaattggaaagaagactaagtaataaagt

SEQ ID NO: 71440 - DNA, 201 bp, Bos taurus; identical to SEQ ID NO: 31822

SEQ ID NO: 71441 - DNA, 201 bp, Bos taurus; identical to SEQ ID NO: 31823

SEQ ID NO: 71442 - DNA, 201 bp, Bos taurus; identical to SEQ ID NO: 31824

SEQ ID NO: 71443 - DNA, 201 bp, Bos taurus; identical to SEQ ID NO: 31825

SEQ ID NO: 71444 - DNA, 201 bp, Bos taurus
atcttccaggcaagagtactggagtggggtgccattgccttctctgattctaaaggcagatctgcttaatcaatccatgtcatttatcttcctagattgcmgtacctgttagtagtagacattcattgttcagaattgtgctattgctacttctgtttctgtacatgggcttcaagttcaaaagtaaaacacaagatcaga

SEQ ID NO: 71445 - DNA, 201 bp, Bos taurus
aaaaaactttgactattctaaagtgaaaggataccagtgtgcaactttactgtgcaagaaagctcatattcacagcctcagaagattacactacacggaamaatgaacatgcattgcaaaacaattgtgatcatttttggctatattttgtgagggtcagtgtctttttttcacaatatctcaagaaatatcttggtaaaa

SEQ ID NO: 71446 - DNA, 201 bp, Bos taurus
gaaagaaggatagctgctgtgtcaactgctttcaagaattatggagggcaggccaaggaaaaggcttaagaataatgtaatagttgttctttagttttttwaaaaaatgttctaaggcactggttatcaagactttccctatgaaaacttcaaagctcagttttcagatcccagattaagatgctggataaatgcacagta

SEQ ID NO: 71447 - DNA, 201 bp, Bos taurus; identical to SEQ ID NO: 31827

SEQ ID NO: 71448 - DNA, 201 bp, Bos taurus
tggagtggtacgcccgatggtttcctttgacgcagacgggcatttggaagatgtgtctgtgtgagttctggctgctactgctgggttccggtttgaaaggkcatcttttgcctgacgaggaggacgtaacgtttatcaatgagtacgtgaacctccacaatgagctccggggcaacgtcttgccccgaggggctaacttgc

SEQ ID NO: 71449 - DNA, 201 bp, Bos taurus
ggaaggccacagtgtagaaatgaaagaaactagacagatgtttgcaggtcagtgttacctgtgggaagttcgagtgctgtggtaatatactatgggggtgytcctacttcttccaagtggtagaagagtaaaggacaccagtgaccctcatctgggttttgcagtgcaaataatttcatgggattctatttcctcagatga

SEQ ID NO: 71450 - DNA, 201 bp, Bos taurus; identical to SEQ ID NO: 31828

SEQ ID NO: 71451 - DNA, 201 bp, Bos taurus
cagcattctagacaatatcccaggaatcagtagaaaagagctggattccaggacctgcttgggagtgtggtgaggtgctagtgatctaatcgacacattcygggttagggtcttgaagggttggcccttaggaataacagtgaaccagaagtggtccttcattggaatgagattcaagctttcaattccctcagtctcaga

SEQ ID NO: 71452 - DNA, 201 bp, Bos taurus; identical to SEQ ID NO: 31829

SEQ ID NO: 71453 - DNA, 201 bp, Bos taurus
agtagattagattattagatttagattagattcaatttagaccctattagatttttcaatattgacaccctactattgaaaatgagaaattagctttcatrtaattcaacactcaggcacatgcacacacacacacgcttttccactcatcttcccacgatcattttttgggttagatcagtattcagtattatattatca

SEQ ID NO: 71454 - DNA, 201 bp, Bos taurus
cgtgaatggaaggacggtttcactaactctttaactgaaagccttcaagtttccactcaccactggtgagccaggagtgggaagaagacatggagaaaacrgatgaatgaatgtgcaccaaagcgggattcataggccaaaagaaatattaaaggaataaaatgtggaacctaggagaaaacctcaaaggagttcacgcct

SEQ ID NO: 71455 - DNA, 201 bp, Bos taurus
gagcacacaggcacacaccgatgtcgaaggactagagtcagaactaggacttaagcccaggttgttttcaatatgatgtgcacatgaagagccttgctgcrggagtgctgacagcagcgtagaagtgaaactcaccaaatgacaacagacaaatgaatgaaataatataccagctcaatgggatttgatgctgtcattaac

SEQ ID NO: 71456 - DNA, 201 bp, Bos taurus
gataagtaaactacttctgcccagagggaaacctgccaacctcagatgcgaacggtctgcggaaaccaaaagctctggacttaccaaggtagggaatcttkagagcaaccttcccaaattaagcagaaacctcaaagcgctatgttctcagagataataaacgagttctccaggacaataccccaatccacctcatcagcc

SEQ ID NO: 71457 - DNA, 201 bp, Bos taurus
catttaaaatgttcacctgatcctgtttgatttccccagtgttctaaattgcttcttttgtcttcaaatttccatctttctcctaaagcctttcctctttytgggtttccctgtgtgaatttcccctacctttataaaactccatgcccctaacccagttattggcactgtgtatcccctcccaacaggacctcttcactt

SEQ ID NO: 71458 - DNA, 201 bp, Bos taurus; identical to SEQ ID NO: 31833

SEQ ID NO: 71459 - DNA, 201 bp, Bos taurus
ttttggaatacttgtagatgatgtagtatatttttatatagtatctttcatgatatttgatgacaattattgacacttaaactgataactgaattaacgayatggcaggcttatccttactttatgaacttgtgactaagaagcaatttgtatgacattactttgatactacagagatgtctatttcctcttcaaacatga

SEQ ID NO: 71460 - DNA, 201 bp, Bos taurus; identical to SEQ ID NO: 31835

SEQ ID NO: 71461 - DNA, 201 bp, Bos taurus; identical to SEQ ID NO: 31836

SEQ ID NO: 71462 - DNA, 201 bp, Bos taurus; identical to SEQ ID NO: 31837

SEQ ID NO: 71463 - DNA, 201 bp, Bos taurus; identical to SEQ ID NO: 31838

SEQ ID NO: 71464 - DNA, 201 bp, Bos taurus; identical to SEQ ID NO: 31839

SEQ ID NO: 71465 - DNA, 201 bp, Bos taurus; identical to SEQ ID NO: 31840

SEQ ID NO: 71466 - DNA, 201 bp, Bos taurus; identical to SEQ ID NO: 31841

SEQ ID NO: 71467 - DNA, 201 bp, Bos taurus; identical to SEQ ID NO: 31843

SEQ ID NO: 71468 - DNA, 201 bp, Bos taurus; identical to SEQ ID NO: 31844

SEQ ID NO: 71469 - DNA, 201 bp, Bos taurus
gaggggcttctctctcaataaatgattatttcattctccttactctataaatttggttactcaattttatattaacagtttccatgatgaatgtgggcttsctggtggctcagatgctaaagaatccgcctgcaatgggggaagatctcggttcaatctctgggttgggaagatcccctggaggagggaatggctacccgc

SEQ ID NO: 71470 - DNA, 201 bp, Bos taurus
ccacatggtgtcaggccctgactagcagggactgcagccacgcagcatagctggattctatgcccagtgccctggttgtcccactgatggtcttggtgaaygtgtaaactatcgctggccgtcaggtgtcagtcagtgtgtgatcatgagtagaggcaaaggccttgctagagtggctgggaaggaggtccggagaaggct

SEQ ID NO: 71471 - DNA, 201 bp, Bos taurus; identical to SEQ ID NO: 31848

SEQ ID NO: 71472 - DNA, 201 bp, Bos taurus; identical to SEQ ID NO: 31849

SEQ ID NO: 71473 - DNA, 201 bp, Bos taurus; identical to SEQ ID NO: 31850

SEQ ID NO: 71474 - DNA, 201 bp, Bos taurus; identical to SEQ ID NO: 31851

SEQ ID NO: 71475 - DNA, 201 bp, Bos taurus; identical to SEQ ID NO: 31854

SEQ ID NO: 71476 - DNA, 201 bp, Bos taurus
aacatcaattgtacacactttaattttttactacagcccctctcttatgaaaaaatatctaacttattactttagaaacaggatagagaagttaatttccyaaagtttaggtcaattcaagctttactggttctttgctacctgttctcaaagcagtccacagtctttctctagtcaatttctaagtcttctgacctattt

SEQ ID NO: 71477 - DNA, 201 bp, Bos taurus
gcttccaaaatgggtatatattactaactcatgtattctcaccaacatttagaaagtgactccagggactgtgctctgagaaatcagatactttctgggayttgtagccatgggagagagatttttaatgctttctggtgagaaaagccatttggaatcattgttggaaagaagatgcaattgtgaaaagctacagttggg

SEQ ID NO: 71478 - DNA, 201 bp, Bos taurus
aaccgctggggaattgtgagaaaagtaaaatatgttacacatataaacacacaccttcgaataagctcaatgaaagaaacaagttggccaatggttgagamtaactactggattattatgggaagatgctagctcgggtattccctattccctttgctgctcctgtctctgacccaagcagttacaaaggcttatgtgctg

SEQ ID NO: 71479 - DNA, 201 bp, Bos taurus; identical to SEQ ID NO: 31856

SEQ ID NO: 71480 - DNA, 201 bp, Bos taurus; identical to SEQ ID NO: 31858

SEQ ID NO: 71481 - DNA, 201 bp, Bos taurus
ctcctgagagaccgcaggatgcagcagaaaaggaacagcaactgacattggaaaacctggatctgaagcctttaacctttctgattctgatcatttatacygctgcagtattaatagcacggctgtggtattagcaaatgaaggaacgccaggtggaaaccagtttgacagcactatgcaagtgttggttattctaaagcc

SEQ ID NO: 71482 - DNA, 201 bp, Bos taurus
aacttttgttcaaaacacagtttaagataaggagattgctctgtggaaaacagaaaaatagtgatcctccattttacttttggctctgccagttaattgayaaatgggtaaaatgaaggagctgaaaatgatattagcttttaaacttttttcccccttaaacaatgcagtgacttccccagccatccagtatttaagact

SEQ ID NO: 71483 - DNA, 201 bp, Bos taurus
actaggtaagcagagaaaacacaactcagctgcaaagaaactcacaaaatacacacaccacaaacttccgccatgcagctaagttcactgcatgtgttatragccacactcctctgaatctggtgttacactttcaatccaacttcagatgacccttcttccatcacttcacaaattgcaaccctttggagacccacttct

SEQ ID NO: 71484 - DNA, 201 bp, Bos taurus; identical to SEQ ID NO: 31860

SEQ ID NO: 71485 - DNA, 201 bp, Bos taurus; identical to SEQ ID NO: 31861

SEQ ID NO: 71486 - DNA, 201 bp, Bos taurus; identical to SEQ ID NO: 31862

SEQ ID NO: 71487 - DNA, 201 bp, Bos taurus; identical to SEQ ID NO: 31863

SEQ ID NO: 71488 - DNA, 201 bp, Bos taurus; identical to SEQ ID NO: 31864

SEQ ID NO: 71489 - DNA, 201 bp, Bos taurus; identical to SEQ ID NO: 31866

SEQ ID NO: 71490 - DNA, 201 bp, Bos taurus; identical to SEQ ID NO: 31867

SEQ ID NO: 71491 - DNA, 201 bp, Bos taurus
cttatacatgaattttacaacgccagtgctgatgatccgccttctccagagaacccagggagttgtctaacagactgctctgttttccagcattggcgctygtttccttggaatctgccgaaaggcccaactactttctctgtgtccacgatgacgacactcttagtttgaaactgtgggaagcgaattcagcctttcatc

SEQ ID NO: 71492 - DNA, 201 bp, Bos taurus
agcatttgggtggaagggcttattttcagcttcagctgaactgctgattggtcatgtattcagttgaaaacttactaacttaaaaaatcatttagtgagaktatgtgataaaatgaaacagttcctgatctcaagtaacttgcagttgtgtgtggggtgcgtacatgtaatttttttgccaactaaaggcagcagtagcca

SEQ ID NO: 71493 - DNA, 201 bp, Bos taurus
aggtacagttccagacagacattttatgtcacaagaagctctctaaatcttgactagacttttgattcagtaagataggaaacattctacttatgaaatayggcagattttaagaagcaaacagaatctttctcttttatttttaggaggggagcacctggcactataattgtacaacatttgaatgtgttaagactgatg

SEQ ID NO: 71494 - DNA, 201 bp, Bos taurus; identical to SEQ ID NO: 31868

SEQ ID NO: 71495 - DNA, 201 bp, Bos taurus
catgatggtcaagaaaggggagaaaatgggtaaagggaagatttgagaaatgtggatatagagtggaggacagaacagagcaataactgatgtgtgttcaygtgtgtatgatgtgtgtgtgtgtgctgtgcttagtcacccagtcctgtatgactttttgcgaccccatagactatagcccaccaggctcctcagtccatg

SEQ ID NO: 71496 - DNA, 201 bp, Bos taurus; identical to SEQ ID NO: 31869

SEQ ID NO: 71497 - DNA, 201 bp, Bos taurus
agaaaatctataggttgcccaaggcttgaattgggaaatacataaagtaataagctctgcttgccttggaaagggaaaagggaagagagaaaaagtttaaygtatcacaaattttatgaaaagtatggcactcatgggattttcatttgcagtcaacttttgcgctcatttccttttcatgaggttgaaacccacaaaata

SEQ ID NO: 71498 - DNA, 201 bp, Bos taurus; identical to SEQ ID NO: 31872

SEQ ID NO: 71499 - DNA, 201 bp, Bos taurus
aggtacttttttttaacatgcaggatctcagtttctcactgactatgagataaaggttgtttaagtctccaagtcttaaaagggcttataagtgttaaagrtatcaattattcactcattgtgtgtatagtataaagaaaatgatgaaagagatgggagacatacagtaaattattacaaaactatttctttagagttgta

SEQ ID NO: 71500 - DNA, 201 bp, Bos taurus; identical to SEQ ID NO: 31873

SEQ ID NO: 71501 - DNA, 201 bp, Bos taurus
cccaacttcagtgaaatcctccctttgaacagttctgtcatctctactccttttatcagaaaaaatgcttttgtgttgggccatttttggggctgatgacygtgggagatgttgactccatttccctttcagcatttcagtaccatttttatatccagttataagaaagagttaaagctttgaggcctcatggaatttcag

SEQ ID NO: 71502 - DNA, 201 bp, Bos taurus
ttttgtagaaacatttttctcaggagttgcagttaaattatacatatccccctatacataagcattcagcatatatgaagttgggtgcagatttattaacrtataaatgaccctgttaaacttcatcttcttagatttgcatctctcttcaaaggtttcccttaaacaaaattctttatctaaacttaactacgtcttcta

SEQ ID NO: 71503 - DNA, 201 bp, Bos taurus
ctaagagtacctaagtgcaaagtggggtgacaagcagagaagcttgaaaggtgagaagaggtcagccagttgggaaaggatctcctatgacgtgccaaggrtgcgttgtgtgatcacttgaaagatcagccacccacttcaccctgagctctgagaagaaccacagtaatctcttagtcactaatgaacaacaaacatcaa

SEQ ID NO: 71504 - DNA, 201 bp, Bos taurus; identical to SEQ ID NO: 31874

SEQ ID NO: 71505 - DNA, 201 bp, Bos taurus; identical to SEQ ID NO: 31876

SEQ ID NO: 71506 - DNA, 201 bp, Bos taurus; identical to SEQ ID NO: 31877

SEQ ID NO: 71507 - DNA, 201 bp, Bos taurus; identical to SEQ ID NO: 31878

SEQ ID NO: 71508 - DNA, 201 bp, Bos taurus; identical to SEQ ID NO: 31879

SEQ ID NO: 71509 - DNA, 201 bp, Bos taurus; identical to SEQ ID NO: 31880

SEQ ID NO: 71510 - DNA, 201 bp, Bos taurus; identical to SEQ ID NO: 31881

SEQ ID NO: 71511 - DNA, 201 bp, Bos taurus
gaaaagtttcttagtagggttacagctctcatttttgttacaaaaacaactttctattttagaaagtagggctagaataatgaatgaataatgaatgtacwttttattttgagttttctgagcttctgtttctttttgtgttatcttggaaaaattttgtctttggaattacaaatattttctgaccttaaataacttgat

SEQ ID NO: 71512 - DNA, 201 bp, Bos taurus
ctgcccttcacatgggccttcactgcatgccataccttgctatatcattaccagcaactgttagagaccactaatgatatactcagccattggtcagggaygcagtgggccccttccccgagtgaggggctgttaatgagtgaccgttggtggtcctgcccagccattagtcagggccccgtgtgcccctcccccaagtga

SEQ ID NO: 71513 - DNA, 201 bp, Bos taurus
taacttttccttttttcttaggtttggccttgtgggcttaatgagggcatttggataatagattttatagatttgtgagaaacctggagatggtctatgcytggccccttgtctccagctgaggtgtagagaaccagagatgtgaaggtcacccagaaaatggaatccctagaactagaagacatatttgtgactgtcgag

SEQ ID NO: 71514 - DNA, 201 bp, Bos taurus
ccttaaaattgaatattgaacatcctggttttctgcatttctctagccgcccctggcgaggggagttcctcactggccgcttctctccgtgggtttcagcygcctttcaggcagtcctctttgctgtgctcactccaatctcaaaactcctgccatctgcttaggcaaaggcctccagacctattctactggaaggaaagc

SEQ ID NO: 71515 - DNA, 201 bp, Bos taurus
cttcccctggttcatttcaacattcctgacccatgtgatgccttcagagtttgcacttccattccagaccatgtgaactacattcttctactcataacatygacagaccatagatttttatatcatctgaaattcaaaacttctccagtcttttccataataaaatatttcaaatacctcatcagaatcctatctctctca

SEQ ID NO: 71516 - DNA, 201 bp, Bos taurus; identical to SEQ ID NO: 31882

SEQ ID NO: 71517 - DNA, 201 bp, Bos taurus; identical to SEQ ID NO: 31883

SEQ ID NO: 71518 - DNA, 201 bp, Bos taurus; identical to SEQ ID NO: 31885

SEQ ID NO: 71519 - DNA, 201 bp, Bos taurus; identical to SEQ ID NO: 31886

SEQ ID NO: 71520 - DNA, 201 bp, Bos taurus; identical to SEQ ID NO: 31887

SEQ ID NO: 71521 - DNA, 201 bp, Bos taurus
gagtttctcataggcacatattaacatatctggcagaaagtaaattctttctgctccaattaaagtagcaatttaaaacttggtgaggactagtattttgrggatcagtcttttcaagttgcatattataactaaggaccacattactaactcagaaataagcctgattgtagtattatcttggcagttacagctagctga

SEQ ID NO: 71522 - DNA, 201 bp, Bos taurus
aaatcaaaagaaggggagtcacttttataagatacctgaaaaactaggagatcttttcatttgggtgaaagaacttataacaggcataacttcatggtttygctgaagaaatatatacttaaagacttctaatcatgtttataaggaaattgatgtctccaaaagaattatggggatagaatgtggcagagacttgactgg

SEQ ID NO: 71523 - DNA, 201 bp, Bos taurus
caatccaatctacactcagcacacacacagtagttttaaagcataaaccaggtcatgtcaattacctgttacacaactttcaaaggcctttggacactggrgctcacaaagtaacagttcctgcatccttctcaaacctcatctggtgcatatcatacccctttcctggctatgctcagccacctaggccttctctctctg

SEQ ID NO: 71524 - DNA, 201 bp, Bos taurus
gttcctaattctaactaagctataattattacactagttaatatgtgatataagttctaattaatctttttattagaaaatattgtacagttttatttgaytttatttgcatttagtgaatcaaaatagtaactctgttattctctttaaggcagttcatttgaaatcatttgttggtaaatattttccattctagttgaa

SEQ ID NO: 71525 - DNA, 201 bp, Bos taurus
taatgaattttaatttcattttaaaataattttaatatatctaacgtacaaatatttcccagaatctggtcatgaaaggttgctctggtcaatatggttargaaatattttaggttaattcacctatgtaaaattattcttttaatacaaattttctacagcaacaaagtgtggtactatcagaagttatatatatatatt

SEQ ID NO: 71526 - DNA, 201 bp, Bos taurus
taataaggaatgatcttataaagtcaggttgaagttactggtggtaagaaatagaatttgcatccacattgtagtctgtgttgtatcagtctttccatatrtattcagttcagttcagttcagtcgctcagtcatgtccgactctttgcaaccccaggaaccggagcacgccaggcctccttgtccatcaccaactgccag

SEQ ID NO: 71527 - DNA, 201 bp, Bos taurus
catgaactggagcccaccaggccactctgtctatggagttttccaggcaagaatactggagtgggttgacatttcctactctaggtcccttttaaaataaygggcctaaaaagagtaatgatatgtgagaatacttttttgttagactggcattactatggatgtggaaacatttttcaatatttagttaatcttaaattt

SEQ ID NO: 71528 - DNA, 201 bp, Bos taurus
ttctgtattactgtgtatacgtttccctcaaactgctccttaaagaatagaatcttggttacaagtacccagattttagagcctatattacaattttattycagtttctgttcctaattactattgctcaaatttgtttatagtataattgcaggaaatgtggtcttttttcagatgtaaatatggctttaatgataatta

SEQ ID NO: 71529 - DNA, 201 bp, Bos taurus
ctcccccagccctcctccctcctgggagctctactgatgcctcaaatgggacatcttcaccaaatcatctgactgaagccagggattactatatctacacrggtatttcttttccaaagcaaagggttgttgagtgctatataattcagtgacctgatctttctaatgttcaaatttcagttcttcttattttcttactca

SEQ ID NO: 71530 - DNA, 201 bp, Bos taurus
catttttcaactagtcttacacaagttcaggcaaggtgctaaggaggcacaagaagggtcaggagtctattcttataagaaaggcctaagaaaatgacctyggatgctgacagtaagggattttgtggtaagtttgccattatgtttatattctatttcccttcccattcccccaaagcaagggactctaagagacaaact

SEQ ID NO: 71531 - DNA, 201 bp, Bos taurus
cttgactaagctggccttacaattccccttggcttcactaaactttacacaagtttcttcctgacctcccttttctcagagcatttactttaagcttgcarttgtgaattattgctctggccctttgagatcttttcccaatgtctcaccagttttaacaacccaggaatgtctttctcaaagactcaggagccattcttt

SEQ ID NO: 71532 - DNA, 201 bp, Bos taurus
ctgaatcaaaacatcattgtggtaatatttatgtcatcgatctctgctgattgccagatgtcttattcctactgtgaaatattcatgataaaattatttcytccagaaagtttgtgtgtttatatgcctggtggaatttattaacacatgaccacaaattaatttattggcctaataaaatattacctaataaaaaaatag

SEQ ID NO: 71533 - DNA, 201 bp, Bos taurus
cttaatctccagataagttcaccttatttagtcctccacagcaatgctacaaagtaatgtttattcctttctactctagatgagagaagactgaggcctasagagaaagtggtttacctttggtccactatctagtgagtgtaagtcagaaataaattgagatcgtctgtctccagtgactgttcttttgatttttagata

SEQ ID NO: 71534 - DNA, 201 bp, Bos taurus
ttttcacaggtgtataaatatgtcactaattaccaaattgtacactcaaaatatatgtaatgtattcaattatacctcaagaaaaataaaacatttctggygtgggcataatgttttaggaaagttggatctgagaaatggtccttgttaagagcatgtttgtatctcctcaaaattcatgtgttcaaaccccaaccccta

SEQ ID NO: 71535 - DNA, 201 bp, Bos taurus
ttaataatgacagtgcctagggcaatgtttggataagttttctagaagcctccttgtaaatgattggcattttcctacactcagtgttttcctctaacacraatcactgtgtacacaggcatcacctggaccttgtaatgtaagtacgtgggaattaaggtttggggaactactggtaaatgatatgacactgactactgc

SEQ ID NO: 71536 - DNA, 201 bp, Bos taurus
aaactccaatactttggccacctcgtgtgaagtgttgactcattggaaaagaccctcatgctcgcataggttgaaggcagtataagaagtggacgacaggrtgaaatggttggatggcctcacctattcaatcaatatgagtttgagaaagctccaggagttggtgatggacaggaaagcctggcattttgcagtccatgg

SEQ ID NO: 71537 - DNA, 201 bp, Bos taurus; identical to SEQ ID NO: 31895

SEQ ID NO: 71538 - DNA, 201 bp, Bos taurus; identical to SEQ ID NO: 31896

SEQ ID NO: 71539 - DNA, 201 bp, Bos taurus; identical to SEQ ID NO: 31897

SEQ ID NO: 71540 - DNA, 201 bp, Bos taurus
gtgcaaagcccggagaagcagaaacatgtagtagctacaagtgtggaagctgacaccttgctgcctgtatgtgtagcccagttctgctactttattgtttmtctggcctcagtttcctaatttgtaaaagaatattacctggtttatggagagtctagcaaaaattaatagattattatagtgaaagtcttagagcaaggc

SEQ ID NO: 71541 - DNA, 201 bp, Bos taurus; identical to SEQ ID NO: 31898

SEQ ID NO: 71542 - DNA, 201 bp, Bos taurus
gggtggacaacaaagaattacagaacccaaacatcaataacgtcactgaggagaaaccttatagatagagaacatttgttttgacatactgtgtgtgcatrccaagtctcttcaatcatgtctggctctttgcaatcctatggactgtaaccctccagggtcttctgtccacaggattctctaagcaagaatactggagca

SEQ ID NO: 71543 - DNA, 201 bp, Bos taurus
aggagcctggcatgtgtgtagacaacagagaattcctgtattattaacccctcattctctgacccacagatgggaggccaggttgacctaaacccaaagaragaaaaagctttcgtgggtgtctggaggcttagaagagctcggcctcatagagaaaggcctgggaaggggcagaggtatgcttgccctacgtgcccctag

SEQ ID NO: 71544 - DNA, 201 bp, Bos taurus; identical to SEQ ID NO: 31899

SEQ ID NO: 71545 - DNA, 201 bp, Bos taurus; identical to SEQ ID NO: 31900

SEQ ID NO: 71546 - DNA, 201 bp, Bos taurus; identical to SEQ ID NO: 31901

SEQ ID NO: 71547 - DNA, 201 bp, Bos taurus; identical to SEQ ID NO: 31902

SEQ ID NO: 71548 - DNA, 201 bp, Bos taurus; identical to SEQ ID NO: 31903

SEQ ID NO: 71549 - DNA, 201 bp, Bos taurus; identical to SEQ ID NO: 31904

SEQ ID NO: 71550 - DNA, 201 bp, Bos taurus; identical to SEQ ID NO: 31907

SEQ ID NO: 71551 - DNA, 201 bp, Bos taurus; identical to SEQ ID NO: 31908

SEQ ID NO: 71552 - DNA, 201 bp, Bos taurus; identical to SEQ ID NO: 31913

SEQ ID NO: 71553 - DNA, 201 bp, Bos taurus
cagtcataccaaatcagatcattgtcaacccaatactctcctggaatcaattcgagtacttttttctcacatggtttgctgatctgatttagacttctagraaagctctggacagattatgacaaaagactgctgctgctaagtcgcttcagtcgtgtctgactctgtgcaaccccatagatggcagcccactaggctcct

SEQ ID NO: 71554 - DNA, 201 bp, Bos taurus; identical to SEQ ID NO: 31914

SEQ ID NO: 71555 - DNA, 201 bp, Bos taurus; identical to SEQ ID NO: 31915

SEQ ID NO: 71556 - DNA, 201 bp, Bos taurus; identical to SEQ ID NO: 31916

SEQ ID NO: 71557 - DNA, 201 bp, Bos taurus
gtagaagaaattttggtggccagcacatgagtggagggtggggtggggttgtggaaccaagggtacaggaggatttcccaacagggctgcgacccacccgmggtgtacctccatggagctggcctgtagcatcaggggagagaggggtgagcaaacgcctccctgtccaattatgcatgctctactttcccagtgaatcag

SEQ ID NO: 71558 - DNA, 201 bp, Bos taurus
caaaattcactggacatgacacatttaactgtatataaagtttttacagcaatttaaaggaaaaaaatttaagtggttcacttatactcaacatgtaaacscagaatgaaactttaaaaaaaattcatttaaataaacactcattgcaaatgacaagtgctgtaataacaacaacaaaaaaaaatgtggaaaatactcgag

SEQ ID NO: 71559 - DNA, 201 bp, Bos taurus; identical to SEQ ID NO: 31918

SEQ ID NO: 71560 - DNA, 201 bp, Bos taurus
gaaagaagttagataggcctgttggctaagcttttccaacagcagttgccatttttcccagggaaaaataaaagtgttgcccttaaacaaccagcctccgrtatctaggggtgtgtgtggtggccatgcacacacgtcctgttccctctgaggccatatgagtaacttgcaaagattcttgtgtttaaaggctttctccta

SEQ ID NO: 71561 - DNA, 201 bp, Bos taurus; identical to SEQ ID NO: 31919

SEQ ID NO: 71562 - DNA, 201 bp, Bos taurus; identical to SEQ ID NO: 31920

SEQ ID NO: 71563 - DNA, 201 bp, Bos taurus; identical to SEQ ID NO: 31921

SEQ ID NO: 71564 - DNA, 201 bp, Bos taurus; identical to SEQ ID NO: 31924

SEQ ID NO: 71565 - DNA, 201 bp, Bos taurus; identical to SEQ ID NO: 31925

SEQ ID NO: 71566 - DNA, 201 bp, Bos taurus; identical to SEQ ID NO: 31926

SEQ ID NO: 71567 - DNA, 201 bp, Bos taurus; identical to SEQ ID NO: 31927

SEQ ID NO: 71568 - DNA, 201 bp, Bos taurus
tacaacagaggacaatagagtctgaagcttctaaagcctgtctgtaaagagggcatggcatctatctttactggcacaaggggccagttctggctgtcccygcttatcacaaccaccacatctgaacagcagcagcctactcctgggagaatcatgagtagatgccctggcctcttacctgagttgacagggggccagaca

SEQ ID NO: 71569 - DNA, 201 bp, Bos taurus
aacaaaaactggccaccatctattgagtcttactgtgtagctgacattttatagacatgactcatttattactcacaacacctcaacggtgtggaagaggraactaaggcctaggataactataaggtccaaggtcgagtgcttagtaagcagccctaactagcccaggatctgtcctctgcgggctagccgcatgaaact

SEQ ID NO: 71570 - DNA, 201 bp, Bos taurus
tgacagtaggaaaggggaaggatttgcaagagaaaaacctgttagcaaagtaggacagcagtcagatgaaagataacgaaggctttgttagggtggagatrcagaagtcaagagcaggacagatttttcaaagataaatttgccaagatttattgaccaaatgggtgacaaaggagtattcaacaatggattttgaatgtt

SEQ ID NO: 71571 - DNA, 201 bp, Bos taurus
gaagcagaatcaactaactaccaaagacatatgatttaaaatcagaattctggaaagttacttggtttctttgggcttcattttttcctctatagaatggrcagaaaatgataacgtacatgacagggttactgtgagaactgctctaacattgctgcttcatctctcatctctccaccaggtatactctgcccaaaacta

SEQ ID NO: 71572 - DNA, 201 bp, Bos taurus
gatgaggaggaagaacacataatacaagaaaatgaaaatgaggtagaagaaaagtaagaaccaagatttacgtgaaggattttattctttttttgtgaaartgttttaacttcaagactagaaattccactggaaagggaaaatgagtgtaagtttactgtgtttaaagctaagatgtgaaattataggaagaacctgggt

SEQ ID NO: 71573 - DNA, 201 bp, Bos taurus
cttgttcttatcaagggctgggggatggccaacggctgtttaggcctctgtgacctcacctttgttgttgttgctgctgctgtgtagttactaagccgtgycagactcttttgcaaccccctggcctaaagcccaccaggctcctttgtccgtgggatttcccaggtaagaatactggagtgggttgccatttccttctcc

SEQ ID NO: 71574 - DNA, 201 bp, Bos taurus
tggactgcaaggacatcaaacagtcaatcagaaaggaaatgaatcctgaatattcattggaagaactgatgctgaagctccaatactttggccatctggtrcaaagagccaactcaccttttccacctggagaaaactctgatgctgggaaagatgagaggcaaaggagaatggggcagcagaggacaagatggttagata

SEQ ID NO: 71575 - DNA, 201 bp, Bos taurus
gaagtgtgttttatttacaattttatgttactctcagtacttgagtgcaatctcaaaatgacagaatgatctctgttcgtttctgtgtgacatgacaaaayatgatccactggagaagggaatggcaaaccacttcattattcttgccttgagaaccccatgaacagtatgaaaaggcaaaaagataggacactgaaagat

SEQ ID NO: 71576 - DNA, 201 bp, Bos taurus
agctctcctgctttcatcctggccaataagaaggaaaaacaaagaagggcgtacgcattcttccctctaaggacgatgctcaagcaggtgcaccagcctcyttcactgtacatgctctcctggccagaacatagccctgtggccataacagcatcagtggcagttggaaagtcatttataagtccagcagccaagtctcca

SEQ ID NO: 71577 - DNA, 201 bp, Bos taurus
cttccatctccagagaagatttgatttccaaagagcaaattgtgatcagatcttccaggcaaccacagagtcagaatcccaagctccctctgtccatactmaaggaaaaacatctcagaaatgctacccttggatcagaagagactacagaacacactcccagtgatggtaggagatggggaaagtgggaaggggctgggc

SEQ ID NO: 71578 - DNA, 201 bp, Bos taurus
gaagggaaagagggaaaatggcagggaaagaagctggagggtgaggctgcagcctcctcagtgggctatcctcaaactgcactcccagcctcccagctgckcctcctccatgtgaaaagagcaggcagctccatgaggaagagccctggttccgtacagcccagccccagctcaggcttcactagggaggaggcgtagagg

SEQ ID NO: 71579 - DNA, 201 bp, Bos taurus
cagcctgggttcccatattcattaagcagtcacctggttctacctcccttcccttagtcttagaatgttttttactttcgccactgtggatacttgtaagytgtgcaattctggcccctggttatacaacatcacgtctacaggaagcctcctgccgtgtgtctcgttcacctttggtctgtgaatgtcattcccagggaa

SEQ ID NO: 71580 - DNA, 201 bp, Bos taurus
gtgggatagggagggggtagttggtgggaaaggaattgaaagaggggagagcagacctcctggagtgtctggagactcagaaaaagggtactgtggccccrcagcccttgacattgctcgaggactccttgctgatgactttgaggaaaggtctagcgtccagagtccctggaggttgagttcccttcttaggaaattgcc

SEQ ID NO: 71581 - DNA, 201 bp, Bos taurus
ccaagggccccctccctcccaaggagaaaatcccacaagtggggaacatctggatcaaaccgcaaccatgaaagcacaacatcaaacgagggcttcggagygaccctgcccacaggccctgctccaagagaaactgcagatcttcctgctctaagcttttaagtgtcactgaaccactcaagtttgggatctccccttatt

SEQ ID NO: 71582 - DNA, 201 bp, Bos taurus
taacaaatttcatatttaacaccaaaactaaaacaaatttaaaataatgttatattgactgcatgttgaagggatataatattttgaatagattgggttarataaaatacattattaaaggtagtttcacctagttctttttcaaatgtggctattagaagattttgggcttcccaagtggcactagtggtaaagaaccca

SEQ ID NO: 71583 - DNA, 201 bp, Bos taurus
gggctgagaattcccagggctgttgctaccaggtttgcaaccagacattaaatccggaggcatgagactataaaatgtggttggaggtatgtgcagagggrtgaatttgaagacagcaaaatatgatccaagagaacattagctaagggtctagggattttcttaaccaagggcttgggaaagggttcttccttcacttca

SEQ ID NO: 71584 - DNA, 201 bp, Bos taurus
gcatatactaggctgcttgctggctggccaggcacggtccagagagcagcttaccaaggcagaacccagggtctccagatcttaccaaagaccctagcccratagagaggccacagaaccacattcccacccgacctctgggtcctgaactcacaccatcctgcagctgctggatgagggaacagtggctgccaagaaaag

SEQ ID NO: 71585 - DNA, 201 bp, Bos taurus
tccctttctcgcagatgttctccctgtcgcttatgagtctggagccccaaatagtgccagaatagttagtaccaggcctttcacgtagctctgtcgagatmatctttacccgagcctttccatcaggcgcagatctgcagattccgagggccgcccgtcagctgggagggaagttttttgcactatcttgctgagtacact

SEQ ID NO: 71586 - DNA, 201 bp, Bos taurus
ttccaactagtgacttggcccctctgcgcacttgggtttgggcaggggaagggatagggagggattttggaggcttctgactgtaaatcttgggggccccygactcactcgcccatctcaccccaagtctgtaaagctctcagcctcgaagtgttccaggtgtttagctgtgggaggggagttcctccctccgggtcaccc

SEQ ID NO: 71587 - DNA, 201 bp, Bos taurus
ccagagtcatccacatcacaagctctgttttctgcttcagacatgacagtcactgttcttaggttgtccttcttaagactctgatcccagctactgagccyctcctggccagggcccaggcttgatccagacacacaggtatgcaggtatgcacagactcccctgggcagccagaggttatgtggacacacagacagacct

SEQ ID NO: 71588 - DNA, 201 bp, Bos taurus
gccccccatgacagggtcctatcttattggttacttgtaaggacagggctacataatctgatcaacattccttggcagaagcagggatagaacatttagcrtgctggcggaggccctgtggctgctctggtggaccacaagctacgggtcaaaattcctgtataattgtttttcctgcagattctgatataaaccattggg

SEQ ID NO: 71589 - DNA, 201 bp, Bos taurus
ctccagttgcccctcaaacccatttgctcctcttggtcacccttcacccaccagcacatgcatcttgaattgaagatgcagatgcagactatttgaaaatrattgtgcaaatctcttcaaacacatctggggggcattcctgaagaaatgttgcaagggtcccatcttcgtttcccataaattcagatgcaggcaagaaaa

SEQ ID NO: 71590 - DNA, 201 bp, Bos taurus
ctacccagcttcttctgggcttgttgcctggggccagggtctcagaggagcatcttgtgctgtcctttcaggatgtggatgctgcctacttgaacaaggtrgacctggaggccaaggccaactctctgaccgatgagatcaacttcctccagatgctctttgaggcagtaagatcatgcatgtgtttgtccccctctatgt

SEQ ID NO: 71591 - DNA, 201 bp, Bos taurus
gacccccaaagtccactccccctaccccagcctctagaatagttagaaaaatatctacaaggctgtctgtccattcctgctgtgccactgggcccagaggrcacacagacgagggctccctgggcagctgcatcaggacccttccgcacattcccttccagctcctccttcagcctggcccagagctcagcctggggcccc

SEQ ID NO: 71592 - DNA, 201 bp, Bos taurus
ccaagccccacccaaggagggttaagcaaaccgttgctaagtccaccgtatccagctgagcaggctctgtgtgtgtgtctccctggctccccttctcctcyttccctacctcccaggtatgaggacgagatctccaagcgcacggacatggagttcaccttcgtccagctgaagaaggtagcctccccagcttaccccatg

SEQ ID NO: 71593 - DNA, 201 bp, Bos taurus
agcccaccactctaaaagtgaggacgaggaaactgaggcttgggaaggaggggccacttagccagggtcacacagctgactctctgagtcccgactgcctygtctgcctcccaggtggggcaggccaggcctccccagcagcaggtctcgggcaggagccagggtctccctgggggctggggagcattgtagggttcaggg

SEQ ID NO: 71594 - DNA, 201 bp, Bos taurus
ggctcgcatcgccgaggacgagacggtggtggtgagcccaaacatcgtcaccattgacctgaacacttttgagttctccaagcctgtccagaggggccgartccagagtcggggcaactttgactggagcctgaccttcggctgggaggttttaccggcacgagagaagcagaggcgcaaggatgagacctaccccatcaa

SEQ ID NO: 71595 - DNA, 201 bp, Bos taurus
agtatttttatgatgtatggcaaaatgcctcttagctcagatcatctgaacggaggatcactgcacgggtctgcaggcctggccccgttggatacccttgrcgtgggctgtccgtccagtcccacactccaaacgttgggagtgtcagtctccaagaggctgatggcctggggtcaaaactcctcctcactcgactcctag

SEQ ID NO: 71596 - DNA, 201 bp, Bos taurus
atgtattattggactttgttatatctatcttgtgatttaacatttttattttgaattacataaaggccttaatttggccctggcatggtctgtcataatartatcaattcaaaaagaactaaggtcaagtcccagcggaagaagctctgtttagactggcatcactccattccttgatggccaattactactccacttagt

SEQ ID NO: 71597 - DNA, 201 bp, Bos taurus
ttcagggattgaactgaatcccaggccacagcaatgaaaggctagaatcctcatcgctatgccaccagggaactcccaataataatactctttttgggggsagtgggatgaggggcctgtgctttgtggcttgtgggatcttggttccctgaccagtgattaaacttgccctttgcagggaaagcatggagtcctaaccac

SEQ ID NO: 71598 - DNA, 201 bp, Bos taurus
ttagtggccctgacatataagcaggcaaggaggtttggaagctggcaaagcctcagagggctgagcagagaaagtgaagagccctatttaatgggtattartttggccattctaattctaaagtctctggctgatgagtgattatttttgtctaaaaactcagtacttcttgacagcctggccacatttctccccactgtt

SEQ ID NO: 71599 - DNA, 201 bp, Bos taurus
ataggttctttttcatatgcaaaatgggtggagtcatttgtaagagtggtggtttagtcactctatcctgtctgacttgctgccccatggactgtagcctmcctaacttatttttaaagatagctgctgctttgggtttaccataaagtcaacgtgttctacatttctagaagactaaattcagctctggtcttaatattc

SEQ ID NO: 71600 - DNA, 201 bp, Bos taurus
cgattgcaggcctgagtgatcctggctttgcttctgcagtgcttcccatgtgtcctgtactcagtgaggatggggagtgagcacctggagtcccagcaacrttgtacagctaagctaggccttctttcaggaccttctccccaccccatagctgcctctgtgcccctctcacctttaaggccccacagatctctactgtgt

SEQ ID NO: 71601 - DNA, 201 bp, Bos taurus
tctaggctgtgcgcaggtggcttcttcctcctgggagaccttctccaccctcctggctggcttctggccccggcctactcttcctccaagatgcctttccygatgacccaagactgcccctcctgggcgttcctagagtactccagactttccttatcacagagctgtcacaacatggtgttgtctctgctctggcctgcc

SEQ ID NO: 71602 - DNA, 201 bp, Bos taurus
tctaataagtgcggtggatgattcctgcaggagagtgagcctgcagagcagagtctggaccgagagcagctggagcctaagagggcaaaagccaccaggamatcgggtttctgtcattgactcgtgggaaagctaacaggatagcactgggggcattttctaaggcagaagcactccaaggagttctttaagagcctcatg

SEQ ID NO: 71603 - DNA, 201 bp, Bos taurus
cagggaggcctggcatgctgcggttcatggggttgcaaagagacatgactgagcgactgaactaaactgaagaaccagtaatggtaatacaaagggcaaayttatataacaggcctatacaaagtagaagactatatatgagaagacagataacagcactcacatttattatttaggttctaatagcttctttcagtcttc

SEQ ID NO: 71604 - DNA, 201 bp, Bos taurus
gaaagaggactcttgctttgagctcctccacagagctgttggacactttgaattaaggaaaaatggcaccatgccacgagaagtggccaaagaccagcagytgtgtgaaaagctgactgttctatgctcagccccagggactctaaaaacactttctcgctatgctgtgcgccggagcctgggactccagtatctgccaga

SEQ ID NO: 71605 - DNA, 201 bp, Bos taurus
tgcaacgtatcgattaaacccgggccccctgcattgggagtgtgcgtggagtcttagccgatggactaccagggaagtccctcatgttaaccttttaaatkaaacctacattaatccttcactcccaattctgaaatcaggatgaagtgatagagtggagaaagggctgagtttgtaaagtaatttagaaatcctagaggg

SEQ ID NO: 71606 - DNA, 201 bp, Bos taurus
tttgtgaacctctgctgaggagtagtaccccgactccacccgccccacccccattcccagatgacaccccagaacctatgaaggcaggctggggtccaaayttgtgtggggaggaaatgacaagtaaactgaagaaaatgttctcgacctcaatagaaatccaagaaataagagttatactaatcattagtacaataaaat

SEQ ID NO: 71607 - DNA, 201 bp, Bos taurus
cctggcacattgaccaaccctccccacaccggccactggtcttgggatgaacaggagcacaggaaggctcagcttcaggaaaatctttcactctggctgcyctgggccatctcaggcacgcagggctttcctcaaaatttttaatgtttctggggagtcctgggacccaccaggactggcagtgccacttgggtggaacat

SEQ ID NO: 71608 - DNA, 201 bp, Bos taurus
aggaatgagacacagccagattcagacctacctgcctggaaatttggtatatttctattgcattagtctgctttattgttacctggcccacctcttggccyggagtatggatttccaagaagatttgaaagcattttcctccaggttgctaagtcagttgcctgtctccgtcacttgggcacgctggcattctcatccatg

SEQ ID NO: 71609 - DNA, 201 bp, Bos taurus
ttgattcaaagatgagcctaaaaaaaaaaatgagcctgactgctgacatttggctatagaaatcactagcatgaaccgtgtataaataaaagttctggagrcttctgtttctagtaatggcagactggataatttcaatgaaccttctgtaaaggacataaagttctggataaacagattttaaaactctgtttgaaaaca

SEQ ID NO: 71610 - DNA, 201 bp, Bos taurus
gactaataaatatgaatttccagagcctaataaggtttctgattttgctttctacatatttggccacttataaaaacatctatagaatttcctgataccargttccaattcatatcattttttcaatttacatttttatttttttgacaatctctgctgtacagtcatgtgtactatataaagtgtacactataaagtggc

SEQ ID NO: 71611 - DNA, 201 bp, Bos taurus
tgagggtgcaagacccagatatatcatgctttaggccagaatcctttgtatcagactgagggaagctggagctggccattttctcttcctgataaaggacrtctagatatgaattagggaaccatggtaccaatatctaatgatcaatccatcaatacttgccaaacaactctacctggtgtatggccacatgggttgtac

SEQ ID NO: 71612 - DNA, 201 bp, Bos taurus
ttctaagttgtactttcctctagagtcaacagttcctctcatgtggatccttcctatcaccattaaaacctgctcaagtttctctatttgacagaaaaaamccatccctggccttcatattctcctctagttctctgagcccttcagagtcaaaccccttccttgaaagagagctcagtattttctacctccttttctcct

SEQ ID NO: 71613 - DNA, 201 bp, Bos taurus
atctttttccatcccccaactttcaatctatgcgtgtctttcagcctaaaatgagtccttcataggtagtatattgtaggttcttgttttttttttttttwaatccaatatgtaactctatgtcttttgttcagagcatttcatccaaagacatttgaagtaattcttgataaatatataattgccattttaaaccttatt

SEQ ID NO: 71614 - DNA, 201 bp, Bos taurus
catgtaaaacaaattcaagcagcatagtccctctttccaggtgatccctgccactcccctctgccacctccacttttgaggaaactgtgatctccataacyattgctcagtttttttgttctcttttctgtgtctagattctttttttcggcataatgtttaagagattcattcatgtagtacatctgaaatttgtctttt

SEQ ID NO: 71615 - DNA, 201 bp, Bos taurus
gtctaggtcatttatttttagatttaaactaaactgttagtgcacagagacaaaggtaaatatcaaatgtatgggtatatactcaagtcaaaggagatgartcaaatttgcaaatgacatagattgagaaaggtagctaatatggcaaaaaacagaaccaagattcaaaactactcagactgtaggaacaagaggattgaa

SEQ ID NO: 71616 - DNA, 201 bp, Bos taurus
atcccaaggctgtgcactgtgaacccagtgttattagcaattaggccagtcactttttgggatcagtctcttcagtgtacacccagagatgcttacacatrtgacctgtgtttcccagggcccttccagtttgtgtgtccaggatagcttatcttactttgacaggattctggtaggcaatgttacaggaaggtgtttgtc

SEQ ID NO: 71617 - DNA, 201 bp, Bos taurus
taattctgttccctgtgctcttggcataacttttcacagaactatcttgaggtcttgggttaaacatcacttctatatagaattctactctggccacccartctaagtagccagactttttattaatctcataacatcacctagtttgtttcttttctagcactttttacaatttttgattgtacacttgattattaatgg

SEQ ID NO: 71618 - DNA, 201 bp, Bos taurus
ttgttgaaactatgtcgatggtgtatgtgactgaatcccatcaaggcctctagataaacctttaaaattctggcagttacctgggtggaaatctattcatytcttggctgcccagggccagtctcatatgtaagctaccttgcttatcaaacctgccaactcccaatctggaatggtctgtctctttcttgggactctctt

SEQ ID NO: 71619 - DNA, 201 bp, Bos taurus
acttgagaaactaggaaagaaaccttatcaaatatcaaatgttatttactagtgagaaaacataattccctcctggttccccagagtttaggccatcctgkcatcactccatcccacaagatccaatttggtatcaccattacccttccagaaattggaggtttgagtgtgtatttagatggtgacaaagccagtacatta

SEQ ID NO: 71620 - DNA, 201 bp, Bos taurus
tattggctaaactagccaacttggcccaggacgatttgatacctaagccaagcaggctcaatcatatgctcccctaggaatctgaaacttagaaacaactrtttaatctctgcatgtggctagaactgtgactgtcaattgggaagggcaaggtggtcatactctatcattgagtacatagagagatcccattaggaaaga

SEQ ID NO: 71621 - DNA, 201 bp, Bos taurus
ggaaagttcacacagaccaaattggattggctttgctgaagagtgaaacggtatggattctgaaaagatatgaacttacctgttttgtcagatgtacttaytacatgagccatctcattgctttcttaacccagcatataaatggatgtatacccccatatatatgtactgtacatcatgtttattgaacagccactatgt

SEQ ID NO: 71622 - DNA, 201 bp, Bos taurus; identical to SEQ ID NO: 31928

SEQ ID NO: 71623 - DNA, 201 bp, Bos taurus; identical to SEQ ID NO: 31934

SEQ ID NO: 71624 - DNA, 201 bp, Bos taurus; identical to SEQ ID NO: 31935

SEQ ID NO: 71625 - DNA, 201 bp, Bos taurus; identical to SEQ ID NO: 31937

SEQ ID NO: 71626 - DNA, 201 bp, Bos taurus; identical to SEQ ID NO: 31943

SEQ ID NO: 71627 - DNA, 201 bp, Bos taurus; identical to SEQ ID NO: 31945

SEQ ID NO: 71628 - DNA, 201 bp, Bos taurus; identical to SEQ ID NO: 31946

SEQ ID NO: 71629 - DNA, 201 bp, Bos taurus; identical to SEQ ID NO: 31947

SEQ ID NO: 71630 - DNA, 201 bp, Bos taurus; identical to SEQ ID NO: 31948

SEQ ID NO: 71631 - DNA, 201 bp, Bos taurus; identical to SEQ ID NO: 31949

SEQ ID NO: 71632 - DNA, 201 bp, Bos taurus; identical to SEQ ID NO: 31950

SEQ ID NO: 71633 - DNA, 201 bp, Bos taurus; identical to SEQ ID NO: 31951

SEQ ID NO: 71634 - DNA, 201 bp, Bos taurus; identical to SEQ ID NO: 31952

SEQ ID NO: 71635 - DNA, 201 bp, Bos taurus; identical to SEQ ID NO: 31953

SEQ ID NO: 71636 - DNA, 201 bp, Bos taurus; identical to SEQ ID NO: 31954

SEQ ID NO: 71637 - DNA, 201 bp, Bos taurus
tgatgacctagaatgtgtgtatcatttaacttcatcaatagaagattccttctcttccaggatgtagttagaacatttgacattaggcctattcctttcartagacatatttttggctgaaagtaagagagatatactaatgaagctgaccttaacaataagtaataggcttaaaagaaaaatttactgagggcttactga

SEQ ID NO: 71638 - DNA, 201 bp, Bos taurus
ttaacaaatagtctgtacttactataagaagctagatttttatgcagtggtggacaatttgaaaaaaagttcaaagttatttggactctaacataaaaacrtcagatatgaaaggtagacataagagagtagcaagaataacagtggaaaattcagcattatgatggtaaagaacatgtagttttatcaaaagtcctctaa

SEQ ID NO: 71639 - DNA, 201 bp, Bos taurus
aaagggagcaagactagctccagggtagagactgccatcgccagagcacctgtcgttgcacacactcagaagggaacaagcctaagtgtagggtgaagaaygcttagtacatgaagaatgaataatgatgctgcacataaggaaccactttcaagaacaaaatactaaccatttcacccaattttacaaagacaaagttaa

SEQ ID NO: 71640 - DNA, 201 bp, Bos taurus
ctgcctaattgctgtgactagaaatcccaataatattttgaatgaaattggagagaggaatcatgcttgtgttatttgtgatcttagactcctttacgttyaacaagttgtctttctcttgctgcttctaagattttctctgtctttaactttcaacatttaagttatattagtaatatgcactgttttgtgcttgtttgg

SEQ ID NO: 71641 - DNA, 201 bp, Bos taurus
tcagtgtttgtttcctataatataacatgtccgctctgtaattagatacatcaaaatagctagctagatccttatttggcaattcattgttctaacttggrctgattcctggtttattgtatccattcagcagatatttttctcaaagctgcactctgatacaacacccagcctgttttcccagccacccacctctcttcc

SEQ ID NO: 71642 - DNA, 201 bp, Bos taurus
tttttctgagattttatcttgtaccttcatctgagacataactttctgctttttcattctgattaactttctgtaatgtggtttttgttttagctgctgtkggactgttggtcttcttgcttcttctgtctgctctctggtgaataaggctaagaggctgtgtaagcttcctgatgggagggcctggcagtgggaaaaact

SEQ ID NO: 71643 - DNA, 201 bp, Bos taurus
ttcctctaatacttccttgaaacccagaccatatcagatattgtcttacacattctcatagcactatataggttctcggttataacacttaccatcctttyttgttcgtgattaactctatttccctcactatattttttaaatttatagaagcagaatctttgtgtttctttatagaaaaagtctctgtttcgtctgttc

SEQ ID NO: 71644 - DNA, 201 bp, Bos taurus
tgtaatgtctctgcttttgaatatgctatctaggttggtcataactttccttccaaggagtggaagaagtcagtaacaaaaagctgtttcatatgagtctrtatgtatgaaatatccagaatagacaaatctgcagagaggagcttggtagtaggcagggactgagcagcagaagaaatggagatggactgctaatgggta

SEQ ID NO: 71645 - DNA, 201 bp, Bos taurus
gaacctgggtctgcccaccagtgggccagcaataaccctgggacccctgaaacttctaaactagcagtcttgggatcctgcccaacacatcagtaaccagyagcttttacacaaggcagggcctggcaaccaaagggacaaagccagccatacctaatgaactgcctacagtagtcaacttgccacgacagactcatgaag

SEQ ID NO: 71646 - DNA, 201 bp, Bos taurus
gatagctgggcccccgactgagcagttgaaatttactcctgtagacacttcaagataaagataaggcaggagcagagaggagctggaccctgtttcagtayaaggaggccacataattatcatccttggggttaaggagacctctcagatcatacatacacagaaaggatcttgaggggtcagagaatggaggggatgcca

SEQ ID NO: 71647 - DNA, 201 bp, Bos taurus
taccctcagtttagcccattgcctgctgtgcttaatgtcttcttcaaaccaagtgacactgaaatccaggagaactgctgcagtgggccaagtgtaagtaktgccttgactgctgccattgtgaaacaggtctcaggatggagggagttgtaattctccttttgacttggctgagaaggggagagatgggtggtgtctgag

SEQ ID NO: 71648 - DNA, 201 bp, Bos taurus
attagagttttgttttccaaatagtatctcatttatattataagttattaaaaatattcccttgttttcttctctataaatggcctagtttaaattatttktggctaaggtattgagaagaatgtctgtcgcttcttagttgcagttgtgtgataatataccctcagagatggcctttttaaaaatgatgttaaatgtgaa

SEQ ID NO: 71649 - DNA, 201 bp, Bos taurus
ttctgtattctctttgaaggcttcgaaacttccaatgtcaataattatagtaggtgttggaccagcagaatttgatggtgagtaacaaaatttctatagcrttaattgggaatttattaactgtaactcatcatgtacttacatatctatcactcttttgtttgcatatagggatatgagtgtgcatgtggatttgtatac

SEQ ID NO: 71650 - DNA, 201 bp, Bos taurus
ctccccctggcaaccctgctcagcggaagacacctgtactctgttcccatgggcagcctggagaggttggcacttggaggcccagagaacgtcagctcccrtctatgagctatgtccacgtgtaaaccaagatttggggaagggacagggtgagttgggaggctgacactttcttaggccgtctcctctggttcctcaggt

SEQ ID NO: 71651 - DNA, 201 bp, Bos taurus
tatattatgtgacttttaatgaaataaatttttttaaaaaaatgggttgctaggtcttatccgccttttaatggataaaactacagagggcttgaaatcamtggagactgttttggagcttgggtgccacaatcttcaaagcaaaactggagtatctttttattacgctattgcttattatgtacttctacctgtaaactt

SEQ ID NO: 71652 - DNA, 201 bp, Bos taurus
caaagttgccaatggaattaagctgttaatcagctaaccttgagatggagagactgtcttggattctttgggttggcccaactacaagagttcttataaaytgaagacggaggcaagagaaagagaaccagagacagcagtgtgagaagttggcctaatatttctgattttgaagatgaaagaaaagggccatgagccaag

SEQ ID NO: 71653 - DNA, 201 bp, Bos taurus
actacagcagcttaattactgtcgtaatgcattcagtgtttggagacaatatgaaacccttattatacactttacaattaatttgcaattaatttagataygcagttgtgctgtacagaataaaatgcacaagtataaatataaatgatgaataataagccataatgaacgatcaggatctggaatcctctaaaggacaac

SEQ ID NO: 71654 - DNA, 201 bp, Bos taurus
aatccctagtctgaacactcacttccatttctactgctagaacagtttcaactcattttaacatccttttcgctaaccatccatcaccaaacagcacagtrcctactaggttccaggcccaatactaaagctatatgttggggtaagatgcattaaaggcctgccctcaaagcatgtgttcactagaagagaccttactgt

SEQ ID NO: 71655 - DNA, 201 bp, Bos taurus
tgatccgtattcctgaataaaaaataaccagaggtcaaatgacagagatttcagccaagtatacacatgcggtcatttttgaaaactgcagtataaatccyaagactgtaactgttagacaattgatatgaaatgtctgagaataggcttccagggaaagggtgaaaggttgcggtaggtctttaagcacagagccaagac

SEQ ID NO: 71656 - DNA, 201 bp, Bos taurus
gctatttcctccctcatccatcttggccatgctatgtcccctctccttcttgctaacagctcttacactcaattactgggcaagcaccaatactcagaaakaaaacattttatcagattgtagcctgtggcaagtaagaaaaatagccacaaagtgaaaaatgaaaaaaaatcattcaattagttgaaaatagataaaatt

SEQ ID NO: 71657 - DNA, 201 bp, Bos taurus
accccctcctccaccaaatgagcagttgtcagtgaacaaccattagaggtcctgctcagccattggtcagtgctgcagtgggcccctcccccagcaagcakctgtcaaggagaaactgttactgggcacattcagccagcagtgggggagtggtggtcctcaggtggagagtgaggtaagaggtggatcctggccttctcc

SEQ ID NO: 71658 - DNA, 201 bp, Bos taurus
caccatacccagcacaacacccacacaatactcacagatgagctcgagaacagtttattagtcatatacagtcacagtctgggttaaaggacaccactaaycaggcagggccatgcagacgtttcgctcagcaacagagagaacaaccaggtgctgtgaaggcaggttttgtagtctcaagaggttgagatgcctttggct

SEQ ID NO: 71659 - DNA, 201 bp, Bos taurus
ccagagaggagcggctgcacccatcacgtcgcactgtaggctcaacgagtccgacttccaggagccctacatcttcaaccacaccttcactctggctcagraggtactcatctcagtctttctcttttgcatcttatctacttggaacctgaatagttcttaaaatttcttcagaggacatctaagatctttaacagatga

SEQ ID NO: 71660 - DNA, 201 bp, Bos taurus
aaaatcccatgtaatctttcactctaaaaagagaagaaatgagcaataaaagaacatttcacaagatatatgttctaattgtatttttaattgaatctttmattaggacattgggggaagagactggaggaggcagtatgcatgaatatcaaattactaaagtaaccaagagggtaaatggatcaaatcccagaaaaatta

SEQ ID NO: 71661 - DNA, 201 bp, Bos taurus
actacaattcagtaataaaaagacaacctcaattttaaaaactggggaaagtccacaaaaaagtaaatggcaataaacaaacaaaacagcattaaacatcrgtagtcattcagagaaatggaaattaaaactacacctatacaccaattaaaagagataaattaaaaagcaacataaccaggacttcctggcaatccatca

SEQ ID NO: 71662 - DNA, 201 bp, Bos taurus
tggccagtgggcacccattcaagttcatctgtgtgaatcttgacacgtcctcagaatctcttgttttctaaaataacaatattttagatttccaatcttakaatggccctgctccaaacctgcaagggtattgacaaaccaagatctgcacactgggggtgctcattcctttgggaatgttgctattcccaggccttctca

SEQ ID NO: 71663 - DNA, 201 bp, Bos taurus
atttgggaggacaaactgcagttccttcagaggccaaaataaactgctcggcagaaagagtcctagtagtgcagtggttggtctctgacaactacaaaccrgtagttattgcctcaggggccccgaattcttcagtccccatcagacactcaggaggtgaagacttaggtgttatctagccagaaccccagcctcggggca

SEQ ID NO: 71664 - DNA, 201 bp, Bos taurus; identical to SEQ ID NO: 31956

SEQ ID NO: 71665 - DNA, 201 bp, Bos taurus; identical to SEQ ID NO: 31959

SEQ ID NO: 71666 - DNA, 201 bp, Bos taurus
attgtcgtgattattattatttgaagcaagaaatatagagaggcggtggccttgacattactttttaacaaggaaattgggttatttaaagtgtactgtgygtgtgtgtgtgtgtgtgtgcgctcgcgtgcgcacctgtgtacgtgcatgctcagtcgtgtctgactctttgtgactccatggactgtagcccatcaggct

SEQ ID NO: 71667 - DNA, 201 bp, Bos taurus
ggtggcctctcctgcttctcactttctctgcggcttccgaggcacctccagcaatctcaaggaatcagatggggcagtcgctggtctcggtctccccagckgacagtggccccagccagatgttgcaccggaagccttcacacccctctcccattaggcagtaatggcgcccgggctgcagggggaggggcgccgggcagc

SEQ ID NO: 71668 - DNA, 201 bp, Bos taurus
tgcttgcaggtgctaaacaagccgaggatagacccaagacctgacccagcccgaggctcttctcaccacggactcagcagcagggtcgccaaaggccaaawccaattcagtaaacacagacttctgggaagcaagtgcgcttgctttccttcggtgtcagctggaggttgcatttgccttgagcactaaaacattctgcag

SEQ ID NO: 71669 - DNA, 201 bp, Bos taurus; identical to SEQ ID NO: 31962

SEQ ID NO: 71670 - DNA, 201 bp, Bos taurus
aaattctagaatgcttcattctcactgaaataaattataagcataggaaaatacatacaaagctcttttaaaaggtgcaaatgagagaacaaatgtattayacttaaaagatttttacatcttgaaaatgaacaatggaaaacttaagttttaaagtggtaatacaaatcagaggaccactttccccaccacttttgaaac

SEQ ID NO: 71671 - DNA, 201 bp, Bos taurus
ctagaaaagatctgtatgagccccaacaggtcttcatgtgattaaaaatgctgctgatgagagttttgtatacacatgggcacttgggttgccaaggaggrcccccaaggaaagttccaactataaaaaggttccaggctccttgagagagaaaaaaggaaactgagggcctgacaatcagagccccacaccccagacacc

SEQ ID NO: 71672 - DNA, 201 bp, Bos taurus
agtgcaaaaggaatgatttcactttgattgcattgcccctctccccacactggcacagcaccaaactgagaggagcctcccttggccttcagtttctccaytgggcaaaagaaagcccaacctacgtagacattcttcttcacaccattgtcagatgctccccaaaagggccacttggatcttgcctctaaggcatcactg

SEQ ID NO: 71673 - DNA, 201 bp, Bos taurus; identical to SEQ ID NO: 31976

SEQ ID NO: 71674 - DNA, 201 bp, Bos taurus; identical to SEQ ID NO: 31977

SEQ ID NO: 71675 - DNA, 201 bp, Bos taurus
gctccctgtagaatctgtcaaaatatgatgaactactatatattccaccaactcaagaatcacactggccctaccctattatgtacacagcatgacaaaartgcttaacacaaggagcaaggatgtgggaaaagtgagcacacacatactggtggttagaatttacatccattacgttttttgaaaggtatgtttgcagta

SEQ ID NO: 71676 - DNA, 201 bp, Bos taurus; identical to SEQ ID NO: 31978

SEQ ID NO: 71677 - DNA, 201 bp, Bos taurus; identical to SEQ ID NO: 31979

SEQ ID NO: 71678 - DNA, 201 bp, Bos taurus; identical to SEQ ID NO: 31980

SEQ ID NO: 71679 - DNA, 201 bp, Bos taurus; identical to SEQ ID NO: 31982

SEQ ID NO: 71680 - DNA, 201 bp, Bos taurus
tggctgtctcctgtgcttttcctcacaagagaacacgatgagactgttctcccaacacaatctgtaaaattcatcctatcctggccaagatgggagggacratcagcaagcagtgatcattaatgaaaagtaaaaaatatagatgagaatctatcatacagttggccttactgcacatacactccatttcgcctctcttga

SEQ ID NO: 71681 - DNA, 201 bp, Bos taurus; identical to SEQ ID NO: 31983

SEQ ID NO: 71682 - DNA, 201 bp, Bos taurus; identical to SEQ ID NO: 31984

SEQ ID NO: 71683 - DNA, 201 bp, Bos taurus
caggtaagattctcagaggtacagggaacatagaatattaaaggtgaaaggacaaggaaaggaattgtaggcaaggaacaggtaggtaagaaaacagcacrggccaaggcacagagaataggaatgttttataattgtcacttactctgcttttttgtttggggatttacttgttatactactaatgaagagacagtgtgg

SEQ ID NO: 71684 - DNA, 201 bp, Bos taurus; identical to SEQ ID NO: 31986

SEQ ID NO: 71685 - DNA, 201 bp, Bos taurus; identical to SEQ ID NO: 31987

SEQ ID NO: 71686 - DNA, 201 bp, Bos taurus; identical to SEQ ID NO: 31988

SEQ ID NO: 71687 - DNA, 201 bp, Bos taurus
attttggtagaccccgggagttggtgatggacagggaggcctgtcatgctgcagttcatggggttgcaaagagtcagacatgactgagcaactgaactgayctgaacgtaaggttggcccgttggtttgtgtaagcttctcatagggtgagatttgtgctgtttttgtttgtttgtttgtttgtttgtttgtttgttttcc

SEQ ID NO: 71688 - DNA, 201 bp, Bos taurus; identical to SEQ ID NO: 31989

SEQ ID NO: 71689 - DNA, 201 bp, Bos taurus; identical to SEQ ID NO: 31990

SEQ ID NO: 71690 - DNA, 201 bp, Bos taurus; identical to SEQ ID NO: 31991

SEQ ID NO: 71691 - DNA, 201 bp, Bos taurus
ctaagcaggcctcccacaccagccccttcaaactgtgaaggggcaccccctcacaaaatccagaggctccatgtttccaaccacataatacctccctggtrctcaggtgtccaggcccatatgtgacagggcagggcaagctctggcctgaggctgcttgtatggcctcttcctcagccacaacagccatcaccacaccaa

SEQ ID NO: 71692 - DNA, 201 bp, Bos taurus; identical to SEQ ID NO: 31993

SEQ ID NO: 71693 - DNA, 201 bp, Bos taurus; identical to SEQ ID NO: 31994

SEQ ID NO: 71694 - DNA, 201 bp, Bos taurus
cttctgagggtttaaagatgaagaatgagttagtaccagtagctaagtagcacctcagtcttattagcttattaaagaagaaataaggagttctctgtccrtgtgtttatctattgaatctcttgacagtacagctttcccactacaaaaagcagggtaaagatcccacagtgtcagacctggtctgatactagctgcttc

SEQ ID NO: 71695 - DNA, 201 bp, Bos taurus; identical to SEQ ID NO: 31996

SEQ ID NO: 71696 - DNA, 201 bp, Bos taurus
gtgtcccagaaatagactcgagtgtatgtgggaatttagtatatgatgacatttcaaagaaatggaaaaagaaagattattcagtaaatggtgctggatgmagaagtaacaacccctgatactaagataaattcaagatgggtcaaagaatttaaaagtaagcaaaatttgtactagcagaaaacatgaatgaatgtttta

SEQ ID NO: 71697 - DNA, 201 bp, Bos taurus
aggcgggtgtccagcaaggtcaggctgatgatggccaggtttccagacacggtcatgaggtaggcaagcagcaggagcaggaaaactgccacctgaagccyttggtgtctgcaggccttggaggaagaactcagtcaccaaggtctgattggccattgtagatttcatgtccttgccagaaacatgcaagcccgggcagat

SEQ ID NO: 71698 - DNA, 201 bp, Bos taurus; identical to SEQ ID NO: 31997

SEQ ID NO: 71699 - DNA, 201 bp, Bos taurus
tttattttctctagatataaatcaccctgtgtttctcctccctttcatggccaaatgtttccaacatgttgtttcttgtttttttttcatgtctcaacttmtctctatccatatataacttgaatctggttttccctcttatctctctctcaaaaacttttttctgaagtttccaatggccactgtgtagctgaaaattaa

SEQ ID NO: 71700 - DNA, 201 bp, Bos taurus
gaggacaatattcaaaggccatttttacttagctttgtaatggataacactttgttccctaacgcattctctcttgcctttctaatgatttcttaccaaaratctctcacttaatattttcactttctgtaagaaaccacacataggtacaggagagaagagtaaaagtatgtgtagatttctagagccaagagaacctta

SEQ ID NO: 71701 - DNA, 201 bp, Bos taurus
gagaacagacaccaggcgaaaccaatgcatttccctgaaataggcttggggccattgagttgcatttggggaggggattgtgggcatccagagcatggtcyagaagtggtagtgcaatatcaaagtggacacattctctcggtccactgattcttcagcccatgagctctctaaaactcgggattcctcttgcctgggtct

SEQ ID NO: 71702 - DNA, 201 bp, Bos taurus
gctgagacttcatgcaaacatattctcctttcaggttgcatcttcacatagtttctctaagtgttcaaggttaaagagtacaactttctgtatgtggtcayttttttccacacgtggtggcagtgcttctgtttcagcaggttttcatacacacctttttctctttttttcctgtcaacagcagtctccaaactttcacaa

SEQ ID NO: 71703 - DNA, 201 bp, Bos taurus; identical to SEQ ID NO: 31999

SEQ ID NO: 71704 - DNA, 201 bp, Bos taurus; identical to SEQ ID NO: 32002

SEQ ID NO: 71705 - DNA, 201 bp, Bos taurus; identical to SEQ ID NO: 32003

SEQ ID NO: 71706 - DNA, 201 bp, Bos taurus; identical to SEQ ID NO: 32004

SEQ ID NO: 71707 - DNA, 201 bp, Bos taurus; identical to SEQ ID NO: 32005

SEQ ID NO: 71708 - DNA, 201 bp, Bos taurus; identical to SEQ ID NO: 32006

SEQ ID NO: 71709 - DNA, 201 bp, Bos taurus
ctgtccatcaccatctcccagagttcactcaaactcatgtccatcgagttgttgatgcaaatgcaaatcaaaaccacaacacatggtcctttgcatccatyaggatggccataatttaaaaaaaatgaaaataacaagtgttgaccaagatgtggagaaattaggaccctcatatattgctcatgaaaatataaattggtg

SEQ ID NO: 71710 - DNA, 201 bp, Bos taurus; identical to SEQ ID NO: 32007

SEQ ID NO: 71711 - DNA, 201 bp, Bos taurus; identical to SEQ ID NO: 32009

SEQ ID NO: 71712 - DNA, 201 bp, Bos taurus
aggagagaaaggcagtgataagaccttccacaaacacagctgtatgacaaggcaaagcaggaaaggtttacaacttgggaaagaagttatctgagaaaatycagcaacttgggaaagaagttatctgagaaaattcagcagcagataatagagggggagagctgaagaaggaaggaggtgactggggcaggcgctgagcct

SEQ ID NO: 71713 - DNA, 201 bp, Bos taurus
aagaacgatgcagagaacagaatttatgatctgacagtgaaatgctttttcattaccatcattgctttattgtacactagtcctaccagcgttttgtcatrtccttttgaaaatttgcaacttttccaaggttaattgtgagtttgttggagcacatgtaaatcaccaattctttttcttcagttgagagataaactctgg

SEQ ID NO: 71714 - DNA, 201 bp, Bos taurus
ttctacaatgaagctgaagcactattataaagcttgtctcatctgagaagttcagagagaacccccacgtccaggaaaagctccccccacacaccagtcaygtggtcacacagcaacatattctcccccaaagtatgtccattccaccaaaccaagaaatttccagaaagcatcctagagtagagttgagttcactccttc

SEQ ID NO: 71715 - DNA, 201 bp, Bos taurus
ccaaactaaaatgcttcttatcccccaaaatactgctctactggcagagttgccatgttgcagaattcaaggaacgatggccacagagtgtccaaggtggyaagaatatacagaagaactgtacagaaaaatcttcatgaccaagataatcacgatggtgtgatcactcacctagagccagacatcctggaatgtgaagtc

SEQ ID NO: 71716 - DNA, 201 bp, Bos taurus; identical to SEQ ID NO: 32013

SEQ ID NO: 71717 - DNA, 201 bp, Bos taurus; identical to SEQ ID NO: 32014

SEQ ID NO: 71718 - DNA, 201 bp, Bos taurus
aagtggggtatacacactccagggatgtgcaaggtgattcagtagagtgaaggaggacaacatcagaacttccatttatagttattttaaatcttatccaytaaaaactttctacctctggcatatgttttataatatattagcatagcatttcattaaggtaaattataaacaaatgcatattagaagttgtgctaattt

SEQ ID NO: 71719 - DNA, 201 bp, Bos taurus
taaatgacataaattcattttctcatatttctggaacttagaagtctgatatcacggtgtcagcagagtaagtttcttctgaggcctctccccgtggtttrtagatggctgtcttctctctgtgtctccacatacgtcttctctctgtgtgttttctgtgtcctaatttcctcttcttagaaggacattggccgtattgga

SEQ ID NO: 71720 - DNA, 201 bp, Bos taurus; identical to SEQ ID NO: 32016

SEQ ID NO: 71721 - DNA, 201 bp, Bos taurus; identical to SEQ ID NO: 32017

SEQ ID NO: 71722 - DNA, 201 bp, Bos taurus
agtagtattccatttaatgcagacttttcatggatcccttccatcacaattattcctggttgtttgctcaaaataatgtatttccttttctcatctcaaayttactaagtcagaatttttaagtatagggtctaagaatatacattttacaaagcttccttagtttgttatgtactctataaagtatgagaaccactgatc

SEQ ID NO: 71723 - DNA, 201 bp, Bos taurus
tgaaaacttaagtgcttcaaaaacacatttcaaaaaaatcattagttaacagtgcagttattagaaatcatacagattaaaaaagtaatcctctatatgcmtaactgactcactatgttgtatacctgaaactgctgctgctgctgctgctaagtcacttcagtcatgtccgactctgtgcgaccccatagacggcagccc

SEQ ID NO: 71724 - DNA, 201 bp, Bos taurus
gcttaggcagagttagaggaaaggatatgtaggttttaaatcggattttaatgtctcttgcaccttcccatcaaaatcagtagcagatgttcatagaaaayaacttggcatggcaataaatgttttcataattccagtagcaacattttccaactgctttcagaaatgcagtattaaatagaaaaaggaaagtgaattttt

SEQ ID NO: 71725 - DNA, 201 bp, Bos taurus; identical to SEQ ID NO: 32020

SEQ ID NO: 71726 - DNA, 201 bp, Bos taurus; identical to SEQ ID NO: 32021

SEQ ID NO: 71727 - DNA, 201 bp, Bos taurus
ttaggtagctatttacgaagtgacaaatagcttctctgttgaaatcaggaaacaactaaaattcaaagacaaaaaatctatccacacagtcatttttaaayctgttatgaaacatccctgctttctcacagaaacacttttgaaatcaattttcttggatggcattcacttaattacaaaattaggcagcctgatcaatct

SEQ ID NO: 71728 - DNA, 201 bp, Bos taurus; identical to SEQ ID NO: 32023

SEQ ID NO: 71729 - DNA, 201 bp, Bos taurus; identical to SEQ ID NO: 32024

SEQ ID NO: 71730 - DNA, 201 bp, Bos taurus; identical to SEQ ID NO: 32025

SEQ ID NO: 71731 - DNA, 201 bp, Bos taurus; identical to SEQ ID NO: 32026

SEQ ID NO: 71732 - DNA, 201 bp, Bos taurus; identical to SEQ ID NO: 32028

SEQ ID NO: 71733 - DNA, 201 bp, Bos taurus
gagagtgaaaggaggcattgttaatgattacgccccaatgacagatgcaaaccaggactatcataggcaaacctagaggtaaggtcactctgtgtcctgcygtttcagatgcccttcttggatgatctacaactttgtgaaaagggcactgatattatagccagtagaaatccagtttaattgagtcaaagcatggaaaaa

SEQ ID NO: 71734 - DNA, 201 bp, Bos taurus; identical to SEQ ID NO: 32029

SEQ ID NO: 71735 - DNA, 201 bp, Bos taurus
gttcaccttcctcattctcttgggccgataaacttctactccatcttcagttctcagtctaaatgtcacttcctctaaccaataccctccagtcagaattraagttcctaattatatggccttgtgacacccgtgttttgactttggtcatacggatcgcatgtattgttctttctgtcattgtctgtctttctcaataat

SEQ ID NO: 71736 - DNA, 201 bp, Bos taurus
ttatgaccaagaacaaggccctatatttagtatgagttccagggctatcattgcaaagcaagaatggcagcctaagtaccttcccaaggctgtagcttgcmggcccttcctaactgctagtgcttcttaattaaaattgaagttactgagtgaacaatttcagtttaatctgttttatgcatattaatacccagatactct

SEQ ID NO: 71737 - DNA, 201 bp, Bos taurus; identical to SEQ ID NO: 32030

SEQ ID NO: 71738 - DNA, 201 bp, Bos taurus
ggtttttctctccttcctatctctcatccacttagcaaaatgcctgacccagtggaagaggtggtgaataaggaggttcagagagtatgagaacaaagcayccaagaaggggactcagaaacaaaataatgatcatgttggttcatagaccctgcttgttgatcatactaacttccatatggagccaaatctctctatcat

SEQ ID NO: 71739 - DNA, 201 bp, Bos taurus
atgtacgtgtgatacatgtgtgtcaactcagccccatgagcgtgcacagggcacactagacccagggtagcatgcaggcttgggcggccgcgggagcaagrtgcaaggtggggaagaggtgtaggtagccttggagaagagaagacctttggggtgggacacagttaactaggtggcagtagcagctggccctggtggccg

SEQ ID NO: 71740 - DNA, 201 bp, Bos taurus; identical to SEQ ID NO: 32035

SEQ ID NO: 71741 - DNA, 201 bp, Bos taurus; identical to SEQ ID NO: 32037

SEQ ID NO: 71742 - DNA, 201 bp, Bos taurus
ctccagccacacccattggatgctgccaataccttcactctccacagcactctcttagagcgttgagggggaccccctcatatctatgcctcttctgagcycttctagcagttacccaaccttttgagagtgtgaacacccctcttcccgagccaggaaggtgtagtgctcagcaaggggctatggatgagactgcccatg

SEQ ID NO: 71743 - DNA, 201 bp, Bos taurus
tatgtgatggcaagtacctgacagagcttggttctatcacagttcttttgactccccagtccagccttgtaactgctacgtcacacgacttctctccgacrccaagcatctgtgcatgtgaatgttatgtgatgtcctttgccgacataaaaaagaaaaagtgaaagagagtgttagtcgctcagtcgtgtcaaactcttt

SEQ ID NO: 71744 - DNA, 201 bp, Bos taurus
ataggagggcatcttctgtgtactttgttatggacacaacatagcacccagcaaagagctggttcaatgatcatgattggaataagcatctgttggtgctkttgggccttccgtgagaaaacaggaaaagtgaaggctgtcctggtgttttagggggccatgtgcaacacagaacctcaacagctggactcctcactgtcc

SEQ ID NO: 71745 - DNA, 201 bp, Bos taurus
tttccaacaatgactctggggcttggccatgtggactagctttggtctgtagagaatcggcagcacaatgtaaaagtggctgcttggtaagtacttgcacrttgggtttgctgactgggagtgctcttggtaactaggtatcatattatgaggaagctcaagcagccatatggataggcccatgtagagaagaaccagagc

SEQ ID NO: 71746 - DNA, 201 bp, Bos taurus
cacctgcacagaataacgattattgtgcctctctttccccacgttccccacgcctcagaccatgctgcttccttatttgctatcccataaatgcccccagycccttgcctttggggaggcagaattgagactcattcttccatttccttgcctgggtgccttgtgaataagttcctctgctgcaaaccagcatctcagctt

SEQ ID NO: 71747 - DNA, 201 bp, Bos taurus
ggcaaactgtggcgggcagtcacccatcttaagcaggcagcctcctctggctagtgggtgccacttagtcaagcaggcccagcactattagagcctttggkttttcaagagaagtcagaaaacagacttttatgtgaaatcgcccactgattaaatgtttgtccacttttttagaaagactaacgtggccaaataaagtat

SEQ ID NO: 71748 - DNA, 201 bp, Bos taurus
cccatgagaagtaaaatattggcaaagagagaaagccagagggaagggcaagcactccattttgggacttggggattggtggaattgaaaagattagagtrgaccattttcttcttcctctagccccagccacacccacacgtccttctatcagatgggagttaaagcgcaaggctagtttgcctggggtaaagtaggtaa

SEQ ID NO: 71749 - DNA, 201 bp, Bos taurus
cagggtagggagtcttcctgtctgactcacattctcacctgctctgatgtgactccagtcagagctggagccctgctgcccattgacaggctggccagagyctcaggtgttctctgtgcccttgctttagatcagggaactactggcagcgccagagagagagggggaagctgggggccaggagatgccccagcctgagga

SEQ ID NO: 71750 - DNA, 201 bp, Bos taurus
ccgagggggacacaagggtccctgaggtagttttggggtcctgtccagtttcattcccatttgaagggattgttaataccaagaatatctgcctatcatgrgtattaccttagatttattaaaaaagaaaacaagataatatttatatagtactctgtaccagcaccattctaaaatacatattcatacttttaggaatta

SEQ ID NO: 71751 - DNA, 201 bp, Bos taurus
ctagctttcaacactttcttcattgtctccccaagccccagttcctatcccaaacctctcttgtcatctttctccaacaagcttcctaagaaatgtgcagkaattccaatgactatatgctgctgctgctgctaagtcacttcagtcgtgtccgactctgtgcgaccccagagacggcagcccaccaagctcccctatccc

SEQ ID NO: 71752 - DNA, 201 bp, Bos taurus
ttgtcccctgatcctgttgaaaggagccaagctccaggtggaactgcagctcgggcttgctgatatagcacgagtggagttttccataggaaattaaccargtaacactcacattctttcccttctctcctttccactcttctcttccctctttaatgaaacagcttaagctcagcacttgaactctctcacaggggtgaa

SEQ ID NO: 71753 - DNA, 201 bp, Bos taurus
ctgaccaaaataagcacactttcctgatggctcagatggtaaagaatctgcctgcaatgcaggagacccaggttcagtctctgggttgggatccaaaatgrtgattcttgaaatgtagtctctgaaccaccccagatccactgaattagaaactctgggagtagggtccacaatatttgtttaaacaaaccctccagaggg

SEQ ID NO: 71754 - DNA, 201 bp, Bos taurus
gaaggtcccagcagtccttgagtcttcactgagtgtgtttaatgccggttccctatgtgttgaaagcagcagctatggaccctgttctcagttggccgatrttacggtagtcccagtgcacagcttcgtggctgagacaggcgaggtgtccagtgagagatgttggatggatgatggatgagtggatggatcagagtaaac

SEQ ID NO: 71755 - DNA, 201 bp, Bos taurus
aacagactctagcaatgagccgagatggctccagaccctaccaccaggttcggccacctcagctatgttaccacagggcctcgtgggagggcaaagccccytcatttacattgtagtctccaaggggatttctgaggtttagcttcttccaatcctggtatcttggcatagatggaggcctctgggaggtcaagagaaatc

SEQ ID NO: 71756 - DNA, 201 bp, Bos taurus
gggccttgattagttgaggacatcttctccctctgggaactagtagtgattcctaaaagaacccggggtctgctcttcactgtccaatttaggatagcatrctgggtgggagtggccttgcaaagcctccccgctgtttctgttgtgttctgaaaggctcaacgtgtcacatggtctgaatgcattctctggtcctcaaga

SEQ ID NO: 71757 - DNA, 201 bp, Bos taurus
ggctgggagcctcaggctcttcttgtcaactgcagggagccttctccactgatccactcaatcctcgtttcaaccattttccaagagtgtcatgatgtgtsatgacagcatctgctgtcccacgcggcccctccttgggtcttctgatctcactactggaggattgagtgttggtgtatgaaggatccttggggctggggg

SEQ ID NO: 71758 - DNA, 201 bp, Bos taurus
gtcaacattattttgctgggcctggtgttaccaccttctccagtcactggtgagagagaagatccaatttaaaagtgggtgcccctgagacaggccattgmtaaatggacttgacaccttgacctcccttcttttccagtgaggttcagtaatggtgaatttgaccatgggtgggcaaccatggccaaataatatatttgg

SEQ ID NO: 71759 - DNA, 201 bp, Bos taurus
cagctttgtggagatagtccccgcccatccggccatggctgggttggccactgacatggatgtgggctgagaaatgaggctggctgtttatcagggcttgmccttggctaaactggggcccagccacctttcaatggccccagatggtagctaagtggtggagactggacctccatgaggattctgatgtaggtccccttc

SEQ ID NO: 71760 - DNA, 201 bp, Bos taurus
aaacaggtgtcaggtcatgggtgtgggacagtgcatctggtttgtgttttgctgaactggattgggatttcatggctgcaggtggccttggggggaagggragataaatgagaagggtatcacaggagtgtgtcctggggagtaagattacaggtgaccagagtagaactgcatgagactgagccacccctgagtggacca

SEQ ID NO: 71761 - DNA, 201 bp, Bos taurus
aagaaaagagagagagagagtgaagagaaggcttcaacatgtaagatgcttatccaaagtggatttggtctggaaaggcctgtaaaaccttccacatgacyggcacagtgcagggataaatgaaactctcaaatcctaccaagtatgccctcattcaacctggatccttggagtggcctccaaagtgtccacagctcaaga

SEQ ID NO: 71762 - DNA, 201 bp, Bos taurus
gctctcgcctctcaggccagtgctccatctggccagcactgggagactcctgtgctttttacccttgcacagccccagacacataatggcaatcaggctayagcccatgagcaccatttttcatacaaaaaaatgaaggttcttgagcaattaaaaaaaatgacttattggaacagctgtctcagagaaaccgtggtcccc

SEQ ID NO: 71763 - DNA, 201 bp, Bos taurus
ggttttcatttcacacgtccaacaccatttcagtgctgtagaaatgaaaaaaccattcaaccctccttttctacccactgctacccacagcttgggcctcrccttctctccctagagctgcttcccaggggtctttcctcttaccttccttcccttgattcagtccacacatccagggaccagggtaaagcccggcgccaa

SEQ ID NO: 71764 - DNA, 201 bp, Bos taurus
aaattatctttgacgtgtgtttcctcctacgatcatgattacagtatgagtcaccatctgagcaagaaatggccttaagaaaaataaataaatgaaaaacmaagtatggtctcactgtctttagtcctctgtccagaaagtatacaagggactgctgctgctgctgctaagttgcttcattcgtgtctgactccgcgtgac

SEQ ID NO: 71765 - DNA, 201 bp, Bos taurus
gtaagcgtgtcctggaagggtggccaggacaaatcagaccaagaagtcagtatctcccaatcatagtgaaaggtgtcacaactttgcatcataaagttccycaggccctctccttagcccacttgctaactctgggccaaagcagagggttttggaaagagctagggttggaagtcagacagacctgggtctgaacctggt

SEQ ID NO: 71766 - DNA, 201 bp, Bos taurus
aactagaggcattttttgacttctcttttgtgatcgtcattgttcgtgaagtctaggttttctgcttgaagcactgacactagctacataggcaggactckaggaaatttggccaacggctcccctacctgccgccctactggcctctcccccgccccactgaagcctttaacttctgtggcactagtctctgggctgttt

SEQ ID NO: 71767 - DNA, 201 bp, Bos taurus
cccgtgcttgtcacgaatcactgtgcggagacattgtgctgcaggaaaagtgctgtgtgaacccaagtcacagacgtgtcagctcaagtcacacctgagaygcaggggagccttaagacacagattgtaggatgctttaagacggcaaaagcagaagctccaagcacatatcaggatataggaaattaacagatacacact

SEQ ID NO: 71768 - DNA, 201 bp, Bos taurus
ctaccctttatcctatcaagctgaggtcacagagctggtaattgacagaggcaggatttaaacccaaagtcaaccatggtgatctcaggacacacacttcygttctggatggccgaccacagaatagcaaacccagaaaaactcctgaaatctttaggtcacctctgttcatagtggaggattattctcaaacctggagag

SEQ ID NO: 71769 - DNA, 201 bp, Bos taurus
caaaggccccagctctgagcaccggatgcctgttatcttcagatccattataggacaatacgctgctaactacagacatcagctagagggagagaaggctycttctggctcctacgaggccgagggaagaggcctgatgtgcaggtccagtgtgtggaaaggtcacatgcatcccccgctggcatgcagtattgctctaac

SEQ ID NO: 71770 - DNA, 201 bp, Bos taurus
tccatgaccacggagtctgggacgctgtgctcatccctgtagtgtggccaaatccggaaataggaggtcggtggtcttggtctctggcccccaacacctcrcttctccagccttgctttgcctgtcatgcaggtcacatgtctgaccaagttcccaaaggcaggaaaggagaccttttcctccatctcaaggcaggcctac

SEQ ID NO: 71771 - DNA, 201 bp, Bos taurus
ccccctttctggataatttccctgggcccagacttcatgaggacactgagcacccatgttctgtcaaagtggggttctagcctcttcagctttgtacctcyagctccacacataataaaactggcccatttcagctgctcaagtatttgactctgcaagggaatccagagagagggtggtgggttctctgatggaattaag

SEQ ID NO: 71772 - DNA, 201 bp, Bos taurus
gctggtggggacctgctcatgctgggaactcagtaataatcacagtaacagccatggcgattgctaactcttatcaggagctgcatgcctgggcctctttmtagagctcagcatgtatttaattaatcctcacaactaacctaggagatgggcatctgcctccattttatatgtggggaaactgaggccccgggaggttga

SEQ ID NO: 71773 - DNA, 201 bp, Bos taurus; identical to SEQ ID NO: 32042

SEQ ID NO: 71774 - DNA, 201 bp, Bos taurus; identical to SEQ ID NO: 32043

SEQ ID NO: 71775 - DNA, 201 bp, Bos taurus; identical to SEQ ID NO: 32045

SEQ ID NO: 71776 - DNA, 201 bp, Bos taurus
gcccactggtgaatggagccaggtcttggccctccggtgagcagggctctgtcaagaggtggctgtgggctcagaaagtctgggaaacctgtgtgctgatkggtgggcctgtgttcccaacctgttgactgtctggcctgaggatttctagtagcagggtgagatcaggtctcagtgccaaggacccaggatacctgcctg

SEQ ID NO: 71777 - DNA, 201 bp, Bos taurus; identical to SEQ ID NO: 32048

SEQ ID NO: 71778 - DNA, 201 bp, Bos taurus
atatttcacactttacacaaaaattaactaacagttcctagaacaggtcgtggtagcatctgtgtctcaaagtctggctggtacgagcaggcagctggccrcagggatgagcccaccacatccgtccccagaaacctaggcgctgcttattttaccgcttgccgagaatcactgctttgcctgggccacaagctgggccta

SEQ ID NO: 71779 - DNA, 201 bp, Bos taurus; identical to SEQ ID NO: 32049

SEQ ID NO: 71780 - DNA, 201 bp, Bos taurus; identical to SEQ ID NO: 32050

SEQ ID NO: 71781 - DNA, 201 bp, Bos taurus; identical to SEQ ID NO: 32052

SEQ ID NO: 71782 - DNA, 201 bp, Bos taurus
gcctgttccagctgaaatctcaatattagttatcttgataaagaggaatttctataaccagcctccaactctgcttcctcatttaatgtccttatacaacyggggaaagacagactgtaccatgaatagcatcatcactaaaacatctcctgcagcttgtctgtctggcaagggcttgtgaaatcatggatgattagtgaa

SEQ ID NO: 71783 - DNA, 201 bp, Bos taurus
tttggaggcccttaaagtagctttcctgaaaagttcaagaacttctcctatcactctccatttacatgggatccatgagcagacagacctgcccccaacaycctcaaatcccagtaaggacactagcctgccaagggtctcaagttcacacacagagacactcctgctgctcactctgcagagggagagaagaaaggctgt

SEQ ID NO: 71784 - DNA, 201 bp, Bos taurus
ctaacatcttcttaataagggtcggctttttaaaatgcaaagggtatgttctgcttctccagcagtatgtcagccctaatccaaaccagatcggccactgkacagggttcatggtcccaattaagaaccaaggctaagctctcaggagccggcaccttctggggctgctcagagtcctgggccaacctgctgcctggcaca

SEQ ID NO: 71785 - DNA, 201 bp, Bos taurus
cataagtgtgagaatcaggccacgtggctccacggagtcgtgtcctgccatgcccgtgatcaagcccggactgaggcggtggctgccagggcaatggataygggccaaaccaagacggatgcagaagcaggagggagaggagtgatgggggtcagcgtcacttgtcatgacacctctgaccacaccattccctcctgaccc

SEQ ID NO: 71786 - DNA, 201 bp, Bos taurus; identical to SEQ ID NO: 32053

SEQ ID NO: 71787 - DNA, 201 bp, Bos taurus; identical to SEQ ID NO: 32054

SEQ ID NO: 71788 - DNA, 201 bp, Bos taurus; identical to SEQ ID NO: 32056

SEQ ID NO: 71789 - DNA, 201 bp, Bos taurus; identical to SEQ ID NO: 32057

SEQ ID NO: 71790 - DNA, 201 bp, Bos taurus
ggggtggtaacatccggcagctcccatgcctggcccttgcccccactctcacccccacgcccccattccccacccccggaggcccttgttctgcctcagcrtctctcagctcccaggaaccagaggctgtgtctccttgagctttctccactgcatacaccagccagggccagggctccacctagcacataggctcgtggg

SEQ ID NO: 71791 - DNA, 201 bp, Bos taurus; identical to SEQ ID NO: 32061

SEQ ID NO: 71792 - DNA, 201 bp, Bos taurus; identical to SEQ ID NO: 32063

SEQ ID NO: 71793 - DNA, 201 bp, Bos taurus
tttccagtgacacctaggacatttcttgaaggcaggtattttttaccttcagccccttgatccttgtgcatattaaatacccaggagtactgcttttcatkgtgttgttacattagatggccacaagggagcagcagttcttcatgtcccactcctttttttcccctgtaatttccttgttattttatgttggaatattgt

SEQ ID NO: 71794 - DNA, 201 bp, Bos taurus; identical to SEQ ID NO: 32065

SEQ ID NO: 71795 - DNA, 201 bp, Bos taurus
agactctacaccagcatggaccttttaaattgtagtaattaccataaaacagttctttaattgccagtattattgctgttagttaaatgaatagttgggamtgtgataaaatgttccatggcattagaagtccagaatattcagttcctttccattaaaaaaaaaaaaatcctgcctgaaaagttgattgtaagacttaaa

SEQ ID NO: 71796 - DNA, 201 bp, Bos taurus; identical to SEQ ID NO: 32067

SEQ ID NO: 71797 - DNA, 201 bp, Bos taurus; identical to SEQ ID NO: 32068

SEQ ID NO: 71798 - DNA, 201 bp, Bos taurus; identical to SEQ ID NO: 32069

SEQ ID NO: 71799 - DNA, 201 bp, Bos taurus; identical to SEQ ID NO: 32070

SEQ ID NO: 71800 - DNA, 201 bp, Bos taurus; identical to SEQ ID NO: 32071

SEQ ID NO: 71801 - DNA, 201 bp, Bos taurus; identical to SEQ ID NO: 32072

SEQ ID NO: 71802 - DNA, 201 bp, Bos taurus; identical to SEQ ID NO: 32074

SEQ ID NO: 71803 - DNA, 201 bp, Bos taurus; identical to SEQ ID NO: 32075

SEQ ID NO: 71804 - DNA, 201 bp, Bos taurus
ttcatggggtcacaaagagttgttggacacgactgagcgactgaactgaatttcccaaacccttcgaagaaagaacaggagggaataattcaaaattcatkttataaggccagcattacctgataccaaaaccaaggcaggaccaccacaagagaagaaaattgcaggcctttatcccacaaaatcagagatgcaaaaatc

SEQ ID NO: 71805 - DNA, 201 bp, Bos taurus
tatgggggtgccaatggaaaatacaaccattcagtaaattttttgccaatgtaataaaagaatatttattttgtatatttttttgactgccagttatataraactttttttcccatatatcaggcatttgtgtttcctcctttttgaagtatctgttcatgttagatatttagttagcttagtagcacagttgtgtccgat

SEQ ID NO: 71806 - DNA, 201 bp, Bos taurus
tgaactcttagaatttatccatctattacactcaaggccacagctctggagtgtgatggggcattcacaacttagcatataagaatagcaccccaacaacyatttacataggctcacgggccctgatgagacttgctactacttaataaatacatctctgcatttactgtgcaaaacttgtcagaacttccccttactgat

SEQ ID NO: 71807 - DNA, 201 bp, Bos taurus; identical to SEQ ID NO: 32084

SEQ ID NO: 71808 - DNA, 201 bp, Bos taurus
ggaggaatggtaaactgaaaaagggcaaaggcgtggcctttgaggaagcagcccagatgaaagttcctgcgattgcataaggtaaccaccaggtggcgcaygggaaagcatcaaacttgggccctcggcggactacagttcagttccctcagcccggtccgcctcttagtgaccccatggactgcagcactccaggcttcc

SEQ ID NO: 71809 - DNA, 201 bp, Bos taurus
attttaaactactttgtttagaaaagagtggttagggttttgtagcacttcctttgttcatttttgcctcactaataacacctagactcatactttggccycagcagtacagaggatacaggtattgttttctttaaaaaaaaaaacaaaaaacaaaaaacagtcccatttgaaagagaaacaatggtggtattgctcttt

SEQ ID NO: 71810 - DNA, 201 bp, Bos taurus; identical to SEQ ID NO: 32087

SEQ ID NO: 71811 - DNA, 201 bp, Bos taurus
acccaaggcctcaaagttactgatctctcagtgaagatgctcttctactggtagaagaagattctaccaagaagaatctactggtagagtctcttctactraagagggccataggaagccatcaactaggctgtaatgtctttccagacattgcttgctctgctgttacctgagctcaccaagtgccacctgtgttcctgc

SEQ ID NO: 71812 - DNA, 201 bp, Bos taurus; identical to SEQ ID NO: 32088

SEQ ID NO: 71813 - DNA, 201 bp, Bos taurus
aaattagatgaagctgtggtgtgcataacagagctatgcccatggccccatagctttttagtagggatactactcaatagccaacagcattggtcacttgrtgtacactctactgggcctatttccttttaggattcttataaccatgggtttctaaatccactccttgtttcatttttttcttctttgtgatgcaatgtt

SEQ ID NO: 71814 - DNA, 201 bp, Bos taurus; identical to SEQ ID NO: 32089

SEQ ID NO: 71815 - DNA, 201 bp, Bos taurus; identical to SEQ ID NO: 32090

SEQ ID NO: 71816 - DNA, 201 bp, Bos taurus
tggccatggagaccctcactcccatcccctcaggttgttcctgtatagccaagaacagtcctctccccagatccactctcctaactgcattaggagcactyggcccccaccagcactggtagcctcctgtctcaggctggggtgcccagggctgattccagaggcagctttgatggtggcagtgctcaggactccggagct

SEQ ID NO: 71817 - DNA, 201 bp, Bos taurus
gtcatacagttggaatcatatagtatgtagcctttttaggttagttaatgtgcatttaaatttgttccatttttatggtttgatactttttttttttagcrctcaagtgatattgtgttgtccgaatataccataattatatatccattcatctactgaagaacaccttggttgttttcaaattttggcaattatgaataa

SEQ ID NO: 71818 - DNA, 201 bp, Bos taurus
agaacatggggtgggctgagaaggacagaagtacggggcaggaatgagaggtgtagagtttggttcacagttccattccctttattaacaatgccaagcakgatctcttcagcctgcacaatcgggaaagttcctggcaaaaaagtgcacaccctcttttatttcccagaactgtaattcccattaaattgcttctctgga

SEQ ID NO: 71819 - DNA, 201 bp, Bos taurus
aaattcagtgaagaatactccaactaaacagaagcttttaaaaattagatatattaaaactgtaattaattgatacagtgggttaaactggaaatgttcayacttatttattttatgttagcttaaaacctataaatggattttcatacacaattttttccttttgtagatctagaatcttttcttcgagtataggtacac

SEQ ID NO: 71820 - DNA, 201 bp, Bos taurus; identical to SEQ ID NO: 32093

SEQ ID NO: 71821 - DNA, 201 bp, Bos taurus; identical to SEQ ID NO: 32096

SEQ ID NO: 71822 - DNA, 201 bp, Bos taurus; identical to SEQ ID NO: 32097

SEQ ID NO: 71823 - DNA, 201 bp, Bos taurus
aagaaactgataaccactcccattaaaaaggagtgtagtacatttatcattccactaacatttttaccagtcttctcatctcaagataagtgagcagggayttctccggtggcccagtggttaagactctgtgctctcaattcagggagcctggaatcgatccctgtttagggaactagatcccacatgctgcaactaaga

SEQ ID NO: 71824 - DNA, 201 bp, Bos taurus
ccctgtacttcaagacactccccctaaagaaaaaaaaaaaaagaacctccaggaagtctgcaggtgcaagtgtgttttcagagaaattaatgaaggattgyccttttatgctgtgtattcaaatacgtttgcactggtgtagtgctgaccttaagtacacagaacatgaacatagccttttcttggtacttgtgatggcgt

SEQ ID NO: 71825 - DNA, 201 bp, Bos taurus; identical to SEQ ID NO: 32099

SEQ ID NO: 71826 - DNA, 201 bp, Bos taurus; identical to SEQ ID NO: 32101

SEQ ID NO: 71827 - DNA, 201 bp, Bos taurus; identical to SEQ ID NO: 32104

SEQ ID NO: 71828 - DNA, 201 bp, Bos taurus; identical to SEQ ID NO: 32105

SEQ ID NO: 71829 - DNA, 201 bp, Bos taurus
gtctttactctttttccttctttttgcagctttgactaaataagttcaatgacctatcttctaattcactcactcactttttttttttgtgggggccaaakggtctcttccttcagtatttatggtttcacttcagcagggaaagacattcaccagtcagcttggaatattggacaggcctgctggtagtgtctgttggca

SEQ ID NO: 71830 - DNA, 201 bp, Bos taurus; identical to SEQ ID NO: 32108

SEQ ID NO: 71831 - DNA, 201 bp, Bos taurus; identical to SEQ ID NO: 32110

SEQ ID NO: 71832 - DNA, 201 bp, Bos taurus; identical to SEQ ID NO: 32111

SEQ ID NO: 71833 - DNA, 201 bp, Bos taurus; identical to SEQ ID NO: 32113

SEQ ID NO: 71834 - DNA, 201 bp, Bos taurus
aactgcttaggggagactaaggtcatttcaaccatcactctgagtggagccatgcagtgtagtgggaaacaaggtggaccaaggcaccattaagggctccmaatcggttcctttttctagctgataacctcagcaagactacctctctgagcttcctttcctccatctgtcatggaggcagtgataaccttccattcagat

SEQ ID NO: 71835 - DNA, 201 bp, Bos taurus; identical to SEQ ID NO: 32115

SEQ ID NO: 71836 - DNA, 201 bp, Bos taurus
gtgctgcgattcatggggtcgcaaagagtcggacgcgactgagcgactgatctaatctgatctgattcaggactttcccagtaatttagtagatagggatyggcctgccaatgtaggggacatgggtttgatccctggtccaggaagactccacgtaccccagaacaactaagcccgtgtggcacaactactgggctcgca

SEQ ID NO: 71837 - DNA, 201 bp, Bos taurus
atctttggttgagttttcatcagtgagaacttgcaagcatttttgttccacagtggaaacactacattgaatgtgatgggagtcctgatccttcaatagcycaagaaattaatacttttattaccttgtggaaagaggaaaccaatgagactttagaggaagtgattgagaagagtaaactagtgctaaatgtaagtattt

SEQ ID NO: 71838 - DNA, 201 bp, Bos taurus
tttctttttactcctagtatctagtgctgcctgtacaattcaggcactcagtaaagcttcattgaatgaatgaattagtaagtgagaagtgtcagaggccrgatgaaaaggttggcagagaatgcatggtattaaaactggtcaagaggaagatacaaaaaatatagtgatgagagtaagagaaaagatcatctactaaga

SEQ ID NO: 71839 - DNA, 201 bp, Bos taurus; identical to SEQ ID NO: 32121

SEQ ID NO: 71840 - DNA, 201 bp, Bos taurus; identical to SEQ ID NO: 32122

SEQ ID NO: 71841 - DNA, 201 bp, Bos taurus; identical to SEQ ID NO: 32126

SEQ ID NO: 71842 - DNA, 201 bp, Bos taurus
aatcaggtcagctactaggaagtatataaagggcagttcaagagaacggatttcagtgagatcagaacatgctatatgtaaagcattcttaattctacagrggatatatgttaggggaaattagtgttattgccactacttgaagttttctcattccatttttcactcaaatatttgccaagtgctgatttctctatttgg

SEQ ID NO: 71843 - DNA, 201 bp, Bos taurus; identical to SEQ ID NO: 32129

SEQ ID NO: 71844 - DNA, 201 bp, Bos taurus
aataaataacaacaacaagagagtaaatcctaagagttctcatcacagggaaaatattttttctatttctttctttctttttttacttatatgacatgatrgatgttcactaattgcctggagaaatgtcaataacctcagatatgcagatgacaccacccttatggcagaaagtgaaaaactaaagagcctcttgattaa

SEQ ID NO: 71845 - DNA, 201 bp, Bos taurus
taaagagagctgactcagccaggagtactgcctttttgactccttccctcatttttcttccttctggctagaaagtggccatgataactggagctccagcmgctctattaggtcatgaggtaaccttgtaatgaaaaccatgtattaagagaagagcaggaagaagcagctttaaggcctgatgataacagaacttctatt

SEQ ID NO: 71846 - DNA, 201 bp, Bos taurus
aattggttcctttcctttagttaattaggtaaaattctactgatccaatggtaatacggtttataaaaacagaaaggaacatttgcaatgttggggaggtrggaaacaaatcgtggctaacactgttacagattcaaacagattttaagattctactcatggaactagaatttaccattttaaatgcctgtgtttctactt

SEQ ID NO: 71847 - DNA, 201 bp, Bos taurus; identical to SEQ ID NO: 32135

SEQ ID NO: 71848 - DNA, 201 bp, Bos taurus
attatgaaaggagtcaaagttagagggcttaatcaagtgaaatttctctggataagagagagagaggtgatggagaaaaggccagtttttggattcagttyagttcagttgctcagtcatgtctggctcttcacaaccccatggactgcagcatgccaggcctccctgtccatcaccaactcccagagtttattcaaactc

SEQ ID NO: 71849 - DNA, 201 bp, Bos taurus
agttcaacaggttcaaacctgggtaataatctttcccctcagacaaccttctcctcttgtgttacatatcattgtaagagccacaagaaccgaaaccaccrgcacatcttagagggacagaaatctgacaactggtacagaattcacactaaatcagcatggacactgcatcgtagacctccactgcttacaccacttttc

SEQ ID NO: 71850 - DNA, 201 bp, Bos taurus; identical to SEQ ID NO: 32136

SEQ ID NO: 71851 - DNA, 201 bp, Bos taurus
tgaggcatttaaaaatctctctgtatataatatgtaactaagtggggataagtttaaattaaacttcttcactatgagttggacctaaatgattttttacrtaagacatagtagatcaatatgttatatttgttcctttgctatgtcactttgtatatcatattctaattgcatttataggtatttataacttccctccaa

SEQ ID NO: 71852 - DNA, 201 bp, Bos taurus; identical to SEQ ID NO: 32138

SEQ ID NO: 71853 - DNA, 201 bp, Bos taurus; identical to SEQ ID NO: 32139

SEQ ID NO: 71854 - DNA, 201 bp, Bos taurus; identical to SEQ ID NO: 32140

SEQ ID NO: 71855 - DNA, 201 bp, Bos taurus; identical to SEQ ID NO: 32144

SEQ ID NO: 71856 - DNA, 201 bp, Bos taurus
gacacgactgagcgactgatctgatctgaaaatctctagatatttttcacaaactgaagttttcatattcaattctcactttgggccagcaaccacttacyccaataacaggcagagaattcatatgtgtagctgcctaagagaaggataaatatctggataatccattatgttttgttataaagcttctttcagtggcca

SEQ ID NO: 71857 - DNA, 201 bp, Bos taurus
ttctgagccaatctctgggcctcataactatgtgtgaaatgcttttagacaaatgaaacatgaaaagacagtttgggccatctgtccagtgccagaccaayagagtaaaatgattgggaggggtgggctggagcagtaaggggctagtggtgtcctgaaagacaagggtagatgaggcccaggtggagctagctggctcac

SEQ ID NO: 71858 - DNA, 201 bp, Bos taurus
catctaaagggagtttcgttgaccaagggaccagatgctacagaacagaatggccatactttctacccttatgtgtgtgtggactgtggcccacaaggctyctctgtgcatgggatttcccaggtgagaatactggagtgtgtagccttcccttctccaggggatcttcgtggccccgggactgaacccagatctcctgca

SEQ ID NO: 71859 - DNA, 201 bp, Bos taurus
atcactttcctcagagttaaattctgcctgcccccatttttctgggaaattaggatttacatattttccactcttccctttttcctccctctgcttgatgytatcttatgcatgaaattgtacaaggggttcaccttcattttctttttctctttttaaaaatgttttattttgtactgagatatagccaattaataatat

SEQ ID NO: 71860 - DNA, 201 bp, Bos taurus
taagtgttagcaagatgaaggaggagaatatcctgaggggcataacatctcactctaacacacagagctgtgatccaagtactaactcaatctgagggtgycaggatagactcaaagaaaggtctttgagtcctcacatacagtcctctgtgagtctctaagaagggacctgcatggcaagggatgtagcagtggctgtct

SEQ ID NO: 71861 - DNA, 201 bp, Bos taurus
ctgatctgggtagatatttaccccagactcctccttccattttttgttttctttttcttttcatgtgtcattcttgtgatgaatatttgaacatcagcgtrgtgcttacataactttaagtaccaagcttttcagagggaactggggcagccaagtggaacatattatggctggggaggggggaagtgctaccatgttgat

SEQ ID NO: 71862 - DNA, 201 bp, Bos taurus
gagataagagtattgctgaagaatactgcttaataaacctgtgagaccctgaagttattctgcttttattaaataattctacgggaaactggccagagctytatttttcctactagtgctaccaaaggcgagcatagttcaagctttatcttttctgtgacagcattttattaatctttgaatccttagaactgggcctcc

SEQ ID NO: 71863 - DNA, 201 bp, Bos taurus; identical to SEQ ID NO: 32147

SEQ ID NO: 71864 - DNA, 201 bp, Bos taurus
aaggaatcctaattcttatgacagttgcacactatagccctttctcagagctctgcaatgaacaatcatcacagtttctttggagccaggaaatggccttmttccctaacttgccagattcaatagataccttaagacaaatagatgagatcatgtcttgacacctctaaatcagatgaggcccttcagatgtctaaggag

SEQ ID NO: 71865 - DNA, 201 bp, Bos taurus; identical to SEQ ID NO: 32148

SEQ ID NO: 71866 - DNA, 201 bp, Bos taurus; identical to SEQ ID NO: 32150

SEQ ID NO: 71867 - DNA, 201 bp, Bos taurus; identical to SEQ ID NO: 32151

SEQ ID NO: 71868 - DNA, 201 bp, Bos taurus; identical to SEQ ID NO: 32153

SEQ ID NO: 71869 - DNA, 201 bp, Bos taurus
ggacctttcctcaggcatctctctttgagaattttagagatacagacatataagtcagcaattatgttatggaggtatgaagaaacttaaatcttccatcygtatatttatgatttgtcattttccgtatgcagatgtttcagtttctaagaactattgttttctttcactgatgaaagatctgatgtccaggcagtttaa

SEQ ID NO: 71870 - DNA, 201 bp, Bos taurus
cgtttgggaagagtgtgtactctgctgttattggttggagaaatctaaataacaattatatggcatggtttaataatatagttcagatcatctatgttcayactgactttttatctctatgatctgtcaattgctgttggaggggtattgatatcgtcaaataaaatggttgattcttctatttcttcttttatttttcat

SEQ ID NO: 71871 - DNA, 201 bp, Bos taurus; identical to SEQ ID NO: 32155

SEQ ID NO: 71872 - DNA, 201 bp, Bos taurus; identical to SEQ ID NO: 32156

SEQ ID NO: 71873 - DNA, 201 bp, Bos taurus; identical to SEQ ID NO: 32157

SEQ ID NO: 71874 - DNA, 201 bp, Bos taurus
ataccttttgcctctgtgcagaaatgtaactgagttcttaccaatggactatcaataggattgatgttcaccacttccaggccttgtctatgtaactgttmatatccattcttccattctaaaaatttcatagaatttgttcaatgaatttcaattccaagtgaccttgtgaaacgcaggccaaagttgttaagacctcag

SEQ ID NO: 71875 - DNA, 201 bp, Bos taurus; identical to SEQ ID NO: 32159

SEQ ID NO: 71876 - DNA, 201 bp, Bos taurus; identical to SEQ ID NO: 32160

SEQ ID NO: 71877 - DNA, 201 bp, Bos taurus; identical to SEQ ID NO: 32161

SEQ ID NO: 71878 - DNA, 201 bp, Bos taurus
ccctcataataatatcctaaagtgggcaggtgtggtagattggttgcataaatagactaaattcctcatctcttcaggcatccaggtccctgggccacacratgttgctattcttctaatagactgagtctgtgtcctagcactttaattctgcagtcacacatatgactttctttggccaatagcattttagctaatctg

SEQ ID NO: 71879 - DNA, 201 bp, Bos taurus
ggaagaagaaaaatcatatctgagagcagtcaagttctagtcacgttctggggcacaacacattttctatcaatgtgaagagtcagtcgtgctgggtacaytcagggaaggaagctaataaactgcacagtgggctgtgatgaccagttaatctgtttagcgtgtttactctttaattcaagccgagagggtagcctcatc

SEQ ID NO: 71880 - DNA, 201 bp, Bos taurus
cccatatgtcatgtcagttacacaaaaaattttatgggttctctgctttagttttcaagataggtgtaaactgtgttttgtaaaaataccctaaatcatayagaatcatgttttatgaataattatttgaatggctaatttcatatactttgaggaggctgtcatatttttattgcaattactcttaccgtctgatagttg

SEQ ID NO: 71881 - DNA, 201 bp, Bos taurus
gttgtaaatgaaagaggaccaagggcccaggggtcgagcagccagaccaagagacagcctcatagacgaaatgacaagtgagcttcaagcatctctgcttycagtgggccctgggtgatcaggtcatgttgaagacagagacctaaacagctgatgataggggatgaaagactcaggctccttgacacaggagctcccttt

SEQ ID NO: 71882 - DNA, 201 bp, Bos taurus; identical to SEQ ID NO: 32164

SEQ ID NO: 71883 - DNA, 201 bp, Bos taurus; identical to SEQ ID NO: 32168

SEQ ID NO: 71884 - DNA, 201 bp, Bos taurus
gagggtgggaggtagtgtaatagcacagccagtatagcctgccttgggctgaggattcctggcacaccccaagacctcatggctggccaccgtgtgtcctrgatgcattctgctgccttgagaacatgtggtccggtgttgtagagagcaacagccttcaggccttcagcgtcgtgttgccatgacaacagacaactatag

SEQ ID NO: 71885 - DNA, 201 bp, Bos taurus; identical to SEQ ID NO: 32170

SEQ ID NO: 71886 - DNA, 201 bp, Bos taurus; identical to SEQ ID NO: 32171

SEQ ID NO: 71887 - DNA, 201 bp, Bos taurus; identical to SEQ ID NO: 32172

SEQ ID NO: 71888 - DNA, 201 bp, Bos taurus; identical to SEQ ID NO: 32173

SEQ ID NO: 71889 - DNA, 201 bp, Bos taurus; identical to SEQ ID NO: 32174

SEQ ID NO: 71890 - DNA, 201 bp, Bos taurus; identical to SEQ ID NO: 32175

SEQ ID NO: 71891 - DNA, 201 bp, Bos taurus; identical to SEQ ID NO: 32176

SEQ ID NO: 71892 - DNA, 201 bp, Bos taurus; identical to SEQ ID NO: 32177

SEQ ID NO: 71893 - DNA, 201 bp, Bos taurus
ccggtcctcgtcaccccctgctgtgcgtgcccctccatccttatgaccacggtcttcatcatctcttgcctgaactgttgcaaggcctcttgagcatttcyagctcttccacttctgccccttctgacctgcccctctgtctcctccagccctaaagctaaggaccaccaatggcactccgcccccttctgttcgactctg

SEQ ID NO: 71894 - DNA, 201 bp, Bos taurus
ttctaggtttgtcaatgactctgaaatttccaacttatgctgcaagaggtcaaaagcccttggagagaagtcaatgggtaggtacgactatttcaatatamtcaaaaaacagaagttaaaattttttactattagctccctagactgcaaaaatgtgtgcatcttttctcttgactcagaagtgaaggagcagtatgcctc

SEQ ID NO: 71895 - DNA, 201 bp, Bos taurus
ggccttggctgaagctcccaaattctagaggcttgagggctcagtcactccattccatttcctcaaagcaaagttctgatttaaatttatttttccctagwggggtggaatgggagtggggaggccggctcaagagggagaggatgtatatatatagttatgactgattcacgttgtacagcagaaaccaacagaacactg

SEQ ID NO: 71896 - DNA, 201 bp, Bos taurus; identical to SEQ ID NO: 32182

SEQ ID NO: 71897 - DNA, 201 bp, Bos taurus
gagatgagaggcttcttgttggccactcatgaagcagggcagccactcttgagagaaggatttatagctgtcaacatcagggtctcttgctaggggagtcragggcctgactgcaacggagtgaaagggttcaaaagaaaacttagagtcagtgagagtagacagcactttcaaggaattttattgccaaaagggtaaaga

SEQ ID NO: 71898 - DNA, 201 bp, Bos taurus
gagctcacatagtaactcaagtgatggggagcaggtataaagctgtgctcagttattcgttgcttatctcctgctgtgcagcccagcttctaacaggccayggatggtactggggggttgggaaccccggactaaaggacctactggaatgatactgaatttatcttgctgagttaggggtaggtggtggcacagggtaag

SEQ ID NO: 71899 - DNA, 201 bp, Bos taurus; identical to SEQ ID NO: 32183

SEQ ID NO: 71900 - DNA, 201 bp, Bos taurus; identical to SEQ ID NO: 32184

SEQ ID NO: 71901 - DNA, 201 bp, Bos taurus; identical to SEQ ID NO: 32185

SEQ ID NO: 71902 - DNA, 201 bp, Bos taurus; identical to SEQ ID NO: 32187

SEQ ID NO: 71903 - DNA, 201 bp, Bos taurus; identical to SEQ ID NO: 32188

SEQ ID NO: 71904 - DNA, 201 bp, Bos taurus
ctataagaaaggcttcaattatttttaagaaagcaggggataatatattgatatacatttctgtttaaattgctgttattttgtaaattcttcagtactgraaaagtaactttctagcacctgagtttcccacaaatacaaacagtaattgtatcaagcatattaaaaaaagctaaaaataataattgtatatacttatac

SEQ ID NO: 71905 - DNA, 201 bp, Bos taurus
cttgaggttgggactactatcatatcccttttacagaggactaactggtaatcaggaggattaactaaattacccagttttatgtggctattaagtggtaragttaagactgagctataatatgggaggaatattgaccagagggaaatgtcgactgaaagatttacccagatattttctcctaatgctaggattgagcaa

SEQ ID NO: 71906 - DNA, 201 bp, Bos taurus
aagatgtgacagggactaaggatgtggtcagactgaattagggccacatctttgcagaaaaaatgtagctggacacagtcacccaggctttctccatgggkacattgagggaaggtagtcctggccataagtatagctcttctcagcttgatgagcagctgtagaatttattttcaccacttgggtagaatacaagtggag

SEQ ID NO: 71907 - DNA, 201 bp, Bos taurus
tggagtcgcacagagtaggacacgactgagcgactggacaacaacaacccatctgctaaggctggtccctccaccacagaactggactccttttcctctcrccttactcaagaatttcgtcttaaacacatttcccttatatcttcacatttccctttctactagatcaataccatcatatcccttaacaacactctcctt

SEQ ID NO: 71908 - DNA, 201 bp, Bos taurus
cccaaaatggtgattcacgcaacctcaccgtttccaggtttcaacatggcttccgtaacccgcgccaacagaggttaatctcaggacgccggccgaacgcycgcggaagtagcgtcagcggaagtgcgtcagcggaagttttttggaactcagctccccggctctacgtcccgcccccgcgctgacgccccgcccccagcg

SEQ ID NO: 71909 - DNA, 201 bp, Bos taurus
ctctacattgtctgggtcaccctggacttttgatctcttagagttgtccacgctgtgcttccagcaattccacaattacaattctggtttctctaccctgrgactggctcccaaagaggtttctgctccaatatattgcctttgtgtctctccagatctgggagcgatagtttgctcggtgtatgaaaagttgctggtttt

SEQ ID NO: 71910 - DNA, 201 bp, Bos taurus
gcagaatatcatgtccaagctggtttcagttaccaggtcaacaggcatctccatcactctgagagtatagcaaattctgaagaatcttcattctgttttcmaaagtggctgcaccaatttacaatcccaccaacaacgtatgagggttgtcttttctccacatccttaccaatgcttgctacttcttgcatttttgatcaa

SEQ ID NO: 71911 - DNA, 201 bp, Bos taurus
acagaggaacctgacatagtgaaagctcagatttttcctttacagttctgtttgctaggagtctgaagagagtctccatgggccaacatcccagtggtcayagggctgtgttcttcctgcagtctctggggaggactcctttcccagccttttgtggtttctgtgtggcctcatttcttggctcaggaccctctttattct

SEQ ID NO: 71912 - DNA, 201 bp, Bos taurus
tacagtctagagattctgttgttgttttaatgaaagcacagacttactctgttcagttctctatgctagaagtctgaccagggtctccttgggccaacatyctggtgtccacagagctgcgttctttctgaaggcacgagaaggactcctttcccagcgtttcccggttcctatgtggcctcattccttggctcagagcct

SEQ ID NO: 71913 - DNA, 201 bp, Bos taurus; identical to SEQ ID NO: 32205

SEQ ID NO: 71914 - DNA, 201 bp, Bos taurus; identical to SEQ ID NO: 32206

SEQ ID NO: 71915 - DNA, 201 bp, Bos taurus; identical to SEQ ID NO: 32207

SEQ ID NO: 71916 - DNA, 201 bp, Bos taurus
cgggccagttctgggggccaggaactaagaacctgtgtcggaggctgttgtccactattctaggtgctgctccctttttctcagccggttggataggtggyggcctgtaaccttgttagaggtactttaggatctgtggcctgcactctgggtagaggtgatgaggaagctgagtttcagagacttcttgtgggcttccat

SEQ ID NO: 71917 - DNA, 201 bp, Bos taurus
ccacacagaacctgaccgagctggacacgaagatccaggagaaggccatgaaggtggacatggacatctgccgccgcattgacatcactgccaagctctgygacttggctcagcagcgcaactgcgaggacatgatcaagatgttccaggtgagggttgccggcgcctcgccccagccccggcggccccacctcactggtg

SEQ ID NO: 71918 - DNA, 201 bp, Bos taurus; identical to SEQ ID NO: 32210

SEQ ID NO: 71919 - DNA, 201 bp, Bos taurus
cggtccttggaggtcaaaggggagtgatgctaactaatgctggtctatccagaggcctttgtggtagaatccagcttgactgagatgtgtgcatacatatrggaggatcctgagatatacgaaatatggactgtgaaccaggcaaataaaaatgattagccaaaggaaacctggaagaaatacaccaaaaaagtaattcaa

SEQ ID NO: 71920 - DNA, 201 bp, Bos taurus; identical to SEQ ID NO: 32211

SEQ ID NO: 71921 - DNA, 201 bp, Bos taurus
tgacatgtgtccttttaagaaacacagaggggagacagagagcgagaaggagagaccatgtgaagacagaggcagagactggagcgatgtggccacaagcygagaaaggtctggagcccctggaggctggaagagacaggaaactccttctctgtcttagagccattggaggagcttggccttgttgccatcttttttttt

SEQ ID NO: 71922 - DNA, 201 bp, Bos taurus
taggaatgattgtgttggggcaaaggttcctttttagcacctggctaaatcctggctctggatgtttctgcggtgtgtcctgattcagtgtagtgggcagyggcagggtcaggggatgaggaacatgggccatcggaggggtgctgagctcagcagaagtgccttcagtgtgggcaaaggtcagaggtcagatgatagatg

SEQ ID NO: 71923 - DNA, 201 bp, Bos taurus
atccatggcaggtggacaaatgactactgaacagtgaacaaatacaggcataaatacagctacagacatcttgccaataaaaggtacatgtttaggggtcrcatgcctgagagtcttggtttcacaagaaccatgctgtgaccttctcctcttcatatgcactgctctgccctctgtctcctgacccctcactcccaaacc

SEQ ID NO: 71924 - DNA, 201 bp, Bos taurus
cggtgtgggtagtagctctgtagggtcagaggagctggctgagggcccatggaagcacacatgtgctgtcccttttttgcgggtgggaggtggggggagcrggaagggagctgtccccgggcctgaccctgcaggcgtctgcccacctgctcactctgtagaggtcagcccactttggggggacagcctgtctctctagcc

SEQ ID NO: 71925 - DNA, 201 bp, Bos taurus
tctcaaccattctttacatcctcctgtgatgaagaggaggaggaggacagtgatagatatatttatggagctcttggcatataacaagccttaaattaagygtattacatagattttctactttgacccaatgggctagttaatatttatttctcatcttaaaggtaagaaaactaaagcttatggagtcttacttcatac

SEQ ID NO: 71926 - DNA, 201 bp, Bos taurus; identical to SEQ ID NO: 32215

SEQ ID NO: 71927 - DNA, 201 bp, Bos taurus
gaagacaagcccatggcctgagaccctacacgctctctaattggtgagaacggggtgttggtgggaatgacattccgacactaactctgaacatccgacgrtgggggaagggcagtggccagatatcggcagaaccccgggctcatcctagctctgactagctttctcagacttagagactgagtcaccctcctgcccttc

SEQ ID NO: 71928 - DNA, 201 bp, Bos taurus; identical to SEQ ID NO: 32216

SEQ ID NO: 71929 - DNA, 201 bp, Bos taurus; identical to SEQ ID NO: 32217

SEQ ID NO: 71930 - DNA, 201 bp, Bos taurus
gcctgagaggacattctggacaccaacatccctccccagccctcactgacgcttggtgaacgactgccaacgaggtcaaccctgcgctctggctggctcaraggctggccttgcacacatcctgctggcctccagttttgttttgttttgtttttaatgtgggtaaacatggaccacagacccacaccaggcacctactct

SEQ ID NO: 71931 - DNA, 201 bp, Bos taurus; identical to SEQ ID NO: 32219

SEQ ID NO: 71932 - DNA, 201 bp, Bos taurus; identical to SEQ ID NO: 32220

SEQ ID NO: 71933 - DNA, 201 bp, Bos taurus
cctcggggacattacagagccccccaaatttaaaatacaaaagcactttgaagatcaaggaaagcaacaagggaggcaggggtccagacgacaggcctagytctaagaagtctttcttctacaaggaagtattcgaatctcgtaacgcgggtgatgccaaagagggaggaaggaccttaccggcggagagaaagatgttca

SEQ ID NO: 71934 - DNA, 201 bp, Bos taurus; identical to SEQ ID NO: 32223

SEQ ID NO: 71935 - DNA, 201 bp, Bos taurus
gtggccagtaggaagaagctgtggctgtaaggaattagtaatgagatatgaagttgctcacctccaggtcactagttcaaaaccagatcagcagggagtcraagttcctgaccaaggaggccacggaggtttgtttgaatggctggaaggcaagaaattcgttttctcagaagtcagtgccggccggtcagccagggccac

SEQ ID NO: 71936 - DNA, 201 bp, Bos taurus; identical to SEQ ID NO: 32224

SEQ ID NO: 71937 - DNA, 201 bp, Bos taurus; identical to SEQ ID NO: 32226

SEQ ID NO: 71938 - DNA, 201 bp, Bos taurus
ccccaagctgggagcccacctctctgcctccccagagtgagctggggcatcaccagccatgtcagcgctgcggctgggagaagggtctgcggccgatgccygacgactggtctgatagtcagaccccacttcccttggggaaggcagtaggaggtgacagtagcagagctgggccccccaccaccacggctcaaatccccc

SEQ ID NO: 71939 - DNA, 201 bp, Bos taurus
cgcctgaggaattcagggcatcccgggcccagcattgttcacatcacacattcctcttcttgaaaagctcctggatagctctcattcctctacctcccggragaaaccatagtagaggacgggccaccagatcccccatgtgatgggaacaaaggggggacagccacagggtacccctgcccaccagctccctggcagggg

SEQ ID NO: 71940 - DNA, 201 bp, Bos taurus; identical to SEQ ID NO: 32231

SEQ ID NO: 71941 - DNA, 201 bp, Bos taurus; identical to SEQ ID NO: 32232

SEQ ID NO: 71942 - DNA, 201 bp, Bos taurus
aatgcacaaaagcatctctctatggctgaatggctaactaggacattcccacactgtggaagggtttataaattttaataatgcacagcaacctggaattygtgcaccatctccaagactcctcctgcccactaactgtaagcagatttaataagccctgagatacagacaaggaggtgtgctgattctctgacagtcccc

SEQ ID NO: 71943 - DNA, 201 bp, Bos taurus; identical to SEQ ID NO: 32234

SEQ ID NO: 71944 - DNA, 201 bp, Bos taurus; identical to SEQ ID NO: 32235

SEQ ID NO: 71945 - DNA, 201 bp, Bos taurus; identical to SEQ ID NO: 32236

SEQ ID NO: 71946 - DNA, 201 bp, Bos taurus; identical to SEQ ID NO: 32239

SEQ ID NO: 71947 - DNA, 201 bp, Bos taurus; identical to SEQ ID NO: 32240

SEQ ID NO: 71948 - DNA, 201 bp, Bos taurus
cagtagccacagaggtaacatggagctcatatgagctaccccaccagtgtaatcagccttttcccaaagcaggggatttctaagagcgaagcagaggtcaytgcaaattagaattgctttggaggccttaactcttcattgaaaactgccaccatatttgtggtccctgggattaggaactggaggtggggtggcaagtaa

SEQ ID NO: 71949 - DNA, 201 bp, Bos taurus
attgtatgttaggtatatgtttaattttttgaaatattgtcaagccattttttttaagtgttattttacatttctgcctgcaggatataggaattcagttkatatatcattctccctaatacatggtatggtcagtctttaattgtaggtatttttataggtgtgtagtggtatgtcatggtttttatttgtgtttcccta

SEQ ID NO: 71950 - DNA, 201 bp, Bos taurus
gaatggccagtgaggtaagaagggaagcctagaagctacttgtgaactgatttgtgttgtgccaaaattcccattgaagcttgtgccccagtacctcagaytgtgactgtaactagagataaggcctgtaaagaggtgaaagttgaaagttaagtcgctcagtcatgtccgactctttgtgaccccatggactgtagccta

SEQ ID NO: 71951 - DNA, 201 bp, Bos taurus
ttttgaaccaaggcctttcttgtagggatcctggaattttccagtattcttctctttatggttttcctgacctagatgacaagcttcgtggtatgaatatrtagtagtggccaggtctgaactctgttttgttgctgctgttttaagaactcacagaaatatagtagcgactatgagaagtaggatttaaaacattaagaa

SEQ ID NO: 71952 - DNA, 201 bp, Bos taurus
gttaatgttatcattgcagtagttttcagtgactcgttagagctttgggcagtgtttgccataagaattctcagctagtaattcatatttgtgtgtaatargccatgtttgcctttctgatagaagtccatatttacctccccagaacttccttcttagtttgtatagattatcagggctagtggttttggttgtctaacc

SEQ ID NO: 71953 - DNA, 201 bp, Bos taurus
ggtgttttagggccgtagtcctggaatctcaaattatccaccacaatgggagaaccaaggtagaaggacctcctccctggcctgcaggaggaagaggcccygtgcagggcggtggctcaaccagctcttctggtggtcctccgggccctgctgggtccaccttccccaccagataatggtccctgctgcctgcctgtggat

SEQ ID NO: 71954 - DNA, 201 bp, Bos taurus; identical to SEQ ID NO: 32243

SEQ ID NO: 71955 - DNA, 201 bp, Bos taurus; identical to SEQ ID NO: 32245

SEQ ID NO: 71956 - DNA, 201 bp, Bos taurus
aaaaatttgtttattataaagtaatacttgcttacagtaaaagattagaaaagcagaacactgaataaacagagctaggcaacctctctggtgggccagtrgttaggactctacactgttactgagggggcatgggtttgatccctggttggggaacaaagatcccatctgcattgcagtgtggccaaaaaataaaataaa

SEQ ID NO: 71957 - DNA, 201 bp, Bos taurus
agtagaagactggttgctgaaagtaggggaaattgagagaggctggagaaagggcataaactcacagttataagaggaatgagatctgaggatggtgactrtagttggcaacagtattgtatgagattttctagaaagtagaatttaaatttcttcccaccccccaagaggggtgtaagtacatggggtgacagatgtgtt

SEQ ID NO: 71958 - DNA, 201 bp, Bos taurus; identical to SEQ ID NO: 32246

SEQ ID NO: 71959 - DNA, 201 bp, Bos taurus; identical to SEQ ID NO: 32247

SEQ ID NO: 71960 - DNA, 201 bp, Bos taurus; identical to SEQ ID NO: 32248

SEQ ID NO: 71961 - DNA, 201 bp, Bos taurus; identical to SEQ ID NO: 32249

SEQ ID NO: 71962 - DNA, 201 bp, Bos taurus
ccccctggctcactcatctgcacctttttccaggtccatcatgtggttagcatttctctggaaatgtcatgcctttggtcaagctgtttccatggccaggyacaggcttccgtgtagagagggtagcctcctccaggaagccctccctgactgccttctctgggtcagctggctcctggggcccccactgcccactagggg

SEQ ID NO: 71963 - DNA, 201 bp, Bos taurus
atcaccaatgggctccggctgccaaaatctctcagttcacagaggctgggatgttgggtgtggtgcccagagcaagagtgagactggccctgggccctgcmctggtcacactgctcagccccataaccagccctggcataaatctccaaggatcagaggaaagagagcaggctggggggcctggcaagggcagcgagggcg

SEQ ID NO: 71964 - DNA, 201 bp, Bos taurus; identical to SEQ ID NO: 32250

SEQ ID NO: 71965 - DNA, 201 bp, Bos taurus
atttatcctgccttctatgtgaagaataaatggtaggggcaaggtctaaaggaaggaagctagttagaaattattatcaataatccagaacagatattaayagatggtttaggccagtgaggtaacaaaggagaaggttgtgagaagtaattaaatttacatttttttctccctctctgtacacatatagatacaaatagg

SEQ ID NO: 71966 - DNA, 201 bp, Bos taurus
cagtgggcctcagttgcctcacctgtaaaacagaatgacaaaaacatctactccataggatggttgtgagattaatcaaattctttcaaaggtctcaacaygggccaaacggggtcagaattcacacccagggtgaagccaggcagtgagggcagcagctacacgcatacactcagctgccatcgtagaagcccactctgc

SEQ ID NO: 71967 - DNA, 201 bp, Bos taurus
agggactccttgtcaaagggctgggtggtggacaatggtactgaaggattccccatgctcccaacgggagccaaaccggaaaatggtggccactagaattygacagagccaaatcagaacatgacaatcagcacagtgtctctgtccgcccgtcagtaagttcatcatttctggtttctgacaactctagaggccaaagga

SEQ ID NO: 71968 - DNA, 201 bp, Bos taurus
tccttgtgggccacgttccctgttggctgttgcctggagacttccctcagttccacgtccgtgtgtttcttcataaggcagctcaaatcctggcagccgcytccctcagagcgagcaaggaggggccggagagcaggagcttgaccgaggccggggctttgtaatctcctcacacaagtgacatcccgtcacttcttgcca

SEQ ID NO: 71969 - DNA, 201 bp, Bos taurus; identical to SEQ ID NO: 32256

SEQ ID NO: 71970 - DNA, 201 bp, Bos taurus
aagaactggctagaacttgagagatcctctgagtcatttccctactgcacagcacctaactcatttcagaaaggtggcctactcttcaactgtaacatttkcaaagaaagattgctttaaaaattttttttatttggctgtgatgggtcttagttgtggcactcaggatcttcgtggcatcatgcgagatctttcgttttg

SEQ ID NO: 71971 - DNA, 201 bp, Bos taurus
tgacctctctgagctattctagagaactgaacagagcaacttggagttgtcatgagaaggaaacaagttaaagggaattgtttggtgagggccctgcaaayggtgggcagcccctcaccgcccccccaccaccaacttggcagagacaggcttcctcacctcaccccactcccagacatgctgctgcaatggcctctttgc

SEQ ID NO: 71972 - DNA, 201 bp, Bos taurus
gccatgtgccttgaagactcttagttccccaaccaggaattgaaccgtggacccccagcagtgaatgcttggagtcctaaccactggaccccacagggaaytcccagggccacagttttcctagaggtgtgtttcctgctcggtgaggtaaggcagtctcccagcatcgctcaaaggattgtgcactgtacagactcactc

SEQ ID NO: 71973 - DNA, 201 bp, Bos taurus
gagaccaccaaaagatagctcccaaagttgccaagtgtccctgggggttaaaatcgttccagttgaaaaagagctctttgagctcagttgaaaaggccacrtgctcctccctgggctgctttcctgggcatacctcctgcaaaaccattccttttgtttgacaggacactttggcccagagagactggttgacttgccaaa

SEQ ID NO: 71974 - DNA, 201 bp, Bos taurus
gtgataaataagacctggtttcacgtatgttaagcgttatggctctggtgagtttcagaagctcagctgccattttggatctaagttcctgcagagcccakccttatggcacaccaaactctggtaattcaggagcaaataaaaatgagttatacatcaagcgtgcaggtggatagtccttaatttgtgccttttgttgaa

SEQ ID NO: 71975 - DNA, 201 bp, Bos taurus; identical to SEQ ID NO: 32259

SEQ ID NO: 71976 - DNA, 201 bp, Bos taurus; identical to SEQ ID NO: 32260

SEQ ID NO: 71977 - DNA, 201 bp, Bos taurus; identical to SEQ ID NO: 32264

SEQ ID NO: 71978 - DNA, 201 bp, Bos taurus
gcgtcaatgtgtgcaacagttataggagcacgtcgcactttctgggaaggctaagctgtttaggtaggacactgggctgtcacaggggtgggcggggccargtcatgaaggtcctgtgtgccatactaaaagaccggagattcaagttcttttgaaaagaaccggaatctcacgcaagtgttgagaatggacgtgtagaca

SEQ ID NO: 71979 - DNA, 201 bp, Bos taurus
atctttgccaagaaagaaaagggtgttctaaataatggaagcaggcattaagatactcagacaggcctggtgggtggcctaggtcacccagagttgtgtcstgagtctgaagagaagtaagtcagggtatgatgcagtgggcatgaccccaggaaaatcgtgcagaaaggcaggggccagggacgtaggaggtccaacacg

SEQ ID NO: 71980 - DNA, 201 bp, Bos taurus; identical to SEQ ID NO: 32265

SEQ ID NO: 71981 - DNA, 201 bp, Bos taurus; identical to SEQ ID NO: 32266

SEQ ID NO: 71982 - DNA, 201 bp, Bos taurus; identical to SEQ ID NO: 32267

SEQ ID NO: 71983 - DNA, 201 bp, Bos taurus
ggccagccaagcacatgcgtttctcccagagccgtcctgagaggggaggggaggggagggttgccctcctacacctggccccacctgtacctccttccgtkagcctttgttctagctagaagggcccctgaattctccaggtaacccctgagagggaaggaaatgccttcccagagatgaacataaagccagctcaggccc

SEQ ID NO: 71984 - DNA, 201 bp, Bos taurus
cctgacctatctggtgacgtcctgcaactccctgaaggccccaggctcagctgcgttcttatgaattcactcagctgtttgctgtgctgtccactcccccmacaaatagggcccgacctgggactctggttgggacagaaaggctgagcctccgaggaggaggcagcagcttacccagcagagaagtgagcagggtcagcc

SEQ ID NO: 71985 - DNA, 201 bp, Bos taurus
agggctgcccacattctccaaggctcctgcaaggtgggtgcctctatgggtggctcccagatctgagttccacggaagatgattcagggctggcccagccytcacttggttctgaaccatttatggtttataaaacaccttccctagtgtcagtaatgcctaacacggcccccggcatcactgacaccccagtgagcccag

SEQ ID NO: 71986 - DNA, 201 bp, Bos taurus; identical to SEQ ID NO: 32274

SEQ ID NO: 71987 - DNA, 201 bp, Bos taurus; identical to SEQ ID NO: 32275

SEQ ID NO: 71988 - DNA, 201 bp, Bos taurus; identical to SEQ ID NO: 32276

SEQ ID NO: 71989 - DNA, 201 bp, Bos taurus; identical to SEQ ID NO: 32277

SEQ ID NO: 71990 - DNA, 201 bp, Bos taurus
ttggtggattttttttttttttccttttgacacttgaaatatttcattccactctttccgtgtttgcatggtttctgaagacaagtatgtgtaggccatayttttttttgtggttgcaagtgtcataaaatttttgttgaaaactgggcaattctcaaatcatcttggccctcctttccattttgtttgtttagaggctct

SEQ ID NO: 71991 - DNA, 201 bp, Bos taurus; identical to SEQ ID NO: 32278

SEQ ID NO: 71992 - DNA, 201 bp, Bos taurus; identical to SEQ ID NO: 32279

SEQ ID NO: 71993 - DNA, 201 bp, Bos taurus; identical to SEQ ID NO: 32280

SEQ ID NO: 71994 - DNA, 201 bp, Bos taurus; identical to SEQ ID NO: 32281

SEQ ID NO: 71995 - DNA, 201 bp, Bos taurus; identical to SEQ ID NO: 32282

SEQ ID NO: 71996 - DNA, 201 bp, Bos taurus
ccacaagttttaaactttcaccaaagaggagaagccagtggccctgtgtaggcacacaccaggactcagcaagtctctgaggtctcttcatttactgaaaytctgacggagggggccccgggcagcctttctgtctcagtcttttgtagttcaaggctacagctagcctatgttgaagcaattaagtatctccccctgagt

SEQ ID NO: 71997 - DNA, 201 bp, Bos taurus; identical to SEQ ID NO: 32284

SEQ ID NO: 71998 - DNA, 201 bp, Bos taurus; identical to SEQ ID NO: 32285

SEQ ID NO: 71999 - DNA, 201 bp, Bos taurus
gtctctggcaccaacccagccaacctgagccacttgggctgtatctctgtgctgggtaccagctttcatctggtcacacctgagcccctgcgggcaaccayctggcctctctggggccattcaggtctccacatgacctgagcagcaaaaccacgacccacaaaaccatccctgcaccaacagcaacatctttccatcgac

SEQ ID NO: 72000 - DNA, 201 bp, Bos taurus; identical to SEQ ID NO: 32287

SEQ ID NO: 72001 - DNA, 201 bp, Bos taurus
ttcctgcatccaggaaggagcctggaaggcttcgtgtggagctgacgtttcttttcctctttctgcccgagggagaggcgggcccccgggggttggctccrgttccctgctgcttccccacgtagaccctcaggtttggttgtgagagacccgggaggaagtgtgtttatgagagccgagaagtcgggaggatggttctgc

SEQ ID NO: 72002 - DNA, 201 bp, Bos taurus
ttcagatgagggactgcactggagatttctggggcacttgtgtctcagttggggacacacaacaggtctactgaggaatgcccaggctgtggcctcaagcwgctgagctagagaatccagtcgggttgggggctgttagattaaaaaccactgggggctcagtcagtgaagcaggcctggtgttcattaagaccctgctcg

SEQ ID NO: 72003 - DNA, 201 bp, Bos taurus; identical to SEQ ID NO: 32293

SEQ ID NO: 72004 - DNA, 201 bp, Bos taurus; identical to SEQ ID NO: 32295

SEQ ID NO: 72005 - DNA, 201 bp, Bos taurus
aaaaggccaggccttgccctccccatccctgcgccatgggaagctgtctccccttccccagcagtgagtcacaaaggctcatcgagccctggctgtgtgtrctccctggcccgggtggagccggccctgcaggggtcgggggcagcagtggcttggtgggcagagccgagctgctgctcctgggactgacactgagatcag

SEQ ID NO: 72006 - DNA, 201 bp, Bos taurus
actgtaagcatgagagaattcaacaggattttacaaaactcaaggctctgagtggtgtttcaaaccttcctgggcatgtgaggcctctttaattcaggaaytatcttttcccaaagactccgccgtccactgtccatacagcaggctgcgctgcggcccggcatcctccacgcgttccctgcgctctcccacctcccggcc

SEQ ID NO: 72007 - DNA, 201 bp, Bos taurus
gtaaactccgagagttggtgatggacagggaggcctggaatgctgtggtccatgggattgcaaagaatcagacacaactgagcaactgaactgaaatgagrtaatcaagaagctgggggccaagataggggacgggccgtgtccacagtgacgtggagagcctggtgcacaggcctgggagtttccgtggacccggaggag

SEQ ID NO: 72008 - DNA, 201 bp, Bos taurus; identical to SEQ ID NO: 32298

SEQ ID NO: 72009 - DNA, 201 bp, Bos taurus; identical to SEQ ID NO: 32299

SEQ ID NO: 72010 - DNA, 201 bp, Bos taurus
caaaccggccagggtcacgcagcacctgagacccagagcctggatccaggcttgtagacccagtctcctccccagggagacagaaggccaggctgctgagkggggagggcgtgaccgcgtggacccaagtggtgcccgcaaggactgggagtggtggaggggctggtccagggggcggggcgcctggcccctgcactgcgg

SEQ ID NO: 72011 - DNA, 201 bp, Bos taurus; identical to SEQ ID NO: 32301

SEQ ID NO: 72012 - DNA, 201 bp, Bos taurus
atggcacagccctttacaatgaacagttccttgacagtagtggctgatgttcatcttgcagtcagcgtttgccaggccctcttcctaccaccctgcacacrtttgtctccctggtggtttatttcatttttaaaagtctttgttgaatttgttacaatattgctcctgttttatgttttttggccaagaggcatgtggggt

SEQ ID NO: 72013 - DNA, 201 bp, Bos taurus; identical to SEQ ID NO: 32303

SEQ ID NO: 72014 - DNA, 201 bp, Bos taurus; identical to SEQ ID NO: 32304

SEQ ID NO: 72015 - DNA, 201 bp, Bos taurus; identical to SEQ ID NO: 32305

SEQ ID NO: 72016 - DNA, 201 bp, Bos taurus; identical to SEQ ID NO: 32306

SEQ ID NO: 72017 - DNA, 201 bp, Bos taurus; identical to SEQ ID NO: 32307

SEQ ID NO: 72018 - DNA, 201 bp, Bos taurus; identical to SEQ ID NO: 32309

SEQ ID NO: 72019 - DNA, 201 bp, Bos taurus; identical to SEQ ID NO: 32311

SEQ ID NO: 72020 - DNA, 201 bp, Bos taurus
gcgcaggagaaggggacagggatgcagaaaaaagggggtgcggcagtgagtggtttgcactcatcaaagtgagcagggcgagtgggtggccagggctctgsgaggctcttggtggcccttccggctgcctggtcagcagggttgaagggcaggctgcctggcccccagggttattatttcttgacccctcagcctggtttg

SEQ ID NO: 72021 - DNA, 201 bp, Bos taurus
gggaagcctggcgtgccacagtccagggggtcgcaaagagctagacatgacttaggggctggacaacaaaggaaacccgaaagttcaaaaccaaggtgtcrgcgggccagcatccccccggggctccagtgaggacctgctcctcgcctcccgagagctgagaagattgaatcagaacattctggaggagcagttgatgaa

SEQ ID NO: 72022 - DNA, 201 bp, Bos taurus
actttgttaaggacactgagatattcagccagagcctacctgcgcaagcaggcagaggctaatcctcacctcagactcagtatgaaaggaagcgtggctgycatggccacctgtatctctgcccttgatagacgtcagggtcagccaggttcctgccccccgggaggggtccatgctctgagcatctttcctgatgctggg

SEQ ID NO: 72023 - DNA, 201 bp, Bos taurus; identical to SEQ ID NO: 32315

SEQ ID NO: 72024 - DNA, 201 bp, Bos taurus
catgttggccatggtcacagacattgtgctgcgggctttgctctgtgtccacctcgggctggaaagaggcagaaagagtgaagatgaacgtttggagacakaaaggcctggctgcggtgccctgcttgctctcccatcaggaccacgtggtctcagctcaggctctgtgccccgtttgcaggcagatgtctgtctccctgc

SEQ ID NO: 72025 - DNA, 201 bp, Bos taurus
gaggggaggtctggctgtcatgggacactcagccgtgggagcaaggggagcagggtcgaccccaaaaagggaagggaattggagttggtggatggggactyggggccatcatgtgggggggatggagaggcgtttactaaagttcctcggtggttccactggtgtgggagcggctgcacgtgggaggaagatgggaggcag

SEQ ID NO: 72026 - DNA, 201 bp, Bos taurus; identical to SEQ ID NO: 32316

SEQ ID NO: 72027 - DNA, 201 bp, Bos taurus
ggcgcattttaataaggaaaggccctcttgccggagtgtctgcgtttaatagacagtcatttacggacaggggagaagctgtcctgctagtgggtttttayggccgtgactcaggccgcccttttgtggataaatggctaagagctatttttccataaattaacaagagaggaaaacccataaaatgtgttaggaggcttc

SEQ ID NO: 72028 - DNA, 201 bp, Bos taurus; identical to SEQ ID NO: 32317

SEQ ID NO: 72029 - DNA, 201 bp, Bos taurus; identical to SEQ ID NO: 32318

SEQ ID NO: 72030 - DNA, 201 bp, Bos taurus
tggaccagcttagctggcggttgcatttaccagatgacactgcggagtttgaaagggattgttcttgcaagaggccgacttcagggcccagagaagctgcygggggtgagcagggggtcagggcagcccccaagagacagcaagtaggggcttgaggagggaggtggaggcggggatgaagggaggagaggggccctgact

SEQ ID NO: 72031 - DNA, 201 bp, Bos taurus
gcctccccgtcgtctgtagccccctcgtctctcgtacggagtgggtctcattcccgggcaggtgaccacacaccgctgaaacagaaggccagggcactctkaacagagctcagtttcccgagggtctccctgctccctcccttctgcatctctccccgcctctcccctctgaccccctccactcccccgcctctctctggt

SEQ ID NO: 72032 - DNA, 201 bp, Bos taurus
aaacaactctgatggggatgcagagagaatgcttaatcggccttttcacctttaatggcttcagggggtgcaaccagaggaccgttcatcatcacacgctyggagtcggaggagggccgccatttcagtgtggatgtgctcggtgtctggagcctcagagtgtaaggaggggccccagaacttgtgtgttggagcccagga

SEQ ID NO: 72033 - DNA, 201 bp, Bos taurus; identical to SEQ ID NO: 32321

SEQ ID NO: 72034 - DNA, 201 bp, Bos taurus
gtactgaagacggcgtacagcaccccgccggagcctggccggtccagcgaggctgccaggcaggtgccgaaggcgggggcctgggcatcgccggggtccargcagctcaggtccacctccaggtaggagtagtagaaggggtcctgtttgcacatgcgcgccagcagcgtgcggttccgggccgggtgtttgtcctgctgg

SEQ ID NO: 72035 - DNA, 201 bp, Bos taurus; identical to SEQ ID NO: 32322

SEQ ID NO: 72036 - DNA, 201 bp, Bos taurus; identical to SEQ ID NO: 32324

SEQ ID NO: 72037 - DNA, 201 bp, Bos taurus
caacaactgacactcagaaccactctggacccagacagccatctgtattccacttacagtgagaattaaattcactacgtgagctactcagcatgttatcrtaagacaggctttgtggccatggcttcacccaccttccaggggcgtgagtgtccaggcccatgggaaacggccccggcaatggcgaggctgtggcgctgg

SEQ ID NO: 72038 - DNA, 201 bp, Bos taurus
caaacagagcccagtcctgggcccccgagcctggctggcaccgctgcccagcgtcctcgaggaagccaggagacaaaaccttgtctctcacccctcccccrgtctgtccagggcaccagatcaaattcaagaaccaccctcgtcctcagacccgcgcttcctcatggacattctgatctgctggcatccagtctgaaagtc

SEQ ID NO: 72039 - DNA, 201 bp, Bos taurus
cggcagcagaagcggccgccccggcagacaggccccgctggacacggcgcttctcggacccgcatcctctccccggcagtcgggctgggcaggcctggagygagccctatgtcaatgtgctcatcttacaccacgttgctgtgaaaagccctcctgctagagtaaggcctcctgagacgctcgcctgcccacaaaggctct

SEQ ID NO: 72040 - DNA, 201 bp, Bos taurus; identical to SEQ ID NO: 32325

SEQ ID NO: 72041 - DNA, 201 bp, Bos taurus
agctcaacttcctgctgcaggaaatcgacaactgctaccaccgggcggccgagggccgcgcgcccaagatcgagaagcagatccagtccaagggcccgggmatcacggagcgcgagcggcgcgagatcatcgagaacgcggagaaggagaagagccccgagcagaacctgttcgagaagtacctggagcgccgcggccgca

SEQ ID NO: 72042 - DNA, 201 bp, Bos taurus; identical to SEQ ID NO: 32327

SEQ ID NO: 72043 - DNA, 201 bp, Bos taurus
acaaaaaaaaaaacctttttacttgatataaaagtaaaattcacagttaagtttttctactggtctagatattcctcctagttttcatccttccaacccaycataaatttgaggtagactttcagagagtgacagcttctttcttggattatcatattattattttgcttcagtcaaatagcagcaaaatttctcaactgg

SEQ ID NO: 72044 - DNA, 201 bp, Bos taurus; identical to SEQ ID NO: 32328

SEQ ID NO: 72045 - DNA, 201 bp, Bos taurus; identical to SEQ ID NO: 32330

SEQ ID NO: 72046 - DNA, 201 bp, Bos taurus; identical to SEQ ID NO: 32331

SEQ ID NO: 72047 - DNA, 201 bp, Bos taurus; identical to SEQ ID NO: 32332

SEQ ID NO: 72048 - DNA, 201 bp, Bos taurus; identical to SEQ ID NO: 32333

SEQ ID NO: 72049 - DNA, 201 bp, Bos taurus; identical to SEQ ID NO: 32334

SEQ ID NO: 72050 - DNA, 201 bp, Bos taurus; identical to SEQ ID NO: 32335

SEQ ID NO: 72051 - DNA, 201 bp, Bos taurus; identical to SEQ ID NO: 32336

SEQ ID NO: 72052 - DNA, 201 bp, Bos taurus; identical to SEQ ID NO: 32337

SEQ ID NO: 72053 - DNA, 201 bp, Bos taurus; identical to SEQ ID NO: 32338

SEQ ID NO: 72054 - DNA, 201 bp, Bos taurus; identical to SEQ ID NO: 32339

SEQ ID NO: 72055 - DNA, 201 bp, Bos taurus; identical to SEQ ID NO: 32340

SEQ ID NO: 72056 - DNA, 201 bp, Bos taurus
aggggcagggtcctggttttaggagttggcaagtggcttaaaaacaaattaataagaggcaacagaccagatgttccataaaagtggagtggagatttgakcagggtatgtttgtaggtttatgagaagggtggtaaagatttgggcccaaacagactgcagggctaactcccgagtgaagtagcaaacaccatctctgga

SEQ ID NO: 72057 - DNA, 201 bp, Bos taurus
actggagagaaggtagactaatttccaaaaaccaactctgaagattctgctcaaccatgaaagtttcaaaagcaagaaagtgacgttcatcattttgggartgggccagtcttcattatcctccactgtgtgcaaagtttctcctgattggttggtggggagataacagggcggtgctccaggaatcttgttctgagcctg

SEQ ID NO: 72058 - DNA, 201 bp, Bos taurus
aaaaaatgggccaaagaactaaatagacatttctcccaggtttatttgtgataggcatataattcttcgaaattcttatcacagattccaccgagagtgarttttgctaagagctgggcctaccaggctcctttcattgcatgaattaccttgtaaaaatttcttgcaaatgaattgctgcattatttgctgtgcatattc

SEQ ID NO: 72059 - DNA, 201 bp, Bos taurus; identical to SEQ ID NO: 32341

SEQ ID NO: 72060 - DNA, 201 bp, Bos taurus; identical to SEQ ID NO: 32342

SEQ ID NO: 72061 - DNA, 201 bp, Bos taurus; identical to SEQ ID NO: 32343

SEQ ID NO: 72062 - DNA, 201 bp, Bos taurus; identical to SEQ ID NO: 32346

SEQ ID NO: 72063 - DNA, 201 bp, Bos taurus; identical to SEQ ID NO: 32347

SEQ ID NO: 72064 - DNA, 201 bp, Bos taurus; identical to SEQ ID NO: 32348

SEQ ID NO: 72065 - DNA, 201 bp, Bos taurus; identical to SEQ ID NO: 32349

SEQ ID NO: 72066 - DNA, 201 bp, Bos taurus; identical to SEQ ID NO: 32354

SEQ ID NO: 72067 - DNA, 201 bp, Bos taurus
atgaaccaataaaatgttgcccacttaggagtggagaaaaatacagcaaaggattggggaagagatcttaaatctgaaaagattttgtactcagtttgacrcaaaagtccctttgaactctaactgtgtttcagttggaaacttgaaatacaggtgaagcattaggagtgttgtttttgcagaagatatcgtgagtagtaa

SEQ ID NO: 72068 - DNA, 201 bp, Bos taurus; identical to SEQ ID NO: 32355

SEQ ID NO: 72069 - DNA, 201 bp, Bos taurus
ccttagtgggtgttgaaggagcagttttggttttattataggatcctacgggtgtctgatctattgatgaccttgtggaaagagaccacagtgccaacaayctgcatgagtgaatggatgagtctgtgagtgtgtgtatgtctgtgtgtgtatgatgcttatatacaaaaatttgaacatatggtagaatgatgcaagagt

SEQ ID NO: 72070 - DNA, 201 bp, Bos taurus; identical to SEQ ID NO: 32356

SEQ ID NO: 72071 - DNA, 201 bp, Bos taurus
cataagttatgaatggtgaaaacatgctattaatttcatttgctagcaggatgacatacaaggaaagaagaagaaaggcactgtggaagagagatcacctracatggattttcaggatgcaaagataaatattatgaagttgcttgtgagtagatagagataataggaagggtagcactctaaatataaataaaatcacta

SEQ ID NO: 72072 - DNA, 201 bp, Bos taurus
atttctttccagataaatctataatctctccccagttgccctattggtagctgagaacagtctcatttttctttctacagactttgactattaatcactcytccattacctcctttcactttgtctaacttcagtctctctgttattattagaatacttctgtctgtatttaaacttgctggctatcccactttcattcca

SEQ ID NO: 72073 - DNA, 201 bp, Bos taurus
gctaattatcttggagaaggcgcactgcccggtttttggccttgcatggttgaccttggaacagtcatggtgctgttgggtataatgctaacgtatcacartgagcataccatgagactcaaggtctactggaagttgaatcttctgtcgtcttggacccagtatgttctaaccagttttcgtggtatcccattcttctga

SEQ ID NO: 72074 - DNA, 201 bp, Bos taurus; identical to SEQ ID NO: 32358

SEQ ID NO: 72075 - DNA, 201 bp, Bos taurus
atgcctttattccttccaatgtaccagtaaaaacatatttagaaaagtattaatccagaccaacacctgaaataccaatagttcacctttctatgagtcayttgacgacagtaaaatatatactccaactgaacagaaccacccttatgtttagtactaagatttccctaactcccaagactaacatatttttattgtctc

SEQ ID NO: 72076 - DNA, 201 bp, Bos taurus
tcatctttcattttgcatcctggcctttcatatttgctttgattaatattttgattattttttgaacaaatggagtcttgaaaaaacaaggctttctttcyggccttcagcagtgctctttcatccattcctgctgctgctgctgctaagtcgcttcagtcgtgtccgactctgtgggaccccatagatggcagcccacca

SEQ ID NO: 72077 - DNA, 201 bp, Bos taurus; identical to SEQ ID NO: 32359

SEQ ID NO: 72078 - DNA, 201 bp, Bos taurus; identical to SEQ ID NO: 32360

SEQ ID NO: 72079 - DNA, 201 bp, Bos taurus; identical to SEQ ID NO: 32361

SEQ ID NO: 72080 - DNA, 201 bp, Bos taurus
aatatatctgcctactcctgaagttttcctcctgtcctgatcctcctaacatttaataagatatcaaaccaaatgtgtcatcaccattaaaaatacacatragcaagggaaagggacttctggtcctctttcttccacaactttatcatctgaagggtaaggccaacaaatgtatgacttcttgtatcaagaaatggactt

SEQ ID NO: 72081 - DNA, 201 bp, Bos taurus
cgttttttgaatgttgaattttgagccagcttattcactctactctttcacacttatcaagagactctttagttcttcttggctttaagctcttagagtcrtatcatgtgtgtatctaaagttgttgatatttctcctggcaatcttgattctagcttgtggtttacccagcctggcatttcacctgaggtactctgcaaa

SEQ ID NO: 72082 - DNA, 201 bp, Bos taurus
actaaagaccaagggactagtgattaaaaaaagacgactagcctctaactcatgtttattagttggattgcgatgcacctgaacgatggtggagagaatayaggagatagtgttggggagttggctccaccaggagtatgttggcatagttatatgaagaagggctttgggacaggacagcaagcaagtacctagagagaa

SEQ ID NO: 72083 - DNA, 201 bp, Bos taurus; identical to SEQ ID NO: 32362

SEQ ID NO: 72084 - DNA, 201 bp, Bos taurus
gttatcgtctgccttttagtccaccctcagcattatgtctctacttttctcttctccacactcacattccagcctctgaggctggccctgacctgagatarccaccctttcttactctctttcttccctccggcatctgtagtttaagccccagacgtcagccccagcctgggctggccacatgctgccacatctcactga

SEQ ID NO: 72085 - DNA, 201 bp, Bos taurus
atctaccaggagggttgcagcctgagatcagctccccagaggagacacacggcacctgagatggcactctcatggcgcacccaggaaaccaagtggccagragcgggtggtgattaagactcacagcccacctgggaaggtgcgcttgccaagcacatggttgcctgagctgctcggaactgggtagggcacaaaacacag

SEQ ID NO: 72086 - DNA, 201 bp, Bos taurus
gtcagctatggggaatgtgtcaataggaaatgattgaaagagtttctgtgtgacaaagtgggccagattaaagcaaagtctcacaagttttagtggtcaaygtaggcagcaggatctagtaacattttctaaccaggtcaaagagtaaatagcattgtctgggaaattcagatcagcagagaaggtgaaacaaaaagaaca

SEQ ID NO: 72087 - DNA, 201 bp, Bos taurus
atggtccaattgaggtcagaaaaagagagagatctttatttctatcagtaaaccacagtggtgtgtgtgtttacatctatgctattgtgatgatgaattarcatcatttttatcacctggccacttcacaatacacaagaatttaggggtgagttggtcaatatcaccatgacttccattccagagttcatggctgtgtgt

SEQ ID NO: 72088 - DNA, 201 bp, Bos taurus; identical to SEQ ID NO: 32366

SEQ ID NO: 72089 - DNA, 201 bp, Bos taurus; identical to SEQ ID NO: 32367

SEQ ID NO: 72090 - DNA, 201 bp, Bos taurus; identical to SEQ ID NO: 32368

SEQ ID NO: 72091 - DNA, 201 bp, Bos taurus
aatatcctgatattcacaaatataatttaaagatgattaaagttacgtctaatattttgcacattccttcttttaaaagtggtgttttattattatggtgktgtttcaatcttgtgaggtttccctggtacaaaaaaattatcatcatcatacttaggattctccaagtagttggcttagaaatgatacattcatttacct

SEQ ID NO: 72092 - DNA, 201 bp, Bos taurus; identical to SEQ ID NO: 32370

SEQ ID NO: 72093 - DNA, 201 bp, Bos taurus; identical to SEQ ID NO: 32371

SEQ ID NO: 72094 - DNA, 201 bp, Bos taurus; identical to SEQ ID NO: 32373

SEQ ID NO: 72095 - DNA, 201 bp, Bos taurus; identical to SEQ ID NO: 32374

SEQ ID NO: 72096 - DNA, 201 bp, Bos taurus; identical to SEQ ID NO: 32375

SEQ ID NO: 72097 - DNA, 201 bp, Bos taurus
atgcattcctcttgaaaccgagaaggaccctgcaaggccctcctgggtccaagagcccctccatgccttccatttattgtttgcagaaaaaggcttcaacygcataggccttccctgagttccaaggtgcagattcaagcagttactaattatgtaagtgagagaatgcagaaacaaaggaaaagcagacaagaaaaaata

SEQ ID NO: 72098 - DNA, 201 bp, Bos taurus
caattactctaaacaggccatgttgctgaccctttgtcctgagacagggttggggaggagggataagaacagctgtctgctgcaccttcggaggcaggcasattctgtcagagcctcaactgctgcaggcctgaactgggtggcttcagggattgggatgccactttctgtgtggtagacctaactgagcttcagctatcc

SEQ ID NO: 72099 - DNA, 201 bp, Bos taurus; identical to SEQ ID NO: 32379

SEQ ID NO: 72100 - DNA, 201 bp, Bos taurus; identical to SEQ ID NO: 32380

SEQ ID NO: 72101 - DNA, 201 bp, Bos taurus; identical to SEQ ID NO: 32381

SEQ ID NO: 72102 - DNA, 201 bp, Bos taurus
aggctgggatgcctcaggcccagcagccgacaggagacaggctgattgaagatcctcagggcacaatttgcccactgggtggcccaggacacagctccacycactagggcagcaggcaatagacctgcaccagggctttcaagccagagactctaggacccaggcccccctgcccccccaccaaagagcagacaccagcca

SEQ ID NO: 72103 - DNA, 201 bp, Bos taurus
aaacaaaaaaagttccgaatatgataaacataagggacctaaaataaactgagataataaatgtctttctcactctcattcatcccttcaaactatgtgtyctagatgctgtgttatttattcaacgcgatttggcttacatttggaattcatgagataaggctactcagaagaatacattttagctactaataatggaca

SEQ ID NO: 72104 - DNA, 201 bp, Bos taurus
tttctctacaggaataaagataacataaggggagtctctcaagaggattggagacttcagtactggccaaccacttggtaactttttaattatcttttttytcttctctgtatttagaccatttaattcatttagaatccccattgaaactctaacacctcctccaccatgaaccaattatggaaagacttcctccataca

SEQ ID NO: 72105 - DNA, 201 bp, Bos taurus
tcatatgatgaaactagttgtgaggctttaactgaagttcaacttctttccccaaaatattgtctaaacttttggccattgcttccttatttgttaggttrtgcttagaacaaagaatgtttattaatgttcaaaggaaataattcctgtgcaggatatggcaatgaagtttgtggaatacagacagaaaaccaatattat

SEQ ID NO: 72106 - DNA, 201 bp, Bos taurus; identical to SEQ ID NO: 32382

SEQ ID NO: 72107 - DNA, 201 bp, Bos taurus; identical to SEQ ID NO: 32385

SEQ ID NO: 72108 - DNA, 201 bp, Bos taurus; identical to SEQ ID NO: 32386

SEQ ID NO: 72109 - DNA, 201 bp, Bos taurus; identical to SEQ ID NO: 32387

SEQ ID NO: 72110 - DNA, 201 bp, Bos taurus; identical to SEQ ID NO: 32388

SEQ ID NO: 72111 - DNA, 201 bp, Bos taurus
agccatcgaatcagggagcagggagaaaatgttttgaggtttggatctcctccaaatccctgtttaccacatcagagtaggtggccattaagtccctactyggttccatttacctctcacgagttcctctacctacaataggacaatttcccaggtatgcttagaaaccatcctgtggaggtgagcagcttccagtttctg

SEQ ID NO: 72112 - DNA, 201 bp, Bos taurus; identical to SEQ ID NO: 32391

SEQ ID NO: 72113 - DNA, 201 bp, Bos taurus; identical to SEQ ID NO: 32396

SEQ ID NO: 72114 - DNA, 201 bp, Bos taurus; identical to SEQ ID NO: 32397

SEQ ID NO: 72115 - DNA, 201 bp, Bos taurus
gtgcgcatgtgcacccacatccatctagctatcgatctgcacactagacttctaaaattagcattccttcagtttatttggtcatatctactttgaaatgyctaacaaaattaaaagaatgtgtgattttaaaatatattaaaatatgcattttataatattttaagaatttattgactgtgtagatcacaacaaactgtg

SEQ ID NO: 72116 - DNA, 201 bp, Bos taurus
acaggttaaaaatggtataggccaaaatatagacttttggaatttttgctgcctcaatagatttagtatattttttaccagctttataaaggaaggaaatrattaattacctgtaggccacttagttaatcattgtcatcattcaaaacacagtgaaacaaaagaatacctaaattaacaaacttactaaatatatgagtt

SEQ ID NO: 72117 - DNA, 201 bp, Bos taurus
aacacaatgacatggaaagagaagcctcaattgtttgaattttttcaaaaaaacttccttccaggctaaaatgcttcttacagatgcactaaataagtaaygtattaacattgtaaccaatgaaggggtttgttagaactgtccctagggttacatatttcttgaagaaagcaagaatatacattgcaacttaaaataata

SEQ ID NO: 72118 - DNA, 201 bp, Bos taurus
tgaataaccataaagtcagactaagtcatatataagtactttgcttcaaaacacattggtaagctgaccaaacctctttgcttatttcatgaggttgtaartcaatctttttataataaagacaattatattttatccacaaccctaataaacatttttatgcaagtactttattttatatttttctttaataatgaatac

SEQ ID NO: 72119 - DNA, 201 bp, Bos taurus
ggaaatgaatctctgtgtatttgaattagtacattcatttccacttaaaaattctatattttgtcatgtggaagaaatgttagttgaagctaaaaattcayattatctgagaaaccgtttctgcaattaaataaatgatagtttaacaaatattaaatacatgtatttttttctcaacccagtttccacctttgtattgat

SEQ ID NO: 72120 - DNA, 201 bp, Bos taurus
tctggtgggatacaggccatagcgtctcaaagaatcagacatgacttcaacaacttagcaagcaagtttgtgagtaggtcttctgctcgttatagttctgytagtcatagttcagaacacaagattatagcatgcctacattaattaaaggtactatttaataatgcaatatattttttccagttttctagaaacagtcta

SEQ ID NO: 72121 - DNA, 201 bp, Bos taurus
agaagaaacaggaaacacttgtgtatttgaaagaagcattgacacctatgatgcttggaattagattctatgacatgtaagaacaatggatccagaaaacrtttatgaaacttttattgcaacatgttttcaccttgtcagtttaaatttttaatgcacactgacatcaaccacttgctctattgtatacatacctcataa

SEQ ID NO: 72122 - DNA, 201 bp, Bos taurus
attactgactttatcctgaaaaaaattcctataccttatcttaaaattgaaacttatttgaaacaaaaatctgcttttttttttgttgttgttcattaatrccttcatttaccttcacttttgtgctctttttgtatgtacagaattttaggttggtaagtgcacaggtgttgttgctacagttattgtcattttcagtac

SEQ ID NO: 72123 - DNA, 201 bp, Bos taurus
aaatagtattcaaaagaaattggccttggatattactatttcaatcaactaaacatgtctgatttatattctgtttactttacattgacaatagatagggraaaaaaagataaatcttggctgtgtaagctttattttaaaaatgaccatgtaccaaggatttctgtcactaaatcattgatttatctggattgggaggca

SEQ ID NO: 72124 - DNA, 201 bp, Bos taurus
agactacatgttatgaaccagttccttaaaatctctctctctccctctgtatctctcactctttcatattcctcatgtattttattagggcatgatggctyagccaagttgatatatacattaaccatcacattgatggaaacattaaccttcaagagggcagtggctgaaagaggctgctagtggtcaacttgtaaggaa

SEQ ID NO: 72125 - DNA, 201 bp, Bos taurus
gatatgttaaatatatcagtccaacagtgttactctatgcaaagtagagtttattctcctgtgctcaaataaattacagaagcattagaaaactgtattgraatattgcttacatttctgtgaacaaatggtttattttaatatgggacaggcagaattagtgaagacatattggcaattttcatagacataagacacaca

SEQ ID NO: 72126 - DNA, 201 bp, Bos taurus
ctgccatgtattttgtttctaacatgttaacattctttcagtcattaactcttgagccagcaatttgtttttaagctcaggggaggcctgggaacctagtktttctacaaacaaaaagcagatggaggacaagaggaggagtctgtcctgggaaggccacataggattctgcttgtttacgttatttagaattgacattct

SEQ ID NO: 72127 - DNA, 201 bp, Bos taurus
gcctgagaatcgttccaccgaggaattgagaagtgctccttctaggtccctaaccagttaatcaaatgtatttcccactgtccacaagttaatgtgcggcktgccaggtgagtcagtcataaagaatccacctgccaatgcaggagatgtgggtccaatcccagggtaaggaagagcccctggaggaggaaatggcaaccc

SEQ ID NO: 72128 - DNA, 201 bp, Bos taurus
tataacccagtttacttatctaattccagttggcatttgagtttgtgtaactaagacttcacaacctaaaactctggcccctatttacctttaatttaatytttgaaatgtcaaatcttctcttggaacaaaggaaactctaagacttcacaacctaaaactctggcccctatttacctttcttaggcttgatggtagatg

SEQ ID NO: 72129 - DNA, 201 bp, Bos taurus
tatactcaggacctgaaataaatatgaattaggaatactgaagattatggtaataatgcctagaacgttcttagaatagtctaatgaaatacattattggrttacaaaatagttaattgaagtcatatcattacaatagttgattcctttgatgtattgcctctgggcatgattaaagatttaacaatattggtcttatat

SEQ ID NO: 72130 - DNA, 201 bp, Bos taurus
gagtatatataagaaattgttgaacatatgtatctaatttaaaggacacacagtaagaaacattaatcagccacccacaatctttcaaaatacatatatcyatactctctgtagaaaaatatagtatacatacaaaatgcatagaaaatataaactttgattttccctactcccattggcataaacaatatgagctattat

SEQ ID NO: 72131 - DNA, 201 bp, Bos taurus
agatgactgattcatcgcagtccccataattgtccttcttcctatgctgctgggattcttcatgctacagtggtaagccaatctgcactgctagaactcaycatccagatactagaaactttcactaagttcacataaacaaaagatatgatttttttttaatttggtgatcatctttttatctttttccagttcctacca

SEQ ID NO: 72132 - DNA, 201 bp, Bos taurus
taaactctggagttggtgatggacagggaggcctggcgtgctgcgatttaccgggtcggaaagagttggaaccgactgagcgactgaactgaactgaatckttcaaataaacgcaggccaggcaaatagacttaaattagtaagcaaatgttggcaactaaagccattcagatattaaaatattgtaattaccaaacagaa

SEQ ID NO: 72133 - DNA, 201 bp, Bos taurus
tcaaaagaaaatattttgtaagatatataagatattcttagttttttggtaaaagcatgttgaaactttaaaaagccaatttgctttattaaatagtgagktctcccttagtaacagttagcaatacttgcgacattttagtgtttattctgtttgagtgacttaattgtaattgaagtcattttacagttaagcctcaaa

SEQ ID NO: 72134 - DNA, 201 bp, Bos taurus
gcatgtatctttttcacttagaagactttttaaaacacatatgctggggtctgtggttcagtagattgtcaaataggcctgagaatttgcatttttgacaratttacagaggatgcccttgctgttggaactgcactttgagaaccattgctttggactaggagttggttactatggccaatgagccaaatttggcctgtt

SEQ ID NO: 72135 - DNA, 201 bp, Bos taurus
aaacctttgaagagtttggaggataggaatgatgccagtgtgctgtggagaaataaatgccacggctaatttaaaaagaggaaggaaatagaatccttcayctatttatcatttatatgtttattttttgtcctactaatttcatatagggtttgaggggatttatacaaaagtgtaggttagatggtaaagaatctgcct

SEQ ID NO: 72136 - DNA, 201 bp, Bos taurus
aaatgaaaatctctttacaaatgtaccttaaaaatagtcatttgcatctcacagaataaggccccaaattctcaacatggcctttgctctccataatctgyctctgccaacctctctcatcatatttctttatacactcattattcattgagctctaaccccacttagcatcctttgtaaactccaagaactctcaacttg

SEQ ID NO: 72137 - DNA, 201 bp, Bos taurus
atgcagtatcacctgattcactttaacttcagaactgaatgtggcatttctctttaagtattgttgctttataattttctgtcaactatttttttttcttytggggggccagaaggataaatgccttttcctaagtggtctctgagtttattctcaaattacttagcaaacatttcacactttaagattatcttttaaata

SEQ ID NO: 72138 - DNA, 201 bp, Bos taurus
tctatagcaatgaagtttattctataattacaatgtcaatgaaagaagaaaattaaatagccaatcttagagcaaaccttccaggcctttattctcctgtrttgtctctccaaatgtgtctctctggtgtagccttctaccagtggtggtgggggtttagttgctaagtcatgtccaactcttgtgacccatggactgtag

SEQ ID NO: 72139 - DNA, 201 bp, Bos taurus
aagtctaagatgtacttctggaaaatgcataggtgaggacattgcagagcacacaaggaaatattttactggtttcatcccatgacctgttatgtttcaartatccaagatactatgatgtttcttcataaacttgaggatatatatttcttacaatcgttattaaatatttctaggattatccttacaattctatgttct

SEQ ID NO: 72140 - DNA, 201 bp, Bos taurus
tatttccattccaacttgaagtccattatatatatctatatatacatataccacatttaaaaaatggtagactaaagttgacaatttttcccaattcaagkataatataaattttatacaagattacaagtaaatctttattgttatagttcaagagtagttagactcagtgaaatagcaaagtcaatgaaaagcatcctt

SEQ ID NO: 72141 - DNA, 201 bp, Bos taurus
gaaatagttacactggttggtaaaatgtttgctttaagttcctgttgtaaactgtatgtaaaatctgaaggagctattttgataatacttgtcatttacayttgaaaacctgtttatttctcccatgaataaagtcatacttttctgttctttctctcctgattacaaactccttcaagctgactaaactttgcacattca

SEQ ID NO: 72142 - DNA, 201 bp, Bos taurus
ttcaagagcaagaatggagaggattcatgctggcttcctgacatctgaatttctttatgcctggataacaaattctgataacaacccacacttcctttgtyacttgtactttttttttttttaagaaaagaaaacatgaaaaggaatagaaaaacattgtttccttgattttatcctggaatttggcagcactgacagacg

SEQ ID NO: 72143 - DNA, 201 bp, Bos taurus
gcagagggaaggggttccatacctggttggggaactaagatcctgcatgccatgtggcatggtcaaaaaataaaggagtcaaatgatatctctgtttcccrggtacattctcttgttcttcctataataagagaatgcaggatttctagggcacagacaagttgctgctgctgctaagtagacaccagctaaactgaagaa

SEQ ID NO: 72144 - DNA, 201 bp, Bos taurus
tcatagaagttaaacactctgtctcccttgagactgtgaaattgttcacaggttcacaaaagtccctgatgttctaatagctgagtgtcctgaggaacttkattactctgactcacgtttggccagaatgattcagcattaggaaatttattcgctgggtcaggactgttctgtgcatttgaaacattaaacagaagattt

SEQ ID NO: 72145 - DNA, 201 bp, Bos taurus
ctgacattcacttaatatgatctgagttgtaacacatgtctttctcttgaggttgctgtgaaagttacataggataatatgtacagaggccctctaatagwgaatgaagtattatacaattttagtgctgctgtgctgtgcttagttgctcagtcgtgtctgattctgtgtgactccatggactgtagtcggccaagctcc

SEQ ID NO: 72146 - DNA, 201 bp, Bos taurus
cccacaaacaagattttagaccatgttcaatttcccaacttccaatgatcagatattttttcatgacatttaattcttactatcagatattattcaatgcyctggcctcagttctcccaaagctcatgaagaatgtttctcctccgaggctattgctttgtcctagatcttaaactcaataagctacgtatcttgagtctt

SEQ ID NO: 72147 - DNA, 201 bp, Bos taurus
ttagaatttattgctttctgagatgtttgcctttccttattaatttatgacaatgagtgccattctgagagagacagagaagacatatcccagtggcttaytcagcaaaatgctagaagagaacactttttaaagttagacaaggtaaaataggctggaaaaatttattttttttttacaggaatcctttcaaacttctaa

SEQ ID NO: 72148 - DNA, 201 bp, Bos taurus
gtaaaatttaattacaaaattttaaaatggtgttttattaaatgtattactcatgttataagaaagattaagaaaaacaaagcatttatgcagatttgccytcagttttctagaaatgttgcttttattttgcatttggttttgggtggttctttgttttgtatttgtgaagttggctgtctagaaatgacaagctttgtc

SEQ ID NO: 72149 - DNA, 201 bp, Bos taurus
tatgtttgatctacagtgatgttgatgagaaaggcctgcaggccaggatgggacccagaaaaccagcagcagacagtgactcagcctgtggctccatcttycatagggacctgtgagtagtgaataaggccgtcactggtttcagtggctcattatgcaaaaatggataaagacctaaacaacaaattttttttttttaag

SEQ ID NO: 72150 - DNA, 201 bp, Bos taurus
tcctctaaagcaaacagaggagaggacaggcaatgaaaaagggggtaaaagtgaaatccaaaatcctttgcctcaaaatgtaattttgttgtaaccgtgtygttacatatatgcttgtttctaagtacagatttgttttggaggcggggaaaagctcctttcttgcatgctttgcgtcccagtagatacacaatgtgcttc

SEQ ID NO: 72151 - DNA, 201 bp, Bos taurus
ccgtttcttttcttcacagccaggtaccttcaaaggcctacgtgtgcttgctgtctgccacctctctctctcatgccccttaagcccactccagtttcctycacaaatccacgaagcagtctacccaaagttaccagtgtcattaattcgaggggctaatgtctagtcttcatcttacccgatctctcagcagcatttaac

SEQ ID NO: 72152 - DNA, 201 bp, Bos taurus
gtgccacactggtttccagtggccctggtgacaactgacagctgcagacaccctctagttttcacagcttagggctccacggagctcatcagtgtcaagcycagtggcctgctccagcagcttttgccactgacgcgatgacagccatcactgcggtggatccctggagagggggacattgctgcatgctcacccactccc

SEQ ID NO: 72153 - DNA, 201 bp, Bos taurus
ccttctctccccactgctgtcggggttgctcactcctgagacccaggccacttcctcatctaatggcagccccctctcaccgcctctcactctcgccaccrtctttctgcttgagcaaacccgtcccacatgattcctcagatcccacagacaggatagaggcaacagaacgctttttcctaaatgaaatcctacaggaac

SEQ ID NO: 72154 - DNA, 201 bp, Bos taurus
aaagcttctttaagcgcatgtgtgccttatgggagaaaaggccaaagcaagggaagtgtgatttaataggaagagcctggctttgggatcttattggtccrgtctcaaggtctgacttggccacttgctaacaataggccctttgcaaatggcttaactctgagcctgagttctcctcctgaaatgaggttagctgggggc

SEQ ID NO: 72155 - DNA, 201 bp, Bos taurus
ggcatattagaacacttaacagtctttaactgacagttgagctataaacagttaggaacatatgaaggacccaagtacgaaagggttagtgatgttccaaygacatggagcccatagactggtgtccctggaccaattgcagaatcactgaacagaatcactaaaggctttttttaaaatcacagagccttgagtctcact

SEQ ID NO: 72156 - DNA, 201 bp, Bos taurus
tgcagacaataatgtcagcctcataataaatgacagggcagaggcaccttagaagtctgaagatgtccctccacctgaccaacaagctgagcggccctttmgggacagtgaccctgttttataaggcagcacgtggtcatcagtccatcatgctgggggagttgctgagcttttttcacaactgaaagaaccagcagaaca

SEQ ID NO: 72157 - DNA, 201 bp, Bos taurus
actctttacccaaatgcagacctgcatataatcctacatattcagatggacattatgttgtatgtttgaatgccatgcaactaatcatctgtcacagaagraaaaaaaggctgggcaacttagctgtaggaaatagtttgcagatggaaattgttaagccagggaaagccaagtatgggttttagaaagtttaagtccact

SEQ ID NO: 72158 - DNA, 201 bp, Bos taurus
gttctgagcataccatccccttcagggaccctggccaattttatgtttaaaaaccatgacccttcctcacatgcgtttggttaggattgacctaaccaaargcaatttagaacaccattggccattatggggaactgttgaaacacccaaacttacttttcttaaaaccaaatttgatgctgtagctttaaaatttcctag

SEQ ID NO: 72159 - DNA, 201 bp, Bos taurus
cctgattgaattgaattggaaatttttgtctgcaaaaatctttattgcttccatttggtccaagatttgtgagagggctccaggatggttaaaaaactgcytaagtggccacagagaggggtttcaggtagaagccctgacacctgctgctactgctgccgctaagtcgcttcagttgtgtccgactctgtgcaaccccat

SEQ ID NO: 72160 - DNA, 201 bp, Bos taurus
ggattgaaaatcactagactagattctataattctttcatgctctgaatttctgactttattatttgaatagatactatgaatcaaagctgcttttaagcsatgatattatgacttaaaagagaaaggaaacttgtaattttattatatggggtagctatagttcacaaagattttcaagtgtctattataaaaatcataa

SEQ ID NO: 72161 - DNA, 201 bp, Bos taurus
tttacttatatataattttatataaattttaatatggtatgcacatatgttggtgtatttttttctgctttagtgcatagtagaataacattcagtgtgaygggctagttgaaaaattaaatgaagggaaattcaagatttaattgtccaagagttttgagagtttatagggatggcaacccactccaatattcttgcctg

SEQ ID NO: 72162 - DNA, 201 bp, Bos taurus
actttccagaggaaacaaagcagagctgtattctatatgatttgttaacatagaagcttatagggtaatatgatataatccgagggatgaattgtgtttcrttcacacctgatgccaagagatctgatggcttttggggggttttgttctagggattttagagaagaggtgtcacttaaactcttaagtgctatcagtttg

SEQ ID NO: 72163 - DNA, 201 bp, Bos taurus; identical to SEQ ID NO: 32399

SEQ ID NO: 72164 - DNA, 201 bp, Bos taurus; identical to SEQ ID NO: 32400

SEQ ID NO: 72165 - DNA, 201 bp, Bos taurus; identical to SEQ ID NO: 32401

SEQ ID NO: 72166 - DNA, 201 bp, Bos taurus; identical to SEQ ID NO: 32402

SEQ ID NO: 72167 - DNA, 201 bp, Bos taurus; identical to SEQ ID NO: 32403

SEQ ID NO: 72168 - DNA, 201 bp, Bos taurus; identical to SEQ ID NO: 32404

SEQ ID NO: 72169 - DNA, 201 bp, Bos taurus; identical to SEQ ID NO: 32405

SEQ ID NO: 72170 - DNA, 201 bp, Bos taurus; identical to SEQ ID NO: 32407

SEQ ID NO: 72171 - DNA, 201 bp, Bos taurus; identical to SEQ ID NO: 32408

SEQ ID NO: 72172 - DNA, 201 bp, Bos taurus; identical to SEQ ID NO: 32409

SEQ ID NO: 72173 - DNA, 201 bp, Bos taurus; identical to SEQ ID NO: 32410

SEQ ID NO: 72174 - DNA, 201 bp, Bos taurus; identical to SEQ ID NO: 32411

SEQ ID NO: 72175 - DNA, 201 bp, Bos taurus; identical to SEQ ID NO: 32412

SEQ ID NO: 72176 - DNA, 201 bp, Bos taurus; identical to SEQ ID NO: 32413

SEQ ID NO: 72177 - DNA, 201 bp, Bos taurus; identical to SEQ ID NO: 32414

SEQ ID NO: 72178 - DNA, 201 bp, Bos taurus; identical to SEQ ID NO: 32415

SEQ ID NO: 72179 - DNA, 201 bp, Bos taurus; identical to SEQ ID NO: 32416

SEQ ID NO: 72180 - DNA, 201 bp, Bos taurus; identical to SEQ ID NO: 32417

SEQ ID NO: 72181 - DNA, 201 bp, Bos taurus; identical to SEQ ID NO: 32418

SEQ ID NO: 72182 - DNA, 201 bp, Bos taurus; identical to SEQ ID NO: 32419

SEQ ID NO: 72183 - DNA, 201 bp, Bos taurus; identical to SEQ ID NO: 32420

SEQ ID NO: 72184 - DNA, 201 bp, Bos taurus; identical to SEQ ID NO: 32421

SEQ ID NO: 72185 - DNA, 201 bp, Bos taurus; identical to SEQ ID NO: 32422

SEQ ID NO: 72186 - DNA, 201 bp, Bos taurus; identical to SEQ ID NO: 32423

SEQ ID NO: 72187 - DNA, 201 bp, Bos taurus; identical to SEQ ID NO: 32424

SEQ ID NO: 72188 - DNA, 201 bp, Bos taurus; identical to SEQ ID NO: 32425

SEQ ID NO: 72189 - DNA, 201 bp, Bos taurus; identical to SEQ ID NO: 32426

SEQ ID NO: 72190 - DNA, 201 bp, Bos taurus; identical to SEQ ID NO: 32427

SEQ ID NO: 72191 - DNA, 201 bp, Bos taurus; identical to SEQ ID NO: 32428

SEQ ID NO: 72192 - DNA, 201 bp, Bos taurus; identical to SEQ ID NO: 32429

SEQ ID NO: 72193 - DNA, 201 bp, Bos taurus; identical to SEQ ID NO: 32430

SEQ ID NO: 72194 - DNA, 201 bp, Bos taurus; identical to SEQ ID NO: 32431

SEQ ID NO: 72195 - DNA, 201 bp, Bos taurus; identical to SEQ ID NO: 32432

SEQ ID NO: 72196 - DNA, 201 bp, Bos taurus; identical to SEQ ID NO: 32433

SEQ ID NO: 72197 - DNA, 201 bp, Bos taurus; identical to SEQ ID NO: 32434

SEQ ID NO: 72198 - DNA, 201 bp, Bos taurus; identical to SEQ ID NO: 32435

SEQ ID NO: 72199 - DNA, 201 bp, Bos taurus; identical to SEQ ID NO: 32436

SEQ ID NO: 72200 - DNA, 201 bp, Bos taurus; identical to SEQ ID NO: 32437

SEQ ID NO: 72201 - DNA, 201 bp, Bos taurus; identical to SEQ ID NO: 32438

SEQ ID NO: 72202 - DNA, 201 bp, Bos taurus; identical to SEQ ID NO: 32439

SEQ ID NO: 72203 - DNA, 201 bp, Bos taurus; identical to SEQ ID NO: 32440

SEQ ID NO: 72204 - DNA, 201 bp, Bos taurus; identical to SEQ ID NO: 32441

SEQ ID NO: 72205 - DNA, 201 bp, Bos taurus; identical to SEQ ID NO: 32442

SEQ ID NO: 72206 - DNA, 201 bp, Bos taurus; identical to SEQ ID NO: 32443

SEQ ID NO: 72207 - DNA, 201 bp, Bos taurus; identical to SEQ ID NO: 32444

SEQ ID NO: 72208 - DNA, 201 bp, Bos taurus; identical to SEQ ID NO: 32445

SEQ ID NO: 72209 - DNA, 201 bp, Bos taurus; identical to SEQ ID NO: 32446

SEQ ID NO: 72210 - DNA, 201 bp, Bos taurus; identical to SEQ ID NO: 32447

SEQ ID NO: 72211 - DNA, 201 bp, Bos taurus; identical to SEQ ID NO: 32448

SEQ ID NO: 72212 - DNA, 201 bp, Bos taurus; identical to SEQ ID NO: 32449

SEQ ID NO: 72213 - DNA, 201 bp, Bos taurus; identical to SEQ ID NO: 32450

SEQ ID NO: 72214 - DNA, 201 bp, Bos taurus; identical to SEQ ID NO: 32451

SEQ ID NO: 72215 - DNA, 201 bp, Bos taurus; identical to SEQ ID NO: 32452

SEQ ID NO: 72216 - DNA, 201 bp, Bos taurus; identical to SEQ ID NO: 32453

SEQ ID NO: 72217 - DNA, 201 bp, Bos taurus; identical to SEQ ID NO: 32454

SEQ ID NO: 72218 - DNA, 201 bp, Bos taurus; identical to SEQ ID NO: 32455

SEQ ID NO: 72219 - DNA, 201 bp, Bos taurus; identical to SEQ ID NO: 32456

SEQ ID NO: 72220 - DNA, 201 bp, Bos taurus; identical to SEQ ID NO: 32457

SEQ ID NO: 72221 - DNA, 201 bp, Bos taurus; identical to SEQ ID NO: 32458

SEQ ID NO: 72222 - DNA, 201 bp, Bos taurus
ttaccctcctgtttcaccttcatcaagaggatctttagttcctcttcatgttgccattaaagtggtatcatctgcatatctgaggttgctgattttctccsagatttagtgattccaacttgtgattcatccagcctggcagttcatatgatgtactctgaatagaagttaaataagcagggtgacaatatataactttgg

SEQ ID NO: 72223 - DNA, 201 bp, Bos taurus; identical to SEQ ID NO: 32459

SEQ ID NO: 72224 - DNA, 201 bp, Bos taurus; identical to SEQ ID NO: 32460

SEQ ID NO: 72225 - DNA, 201 bp, Bos taurus; identical to SEQ ID NO: 32461

SEQ ID NO: 72226 - DNA, 201 bp, Bos taurus; identical to SEQ ID NO: 32462

SEQ ID NO: 72227 - DNA, 201 bp, Bos taurus; identical to SEQ ID NO: 32463

SEQ ID NO: 72228 - DNA, 201 bp, Bos taurus; identical to SEQ ID NO: 32464

SEQ ID NO: 72229 - DNA, 201 bp, Bos taurus; identical to SEQ ID NO: 32465

SEQ ID NO: 72230 - DNA, 201 bp, Bos taurus; identical to SEQ ID NO: 32466

SEQ ID NO: 72231 - DNA, 201 bp, Bos taurus; identical to SEQ ID NO: 32467

SEQ ID NO: 72232 - DNA, 201 bp, Bos taurus; identical to SEQ ID NO: 32468

SEQ ID NO: 72233 - DNA, 201 bp, Bos taurus; identical to SEQ ID NO: 32469

SEQ ID NO: 72234 - DNA, 201 bp, Bos taurus; identical to SEQ ID NO: 32470

SEQ ID NO: 72235 - DNA, 201 bp, Bos taurus; identical to SEQ ID NO: 32471

SEQ ID NO: 72236 - DNA, 201 bp, Bos taurus
cccaacaggccttaaataacagtaatcaggctatgagcttactgaattatgagatctatatgatgaaaaaaaagcagtattataaaacacatggccctcartatctttccagcatctcaaagaggcaggccgtaattcaaactgagtgctgcatccttataccagatgaatcctccaatactatccacttaatgactcaca

SEQ ID NO: 72237 - DNA, 201 bp, Bos taurus; identical to SEQ ID NO: 32473

SEQ ID NO: 72238 - DNA, 201 bp, Bos taurus
tcctctattccagagtttccataatagctgctccttcttacccaggtgaagccttggaaaacagtgtcctgtctcaaaacggacaagaacttacattatcygtaaatcatgttaaaataaagagtattaaagttgccaaaagaaaactctcaggcctaataataatgaccttggactttcctcccaccaaccgtctaagac

SEQ ID NO: 72239 - DNA, 201 bp, Bos taurus
aaatatgagtggatcacattgcttgagtaaaggctggtctgcttctaggttgctcatatttccaggtcatagccctactggtacgatctcaaaaacttggkgttttcaactggtaaactcacagctccaaactttgtctccctgttaatgagctgctactgctgctaagtcacgtcagttgtgtctgactctgcgacccca

SEQ ID NO: 72240 - DNA, 201 bp, Bos taurus
caattctaccaagactctgtctgcccttgctcacaataatatttatattttcagaaatgctatagaagattttgattcttgcatcatttagaacttacacrgtataaatgtgagaagacataaatggggcagaattgaagaatgaaaggcctgagagaggctttgccaatctgcatggtcgacttcccataatttgaccca

SEQ ID NO: 72241 - DNA, 201 bp, Bos taurus; identical to SEQ ID NO: 32479

SEQ ID NO: 72242 - DNA, 201 bp, Bos taurus
tacctgaggcccaatgtggtgggctagggagagatgtctgggttgttagggggtccctgtgctacctagcaaggtaggaattatggatgggcaagaaggaraatgatgggccaagtctgaccagaaagttcagagctttagtgacagaaagacatcccccattcatgggaacaagggacatctaggcaggagtctgtttgg

SEQ ID NO: 72243 - DNA, 201 bp, Bos taurus
caacaacttccatttacagaagcccttcccttcatcaggcatcatgaaggagcagagcgaccacactgaagtcatgaagaccacacatgaaggagcagagygacacactgaagcgacacactgaagtttcctgccccaggaaactcacaatttagcaacaagtacataaaaaaacaaccatgaagtgatgaaaaatgacat

SEQ ID NO: 72244 - DNA, 201 bp, Bos taurus
ataattcagatacctgctctgccttttttgttgttcgtaattaaacaataggtgaattcagtaggctgtttattatgataatcacagaatactcagctcaytataggaaaaatgaggagaaaaatatggtagccatgagggctgaactaaaaaatttgaattactaaatgaatagagaggataaaaggggagaagagaaca

SEQ ID NO: 72245 - DNA, 201 bp, Bos taurus
cactgtaaattagttataagaattagtaagtatagtacttttaaaactagttgattgtttaaaaattaaatagtgaaattacatatttttcttaaaactgmctcctaaatactgaatttaaaattctctactcgtcctgcttcttagtttgtattccatgattaagttggtagttcattttagtaacatgaactaaagttt

SEQ ID NO: 72246 - DNA, 201 bp, Bos taurus
aatgtcatcaaggattttttctttctcaacttttcatatcaagacatttcagtcataaagaaaaaattaacactaaaatgacacagagagcctcaaccaayattcaagaattgtcagtatgctgccatattcacattctttttactttctggtttgtagaactactgaaaagtaaattgcaaaattatggcatttcactcc

SEQ ID NO: 72247 - DNA, 201 bp, Bos taurus
acccagctggctaacctggagagctgcttgggaggtgggtaatctgccgctttaagatcgttaagcctttaaagttgctgacagagtagaaggggttaagrttcttgtgaagggcgtgtctgtgtaaataatggttatcactaggcagccggggcaactcctgatacccaaggcaggtcatattctcactactgctctgtt

SEQ ID NO: 72248 - DNA, 201 bp, Bos taurus
tattttagtgaaaaatctcattttctctttcggatgtgtgaaattaccttagcatgactgatctagtaacgtctatgtcagtcaagatcagaaaatactcrgaagaagtattggcagctatcagtctactttaaattagttaggattttgactgacttatgaagtattaagatggctatttttctatgatattgctaagct

SEQ ID NO: 72249 - DNA, 201 bp, Bos taurus
aggtggcaggataaggctggttctaccagtgggagggagaaccccaaagtggtttcagctgccactccaggaaggcattgcctgaggtgaagaagcatttstaatgtgctgttcacctaggaatagggaacagacaggatattaacaggaaggaaataatgagcaattgccacctccctccttcagtcttgcattgtccct

SEQ ID NO: 72250 - DNA, 201 bp, Bos taurus; identical to SEQ ID NO: 32480

SEQ ID NO: 72251 - DNA, 201 bp, Bos taurus; identical to SEQ ID NO: 32481

SEQ ID NO: 72252 - DNA, 201 bp, Bos taurus; identical to SEQ ID NO: 32482

SEQ ID NO: 72253 - DNA, 201 bp, Bos taurus; identical to SEQ ID NO: 32483

SEQ ID NO: 72254 - DNA, 201 bp, Bos taurus; identical to SEQ ID NO: 32484

SEQ ID NO: 72255 - DNA, 201 bp, Bos taurus; identical to SEQ ID NO: 32485

SEQ ID NO: 72256 - DNA, 201 bp, Bos taurus; identical to SEQ ID NO: 32486

SEQ ID NO: 72257 - DNA, 201 bp, Bos taurus
tgacctgcagaaatggtggcaaggttcctgcaattcaaaatagaaaagagagcattgtagacccacagagccaatcttcaaactgacatgttacaaatggrtttgttaatgcatttctaaaatgcccatattcttaataatatcggttatttattattaaatcttggtaatgaataaagaagaaaaatcaaatcataggta

SEQ ID NO: 72258 - DNA, 201 bp, Bos taurus
tggaatgttgtttgaaaagcatggagataaagcaaaagcaagtggtgagtttggcagggatgaataggtatcgctgttaggtcattggacactaagtctcktttttggacacttctgggactggaggtacagtatgatgatttggaagtcattctctttcagtagaccacatcttttaattcagtcttttgccaatataaa

SEQ ID NO: 72259 - DNA, 201 bp, Bos taurus; identical to SEQ ID NO: 32488

SEQ ID NO: 72260 - DNA, 201 bp, Bos taurus; identical to SEQ ID NO: 32489

SEQ ID NO: 72261 - DNA, 201 bp, Bos taurus; identical to SEQ ID NO: 32492

SEQ ID NO: 72262 - DNA, 201 bp, Bos taurus; identical to SEQ ID NO: 32493

SEQ ID NO: 72263 - DNA, 201 bp, Bos taurus; identical to SEQ ID NO: 32494

SEQ ID NO: 72264 - DNA, 201 bp, Bos taurus; identical to SEQ ID NO: 32495

SEQ ID NO: 72265 - DNA, 201 bp, Bos taurus
agcattaccttctcctggaagcccagtgcactgattactccctcctgagggcttccctggcttcccatgtgttcctctgtaagaacatttatcaccttgtrttgttattatttgtttatgagcctgtctccactgtagactttgaacttcttgagtttgagagctctgtcttaaccaccactacatctcaaagtttgattt

SEQ ID NO: 72266 - DNA, 201 bp, Bos taurus
tggcttgtcagggtttcctggttagggacgcttgtgtcagtgttctggtgggtggagctggatttcttctctctagtgtgcaatgcagtatccagtagtgrgtttggaggtgtcagtgggtttggtgtgacttttggctgcctgtatttttgtgctcaggtttatgttcctgcattgttggagaattagcttggtatgtct

SEQ ID NO: 72267 - DNA, 201 bp, Bos taurus
tgaagatattgtgaaaggagataatatcaaggagtttgagagaagatcccagaaattaatgatagagaaatgggaaaataagagataaggtaaacaggtgraaaacacttaatacatagcaaaataacaagttaccactgtggacaacagggacttaatcccactgcatattctggaagactgtattccgcatacctcacg

SEQ ID NO: 72268 - DNA, 201 bp, Bos taurus; identical to SEQ ID NO: 32496

SEQ ID NO: 72269 - DNA, 201 bp, Bos taurus
atctttctttctcatttccaaagaacacttgtgatccgaggttaatctatccagtgtaatgtttgtttgaaatcctcaaggtcattttatatcaaggtggmagagtaaaagttgcttgtggaaatcaatccaggtggcagagtaagaggacgtgacactcacctattcctagaactacatcagaagtattggatgtatttg

SEQ ID NO: 72270 - DNA, 201 bp, Bos taurus; identical to SEQ ID NO: 32497

SEQ ID NO: 72271 - DNA, 201 bp, Bos taurus; identical to SEQ ID NO: 32498

SEQ ID NO: 72272 - DNA, 201 bp, Bos taurus; identical to SEQ ID NO: 32500

SEQ ID NO: 72273 - DNA, 201 bp, Bos taurus; identical to SEQ ID NO: 32502

SEQ ID NO: 72274 - DNA, 201 bp, Bos taurus; identical to SEQ ID NO: 32503

SEQ ID NO: 72275 - DNA, 201 bp, Bos taurus; identical to SEQ ID NO: 32504

SEQ ID NO: 72276 - DNA, 201 bp, Bos taurus
gttgtcctgttccttgaactacattttcttattactaagctaatagagctgggtttagttctcttgctttattctatacctcataaatctcctaaattgckttgagatatttttagactatgatatgccttaagtagaattttcaagcatacatcttacttagtcagctttggggcttctaaacgatatattttatagtct

SEQ ID NO: 72277 - DNA, 201 bp, Bos taurus; identical to SEQ ID NO: 32509

SEQ ID NO: 72278 - DNA, 201 bp, Bos taurus; identical to SEQ ID NO: 32510

SEQ ID NO: 72279 - DNA, 201 bp, Bos taurus
aggtgggttatagtccatgggatcacaaagagtcaaacaccactgagcgactaacacagacctaggtacttcagatatataatttagatatataatacatraaacacaataattctgagggttaagtaatgttattatcccattttatatatagaaactgaaactcagggacataaaaatggtaaatataaatgtaaatat

SEQ ID NO: 72280 - DNA, 201 bp, Bos taurus
ggccatgtatgacaatttttgccctacttaattgacaatgtaacctaattctcagactagttcccaaaaaaagaatcctttctcttttgaatctcagaagrgctcttaaaatggatgggccctctgggactcacggatgtgtttccactgccacatagtcaaagaagcctaaaatcacagggatttatatcaaatggcatt

SEQ ID NO: 72281 - DNA, 201 bp, Bos taurus; identical to SEQ ID NO: 32511

SEQ ID NO: 72282 - DNA, 201 bp, Bos taurus; identical to SEQ ID NO: 32512

SEQ ID NO: 72283 - DNA, 201 bp, Bos taurus
tacagcttaatgatggaaggtggacacaggtcttctagagctttttaaagtatcaggaaaccatgtactgggggctggcataggctgatttgtttcactgrtgccatataatctctgagcactctgggagatgttctctagtgctaaaagatggtggttgcatgtgtgataacaggatgctagttaactaggaaatgaaga

SEQ ID NO: 72284 - DNA, 201 bp, Bos taurus
atgagtacaactttttctttagagtcatcatgcagtgtttctttctgtatcttatatcacttagcattctgctctccagatttatctatattgtcacaaayggcaggatattctttaaggctgaatattagtccatcatattctacattttctctatccattcattaactaatagacacttaagttgtttctgtaccttga

SEQ ID NO: 72285 - DNA, 201 bp, Bos taurus; identical to SEQ ID NO: 32518

SEQ ID NO: 72286 - DNA, 201 bp, Bos taurus; identical to SEQ ID NO: 32519

SEQ ID NO: 72287 - DNA, 201 bp, Bos taurus
gggagcagtttgcctgtgggatgggaaggacaggtgtccacaacagatggcgtgctcactgggagtcgtctccagatgaagggccttttctttccctccarctccgcggactcccaatctcttcctccagttctttccctctagtcaccattatggcctttccccagccccaagccctcaagcttctcactgacaatataa

SEQ ID NO: 72288 - DNA, 201 bp, Bos taurus
taggaagtctaagaagtcacttattacccaaagaatttttgagatgcctgaaaaaaattggagcttccttctctttgagaaacaacccaaaatagctaatytgcacatcttgtcacatcttaaattgttcttgtcaccctaaaccaagacatttgaaataaaaagtcaacataaaacagctctaagttcagtgtaagaata

SEQ ID NO: 72289 - DNA, 201 bp, Bos taurus; identical to SEQ ID NO: 32522

SEQ ID NO: 72290 - DNA, 201 bp, Bos taurus; identical to SEQ ID NO: 32525

SEQ ID NO: 72291 - DNA, 201 bp, Bos taurus; identical to SEQ ID NO: 32529

SEQ ID NO: 72292 - DNA, 201 bp, Bos taurus; identical to SEQ ID NO: 32530

SEQ ID NO: 72293 - DNA, 201 bp, Bos taurus; identical to SEQ ID NO: 32531

SEQ ID NO: 72294 - DNA, 201 bp, Bos taurus; identical to SEQ ID NO: 32532

SEQ ID NO: 72295 - DNA, 201 bp, Bos taurus; identical to SEQ ID NO: 32533

SEQ ID NO: 72296 - DNA, 201 bp, Bos taurus; identical to SEQ ID NO: 32535

SEQ ID NO: 72297 - DNA, 201 bp, Bos taurus
ttgtctcaaaccaaagtgtttgaccttctctttatttttattacttccttaccagttgccctttcaactccacgttatcctttttaaggctttgattagcrttctcctaatgtgacatttccttagaaaatatttggcttggtcccaggacccccatatcactgaacacacttctgcactgctctaaccgggtagccagaa

SEQ ID NO: 72298 - DNA, 201 bp, Bos taurus
catgagtcatttgactaaagggtatagcaatcaagctgaaaacctgctacatggttaaattaggaacaagcacagcttcattttcttttcagtcctttttwaagtacactgtgaagctctggtaggagtaagagatcgggttggaaatgaagtgtgatagcattgatatgaataattttcaacaacaccaaagtgaatcaa

SEQ ID NO: 72299 - DNA, 201 bp, Bos taurus
tcacagaacaccttagcacaatagcagtaaaggaaactaattttttaaaaattagaaaaatgggtattacactaccaattgtgaaagtattactgtttgcyacatttaaaacttagctgtgtctaccttaatttttctttagataaaacaaggcaaaagaatcttcctaaaaagattccaaatacctatgaggtgagaaaa

SEQ ID NO: 72300 - DNA, 201 bp, Bos taurus
tagaggagagccactgggtggtgagagtcctgctgtttatttgggagcaagaacctcattctattcattaatgtcaaggactttatgctgacaagaccctycaaccacctttaggatcctacagctttcatgtgttgttttttgacttccctgtatgtttgtggcagcaccacaatttccttttacaaaacaatcccttct

SEQ ID NO: 72301 - DNA, 201 bp, Bos taurus
gtaaaaggggttcagcctccagtttccatcaaatctcaagctaccactaaacctctctgtcttggtctctgctcaccccttcctctcaggggtcctccccyagactcataaccaacagagccacgtggctgggggtgggtgatgactgaagctgagccctgaactcaggacaagccaggtggaaggatatctggaaaacaa

SEQ ID NO: 72302 - DNA, 201 bp, Bos taurus; identical to SEQ ID NO: 32538

SEQ ID NO: 72303 - DNA, 201 bp, Bos taurus
aaacatgcatctgctttcccaggtttagccacttgaagaaaatggccttggctaggccaaaactgaaaatgcatggagtcttacggtatcaggccctgaayatcttacagaattacatccaagactgcattagctgctgaacattctaaagtacacctgaggtatgagatacatcaatgaatcaagtcttttttcactgac

SEQ ID NO: 72304 - DNA, 201 bp, Bos taurus
ttgtcccacccagcaccactgagtagatggacgagggaccaggttagctggcccccagccactaccacaaaccaggaccaagcagatgaatccagggcctragccaaatagaactgccccctgggaaaccaaaccaagaggcaaagaaggaacatcaactgggatggggcactggggctgagcgctgatcatgtatcagga

SEQ ID NO: 72305 - DNA, 201 bp, Bos taurus
gacagcagagctgaagggcccagccctgcttctccatgcggcctcaggaggcctatctggaaccaacctatctacaaatggggttgtgaaattacccaggsagggtctgctgcaaacatgaatggagtaacatggggggcgcaggacgctggagctgctgttgaccttgaccccgaatgtctggctggcctggcccattga

SEQ ID NO: 72306 - DNA, 201 bp, Bos taurus; identical to SEQ ID NO: 32539

SEQ ID NO: 72307 - DNA, 201 bp, Bos taurus; identical to SEQ ID NO: 32540

SEQ ID NO: 72308 - DNA, 201 bp, Bos taurus
tactcaagtcatgatcagaagactaagaaaagttactgaaaataccacaacgcttgagctaataatgagggcctctggttattcgctgtgggaacaaaatygtccttaactctgtggttctggaatgttgatcttaagctgtgggagttttatttttcctttgagaacagacacatggcatgcccatttccataaaagaaa

SEQ ID NO: 72309 - DNA, 201 bp, Bos taurus; identical to SEQ ID NO: 32541

SEQ ID NO: 72310 - DNA, 201 bp, Bos taurus; identical to SEQ ID NO: 32543

SEQ ID NO: 72311 - DNA, 201 bp, Bos taurus
ccagtttaatgctctgtggaactaaccacatgagaacaagcaaaggctgtttattctgagctttcctgagaagggaggcagtcttgcctttgggtagagastggagagcaggccgaagggctgggaatgcttcagagggaagaagaaggaaggctgcaagcctaacgctgactagaggcagtgggccccgggaggctgaag

SEQ ID NO: 72312 - DNA, 201 bp, Bos taurus; identical to SEQ ID NO: 32547

SEQ ID NO: 72313 - DNA, 201 bp, Bos taurus
catgtctgtggatccaagaagtgtgctccttcttggcccagatgccttctctgtgcctttgagagcccccgttgtattattatttacacctcttcttgccmttgcttcttaccctcaacaaacctagttctccctggagagtaagtgagcttcaactaagcctgggaaaggggatcgatgcagccgtgtgctcccagaccc

SEQ ID NO: 72314 - DNA, 201 bp, Bos taurus
ccctgatgcaagaggactgctgtccttgtaagaggaggagattagggcacagacacacacagaaggaagactataaagagataccgttagaagacctgccrcctacatgccatggagaggcctcagaagaaaccaccctgctgacatcttgatcttggatttccagtctccctacagcaagaaaataagctctgttgttta

SEQ ID NO: 72315 - DNA, 201 bp, Bos taurus
ggtgatggacagcgaggcctggtgtgccgtgattcatggcgtcgcagagttggacacgactgagcgactgaactgaactgaactgaagaaatgcactcccyggttaggtacccaagtgttcggccaaaactcagagcgttttatatcaccaaaatgcagaaaaagaataaacaccaaagggaaaatgagcagtttcttatt

SEQ ID NO: 72316 - DNA, 201 bp, Bos taurus; identical to SEQ ID NO: 32551

SEQ ID NO: 72317 - DNA, 201 bp, Bos taurus; identical to SEQ ID NO: 32553

SEQ ID NO: 72318 - DNA, 201 bp, Bos taurus
cttcttatttttccatcacagtgacaactaatatcgactgaaatctgacaggacatttaaatgctaagtacattcatttcatgttaaatttccataacgtyttggttgctgaattatgtactatatttgtactgattttctgaaagctaagcattgctggcctacccaagataatttgcaggccgttggtcaattaaagag

SEQ ID NO: 72319 - DNA, 201 bp, Bos taurus
taaaacagctgctaaatgccatcgacatgtgctgccacaagctgcacaagagctgcagtcctggaaggtcaaggaccccggcccacgtggatttacccatrtggtattgtgttttacataacaccaacccattgctggctctttcaagattcctggccagtgtgccaatatattgatatgtaagggtcctaatatataaca

SEQ ID NO: 72320 - DNA, 201 bp, Bos taurus
gacagagagagtgggagagagttttgataacctctggagggcagcatgggttgtgatgcaactatcaaagtcactgcagtatcaaaaatatttaaacattycaatttttaaccaggatggcactgacagaagtgttctttatatttaatattagatatgctgtaagtaattaataatttttaattacttacagcatatcta

SEQ ID NO: 72321 - DNA, 201 bp, Bos taurus; identical to SEQ ID NO: 32554

SEQ ID NO: 72322 - DNA, 201 bp, Bos taurus; identical to SEQ ID NO: 32555

SEQ ID NO: 72323 - DNA, 201 bp, Bos taurus; identical to SEQ ID NO: 32556

SEQ ID NO: 72324 - DNA, 201 bp, Bos taurus; identical to SEQ ID NO: 32557

SEQ ID NO: 72325 - DNA, 201 bp, Bos taurus
ggttattcattatctaaagaaagaatatatatacctaaaaataaattcaatgattagcagttatgggttaatatactttgaagcactgattgaaaaaataytgcaaattttatcacaaaaagaatagctagtattgctgagctttgaaatgaggagttgtccatctttattgatgtgtgagttacctatgctacgaaattt

SEQ ID NO: 72326 - DNA, 201 bp, Bos taurus; identical to SEQ ID NO: 32558

SEQ ID NO: 72327 - DNA, 201 bp, Bos taurus
acttgtaggattagtagtcctgaaatcctataatacaaacattagaatagtcatataaagatagtaattatatggaaatttcttatttcaggcctttttakctcctttctttcttatccttccagacactgcagagattcaaatctattctgtaaagcatctcctttccataagtttagtaaactattcttgattttcctt

SEQ ID NO: 72328 - DNA, 201 bp, Bos taurus
aatgaatcatcctttatacatcttgagtaaaattgtttctatcattcttcacaattgttatattattgtctgagtctagtggttgtgattcctctttgctratagtgaggtcatcacccaagaatgcctgtgcttatgagaaattcagctattacccaggaaaatcacaaagctgctgcttttatattgctctatttctgg

SEQ ID NO: 72329 - DNA, 201 bp, Bos taurus; identical to SEQ ID NO: 32562

SEQ ID NO: 72330 - DNA, 201 bp, Bos taurus
cctagtgatttagttttaatatttacaaactttttttttttgtgtatgtgtttgttggatgttagattttctttgttttccttaaaaatcaagcatttcamtaagatattcacagtgtggttttgatttcattatttaattagtcatgtaaatcaaggaatgatttcatccatagagtcattgctttcaactcagaaaata

SEQ ID NO: 72331 - DNA, 201 bp, Bos taurus; identical to SEQ ID NO: 32566

SEQ ID NO: 72332 - DNA, 201 bp, Bos taurus; identical to SEQ ID NO: 32567

SEQ ID NO: 72333 - DNA, 201 bp, Bos taurus; identical to SEQ ID NO: 32570

SEQ ID NO: 72334 - DNA, 201 bp, Bos taurus; identical to SEQ ID NO: 32571

SEQ ID NO: 72335 - DNA, 201 bp, Bos taurus; identical to SEQ ID NO: 32572

SEQ ID NO: 72336 - DNA, 201 bp, Bos taurus; identical to SEQ ID NO: 32574

SEQ ID NO: 72337 - DNA, 201 bp, Bos taurus; identical to SEQ ID NO: 32575

SEQ ID NO: 72338 - DNA, 201 bp, Bos taurus; identical to SEQ ID NO: 32576

SEQ ID NO: 72339 - DNA, 201 bp, Bos taurus; identical to SEQ ID NO: 32578

SEQ ID NO: 72340 - DNA, 201 bp, Bos taurus
tccttatttcttattgcattgaaatatataacagcagaagggaaaattcaagccctggtacactaaaaccattaaagtagctggcaaaattataatctagrtaacttaccttccatcctacgttgctataattttatcagttgaaaatgatatccacttcattggagaagattgtttaacaagcttttaatcatcattgta

SEQ ID NO: 72341 - DNA, 201 bp, Bos taurus; identical to SEQ ID NO: 32591

SEQ ID NO: 72342 - DNA, 201 bp, Bos taurus; identical to SEQ ID NO: 32592

SEQ ID NO: 72343 - DNA, 201 bp, Bos taurus; identical to SEQ ID NO: 32593

SEQ ID NO: 72344 - DNA, 201 bp, Bos taurus; identical to SEQ ID NO: 32598

SEQ ID NO: 72345 - DNA, 201 bp, Bos taurus; identical to SEQ ID NO: 32599

SEQ ID NO: 72346 - DNA, 201 bp, Bos taurus; identical to SEQ ID NO: 32600

SEQ ID NO: 72347 - DNA, 201 bp, Bos taurus
tgattgttagcacatggaaattagccgaggatataagatggaattttattatttttgtagaaatgagaaccccctccaacataattaaacactaccaatgrcaataaaacctgataagcaaataaagcaactagtgcctccaaactcctttcaaaaataatgtttttgtgaaatatggtcacctcaaggacaggcatcctc

SEQ ID NO: 72348 - DNA, 201 bp, Bos taurus
attttctggcaccaaaagtaaagcaaagttccctttccaccaacctggcttctttaatggcttttgagtggctagcagctgcaccctgttttctttaacaygtcacagcaaagtgaagactccaaaagaaatactattaaagtatatgcttgttgcagtgccttttagaatcctaagggccaaattagttttgatttggaa

SEQ ID NO: 72349 - DNA, 201 bp, Bos taurus
cgtggagattgtaggtgattaaatttttggaaaactttatattactgtttgtgaaaggctttcttgcttttggaaatgatagcaggctaggccctgtcttrtaaattttacaaaagaaactgtgaagtctaatcatctaaaaaaaattttttttaagccattctatatctaaatgcaaaagtctcaaactgagatgttaag

SEQ ID NO: 72350 - DNA, 201 bp, Bos taurus; identical to SEQ ID NO: 32603

SEQ ID NO: 72351 - DNA, 201 bp, Bos taurus; identical to SEQ ID NO: 32604

SEQ ID NO: 72352 - DNA, 201 bp, Bos taurus; identical to SEQ ID NO: 32605

SEQ ID NO: 72353 - DNA, 201 bp, Bos taurus; identical to SEQ ID NO: 32606

SEQ ID NO: 72354 - DNA, 201 bp, Bos taurus; identical to SEQ ID NO: 32607

SEQ ID NO: 72355 - DNA, 201 bp, Bos taurus; identical to SEQ ID NO: 32608

SEQ ID NO: 72356 - DNA, 201 bp, Bos taurus; identical to SEQ ID NO: 32609

SEQ ID NO: 72357 - DNA, 201 bp, Bos taurus
ttctttgtttatattcacatttctcatttcaaatatagtgcaccaaaaaataatgtgtcagtcttcttccttttgctctcaaataaattattttcatttckccttccctcctagcctgccttcttcccttccttgatcttttctttctctcttactttgaaaatgtgtgcccacacttttcttattatttgttaaagttat

SEQ ID NO: 72358 - DNA, 201 bp, Bos taurus
catatatttttagtgtatgctttcttatagaaggggcatgactagaaatattgtatttccattagtagcaaatatcagtgagaattatctattccatcaayactttgcattaagctaggaaaaacagaagaacttcttaaagacacaaatatatgtgtgtgtgtgtgtgtgtgtgtgtgtgtgagagagagagagagaaaa

SEQ ID NO: 72359 - DNA, 201 bp, Bos taurus; identical to SEQ ID NO: 32610

SEQ ID NO: 72360 - DNA, 201 bp, Bos taurus; identical to SEQ ID NO: 32611

SEQ ID NO: 72361 - DNA, 201 bp, Bos taurus; identical to SEQ ID NO: 32613

SEQ ID NO: 72362 - DNA, 201 bp, Bos taurus; identical to SEQ ID NO: 32614

SEQ ID NO: 72363 - DNA, 201 bp, Bos taurus; identical to SEQ ID NO: 32621

SEQ ID NO: 72364 - DNA, 201 bp, Bos taurus; identical to SEQ ID NO: 32624

SEQ ID NO: 72365 - DNA, 201 bp, Bos taurus
acagtcaaaggcttttgcatagtcaataaattccaaccaaacaaattaaaacagttaaataaaagaaaatgacaagtaggccaaattataaattagatatrgaaataaagtgaaagtcagtcatgtctgactctttgcaaccccatggactatacagtccaaggaactctccaggccagaaaattgaagtggatagccatt

SEQ ID NO: 72366 - DNA, 201 bp, Bos taurus; identical to SEQ ID NO: 32625

SEQ ID NO: 72367 - DNA, 201 bp, Bos taurus
aggccgagtctgctccctagttgttggagtaggtgcccccagctctgtttcttggctgtgattctgatctatagtgtgaggtagaggggactgtagcactrccactggccagaagtcattgcattttactcctttggagctgttcacctacaaatatgttccatggctccccttctgtctgtagagtgggctcacaaagta

SEQ ID NO: 72368 - DNA, 201 bp, Bos taurus; identical to SEQ ID NO: 32626

SEQ ID NO: 72369 - DNA, 201 bp, Bos taurus
aggaacatattactcttttgattcttctttacagtactttgaatcattatcttgtgtgcatttttcctaaattactaccttatgttaagcaaagacttatrcattatgctactttgtttttctagtacttcccacaggatcctaaacctttcagatgatcagtaattttggtgactattggtaagttaagaatagcaacat

SEQ ID NO: 72370 - DNA, 201 bp, Bos taurus
aatgtaaatgcaagatttttctcatgtattgataacaatgctccttcacctctgttagggaactcaggcatttattggccaaattttccagataaaaacayagcttttcatcttatggatctcagtagtattgtctctcccttttcatgttaatgtaacagaattaccccagatgccaggtccatgggccacttacatcag

SEQ ID NO: 72371 - DNA, 201 bp, Bos taurus
tcacagaggaattaagtgacctaaatacaaggtgtcaagctacaatttaaagacaacttttttcccagcccctacacttgcaggccacttttctttgattrctattgttttgaaaattaatgataagatgagcatgaatcctaaaagatggtgccgtaaaagtgctgctctcaatgtgtcagcaaatttggaaaactctgc

SEQ ID NO: 72372 - DNA, 201 bp, Bos taurus
tataaaaatgcataccaaggacaagagtcaaaaaataagacaaaatattgtcattaaattggaaggaacaaagagtttaaaagttgatcattaaacagatyacccttagagagtctcagtaaaataagcactcagggatccatgttagaaaaatagatttaatagagtggaagaaatagaagctgtgttataatattatat

SEQ ID NO: 72373 - DNA, 201 bp, Bos taurus
tggttttgaaaataaagattaaatcagccatactcaacccaaaataaaagttatgtctttttagctatggtatatattccaggacctgaattatactttaygaattacaatgaattttaaaagcaatatatgtcccatggatataacaagtaaggggattttcaatatttccaatttatgcttttatttgttacttatttt

SEQ ID NO: 72374 - DNA, 201 bp, Bos taurus
gtgtaattatctaatgtctagcgaaactatgtgttcattttagagtctcacaatcaaaatttgaaatggaaagggccctgtggaagggtatggtaaagttrttatctattgggagagctagacatgacgcctaggatggggagaaagaagtaggagatttcagagtctgtaaaaagaaacagaaacataatgttttttaaa

SEQ ID NO: 72375 - DNA, 201 bp, Bos taurus
acaccatcgaatgcattaaaattgtttaatagacttatatgtcatatatacatatatcactttgattttcaggtggtgagagtgctgttttgagcaaggargtgaagggaagtcaacgaaaacaggagcattccttttggataagacttttccattccttactttgactaaaaatcaggatcaaaaagacataacaatcaa

SEQ ID NO: 72376 - DNA, 201 bp, Bos taurus; identical to SEQ ID NO: 32627

SEQ ID NO: 72377 - DNA, 201 bp, Bos taurus
accttattctccaacaaagatgacaccagcaaacaggcttacatcaatcgtatagccactaattcagtaaaattattgtacctttctttcagtgtttcctmcaaaaaccccagagaaatactcattcatcccagatgacttggtttattttctttcccctaaactactattaaatgtagtgtctttgttggccatggcctg

SEQ ID NO: 72378 - DNA, 201 bp, Bos taurus; identical to SEQ ID NO: 32630

SEQ ID NO: 72379 - DNA, 201 bp, Bos taurus
acttaattaattttagaagtcacttcctccaggaagccttccttgcttggaggaggtattctcatacaacttttaaacgaacctcttgaaagcaagacagytcatttaatgggaagtcaccaaatgcaccaatctgccaacattttgtttttgttttagaagcaattttcttgactatatccattgactgactttagactg

SEQ ID NO: 72380 - DNA, 201 bp, Bos taurus; identical to SEQ ID NO: 32631

SEQ ID NO: 72381 - DNA, 201 bp, Bos taurus
ttctctctcctccccccagggacagtaatgtctagtcatttcctacctgggaagaaaagaaccttcaggcaagcttctcacctgtcacttaggtggacgayttgtttgaatcactgtttctactttgatgtgaggtggtagaaggagaaaatccctcctggatcaagaacaagaaggggaaataaattccagaaacaacca

SEQ ID NO: 72382 - DNA, 201 bp, Bos taurus; identical to SEQ ID NO: 32637

SEQ ID NO: 72383 - DNA, 201 bp, Bos taurus; identical to SEQ ID NO: 32640

SEQ ID NO: 72384 - DNA, 201 bp, Bos taurus; identical to SEQ ID NO: 32641

SEQ ID NO: 72385 - DNA, 201 bp, Bos taurus
cactctctattagaggttttgttcccccattaaaccacctacatgcaaatctctgtcttggagtgtatttcccaggagcctaaacccagctatgtgccatyggcctgatggcagaaagaaacattggtcctctgtctccactttcagaccgtgatgtagtgagacaagcaaatggtgagcctgctggtagatatcgttaaa

SEQ ID NO: 72386 - DNA, 201 bp, Bos taurus
cagaagagcctggtgtactgaagtctatgacgtccccaagagtcagacatgacttagtgactgaacaacaacagatgaagataagaatgaggccacatttmtgttacaagaaagaactacttacactaactccatgaactggacttcaccaaaaccagctgtagctggcctggcagagataatgctatgctgtgtggagcc

SEQ ID NO: 72387 - DNA, 201 bp, Bos taurus
catggtacctcagtgactgttcattattattttcaaatgaccaaaatgctggtcccttggcaatagtcttaaacccctacacatgtggaactcaagcctgrtaatttcctgcatatgtttttgcttctaaaaagaggtagggtgagaattagattaaattgtgactgtgagtcatggaagaatactaagggaaatttctac

SEQ ID NO: 72388 - DNA, 201 bp, Bos taurus
cttatagtctttaatgcctgaatcagcatacatttattgagatgccactatatgttgtgaccaaaagtccatgttgtgagtgtgggtttattagagatatytcaaccagaatttctagaggcatttcaaatttcctgtttccaaaacagaactcagtaccttacctgcaacacctgtgtaagacaccatcctctcacttag

SEQ ID NO: 72389 - DNA, 201 bp, Bos taurus
taattctttattattggcatataggaatgctgtttatttgtccataaaattgctttttctgaaatgcgaaacataaaattaccactcaaaacctacaaaartagaaaaggtatacactttactcaataatgtccaaaacagccagaaaagatttgcatcactatgaaaggcgacagagaaactatggcattttcttccttg

SEQ ID NO: 72390 - DNA, 201 bp, Bos taurus
cagttttactccaattggtcacaaaaggccaaagtcatacaaaataagaacagtgttctgaagaagttcaaaataatctaggacaggagagaagtaaatayggcacagaagaaatagaagtggccatgagttgataattactgaagttgagtgatagatacaagagagcttttatacatttctactttcttctattttagg

SEQ ID NO: 72391 - DNA, 201 bp, Bos taurus; identical to SEQ ID NO: 32648

SEQ ID NO: 72392 - DNA, 201 bp, Bos taurus
aaatagttcagaaaaatctcttatttttctctcctcccctcttccacccactttaaacatgaaaatttccactctggcctcttttctgaccagaactgtgraaaagtgaggaacacaaaggacagcaaattccgctatagtcagggatatttctcctgatttgaaatgataatggagcgatgggggcccttacgcaatctg

SEQ ID NO: 72393 - DNA, 201 bp, Bos taurus
tttgcatcacaatcagaagtacacacttcaaagcacagttttataaacggcaggtatggcaacatgggacactggatggggagtttctagtgttatgttayatccagtgaagagtcaaagttatgcctgatgcatttcattaagaggacccctctccctctcatcaaagtattttcaactgggcctccctctaccactcag

SEQ ID NO: 72394 - DNA, 201 bp, Bos taurus; identical to SEQ ID NO: 32651

SEQ ID NO: 72395 - DNA, 201 bp, Bos taurus; identical to SEQ ID NO: 32654

SEQ ID NO: 72396 - DNA, 201 bp, Bos taurus; identical to SEQ ID NO: 32655

SEQ ID NO: 72397 - DNA, 201 bp, Bos taurus; identical to SEQ ID NO: 32656

SEQ ID NO: 72398 - DNA, 201 bp, Bos taurus; identical to SEQ ID NO: 32657

SEQ ID NO: 72399 - DNA, 201 bp, Bos taurus; identical to SEQ ID NO: 32658

SEQ ID NO: 72400 - DNA, 201 bp, Bos taurus; identical to SEQ ID NO: 32659

SEQ ID NO: 72401 - DNA, 201 bp, Bos taurus; identical to SEQ ID NO: 32660

SEQ ID NO: 72402 - DNA, 201 bp, Bos taurus; identical to SEQ ID NO: 32661

SEQ ID NO: 72403 - DNA, 201 bp, Bos taurus; identical to SEQ ID NO: 32662

SEQ ID NO: 72404 - DNA, 201 bp, Bos taurus; identical to SEQ ID NO: 32663

SEQ ID NO: 72405 - DNA, 201 bp, Bos taurus; identical to SEQ ID NO: 32664

SEQ ID NO: 72406 - DNA, 201 bp, Bos taurus; identical to SEQ ID NO: 32665

SEQ ID NO: 72407 - DNA, 201 bp, Bos taurus; identical to SEQ ID NO: 32666

SEQ ID NO: 72408 - DNA, 201 bp, Bos taurus; identical to SEQ ID NO: 32667

SEQ ID NO: 72409 - DNA, 201 bp, Bos taurus; identical to SEQ ID NO: 32668

SEQ ID NO: 72410 - DNA, 201 bp, Bos taurus; identical to SEQ ID NO: 32669

SEQ ID NO: 72411 - DNA, 201 bp, Bos taurus; identical to SEQ ID NO: 32670

SEQ ID NO: 72412 - DNA, 201 bp, Bos taurus; identical to SEQ ID NO: 32671

SEQ ID NO: 72413 - DNA, 201 bp, Bos taurus; identical to SEQ ID NO: 32672

SEQ ID NO: 72414 - DNA, 201 bp, Bos taurus; identical to SEQ ID NO: 32674

SEQ ID NO: 72415 - DNA, 201 bp, Bos taurus; identical to SEQ ID NO: 32675

SEQ ID NO: 72416 - DNA, 201 bp, Bos taurus; identical to SEQ ID NO: 32676

SEQ ID NO: 72417 - DNA, 201 bp, Bos taurus; identical to SEQ ID NO: 32677

SEQ ID NO: 72418 - DNA, 201 bp, Bos taurus; identical to SEQ ID NO: 32678

SEQ ID NO: 72419 - DNA, 201 bp, Bos taurus; identical to SEQ ID NO: 32679

SEQ ID NO: 72420 - DNA, 201 bp, Bos taurus; identical to SEQ ID NO: 32680

SEQ ID NO: 72421 - DNA, 201 bp, Bos taurus; identical to SEQ ID NO: 32681

SEQ ID NO: 72422 - DNA, 201 bp, Bos taurus; identical to SEQ ID NO: 32682

SEQ ID NO: 72423 - DNA, 201 bp, Bos taurus; identical to SEQ ID NO: 32683

SEQ ID NO: 72424 - DNA, 201 bp, Bos taurus; identical to SEQ ID NO: 32684

SEQ ID NO: 72425 - DNA, 201 bp, Bos taurus; identical to SEQ ID NO: 32685

SEQ ID NO: 72426 - DNA, 201 bp, Bos taurus
agaaattcagaacacagattcttgttttgaaatcttaaggtttccaattagaattctggtttcaaagaggttactttcacgttctttttctttaatctaayggagtctaacatttcacagactaaatgggcattcttaaactaacctggcataatttaaatcattttgaacatttgttaacttgaaaagtaagattaatat

SEQ ID NO: 72427 - DNA, 201 bp, Bos taurus
aactttatacctaatcattttttaaaaaattatataccataaaactagtcatttaaagggttcatatcacaaatattatagtcagttcagtccttcagtcrcatctgactctttgtgacccatggactatagcactgagggattctctgtccatcaccaacttccaaagcttactcaaactcatatccatcaaatcggtga

SEQ ID NO: 72428 - DNA, 201 bp, Bos taurus
cctaagatattccaatctaaaatggcctaccaccaaagcagctgcactccgttaaatttacatggtttacatgggaaggaaaggaaagaaaaggagtaagyaagcaaaaaggaaaagatggaaggaagacaagaaagaaggaagggaaggagggagagagggagggaaggaaaaagggagggaaagaagggaggaaaacca

SEQ ID NO: 72429 - DNA, 201 bp, Bos taurus; identical to SEQ ID NO: 32690

SEQ ID NO: 72430 - DNA, 201 bp, Bos taurus
taagtaagtcctctcttaccttgtatacttctattgtacctttccagactttagtcacaccctttcagaataaagacactcagttttcacaaatgaaaatratcttggaaagagctagaaggtggggcataaaattgtttcctttttcagaccccaccccctcaaaaaacaaccccaacaaaaagagaaacagtatgatct

SEQ ID NO: 72431 - DNA, 201 bp, Bos taurus
gttacagatttccacttctatgtattatcctaccttcagcctcctaacagatattaaatatagttagtaattggacaggtcatatgcaaaccgtctaaagyggcctgataaaatatgtagaacatctttttcctccagacaacatttctacattttgagaacagaaagttctccaaaacacataccaagtgatgtgtagcc

SEQ ID NO: 72432 - DNA, 201 bp, Bos taurus; identical to SEQ ID NO: 32694

SEQ ID NO: 72433 - DNA, 201 bp, Bos taurus
tttttcagctttaagaataaactgagagtgggaactcactatgaatataggtgagttgttttttttttttagttcccaataacaaaggtacatgcatatayttgcatcacttacctgtaggtttgctagcttaattcagttttgagtcaaagcatcagacagaggtgactcatttaggtgtgtgatcccttcaaaaaaaag

SEQ ID NO: 72434 - DNA, 201 bp, Bos taurus
acaaccttgcctttgttcccccccatgaatataattaaaagagacaggcttgcaaagacctactgatgggtcacactgggccctgccaaagtatgggatcrggatatgaagcaaatcccattaattatagcaatcaatgattcctccagagagtaaggcttacaattagaggttttcaaaaactttcgaggccactggaga

SEQ ID NO: 72435 - DNA, 201 bp, Bos taurus; identical to SEQ ID NO: 32696

SEQ ID NO: 72436 - DNA, 201 bp, Bos taurus
aaatgagtctgtcaaggaaacatttttccgaaaactgtgtctgttaacagtgcttgcatacttacttctacaatttagaatctattgttttttctctactyggtttttattttatggtaatgtaggctttttccagttaaaataataaatacctttgttatactcaaaacattctttatacattaaattggtacaaataac

SEQ ID NO: 72437 - DNA, 201 bp, Bos taurus; identical to SEQ ID NO: 32697

SEQ ID NO: 72438 - DNA, 201 bp, Bos taurus; identical to SEQ ID NO: 32698

SEQ ID NO: 72439 - DNA, 201 bp, Bos taurus
ctgggcctagaggcccaaataattgaataagtcttcataattaggaatgaaaccaagtacaaaattatttgagactttgtatttttgtgggtacccatccrcattctctggcctcttggatgcaatggtatatgttaatgattctgagattttacttttttttttttaactttacaatattgtattggttttgccatatat

SEQ ID NO: 72440 - DNA, 201 bp, Bos taurus
gaactactataccttatatgtaataatttgatgactactaagaatgaaaccaatgaccagaaggagttatcttttaactacatataaggcctcacatgcartcatatacatttcatgtttttactatcatgaaaggttgtgcatttttcaagttaaataggccacatttttaatttgtcattgaaccacaaatcaacctca

SEQ ID NO: 72441 - DNA, 201 bp, Bos taurus
aaattataaatacatacctgcttgcttggtggtggcaaatggggacctttttcttggttttcatgtgtggacactgaagccatgatgaccttgtcttcgcytctcttctagttgagtggactcagcttccttgttgacccactatctaaggaaagtataagagtcactgtgcagtgatagaacatttatgtcaaccataaa

SEQ ID NO: 72442 - DNA, 201 bp, Bos taurus; identical to SEQ ID NO: 32702

SEQ ID NO: 72443 - DNA, 201 bp, Bos taurus
acaattgtttgaaaaagaataacaattattttatgtccttttttgcctgccagtgacttttgacactgattgtttaatatttgccaaaaagaaaagaggamaggggttacagattaatgtcctgaatatttggtccttatctattaggaatataccaataaaaagaaatacaatacacactatgaagttgtcagggcttcc

SEQ ID NO: 72444 - DNA, 201 bp, Bos taurus
gtccccaggtcgctactgcaggcccaggctctgctgagctgcaaagctgtatcacaggcacctaaactctaaaacacaagttattttcttctccatttctkcttctgagtcagagagaatgtaaacacctgccatcgaatcatccccgactggacgaggggccctggataatgccctcatttacttccacatcccatcaac

SEQ ID NO: 72445 - DNA, 201 bp, Bos taurus
atcctcaaagcaagtgctctacaatggatatgcttctgggacaccaggccaaaggggtctcatttttatcatctctgagcattttcataactttatcaatyttcaccaaaagcagggtttacattcagttacccaaaccctataatgaaaagtcattcacacaaacacacacacgagaaatgtggatcaaaggagacaaat

SEQ ID NO: 72446 - DNA, 201 bp, Bos taurus
caaagagttggacacgactgagcaacttttactttctttcacttttcatgaccagtgaaggcaagctgccactcaaatgtcacaattttaacaccaagackttgccaaaagagcagtaagaaaggtaccaagtcagacccaaggtctggggaaattttcattgacttctaccttcaaaacccaagttcgttgactctaaga

SEQ ID NO: 72447 - DNA, 201 bp, Bos taurus
tgaagcaggtgaagtttgctctcaggattttgcactttttattttaaacaatatcatactactccccttgtaggtcaccattagtcactgatagtccttgygacacaatgaccatcatgtcccacttttagacaactctcttctttaaatgtttctaagaagacttgctgaattttaagtcaacatatatataacatctat

SEQ ID NO: 72448 - DNA, 201 bp, Bos taurus; identical to SEQ ID NO: 32709

SEQ ID NO: 72449 - DNA, 201 bp, Bos taurus
gcacctcccccacccccccataacacataacttagactctgtttcttgttttcaggccctgagccagctacactgtcttgtcaccaccattatcagcagaraggaggagacaggcacagggtggcggcctggctgacccaagactgaggttagaatcagctgaagtcaggcagaaactgggagttagcaattttagagggg

SEQ ID NO: 72450 - DNA, 201 bp, Bos taurus
gggaaccaaggagaacctagcgaaagcttcaggaagaagggggcagaggggcaacaacgatgacgatgaattctgcaccaagcacatcagcttagaagcaraagccttctgagctcacctttcaccatataggattaaaagaacacatgctgtggctcagaaggtaaagactctgcctgcaatgcaggagacctgggttca

SEQ ID NO: 72451 - DNA, 201 bp, Bos taurus
gatcattacaattcaacatgaaaatggcttcagcaaagccatggcctgaaaacaaatggctaactttacctagagaaactaaaggaacttactatatcttracgtttccacagtaacaaatggcccactgaaaatcacagaagttccttgtaagtgatagataattcatgattttcacaaatgatttttctgtccctctaa

SEQ ID NO: 72452 - DNA, 201 bp, Bos taurus
gaattattaattatggggacaaaagcatcagttacacaaatcccacagacctggggttgcaggcaatctattttacattaaaataatatgctgacccaaaktcccttggggtatctgcaattaagccaagttttctgccactttatagcaaggaacatttttcctccaatattcaataacataaccctcatttccattgag

SEQ ID NO: 72453 - DNA, 201 bp, Bos taurus
gccgggctattctctcctgcgctgtggagactgaagctcctgaagaaggaagggggtagaaggatgctgcctggtgaatgctgcttggataccagcaagawttgaagcttggcttcttttcaccctttaaaatgtggatgggctcacgtcttacctgcctgctatgctcaggaatgactctcaccactggacagccccgtc

SEQ ID NO: 72454 - DNA, 201 bp, Bos taurus
gttgggtcatgggtggtgatccatgagccagacgagaccccatccatctctgacacccatcgtgcaggggtgggtgaggcgtgaagagtctggtgggaggkgtcatatttaggatggtggccttttagtcaagtagttgcacagggaagaatttttaacatcttacataaaattgagcactgtatttcattaaagctagct

SEQ ID NO: 72455 - DNA, 201 bp, Bos taurus
ttccttctgccttgaggagttttggtgagtcagatatgagctcatctgtctaatatataagcacatagaagacaatcttctcatgggccctgaaagcattrcattgaaggcaacccaactgcctctggatggtccagagtgactgccctacctaggactgtgagctgcctggccacacaatgtcttttcttagtcttcctg

SEQ ID NO: 72456 - DNA, 201 bp, Bos taurus; identical to SEQ ID NO: 32715

SEQ ID NO: 72457 - DNA, 201 bp, Bos taurus
gatgctttgaagaccagggaaggccaggtgatgtccaggcaacttgcagagtcagaaagattttaagttgattcaaatagagaataggtaaagagacctcraaaaaacccgtggtgggccctcgtaccataccaggtattgcagcaaaccaacattgtctttcaagtaaaattaactctgttaattgcaatttatgttgct

SEQ ID NO: 72458 - DNA, 201 bp, Bos taurus
ttacaatctcagttaaacttttactaagaatgtttacaacacagggattctcaaacttgttaaacttagcaaggattgtttttcagaagaaaagaaaaaaktcagtacattttatatcccatagcgttgattctgcagaatatagctggtgttctgtttaaaaagaaaagaaaagtttaagtacaaatgggtatatgaatg

SEQ ID NO: 72459 - DNA, 201 bp, Bos taurus
ctcttttgctctttcatccctggctagctcctactgtcccatcaggcctctgatttgatgacttcctccaagtagtcccactggccctcataacaccttamcataaccccactacagcccttagcatacagtgttgtaataacccattttcctccatttggccactagactaagcttctcacctgtgtaccctggaggaag

SEQ ID NO: 72460 - DNA, 201 bp, Bos taurus
agcgagaagttgagagtgagggttgggaggtgggcaggactcaccgaggagctgcaaaccaaaataagaaatctagggagcagaaggagaaaagagagtgmgctggagccaagacctcaggccaagtggaactggaggaaatgtcatcattggtaaaggaggacttggagaagaaactgtttaagccactctcacagaatc

SEQ ID NO: 72461 - DNA, 201 bp, Bos taurus
agggcagggctgggggagggagagtgggcctttggacagacgtccaccaccctccccaaacccaggtgctgacatctgaaataaactttccgttccaccartctggcctgtttgttggcttttgagtggggagcatctggacaccaccaccatttggtaacatgggagaaatccccaggaagaatctgtcaggagaagaga

SEQ ID NO: 72462 - DNA, 201 bp, Bos taurus
aaagctctatctcatctcatttgtccccaggccaaacctttagaaattacacatcttcaagccaaacgctttctgtcctttagattcctgcaagagttagkaaaggcccatgggatcctcagaattataaatcataaacagccaaaagcacagtgagaggagacatgaagttcatgccccaagagtgaatcctgctgtaca

SEQ ID NO: 72463 - DNA, 201 bp, Bos taurus
ccagtggaagagatacagcagttaacaataattgactgtctgcctctttgaatttacagtctgtctgaaaacaaacagtaaacaggtaattacaaaggtgrtccagattaaatgtatataaacttaaactgaattgattgatacaaagataaatatgatttagccccctttctgaaggagcttataccttaagtgttgaaa

SEQ ID NO: 72464 - DNA, 201 bp, Bos taurus
gaaaacacccaggtgtaggaatttgcaaactggtcacatttcatgggttctctaagcttccccctgagaatgtgagaaaggaagtgaatagaggtgggttragggttgaaacctaagttttcaacttgggatgaaagaggagttgtagggacttacttggcggtccagtggtgaagacttctcacttccactgcacctggt

SEQ ID NO: 72465 - DNA, 201 bp, Bos taurus
accacctcactgcccaaggccatagtcctgccctcagaactaacctaggcacttccttcaaattccagcacatcttgactagctcccgttcttggttcttrctggccatactgctacacattttatagactcagaaaggaaagttggccttagtcacttctcttcagatggagaagaggaaagggcagtgatggccaaaga

SEQ ID NO: 72466 - DNA, 201 bp, Bos taurus; identical to SEQ ID NO: 32720

SEQ ID NO: 72467 - DNA, 201 bp, Bos taurus
taccaactaactgttagtgaatgaagcaatttacaagcaaattggaaccctgtaatttgaatacaacatgacaagcggcataatatagaaatgcatactaraaggtgaaaatttcctctcacatgtgcactgtacaaaatagtcctggctaatatttgactactagttttagtaaaaacactggcctgggcattcttgaat

SEQ ID NO: 72468 - DNA, 201 bp, Bos taurus
cttatattagtgtcactggatcagaatgacaacacacttgtatgtttttcattgaatgagtgatactgttgtcactgtataaatctgtatctctgttttayaccaaacaataatgattgcctgaatgattttgcattgattactgttatcttttgctatattttaaagttgatttttactagttgccattgtaatatagca

SEQ ID NO: 72469 - DNA, 201 bp, Bos taurus; identical to SEQ ID NO: 32722

SEQ ID NO: 72470 - DNA, 201 bp, Bos taurus
ggacaactggtaattggtcattttattgaaaaagtcaattaaagcagggaaacaataacaaaaaatacatatcctaagcattttctcttaaaacagaaaayaggattgccaatctttttgatgtatgacacaaggcacatggccaggggtaatactacttacactaagagaacctcccttgcagctaggtatgaccacatg

SEQ ID NO: 72471 - DNA, 201 bp, Bos taurus
ttaatgctaaccctaagtctacaggaagttcagggatctgtttcaggccaattaacttcacagcattcatctcatcatgggacctgggacttgacttgccmattcattgtccacagctatagggccactcaatcgactagaaatacttgaaggtaaacacttctgactggtgtaatgttttatgtacagtgtttacagaca

SEQ ID NO: 72472 - DNA, 201 bp, Bos taurus
tttatgattgagagttttgttaatgtcatttgtttctgttgaggtttgctgtggtctctaggataaaatttgagttcttcatgctgtttaggcctctttayctttccatgggccttttccctcaatctgaaatgattgtgctgcctgtcccatgcctcctcaaaaacgggtaatagggagaaggtgttttttacttttttt

SEQ ID NO: 72473 - DNA, 201 bp, Bos taurus
caaaacatagttttgaaagctctaaatatatttcttgcttccttccctctaaagcctaggtctaaaaggaagcatgtctcttggccaggggtcttagtctyttctgtggctaacgtggacacagtgagtaaagtggggctgcgtttgtgtgtactgctggctctgtttctgatgcttccttgtctgtcctcaccaacacaa

SEQ ID NO: 72474 - DNA, 201 bp, Bos taurus
agaaagggctggcctcagtcaataccatggcgggtctaagggagccacgccgctgtaatgcacatggtcgtccctcagtatccattgggggttggtaccasgagtcctgtggatatcaaaatccacagatgttcaagtcccttacatggaatgatacactacagtgaatacaggcagctcttggaatctgagaatgcaaaa

SEQ ID NO: 72475 - DNA, 201 bp, Bos taurus; identical to SEQ ID NO: 32723

SEQ ID NO: 72476 - DNA, 201 bp, Bos taurus; identical to SEQ ID NO: 32724

SEQ ID NO: 72477 - DNA, 201 bp, Bos taurus; identical to SEQ ID NO: 32729

SEQ ID NO: 72478 - DNA, 201 bp, Bos taurus; identical to SEQ ID NO: 32730

SEQ ID NO: 72479 - DNA, 201 bp, Bos taurus; identical to SEQ ID NO: 32731

SEQ ID NO: 72480 - DNA, 201 bp, Bos taurus
cagaagttgctagtcctattaaggcccaggcttggtgtccagaatattactttcactgcatcctattaatcaaatccattcacagtttctcaaagagtatwaatttctggggccatctttggagatgagcaaccacacattttaataacatttattgaagtgtgttcatgaaaatttaagctccataacattttatttttt

SEQ ID NO: 72481 - DNA, 201 bp, Bos taurus; identical to SEQ ID NO: 32732

SEQ ID NO: 72482 - DNA, 201 bp, Bos taurus; identical to SEQ ID NO: 32733

SEQ ID NO: 72483 - DNA, 201 bp, Bos taurus
tgcattgcaggcagattttttactaactgagctatgaaggaaattgtgaccaaacaaattaatcccacatatttcagacatgctttttaattaatttgacytgtttttattgatattttgtggtaggttttggacaagtaaaatataaacaaagctgtcccaagccaaatagattttttttttggcatttatgcaatatgc

SEQ ID NO: 72484 - DNA, 201 bp, Bos taurus
tctgatataaaaaccacagaaaatgcattattctttgataaaaaaaaaagctacagaataatattctttgtcaaagcgtatgtaaaaatcccaaacaaaaytttggcaaaccaaactcaaggatgcataaaagaaaaattctcagtgaccaaattaggccaatcccaggaatgtaagaacattcaaatatcaacaaatgta

SEQ ID NO: 72485 - DNA, 201 bp, Bos taurus
atggcttattttgcataaattgacaagctaaatctaaaatttataaggaaatgtaagaaacccagaaaaaccccaaaaattgagacaaaaaaataaggttrgagatttctattttctgatttcaaaacttactggaaagctatagtaaacaataccttgtgaagttagcatatgcatatacataaataaaataaaactgac

SEQ ID NO: 72486 - DNA, 201 bp, Bos taurus
agaacaaatcactgatgacagctagacagtgattcagaaattgcatacatctctcaacccgcactctggtttgtctaatctcgctttgctcttggttccamatttgtgattctttacagtaacttcacacttcccttaaaacttcactttgcttgctctggtttgctgctaatagactctagcattttggacactagtttt

SEQ ID NO: 72487 - DNA, 201 bp, Bos taurus; identical to SEQ ID NO: 32734

SEQ ID NO: 72488 - DNA, 201 bp, Bos taurus; identical to SEQ ID NO: 32735

SEQ ID NO: 72489 - DNA, 201 bp, Bos taurus; identical to SEQ ID NO: 32736

SEQ ID NO: 72490 - DNA, 201 bp, Bos taurus; identical to SEQ ID NO: 32737

SEQ ID NO: 72491 - DNA, 201 bp, Bos taurus; identical to SEQ ID NO: 32738

SEQ ID NO: 72492 - DNA, 201 bp, Bos taurus; identical to SEQ ID NO: 32739

SEQ ID NO: 72493 - DNA, 201 bp, Bos taurus; identical to SEQ ID NO: 32740

SEQ ID NO: 72494 - DNA, 201 bp, Bos taurus; identical to SEQ ID NO: 32741

SEQ ID NO: 72495 - DNA, 201 bp, Bos taurus; identical to SEQ ID NO: 32742

SEQ ID NO: 72496 - DNA, 201 bp, Bos taurus; identical to SEQ ID NO: 32743

SEQ ID NO: 72497 - DNA, 201 bp, Bos taurus; identical to SEQ ID NO: 32744

SEQ ID NO: 72498 - DNA, 201 bp, Bos taurus; identical to SEQ ID NO: 32745

SEQ ID NO: 72499 - DNA, 201 bp, Bos taurus; identical to SEQ ID NO: 32746

SEQ ID NO: 72500 - DNA, 201 bp, Bos taurus; identical to SEQ ID NO: 32747

SEQ ID NO: 72501 - DNA, 201 bp, Bos taurus; identical to SEQ ID NO: 32748

SEQ ID NO: 72502 - DNA, 201 bp, Bos taurus; identical to SEQ ID NO: 32749

SEQ ID NO: 72503 - DNA, 201 bp, Bos taurus; identical to SEQ ID NO: 32750

SEQ ID NO: 72504 - DNA, 201 bp, Bos taurus; identical to SEQ ID NO: 32751

SEQ ID NO: 72505 - DNA, 201 bp, Bos taurus; identical to SEQ ID NO: 32752

SEQ ID NO: 72506 - DNA, 201 bp, Bos taurus; identical to SEQ ID NO: 32753

SEQ ID NO: 72507 - DNA, 201 bp, Bos taurus; identical to SEQ ID NO: 32754

SEQ ID NO: 72508 - DNA, 201 bp, Bos taurus; identical to SEQ ID NO: 32755

SEQ ID NO: 72509 - DNA, 201 bp, Bos taurus; identical to SEQ ID NO: 32756

SEQ ID NO: 72510 - DNA, 201 bp, Bos taurus; identical to SEQ ID NO: 32757

SEQ ID NO: 72511 - DNA, 201 bp, Bos taurus; identical to SEQ ID NO: 32758

SEQ ID NO: 72512 - DNA, 201 bp, Bos taurus; identical to SEQ ID NO: 32759

SEQ ID NO: 72513 - DNA, 201 bp, Bos taurus; identical to SEQ ID NO: 32760

SEQ ID NO: 72514 - DNA, 201 bp, Bos taurus; identical to SEQ ID NO: 32761

SEQ ID NO: 72515 - DNA, 201 bp, Bos taurus; identical to SEQ ID NO: 32762

SEQ ID NO: 72516 - DNA, 201 bp, Bos taurus; identical to SEQ ID NO: 32763

SEQ ID NO: 72517 - DNA, 201 bp, Bos taurus; identical to SEQ ID NO: 32764

SEQ ID NO: 72518 - DNA, 201 bp, Bos taurus; identical to SEQ ID NO: 32766

SEQ ID NO: 72519 - DNA, 201 bp, Bos taurus; identical to SEQ ID NO: 32767

SEQ ID NO: 72520 - DNA, 201 bp, Bos taurus; identical to SEQ ID NO: 32768

SEQ ID NO: 72521 - DNA, 201 bp, Bos taurus; identical to SEQ ID NO: 32769

SEQ ID NO: 72522 - DNA, 201 bp, Bos taurus; identical to SEQ ID NO: 32770

SEQ ID NO: 72523 - DNA, 201 bp, Bos taurus; identical to SEQ ID NO: 32771

SEQ ID NO: 72524 - DNA, 201 bp, Bos taurus; identical to SEQ ID NO: 32772

SEQ ID NO: 72525 - DNA, 201 bp, Bos taurus; identical to SEQ ID NO: 32773

SEQ ID NO: 72526 - DNA, 201 bp, Bos taurus; identical to SEQ ID NO: 32774

SEQ ID NO: 72527 - DNA, 201 bp, Bos taurus; identical to SEQ ID NO: 32775

SEQ ID NO: 72528 - DNA, 201 bp, Bos taurus; identical to SEQ ID NO: 32776

SEQ ID NO: 72529 - DNA, 201 bp, Bos taurus; identical to SEQ ID NO: 32777

SEQ ID NO: 72530 - DNA, 201 bp, Bos taurus; identical to SEQ ID NO: 32778

SEQ ID NO: 72531 - DNA, 201 bp, Bos taurus; identical to SEQ ID NO: 32779

SEQ ID NO: 72532 - DNA, 201 bp, Bos taurus; identical to SEQ ID NO: 32780

SEQ ID NO: 72533 - DNA, 201 bp, Bos taurus; identical to SEQ ID NO: 32781

SEQ ID NO: 72534 - DNA, 201 bp, Bos taurus; identical to SEQ ID NO: 32782

SEQ ID NO: 72535 - DNA, 201 bp, Bos taurus; identical to SEQ ID NO: 32783

SEQ ID NO: 72536 - DNA, 201 bp, Bos taurus; identical to SEQ ID NO: 32784

SEQ ID NO: 72537 - DNA, 201 bp, Bos taurus; identical to SEQ ID NO: 32785

SEQ ID NO: 72538 - DNA, 201 bp, Bos taurus; identical to SEQ ID NO: 32786

SEQ ID NO: 72539 - DNA, 201 bp, Bos taurus; identical to SEQ ID NO: 32787

SEQ ID NO: 72540 - DNA, 201 bp, Bos taurus; identical to SEQ ID NO: 32788

SEQ ID NO: 72541 - DNA, 201 bp, Bos taurus; identical to SEQ ID NO: 32789

SEQ ID NO: 72542 - DNA, 201 bp, Bos taurus; identical to SEQ ID NO: 32790

SEQ ID NO: 72543 - DNA, 201 bp, Bos taurus; identical to SEQ ID NO: 32791

SEQ ID NO: 72544 - DNA, 201 bp, Bos taurus; identical to SEQ ID NO: 32792

SEQ ID NO: 72545 - DNA, 201 bp, Bos taurus; identical to SEQ ID NO: 32793

SEQ ID NO: 72546 - DNA, 201 bp, Bos taurus; identical to SEQ ID NO: 32794

SEQ ID NO: 72547 - DNA, 201 bp, Bos taurus; identical to SEQ ID NO: 32796

SEQ ID NO: 72548 - DNA, 201 bp, Bos taurus; identical to SEQ ID NO: 32797

SEQ ID NO: 72549 - DNA, 201 bp, Bos taurus; identical to SEQ ID NO: 32798

SEQ ID NO: 72550 - DNA, 201 bp, Bos taurus; identical to SEQ ID NO: 32799

SEQ ID NO: 72551 - DNA, 201 bp, Bos taurus; identical to SEQ ID NO: 32800

SEQ ID NO: 72552 - DNA, 201 bp, Bos taurus; identical to SEQ ID NO: 32801

SEQ ID NO: 72553 - DNA, 201 bp, Bos taurus; identical to SEQ ID NO: 32802

SEQ ID NO: 72554 - DNA, 201 bp, Bos taurus; identical to SEQ ID NO: 32803

SEQ ID NO: 72555 - DNA, 201 bp, Bos taurus; identical to SEQ ID NO: 32804

SEQ ID NO: 72556 - DNA, 201 bp, Bos taurus; identical to SEQ ID NO: 32805

SEQ ID NO: 72557 - DNA, 201 bp, Bos taurus; identical to SEQ ID NO: 32806

SEQ ID NO: 72558 - DNA, 201 bp, Bos taurus; identical to SEQ ID NO: 32807

SEQ ID NO: 72559 - DNA, 201 bp, Bos taurus; identical to SEQ ID NO: 32808

SEQ ID NO: 72560 - DNA, 201 bp, Bos taurus; identical to SEQ ID NO: 32809

SEQ ID NO: 72561 - DNA, 201 bp, Bos taurus; identical to SEQ ID NO: 32810

SEQ ID NO: 72562 - DNA, 201 bp, Bos taurus; identical to SEQ ID NO: 32811

SEQ ID NO: 72563 - DNA, 201 bp, Bos taurus; identical to SEQ ID NO: 32812

SEQ ID NO: 72564 - DNA, 201 bp, Bos taurus; identical to SEQ ID NO: 32813

SEQ ID NO: 72565 - DNA, 201 bp, Bos taurus; identical to SEQ ID NO: 32814

SEQ ID NO: 72566 - DNA, 201 bp, Bos taurus; identical to SEQ ID NO: 32815

SEQ ID NO: 72567 - DNA, 201 bp, Bos taurus; identical to SEQ ID NO: 32816

SEQ ID NO: 72568 - DNA, 201 bp, Bos taurus; identical to SEQ ID NO: 32817

SEQ ID NO: 72569 - DNA, 201 bp, Bos taurus; identical to SEQ ID NO: 32818

SEQ ID NO: 72570 - DNA, 201 bp, Bos taurus; identical to SEQ ID NO: 32819

SEQ ID NO: 72571 - DNA, 201 bp, Bos taurus; identical to SEQ ID NO: 32820

SEQ ID NO: 72572 - DNA, 201 bp, Bos taurus
taacatgaactaaaatcttgaaagaaaacttacatggatgaaattatcaactctccacatctgtttcctggatttctaatctaatcattcaatggtttaaygtgaaacacaagccttatctctagtttagtttgtatcctgaagtatacttcttcagctgtctgggatttacacaactttggtgctaccgtagtggtatat

SEQ ID NO: 72573 - DNA, 201 bp, Bos taurus; identical to SEQ ID NO: 32821

SEQ ID NO: 72574 - DNA, 201 bp, Bos taurus; identical to SEQ ID NO: 32822

SEQ ID NO: 72575 - DNA, 201 bp, Bos taurus; identical to SEQ ID NO: 32823

SEQ ID NO: 72576 - DNA, 201 bp, Bos taurus; identical to SEQ ID NO: 32824

SEQ ID NO: 72577 - DNA, 201 bp, Bos taurus; identical to SEQ ID NO: 32825

SEQ ID NO: 72578 - DNA, 201 bp, Bos taurus; identical to SEQ ID NO: 32826

SEQ ID NO: 72579 - DNA, 201 bp, Bos taurus; identical to SEQ ID NO: 32827

SEQ ID NO: 72580 - DNA, 201 bp, Bos taurus; identical to SEQ ID NO: 32828

SEQ ID NO: 72581 - DNA, 201 bp, Bos taurus; identical to SEQ ID NO: 32829

SEQ ID NO: 72582 - DNA, 201 bp, Bos taurus; identical to SEQ ID NO: 32830

SEQ ID NO: 72583 - DNA, 201 bp, Bos taurus; identical to SEQ ID NO: 32831

SEQ ID NO: 72584 - DNA, 201 bp, Bos taurus; identical to SEQ ID NO: 32832

SEQ ID NO: 72585 - DNA, 201 bp, Bos taurus; identical to SEQ ID NO: 32833

SEQ ID NO: 72586 - DNA, 201 bp, Bos taurus; identical to SEQ ID NO: 32834

SEQ ID NO: 72587 - DNA, 201 bp, Bos taurus; identical to SEQ ID NO: 32835

SEQ ID NO: 72588 - DNA, 201 bp, Bos taurus; identical to SEQ ID NO: 32836

SEQ ID NO: 72589 - DNA, 201 bp, Bos taurus; identical to SEQ ID NO: 32837

SEQ ID NO: 72590 - DNA, 201 bp, Bos taurus; identical to SEQ ID NO: 32838

SEQ ID NO: 72591 - DNA, 201 bp, Bos taurus; identical to SEQ ID NO: 32839

SEQ ID NO: 72592 - DNA, 201 bp, Bos taurus; identical to SEQ ID NO: 32840

SEQ ID NO: 72593 - DNA, 201 bp, Bos taurus; identical to SEQ ID NO: 32841

SEQ ID NO: 72594 - DNA, 201 bp, Bos taurus; identical to SEQ ID NO: 32842

SEQ ID NO: 72595 - DNA, 201 bp, Bos taurus; identical to SEQ ID NO: 32843

SEQ ID NO: 72596 - DNA, 201 bp, Bos taurus; identical to SEQ ID NO: 32844

SEQ ID NO: 72597 - DNA, 201 bp, Bos taurus; identical to SEQ ID NO: 32845

SEQ ID NO: 72598 - DNA, 201 bp, Bos taurus; identical to SEQ ID NO: 32846

SEQ ID NO: 72599 - DNA, 201 bp, Bos taurus; identical to SEQ ID NO: 32847

SEQ ID NO: 72600 - DNA, 201 bp, Bos taurus; identical to SEQ ID NO: 32848

SEQ ID NO: 72601 - DNA, 201 bp, Bos taurus; identical to SEQ ID NO: 32849

SEQ ID NO: 72602 - DNA, 201 bp, Bos taurus; identical to SEQ ID NO: 32850

SEQ ID NO: 72603 - DNA, 201 bp, Bos taurus; identical to SEQ ID NO: 32851

SEQ ID NO: 72604 - DNA, 201 bp, Bos taurus; identical to SEQ ID NO: 32852

SEQ ID NO: 72605 - DNA, 201 bp, Bos taurus; identical to SEQ ID NO: 32853

SEQ ID NO: 72606 - DNA, 201 bp, Bos taurus; identical to SEQ ID NO: 32854

SEQ ID NO: 72607 - DNA, 201 bp, Bos taurus; identical to SEQ ID NO: 32855

SEQ ID NO: 72608 - DNA, 201 bp, Bos taurus; identical to SEQ ID NO: 32856

SEQ ID NO: 72609 - DNA, 201 bp, Bos taurus; identical to SEQ ID NO: 32857

SEQ ID NO: 72610 - DNA, 201 bp, Bos taurus; identical to SEQ ID NO: 32858

SEQ ID NO: 72611 - DNA, 201 bp, Bos taurus; identical to SEQ ID NO: 32859

SEQ ID NO: 72612 - DNA, 201 bp, Bos taurus; identical to SEQ ID NO: 32860

SEQ ID NO: 72613 - DNA, 201 bp, Bos taurus; identical to SEQ ID NO: 32861

SEQ ID NO: 72614 - DNA, 201 bp, Bos taurus; identical to SEQ ID NO: 32862

SEQ ID NO: 72615 - DNA, 201 bp, Bos taurus; identical to SEQ ID NO: 32863

SEQ ID NO: 72616 - DNA, 201 bp, Bos taurus; identical to SEQ ID NO: 32864

SEQ ID NO: 72617 - DNA, 201 bp, Bos taurus; identical to SEQ ID NO: 32865

SEQ ID NO: 72618 - DNA, 201 bp, Bos taurus; identical to SEQ ID NO: 32866

SEQ ID NO: 72619 - DNA, 201 bp, Bos taurus; identical to SEQ ID NO: 32867

SEQ ID NO: 72620 - DNA, 201 bp, Bos taurus; identical to SEQ ID NO: 32868

SEQ ID NO: 72621 - DNA, 201 bp, Bos taurus; identical to SEQ ID NO: 32869

SEQ ID NO: 72622 - DNA, 201 bp, Bos taurus; identical to SEQ ID NO: 32870

SEQ ID NO: 72623 - DNA, 201 bp, Bos taurus; identical to SEQ ID NO: 32871

SEQ ID NO: 72624 - DNA, 201 bp, Bos taurus; identical to SEQ ID NO: 32872

SEQ ID NO: 72625 - DNA, 201 bp, Bos taurus; identical to SEQ ID NO: 32874

SEQ ID NO: 72626 - DNA, 201 bp, Bos taurus; identical to SEQ ID NO: 32875

SEQ ID NO: 72627 - DNA, 201 bp, Bos taurus; identical to SEQ ID NO: 32876

SEQ ID NO: 72628 - DNA, 201 bp, Bos taurus; identical to SEQ ID NO: 32877

SEQ ID NO: 72629 - DNA, 201 bp, Bos taurus; identical to SEQ ID NO: 32878

SEQ ID NO: 72630 - DNA, 201 bp, Bos taurus; identical to SEQ ID NO: 32879

SEQ ID NO: 72631 - DNA, 201 bp, Bos taurus
aagggatgggccgccctgcctccgtgggggaccgcgggcaggtgggcacaaggcggggctcctcccctcgcagcacaaccgggaggggaggggcagcctcrctcaggtcagctctggcctcaggagccaggaccctgcctccttcctattccctctcaggctccccagaccccctggctgtgcccatacagagggcacgag

SEQ ID NO: 72632 - DNA, 201 bp, Bos taurus; identical to SEQ ID NO: 32880

SEQ ID NO: 72633 - DNA, 201 bp, Bos taurus; identical to SEQ ID NO: 32881

SEQ ID NO: 72634 - DNA, 201 bp, Bos taurus; identical to SEQ ID NO: 32882

SEQ ID NO: 72635 - DNA, 201 bp, Bos taurus; identical to SEQ ID NO: 32883

SEQ ID NO: 72636 - DNA, 201 bp, Bos taurus; identical to SEQ ID NO: 32884

SEQ ID NO: 72637 - DNA, 201 bp, Bos taurus; identical to SEQ ID NO: 32885

SEQ ID NO: 72638 - DNA, 201 bp, Bos taurus; identical to SEQ ID NO: 32886

SEQ ID NO: 72639 - DNA, 201 bp, Bos taurus; identical to SEQ ID NO: 32887

SEQ ID NO: 72640 - DNA, 201 bp, Bos taurus; identical to SEQ ID NO: 32888

SEQ ID NO: 72641 - DNA, 201 bp, Bos taurus; identical to SEQ ID NO: 32889

SEQ ID NO: 72642 - DNA, 201 bp, Bos taurus; identical to SEQ ID NO: 32890

SEQ ID NO: 72643 - DNA, 201 bp, Bos taurus; identical to SEQ ID NO: 32891

SEQ ID NO: 72644 - DNA, 201 bp, Bos taurus; identical to SEQ ID NO: 32892

SEQ ID NO: 72645 - DNA, 201 bp, Bos taurus; identical to SEQ ID NO: 32893

SEQ ID NO: 72646 - DNA, 201 bp, Bos taurus; identical to SEQ ID NO: 32894

SEQ ID NO: 72647 - DNA, 201 bp, Bos taurus; identical to SEQ ID NO: 32895

SEQ ID NO: 72648 - DNA, 201 bp, Bos taurus; identical to SEQ ID NO: 32896

SEQ ID NO: 72649 - DNA, 201 bp, Bos taurus; identical to SEQ ID NO: 32897

SEQ ID NO: 72650 - DNA, 201 bp, Bos taurus
ataatgagaggccagtccaagtttacatagtaaatagcaaaactggatcttgagcctcggatttctgaatgtaagagaaatgtatttttcgctacataccrgtttaattgattggccaccatatgttaagtgtctggatacttccctgatggtccagtgaaattcaccgtgtaatgcagaggatgtgggttctctccctgg

SEQ ID NO: 72651 - DNA, 201 bp, Bos taurus
ccatctctaagggattttccccacccaggaactgaaccaggtttcttgcatttcaggcagatttattaccatctgagtaagaattcctgtatcccaatatyaaaacacagggcaaactcactattgtacatctctgaagcctagaagaagtgacggcctattctgaacaaaataggatgtcctgagttactgcgaccaaca

SEQ ID NO: 72652 - DNA, 201 bp, Bos taurus
tagacgtgcagttgcaaggtcagaaagtgggcatagcttcaactccactagaaaggaaggccaagtgttttctgaagagtttatcccaatatatacacttytttcagtgaatgaaactttcttcatggtaactttttttagtcattttaacaggcatataaagatatttctttctggtttcagtttgcattttcttcagta

SEQ ID NO: 72653 - DNA, 201 bp, Bos taurus
cattgctgggcacaagctctgggacgtcatgggaatgaaagcaaaatcacattcctgaggagggttcacacagtctgtgcactagatatgggatactcacrcaacttactctctaaattaacccagcgaaggaggtgttttcatgaagatgattataggaatggtgggaatttttcctttacaaatgaaggaacaggtcca

SEQ ID NO: 72654 - DNA, 201 bp, Bos taurus
cctggaaatggcaacccaccctagtattcctgcctggaaaatcccacgaacagaggagcctggagggctacagtccatggggtcaccgagagtcggacatractgagagactgatcacacagagtatgcgtgaaaaccgcaattccagactcatacttcaaggtccatttgttatgttggataaacaactatagaaaacat

SEQ ID NO: 72655 - DNA, 201 bp, Bos taurus
ctgttgataccctctcttccaatttctcagagatgagcaaagaatgggtctattctccatgaagagctttacagtcaggatatgtcactggccagagtctkctgttaataagaaaattgatttgataaattgaattcattaaacatgtgtgtgattcaagatattactaaagtatcacattataatttacatttaaaaata

SEQ ID NO: 72656 - DNA, 201 bp, Bos taurus
ttcagcctttacctgcccactgacctatggataggttcctatccttttaagcactcctatgaagtttaaaaaaggctgaacaaacagtatggtgaacacayaatggcttgtttacgaggacacactgtctaagttggagatgtgcatttgaccctttaaacatggtccagaaacactaagactatttgtcaaagaagttag

SEQ ID NO: 72657 - DNA, 201 bp, Bos taurus
atgatacttgataggttaacatagaaattgcttaattaaatgcaatcctaggccaggcaggaaaatataaatacacttatatggccgggtgtgtagacaaragtggaggggtcatgaccttgtggagatgagtgaacacccagttgagtgttaacatgcagaaatagaggcccaattttctgcaaatttttaagagtctag

SEQ ID NO: 72658 - DNA, 201 bp, Bos taurus
gatccattaatcagcatgaaatatgttagaaataagttttcattggtgaaatgagtagtgttcaaaatataaaactgcctagaaaagcgttaaagtcttcrcatcagtgagggatagaactccagcaatttcatggccaatcatcttcatagtgtctatatctagatttgcctttattttattgggctccgaaatcactac

SEQ ID NO: 72659 - DNA, 201 bp, Bos taurus
atatattttcatgaattttgataaaatttggccagttaatattttcttcatatgtttcatcaaaacaaataatcaaaacaaacaaaaatctgacctcgttrtcaaagcagcatccctgtactctttcttgaggaggatggcaacaacgatggtaaaactagtaacagcaagagaaaaaattttgcccatgcccacaactca

SEQ ID NO: 72660 - DNA, 201 bp, Bos taurus
tatctcttcttgctattctttggaagtctgcattcagatgttactgaatatatataaggcaagtgaattactgtatgcagtaaatatcaaaaagcaaagcraaactaacttatctaaggcttccctggtggcccagtagtaaagaatttacttgccaatgtaggagaaatgagtttgatccattatctgggaagatcccac

SEQ ID NO: 72661 - DNA, 201 bp, Bos taurus
tgctgcgtgtactgtggtaatatattcttagggctcagggactggtatttccaaatccttcctctatagctcaaccactaaggcctctactcagttctcayggcctcagtgctggggccccatgtccagaatcatccagttgtcatatcagcccaatctggatctactatgcttcactgtagttagctcaccaccacccct

SEQ ID NO: 72662 - DNA, 201 bp, Bos taurus
cattttgagatggcttgttatgagcattattgtggcaagactaattgagtcttttctaaattaattagaatatctactctattctctctccactccttgtyccaaccatccttcctttttcaattcacaaagagcagagtatttggggctaaaactatgtgcagctatataaaatttagtagaatgacagtacctaagaaa

SEQ ID NO: 72663 - DNA, 201 bp, Bos taurus
ggttttccttcctacattatgctacaagatttaaatataaaaacttcatttgtgagcactcttttacttattagtctcacagatctaatgaaaagtgtctyactgcagaaaaagtggcattttcgatacataattgcaaaaagcataggcagacttggcttaggcaccaaaactaaggtggagcgtggtggtgccgggggc

SEQ ID NO: 72664 - DNA, 201 bp, Bos taurus
tttaccacctgctagattagtggttcctcttccttcacatgttcacttaaccagtctcctatagggttttctttagctcttaactgaactaatagcatttkatattttgtgtcaagtgttgccagagtctttattatcagtttgtcaccactttggtcaggaggggagattttaggggcacccacaacatcatccattaca

SEQ ID NO: 72665 - DNA, 201 bp, Bos taurus
tagtccatggggttacaaagagttggatacgactgagcgactttcacttcacacattgtttaaatactgcatctttgttatgtatattgaaattggaaccygtaatgcctccagctctgatcttctttcttagcattgctttggctattctgagtcttttgtgttccatataaattttagaattgtcttttctatttcctt

SEQ ID NO: 72666 - DNA, 201 bp, Bos taurus
tccaaagtacataaattatttactgaacaattagttggataatagccatttgattaatctgaagatagatgcaataaatgttacaagttctaaatcctttygcatccaagtctgactactacaactcttctaatctggggaaataatatatcttgtgcccatactcctttacaccttggctcaccacaaatcatcccacaa

SEQ ID NO: 72667 - DNA, 201 bp, Bos taurus
agatggggctccccttgtggctagtgaacttgacctcctcatgtatttctccctggtcctgtctgccctgggctcctgcacaaccctactaaagccagcarttacatgcagtccacaccaggggatatccctcacgatcctggctctggaggccacagaagcttgtgtttctgggtcacaaaggactgaaacaatcagaga

SEQ ID NO: 72668 - DNA, 201 bp, Bos taurus
gaactcaatttccattgatggagcagccacagcatgctggcagtatctttggcattggtggagaaaggtcaagagagagggagatgacaagttcactgccrctggagctcttgagtctactagaagcttgacaaatgacagccaggcaaaccagttaagtgcattctctaaagccaagtcttagaataaataggaaagctg

SEQ ID NO: 72669 - DNA, 201 bp, Bos taurus
ccctcccccatcccttccccttggcaaccacaagtctgttctctgtatctgtcaatctgtttctgtttcatgtgtgtatgtgactctttgcgacactatgractatagactgccaggctcctctgtccatgggattccccaggcaagaataccggagtggattgccatgccctcctccaggggatcctcctgacccaggta

SEQ ID NO: 72670 - DNA, 201 bp, Bos taurus
tggcaagtctgtgtaataaatagcctaccacatgttaaaagaataaattcacaggatctgggcatttaaaagaaactttaggattcacccagagaatccarggacttcattttagagatgagaaaactgaggcccagagaaattagaagacttattcaagacctccctggaaagtagttatagaatcagggctggaaccca

SEQ ID NO: 72671 - DNA, 201 bp, Bos taurus
tactcatagtcatagatttggggggataaataaaatggccaaggggacatagtccgcttcccaagtgtcccagagccagttcaagataggacaccaattcraagaagcagaaagagaggaggccaggaggaaggaaagtgagaatctgtgcaaattccgaggactttggattcttaccaccaaaatcctgggggttcaaag

SEQ ID NO: 72672 - DNA, 201 bp, Bos taurus
gtatatgacaacttctcttttttagtcctatttgtttcctggcatccgggcatccatgttcagaatctccactgcagctacttacaggatcgttgatgcartgaacagaacagcctcccaagatacagtcccaaatgtaataaatagcctaaaaactatgtatcaaatatataataatcagagctactaatcaaactaaat

SEQ ID NO: 72673 - DNA, 201 bp, Bos taurus
taaaattttgagaactgctattatggatgatctcagtccagtagggtaggtaaaaaacattattgaacttttcaacatagtcagataaattacacaatatkaatgccggcctactatgtctccttgttaattacttttaatggattatcaggttcactcctcatgggagccctataaattgggtagaattatctcatttta

SEQ ID NO: 72674 - DNA, 201 bp, Bos taurus
gcgtggcgcatcggagctacaggcgcaccgcagcgcggcggccttgctgggggaataggcttaaacgcagagttctggtcccaggcctgacttcactgctkcgctcgctgtcccttcctcgagcgcaggtcttcgaccgcccctgtgtccccagtgccctcggagtcgagggtccgaggacaggccgatccagcggaggcc

SEQ ID NO: 72675 - DNA, 201 bp, Bos taurus
gcccacaacatatggccgagtttaaaaaagaattctagagaatgtaactcaggcaccgaaactgaatcacaagtctcagcacttcgcccacgaatgacagyacaaggtatcttcctagaggccaagggtgggaaagcgattacttctgctggggattaagagagaaggtaagaaattgggcctttgaaagatgtctctgct

SEQ ID NO: 72676 - DNA, 201 bp, Bos taurus
gagcaagagaatgctccggttccttcagcccctcataaaggcaccaatcccatcatgggagctccacatcccatggcctcatttaaattcaatgatttccmtaaagccacacctccaaacaccatgacattgaaggttaggacttggacataaggatgcacgtattaggccatagcaaaggcgcattgccgccatactgca

SEQ ID NO: 72677 - DNA, 201 bp, Bos taurus
cacgctatgcagtgtggccaaaaagaggaaagactttggttcttcacttttgtattctccacaccctcaatggtccttggcctatagcatgctatattcaktcattcaatcttgtccgactcattgtgactccattaacggtagccttcaggctcctctctgggattttccaggccagaatcctggagtgggttgccattt

SEQ ID NO: 72678 - DNA, 201 bp, Bos taurus
aaggcagaaaagggaggggacctaacgtgtattcagtagcttcagtgagccgaaattgctctaggtgctttgccgtggttttctattttcacaataacacyagaaggttggtatgactcgttccatttcaaaatgatgaaacagactcaagtgggtttggtcagggctccagggtcgctcagcagataagtaatttgtgct

SEQ ID NO: 72679 - DNA, 201 bp, Bos taurus
gaatccggatgtgtctgcatgctgagtgagggaagagaaggataagcgagatgccaattcatctgtaacatgtgtcaagatcttcagattctcagacactygcaccactattcatttttgacctttgaattattattgactcaagctttgcctattggattgtttgattgtccagtttctttttcggctcttagtgtcctt

SEQ ID NO: 72680 - DNA, 201 bp, Bos taurus
tcctgtaaaaggaataccagatatggggatgaaagcaaggcttagggggtctgtcaaaaaacatgtctgcctagtgcctgtcctttggtgttaaagcaacygaaattaatggttttacactgtggtaggttgagttctctgaaagcagcttctgaggtgtatcaaatgtttagtatgtgttcactgtgacaagaagaagga

SEQ ID NO: 72681 - DNA, 201 bp, Bos taurus
cctactcatcctcaaggttcacagaattctcaattatcacacctaccccactggttagtataaaatactcaggaaggatgtgattctgaagacctcaaacrgtccaaatacaacttaattcaagactattcttaaccaaggatggcaaatgttaagaagtcagtgaatattcttttttgaatactggtgttaccagctagt

SEQ ID NO: 72682 - DNA, 201 bp, Bos taurus
aggagcttgataaaaggatttgttggtggggatttttcttagcatcctggtgacttcaggggtagatgtgtatattgagctcacatcagaacaactgcagraaaaaaagaagaaaaggaagccagacaaggaaagtgagatggggtgaatatccctgctggagacaatgactaatttaagcagggaaggagaaaaactttt

SEQ ID NO: 72683 - DNA, 201 bp, Bos taurus
acccccacgtccgaggtcaggggcagcggccgagagtgtcaggctgtgactgtggaggaacagctgaaaggagctaccccaagttcaaaatcaggggtggyggccgggagaagctacccaccgcctgagaccaggagcggctgccgggaggagctaacccacgcccaagtcagagtggcggccaggaggagcaaccccatg

SEQ ID NO: 72684 - DNA, 201 bp, Bos taurus
catcttttaatttcatggctgcagtcaccatctgcagtgattttatcttaggggttcataaatgactggaggaatatatgaacaaataaatgggaagtttrgggtttcctgtgtctacagtctctttgctcttcagcaaagaatcatacagcaagataatgcatcttgctcttcttcctgttcttcacaaggccttgccca

SEQ ID NO: 72685 - DNA, 201 bp, Bos taurus
tcaaggcaagcttttccacccttggaaatcatataaatatgttatgatcttaatttttaagtatgatctataatttactttggaaaagagaataaaagatratgaagtgataattgctttggataaaatataaatgccacggatttttccaaggtcaagattttcccaattgtttgtttttctgcaacttatttcagtcct

SEQ ID NO: 72686 - DNA, 201 bp, Bos taurus
aaaatgtgctgagtgtgcttccaaagagaaaaggcgccagagggcctttggtggggcgtgctgagccttgtaatcacaaacagatgacggagattcctggytctgcttccagctagcgagggccctgagcaccaactcacaatcagcctggtataatcgtcgtggtttaccttacaaaaatgtcaaactgtcatggattct

SEQ ID NO: 72687 - DNA, 201 bp, Bos taurus
acaaagtttttgcagtatttttctgcatgtgaaaactgggcaaaaactgcacatgaaaactaccattcttccacaagattctctttcaacaggcagcctaraatgttcaatctagtctcctttatcctgagaagaaaactgactttgttgacgaactagtccattttcttctttttaatcttgtagcaaccttaatcaggg

SEQ ID NO: 72688 - DNA, 201 bp, Bos taurus
tagagggaaactgaaggcctcagatcaaagggagaaaagcaggaggcaacaggcattgctgacaagttgccttcttgcattgctgcaagaaggacaagtaygaaggcctgaaaccacagaaaggagcagaggtttgtgtaggaactggagagtgagtgcagtggacatggaaagcctacccccacccctcgctaattctcc

SEQ ID NO: 72689 - DNA, 201 bp, Bos taurus
atattttcaaaattactcaacccaagaatcattttctcttacagcactgattgataagaaacatatctcagatggccccttaatcactcaaaatgactccratactactccacctacctgactttgcttatacttttcttccctacttggttctgagttttttcctctgtgccctgactttagacccttgatttagaggcc

SEQ ID NO: 72690 - DNA, 201 bp, Bos taurus
aaaacactttagaggcaaatatgtcaccatttgacaaagcttttttttctttttttgattgtgccagggcttacaggatcttatttcccaaccgtggattraaattgttggtaaaagcccagagttctaaccactggacaatcaaggaattttcactggtaaagatttgggaaactctcatatcatttcttttcacgctat

SEQ ID NO: 72691 - DNA, 201 bp, Bos taurus
gataaagaaagactgatttctagaaagtgcatttgaaaatgcactggctctagtctgcatactttatttgtgacagtaaatattcctctcttaggtttaartcaacttgttggatttctgtcccttgagccccaggtattcacaatctcaactaaagtataaaccttgcatcagagacctgggcttgttaacacaaagatc

SEQ ID NO: 72692 - DNA, 201 bp, Bos taurus
ccaaaattcttctaaataaataaatagaggtgtttttttattttctccattagagtttacagaccttttgaactcgatccacaggcccaagactaacaatrctttggctactgggacccagaaggagcaaacaatgcagagggcacgttggaaagagcagtggcctttggcagagggacgcacatccacacagccagccca

SEQ ID NO: 72693 - DNA, 201 bp, Bos taurus
ccatttgaaagtgactttaaaagtaaatttaaatgaaaagaaaataaaaactaatacatgctgtaacatggatgaactttgagaacataacagaagtgaargaagctaatcacaaagaaacatattgtataattgtatttataagaagtacccagaatcagttctgaatattcactgcaaggactgatgctgaagctccaa

SEQ ID NO: 72694 - DNA, 201 bp, Bos taurus
ttccgtgacattcaaggccagggtcgttgggaggctctgcttgccctgctcgctgtgccgtgtgctgcttggtcccggcatgcaacttcaggctgttagcrctctaatgtgctcccgtggaatggcctgattacccaggcctttgatgtggaaatgtcatcctgacagtgagtggattccaggaactcttccagcagagat

SEQ ID NO: 72695 - DNA, 201 bp, Bos taurus
tcatgaaaccaaatcagttgactttaagctagaaacctagcgtatgtgccaaaaaaggtctccgcctgccctgctagtgccaatggccaagatttctcacyccagttttcttgtcatcagcactgatctaagaaatcagagctttgagacattttcatttagatgaacatgagtatttataattttcctgggcctcctcca

SEQ ID NO: 72696 - DNA, 201 bp, Bos taurus
tgtgtcgcagtgctcacattatctctgctttttcttcttaataaacccgctcccttctgaaatgctctatatctggaaatgcttttccaacccatgctcaractccctcagtattggcaattccaataaccagctctgcatgactttgagacaagccctctacaccctgtaagtcttttccatagtacatccaaagcagaa

SEQ ID NO: 72697 - DNA, 201 bp, Bos taurus
ctctgcccagctggcattgctctgtggctgtcgggcttagccattcacatcagcttcccgatacgaagtgtccactgtgctctctttagtctctggggcasaattaaactcgctgttccctggcccttctcattcatagattgtgttgctttcaccttccaggaagtgttcatgggtgtcatctcagtgacaggcagagac

SEQ ID NO: 72698 - DNA, 201 bp, Bos taurus
tgtcatcactttacgtcaacacactaaatgcctaacctgtgctgttaccctttaacaggagccaaaggtgacaaggaagaatataggccacaccacaaackacgtaagtgtctaaatatagcgtagttcagttccttagactatctttggaaaagacattgtttagataatgctaagactacagtttgctccagtagtgat

SEQ ID NO: 72699 - DNA, 201 bp, Bos taurus
agatccacatgcacacggtggggagggccctgagttagaccaaatacggactcggagaccaacaaagcaagattgactggccagaggaagccaggaagaaytgcccccatataaatgatttaaatttccccaaagccttgactctctctaagcctggccctgtgtgtctatccacatgtacttttctgctcctaataaaca

SEQ ID NO: 72700 - DNA, 201 bp, Bos taurus
aatgcttcctcttcatttcttcctcttcccccttttcctttcttattttttatttttctctgcctctgccccctttcttccttcttcccaactcatgagcragtgataagaagcggagtataagtaattctggaacttccctggtggtccagtggctcagactccacgctcccaatgcaggggacccaggtttgacccctg

SEQ ID NO: 72701 - DNA, 201 bp, Bos taurus
aacactgttgtttaaatttaaatgcttaacaagtcctcagcagcatgatcttggtccaagcatgttggttaaggtgagttccagtcttaggcacatgcctracacagcgggcctctccatcacaggaccttggcttggaacccgacattccacttcctcattccgagttctccactggaagcctaacctcagacaacatca

SEQ ID NO: 72702 - DNA, 201 bp, Bos taurus
ataacagagtggcagccccctctgctccgaggtcttatctactctgatggcccagatgggctagatgccagtccatcacattgaggccacctgtattccaygaccaccctctgagtgactgtttcccaagacaacctgggacttggcttgagcacccccccaccccccctgctgcacacagacctctgctccttggccatc

SEQ ID NO: 72703 - DNA, 201 bp, Bos taurus
tggggatccactctgtctgccttggttagcccagggccagcctttgatcctggagacggctccctggaagccctgaggccacctgggtctggtttagggcrggctcattgcaactagaaactgatggggtcctgtgcatgacagcagcaaccaagtgccacagcagctctggaaagcccacgagtgtgtgccaggggaagg

SEQ ID NO: 72704 - DNA, 201 bp, Bos taurus
acacacacacacacacacatatacatatacacacacacatatataatgcttcgtgaattttcatgtcatcctttcacagtggccatgctagtcttcttagygtggtttcaattttagtacacatgctgctgaagtgaacacttcaacttcttcaatgaacttaaactagggtgaacacgtatcaccttgtggcctctttgt

SEQ ID NO: 72705 - DNA, 201 bp, Bos taurus
attctcattggcactagctcactcttccagaaaagagcccaagcaaacgctacacaggacgcgattcttgagaaaacctccgggaccagtctggcccttgrctttccccagcaccagctcacacccatccacaccagggattctatttcactgttagaccacctatagccaagtctgcgcctggggcaggctggcctgtca

SEQ ID NO: 72706 - DNA, 201 bp, Bos taurus
gtagactgcccagcacagtgagtgacaccggggagagaggatcgattcatgtcatcatttccctccacgaccttatttacggccgggcgcactgccaacaygcatccgcgtgatttgaaggagacagtgctggctctgtctgataaagggggaacacgcaggtgctggatataatacagcgccctgactctaggggacgtt

SEQ ID NO: 72707 - DNA, 201 bp, Bos taurus
aatatgtttgaaattagctccatatacttttcccgagtaacaagaacatcacgtgctttgctgacttgaaaggaccctgaatctggagaagccggggcttkagctgtcccatcagtgttttgacctaaggtgacacatgtgacatctctgtgtttcattttctcccctgtagagcattacactagattaccctggtgtcct

SEQ ID NO: 72708 - DNA, 201 bp, Bos taurus
tgctccaaggtctcagtagccctgagctcttccgaggagtgggccatggggtcaagagtgtgcacttggagccacctggcctgaacttgaatcccagctcygctgctgtgtgacctcgggcaagtgactcagtcaccctgaactcaggttccttatttgtcagataaggatgcggacagggccagccccacagggatgctg

SEQ ID NO: 72709 - DNA, 201 bp, Bos taurus
cgccaggcctgctggtaaattccgtacttttttcacagctgcgctgaagtgtaattgacttacaacaaactggacacgttactgacttggagggattcttmaccccatgtggccatcaagtgtcgaattgatgtgcctcaaatgtatagtgtgtgacatgcaatgttgggtactggtagggtttcaggggggttcaggggg

SEQ ID NO: 72710 - DNA, 201 bp, Bos taurus
aaataggaaaaaaagtgcccccgggggaggaagagcagaagtcctattccacagagagaaagaaactgccctggcaatttccaaaccaagaagctggcgtmccggggtgatacagatagaaagccaggccagaggctgtctccgtccatggagcccgcatgcaggtcagcacgcgcgccacgtccccctccacgaacgtgg

SEQ ID NO: 72711 - DNA, 201 bp, Bos taurus
aatgctccttccctaatcttattaccgagcgtctcttctcatcctccagaacctctgaaaacattgcttttccctgacgtctactgcctaatgtcttctcygcctgcattcctttaatttcagacttgatactggattaaacattcaaagcaaatggaatgtggcctgtggctaaaggtacaagggggaaaactatgtcac

SEQ ID NO: 72712 - DNA, 201 bp, Bos taurus
gagccttttattcaaagctccctcaactaccagatgcccacccccacatctgcgctgatctgccagaccctccatcaggacccactgcaaggtgggaggayggcggagggtcttcacttcctctggttaagcctcccccttatgcaaccattgcacactcccctgtactttattccggctccttgatgctttagtctgcag

SEQ ID NO: 72713 - DNA, 201 bp, Bos taurus
agcacgtttgccgtcgccacaggctcaagtctgaggacttgatgaaggcaacggggaggctctgacatggatttcttggaggtggagacctcggtgcaccmgcggggtcctgttggccagcacactctctgctccttatgcaaagccagggcaaaaggtgaacggctaacatgtcctaaagggcagtcctgctgtaatgcc

SEQ ID NO: 72714 - DNA, 201 bp, Bos taurus
gcagtggaaagggtcaataagcagataggaaccggagtgtagtaattagggaagcttcggcactggaatacggagagacagaacaggaggttgaaagggayctggtgagtcagttttttctgttgatgcccacaagtgacagcatgatagctacctggtacctgtgttggtgtggggcccctcgagagcctgggaagtcac

SEQ ID NO: 72715 - DNA, 201 bp, Bos taurus
gaatcccggaagcaaaatgtatgaacttcctgcacactgtggcagaactgttatttttaggcattttacagctcaactaacagtattattaccttttcaayatttgtatatttgcaatactcttaggaaaactactgagcccttaaatccttgttaattggagcctaacaacttattgaccagagatgtattcatacgtct

SEQ ID NO: 72716 - DNA, 201 bp, Bos taurus
ttgtggcatgattccacgctcctggtgggaaatcccctctccatcttggaaagttgttttcctaccttcggatggcctgttcatctgtcagctgtcctccyggtcttgcccctgcagatcacacctgaaatgggatttctcaggctgccaggcctccctcctcgggcctccacacaggtccccctcacccctccagagatc

SEQ ID NO: 72717 - DNA, 201 bp, Bos taurus
gattcttgttcctaattgcacttggccggctcacctcccattcggctgggtgtcacctcctatttgcgctgcgtaaatggattctaatagctttcttctcytccatcactcaaagaatggccttggtagccaaaaaggaaattagtttcaggtgaaagcctatttttgccctggggaagaccaaactgttaattacctaga

SEQ ID NO: 72718 - DNA, 201 bp, Bos taurus; identical to SEQ ID NO: 32898

SEQ ID NO: 72719 - DNA, 201 bp, Bos taurus; identical to SEQ ID NO: 32899

SEQ ID NO: 72720 - DNA, 201 bp, Bos taurus; identical to SEQ ID NO: 32900

SEQ ID NO: 72721 - DNA, 201 bp, Bos taurus; identical to SEQ ID NO: 32901

SEQ ID NO: 72722 - DNA, 201 bp, Bos taurus; identical to SEQ ID NO: 32902

SEQ ID NO: 72723 - DNA, 201 bp, Bos taurus; identical to SEQ ID NO: 32903

SEQ ID NO: 72724 - DNA, 201 bp, Bos taurus; identical to SEQ ID NO: 32904

SEQ ID NO: 72725 - DNA, 201 bp, Bos taurus; identical to SEQ ID NO: 32905

SEQ ID NO: 72726 - DNA, 201 bp, Bos taurus; identical to SEQ ID NO: 32906

SEQ ID NO: 72727 - DNA, 201 bp, Bos taurus; identical to SEQ ID NO: 32907

SEQ ID NO: 72728 - DNA, 201 bp, Bos taurus; identical to SEQ ID NO: 32908

SEQ ID NO: 72729 - DNA, 201 bp, Bos taurus; identical to SEQ ID NO: 32909

SEQ ID NO: 72730 - DNA, 201 bp, Bos taurus; identical to SEQ ID NO: 32910

SEQ ID NO: 72731 - DNA, 201 bp, Bos taurus; identical to SEQ ID NO: 32912

SEQ ID NO: 72732 - DNA, 201 bp, Bos taurus; identical to SEQ ID NO: 32913

SEQ ID NO: 72733 - DNA, 201 bp, Bos taurus; identical to SEQ ID NO: 32914

SEQ ID NO: 72734 - DNA, 201 bp, Bos taurus; identical to SEQ ID NO: 32915

SEQ ID NO: 72735 - DNA, 201 bp, Bos taurus
gccacctgctttctctctcagaaacacttctgtgtggtcttcatgactcagtggcatcaacccttcatcacgtttcctttatctttcacactccttttttyggccgcaccatacagcttgtgggatctcaattccctgaccaggggctgaacccaggccacagaaatgaaagcaccaaatcctaaccagggaacttccact

SEQ ID NO: 72736 - DNA, 201 bp, Bos taurus; identical to SEQ ID NO: 32916

SEQ ID NO: 72737 - DNA, 201 bp, Bos taurus
actatgtccctaatttagggattatccaagggtgagagtcaagctgaagcccagaggaactgggtaactcaggaatttagatcaacctctgccttccagamaggggtcccgtgttctgaaagctgggtttagtgcaatatccagaatcatgggctgtgtatgaggtcaagtcaccagtcctcaagagcaaactgggtggta

SEQ ID NO: 72738 - DNA, 201 bp, Bos taurus
tccactccacaggggctgccttgctcagctcacaatgcagggtggctgtggccccttctgtggcttttttgttcctcaggtgttttgtgaaactggtgggmaggactggtcacaaagatagacaggccatcacatggggtgaacacacagagaagacacgaggtgaagagaggagcgggaacacaacacccaagaggacac

SEQ ID NO: 72739 - DNA, 201 bp, Bos taurus
agttgatccctatgaccttggacaggtgtcttcgcctctctgggcctcagtgtcctcatctgtacaatggggataaaaaagtatgatctggccaagctgaygccagggttccacgagtgctcagtccaggaaagccataactgtctttcttatcccaggttcgaggccttctcctcccggactggagctgctactgcaaca

SEQ ID NO: 72740 - DNA, 201 bp, Bos taurus
gcccaagttgtcagggacccagtggcaagcaacatagatcaagatccttgtatgcataacactgacatcctacaggggacaccaaaaggccacgaggaagmcctcattggaggatgtgatgaggagtgcctacatccgaccgcagcctgaataatgagagggagccgacccgtcacagacgaggggaagagcattctagga

SEQ ID NO: 72741 - DNA, 201 bp, Bos taurus; identical to SEQ ID NO: 32967

SEQ ID NO: 72742 - DNA, 201 bp, Bos taurus; identical to SEQ ID NO: 32968

SEQ ID NO: 72743 - DNA, 201 bp, Bos taurus; identical to SEQ ID NO: 32970

SEQ ID NO: 72744 - DNA, 201 bp, Bos taurus
gccgtttgccagtgagcccaggcttgagggcccttgggaggctggggggagggtaggagatcctcgcagaggaagcaaaagggcaaagaatgtcagagccragggccaggggtagtatcaaccttgtcataataacaacaaaaataaataataggtgacaagaatcatgcactcactgcatgccaggctctgtgccaagcg

SEQ ID NO: 72745 - DNA, 201 bp, Bos taurus
gccgcagatatgaggatgactgctatcaggaaacaaaacagaaacaagtgttgatgaggacatggagaaactggagctcctgtgcattgttgacaggaacrtgaagagtatagccactgtggaaaactctacggaggtttctcaaaaacttaaaaatggaattaccacacaacctagcaattccagccaaaagaactgaaa

SEQ ID NO: 72746 - DNA, 201 bp, Bos taurus
tctggtgggcccactaagtaagaggccgagcagcttccccagggtctagctagggaagacagggcagaggggctagcaatccccgatgttgccgggacackccgggccgcgaggccagcagtgagcagggctgtggaagcagggtgcaaaggggtggttactgcttatgggtagcgtgggtgagaggatgccagagccaga

SEQ ID NO: 72747 - DNA, 201 bp, Bos taurus
taggctctgctcctctctgtgaagctgggcccctccttagaccaggggttctcaactcaggaagattctgcccccacgaggacacagccatgtccagagayctttctggccatcacacctagtaaggaggtttgctactggcatctagtgggcagaggccagggctgccgctccaacaccccacagggcacaagatggccc

SEQ ID NO: 72748 - DNA, 201 bp, Bos taurus
gccaccccgccccctccaggcacctgctaaggcggcagcacagcagtggcgggttgtgtttctttaacccctggggcctgttgacacagattagtatcgcyggtcaggggtcaatagggaaggctcttgaggtcaagacctgaacaactggagttgtaatgagccacgtggggaagaggcccaggcagaggagagggccga

SEQ ID NO: 72749 - DNA, 201 bp, Bos taurus; identical to SEQ ID NO: 32971

SEQ ID NO: 72750 - DNA, 201 bp, Bos taurus; identical to SEQ ID NO: 32972

SEQ ID NO: 72751 - DNA, 201 bp, Bos taurus; identical to SEQ ID NO: 32973

SEQ ID NO: 72752 - DNA, 201 bp, Bos taurus; identical to SEQ ID NO: 32974

SEQ ID NO: 72753 - DNA, 201 bp, Bos taurus
caagccaacaatgcttcccagagttggagtggaagcccccaccccaacgttgacattgggggggcatggcggggtggcggcttcccaagggtctcagcccrtaactttctcgaaggccctggagggcgcggtcactgggccggagcgacctctgacagtcaaagtgagctatttcgaagtctacttcttggtgttccccag

SEQ ID NO: 72754 - DNA, 201 bp, Bos taurus; identical to SEQ ID NO: 32975

SEQ ID NO: 72755 - DNA, 201 bp, Bos taurus; identical to SEQ ID NO: 32976

SEQ ID NO: 72756 - DNA, 201 bp, Bos taurus
aagtgaggtatacacaaatatttactgaacagtttattagtatagaaaatgttaaaaggctcttgtactcttcactccaacaaaagagcttggtaagaaarataaatagatatactggactagagatattcgagaactgccacagctgttatgaaaatccaaataccaaactgtcatttctcagtggccccttaacacaga

SEQ ID NO: 72757 - DNA, 201 bp, Bos taurus; identical to SEQ ID NO: 32977

SEQ ID NO: 72758 - DNA, 201 bp, Bos taurus
tgaaaaaggagggtttttaaaaagtggatgggcattgcttcaaacatatgaggcctttcctcaagcaacttcacttatattgacattttttattttcttayaaccagcagtgccagataatcagacaggtttctgaccataggtaatatttatgggctccttcctccagaaaaacaaacagacaaacatatgaggcctgct

SEQ ID NO: 72759 - DNA, 201 bp, Bos taurus
accaaagtgtagaagcccagctgggtgacaccatgggtcagttggctcagctcccagtaaagctgctctatgtccagcctgtggcccatggggtcagggtrgtaggtgcagacgacatacacgctggtggctgcactatccttctcaggtctagggagagggaggtgggaactcaaaagagaagtcttgaaacctctgggt

SEQ ID NO: 72760 - DNA, 201 bp, Bos taurus; identical to SEQ ID NO: 32979

SEQ ID NO: 72761 - DNA, 201 bp, Bos taurus; identical to SEQ ID NO: 32980

SEQ ID NO: 72762 - DNA, 201 bp, Bos taurus; identical to SEQ ID NO: 32981

SEQ ID NO: 72763 - DNA, 201 bp, Bos taurus; identical to SEQ ID NO: 32983

SEQ ID NO: 72764 - DNA, 201 bp, Bos taurus
gtattcaggaccagagcagctggcttctgataggctgatttggatgacagatctgggttcacacagagacaagcgaggcccgttcagcaaaaacgcattgrctccagtttttcatttttatttatttaaatatttttgccacgccttgtggtttatgagatcttagttccccgaccaggccttgaaccctggccctcggtg

SEQ ID NO: 72765 - DNA, 201 bp, Bos taurus
caagattattcattgcagccttgtttgtagaagcaaaagattttactcacaacccaagttaaaaacaacccgataagcaagaggtggactattcatactckaggatactgggcaactttttaaaaaatgtaagaatggaaattcccagtcagtccaatgtttagaactccatgctttcactctgagggcccaggttcaatc

SEQ ID NO: 72766 - DNA, 201 bp, Bos taurus; identical to SEQ ID NO: 32988

SEQ ID NO: 72767 - DNA, 201 bp, Bos taurus; identical to SEQ ID NO: 32992

SEQ ID NO: 72768 - DNA, 201 bp, Bos taurus
agcctagggatgtaggcacccctctggggactggattcatttcctacatgtccaggtctaaaggattttctaggaaaatgaatatttgccagggccccccygcgtggaggagattctggggaatcgcaagaaaggcacaactcgcacccctcggctgctggctccagagccccacacctgaatggggcggaggcgggcggg

SEQ ID NO: 72769 - DNA, 201 bp, Bos taurus
ggccactgttctaaatacagtagctcgagtccctttggctgtcaaagttctttacaccttagctccctactttgaaatccagctcatcatccttcaagatmtagttcagaggccacctcctccaggaaggctcctctgatttcctttcctccatatacttatttagatctttccctcctcctgtgttccttatactggagt

SEQ ID NO: 72770 - DNA, 201 bp, Bos taurus
tacattgcaggtggattcttcacgcactgagccacctgggaagccccttttctctatcacatcttgagagcctgtcggaaatgcagacactcgggcccacmccagactaaccatcagagtctgcattttagcgaggtccccaggggattcctgcatgcacactggggtggccaccccctccctccactccccagagtttcc

SEQ ID NO: 72771 - DNA, 201 bp, Bos taurus; identical to SEQ ID NO: 32996

SEQ ID NO: 72772 - DNA, 201 bp, Bos taurus; identical to SEQ ID NO: 32997

SEQ ID NO: 72773 - DNA, 201 bp, Bos taurus; identical to SEQ ID NO: 32998

SEQ ID NO: 72774 - DNA, 201 bp, Bos taurus
tggtagaaccgcaagacttgcctgacctatagctaaactgaggatggaggtcttttaaatataatttttaataagcagctgtaccttttggggaagagagraccctttaagcagagttattggtagagaggattgaagttggattcgtgctgtctctagaatgttaagtagacaaagtcctaatttctaaacctggctttt

SEQ ID NO: 72775 - DNA, 201 bp, Bos taurus
cgtagtcgcaataggagttacgagaagagagctctgtgtcgaggtggagggtcccccaccatcgcctacagagtggtcctaggccgggggtcccgggatcrgagagaactgggttctagggagcctctagaacagcgtccggatcttaccttaatttaggggccggcttgagtggagtgttgcatgtaaagggatcgaatg

SEQ ID NO: 72776 - DNA, 201 bp, Bos taurus; identical to SEQ ID NO: 33008

SEQ ID NO: 72777 - DNA, 201 bp, Bos taurus; identical to SEQ ID NO: 33010

SEQ ID NO: 72778 - DNA, 201 bp, Bos taurus; identical to SEQ ID NO: 33011

SEQ ID NO: 72779 - DNA, 201 bp, Bos taurus; identical to SEQ ID NO: 33012

SEQ ID NO: 72780 - DNA, 201 bp, Bos taurus; identical to SEQ ID NO: 33014

SEQ ID NO: 72781 - DNA, 201 bp, Bos taurus; identical to SEQ ID NO: 33017

SEQ ID NO: 72782 - DNA, 201 bp, Bos taurus; identical to SEQ ID NO: 33018

SEQ ID NO: 72783 - DNA, 201 bp, Bos taurus
tgtcatctgccaggaaggccgcctgggtaggttatctcctcctgggaccagccttcaaggacagaatgtgagcctggctgtagggccaccagggtccccgytgctctgctcagctgcctctgagccaccttttcaagttcacctccattccctccccggccacgggtcccctgggaggccctggagatgcccagaggcctc

SEQ ID NO: 72784 - DNA, 201 bp, Bos taurus
caaggtgggccgtttcggtcaatggatccctaaacttactagctccagccttgctgttcctccaacattccaggcatggaccagcctcatggcctttgcayggattgttccctctgcccagaatggtcttcatggaagtctcttttgtttcttgttgtattctcagacccccaaacagggcccagcacacaataagagttc

SEQ ID NO: 72785 - DNA, 201 bp, Bos taurus; identical to SEQ ID NO: 33019

SEQ ID NO: 72786 - DNA, 201 bp, Bos taurus
aggccactagggccccgctccccaccccggtcagcctagacctgcctgcacctgcccccccaaagcttgtccaccagccttctgactgcccttccttccakggggcctggtctgggggtctagacgtgcagaggagcccgtttctccagaacgatgctgccccttggtctccagctcagcttgggctcaggccaccagtga

SEQ ID NO: 72787 - DNA, 201 bp, Bos taurus
caaagccacactgattgtaaatggggagattgcaatgccatagtcggatttccgagggaggaaatgaagaccagcccaggaagggtgtatatgggtcaggmgtgtaggccttctctggcccaacagcaggatttgaacactgacttagcatgccctttcttccaccagccgccccaaagggcgggcctggtgtgagtcagc

SEQ ID NO: 72788 - DNA, 201 bp, Bos taurus; identical to SEQ ID NO: 33021

SEQ ID NO: 72789 - DNA, 201 bp, Bos taurus
ccatttggggcactgcaaccaggctggtgaggagcagagggtgtggggggatcccgtgttgctggaagggtcctgattgtgatgctggccgagattaaacygggtgtggggaggtggaatttcagatgggagcagtggaagtgttgggggactcccaaaaccctgtcaggatggatgaaggccaggtttacaggggatgga

SEQ ID NO: 72790 - DNA, 201 bp, Bos taurus
accacatccatctccccccacatttagccttcagagaatgacggtttgattgtgcagagctaagaataaccccaactgtaaagtaccctggaactgcaggkaggtgagaggcagagcctgtaggaaggaggcggggaaaagggcaggtctcatccacacatgccccccaccccggtgccaaagctctccactctgtagctt

SEQ ID NO: 72791 - DNA, 201 bp, Bos taurus
gagtcacctgctgtcactgcccatctagtgtgccagataagggtgcgtgcctcagcacccacttagagctgtcctccccttgagcctaccctcgatgatcygcgaacctgggtgtgtggcctctccggctgcagcctgaccagtctgggggctgtttgcctttggccttcaggcctgtttgcctgtcagcctgcctttctc

SEQ ID NO: 72792 - DNA, 201 bp, Bos taurus; identical to SEQ ID NO: 33043

SEQ ID NO: 72793 - DNA, 201 bp, Bos taurus
tttgctattatcaaatgtgtcctggatttaagtgtatccaggatttaattcatttttatattttaaaagaacacacgattgtattcaaattttccatcacratggcccttaaacagtatttccatgtcttttacccatacacagtgagtacgctcttaaaatggtatattctgcagtctaaattatgcagattttgctttc

SEQ ID NO: 72794 - DNA, 201 bp, Bos taurus; identical to SEQ ID NO: 33046

SEQ ID NO: 72795 - DNA, 201 bp, Bos taurus
agtactgaattctgtgtctcatcattaaacaccgatgctattctgatggttattacttagatcatagccaactgccctttcctgctggagtgaatctgtcrgctagtggtacaggggaggctgggttctagtccagtcactgatttccggtctcttctggctctaagttacaaaccgcctccccgtcgcttctgacaccca

SEQ ID NO: 72796 - DNA, 201 bp, Bos taurus
gaaactttcatcatgatggtatgaggaggaaaatggtttcagaaacagaaaatatcactcaacaacatggaccagacaagcaacaaggatatactgtgtarcacagggaatacagctttattctgtagtaactttaaactgagtttaagttataaaaacactacttttttttggaatcactattttgtacgcctgaaacta

SEQ ID NO: 72797 - DNA, 201 bp, Bos taurus; identical to SEQ ID NO: 33047

SEQ ID NO: 72798 - DNA, 201 bp, Bos taurus; identical to SEQ ID NO: 33048

SEQ ID NO: 72799 - DNA, 201 bp, Bos taurus; identical to SEQ ID NO: 33049

SEQ ID NO: 72800 - DNA, 201 bp, Bos taurus; identical to SEQ ID NO: 33050

SEQ ID NO: 72801 - DNA, 201 bp, Bos taurus; identical to SEQ ID NO: 33051

SEQ ID NO: 72802 - DNA, 201 bp, Bos taurus
tccaggggatcttcacaactcaggggttgaaccccggtctcctgcattgcaggcagattctttaccagctgagccacaagggaagtccacggtggcagtasttactgggaatttcaccttagaaaaggacccacctctccttctacacaaatacacacagagtcaaatcagacctgcagatagtcactctacaatcacatg

SEQ ID NO: 72803 - DNA, 201 bp, Bos taurus
tttgtaattgatttacttcttccctccaagcattatttagtagtgtattggcctttattcagtcattagacatttctttttagggtaaagttataactaartcaagtttatttatagtttgcgattaccaacgacacattcaaagacataggaaacagatttttacatccttggtttgccctgtaaaactatttctatacc

SEQ ID NO: 72804 - DNA, 201 bp, Bos taurus
aatgatattagagaagaatcagcaactgcagaatatgatttttttcaaatataaatgaaacattgaccaatataggccttaggccatgaaataagcctcarttgaaatcatacccagaacaactgacccctggaaaacaggcatgtgagctgcgtgggccacttgtatgtggatttttttcaaggctaaatacttcactac

SEQ ID NO: 72805 - DNA, 201 bp, Bos taurus
ttaaatctcctgaatcatgtgtgtatggccattgtgtgagagagaaagaatgacaggaaaatgagagatagagaaagagagttagttagttagttttagargtgggaaaacagagaagcaatgggccagagactatatatatgaaccatagctgaagttccaagctaataagccagacagattggacagagcccgtccaca

SEQ ID NO: 72806 - DNA, 201 bp, Bos taurus; identical to SEQ ID NO: 33057

SEQ ID NO: 72807 - DNA, 201 bp, Bos taurus
tcagacatgacttagggactgagcatgcaatacaaattactgtaaataggcatccttgcatgtgctgccatcttgtggccaaatagaaatgtgtttctaartgactctgctactacttttcaagaaaaagaaatgcaaaaggcaaaacggttgtctggggaggccttacaaacagttatgaaaagaagaaaagcgaaaggc

SEQ ID NO: 72808 - DNA, 201 bp, Bos taurus; identical to SEQ ID NO: 33059

SEQ ID NO: 72809 - DNA, 201 bp, Bos taurus; identical to SEQ ID NO: 33060

SEQ ID NO: 72810 - DNA, 201 bp, Bos taurus; identical to SEQ ID NO: 33061

SEQ ID NO: 72811 - DNA, 201 bp, Bos taurus; identical to SEQ ID NO: 33062

SEQ ID NO: 72812 - DNA, 201 bp, Bos taurus; identical to SEQ ID NO: 33063

SEQ ID NO: 72813 - DNA, 201 bp, Bos taurus; identical to SEQ ID NO: 33064

SEQ ID NO: 72814 - DNA, 201 bp, Bos taurus; identical to SEQ ID NO: 33065

SEQ ID NO: 72815 - DNA, 201 bp, Bos taurus; identical to SEQ ID NO: 33066

SEQ ID NO: 72816 - DNA, 201 bp, Bos taurus; identical to SEQ ID NO: 33067

SEQ ID NO: 72817 - DNA, 201 bp, Bos taurus; identical to SEQ ID NO: 33068

SEQ ID NO: 72818 - DNA, 201 bp, Bos taurus; identical to SEQ ID NO: 33069

SEQ ID NO: 72819 - DNA, 201 bp, Bos taurus; identical to SEQ ID NO: 33070

SEQ ID NO: 72820 - DNA, 201 bp, Bos taurus; identical to SEQ ID NO: 33071

SEQ ID NO: 72821 - DNA, 201 bp, Bos taurus; identical to SEQ ID NO: 33072

SEQ ID NO: 72822 - DNA, 201 bp, Bos taurus; identical to SEQ ID NO: 33073

SEQ ID NO: 72823 - DNA, 201 bp, Bos taurus; identical to SEQ ID NO: 33074

SEQ ID NO: 72824 - DNA, 201 bp, Bos taurus; identical to SEQ ID NO: 33075

SEQ ID NO: 72825 - DNA, 201 bp, Bos taurus; identical to SEQ ID NO: 33076

SEQ ID NO: 72826 - DNA, 201 bp, Bos taurus; identical to SEQ ID NO: 33077

SEQ ID NO: 72827 - DNA, 201 bp, Bos taurus; identical to SEQ ID NO: 33078

SEQ ID NO: 72828 - DNA, 201 bp, Bos taurus; identical to SEQ ID NO: 33079

SEQ ID NO: 72829 - DNA, 201 bp, Bos taurus; identical to SEQ ID NO: 33080

SEQ ID NO: 72830 - DNA, 201 bp, Bos taurus; identical to SEQ ID NO: 33085

SEQ ID NO: 72831 - DNA, 201 bp, Bos taurus; identical to SEQ ID NO: 33086

SEQ ID NO: 72832 - DNA, 201 bp, Bos taurus; identical to SEQ ID NO: 33087

SEQ ID NO: 72833 - DNA, 201 bp, Bos taurus
aaagtaacatcccattcctttggaaggctttgctttgcactctttgaaaaaaatacctgtggattgtacttgaaagaaagtatctccctgtggattgatcrtgaaaaatgactttgtatttcatgctccgttattagtgtcactacctcagaaaatgtcagagtggtttctcctgccacatctgactgggagaatctgggt

SEQ ID NO: 72834 - DNA, 201 bp, Bos taurus; identical to SEQ ID NO: 33091

SEQ ID NO: 72835 - DNA, 201 bp, Bos taurus; identical to SEQ ID NO: 33092

SEQ ID NO: 72836 - DNA, 201 bp, Bos taurus
caaaagttcatcattggcctccattaccgcagcagtcaccaaccaggctgaacaggggaaaggttgaaccacagtgctttaatatttatttggccatgtcrggacttagttgtggcgtgtgggatctagttccctgacaaggggtcaagcccattaagaaccctgcattgagagcatggagtctttgccagtgggccacca

SEQ ID NO: 72837 - DNA, 201 bp, Bos taurus
caaataggatgcctaaagttgtattgagctcacagctaactataaacgcaccccttgacatggccctgcccaccaaagggacaagatccaaatccacctgyagagggcaggaaccagtcccttctaccagaaaacctgcacaaaccccaaaaccaactttgcacaccaggcagcagacaccaggagcaagaactacaaccc

SEQ ID NO: 72838 - DNA, 201 bp, Bos taurus; identical to SEQ ID NO: 33095

SEQ ID NO: 72839 - DNA, 201 bp, Bos taurus; identical to SEQ ID NO: 33096

SEQ ID NO: 72840 - DNA, 201 bp, Bos taurus
aagacaattttcacaatgaaaacaatgtaaagaaggaaaaaaaaaaaaaaaccaaattgttttatccccttaaaagcaacatgctatcactccatagtttytcaaaaacatgttcaattatgattaaaaatctctgctttttctattttgggcacttataaatggaagtgcttgaattttatgaattcctttcatatcagg

SEQ ID NO: 72841 - DNA, 201 bp, Bos taurus
ttgctggcccttcagacccaggttgtcatactcaaggcggtgaaaaggaatctgagcagcatagttgctcgaattcttgaggcttattttcaacaggcccrtccagtccaccctgctgctgcctgctattctctagttggtcaggacagctggttccgggtcctctctttcctctttacaggcccgtaggctgaccagtac

SEQ ID NO: 72842 - DNA, 201 bp, Bos taurus
attgcaaaattagaaatgatggtcccttcaagtttaaccatttatgacagggaatgttttcaagattacccacttgtattttaaagacaatcactttcctmttctctgtaaaatgcaaaaatgcttttttaaaaaattaagataaaattaccatttctacatctcattgacgaaaagagagcaagacagcgtgttctaatt

SEQ ID NO: 72843 - DNA, 201 bp, Bos taurus
cagctaggtctggccccggatcttgtgaggtccctgctttttcctgtgttcctggtgtgcatcctccaagaggggagttcctgttttccctcgtctgtggmtttcctgtgagcagactttgctggccttcaaagccagcttctcgcaagaccagccctccacactgcggagcctgatgtggggctcagaactttcactcct

SEQ ID NO: 72844 - DNA, 201 bp, Bos taurus; identical to SEQ ID NO: 33097

SEQ ID NO: 72845 - DNA, 201 bp, Bos taurus; identical to SEQ ID NO: 33099

SEQ ID NO: 72846 - DNA, 201 bp, Bos taurus; identical to SEQ ID NO: 33100

SEQ ID NO: 72847 - DNA, 201 bp, Bos taurus; identical to SEQ ID NO: 33101

SEQ ID NO: 72848 - DNA, 201 bp, Bos taurus
gtgtgtctgatatcagtgtaatgttgggatcctgttatcataggtttgtgagatatacatacagaaattcataaagagatcaattgtacaaatgaaccaamgtaatatgattctataaaaaggagcagttcaagctaccattgggtgacggagttttcctcaaagagggggctttgtacaaggggcagaggaaaatgaagc

SEQ ID NO: 72849 - DNA, 201 bp, Bos taurus
ctgctgggcccacagaaacaggtctgtgacacggagaagtaaaataaattgccaggtcatcacaccttgcccatatcagacctcctttcaattcaataaaygatgtgtcgttggaggtgggccattagcatcacaagggaggctgtttcaggagctctttttctctctcttccgaacactggggctgtggctgagtgccac

SEQ ID NO: 72850 - DNA, 201 bp, Bos taurus
acactgccttgcctacagagaggatccatgagaaaacttttgttgtgggtggtgggtgaatttgggtgatgaacaagatgcagggtgcattaagcagtgarttgtaaatgcacttggatgtggatctcacatatggatcacacatgactcattctttgatccgtttcaagtagatttagagggctcagggcagatttttta

SEQ ID NO: 72851 - DNA, 201 bp, Bos taurus; identical to SEQ ID NO: 33105

SEQ ID NO: 72852 - DNA, 201 bp, Bos taurus
agcagggggtgggcagggccttgagcgggaatggggacaaatactggattcaaagctgaaagaaatgtggtagcagagaaagctgagagaattggagaacyaggccgtgaagaaacagtctgctggaatgaggaccatggtgggggtctttcctgctgcatgtagaaagaaagggcccaagatggggaagatttgtgggca

SEQ ID NO: 72853 - DNA, 201 bp, Bos taurus
taattaaaagattgcaaattctcaaataatacatacaacagtggtgtccaaaaacatcatcatgaagggagaaatgtcttttgttctttcagtggcccagsatccacttacccattgtcagataattaccccatcaattttcctaaactgagatccctcctctctccccctgcctcagctgattctcaggccacacactat

SEQ ID NO: 72854 - DNA, 201 bp, Bos taurus
catcattctaccaaaggagtctgtgacatgaaatatgtaagtttttgttttacaactcagttgatttatataaaaatgatctaggtaaactagagacaatmttattttctcataacagttaggtgatctcattaagtcctctggcatggtggtaattacaaacacattctgatgactcttattacaaagccagaccatttg

SEQ ID NO: 72855 - DNA, 201 bp, Bos taurus; identical to SEQ ID NO: 33107

SEQ ID NO: 72856 - DNA, 201 bp, Bos taurus
tgttgtactagaataaatacagaagctgatttaaatgtaaattagaaggctggtgagaaagagaggaacataaaagatgatagaagagaaaatataaagaygtagttgttatggtttaaatctataaatgggcatgttcttttttaagtgtgacacccaaacctagaatacacagaaaagaagatgagtgtatctaacaaa

SEQ ID NO: 72857 - DNA, 201 bp, Bos taurus
tgaagccttaactctcaaggagatggcatttgaagatggggcctttgggagatgattggtttagatgagaccatgagggtggggccctcacaatggaatcwttactacacctataagaacaggaagagacactggagttctctctcttcaccagatgaagacagtgaaaaggccaccacctccaagccaggaagagagcat

SEQ ID NO: 72858 - DNA, 201 bp, Bos taurus
aatagaggctggcctctttcattccctctctttttaggggtgagaatcagtgtctttgcatgagtatgtcttcatgccaaaatgtttttctttgtggcaamcagatgtggccgtcttgatcttcttcctcctcctcctgtttttcccttttctgttccgctttcgctttagccaagccaaggcaagatggaaagcatagca

SEQ ID NO: 72859 - DNA, 201 bp, Bos taurus
agatgatctgggatagggaaatgctggtctctagatccttgcttttcaaatcagaaagaggacatgcttttgctccttcccccaaaaaaggcacataggcyattgctgtgaatgcatttacctagaatgcacgggagaccaggactaaggctattgctcgctttaacagaattttctaaaaccaaagccagagagagtctt

SEQ ID NO: 72860 - DNA, 201 bp, Bos taurus; identical to SEQ ID NO: 33111

SEQ ID NO: 72861 - DNA, 201 bp, Bos taurus; identical to SEQ ID NO: 33112

SEQ ID NO: 72862 - DNA, 201 bp, Bos taurus
ttaataaatgacatgcagaacttgcatttcagaatttaaatttcaaaagcaagagttggctgattacaaaaactgcactgccacttacgacactttaattkcaagtttccaggcaaatattatgacactctatgttaattactttccatgttttacaagtttatatatatttagaggcatgactaagttccagtgaatgtt

SEQ ID NO: 72863 - DNA, 201 bp, Bos taurus
atgctaaagctctgggaaattaaaaatagcaaatattcttttattactagcctcaaaaattcctactgaaagcatttggatctgctttcttcacagatatytggtaatcatattatatatgtagattgagattgaatgaaatacatttccaaacagtttaatactgaaacattaagcacaaaatattgcatatgtattgta

SEQ ID NO: 72864 - DNA, 201 bp, Bos taurus
aagaatgtagaaatttaaacaaaatttttgcatacgtgtaaaatatattgaggcataatcaaagaagcttacgcagcatatcaaagaagcttatgtggaargagaagaaggaaaagagaagtttcaagaacaaaaaaatgaagaagacagagaagaagggaagaacaagaaaggaaagtgtgacagatgaggtagaggaag

SEQ ID NO: 72865 - DNA, 201 bp, Bos taurus; identical to SEQ ID NO: 33114

SEQ ID NO: 72866 - DNA, 201 bp, Bos taurus
cagggtcattatttaacatgtcttcttaaaatgaccaatgaaattgcagtgcaggcatccattttctcacctgaagactatgtataaagcacattgttggkattataaaggcaactccgtgatgccctctgctttcaaggaatttatattctacatggccagataagtcatgtatataaatatataaaactacaaagttag

SEQ ID NO: 72867 - DNA, 201 bp, Bos taurus; identical to SEQ ID NO: 33116

SEQ ID NO: 72868 - DNA, 201 bp, Bos taurus
ttcaagtgttttctttttctaaatggaagaaaatatttcttattaataagataataaccatctggctataaggaaggatttagccaaaaatctgaaacaayggggaacagagaacagaccaacaaaggcttgtattttatgagaaagtcttagaaacagtattttttaagaagaaatttttttttctaaattactcaggaa

SEQ ID NO: 72869 - DNA, 201 bp, Bos taurus
gaaggagttcagaaagattcaaaacagagaacacaaaataaactacaaaagtatgaaaacacctgatgcactcaggatcaataagggaaaccctctctatyacacacgttcttttcatatcatagccagatgtccttgggaccctaaaataccttcaacagataaactcctcaagttcccattaatctattgttctttttc

SEQ ID NO: 72870 - DNA, 201 bp, Bos taurus
cccagcccagggattgaacttgcatcttctgcattggcaagtggattctttaccactgaatcaccagggaagctccagtaatcagcatattttcagtcaarcaataaatgttagtgagtttttaaaattctgtaagtcactttagtttcagaatttgaatcaaacaaatgccatcaagtttacctccaagatggctaagtt

SEQ ID NO: 72871 - DNA, 201 bp, Bos taurus; identical to SEQ ID NO: 33117

SEQ ID NO: 72872 - DNA, 201 bp, Bos taurus; identical to SEQ ID NO: 33119

SEQ ID NO: 72873 - DNA, 201 bp, Bos taurus
gttccttcaagaagaacttggaatcgacgaagaccttccaccaggcagtgagcagcgagaaagttcgctgtacgaacctcaactgctcagtgattgtagamatgaggcacaagggctccgagccttgcgtggacgtgctgttcggagacgggcattgttgattatgcgcagcgcgcacctcaccgcccacaccgcccagga

SEQ ID NO: 72874 - DNA, 201 bp, Bos taurus
cttgactgctaccaacaagtatttaaagtgccttaaatataaaaggcatgtgcaaggactattaaaagatggaaaaattaagaaaatgccacatcagagamagagaagcctactcaaagcatgggctaatggtggttaccctggctgaggacagtgtgaggtttacccttaagcttcctgatagtcaaagaaaaagtgcaa

SEQ ID NO: 72875 - DNA, 201 bp, Bos taurus; identical to SEQ ID NO: 33121

SEQ ID NO: 72876 - DNA, 201 bp, Bos taurus; identical to SEQ ID NO: 33123

SEQ ID NO: 72877 - DNA, 201 bp, Bos taurus; identical to SEQ ID NO: 33124

SEQ ID NO: 72878 - DNA, 201 bp, Bos taurus; identical to SEQ ID NO: 33125

SEQ ID NO: 72879 - DNA, 201 bp, Bos taurus; identical to SEQ ID NO: 33127

SEQ ID NO: 72880 - DNA, 201 bp, Bos taurus; identical to SEQ ID NO: 33128

SEQ ID NO: 72881 - DNA, 201 bp, Bos taurus
ggtcttgatatgagtcaggtagtcctaaagataaagtatccatgcatttattcatcttctccctcctttttttctttcttccttcctccttccctccctcyttccaattattattttttgagtaactatcacatacataacagcttctaaaacctggagatgcagtagtaaagaagtaaaccctcatagggtccctcctct

SEQ ID NO: 72882 - DNA, 201 bp, Bos taurus; identical to SEQ ID NO: 33131

SEQ ID NO: 72883 - DNA, 201 bp, Bos taurus; identical to SEQ ID NO: 33134

SEQ ID NO: 72884 - DNA, 201 bp, Bos taurus
tgaatggtctgctcaggaatcactggatgagtgttttttcttataatccatttggagatgaatttatcagtggtaactaaaagtattctgtggaaagtacytcaatttttgttttttttaaataagtggagattattccctaaattggtgaaggcagtatgagtcaaagtgtcttttctaagacagatattttttagaatt

SEQ ID NO: 72885 - DNA, 201 bp, Bos taurus
attggggttacaaagagtcggacatgactataactttcacattcacaagttgggaaaaaaagtttaagggatatatcatgaaaaatctcattatctggccyctgcattcaatatggagacaaatagaatgaaccagaggaaaagttccccttaaaatgaagatcagagcagaaaattttgcatttagaatacatcctacaa

SEQ ID NO: 72886 - DNA, 201 bp, Bos taurus
ctgactgaaaaataaagctacaatggatccagactttgcaagacatcctaaagtagccaataacattactaagtgagaggaacaagaagtggctggagaakaaagcatggagtgctgtggcactgaccccattagggtcaaaacaccctcctcagctccagaaccatcttcccattttttaatatgagcaatcattttttt

SEQ ID NO: 72887 - DNA, 201 bp, Bos taurus
gggaagagaaccagttcagaccagaaactcagagtttcctccagagcccagggaccaccccctgcccctaatccagtggtatcggccactgagcctaggamagccctaactcacatctggctgtctctaaccttgaaagtcaaagtgaaaatttggtggtgtccaactctttgcaaccctgtggccaatacagtctatgga

SEQ ID NO: 72888 - DNA, 201 bp, Bos taurus; identical to SEQ ID NO: 33135

SEQ ID NO: 72889 - DNA, 201 bp, Bos taurus
ctctttcttctcacgtgacatattattggctggcttagcaaaagaacttgtgttacatctgccattgtcgtttgcaatcccaaccaattgtgaactaaccrtgagatgctcgtaaatacttcacaatactgacgaacacaggagtctcagggctggctaagataagttttaaatatcaaccgaatcaatcatgtgaagact

SEQ ID NO: 72890 - DNA, 201 bp, Bos taurus; identical to SEQ ID NO: 33137

SEQ ID NO: 72891 - DNA, 201 bp, Bos taurus
ccccagccttcttcatgtcactgtacaaaggaaatataactgaacagttttttggtgaaagatattttggcaagagctaacaggctgtgagctccacctaytccaggcctctcccaacagctccaagagtcaacaagatcagtatctggacatacctataatccactcaagaaatactgattggctgcccattgaaatcac

SEQ ID NO: 72892 - DNA, 201 bp, Bos taurus; identical to SEQ ID NO: 33142

SEQ ID NO: 72893 - DNA, 201 bp, Bos taurus
ttttttgatgccaaactaaatgactctttttatttccttccacttattagtcaaggtttccaggcctctcctttggccttcgcagaatctgttactttttwaacagttttcttttaaactacaaggcacggcgtggagtgcaccctccgtacagtagactattgtttgcgacactcggcccggcagccccatcgctcaacc

SEQ ID NO: 72894 - DNA, 201 bp, Bos taurus; identical to SEQ ID NO: 33145

SEQ ID NO: 72895 - DNA, 201 bp, Bos taurus; identical to SEQ ID NO: 33148

SEQ ID NO: 72896 - DNA, 201 bp, Bos taurus
aaatagataagacatgggagccataaggaatgagctttattaaaaagaccgtgcctattgctaccacgccaaggtgttttacaaaggcggtacgtgacacyggacttcatttattctgtgaatgtccttatgcaagattctttggctcttcacacagtgaggattcagaccttaaagagttttagctaaaggccagatcca

SEQ ID NO: 72897 - DNA, 201 bp, Bos taurus; identical to SEQ ID NO: 33300

SEQ ID NO: 72898 - DNA, 201 bp, Bos taurus; identical to SEQ ID NO: 33301

SEQ ID NO: 72899 - DNA, 201 bp, Bos taurus; identical to SEQ ID NO: 33302

SEQ ID NO: 72900 - DNA, 201 bp, Bos taurus; identical to SEQ ID NO: 33303

SEQ ID NO: 72901 - DNA, 201 bp, Bos taurus
atgatgatgaatgttccaatgcatgagccatcaccattcctctgcttgcatcacattccctaatgtcccattggccaaagcaagttacaaggccataacakgattcaaagggcagagatacagattttacttcttgatgggaggagctgcaacatgacattgtcaagaggaatttgaggccatttttgcaatctattacaa

SEQ ID NO: 72902 - DNA, 201 bp, Bos taurus
gcctgcagggaggtcgtgcagagtagaagagaagatataggtgacatggtctaacctggtggttcaaggggctcagtacatcaacagctctctcttcaacrttcaatgttcggggctgcgcttaggcccaggacccatcgaaagctgggctactgactttaggcaagtaaaatggaaccaatttacaaatttccatttata

SEQ ID NO: 72903 - DNA, 201 bp, Bos taurus
ccctgcctaccctccagcctcatctctcaacacttcctataccgttcctccccacccaacacaacacacattctaataaactgacccacagtaactgctgygggccaccaggatctcttgaacctatggctgcctttgtgtatcctcttctccccaccaagttctctatggacttgaacttctcattcttaccctccatta

SEQ ID NO: 72904 - DNA, 201 bp, Bos taurus
tgagagaacgaatgtgaaagctgttgaaaatgacaagtggcatctgaaataagaactaccatccgttgtgtgtgtcctttgtgtctgaccctgtgctcagygcttccatgcctcatctgccagtcctcacacagtcccaggtggatgctcttggtcccctgctctacgaaggaggaggctgacgtaggctaccttgtgcgt

SEQ ID NO: 72905 - DNA, 201 bp, Bos taurus
gcactgtgcatagaagcccctctccccagcatctcagggcattgttcccttccaatgtgctttctgaatgaatttcctggctggcctgatggtgttttcakttgtgggaggctgaacagggagttggttcaggagagacagctggagtttagggctgcgaggccttcatccattcagtcctgtgaacaccatctgtgcctg

SEQ ID NO: 72906 - DNA, 201 bp, Bos taurus
cagtgcctgtgtgtgtctcctgacttgggtaccaagatatctaagatagagtgggaggtgatggattttgcatgagaaccagcttggggtaaggccacagygtttaaatctcactgaataacagaccctttttttaaacaaatgaactcttgattggaaagtcaaaatacacaacaggtaaagggattctgttctgaatga

SEQ ID NO: 72907 - DNA, 201 bp, Bos taurus
atttcccacctgccacacatcctctttgccccaggcttaagtttagaacttgggtggtatgtttgatggaggtttgaggacatagttagtcccaaaaatayagtccatttgttattattagtctgtgagacctgactgtgtttcttctccaccacccactgctttgagggtcttactttccattgggacccatttctgtta

SEQ ID NO: 72908 - DNA, 201 bp, Bos taurus
accagtttctgatatttacttacttacaagcacccccctgtccaggcctgagactttgttcacgggccaagcaggtatgtcagactccatcttctgtgagrtctggctctccccagagagtactgggccctttacactaacctgtgtcctcaggttgctcttcgggaattcttcaatatgtcagcatcccagatggggttg

SEQ ID NO: 72909 - DNA, 201 bp, Bos taurus
gaggaaacttgggaaagaaggaatccatgttttgcttatagctaagaatattaaaggtactgagatgcaaatccaggccctctgattcagcaacctttccrtcactctccaacatagtgtatgatgtccttaatgagcagcattaaagtggcctaaaagcagaacatgatgccccatgaatgccctttggctggctttcag

SEQ ID NO: 72910 - DNA, 201 bp, Bos taurus
tttatggagatggatgctgtggtttgtaaaagttaaagttactcagagtctcaatcagtgcacagcagtgagataggcctctgtttagtccagtgtcagargctttaagcctaacctcttccaaagttcagtgtccttctaacctgaccctgccctccatggtaagggccctgaaggaagcaaacttggcattctctttag

SEQ ID NO: 72911 - DNA, 201 bp, Bos taurus
gttagaggtttgaggagtttggaacctatgtttataggccaaagattgaggcaacagtggaaagctgggaaggagtgaggagaatatcagattaatggggyaggaatttataacatgaataggttctaatctattaggggatggaggcagacagaagtggagctcataaagagagctctaactagcctggagggagactgg

SEQ ID NO: 72912 - DNA, 201 bp, Bos taurus
tatgacactaatatttgtacagtagccagtagatagcttttaaagtctgtctttctctccaatctttaaatgcagcatgggaagaaattagtttccccccyctccttgtccctaacatttctctttcctctggggatttctgtgcatttttcatatgtccattaattttcttattaatttaacatttgtttaggtgactat

SEQ ID NO: 72913 - DNA, 201 bp, Bos taurus
ctttaccatgttggcaatagatccttgtgtgcaatcttaggactgtgaaaatcctcagaatcagaatccattttttccctccatattttatctttctacarattcctttttatacctaatggtttgccagccttctgggaaactaattttattggcaaaagtctggactgaataaaagacatcttttaggttataaataaa

SEQ ID NO: 72914 - DNA, 201 bp, Bos taurus
gcaatttgcctgtcactgtgctgctttactcatgtcactgcttatctctgagcctcagacgctctcatctccaaagaggtgaaacagtcctgaatgaagcrattttctaaggtctttcctggtatctcccaagactaagagatcattacggagtgatacctgtccccagcccacgatgactacttcatgacttttactgga

SEQ ID NO: 72915 - DNA, 201 bp, Bos taurus
tactggacacataaggaggccaatgtaagcagggagtgatgccatcttagttacatgacagaagatctcttggactacacctggataaggaagtgtcaggkttacaagagtgcctccagagtggccaggaaactgctacaatagacccagcatggatgatggtcgttttcaaagcacagttccctctctgaaagcaatgaa

SEQ ID NO: 72916 - DNA, 201 bp, Bos taurus
ggggtaggatggctgggcatagaaaccataacctcccacacaagtattccctgcatcgcatcctgtgctgagtcaccccagttgttaaaggggaagaaccrtgtagcttgaggttaatggaatcctagatgaaaggaacatttctggtctttaatgtaaacagtttgggcttaattctgttgctgtcatctcctttttaaa

SEQ ID NO: 72917 - DNA, 201 bp, Bos taurus
ctaagaagaacatagaaaacctggaaatatggaaggaaggtgaatagggaggcttgttggcgggggtggggggagagtagagtgctagtaagcaggctttyacggtttgtttcaaaatgcacattctgcttacctcttgtggggggtagtatcgctttataaagttaagaagacaaaatgtgtaaatactgggaagaagaa

SEQ ID NO: 72918 - DNA, 201 bp, Bos taurus
agtcacttgctcttttcttatctccccgtcttcttcttccctcccctccctccccacttctttactttctacttttcccagaaactgcctctttttttagyagtaattataaaatctcatattcttcaatgtcaaagaggtttgagaagctttcttatacaatcctctcactagttttgagaaatctgtgtgctggaaggg

SEQ ID NO: 72919 - DNA, 201 bp, Bos taurus
tgggccccagggccaaggtgaagagaggctctaggaagctgagaggaacccaaagtcaaagtatatgcaacacggacacatgactcaggggcttaacacgrctagtcctggcaaggcccttggcagtctggtcccccaccaccacctccaactctggcacacccgtctcagttgtactggcttttctggactttctctaag

SEQ ID NO: 72920 - DNA, 201 bp, Bos taurus
aagcaggatgatgagggctgagcagcttgtctgtgaccccttgaaagaaccccagagagaaaggaaatctggctttgaagacaaagttttttatcttttgmaagctgcattcctatacacctgcctcctgtgggctcaggtgtcttgcctgacccagtgcctggtttggggtttttttttttactttgtatttggtattgg

SEQ ID NO: 72921 - DNA, 201 bp, Bos taurus
ctggaatgaatagacctctagctttgctcccgaggagcaccatggagagacagggacagatgtaccaacaactagaccatggggccagtgggaaccaacaygaggcactcagggtcagctggcagcctagtggaacacggacacacacagccgtggccagcctgccccattccaatcctggctccacagctctcctgcagc

SEQ ID NO: 72922 - DNA, 201 bp, Bos taurus
ggattaatcaatcaaatgttttagttgaggaccattaggatatcaactttgccttaggcacagtggtaggcattatggctggtgtgaaaaaggaagaaacyagagtacagatttcggactttgcaaaaatcaagatacacaaggaaaaaaaaatagataataaagcaaaatgttcatctgaataatttccaaatgcaggat

SEQ ID NO: 72923 - DNA, 201 bp, Bos taurus
ggtggtggccacatgtccacagctctctcccagttctcctttctctccattggcaacctttatgatagccatggggctccctgactcaaaaacagaagagmaactctcatcctaagagggccttgagttgctggtctggaaaaatcccttctccctctatgggattctacttctcatctctgcaataaaaggaatcattct

SEQ ID NO: 72924 - DNA, 201 bp, Bos taurus
aaatcaagacaataggttaaggggaacagatgaaggggggagctcatcaccataacaacaagcccaacaactctgaaagatggaattttgtttttcttttygcctgtcattcttcctggtactgtcactctccttgctcctgttggaagacaagttgtgagttcttcactcccaccagcaagctgcctggctctgggaagt

SEQ ID NO: 72925 - DNA, 201 bp, Bos taurus
taagatcttttatcaatttacttatttatgttacataaataaatagcacagtcagctctgacagtcatcttgcaattggtcatgcagtggcctgatcagcrtcatcttgattgccttaagtatagtcagtctttagttccagggttggtttgttcccacttctttgaggccaattcttgaaattgtggcagcttatgtcat

SEQ ID NO: 72926 - DNA, 201 bp, Bos taurus
tcaatgagcagacaaaattgttgtcatttaactgtggaacctattttcaccctcaccccctagaaggagaaaaatctctctaggtgcttttgagagttacyggccagtcctcaggaaggcaggactacctgtgacttcccggtgctgatgctgaacctggggaaacaacacagaccctcaggagtcctagtcactcataca

SEQ ID NO: 72927 - DNA, 201 bp, Bos taurus
taattaagttcccaagtgtggtgaagtatgcttatagtagatttattctgctacagatagtaactataaactctggacaaaatgtaaaacacaactgcttraagaatctaataaacaaaagcaggagaatccagagagtgatagaaatttgggaaatgggactgctgctgctgctgctgctaagtcgcttcagttgtgtcc

SEQ ID NO: 72928 - DNA, 201 bp, Bos taurus
attaaagtcagacaccaagtgagagtttgaacttatttctttataattcttaagaatgcattggttgggatacactgcatctccctggtccctgcattcarttatttttctcactggcttattcttcagtttcttatgagctttgtttctataactcatcaatggacacatgcagataaatctaggaattaggaagcatca

SEQ ID NO: 72929 - DNA, 201 bp, Bos taurus
aagtaatttttttttttttttttttttaccactgagccaccagggaagccacccattaaggctggctgaaagaaaaattgccatagatttgctggcctctmttttttcagatggcaatggtttaatagattttactcacatcacattttgagcctggatggaacaatgttaaggccaaaagtttatattcaacaaaactta

SEQ ID NO: 72930 - DNA, 201 bp, Bos taurus
gtggcatcaagaaaatatgaacaagcatactaatttttggtccattaagatcgtatctgatattttcattttcctggcccatgtggtcaatgaaagtatgycaactctcaactttcatgtcgtacagagagtcaaggaatctttgctgatgctctgggcctctgtgcagggagtcatgtcttcatgacacagctgaggagc

SEQ ID NO: 72931 - DNA, 201 bp, Bos taurus
tttcatcatcacgctccagggtcaccctggccagctcttgtgctgggacaggagattacaccgtctctgttcaaagagggggaaatgtgcctgtgccttaygtcaatgcactcagcaaggagaagcacatcctgtttatcttgttgttacctgtagtttattttgggtgattggagggaaagggtaaaataatgaccggta

SEQ ID NO: 72932 - DNA, 201 bp, Bos taurus
tgaataggtaggcctggtgtgctgcagtccatggggttgcaaagagtcggacacgactgagcggctgaactgaacctggaaggaaccaactcagctgggarctggtagatgtggcctcttgctccccagccagcatggcctgagaattaaggtatgtgagtaggaagatcaacagagatgcagtgaggagaggggatggga

SEQ ID NO: 72933 - DNA, 201 bp, Bos taurus
caacctcatcccttgaagaaagaaaatgcttttctgttagaaaaaactgatgtcagacattgtgaatcaaagaattaccagggcaacaaccctttacaagrtgagttatataatacaaaactgaacaatttaaactctagagcaaaagagaaaacaatgatcagaatgaaatctaaacaatatattctctacctactttct

SEQ ID NO: 72934 - DNA, 201 bp, Bos taurus
gtctattcttgcctcttttgtcattgattaattaaccaaaagtatatgattctgaattctccatcctcttccattgatctgtgtgtctattgagccagtaycataatattttgattaccatagctttgtaatatagtctgaagttggggagtgtgatttctccacctctgttctctttctgaatatttttttggccttctg

SEQ ID NO: 72935 - DNA, 201 bp, Bos taurus
gaaggaaatggcggcccactctagtgttcttgcctggagagtcccagggatgtcggacgctggtgggctgccatctatggggtcacatagagtcggacacractgaagtgacttttgaagaacaaaactccaagccaaaacttgtacttgctaatctttgcaagatcaactttctaacacatataagaatactatcaaacc

SEQ ID NO: 72936 - DNA, 201 bp, Bos taurus
ttacagcttttaaaagtcttacagggcccacaagccccaggctgggagctcttgcttcacacaacccttatgtcttatccctaaagtcctgagtccttgartcacctgagatgagccatgtaaggcccaccctgacccttttcgctgtgtgtgtgtctgtgtctgggttcggggatggggcagggatgggaccagggtgag

SEQ ID NO: 72937 - DNA, 201 bp, Bos taurus
aggactcaataaataactactttaagaagctatttcctccaggaggccagtgacctaacagaactgaccacaacatggcagtcccatgtcctcactactcrggagcacaagattattttggcctaaaatgccaggcttggtgtggctgctaggagcatgcatttcatttgggctcttgcacttcctagctgggaccccagg

SEQ ID NO: 72938 - DNA, 201 bp, Bos taurus
gagaagacaaaaagctttccccacccttaaccctgatggattggacacagctgcatggaatgctgcatcattgaggcttctgggccctttatctggattcrgtgagaaagagtgccatgacttattatcaatcactatcaccaatatcaatggaagggacagcagaggcccatgtagcaggtatctaccatccttgacact

SEQ ID NO: 72939 - DNA, 201 bp, Bos taurus
tagtgccagactactgttggcaggcagagctgggtccttgagtctggctgcagggctcagggatcctacagctagtatcagatcactgagggtgggataawgaggagggggctggttcctagcacacatttgggtatgaggcctggggtatcctgaagcttttttttggcctgctagtggaaagggccagggcccagctgg

SEQ ID NO: 72940 - DNA, 201 bp, Bos taurus
gtggccattatgttttctaaatcaaaccaaaaatgtaaatgctagggccacaagaacactaatgagggaaaaataccacagagtatttgaagtaggcatcmttttccaaagttcaactatttattattactatatgcatatactttcagtataaaagagctagaaatctagttgtaaaatatattcaaactattaaaaata

SEQ ID NO: 72941 - DNA, 201 bp, Bos taurus
tggggtaaactccagacatattgtgaagtaactttggtctccaaggcttccatttctctaatctgaggtcttcttcccctttcaatgcctttctttcctcmctcaggagtcttggatttgactgctgtaggtccaccagaccaatgctcacacactgcagcacacatagaaaatgacaagcgagaatgtcattggcaggtc

SEQ ID NO: 72942 - DNA, 201 bp, Bos taurus
tgcagaagacagtatttggaacaacagcgtatattatggggcctaagatagactcagtacaaaaactttaggattaaattagaatgtgctgctgttggaaktgggagctttctggccttgagtattctagcagaggctgtgtgaccatctatagaggagacttctgctttgaatgggtcagactacatgacttcttcagtc

SEQ ID NO: 72943 - DNA, 201 bp, Bos taurus
ctatgtacctgggccgctcttggaccatgtcaccctctcaacacgtgtgagagggaggttattcttatctccataacacagaaggaagtggaggcttggaraggaggccatggatctaaagcctcattgctggcaagggacagagctaggagccaaatgcaagtctaccttaatccaatccctgtggttgcaaacactggc

SEQ ID NO: 72944 - DNA, 201 bp, Bos taurus
ttcagaaaccttgataaagccatgccaggcacattgcgggcacgacgtacatgttaccgattccttgggcctcaccgcagacatgcgaatgccggccaagygcgatgcctcggtactgatgctcacggatcactcaggaagacagctggcaaactgaaacgggacagggacacctctggccttcaaaacagagacggccag

SEQ ID NO: 72945 - DNA, 201 bp, Bos taurus
gaacagtgtaagaacatttgaggccacaggagaaagaagaggatatagagggaagacagacagcgcttacaaaacaacaaatataagcgttaacaactatyggggcacagacaacaaaacctatgctaacagccgacagagtccatggcccaagtgctccatcaacgtgcactcccaggctggccaccattgctcttgcct

SEQ ID NO: 72946 - DNA, 201 bp, Bos taurus
ggtgcacaccaggccccagggttttcaatgtggcttaacagcaattatatgaatgttaggaaggggggaagtgttaaagtccctacatttacattttttcwtggttttacctcttaaagggatagaatacatctcctaaccaagtaagccacgaaaaacccaccccaagagggacacaggatatcctgagaaagcaagcca

SEQ ID NO: 72947 - DNA, 201 bp, Bos taurus
cattgctaccggcgagggtattaagtttctcagtgtgggttttcttttgttggtcattcatagttgtgaatccagctacaatttatttctttttatgctarcaatggacagcaaagggataaaactgtgtaaaagaactctttaattcctaatctcttttttcctactgctacaacttttttgtctttttcttttaaacgg

SEQ ID NO: 72948 - DNA, 201 bp, Bos taurus
catgaagaagctggatgagaaccagaccttgaattacaaataggatttgaagaataatgaaactaatgagtggcaagtggctgaagaggaggcagagtccytcctaccacccagtgtagtgacaaggccgtgcttaaaactttctttgggcaaaagcgcagccttttttaaaatgaggagagagacctgtacttgtttctg

SEQ ID NO: 72949 - DNA, 201 bp, Bos taurus
acccactctgtcctaacctcctggcagaaccccatccctgaataaatccaatttccttccaccctaagcagcacactgtggccagaaaagaaggcttaacrgggctgtcagttcttactttaacttctgggctgcagatcttagattccactgatcatcctactaaggccaacacctccatctgtgcatttcttctttcct

SEQ ID NO: 72950 - DNA, 201 bp, Bos taurus
tggttgagtcaggccaattgaccagtggctgagcagttgctgatagctgattgaacagacaggaaaaatggtctatgccatctgctcagcaagcagccttyattgtggccaaaagccaagcgtaaattaaaaagaagaaaaatcaatttaattatgcatgtgactaagctgtgtttcatgatgagagaactaaaaagaaat

SEQ ID NO: 72951 - DNA, 201 bp, Bos taurus
ggtgtgtgtgtgtagctgcagtgccatcacagatggccctcgtaagatctgtaatgcaggcgatgcctttacctgagtgtgtgtggctcataaaaataacrgatggctgtcaggccacactgggaaattgctttctcccacatctgcaggatgtttccgcagtcactgtgctccctaaccatgtctgctaataataatact

SEQ ID NO: 72952 - DNA, 201 bp, Bos taurus
ctctgtatcgttccaattttagtatatgtgctgccgaagcgagcactgcttttactgttgtttgagttacaaatgtttctctcagttcttataactttgtyttcaaagtttgtgactttatagaaatgtccaggcaaatacagcaatactttacagatcctgaactcctgtcatatgtaaaaaggtctttcctatttcaaa

SEQ ID NO: 72953 - DNA, 201 bp, Bos taurus
acgttcaggccgagtggtggtaccaggtttgctacaagtggaaagaagggaacctgattgattactgcccagataaggggcgggtgaaatctggcagtcartggagagtgtcggagatgggccagatggcagatggtcctgtctggggtgtgcagaagctgcttgaggctctgagagtccagcctgactgagcagcagcag

SEQ ID NO: 72954 - DNA, 201 bp, Bos taurus
tctctttaaaagttccaagtttccaaaagtgtcaaattgacattgtatcatacttaaaggttaagttggatgcatacaatatgaaaccaacttacaaataytgggagaaacttgcctctaaaaggccatcagatttttcactaagaataaaaaaatctaaaaatggaaaataagagatcaaatcttagggacagatggacc

SEQ ID NO: 72955 - DNA, 201 bp, Bos taurus
tcagtttatagaggagaaaggactcacccacaatttctcatcatcaagggtgtgcagggcccatgttctcatcctaaattttctaacttcttggccttttktgccaagcactggggtcccacttcctgggactgtcactaaaggttaccaaatttatggtaatcagattgtgatgagcccctggtgaaaggccagtactag

SEQ ID NO: 72956 - DNA, 201 bp, Bos taurus
tgcagaaaacaaaatagagaccaaaaaacagaagaatatagagaaatatgttccaaaataaaggaacaagataaaactccaaaaacagatcttaatgaatraaatggaaatgtgtgatttacctgataaagagttcaagataacagtcataaagatgctcactgaggtcaagaagcaagaacaaagtgagaatatcagcaa

SEQ ID NO: 72957 - DNA, 201 bp, Bos taurus; identical to SEQ ID NO: 33304

SEQ ID NO: 72958 - DNA, 201 bp, Bos taurus
aagaagagtaataaataaaaataaataattaaaaaagagcaataaataagtaatgtaataaaacttacatttctcccttattttgcacagggacagactcrataggaaaactctgcatttttgaaaattttacttcgctcatctgtttgctttttatgatttttagaatcactgtcttttttaattggagtatgattgctt

SEQ ID NO: 72959 - DNA, 201 bp, Bos taurus; identical to SEQ ID NO: 33306

SEQ ID NO: 72960 - DNA, 201 bp, Bos taurus; identical to SEQ ID NO: 33308

SEQ ID NO: 72961 - DNA, 201 bp, Bos taurus; identical to SEQ ID NO: 33309

SEQ ID NO: 72962 - DNA, 201 bp, Bos taurus; identical to SEQ ID NO: 33310

SEQ ID NO: 72963 - DNA, 201 bp, Bos taurus
ggaagtttttatattggtcttttcaaatttctcctgtgtaaaaaaaattaagttacttttgcttgttagtctcatcatccttgaagatcaatctgtgtctrgaatctcctggtaagttttttatctataatctcagtgatagctaaagcttagtatcatgaagttctcaacagagctaaaaaatcataaggctagttataa

SEQ ID NO: 72964 - DNA, 201 bp, Bos taurus
ttgaaatggaaatggtgttctgggttgtaaaattaaaagataccccttctagggtggttatatggcatgtgttcttttggccaggaatcaaaagtagtcaytggatacaaaatctcattctcaataaccataaaaactgaaaagcactgaatttaacaagaattatgtaaggcctataggaataaattcaataagaagttt

SEQ ID NO: 72965 - DNA, 201 bp, Bos taurus; identical to SEQ ID NO: 33312

SEQ ID NO: 72966 - DNA, 201 bp, Bos taurus
ggaagtagatataagcataaagagaagctcagagaaaagagggctgtaaatacagtagcactgatgtgcaatgcacgggagtttcacacataaatgaaggygacaccaccaacagtcttaggaattatagtcagatgttggtttcagaagccaggtaatcctgaatctgcctcctttgattcctgaattttacattatagt

SEQ ID NO: 72967 - DNA, 201 bp, Bos taurus
tacaggtggaatggtcctcactgaagtctacccggagactgtcagaaggactcctgaaaaaccaaagctatattaaaaatatactgggtaggaaaggaagraaagtgattggatcaagacctgtgcccttgtgaggggtctcaggggtaaaaatagatattacacaggaggacaccctgcctgggtagtgagcagttagag

SEQ ID NO: 72968 - DNA, 201 bp, Bos taurus
ggctgtcactcactctggggacattcaattacgggaaagcggcaatggccatattgactcattagcatcaacaccacacctggtcctgccgagcagtctaygcgctggtgctgggactcaagccaaacaacttaaagggccaaacacagccccgcccatcagcagacacgcccctagacacatgagggctccatgtgtggg

SEQ ID NO: 72969 - DNA, 201 bp, Bos taurus
atagaatatataaattatatatgtaaatatgtagcatgagattgtacatttttttacttttttaaaagttgtgttcttaaaatattgtgtaggactcaccrctcttagctgttagaatgttgttaaatgctatggaaatacttttacagcctgcatttaagaccagaacagtctgaaggaatcagatggaatttacaatat

SEQ ID NO: 72970 - DNA, 201 bp, Bos taurus
aacgacattgcaggcaacataaagtaaaaatactgtaccttgggacatccccagccttttcttctgctcattccccgaaaggctggcatccaggcatggartggcaccctcaggttccacttccagccaattcattctaggttggattgaataagttttctctagagatatacccatacttgaatgaacatttccagagac

SEQ ID NO: 72971 - DNA, 201 bp, Bos taurus; identical to SEQ ID NO: 33313

SEQ ID NO: 72972 - DNA, 201 bp, Bos taurus; identical to SEQ ID NO: 33314

SEQ ID NO: 72973 - DNA, 201 bp, Bos taurus; identical to SEQ ID NO: 33315

SEQ ID NO: 72974 - DNA, 201 bp, Bos taurus; identical to SEQ ID NO: 33316

SEQ ID NO: 72975 - DNA, 201 bp, Bos taurus; identical to SEQ ID NO: 33317

SEQ ID NO: 72976 - DNA, 201 bp, Bos taurus
gatagagcctgtggagtattacagactatcctcagacaagctgcatcagattcaacttataaaaatgatgatgatggaacaaacttctctgtactggatcygactcaaaccaactaggtgaaactccaggcctaatgatcagctatcttatttcatagatagaaaattgctgtggatgttgtgttaaataagtgaattaaa

SEQ ID NO: 72977 - DNA, 201 bp, Bos taurus; identical to SEQ ID NO: 33318

SEQ ID NO: 72978 - DNA, 201 bp, Bos taurus
cagagatgagtcttggtcttggctccctgcaagagctatacagaaccacctgatacacagtccctgagtgcttccacaggaactaaggcccccagtcaggyggagcaaaaccggctgggaccagaggctgataactgagatagctgaaacaccacctggttacctcatcaccagcaaatcagaggaaggtcacacaccctg

SEQ ID NO: 72979 - DNA, 201 bp, Bos taurus
ggcagcgtgaggcctgtcctgttcactgaggatgtttttcattatttattgccttcatccatcagttgcccatagcacagccctaatgacaaccaactgcrtctccagatatggccacatgtccactagggagtaaaatcacacctaactggaaaccattgacctgtgtcatcaacacttaatatgtcatttaatccccca

SEQ ID NO: 72980 - DNA, 201 bp, Bos taurus; identical to SEQ ID NO: 33322

SEQ ID NO: 72981 - DNA, 201 bp, Bos taurus; identical to SEQ ID NO: 33324

SEQ ID NO: 72982 - DNA, 201 bp, Bos taurus; identical to SEQ ID NO: 33325

SEQ ID NO: 72983 - DNA, 201 bp, Bos taurus
aaacaggccttcactagctgtggtcagcagagccctccttctgaagggtttggaatctgtgagaagattctcccactactttccaggccaagtgtgagagytgaagaaagaagcacaaacaacctattcaagtaaacaggcagacagattacagcccatcctgagtatgtaatcttttaaagttactaaaattcataggca

SEQ ID NO: 72984 - DNA, 201 bp, Bos taurus
ccttctccaagggttctttctgaccaagggaacttggatctcgtgcattgcaggcagattctttaccatctaagccaccaaggaagcctgatacttgttayagatgccattaactaaaaatagtttcctcataatatacatatgagaggatatattgtttactacactgtaatgatactcattttcaatctgctttgcaat

SEQ ID NO: 72985 - DNA, 201 bp, Bos taurus; identical to SEQ ID NO: 33327

SEQ ID NO: 72986 - DNA, 201 bp, Bos taurus; identical to SEQ ID NO: 33328

SEQ ID NO: 72987 - DNA, 201 bp, Bos taurus; identical to SEQ ID NO: 33329

SEQ ID NO: 72988 - DNA, 201 bp, Bos taurus
gaggcttttattcacagtgtaatattctacattccatcagtagtttgggaattggagggactgactgactcgtactgtgtgtgaagttggaacaaaatagrcttaactatggtctttcagttgtgtctgttttagccgcagtcatctttaggtgtcctggtaattttgtaaacccaccatgaagttttccatgtcacagtt

SEQ ID NO: 72989 - DNA, 201 bp, Bos taurus; identical to SEQ ID NO: 33330

SEQ ID NO: 72990 - DNA, 201 bp, Bos taurus
gataattataaatatctataataatgtgatgtgagcaaactctaaaagagcataaagttcccttttgaaattgctttcatgtattgtactataatatactmaagtacctaaacggtagtttgggggtaaattaaggttatatacattttctagaagtaaaacatcttttgatatcaaacctagtaaactagttaaagctga

SEQ ID NO: 72991 - DNA, 201 bp, Bos taurus
tgaaatcaagttgtcagccaggcctgtgatctcatctaaagtttcaggttctctttcaagctcactggctgttggcagaacacagttccttgaagctacargactgaggccctcagctcctacccaagtttgactgttccctgtctccacaacttggcattttacttcttcaagaccaaggggaaaaagacacttatttta

SEQ ID NO: 72992 - DNA, 201 bp, Bos taurus; identical to SEQ ID NO: 33386

SEQ ID NO: 72993 - DNA, 201 bp, Bos taurus
ttttcccattgttttccttataacaggtcaccagttaaaaaataactacttgttagttattttctgtcttctctcttacgagaatatcttggccaaaatayaaagaacttgcctctttgaaatgctacagcctttttacagatagtaggcacttaaatcctcagggccactaaagctgttggtataaagatggtgcttaat

SEQ ID NO: 72994 - DNA, 201 bp, Bos taurus
ggccccagctttccctactccaaagcactgcgcctgctctcgcagtagacaccagggatttattgtctagctggactggagtaagggacagggtctgggtrgggccacagtaaaatccagcctttttctacagaggctccaggagaccaccctgcttccaaaagttaattctggcctccaacccagctaggcttaaccctg

SEQ ID NO: 72995 - DNA, 201 bp, Bos taurus
ttcatagaaatatatctctaaatatacagtaagctgtccaagatttcagattttacttcttctctttgaatggccacatcaaattctgtctaaattgtttktttttttttttaagacaaacccctaggtttcaattttcagtgttctatattcagattaatcatgaaattgtgtgatattataagaaacaaataagataaa

SEQ ID NO: 72996 - DNA, 201 bp, Bos taurus
tgaccaaattcctggtgactagttcactagctaggtccttcaggggagtcagatcagcacaaaagaaacatgtcacttttaaatacagttgataacggtayctatccacctccttaaactcttctgttgaaattagttctaaaaagacaacatgccaatcctgaaatgctcccagttgctgcagaatatcatatgttttta

SEQ ID NO: 72997 - DNA, 201 bp, Bos taurus
taatttgttttttccctgagtacaagactgacattagcataaatctctttccttctttttctatataaatgcagagaaaaggttaacccaatgatcttagyttttttttcaatataaaatatcagtaaaaaaaaatggaggtctgtactacatctcaaaaataatagatatttgcatctatgtgaaaggaacaagaattac

SEQ ID NO: 72998 - DNA, 201 bp, Bos taurus; identical to SEQ ID NO: 33396

SEQ ID NO: 72999 - DNA, 201 bp, Bos taurus; identical to SEQ ID NO: 33398

SEQ ID NO: 73000 - DNA, 201 bp, Bos taurus; identical to SEQ ID NO: 33400

SEQ ID NO: 73001 - DNA, 201 bp, Bos taurus; identical to SEQ ID NO: 33401

SEQ ID NO: 73002 - DNA, 201 bp, Bos taurus; identical to SEQ ID NO: 33402

SEQ ID NO: 73003 - DNA, 201 bp, Bos taurus
ttaaaaactatacataaaaataagcaattcaagactgctatttcaaagggttgtattacttatcaaaaagattaaaagtattaaggttatttaaaaaggaraaacagccatagcctttgaagtgccttatctgtgacattaactgatggcagtctataatcatatatttatactatggagcttattgaactttcttcttca

SEQ ID NO: 73004 - DNA, 201 bp, Bos taurus
atttccattttaagttactgtatccagtatgagcagtatcattcaggaactgtcatgggccaggatagttactcttttcatgggctataccatctaaatcmtggatggtatcatgatgtttgtaatttactttaaagtaattgagcgcggataatgtgacactatgtgtgaatatatatgtgtgttgatttaggctatgtc

SEQ ID NO: 73005 - DNA, 201 bp, Bos taurus; identical to SEQ ID NO: 33404

SEQ ID NO: 73006 - DNA, 201 bp, Bos taurus
ttattgagatcagatgtctaaattcaaggcgctgacagtgacatttcttctggagggtttagaggaggagtcctcttacctttctggcttccagaggccgygcgttctccttcgcttgcaatcccttccttgccttgctcccaactcttgctttccttctcacatctcagactactgacacttgagcttcctgctgctctc

SEQ ID NO: 73007 - DNA, 201 bp, Bos taurus
caagattactcccgggcctgcggccaccgactcgctcgcacttcaagctcccccctccccagacaatgtaagggcctggccgtaccgagacagccttctckgagccacaacaccaccaccccgcccccttaagatgggcgtcactcgaactccagccccggagcgctggcctagatggctccgaagataagtcccggaggt

SEQ ID NO: 73008 - DNA, 201 bp, Bos taurus; identical to SEQ ID NO: 33405

SEQ ID NO: 73009 - DNA, 201 bp, Bos taurus
ctgctcttcacaagctgaaaaatctttagaaggcagtgagtccatacaggcacaggaggtgccgttgaaacggagactgcccaccggtgaaggttctgagkgcggttcacaaataccctttccaccctggcgctgatgcttatgactctgctacttccaggcccttcagtacccgtggagtgggtgctgccctaaggacta

SEQ ID NO: 73010 - DNA, 201 bp, Bos taurus; identical to SEQ ID NO: 33406

SEQ ID NO: 73011 - DNA, 201 bp, Bos taurus; identical to SEQ ID NO: 33407

SEQ ID NO: 73012 - DNA, 201 bp, Bos taurus
tgtacaaggcaggaatatttgctctgtatggtctatgcaatctcttgtgtattccttaatttttataataacatgtgttctaaagggctgattcttgctgmtgtttgacagaaaacaacaaaattctgtaaagcatgtatccttcacttaaaactaaataaattaaaagttttaaattgatttattttcggctgttcagtt

SEQ ID NO: 73013 - DNA, 201 bp, Bos taurus
ggaagacataagagaatttatagtatgctttaactggggattgggggtggggggaacacctcctcccagtctaataaaatttggtagctcggggtcacttyctaataggtgctatttcctctattttaataaaggtattttaacacctgaattctatgccagataccattgtcattttttccactgactgactcaactcaa

SEQ ID NO: 73014 - DNA, 201 bp, Bos taurus
taagggcatatcatagtttaattaacagcatttttcttttactggtacatcataaaattgatgacatcttaaatcgagtgtaatatggtagttcatttagkgagagttactggcagaataactctgcgtgtctaaaagtatcattatttcaccctcactcatgaattctgatcatggaagtttaatttgacaatcatcttc

SEQ ID NO: 73015 - DNA, 201 bp, Bos taurus
gataagaaggaaaatctttgtcacttttaattagaagtcttcttaaatattttgttcatgtacagtctgattttgcaggcttagttaataaatcctgctcrtgtgttgaatttgctaatttttttcccaaaaaagtgaataaactaatttgtaatatgataggtcaggaaactatctttagtgatatggcaaaatatgact

SEQ ID NO: 73016 - DNA, 201 bp, Bos taurus; identical to SEQ ID NO: 33408

SEQ ID NO: 73017 - DNA, 201 bp, Bos taurus
gttttaacctacaagtataagctatatggcagagtagaaaaagaatataaaaagaaatttggagtcacgagctatggctctaaaagggacagtaaagcatktaaccctgagactaatccagatacttaatttctttggcacaggtgtcaaatcgcttcagtcgtgtctgactctttgcgacattatggactgtagcccacg

SEQ ID NO: 73018 - DNA, 201 bp, Bos taurus; identical to SEQ ID NO: 33410

SEQ ID NO: 73019 - DNA, 201 bp, Bos taurus
taaaaggataaaaatgagtgaataagcaaataaataaagctactattaatatcagtttcagattctttgctgaaagctgactttgtgaggactaaggcctyattttttatagttgaataatactccactgtgtgtatatggatatggatatacatatatatttatatcacaacttctttggccatcaatgaaggacactta

SEQ ID NO: 73020 - DNA, 201 bp, Bos taurus; identical to SEQ ID NO: 33411

SEQ ID NO: 73021 - DNA, 201 bp, Bos taurus; identical to SEQ ID NO: 33412

SEQ ID NO: 73022 - DNA, 201 bp, Bos taurus; identical to SEQ ID NO: 33413

SEQ ID NO: 73023 - DNA, 201 bp, Bos taurus; identical to SEQ ID NO: 33414

SEQ ID NO: 73024 - DNA, 201 bp, Bos taurus; identical to SEQ ID NO: 33415

SEQ ID NO: 73025 - DNA, 201 bp, Bos taurus
ttcttgcctgcagaatcccagggacaggggagcctggtgggctgccgtctatggggtctcacagagtcggacacgactgaaatgacttagcagcagcagtrccgtataatgcacaaggacttttggactctttttttttggctgaaagatctcattgctgaatgtgctgatacagggaactttcccatggctacaggaaga

SEQ ID NO: 73026 - DNA, 201 bp, Bos taurus
ggcatccatattttttcacactcctacatgatttaaatgtacattatattataaatatcatattttattatatattatataatatacattatattatagcytgagaattgtgattcctttcacctttagacagagatattaaagtattttcctatctcccaaatatctctggattttttttctttttcttttttaaattat

SEQ ID NO: 73027 - DNA, 201 bp, Bos taurus
cctgtagagttctcagcaactatatctgagtgactctgaatactcttaaaggcttttcttgatttttctagagtgagattcatgccactgttttctatttmttcctgtctttcttgttgcttcacctctgggattgaatctagtatagaatttttatatagcattagtatttaaattcttgaatgttcttagttcacaaga

SEQ ID NO: 73028 - DNA, 201 bp, Bos taurus
aaaacccaatctggtaaatatcttgacagtgagactaactctgtgattgaaacttgcctctaccctagaatacaattgtttcttaagaacttatgactacygaagatttattcattttagaagattttgtcctggctctccatcatactgtgctatccctaaaattctaggttgttcctctagctgcatacagatagggct

SEQ ID NO: 73029 - DNA, 201 bp, Bos taurus
caccctggcagctctctactgccctcaactgccaccagtagacaaccatcacgtcactcagtgggacccgatttacactgggcccttgccttcttctaaaracagcttttgcacttgcttagatctaaaagtccattatacaacttcttatttagatgaagtagtgggaaaaacaaacagaattcacagatcatttgctct

SEQ ID NO: 73030 - DNA, 201 bp, Bos taurus
agggaaactcgggagaggctaattgttgaatctgattttaaatgacgatggaaagatgctacatattgccctagaagagaaaggttgggtgagtaggaatrtttataacttggcgacaggggagatacaagcacaatgttgttaagtgtagctttagaacatgttggaattggctgtggtctgggggggactatggagagc

SEQ ID NO: 73031 - DNA, 201 bp, Bos taurus; identical to SEQ ID NO: 33420

SEQ ID NO: 73032 - DNA, 201 bp, Bos taurus
gcagatgctgcatgtagaactgttcagaccttttagatctcaataccacatgcaatgttcatttattcttgttattcttgcttaaatctgtcttcctcctyctttggcacggttcactcctgagcgtgtggtttatgtgattgtgcagtggtatgtgtgtctgttttccagcagttaattctatttctggaaactcaatcc

SEQ ID NO: 73033 - DNA, 201 bp, Bos taurus; identical to SEQ ID NO: 33421

SEQ ID NO: 73034 - DNA, 201 bp, Bos taurus; identical to SEQ ID NO: 33422

SEQ ID NO: 73035 - DNA, 201 bp, Bos taurus; identical to SEQ ID NO: 33425

SEQ ID NO: 73036 - DNA, 201 bp, Bos taurus; identical to SEQ ID NO: 33427

SEQ ID NO: 73037 - DNA, 201 bp, Bos taurus
tcttagctccatgtactcagggacccagggatatctattttaaccctttgttttttagttctgtcttacactgaaaattttattataaacatctttctacmtaagtatgctgctgctactgctaagtcatgtcagtcgtgtccgactgtgcaaccccatacacggcagcccaccaggctcctctgtccctgagattctcca

SEQ ID NO: 73038 - DNA, 201 bp, Bos taurus; identical to SEQ ID NO: 33429

SEQ ID NO: 73039 - DNA, 201 bp, Bos taurus; identical to SEQ ID NO: 33430

SEQ ID NO: 73040 - DNA, 201 bp, Bos taurus
ttggccaccagctagctgaggtcacaatgaagagactgcaacaaagccttgcaggtaaaccttcaatattagggaaagcaaggacttatctcccatacccrtctctggcctctcctccaaggtttttaggtgcctgcaggcacacacaggcactcacccccagtgacctgtgcctttacctcctcacctcagggtttaaag

SEQ ID NO: 73041 - DNA, 201 bp, Bos taurus
ggtcataagttttgcagctactgtctgggactcttagagtacttacttgctctttgaatgctccctcttggaacctagcacatgctccaggtagatagccrctctggtagatagccctggctgaatccccagccaagagctagcattaactgccagccttgtgaatgaactactttgggtgtccagcttggggagttccaa

SEQ ID NO: 73042 - DNA, 201 bp, Bos taurus; identical to SEQ ID NO: 33432

SEQ ID NO: 73043 - DNA, 201 bp, Bos taurus
tgctgcatggctgctcactgaatgcctgaagggcccgattcagagcttcctcagctgaggagaggagttgttgtaacagattacaactgctaagttccacratgttcttcactgtcagcaaagggcaggagatctgagagaggaagagcaataaaggatgaatgctgtcaccttcctccttgcagaaaagagggagtcaaa

SEQ ID NO: 73044 - DNA, 201 bp, Bos taurus; identical to SEQ ID NO: 33437

SEQ ID NO: 73045 - DNA, 201 bp, Bos taurus; identical to SEQ ID NO: 33438

SEQ ID NO: 73046 - DNA, 201 bp, Bos taurus; identical to SEQ ID NO: 33439

SEQ ID NO: 73047 - DNA, 201 bp, Bos taurus; identical to SEQ ID NO: 33440

SEQ ID NO: 73048 - DNA, 201 bp, Bos taurus; identical to SEQ ID NO: 33441

SEQ ID NO: 73049 - DNA, 201 bp, Bos taurus
catgttggaacactggtaacccaggcccagtcatttcctactctcataatttgtcttcttttccctcttcttttaaaaattctatcaggtgcataacaaartagcaaactattttacagtgattgtgagttccatgaactttcaacaattttagccctgttctgtcacttgtacttttcttcatgggaagttgaacatgta

SEQ ID NO: 73050 - DNA, 201 bp, Bos taurus
gctcccctcctgaagttacttgctaattacaacttgcgtcacctccaaactcaaagtctgagcaagaggcccctgtcatgggcctgaattccagcttgcarggaagtctgcatagttggctatgttttacgtttttttttttttttttttttaacttttttaactttaacttggcatgagaagaggctcctactcttacca

SEQ ID NO: 73051 - DNA, 201 bp, Bos taurus; identical to SEQ ID NO: 33445

SEQ ID NO: 73052 - DNA, 201 bp, Bos taurus
atggggtgtatgcgtgttttcagccaaaaagcctacccaagcactcatcagatacaggaagcaagcatgctcctaaggaaaaagccgtttccaaatcaagygagcagccaccatcagagaaatcaacaaaaccaaaggtaaataaagcagacagatgaaagaaagaaagaaagaaagtgaagtctctcaatcgtatccaac

SEQ ID NO: 73053 - DNA, 201 bp, Bos taurus
cagagaaggcattctctttgtgggtttggtttctgaatcctcagcttgtgaaagaggctgtacagggagaaattaatacatgtaaactgttctaagagttygaactctagggagaaagatggcccacagataggagggctaaatcagcaaggagacttttgacatacaaattgaatgcctccctgatggggaggggtagtg

SEQ ID NO: 73054 - DNA, 201 bp, Bos taurus; identical to SEQ ID NO: 33448

SEQ ID NO: 73055 - DNA, 201 bp, Bos taurus; identical to SEQ ID NO: 33449

SEQ ID NO: 73056 - DNA, 201 bp, Bos taurus; identical to SEQ ID NO: 33450

SEQ ID NO: 73057 - DNA, 201 bp, Bos taurus
ggcctcacacagtactttccaactatcttccaactgttggtgactgtgtttctgtgcctgagagtttttctgcgctaagggaaaaactgttctatgtctamagctggccagaagttcaggggaattaatacctctggatgcagccattatgtactactaatggagttagtgtacttcagctgcctcactctaatgctctaa

SEQ ID NO: 73058 - DNA, 201 bp, Bos taurus
ctttgtttaatgaatgctgtattgttaaagacccaatttcagaagatgaattcaaagactaagtgattttctcccctcatacgtatacaaggtaaagaatktaatctacagttaatcaatgaaaagtatcgtgagagatggaagagtggagacaagaaatgtacagtaagtcaattagaaagtttaaaactgaaaggactc

SEQ ID NO: 73059 - DNA, 201 bp, Bos taurus; identical to SEQ ID NO: 33451

SEQ ID NO: 73060 - DNA, 201 bp, Bos taurus; identical to SEQ ID NO: 33452

SEQ ID NO: 73061 - DNA, 201 bp, Bos taurus
cattttgattggtggccaaacctttgtggttctaatctaagggataaagaggtgagcaaaggctaaaaggaatttaggaggcattaatgtactttgggtarggaaagtgaacgcaatgtagaatggggagagaaatgagccactaagtttagagtattagttattcagtctgtgtaaataaaaagcagactctaaggcagt

SEQ ID NO: 73062 - DNA, 201 bp, Bos taurus
tcctagtttttgactgagggccagaaagctaagtggagtccaccataaaacagggagttcctgagcagtccagctgttaggcctcagagctttcactgccrtggcataggttcaatccctggtcggggaactaagataccacaagccttcttgtgtggccaaaacacaaacaaaacataacgtaccaacagtacaggggat

SEQ ID NO: 73063 - DNA, 201 bp, Bos taurus
gtatttctggtctttacccacaaatctatctgtggagcaaatcatcattataggtaaccttaagataaaaagtgtctaaatttcattctaaataacaaatycacatagctgagaactcatgctttgaaatctttcaatagttatcttcagaaagcttaacttcagttatacaacaaactttgccctaacttgaaactgagg

SEQ ID NO: 73064 - DNA, 201 bp, Bos taurus; identical to SEQ ID NO: 33454

SEQ ID NO: 73065 - DNA, 201 bp, Bos taurus; identical to SEQ ID NO: 33456

SEQ ID NO: 73066 - DNA, 201 bp, Bos taurus; identical to SEQ ID NO: 33457

SEQ ID NO: 73067 - DNA, 201 bp, Bos taurus; identical to SEQ ID NO: 33458

SEQ ID NO: 73068 - DNA, 201 bp, Bos taurus
tctcttctttcacgctcatcaagagttcttacttcctcttcactttctgccactagggtggtatcatctgcatatctgaggttgttaaggttatttctgcyagcggtattgattccagcttgtgattcatccagcctggcatttcacatgatgtactctgcatagaatttaaataagcagggtgacaatatacagctttgg

SEQ ID NO: 73069 - DNA, 201 bp, Bos taurus; identical to SEQ ID NO: 33459

SEQ ID NO: 73070 - DNA, 201 bp, Bos taurus; identical to SEQ ID NO: 33460

SEQ ID NO: 73071 - DNA, 201 bp, Bos taurus; identical to SEQ ID NO: 33461

SEQ ID NO: 73072 - DNA, 201 bp, Bos taurus; identical to SEQ ID NO: 33463

SEQ ID NO: 73073 - DNA, 201 bp, Bos taurus
ctgctttggattttactctattatctgtaaaaattgagatgtataaattattaaagatattaagcattatccattcttcttttattcatttctctgatttmtatgaagttaaacttgctggaagctgatttggtcatactaaaacaatatgtaatcttttcaagttttcttagaaggatttcttaccttgtgggttctcaa

SEQ ID NO: 73074 - DNA, 201 bp, Bos taurus
atatgctttctactacatcagaaagtgtcactgtcatgtagcaccatgatcaaacaccttggttttcgagacacctctaaacacatctgtactacagctamactcatggactgcaaggaatggacatatactggcctgtgggaaaagggtaaattttccataatttttaaggtaaagcagctgattcaattaaataccact

SEQ ID NO: 73075 - DNA, 201 bp, Bos taurus; identical to SEQ ID NO: 33464

SEQ ID NO: 73076 - DNA, 201 bp, Bos taurus; identical to SEQ ID NO: 33465

SEQ ID NO: 73077 - DNA, 201 bp, Bos taurus
tctttaccatcagtgccccctggggagccctgaaacattagtgagtgacctgcaacaaacacgtaagttcaagagatctaattcaacctagtgactatagkcacaatactgcattacccacttcaaagttgcgaaaatacaagatcttaattattctcaccacaaaaaagaagagataattatgtgctctggttgaggtgt

SEQ ID NO: 73078 - DNA, 201 bp, Bos taurus
ctgaatgttgctgctttactcctttatcaaagatcagttgaatacactgggtgggtccttcatctgctccattgagctgtttgtctgttcttttaccagtrtcacatcgtcttgattactaaagcttcgtagtgagccttgaagtctggtagcttcacttctccaactttgttcttcttcgatattgtgttggctattctg

SEQ ID NO: 73079 - DNA, 201 bp, Bos taurus; identical to SEQ ID NO: 33466

SEQ ID NO: 73080 - DNA, 201 bp, Bos taurus; identical to SEQ ID NO: 33467

SEQ ID NO: 73081 - DNA, 201 bp, Bos taurus
tggatccacatttagaagggcctgctttacaaagtacgggctgataatgttttccaatcaacaaagcccttgaaactgttcagcttgttagacatctgctrttgaagagtgtatccagctctgaaaacaagatgcaaggaaatgcagtcctcattttctccagcagttagttgctcaaaggactatagccatttcaagagg

SEQ ID NO: 73082 - DNA, 201 bp, Bos taurus
tgaaaccatatccacaatggccatctggctctattctggatatccgaaccaccgttactccattttgttcttttctttaatagttaaaacagatatacaaygtatttttgacaggccataaaacaggctattctggttaacataaattcaagtaaaattaggtagaatctagaataacttcctcatgcctcagtatatgaa

SEQ ID NO: 73083 - DNA, 201 bp, Bos taurus
cccttgcgatagacagagagaaacgtgctcaagtctcagacgacggaggcagaagtgacgatgaccagacccagatctcttgaagatatgcttcggactcrgagtcaacgggcctgtggaaggctggcacgtggagaaagaggcaaagaagagtcactaaggaggaggctgggaacttccacctgagcaactgggtagacg

SEQ ID NO: 73084 - DNA, 201 bp, Bos taurus; identical to SEQ ID NO: 33470

SEQ ID NO: 73085 - DNA, 201 bp, Bos taurus
ttactattaaagacaattgagattaaagggaagaaggaaaggagacagctgggtataattgtctatattgatcaaggtggtttgttcctgattctcacttmcacctattatgcagagcactggttcaggaaaacactcctctccagagtttgcatattcttttccagtcaaaactagaacattattcgttactcactaaac

SEQ ID NO: 73086 - DNA, 201 bp, Bos taurus
aactgtctacctacaaggaggccaggaatactggttgcacttccttctctgatctgcagtaggagagcatttggacacacacatctttagctcatttctcrtgccttacaggcctctctataatgcatctttcctacatcaaagtggaattttccaccctttcctgcctggtttcctgatttaacaaagtttgtaaaaata

SEQ ID NO: 73087 - DNA, 201 bp, Bos taurus
tttgcttcttggccaagaaaggcaatatttcccggctctaaccatgaaaacactgcttatacttttaatcagatgcatctactacgagggagagccccacragttttggcaagctgaataaaggccccatgtgtttggagcccacggtactgcacacacttgaaacaccatctgtaggcagcttcttctgctccagcttgt

SEQ ID NO: 73088 - DNA, 201 bp, Bos taurus; identical to SEQ ID NO: 33473

SEQ ID NO: 73089 - DNA, 201 bp, Bos taurus; identical to SEQ ID NO: 33474

SEQ ID NO: 73090 - DNA, 201 bp, Bos taurus
ctgcaactatggagtgtgtaccagtgttttggaataatcctgctgagaatgcaggaaaaatacaagcaatggacagagtgttaagttttctgttgtgggtkggggaggcaagcctactccattcctgctgacaggactctggctcagaaataattattgacaacatcccttttgtatcaaatacaatgaataatttttttt

SEQ ID NO: 73091 - DNA, 201 bp, Bos taurus
catcagcaaatgttcatgatggaacagtgtgaagtcaggaggctttgcccacgttggaggaggaggacatggcctggcgttttccatcgctgggcctctcrggggttccagtgctccagagggtcctccaggagggggagacctggtctaccttccctggagacaaggacactgggccgggccctccctagggcagtggct

SEQ ID NO: 73092 - DNA, 201 bp, Bos taurus
ctttctcattgtgacgtctcctctcattgcagactgcaggccctaggacacctgggctcaggagtcgtggttcatgggctgaagtagttgtagcccacagrcttagttgccccttgacatgtttaatcttccagacgggggattgaacctgtgtctcctatatttacaggcagactattaaccagtggaccatcagggaag

SEQ ID NO: 73093 - DNA, 201 bp, Bos taurus; identical to SEQ ID NO: 33478

SEQ ID NO: 73094 - DNA, 201 bp, Bos taurus; identical to SEQ ID NO: 33479

SEQ ID NO: 73095 - DNA, 201 bp, Bos taurus
ggtagatggtcagcaagctttgatttttctttctcttgggatactgaaaggatttaaaattctaatatactaatccaatttcaaaattagacctggaaatrtaagcttgtggaaaggcactttaaaatctgtcttggaacacataaaggtctgttcaaaggttgatgtattcaaaatgttctgagggtttttattcatcct

SEQ ID NO: 73096 - DNA, 201 bp, Bos taurus
gttataaaccctgctaagctagcctaaattattttacaacattagttgctaaggaataaaatgtgtgaagctcacatttgtgtatctattaatgactattyttctggacaagtgcccaattttgtctaaaacaaaaaaagtaatctaggttcttttaagacaatttacattttctaattttttaagaacttcaaccaagac

SEQ ID NO: 73097 - DNA, 201 bp, Bos taurus
ttccagtcagatttggaaatacagtcaacttctgaatcacaattaatatcttagtaaaacagataaaacttccatgacatatacagtaattctttgataarcggagcacaatcttactagctaatttgcaccttcccaccctgatgtcctctgcctctcctcggccacatcatccatttacacctcacatgcacaccttgt

SEQ ID NO: 73098 - DNA, 201 bp, Bos taurus
gcggctgggtcggcctcctgtgaacccggaggggtccaggagcaacgaggcatcacgtccacgacctcagccatgaagcagggcaacggagaggtgagatragaagaaaccaagcgtgggccagagacaaggccgggatccgcggccatgacggaggagggcggagagggacgccccctccccaacctacgaagacccctt

SEQ ID NO: 73099 - DNA, 201 bp, Bos taurus
tactgactgaaaatctgactacaatacagaacccctttctcgattatttcctaatttctttcaggtccgggctcagtcatttcagacgagtaggttgtttygtgcacttgtttgttagattttacaacactggatgcacaaaagtaggtcgagggagaattccagaaaattatctcactagactcagatttatggaatctt

SEQ ID NO: 73100 - DNA, 201 bp, Bos taurus
aatggaaaaggcaatggcctagaaaaagaacaagctttcagaaacactcaacaccttggaaactccattccttagctacagttcagtacagcaacacgggsttttatgtgggccaagaccagtcatcaagggaggacagtctctcctctgtctagttcccacatataatccaaactgactataaccttagactatatgcta

SEQ ID NO: 73101 - DNA, 201 bp, Bos taurus
atttcccaaaaactttctaaaatctattcataatatattactagtttcttgggtaactccgaaatctatactagttcataactctacaaagtacaagatgytaaaaataggccaaataaatataacacatatatatcaaatatgctgaccctaagccttaggatagaaaccattttcaaaatcataaaactttaagacatc

SEQ ID NO: 73102 - DNA, 201 bp, Bos taurus
ttgtggcccaatgtgtaacaagccaaaatgctgagatgctaggattttcagcagagggttaattcacaaggcagacaggcaaggaaacagaaaatcaagtrttagaaccaccaccccgaaggccagagtcttgggtatttatgggataaagaataaagcagcatgcggtctgaggcctgaggagtgtggggagcgcgggga

SEQ ID NO: 73103 - DNA, 201 bp, Bos taurus
acccttgagatacatcctccaaaactggtcaagattcaagcccaccgagccaccaaggaggagactcacttcttttgtaatacagtctggccccaatagcrccttttggatggggagttcagttcagttcagtcgcttagtcatgtccgactctctgcgaccccgtggatggagaatcctggcccctaaatgggactgtta

SEQ ID NO: 73104 - DNA, 201 bp, Bos taurus
ctggttgggaagatggtgatggccatttggaccagtgtgatgtgatatctcattgtagttttggtctgcatttctgtaagaattagtgatgggcatctttkcatattgttggccatgtgtcttctttggagacatgtctatctagatctttcacccattttgtgattggttttttttttatattgagtttcataagctggt

SEQ ID NO: 73105 - DNA, 201 bp, Bos taurus
taatataagatatctaataaaagatcaatcttaccatgtctgtggtcctctagagcagttcttaaatctgattttgtgagcaagatatagtaaatgtttcsgtgggtagagtggaggagtaagggcttgttttgtcttctgtcatgagtgaattgctccttcttcagtccatttccgttgggttggccaaaaagttttttc

SEQ ID NO: 73106 - DNA, 201 bp, Bos taurus
attttgcccacagacccaggccaccatgggatctaattaacaagcgtggtcttgaccaacatgtgagaattagggtgcacgtgcgtgctaacattgccagrgaggcctttggaaggagagagaagccacaccaagtggcaaaagcggtggtttggtggcgcacgggcggggagctgcgtccggcctaggagaactagacca

SEQ ID NO: 73107 - DNA, 201 bp, Bos taurus
aaaactctgggtctaaacaaacacacaaccaacatgtgtcgcaagtttagatgatggaactttaagatactgagctctgcttcaggtggcacaggccgaartaaaaccacagaagatgattctcaaacagcgaccgaaagtccagggtttaattgcacgggtgggaattgggtcaacatgactgctggacgcctggtgaga

SEQ ID NO: 73108 - DNA, 201 bp, Bos taurus
agttcctcggagctgtggtcttgtccagctttctatttgtcactgggacctccacctgacagctgtcacattcagcttcttaagccactccgtcagggtcrtctgtgatgggtggttaatgtcatatgacaaagcagagtccatgagagggcggtctggagcccagtccctttaccagccctgaagtcagcctgccaagca

SEQ ID NO: 73109 - DNA, 201 bp, Bos taurus
caatttcataatgatgataaaccactgtcaatttacaacatcaacatacatcaagtgaactgattaaatctacacgctcattttatataatagaaatacartcactgcaataaaacactgtcatgggattaatgtcttctactctgaaaatgtaagtcttgcctttggcttggtattttatgaagcagcaggagaccatta

SEQ ID NO: 73110 - DNA, 201 bp, Bos taurus
atagaagtttattttctcatggtgttgaaggctgagatgtctgagatcaaggtgccatctgactgtgtatacggtgagggccttcttcctggctttgggayggcttgctttctcactgtgtccgacccagcggagagtgagctctctggtgtctttcttataaggacactggttctgtcacatcagggccgcagcagcatg

SEQ ID NO: 73111 - DNA, 201 bp, Bos taurus
gtcgtattacgtataacccagtacctaattgtcagatctcccatcaactctttatgtatcagaggcttgattaaaaactgtgtttaatttttttcccaccrctctcaagatataatgtatatacagctcttttaagtttaaagtgtataacacaatatattacatatatcatgaaataattaccagaatatgtttagttag

SEQ ID NO: 73112 - DNA, 201 bp, Bos taurus
tgagttgtgttgtaatccagacatgagccaaaccttcctgctgccaagaggatcacactttaggggcttctggtgccaggcctgtagaggccaacaacccyggaggcatctgacaacccccttgcgttttctttcatgatcacctttgcttctgttctgcacacatgcatgctgctgctttctggcctcgtgggtgtaaaa

SEQ ID NO: 73113 - DNA, 201 bp, Bos taurus
gtatcatctgatgttttcactcaatttgtgacatttctaatctcagacaagtattttcattcaagactaatgctttacctgctccttgtaaagacactgcmctattgctgcatatttactaatgattgttcacaattattatttttctaaaatttcacataagaatcattattacattcattaatgcaaaaattcttaatt

SEQ ID NO: 73114 - DNA, 201 bp, Bos taurus; identical to SEQ ID NO: 33511

SEQ ID NO: 73115 - DNA, 201 bp, Bos taurus
aagggagcctgacctgctgcagtccatgggatcacgaacagctggacatgacttagcaactgaacaactgaggtgatatttttctgagtcgtctacccaaygccccatgtactgtcaggtttttccactccagaaggtggggacgcaaacgcttcctggccatctctttgctccagagattgttctacctgttccattcca

SEQ ID NO: 73116 - DNA, 201 bp, Bos taurus
tctccatgtctcacttattacagaaccccctccaggctctcagcccctctacgtggggcgtcctcagtgtctggccacacgggggcctgggtggaccagayggcacctgggcacactcatacgcactttctgtcacagagaaggaagcgtccagggccagttcgtccacaggaagcacaagctggcctcctgtctcccatt

SEQ ID NO: 73117 - DNA, 201 bp, Bos taurus; identical to SEQ ID NO: 33514

SEQ ID NO: 73118 - DNA, 201 bp, Bos taurus; identical to SEQ ID NO: 33515

SEQ ID NO: 73119 - DNA, 201 bp, Bos taurus; identical to SEQ ID NO: 33516

SEQ ID NO: 73120 - DNA, 201 bp, Bos taurus
acggcgaaggccaccaggcacaccaccatgtagtacacacccatgtcacccgacgtgaagaccacccgcagcgtcaccgtgttgttcacagaaccgtgcasgttggaggccatgcacgtgtatctccctcggtctgagaaggacaccttggtgatgttcaggaggccgtcatgcatctgccactttcctgtgggagaagga

SEQ ID NO: 73121 - DNA, 201 bp, Bos taurus
aaccttttaaaactagctttgttgagatgtaattcatacaacacaaacttccccatttaaagtgtatgatccaagggacttccctggccatccagtggttmaagtgtcccaaataaagtgcagaacccaagggcaggaatcacttactgaagacctgccccccagccaggcgctgaggatgagccctgaggatgcggccac

SEQ ID NO: 73122 - DNA, 201 bp, Bos taurus
gtcatatttcttgctctcatcagagcctcctgcctaagagtgtgactctagaactcgcctgtctctcgacctgcaggccagtccaggatctaaggccgtartggtaatgggatgacttagcttcttggaagccccgtctctgaagcacagtcctcgtctgactggaaaaaccacagaaagtcccaggagacctgtgccacc

SEQ ID NO: 73123 - DNA, 201 bp, Bos taurus; identical to SEQ ID NO: 33546

SEQ ID NO: 73124 - DNA, 201 bp, Bos taurus
cagtgcagggggcctgggtgcgatccctagctggggaactaagatcccgcatgccttgcaacaaaaagatttttttaaataccaggtactctcatgtgttragtggccttcctgtgccagatactgagccagacaccccacaaacactgtcgtgtttgagacagaccacagagcgccaaagacaaggttgcagaggtctga

SEQ ID NO: 73125 - DNA, 201 bp, Bos taurus
tgtacaccagaaactaacacaatattgtaaatcaactatccttcaattaaaaggaaagggcctgcctcaaagtcaacctggactggagttgatcaaagagmgtctgagaaccacctgcatcagaacgctctctcagcgggtaaattatgcagatccacagagggggccaggacaagacctagatcctctgattccaagagc

SEQ ID NO: 73126 - DNA, 201 bp, Bos taurus
agactgggaggagcagtccttggaggtggtggggacactggaagacatggggacactgaaggacagagtgacagactgcagtgatcctgggggcatagcartgctggggatatggtgattatgggggacatggtgatgctggggcgcatggccacactagggacatggtggcacagggggacacgatgacactgggaacac

SEQ ID NO: 73127 - DNA, 201 bp, Bos taurus
cagggcctgggtgtaggggtgaggggacaggagagaagactggttcccacggtgcctccaaaacaaaagtgcaagtaattttttttctgtaggaaaagatsaaagtacacacatggcccctacctactcacaggaatacagtacaggtggagagcacattctcccagcatgcccacgaggacactaaaaggtcctcttctc

SEQ ID NO: 73128 - DNA, 201 bp, Bos taurus
atgagatttgaggtcctatgggagggagacagacagtggagtggccctctaaagagggtaggagctgggggtaggagagagtcactttcacaggccacatyggcattccagacagccccaaatttgtcattcagtgcccatgtgatactgtccaccatgcattcacacaccacaaacacacagccacatagggggcaccca

SEQ ID NO: 73129 - DNA, 201 bp, Bos taurus; identical to SEQ ID NO: 33553

SEQ ID NO: 73130 - DNA, 201 bp, Bos taurus; identical to SEQ ID NO: 33554

SEQ ID NO: 73131 - DNA, 201 bp, Bos taurus
tgtgaaaaacagaatctcaaatgttcttgatttttatgaagatttaaatgaaactacaaaaaacataaaacaaaagcttgttgatatattattcaactgcmacctagaccttgcttatgtatctgcctattgggagcagtccaaatgtaaattttgacaggttcagtcaatacatttgttttaaaccacagacaatgaaaa

SEQ ID NO: 73132 - DNA, 201 bp, Bos taurus; identical to SEQ ID NO: 33557

SEQ ID NO: 73133 - DNA, 201 bp, Bos taurus; identical to SEQ ID NO: 33558

SEQ ID NO: 73134 - DNA, 201 bp, Bos taurus
ctggactacgagggacaggccctccccacttttctttgtctttctcctttgtcttctctctcacagtttctgctgtgtgaaaaatggttgcatccagagcrgatatattttctttccctgcacggcctccataaatcttgtgtctgtgcatgactccttctcagtgctgggtttttgattccacgcccccaggtagaatac

SEQ ID NO: 73135 - DNA, 201 bp, Bos taurus
aaccctggcccccctgcattgggagccgagtcccaggccctggaccatcatttcagctctcttttgctgcttctctttcctcttgatattcccagaagccygcccctcctctccaatgccgcatcgttggcctctgcacctctgcccaacccagctcccctgcagagacctccgtcaggtcttcccctgtcccctagccta

SEQ ID NO: 73136 - DNA, 201 bp, Bos taurus; identical to SEQ ID NO: 33560

SEQ ID NO: 73137 - DNA, 201 bp, Bos taurus; identical to SEQ ID NO: 33562

SEQ ID NO: 73138 - DNA, 201 bp, Bos taurus; identical to SEQ ID NO: 33565

SEQ ID NO: 73139 - DNA, 201 bp, Bos taurus; identical to SEQ ID NO: 33566

SEQ ID NO: 73140 - DNA, 201 bp, Bos taurus; identical to SEQ ID NO: 33567

SEQ ID NO: 73141 - DNA, 201 bp, Bos taurus
tctccaacaatactcaactgcttgaaacacctgaatttcaaatccctgcaaggcagcagctgggcctggtttactcactctgagaggccctggttcccatmatagcatctccagttcagggaggcatcagtctcagtgatcaaagtgggggctcccatggtggtccacctggcaatgtgggggacataggttccatccctg

SEQ ID NO: 73142 - DNA, 201 bp, Bos taurus
atcccagagccagtggccatatcccccagcacacggactggcccagagtgaggccatcacaaatggaaatgaattggagggacctgagtctgagtcgctasatccaatcacccctgtggcaatggccacctcggttcttgagccaattttttttgtttgaattatgcttctaacactgtaaccaagagtcctgtctaatat

SEQ ID NO: 73143 - DNA, 201 bp, Bos taurus; identical to SEQ ID NO: 33569

SEQ ID NO: 73144 - DNA, 201 bp, Bos taurus
cgtcttttttttggtccttgaactaggacattagaaggacagtatctaacagttcctttgcccattcaattaaagacagaggaattagacaaaggaattaragaccaaaacaccaacccattactaataggtgtttggaaaatacgacttagttgtatgagaaccgtgatctttttaatgccgcatcccagaagtagatag

SEQ ID NO: 73145 - DNA, 201 bp, Bos taurus; identical to SEQ ID NO: 33571

SEQ ID NO: 73146 - DNA, 201 bp, Bos taurus
agttttcttctttttgattggcaaattggtaggcgacatgagtatgtctcaagacactagtttgaattggggcaaatatacattctaatgattttgttacygtgttacaaactgtgctacactctcatgaaaaagttctgaggtgttaaagggcgtccctggtgactagtggtaaagaatccacctgccaatgcaggagac

SEQ ID NO: 73147 - DNA, 201 bp, Bos taurus; identical to SEQ ID NO: 33576

SEQ ID NO: 73148 - DNA, 201 bp, Bos taurus
ttgctgtggctgagtttaagattttgtgtgtgtgtgtttggttttcagtactttagctatcattattcattatgtgtttaatttttatcttaattcttctytggggctctctgaatttactagatctataattcgttttcttccagttatattcaaaattcccagtcatctcctcaaatttttttctgcttcatttggtat

SEQ ID NO: 73149 - DNA, 201 bp, Bos taurus; identical to SEQ ID NO: 33579

SEQ ID NO: 73150 - DNA, 201 bp, Bos taurus; identical to SEQ ID NO: 33580

SEQ ID NO: 73151 - DNA, 201 bp, Bos taurus; identical to SEQ ID NO: 33585

SEQ ID NO: 73152 - DNA, 201 bp, Bos taurus; identical to SEQ ID NO: 33587

SEQ ID NO: 73153 - DNA, 201 bp, Bos taurus; identical to SEQ ID NO: 33589

SEQ ID NO: 73154 - DNA, 201 bp, Bos taurus
gataaatgcagagatgtaatttagaaacttatcagaagtcagctaaagatgaatctgcctttgaaagtaatggcagacaggcccattataaattttagaawagaaaaatgaaatgatgcaaaaagacttagtttttggaaaattaagttttactaaaacatatcatttaatatggtctaactggccttagaaattcaattt

SEQ ID NO: 73155 - DNA, 201 bp, Bos taurus; identical to SEQ ID NO: 33590

SEQ ID NO: 73156 - DNA, 201 bp, Bos taurus; identical to SEQ ID NO: 33591

SEQ ID NO: 73157 - DNA, 201 bp, Bos taurus; identical to SEQ ID NO: 33592

SEQ ID NO: 73158 - DNA, 201 bp, Bos taurus; identical to SEQ ID NO: 33593

SEQ ID NO: 73159 - DNA, 201 bp, Bos taurus; identical to SEQ ID NO: 33594

SEQ ID NO: 73160 - DNA, 201 bp, Bos taurus; identical to SEQ ID NO: 33595

SEQ ID NO: 73161 - DNA, 201 bp, Bos taurus; identical to SEQ ID NO: 33598

SEQ ID NO: 73162 - DNA, 201 bp, Bos taurus; identical to SEQ ID NO: 33599

SEQ ID NO: 73163 - DNA, 201 bp, Bos taurus
tttattaaaatgaaaattcagtttgtttcatgtttatttaccctatcaacataatactttgtgtccactgaaagaatgagattgctaagaaactataaacrtcctcaattacaggccaactgaggaagaaaagtctctgtatgttttcatcagacacacgatagaggtctaattatgtgatgacaagctgtgtcctgtgct

SEQ ID NO: 73164 - DNA, 201 bp, Bos taurus; identical to SEQ ID NO: 33600

SEQ ID NO: 73165 - DNA, 201 bp, Bos taurus; identical to SEQ ID NO: 33602

SEQ ID NO: 73166 - DNA, 201 bp, Bos taurus; identical to SEQ ID NO: 33603

SEQ ID NO: 73167 - DNA, 201 bp, Bos taurus; identical to SEQ ID NO: 33604

SEQ ID NO: 73168 - DNA, 201 bp, Bos taurus; identical to SEQ ID NO: 33608

SEQ ID NO: 73169 - DNA, 201 bp, Bos taurus; identical to SEQ ID NO: 33610

SEQ ID NO: 73170 - DNA, 201 bp, Bos taurus; identical to SEQ ID NO: 33611

SEQ ID NO: 73171 - DNA, 201 bp, Bos taurus; identical to SEQ ID NO: 33612

SEQ ID NO: 73172 - DNA, 201 bp, Bos taurus; identical to SEQ ID NO: 33613

SEQ ID NO: 73173 - DNA, 201 bp, Bos taurus
acgacttacaactcttactgtgcagttgaggaattgccatagataactaaaaccaccactgactgctcatatattgaaataattaatgccttaatctgtamacctggctcataattctttaagtttatttttactgtataattactttgctttttacatgttgcaataaaattgtggcaatgctgcggatgccattcttct

SEQ ID NO: 73174 - DNA, 201 bp, Bos taurus; identical to SEQ ID NO: 33617

SEQ ID NO: 73175 - DNA, 201 bp, Bos taurus; identical to SEQ ID NO: 33618

SEQ ID NO: 73176 - DNA, 201 bp, Bos taurus
aaacactataaaaggctatctggagggaaagggtgaattgggtggtgtttaatgtgtacagattttcaattttgcaagatgaaaagagctctggatactgrctgtgcagcagtataaattatctaacactgctaaactgtacacttaagtttgattaagatggtaaattttatatatgcattttaccattttttaagtgaa

SEQ ID NO: 73177 - DNA, 201 bp, Bos taurus
ctttgcggaaatgagccggagcctccaaattcatggtcgttggtcctgtaaaggcagatttcaggagcagggccgaagacagagagaaaatgtatagctayattttgaattgcagaatgctagtttctttttccctaacctatcagaatcctggcagccagttgttaattccctctccctaatacctgatcaggttcacca

SEQ ID NO: 73178 - DNA, 201 bp, Bos taurus; identical to SEQ ID NO: 33619

SEQ ID NO: 73179 - DNA, 201 bp, Bos taurus; identical to SEQ ID NO: 33620

SEQ ID NO: 73180 - DNA, 201 bp, Bos taurus
gaaagtagcatcagtcaatcccaaagtgatatcccagagcatcacacaattagaaccttgagttccagggttgcccttgggggccatactgccagtcagtyggtactggggctgcacagaagagacacagtttcccaggtagcagttcccatctggcccagggcagttctccaaataagtgggcagctgtgaattcttgcc

SEQ ID NO: 73181 - DNA, 201 bp, Bos taurus
ttagagcaacaataaacaaatggggcctattcaaactttgcacaggaaaggaaatcaccagtaaaacaaacaaaaaacaacctatggaacaaggtgggcasgggggaggcccacaggaaatatttgtgaatgatgcagcaaacaagaagttgatattcaaaatatacaaatagctcataaaattcaataccaaaaaaacaa

SEQ ID NO: 73182 - DNA, 201 bp, Bos taurus; identical to SEQ ID NO: 33627

SEQ ID NO: 73183 - DNA, 201 bp, Bos taurus; identical to SEQ ID NO: 33628

SEQ ID NO: 73184 - DNA, 201 bp, Bos taurus
aaataaaagcccagcaagaggtaagtggaagggggcctgcagatacatacatgtagagcaggcagttgcctgagtcttccacctcggtggaataattcagrgagaatctgggaaggccatggttgagtgaggacacgaaactcagcttaggttccaaaggtcgcatttggaaagggggttggagtggagtcggaggccagg

SEQ ID NO: 73185 - DNA, 201 bp, Bos taurus; identical to SEQ ID NO: 33631

SEQ ID NO: 73186 - DNA, 201 bp, Bos taurus
ttaaaaatcttagtttgtatgaaggcaatttaataaatgccatggaaaaggaaacccatggaatttggggtttcctttggtgtcccatgaaaagggacacmtagactctatttctagcattagagatggagggatttgagaagacctcccagctgacatgtcatttaatgtgcacaattatggacagattgtttacacatc

SEQ ID NO: 73187 - DNA, 201 bp, Bos taurus
cagagattactctgggaaaaaattggtcaagaacaaataggctgaaatttggatatgctactgcttccaaggacaaagaagtaaccatctgtaacacacarctttatttagcaatgaagaacttgctcctaagaggaaaacacctcttgagctaaagcaaatagacccctccactagaagaggggatttggcctctcactt

SEQ ID NO: 73188 - DNA, 201 bp, Bos taurus; identical to SEQ ID NO: 33632

SEQ ID NO: 73189 - DNA, 201 bp, Bos taurus
gctgcgattcatggggtcgcaaagagtcggacacgactgagcgactgatctgatctgaacattaaattatatgcataatgataagctggaattctagtaargaaaataccaggccttgtagcctcttactctatctgctttttaatctgatattatctgaatccttcagctatacagccactcactcaaaagcactctcat

SEQ ID NO: 73190 - DNA, 201 bp, Bos taurus
ctactcctgtactagaattcaccagacaacctctgtgaaagtcaatgtgtttttattgataagccaaaatacagcattcatatatcaaatattgcgagtcraggagcaaacatctgaaatgctttcctaggaaataagagaagcttgacatagaaataaagtttattttcttttttccatagaatgagctacaacagatca

SEQ ID NO: 73191 - DNA, 201 bp, Bos taurus
gtgtttcagacaattcgggtattttattttgtttcagttgtataaaatcttcatggaagagagaaggaatttctcacctgtctagaatcctacattcacawagggccaggacccaattacgaacacactttggggacatataacaatggattggtcactatcacataagcacagatgtgctgctttatctgaaacgttgcc

SEQ ID NO: 73192 - DNA, 201 bp, Bos taurus
tgttaaagtttctaacaggccaccaggtttggaggttacaatcctagcaacaatcttctggttgttcagctatcaggattctgtttcccagggatccccartgctcatcacggacttgttctgggtacagatttctggaatgcttgtctaccccagcctctgggggctgcagctaaaaagctatgggtttaacaagttctc

SEQ ID NO: 73193 - DNA, 201 bp, Bos taurus
agtctgaaagagaaagccagaaataactgaaaggagtctacatttccaaactcaacagtctgccatcaagaatctaaagactttttttttttttttttttwatgatgcccaggggccctggaaatggcagtcagaacataattcggaactaagtaaagctctcaccagcaaatgttacaaaggagagagaactaaagatta

SEQ ID NO: 73194 - DNA, 201 bp, Bos taurus
aggtttgaaaaaatttcaaaattacattttaattatgtgtacatagttaccagtcatttataagtgtgttatttggtggtccttgcttttggatatgggayaaggcagtgaacttctcattctttacccttttctttggacagaaggtagtaatcatgtactcaagctcttgcaaaagtcccacgtttgactttatactca

SEQ ID NO: 73195 - DNA, 201 bp, Bos taurus
ccaaaagtggaactgagaaggtcaatgttggaaggagaaatctgtgtccatgccctttttaagaaaggaagaaattaggggccaaaaagcactagttcttrgttgcagatccgttgagactgaagatcttttccttgacttatcaatcaagatggcggacaagaattcagaggtacgttaaagtcaggtgatgaccttgct

SEQ ID NO: 73196 - DNA, 201 bp, Bos taurus
cttttctaggtatacatgtatgagaagatacaaggatctgggttcattaaaattatttcttaggaatgcatcttaactatctagggccaggatccaaagcrcagaatacttcctgtttttctgtatcttgaattccccacgggacacactgtccttggtggttggctacagtggccaatggcttgatccttgtagaactcg

SEQ ID NO: 73197 - DNA, 201 bp, Bos taurus
tgattagagaaaggattggcctcttgtcaaattatccttgtaggtgaagttggtgaaagatggattagatgatagtataatgaggtggattcctagctcaytgaacaagcaggcccattagagtgttgactgatggctttttgcctgcttggaacagtatcactagcaccatgccacaggactctgtcatcagctctgtcc

SEQ ID NO: 73198 - DNA, 201 bp, Bos taurus
tacagcagctgaatcatgacactgtctttgtgtcaacatcctggtcaatcacccgagctgagcatacctgccaatcatgctgatggcttatttagtaaacrtttatggagtgctgtgtgcaaggcactgggttggaaagttgactcaaagcagcggttcattccaaagaatcgcttgaattgtgtcatctacaaatcataa

SEQ ID NO: 73199 - DNA, 201 bp, Bos taurus; identical to SEQ ID NO: 33647

SEQ ID NO: 73200 - DNA, 201 bp, Bos taurus; identical to SEQ ID NO: 33648

SEQ ID NO: 73201 - DNA, 201 bp, Bos taurus; identical to SEQ ID NO: 33649

SEQ ID NO: 73202 - DNA, 201 bp, Bos taurus; identical to SEQ ID NO: 33652

SEQ ID NO: 73203 - DNA, 201 bp, Bos taurus; identical to SEQ ID NO: 33653

SEQ ID NO: 73204 - DNA, 201 bp, Bos taurus
acaattctagtattcattcattctaaatctcttaaagcaaacagtgtggtagttattctcatagagggctgtagtcagaatcgaggcctctgaatctaaaycagaattgtagacgaaaagtggctctctttagacaaatatttggagcccagataaaaagttcacagttcttcaggaagcctctagagggcgataaagtgc

SEQ ID NO: 73205 - DNA, 201 bp, Bos taurus
caagtcaccaggagatagagatcataggggctactttaaaatccaacaactataccaattaatccacttaaaattaaatgcaaagttagagtaatacactyaaagcaagagacacaggggcctttgtaagttaactacaactatttttagcccttccatgttacttagtttctgaatcttgacaatgttttggacagtcca

SEQ ID NO: 73206 - DNA, 201 bp, Bos taurus; identical to SEQ ID NO: 33655

SEQ ID NO: 73207 - DNA, 201 bp, Bos taurus
tctctgagccacttgttaaaatcatcagtgaatgtggtgggtggtgagtgatagaaagggaacatggagagaggcagcagacatgggagccccaagtctcrttgtgggagggttggttacaagagcacagaagaggaaacaggaggacgctgacctttcttctctcaagaagcagttctcagcagtgcctctcacccaggg

SEQ ID NO: 73208 - DNA, 201 bp, Bos taurus
tttgactacaatgtacaaacaacaagcctacactcaggccacttgaattttagttgcagagataagtcacaccttaccaagtaaatgtagaataaaagttyaaatagtaacaagggccttgaaagaaaataaaacagggaaatggctgagaatgaaaatgttttagacaagatggttggaaaagccacacaaataaggtga

SEQ ID NO: 73209 - DNA, 201 bp, Bos taurus
gggattttgagttctagtaaattctagtattagaattctgcccctgcaagggacatttcacagacaaggctgatgcaatactcagagcatgtattcagagyaatgtcactgcatcccacatctgaaagctaacctgacaccttgtttgccagtacactttcaaggtggaaaagaagccactcatttcactgtcccatttcc

SEQ ID NO: 73210 - DNA, 201 bp, Bos taurus
aggagataaccaaacactgctaaagaagcaaagctttggcgtcactgtgcttgaatgccttgggaggtcatgagcctgcctagaccttagcccctgcagtmaagatttctggtttacttgatgcaagcacctagctgacacatggcagctagagaaaggagcaaccttcatcttctcacagcctccagtgatactcctcca

SEQ ID NO: 73211 - DNA, 201 bp, Bos taurus
ggccccagagaaagccaaaccacccataaagtcacacttgtacccaatcagtagcaacccgcagtgccccagttgatcctgccaggcaaagcctctctggkaggaagctgaaagtgtcctacccatctcatttcttaggctatgttttctggtcatgattcttccactctgttctattttgctggggtggaaagaaggtat

SEQ ID NO: 73212 - DNA, 201 bp, Bos taurus
tcagaagagaaagggagacttgctatttcctgacatctgtattttagtttttgtcattagatgtccatgaagtggcctgtatgttctcacaaaagcctcartgaagtttggggaggtgtgttctcttctttgtagcctcactgaagcagtgagcagactcaaccacaaggcctgaggatcagaaggaagggtgactttagg

SEQ ID NO: 73213 - DNA, 201 bp, Bos taurus
gaccacgtgggggcagaagtacagaccagaggtctaaacactccttataaagactttgaaacaaaacctggtattctcccttcccccaccacccttagctytggtggttccttgtactgctgctgctgctaagtcgcttcagtcgtgtccgactctgtgcgaccccatagacggcagcccaccaggctcccccgtccctgg

SEQ ID NO: 73214 - DNA, 201 bp, Bos taurus
agctcaaagccataaatgacagtctgtatatcaccccattcaaaatgggagaatttacaagcaaagagaaataacacaataatttaaaatgaattcttacmaaataagagttttttaaatggtgataaaaaagaaaaaaaagttataaacatatatgaaaaagaacaggggtttttgagagaagacaaaattttaaaaaag

SEQ ID NO: 73215 - DNA, 201 bp, Bos taurus
gggaaatcaaagtatgagtaaaaagcaaaagcttataagcgaaatctaaatactgcagtgtttcataggttggtacatccacataaactatttcccaggawatgtctgttttcatggagcccattccaaggggataaaagtatctacgtgactagagatcaagctttgtgatccacaagcgaactccaatttgaagtgggt

SEQ ID NO: 73216 - DNA, 201 bp, Bos taurus
gaagaaataggaaatataaacaaaccaattaacagtaatggaattcagtcagtaatcaaaaaacttccaacaaataaagtccaggcccagacagattaatmggtaaattttacaaagtatttaaacaattaacacccatgcttctcaaactattcgaaaaaactgctgctgggccgtcgcagccaccgtgctccaatgtcg

SEQ ID NO: 73217 - DNA, 201 bp, Bos taurus
tttggatctgcacgtttatacgatcatgacttttacctgagttttaaaagatatggaaattactaatcagtctggctggccaagtgtggttttttggtttktttgttttttttttttttggtcacctgttgctctgtattcctcagcaattattactaatgttacacagactgccagactgccaagggcctgtggaagaaa

SEQ ID NO: 73218 - DNA, 201 bp, Bos taurus
tgctgaggttcatgggtcggacacgactgagtgactgaactaaactgactgaaaccctattttctatcaggcacttgaaatctgtgttactaaatagtccyccaaacctatgagatctgtatctgtattccagttttctaaagtgtgaagctgatgttcagcaaacagaaaacattatacaaggacacatatagaataatt

SEQ ID NO: 73219 - DNA, 201 bp, Bos taurus
ctggatttaagtacatggtatttaagtacatgaaagagcatcacacttttcctttgtggagttccttgttttaagaactcagtaaggagttcttgttcacrttcttgaaaatgcttttctcaagaatccatgtttcctccttcaacagaaatcagaaattcgttgctttaagtctagattttggtttcattcattcctata

SEQ ID NO: 73220 - DNA, 201 bp, Bos taurus
cccttgcaggcacaggccttcattcagggggccttgaaaaagctggtttgttgtattgtatggcaggtcgatgaatcaagaagcagagagggcctgtcccrtttcttgtcttgtgtgacatgatgtgaagagagtctgccagcaatgtttcaaagagctgcattatcagacaacataaaggccctccgtccagcctttctg

SEQ ID NO: 73221 - DNA, 201 bp, Bos taurus
gtggggcactatcagggagcagatgctgagtaagggccggtggctggggctgaacaagggagacccaacaaagcagcagacactgcaccgtcagcatgcakggcttcctgtccaagctggccggcttctctcttccctttctccctcacacagtgaaaaggaaatttattaggcaaattcctccatggcagagagagtgtg

SEQ ID NO: 73222 - DNA, 201 bp, Bos taurus
tttccctgctgactggggcctgaggtttccaataatcacaggcaatggcagaagtcaaaatagacagtgcatgggggaaggaagagaatgaagcaggaggrtttatgaggtgggagggcctagggtggcgtggaaagaggatgaaggctgctaaaggtaaggacacggaagagcagggtatgggccatagtggctctaggt

SEQ ID NO: 73223 - DNA, 201 bp, Bos taurus
tggaaaaggaccacaatcctccacgcactcaaagatgtgaaggcctcacgaacacacttagaaaaattgcaggacaaggcaggcaggttgtaggaggtcaragagggcagcatcaggcccggccacaggtgctgggagctagctccaaccccctcccccttgacaaaggccagctcagccccaaactgaaatgagagcagt

SEQ ID NO: 73224 - DNA, 201 bp, Bos taurus
cccatcaagaaaagggaccagcaagtagaaggcctcagaaatggaactgcacctgccgcatccaagttaaaccaaaaggccagtactgctattacgtatcyattgctatattctcagtgaatgaggtggagagctctgggagaaggaagctggagagtcaagaccagactgtgaagagcccatggccaacacaagtcagct

SEQ ID NO: 73225 - DNA, 201 bp, Bos taurus
atttattattcttatgttttgacttgttctgtaaattcttttgaatttttttttcttttttctcctttttatccccctctgttatagctgtcgattttaayggcactatgaaatttaattaacttttcagctttttttttaatatcacctggtcatcctcctttttggaacctagaatgactcacagtcatctctgagaac

SEQ ID NO: 73226 - DNA, 201 bp, Bos taurus
tacaaaagttaatttttaacatatctccatgaaatagaaaaattttaatctcacttcactctattaattatagaaaaagagactgagactgaataacacayaggctgctaaaataaagatgaaagttcacttctaaaaacaaccacagcttcagcaacagttagtaaattcaaacaaagtactaggaacaagcagtcagat

SEQ ID NO: 73227 - DNA, 201 bp, Bos taurus; identical to SEQ ID NO: 33661

SEQ ID NO: 73228 - DNA, 201 bp, Bos taurus; identical to SEQ ID NO: 33662

SEQ ID NO: 73229 - DNA, 201 bp, Bos taurus; identical to SEQ ID NO: 33663

SEQ ID NO: 73230 - DNA, 201 bp, Bos taurus; identical to SEQ ID NO: 33664

SEQ ID NO: 73231 - DNA, 201 bp, Bos taurus; identical to SEQ ID NO: 33666

SEQ ID NO: 73232 - DNA, 201 bp, Bos taurus
gagcctgggagcccacgattgggacgtcagcagttctggctccgctggaggcctttctgcaggtggcccctcgtcgcaatgccctcgtgtggtctcgcctrtgggcttcaacatgcatgtgtctctctgtgtttctcagtttcctcctaataagggtacttgtcggattggattagtgcccaccctaagcgtcgcatttaa

SEQ ID NO: 73233 - DNA, 201 bp, Bos taurus
tttcaattcttttagtttttgcaccattttattttaaggttttgttgttagatgagactggacttgtaattgctatatcttcctaactgtaaatataaccrtatcaattactattttattataaattgaataacaactatcaaaaggcacagaaggtcagactggataaaaaaagcaagatccaactatttgctgcctaca

SEQ ID NO: 73234 - DNA, 201 bp, Bos taurus; identical to SEQ ID NO: 33669

SEQ ID NO: 73235 - DNA, 201 bp, Bos taurus
atgaaacttccttctcattggctagaacctggggacacggcagtcgctgagagttccatttccagtcctgggcagagctaggccagccaggaatccgtttsactctggctcctgaccagtggaggtccctgaagggtcaggaggcattcctggaggtctggcctcaccactgtttgccagaaaaaaggatcctgtttttga

SEQ ID NO: 73236 - DNA, 201 bp, Bos taurus
aatcttaaatttctattcacatatatttagcaaattctcttacttcgtggcttaattgcaaggtatttacccttggagcagtccagtgtacccataaaaayaggagttgatcattatggaaattggccatggaaatacgccgaaggtgttttaaggacatgtttttagtgtctcctctaggaaacctgtatttccacttcc

SEQ ID NO: 73237 - DNA, 201 bp, Bos taurus
tagaagctagttccagacaccatctcagattttctaatatcctctgcgcccttccaaattccctggtgagagaatctgattgacagccttgactcccatgyccatcagccatggagggaatgggggataaaaaaatacaaggttcatgtggtaaaaataaaggctgtatgtgcttaacactgagagtggaaaagggacaga

SEQ ID NO: 73238 - DNA, 201 bp, Bos taurus
ccactgaaatttacaaacgattcattgaaggcagggacaaagagaagtgctcaattccagtgaaagaaccccatccatgagagtttatctcaactgctcaygcttaaattccagatgtgggaagctactgaatttttctgtcaatatatataatttttgaaatatggcctatgggtggatattaaatacttgaaccaactg

SEQ ID NO: 73239 - DNA, 201 bp, Bos taurus
ctgttccaaaaacctacaaaactttgtactaatttctttaaaaaaaaaacaaacaaaaaacaacttactactatttcataaactttttacagcccatctgyagttgtgaaactcagtgtcagactgaaagcaaatgagttcaacagaggtgaatgatgtcagtttccccctgagaattgtttataattcaataaaaagttt

SEQ ID NO: 73240 - DNA, 201 bp, Bos taurus
tgcgggcccctgcctctaggcacagtctgtgctaaataagcagcaggagaaccttgaagtggcagttctgtaaccacttcttcctgaggtcagcacttcakgcatttgtgtgttctgggcccagcagcacagcatcccacaaaggtgggtgttctgtaagtgctttttaatgatggtggtgctgatgatgtatgaaggcct

SEQ ID NO: 73241 - DNA, 201 bp, Bos taurus
tcaaggccatggggccacagcattctctttggaaaagataatatttactagtttgtgcttattgtgtgatgcaactttactacaggaattactattgtccmccagtccctgggaaatctccctaatcagcaatgttaaatgtagttgccctggagagtgaagaacaaggaccaggagacctgtagccaaaagtctcatcct

SEQ ID NO: 73242 - DNA, 201 bp, Bos taurus
attgtttctaacttttccatggatacaaatattgtattcttagctattatattaaactcctgtgtcttagactttttattacagtctccatagggccatamcttatgataggaattcaataaatagttgatgatttagtacatggttatttatttaatggatagtcatctcttaaaacaatgttctgattaaaattggcct

SEQ ID NO: 73243 - DNA, 201 bp, Bos taurus
cagagtcttgaattgtctttaaaatcccttcaaaatgtaagtctagtctctatgttactataagggtctaattaatcaactagaacaaaggaaataatagytttgtacccaaggcagtgaatgatatggtggattatgctttcatgaggctatttttctgagcctgaatttgaaaatcaaaataccaactgcatagcaata

SEQ ID NO: 73244 - DNA, 201 bp, Bos taurus
tttgcatgaaaagtcttctggcttccttataccctcatcctccacacccttgcataacctgcttttcttcctctacaaataaaagaatacaatgtcttagrgtgttgagaggaacctcagatgcccacagaaaggagagagttttaaaaaataggggacaaaaagaaaaacttgaccagctaaacagtatgccctaaacaa

SEQ ID NO: 73245 - DNA, 201 bp, Bos taurus
tgtccaggtggttttagccatcttatgatcctacttttccccctgaagtgtctgggtttttcaagttgttaaagcttttcttatcccattgctccttgctrtgaacaactaaggtactcaggccccattttagaagtgaaaaaacataatttcacaataattcccaatgaaaagaagtaggaatcaaatctagtttttttc

SEQ ID NO: 73246 - DNA, 201 bp, Bos taurus
tataatttcataggctgaaggatggtggttagagggagggaactggacagagtggaagaaatttcaaaatccatgtctaagtccttatgtaagtttgatcygcatgaaaacttgtgggttcatcatcatgggtccagtgtctaccaaaataatccttgtcatattctagttcattttttcccactgacaaaaatacacata

SEQ ID NO: 73247 - DNA, 201 bp, Bos taurus
catgatggtggatgaggccttctgtaagtcattttggtagaaagtattgcatgcaaggatgtcaaatctgtgtctagagtatgtgtctattctagtgagarcaaaacattgcatcttccgtaaggaaagtcaagctgtgtgatcagtgtgccaccagctggttgactgatcatcccagtgagtggggccaatgagggactc

SEQ ID NO: 73248 - DNA, 201 bp, Bos taurus
ttttaatttaaatctcaaacatttgtttctgagaaataactgaaaacttaatttagccaattcagaaataacttgatcaatttatttattaaccaataatmtcatgcttaaacataacctgaaattcttgttcccctactatattccagagaagacttcaggtcagaattttcatgtcttttagtggtaatgtttctatcc

SEQ ID NO: 73249 - DNA, 201 bp, Bos taurus
tcttcaaactatggagtatgggtgtcccagacgcctcaggacctgagtacaggagataggggtaaaggggatgttttggcctggtgaaaattatggcgccwaatcatcaaagacaaaaaacaaatagcttgtgcttgcttcagcaacacatatactaaaattggaacaattcagagaagcttagcatggcccctgcacaag

SEQ ID NO: 73250 - DNA, 201 bp, Bos taurus
ttgatgatgagtttgagtaaactccaggagttggtgatggacagggaagcctgtcgcgctgcagtccttggggctacaaagggtctgacatgactgagtgrctgaactgaagtgactttccttgaatagctcagtgcataaacaaaatacttcaaaaagattagatagattttggagttgtagtagatagttgagttttca

SEQ ID NO: 73251 - DNA, 201 bp, Bos taurus
cttgctaaggaagtggaaaaagtgcacttttttttttttttaaaataacaaatctttaaaaatattccttttagggaaaggaaacaattatcataatgtcrccttttttttgctaattctattcatcacttcatgggaaatagatgcggaaacagtggaaacagtgtcagactttatttctttgggctccaagatcactgc

SEQ ID NO: 73252 - DNA, 201 bp, Bos taurus
gtttatcagagaatgggactcaatctttctttaaagaggatgataaatgtgttacattctatcagtaattactctgcaggaccaagagactttactatgtrcaggcaacccaaataattggacttagaagtcacaagttggatgcacttgtgttaaatatatattagatttgtgtgaaagtaattacagttccagactctg

SEQ ID NO: 73253 - DNA, 201 bp, Bos taurus
atatttatttatcctaaacataaatattaaaatacaagaggacaatccctggtaggcacttgtcttgacatacaagtattctttgtaattgtcattgtacygcaaagatctgaactctgatatatttttactgtggatattcttgagcagcacaaataaaacctgatcctttatttattaattaaagtattggaatataca

SEQ ID NO: 73254 - DNA, 201 bp, Bos taurus
atatgagattttattgcagttcaacctccaatatctcattaccttagatatgtcattcagtcattttgttgtaattgtctttgtttccaatacaaacccarttacctttaagagttgcttagtagatcgaatgagaataactttgaaagcatttttaaagtaaataacatatactgatgggcgatcccatgtatattgtta

SEQ ID NO: 73255 - DNA, 201 bp, Bos taurus
ttggccacctgatgtgaagaactgactcactgggaaagatcccgatgctgagaaagattgagggcataagaagaggtggtgacggaggatgagatggttgkacagattcactgagtcaatggccatgagtatgagcaaactcagggaaatagtgaaggacagggaagcctggcatactgcagttcatcgggtcaaaaagag

SEQ ID NO: 73256 - DNA, 201 bp, Bos taurus
catagcacctaaacaacagtttagaataatcagcaattattatacaataatttttgaaagtcaggaatctgggtatggcatggtataactgggtaactccragtcagagtttctaaaaaagactgtgatgaaggcatttatcaaagtttacatcatctcatagctctactctgggaggattcacctgcaagttcatccacg

SEQ ID NO: 73257 - DNA, 201 bp, Bos taurus
aaacaaaatttaggtaggattttgtgggctagactggttagataatcaggaaataatcctaaatatttgctccttgtggttctgttctaaaagtctctgaytgatttcagttttagccactctcaaaggcctgacatcataattggtataaagttctacagctagggaggaaggtggtttttctctaccccctactgagaa

SEQ ID NO: 73258 - DNA, 201 bp, Bos taurus
tttctgcctcccttcccctcatccccacattttaaactccagttacaacacacttaattccacaacatcccctagtatccatgcaatctgaagtcactatracattaaacaactggtcctctgccaatcattattcatctgtcccatcctagatgtggcaatatcccaaaaagatttaaaatacaatcgtgtcacatgtcc

SEQ ID NO: 73259 - DNA, 201 bp, Bos taurus
tactcacaaatcaagccattgaagaaaacagaagaggacactgaatacacctgtgagcccctgggagatttcagatacctattcagaactacaaatgagtrccgctctaatgaacacctccataattaagtttctagggataagatttctcaggacagctcttacgagccaacacagcttggcaggggttatactccaaaa

SEQ ID NO: 73260 - DNA, 201 bp, Bos taurus
gtaaatagagtaatagaaaaaggacagtatctattatgtaatcaaatacgaatagattgttggaaaggtttatatccagtatctcaaaatgcttgaacaarcaatacattcaattacatatgctcttggaattataagccacattctcacacatatatagctattactacttgtgatccatatttcattactttaacctta

SEQ ID NO: 73261 - DNA, 201 bp, Bos taurus
atatgcagaaagaattgactctgccttttgtaccaatgttaacacaggagcatataatgaaaaatcaattataacataaaatctcgtaataggtgttcaartgttcgctcatcaaataagagcacaaaactatgtctgaatgctgactgtattctatatcactagactatgaatattttttatttcctcaaagtaggaaca

SEQ ID NO: 73262 - DNA, 201 bp, Bos taurus
ttttcagtacctttgatgcatttgactgttagcatcttaacatctgatttaatctttaattggtttgctgcttagtctcagcctgagttttaacattcccyagggagaattcaaattgccctggtttgagtcacctactcatccattaaccaggagaggtgattaggagcttgaacaccagtgatggatccagatgagttc

SEQ ID NO: 73263 - DNA, 201 bp, Bos taurus
ttttcatcttacatgagacccttcatgtgtaagtcaacacttgttgtaagaaatccaaaatacagtttagactcaactgttcttttggtttgtaatttctyttcatcagggacttgaaacttaccagatttagctttagctagaggcttctctctctcaggtagtcctccgtctaccatgagcattgtgtaaggtacaaga

SEQ ID NO: 73264 - DNA, 201 bp, Bos taurus
tgtgcttggctgtttatttttatttgtaagaatgtacttcagtgaataaatcagaaaaaaaagaggtcccaagccatgtttgaaaaaactagacattaagyatttatttcatatcaataaggtagtatattaacctttctgttcacagttcatttcttcttttgaatactgcacttgtatggctgactcaactagagaaac

SEQ ID NO: 73265 - DNA, 201 bp, Bos taurus
acttttagtgtgtagttgatgaggtgctagcccagtgtacagtatactctttccttatcatctcttcttttaaaatatggtctatgtggtttcagtgtgtytctgattttcagattgtaattacttatattttcatgttacatgtgggggatatacaaataccgctccacaaggtgggagtgagaagggagatgatcacct

SEQ ID NO: 73266 - DNA, 201 bp, Bos taurus
tgttttttagagctctgtgatatcttagaggtgataagtctctcttgccctcttttgtataacagagaaactaaatgaaatccataaaagctcaataaatrtccatgtttagtgtgtgccaaaagtgagattataattcaagtattctcattttaaactgtgcgctttctttctggactcttaaattcttcaggtgttcac

SEQ ID NO: 73267 - DNA, 201 bp, Bos taurus
gtttatggcacggctgggggatcccagtctccttttccaatgaaagccctgatgtcctatttactagaaaagtttgtggaaagactggaatgtagcctacrtatggattttgttttatatggaaatccagagatgagatttttgagcatcctttttaatggaactagaatatagagtattgacatttatagatattcaaaa

SEQ ID NO: 73268 - DNA, 201 bp, Bos taurus
cctcatcaagaggacagcatctagtgtggagcatggcatctagaataatattttagtaagtttaatggcaatatttttaaaggtacttaatgtaaacagaygctctcttgctaaggggaactttaagaaaagcaattctaaagggatacattggcgggcactttacacaagacactcatccaagccctgaactaaacaata

SEQ ID NO: 73269 - DNA, 201 bp, Bos taurus
cctaccaggctcctccgcccatgggattttccaggcaagagtactggagtggggtgccattgccttctctgattacctatataaatgcttataaatgagayaaatgtcatctcttttatatacatctgaatatttgccatcaaatcttatataatttggattctactgctgcaatgctctgctggccctcaggaagcatgt

SEQ ID NO: 73270 - DNA, 201 bp, Bos taurus
ttctgggggataagtgttagttctttttgctttgtgtcaagtgctttcacattatcaacggaaatcgtaaggaaagggcccccataatctgttctacaaaycctcttccctttaaaagtgttggcgtgctttgtggtctttgcctccatatttaataaataagaaatatagtgagttgttgtgctacctcagtgcaaattg

SEQ ID NO: 73271 - DNA, 201 bp, Bos taurus
taatcatttcctttgatgtcataatatttatatacatacaaagaaacatgagaagcatcagtaatgttccagtcaggacactgatatagtaaattccctckattctactgccaatgttactcttactgttttggttccgagatctaagccccacttctgggtagattacagatagtttgctaccctatacttggttcaata

SEQ ID NO: 73272 - DNA, 201 bp, Bos taurus
acagatgtcacagaaggaaatggatgtgtatgcaaatgtggccctagtgggtgatcataattgttttttgaaacagtgtattttaaaagaagatatgactrgaattataggttcacactgtccctctgccatttgctttctgtgtatctctggactattcactttaattatatggctgtgtctttaaatgaaatatgcaaa

SEQ ID NO: 73273 - DNA, 201 bp, Bos taurus
ctttacaaaatcacataactcctctagagttttatttttgacccactcaaagagattttaccagggcatctgcaggtgtccttttcttttatccagctaaycttttaaaatgacaacatatggcccacaattgagatatcaataaatctctttaggatattttatatacattcaatacattataagggagagagagagact

SEQ ID NO: 73274 - DNA, 201 bp, Bos taurus
ataaacaagtatgtttcatccactgaccctggagggtttagacaggaacagagtgtacacggaaggagtaactgtcatacaatggaatgcatgctttgttmaacaacaggaagaaagagctattgcactcaagagataatgataaatatatgtcttctgtaagagagaataggatcagaaaagacttccaaaaggaagcca

SEQ ID NO: 73275 - DNA, 201 bp, Bos taurus
gaataaaatatgagtgaaaggcctatgattgtataacccagtcatcagaccagtactgcaatatcacaatggaatggagtcatttgtcaccttagcagtgyaagagaccaagccagtggccactcaagctacagtagccttcaccttgaggcagtgtcggaatgattggtgtggtgagactgaatttccagctttgtcctt

SEQ ID NO: 73276 - DNA, 201 bp, Bos taurus
tccacacagactttggccattttgtatgtttgggtcagtgatggtagagtgtattatggctggtcaggaatgtaaaccctatgagaatggttcttctcccyctaaaccttcagacccggccatggctcttaacatcatcccagattcacctcctgtgctttgcatttctcactcacgtctggatctcccttcctgagcttc

SEQ ID NO: 73277 - DNA, 201 bp, Bos taurus
ttatacagtattgtcatatgaaaattttattgaaattccttaatgaatagcctaacagatgaccactgataaccactgatgaccacttaggaatctaaagyttcctaaggtagctatgtgaggaaaaccaagtaattcagtgatgggtttgactaaagaggagtatttttgaacaaatatatatatatgtatatacacaca

SEQ ID NO: 73278 - DNA, 201 bp, Bos taurus
aagaatatgtcttcttcgtgttagcagtgatggaacacgcagagtctgtaagtgaaatgtgatggcgtccatcttattttctatggtattcttaaatacgktttttaccagaatgtggggatatggagctccatgcatcctaattgtttctcgtgagatgtaacttaaatgtagtaacaggctgtctactctttgaatgtt

SEQ ID NO: 73279 - DNA, 201 bp, Bos taurus
aggtgagacttacaacctcaagtggataatggaataaaatggacacaatgagtaagtgagggaagagatgtagaagactgttctagaattagtaactagtsatcaatttttataaatctttaagatctgtgaaggaagggaagaaaagactctcttataaaagatgcttttaatgaaacccctatttaagccttacacatc

SEQ ID NO: 73280 - DNA, 201 bp, Bos taurus
atattttgtatattaaccccttatttgatatatggtttgcaaatattttctcaagatatggaaacgctttgtaggagactgtggatactgttggtgaatarcatactaacatgctatttgtatactatctgtactatttgcatactatttttactaatgtttactatttgtatactagtctgcatttttaaatgtatctat

SEQ ID NO: 73281 - DNA, 201 bp, Bos taurus
tggagcagtaaagatctaggagaggggacggaggacctgaagaagttacgaactggtgttctcaaagcactgacacaggtggacaagatggggctttcagrgaaatttgataagctaggctcatccagtcactaaagtggaaccccaaatgaggaccccttcatgaggaacacagcagctgatgcgtctacatatctacca

SEQ ID NO: 73282 - DNA, 201 bp, Bos taurus
ctgagaagcttgaaaaccaaagcaaaaagaggatgtagacaagtacataagcttacttttcagaaaagatgtgcattattcaggtttctccaaagaaacaraagcaccaagacatatagagaaaaagaaacatagagaaaaagagatttattaaaaggaactgggtcatgtgattatgaagactgagaggtcccacaacct

SEQ ID NO: 73283 - DNA, 201 bp, Bos taurus
tccccagtcaagaagctaagatgtagctcagaagcttaagaagtcttcttttgggagtgttgaccatcagcaaccctatggcacttacctgagtaaactaygtaagttattctgctgctgcccagggtcctttatttatagtaccaaggcagaccggctctccctgacaatgggctcccattaagctaaccttggccctca

SEQ ID NO: 73284 - DNA, 201 bp, Bos taurus
gaaactgactttgcttgctcctctttcatgtgttagtttcatggctaccattgaatgtacagactgtctctagcctaatttgtagatataatttgtcattygtgcttctgtcccccctaggttttccaaacctgctagtccacaagtacccctccttaactctaacctgctgtctgttgctttcactatccaaaaagaaag

SEQ ID NO: 73285 - DNA, 201 bp, Bos taurus
ccttttctccatacactctccagcatttgttacctgtcaattcccccataactggtaatctcaccacacaagcactacctccttgagaaacctgccaccaygttctgctggccatcctctgctcacagtgggatgttgttctaggaccttgcttcagacaggtaagctgaccagggtgaggtggtacctcactgtagtttt

SEQ ID NO: 73286 - DNA, 201 bp, Bos taurus
atttaggagaagacacacggacctccatcctgaactccagagtgacagcagttgaagtggaggtcagttctgctctggctgctctctaggacccgatggaraactgggctcagagggacaaaggccttccaggagagagactcccaatatgttaaaaaattgaaaaaaatccctaaacaagcttaccaaaactgtgacaaa

SEQ ID NO: 73287 - DNA, 201 bp, Bos taurus
cctatggaagctctgtaatcaaatcctgctggccttccaagtcatattccctggggattcccagtccttggctggatccccaggctgaggagcctgatacrgggcctagaaccttcacaacagtgcaagaacttcttggatattactgttctccagtttgtgagttgcccacctggcaggtataggatttgattttatcat

SEQ ID NO: 73288 - DNA, 201 bp, Bos taurus
taataataaaaccgatttaccagcagcgccagttaattatgcaccattgctatggttattctgtgagacaataaaaggtaatggggccgtttctgaagttrgtgggaaggaacccagcacaatcaccgaggtggactgctgactctcttgaaaaatttctccccaagtcagcatgtgtctgggtgagcagaagtcattaaa

SEQ ID NO: 73289 - DNA, 201 bp, Bos taurus
ttctgtaatgttacattattatttgaaaaatacttataaattgctttaatagacataagaaaatagcaaaggataattttctctggatggcctcttcctaragaaattttaaagcaaatttctgcagcaatagtgtttatgtcttttactatgtactataaacaaagtaaaaacaacaacttaacactttaattctccttt

SEQ ID NO: 73290 - DNA, 201 bp, Bos taurus
caataaaataccatcagatttatgttcttgttgtccaaagagtctatattagctccaacagactgcaaaagaagcttctttttacccatttttcaaacatycaaatactctttgggactgaggagtaagtagctgacctaggaatagctgaaaaagtgagagcaagaaacagcaggataaaaaaagcaaacaacaggatga

SEQ ID NO: 73291 - DNA, 201 bp, Bos taurus
ctagcaccacctcaattccacctcagatcatcaggcattagaatctcataaggagcccacaacctagatccctcacatgcaaagttcacagtagggtttaygctcctaagagaatctaatgccaccactgatctgacattcttctggtccatggcccaggggttggggactcctgccctaagcctgccattgaaaataatt

SEQ ID NO: 73292 - DNA, 201 bp, Bos taurus
agagagaattgaaatgaaattcagctttttcctcaacaggtggatgagacaatgatattatttactgatgattgagtgaggagtaggatttcagtggacaygtttgtggacatcaagatctccacttggagtcactaattttgtaatactagtcaagcaagcagttgaatataggaacataaagttcaggtaaggctgggt

SEQ ID NO: 73293 - DNA, 201 bp, Bos taurus
agaaatactgaaagcaaaacttgaagggcactttaaaaaccaagaactaagacaggttaaaagacaggaagaaaactatgatcaacaggttgaaatgtctytgcaagatgaggatgaatgtgatgtttatattctgaccaaagtatcagatattttgcactcattatttagtacttacaaggaaaagattttaccgtggtt

SEQ ID NO: 73294 - DNA, 201 bp, Bos taurus
tggggaactcaaatcaggtgctctgtgacaactagaggggtgggatgaggtgacaactagagggagggacgttcacgagggaaggaacttacgtatacctrtggctgattcatgttaatgtaaggcagaggccaacacaatattgtaaagcaattatcctataattaaaatgttttacatgtattttattcaagtatagtt

SEQ ID NO: 73295 - DNA, 201 bp, Bos taurus
tctggaccagcgcagggtccatttgtcagttagtttaggggagcttcaggggcccaagttaggcactcttttaaagaggcagtgcttgctaagttggttcmgtcatgtctgactctctgcgaatctatggactgcagcccaccaggctcctctgttcatgggattctccaggcaagaatactggagtgggttgccatgccc

SEQ ID NO: 73296 - DNA, 201 bp, Bos taurus
aggttctgcacgctctctgttgttcttggctattaaaaaagaaagcatatttgttactgaaatgtagttaacatcttaccactgaattatgtatgtcactyagataaatataattgctgtaaatgtctatatggtctcggattcagtttttatttagaaatgggagcttttttgtttataggatcatcaacaactaaaaaa

SEQ ID NO: 73297 - DNA, 201 bp, Bos taurus
gagatcattaaaggcctgcatatgtgaatgaatgatggtttaaaatgctgtcagtctggtgatgcagtatggagtgtatgggagacaaggggagagagccragagtcagggctgttccaacagtaattttagtgtggaatacgaagacctagactgtagtgctggcaaaagatagacatgaaagcaagggtggaaaactag

SEQ ID NO: 73298 - DNA, 201 bp, Bos taurus
gatggacagggaggcctgatgtgctgtgattcatggggtcgcaaagagtcagacacaactgagcgactgaactgactgactgaccacttaaaatgaggtayggccatgtgacttgttttggcctacaaaacacaaggggaagtgatttgtgttacttctgggcagagtatttaagagccaacacttagcacatgatgctct

SEQ ID NO: 73299 - DNA, 201 bp, Bos taurus
tttctgccaaaaatacataagcacattccattcatgaaggaaaaaaaacagaataaacaagctgactgatgctataaataaactgaacaatattcttccaraggatcataaaagacaaggaaaactgaacaactgtactgaatggaagactaaggggaaataacaactacatgcaatgtgaaatacaagtctagaacagaa

SEQ ID NO: 73300 - DNA, 201 bp, Bos taurus
gagtagatatgtaggctggaaggccaatgagacatgagatatgattggttgggtgtggaacctagaactgcctcaagcttgggtacagagtcaggtcaccmgtttggtggggccaagaaaattgcagagaaacagagacagtgtcattctctctgtgtatttcttgttacatggtataataaacttcctttttatttaagc

SEQ ID NO: 73301 - DNA, 201 bp, Bos taurus
attcttctcactttttggcagtgatcaaccatgatcaacttgataaacattcacaccttaaccttcccactcacttgcctctcatattatctgccctgtcyttgtcacctttgccaattcctcttctttcactcactctccaattatgtgcagttcccaaggctcaatctcagatcccctgcttttctctctaagcacaat

SEQ ID NO: 73302 - DNA, 201 bp, Bos taurus
acgaatgatatttgagtatcttttcacccgatcattcctatatctccttgaaagtcttaccaagtcttttgcctattttaaaatgggctttttgtttctaytgtggatttctagttctttacacattctggatacaaatcttgttgaatacatacacctcaaatatttcccccaatctgtggtttatttattcattttctt

SEQ ID NO: 73303 - DNA, 201 bp, Bos taurus
tggattataacccaaagtataaaaacaaatatccacgagtccatactgatataaagtactgaattaattaataaaaagagacaaatctcccttgcagaacrattcaaagtaaattgtggaggtattccaccttcaaagatgtgagcataattccgcattccttatgtgtgggcagtattagtaacgtccttccacacagca

SEQ ID NO: 73304 - DNA, 201 bp, Bos taurus
ggagaatctcctgatctggacactgtgggcccttccagataatcacgggagcagctattcagtgtgttttcaagcctcctcaagggtgggtgcatggaggsaagacagtgggaagccactttcccactgaaagagaataacccaaagggcaacaaggaacaagttgtggctttagaaaaaaaaaaaaatcttctatttgag

SEQ ID NO: 73305 - DNA, 201 bp, Bos taurus
gcctgcgctggagttgggcggcgcccgggccccggcaacagctctcggctggaggagctttggggctgggggtggattgcggagaggcctgggagcggackctctgtaacacaccctccctgccagtttcttcgggtctttcccccgtaggggtaaggggagtgaacagcaggcctggtacttaggctcaccactaacggc

SEQ ID NO: 73306 - DNA, 201 bp, Bos taurus
ttgaggctgcctctgtggccgcccgaggccccagagctgtgagacttggcaaagtaattaagactgagaacccaaccgagcggagctgagtaaaaggtggrcgggcccatcccacaggccaaatgttttggaaaggcaaaagcaggagagttggagaaactaggtaagtgccgcggagtggattttctaattctcttccgt

SEQ ID NO: 73307 - DNA, 201 bp, Bos taurus
gacgctatttcagtctcgtttcttctgtgaagaatccctgactacactgagcatcagtgacctctctcttctaggacttacagtgacattcttggcctgcrctgtctatttagtccccatcatggagtgtcctgcttatacatctaaatctttcatcgagatctgaaggtgctgctctgaccctggccaagtagtaggagt

SEQ ID NO: 73308 - DNA, 201 bp, Bos taurus
gcaattaaatagctgtgtgacctgggacaagtcactttacctctctgaacttgagttttaccacctgtaaaataaggagattggaaacatgatctctattrgttcttcttgacatataaatctatgaattcaaagcacagtgggagcatgcctgcatcattttctcatgagggaaactcttgaaatgatttcattatctat

SEQ ID NO: 73309 - DNA, 201 bp, Bos taurus
agtactatatcattgctaaatgtcttagtttgatgattgtgttatggttacatattttggggtgaagggcataataaaacaataataggcttatatatagygagagatggacgatggttagatagatcaacagatggaatttatcaactgataaattagatagaagattcacgcactgttcttagagctattctgtagatt

SEQ ID NO: 73310 - DNA, 201 bp, Bos taurus
gaggatcctaaggtttcctatgacttcctactctgtaaggtcaacttgtgtcccctgttcctccactgcaacgaggccacttctcagcctcccctcacccygtgcacactataagtacctgctcagccctgcctttgcccaggctggtgaactttctcttttattccctgccctaacaaattgttcaaggcctccttagtc

SEQ ID NO: 73311 - DNA, 201 bp, Bos taurus
tgtaatgctgaaactgctgtctccttttaaaaagtatttctttgttgctttactgataagatttctgtattatttaattagactacaatgggtattgagtycagtagcattggactgtagatcatttcatcaacaccctaatgagtctaagccatttaccatatctccactactgattcagttggaataattttgagagtc

SEQ ID NO: 73312 - DNA, 201 bp, Bos taurus
cagtttcactggggccccgatgaagcttctcaaacactggcctgatcacagcacccagcctctcacatgcagtggctcacagttgcacccatgagcaaggycaggcttttaagcagtgtctgtaggcctgttgcactccactttcacctcctcaacagctgttctccaacaacttatgctcagttcaccagcctacttgtt

SEQ ID NO: 73313 - DNA, 201 bp, Bos taurus
cttgttttggtgttaattctttcactcagccagattggcagatttacccaagacaggtgaataaactgagtaaagagaaaatgaaagaaaagtgaaacaaycaaaaaatacttaaaaaaaaacacaaggaaatcttggtctcatttgagaggtattgaatcgatgttatcatttttcctttaatagaaaggtgtgggagga

SEQ ID NO: 73314 - DNA, 201 bp, Bos taurus
acgtagaaatttttatcagtgattaagtgccattctttttgtgtgtgtgtttgtgtgtgtgcatttctataataataagttatccacagtgccattttccycttgaggtattttaatacacccacctaatattatactagctttctagtagagaatgatattaggaggtgtcatagacccagggatcagcatggcatcacc

SEQ ID NO: 73315 - DNA, 201 bp, Bos taurus
atcactcatcatacactgagattacacagaataaaattgtttctgtggttgtcccttttctttgttggctctgaattattttctcttctacattccatttytgctatcatttctaatatctctgcctcaccaccacatcttaaaatatgatataggatccatgcttacgtctaaatgtgtctatactaatgatgctccact

SEQ ID NO: 73316 - DNA, 201 bp, Bos taurus
cttttgctccctgtggcactgacaggtaactccttggcactcagctggtagccagcatggtctggggtatccaggaaggctttttcacttgggctggcatytgggctggtgtgatagttaattatgtatgtttatttgggtgagccatgtatccagataactgaccaaacattattctggatgtgtcagtgagggtgtttt

SEQ ID NO: 73317 - DNA, 201 bp, Bos taurus
tttctttgctttgatacattttaaaatagatttgcttagacatccagagaagttaatagagttgtccatggctatggcctaaaaggagaggagacaccagsagaaacaattaacttgagctcatgtaggggaaggaggaaaggaagaggaacagggctcatgggtctgggtgcctctggccccagggaagcatgcagtgat

SEQ ID NO: 73318 - DNA, 201 bp, Bos taurus
ttcttttgtgtttgacattcttctgagtactttacgtatattaacttacttaattatcaaactggagatttttcttgtccctcctacacagtgcaaccccygtcctggacaatggtgaacgggccagaaatagactttttcccctcatacaggatgcaatctaatgagttttgagggaactgatcaaaaagttaactgtga

SEQ ID NO: 73319 - DNA, 201 bp, Bos taurus
cgtgcccccagggttacctcccttactctctgaggtgcagctgcctgtgtgccagatgggggctgtagtgcctcagcagcagtaggaggcaggggagaaaygcatgtggcctcagtaaagtgggcactgttcacttgtacccatgcacaatgtgagggacaggagaagcctctgctgtaggctctgtgagcagcagtggaa

SEQ ID NO: 73320 - DNA, 201 bp, Bos taurus
aagatgttcagcataattagtcattagggaaaatgcaaactgtaaccacagtgacattctactgtgcagctcttagaatggctggaataaaataccaagcrctgaggaagatgctggaactcttactcattgctggtcagaatacgaaacagtacagctgctttgaaaaacagttgagtagtattttctgtagttaaatat

SEQ ID NO: 73321 - DNA, 201 bp, Bos taurus
ataggtccgtgcacacaccccatagccccaccttcctctccccttcctgattcccagcacttccccaccccctcctgaggcctctatttctagaaggcagmgcaattcatcaatctatccctctccccaaacccagcccaagacctccttcggcctctccaaagatttcctttctctcgcagcagtataaaaaattcattt

SEQ ID NO: 73322 - DNA, 201 bp, Bos taurus
tgttgatgacatacagtctcaaaagagcctccgaactcatcagcacaaagctgctgctcctgtgctgcctggaagtggtgacatctgtaactcagtggccrggcacacagctgaaattcgactgactagctggagcctgggcagatcttccgtcggctccatggctggggagccaggccagcctagactacctggcagtcc

SEQ ID NO: 73323 - DNA, 201 bp, Bos taurus
gctaattgttgtgcaaggtgcttctgccctcccccagttgccaggagagctcacagtcctagctcagcagagctctcattagcatctctgtgtctgtgacrcagtccctaaggggggaatcctcctcgcagcctggcaaacagccgaatctcctccgtagacccagagccaagaggctgtgtgccggccagcaacaaaaca

SEQ ID NO: 73324 - DNA, 201 bp, Bos taurus
aatgaaaaattagtgttcatctgtatcactctaagatcactgatttctgaaaattaaaaaaataaaagtctgcccaaactaatggccatgtttaaatgacrggcatgaaagaaaaaaaatctagtcattctagttaaccaaatcaggtggaaatgaatctacctatggcagatatataaatatctgcagaaatatatggcc

SEQ ID NO: 73325 - DNA, 201 bp, Bos taurus
agcagggcttcattcagcagagtacagtaaaaatggatgcaaaatcccttacctctccatctggtcccagggcagactctcctccttctgcgttctcttcmgccttctgcaaaacaatgtcaaatgttaggtatgaacccagaaggtgggtacaggaaggacctcatggcaactcagtggcaggcacataacagcatttca

SEQ ID NO: 73326 - DNA, 201 bp, Bos taurus
aaataagaggatgaaacagatgttcatttcaagctctaggctgatcctaatgtctgtaaatgtgtcattctgatatatgaatgtgagtcctgcaagacttratcatgagaaaataggagccccaggattcacctccatgaacttggttcaccctcatccaattctgttgaagacagacctaaaaaacaactaacaaggggt

SEQ ID NO: 73327 - DNA, 201 bp, Bos taurus
aagagttaaagctgggcatgctggggtatagagcggggtgggaatggtcaggctaaggatactaggggagacgagtttgaaggtatgtgtaggcatgaacmaaatgaagacaggatgtcagggcaggaagcacacataaacaaagacacgaggtctgactattctgtaatttgggaagtacctattggagcgtaggatata

SEQ ID NO: 73328 - DNA, 201 bp, Bos taurus
aagccaggtgtagcctctaactcacaggctccttctcctgcctcacaccgtctctacggaaagttgctacagagggccatgcatcactgaagagcacgaaygaaggtcagatggctctcagaagggtccaaactgcattcaaagactcactggaagctgtctccttagtcaggtttcctttcagagtggccaggagagttc

SEQ ID NO: 73329 - DNA, 201 bp, Bos taurus
ctgagccatcggggaagcccttatacttaatatgaagaataaattcctaataggaggaaaacaattagtaactgtaaagataaaacaaagatgactggggktgggggcagaggggcaactgcagtgcaagattctgtctctgacaccaggacttcatgactagaaaacactctgcacttaatgagaatcttcaacagttat

SEQ ID NO: 73330 - DNA, 201 bp, Bos taurus
ggcagcagaagtgacaggcagaagcaggtgatgaaacagctttgctccccagcgggacttctttcctcaaactcattccctcagcccttattatgtgtccrtcactgcacctccaggtctctggtggccccacagactgtccgggaagaaagggagcactgagtacggtgggaggggagcaagcctgtgggcaaggaggct

SEQ ID NO: 73331 - DNA, 201 bp, Bos taurus
agacttcaggccccagctcctgttggtattctcatttcaaggaggtggcttctagacactgcagagatgtcactttttggggcagagcaaatttctaaagkgttgcctatactgctcagcatacaaaaggtactactattatgtgggagaatccgacgattttacttttcctatgtcaggcttccagaatttacagaaaaa

SEQ ID NO: 73332 - DNA, 201 bp, Bos taurus
taaaaaaggaagttttcttattgtttatttttctctagctgtatgatatacttatatatgctcacttcatgtttcataaataatgtgaagtggttttttaraaagttaacatttacttttttaccctcctcatttttatatttatttcagatcaataaatggactgggaaaaattttagaaacacagagatcaaggtactt

SEQ ID NO: 73333 - DNA, 201 bp, Bos taurus
cgtcttaagtacctcatgactgggaaagagcattcaggccaagttctgggatctaagcaacaggtagatatagattctattgctcccacacctgtcatcartatcaatatggccacagtggcccccagtttctgtatgtctgggttccaatattcaagttccagagacagtaaagagaatccagttgggccagctgtccgt

SEQ ID NO: 73334 - DNA, 201 bp, Bos taurus
ctcttccagcatgggaacatgaaatcatcacatggagcattgaagaagaatggaataaaattgataacaaaacaaacaaagaaaagacagatcatatggtrtgggcatggatttcctccagtgcccctttgagagggtcagtgagggaacagcagagtgacacagctcagacctccccaggctgcgactggatttcacatg

SEQ ID NO: 73335 - DNA, 201 bp, Bos taurus
agtggccaatgaatctttacatttacaaactgatattgcccatttcagagaattgtttagggcagtccctaaccagtatgaaaatctcctctttaaaataktgtgaaagcagaggtaatttaagttccttctgatttagcttttattaataaacaaatctgttaaccccctggaagattcttttgagacattcaagctgtg

SEQ ID NO: 73336 - DNA, 201 bp, Bos taurus
atgaatgctgaacattttcaggcccttccttgattatatcacatgggttgatacatgggtcgatctgattcccgttgagatggcaaaataccaccacatcrgctctctctctgactttctctcactgctgtcttatctcccagtgagggtctgcacttgtttggacactgttcagatcttacttatcgtggctgtcaaagg

SEQ ID NO: 73337 - DNA, 201 bp, Bos taurus
tccccttacgccagagctgtgcttcattggacaataaagctcagctgctgctttcatggaacatgaagattggtgggacaaagaaacaagtaaatttaggytctgcaggtggggaaatggagcacacagaagggatctcgacctactaatcataatgtgaaaataagatagtaccatatattttatagtgtgtattatttt

SEQ ID NO: 73338 - DNA, 201 bp, Bos taurus
agccctgcccctcttcattatctgtttcgccatgagtatctggaatctttgctcagattgatccttgtgctttttgccccagctcggctcctgtgcacackcccacaggcatcactcatgtctggctcctaacatccataccttctggttaaggacattggctaacagaaagctggttgcatagagctttctactgactcg

SEQ ID NO: 73339 - DNA, 201 bp, Bos taurus
aaggtaatgcatgtgaagatggaaaagcagaagtttgataaagaagtatctgctgagcatgcagcgacaatgagacatggcgtggaccctgatctctaggygctgccaagttacttccaccacgcctagcccatattctctacagatatccctggagatccctctattctagggatgggtttttatggaaaatcatttagg

SEQ ID NO: 73340 - DNA, 201 bp, Bos taurus
ggatgccactgttaagtcatcccaaagtattgtctctgaagggcctgtgtttctcaactgctctgtgatggttgatacttttcagtatgagtaagcttgargagttttaatttgcaggcctataaattaatacaggctgccaagtgacttggttctaagagctgctctttgatgtataactttgtgaaacttaatatttcc

SEQ ID NO: 73341 - DNA, 201 bp, Bos taurus
cacacactcgtgattccaaagtcttactcatcaagctgccttggtcagcctcatgattttcttgggccctgtatgggtcttttcccactctgagtccttcyagtctcttgtcaccatgtaaatggagtctgagttcctcaaagggggagttttcctttgaccatcacaaccataaacttcagaccttgacttcagtggaaa

SEQ ID NO: 73342 - DNA, 201 bp, Bos taurus
ggtatacatataatgcagcattagtcagacttacaaaggaaagaaattctgacatattctacaacatggataaaccttgaagacattatgctcagtgaaakaagccagatacaagaggacaaattgtatgattctacttatatgaaatacctagagtattcaagtttacagagacagaaagtagggttgcggttgccaggg

SEQ ID NO: 73343 - DNA, 201 bp, Bos taurus
ccctctcttctgtaggatcacacaggcagccactgaactgaaataggaaataaacagcatcagagctaacagaccaacctgggagatgaactttccaggcraggataccacagtgaagaaacacgtggacacttggctgagggggggactgaccggggtttgtaaatgctagaaagatgttcatggggttatgctaattaa

SEQ ID NO: 73344 - DNA, 201 bp, Bos taurus
aatgtgaatattagaccaacaaaaagacaaaaaaccttagtgattgattccgatgcagaaagtgaaaatgaaactgatgatactggagaatgttattctgytcctgcagatgcctgaattgagatatttcatgaaaattaaaaacctttacaggtgtgtcgggtgtacccgctgtatgtaataacccacacaatgttagtg

SEQ ID NO: 73345 - DNA, 201 bp, Bos taurus
ctgctctgtccacagtcttcaccactgcatggggctttcagatatttacatatgtaactatagatactgggatgtcagagggaaacaggccattacttccygtgagacttcccaaacggagttactgttaagatccagcctcctgcttaacttctaaagatgggctgactcccctgacttaccggcagtcaggccggtaag

SEQ ID NO: 73346 - DNA, 201 bp, Bos taurus
cctggatggacgtggctagaaaatcggtagcctcattctgcttgctctgtatctctctagaggtggcccagagtaactcattcctgaaaggccagcctctytacgaagaagcgtgcagcaccttcctcagaggagggagtgcatgcgggcaccccagtgcaggcttccctggaccacccgagttcatctggagacccgctc

SEQ ID NO: 73347 - DNA, 201 bp, Bos taurus
tgaaagctctgccttagcttaagaagcactctttatggcaaaatcttttggccccggaagtcccttgacaataatgttaaaatgcttctacttaagaatgygtgtggttgtgcgttttccttcgggacaatccctcttcctccccatttccataggttcttctgaatcccaactgtctctgatgtagccacctgcctctca

SEQ ID NO: 73348 - DNA, 201 bp, Bos taurus
taggtcatttgctagtttttattaatcttaccacgtctttcctgtagtaggggctcatcatttattttagagatgttaatctcaaaaccagagcccagacyatatatctcacctacttagatggacttagttcctaaaaaccgcaatacatttccttcccaacagattcttatttgataaggaaaagaacttcctttttaa

SEQ ID NO: 73349 - DNA, 201 bp, Bos taurus
ctagaaaagattggattttatgcaacctcttttccttgaattaacagcaataaaaaaaaaaaaaaagtctagaggataacaggccaagagtggtatgaaarttcgataaattgtcagatacctactgcttcttgctttctgctctgccatcccttacaaaaggcccagtatggctgctggaaatctgccattatgtccaca

SEQ ID NO: 73350 - DNA, 201 bp, Bos taurus
tgcatatgacaggtatcaggttaatggtcttactatataaagaatttctatagattaataatgaaaaactaaaaatgggccaagtgagtgaagtcgctcarttgtgtctgactttgcaaccccgtggactgtagcccaccaggctcctccggccatgggattctccaggcaagaatactggagtgggtgccatttccttct

SEQ ID NO: 73351 - DNA, 201 bp, Bos taurus
gagcagattgaagtaacccctcaccctagtctttctgtgatgtagcttctatctgtcctggagttacgacctgagaagcaggcttcaagagtggcatacaytttgtggcttccaaagttattctcagggcatataggctacagatggcatcctggcactcctgccttgctccagattgctggtatttcccagaaaagagct

SEQ ID NO: 73352 - DNA, 201 bp, Bos taurus
ggtggagggtgcgatctaaattacgtgggaaaaaatccgctctgaaatcttattaaaaagactaactagtcgtaaacttaaccagccatcacttgatcaarctcctctgctgcctgaagcagtgttattttaaacctctctgaggactcttggccatatttaaaaccaccttggcaagccctgaaaagtagcaagcataca

SEQ ID NO: 73353 - DNA, 201 bp, Bos taurus
tgtcttggctcatgctgccgaatgtttacttctgactcataatgttccttccatgtggagggccttttattacagcaacattcctggcctttccctacccytttactcatccctcccaggacaggttaggtgacataacagaatgatgactttgagacaaggaattgaattgtgtggctcagtttctccctcttcttggga

SEQ ID NO: 73354 - DNA, 201 bp, Bos taurus
aacatttacttaaaaaatgaacacagattcaatgtggtcctgaatcattatgctgctcaactcttttgagttctgatttgctttcttgaatgagattactkccagcatagagtggcttagccaagagagtataagtcattatagcagagaagagaggcaaagagccattggaagtggataacttagtttctctttcagctc

SEQ ID NO: 73355 - DNA, 201 bp, Bos taurus
aatgcatcagtttgaggataatatttctttaacacttccttcacatttgctaagcttcctttttagtaaagactgggcaggctgaaggcctaagcatctgracagaatttcataacaatgtgatgttttcattttgtttattttatggtcattttctattacatcagataacactgagttttcaacttatggccacgatat

SEQ ID NO: 73356 - DNA, 201 bp, Bos taurus
ttaacacagaagctcaaatatcagtcctatgaaggcagtggagttgtcaacaagttgcattttccaattctgttcagagtgagctgagaccagtggcccarcagtaacagaacttgtcattagggtctaaagaagcaccacattaaaaaaaggtgctgtccaactctgattttgccagcccattagtcccttccttccttt

SEQ ID NO: 73357 - DNA, 201 bp, Bos taurus
ccaccctcatgagaaaggtggttgtttttgtcacagtttcctttttcatagttgagggaactgagacatacagaagttaaataacttggtcaattttatakgcagcaaagaactaggatttatatatataaatcacacacacacacacacacacacacatcatctgatcccaaactctgttgatcatttttcacatatccc

SEQ ID NO: 73358 - DNA, 201 bp, Bos taurus
caaatggaaggagaaacaacatattccctattttgacatatcaccaaggactacataaatgcacatctctttcactccatctcctttagtttgttataaaygccctacggtgaaacaaccttcccttctcgcccacagacttagctgagaatatagaagtgacaggaactgatctcctaacgtgaagaaacagcaattccc

SEQ ID NO: 73359 - DNA, 201 bp, Bos taurus
tccagttatttcatcaaatactactttaggccttcctgtgaaggtactgttatagatgtggctaactttaagcagctaaccattagtaatgtgggtgaacrggcctattctaatcaagtgaaggtcttaagagcaaaaactgaggtttcccaggaaacagaaattctgcttccagactgtagcatcaactcctgcctgagt

SEQ ID NO: 73360 - DNA, 201 bp, Bos taurus
agaccagtaaatagaggaaatcacaggaaaattaagttgaaatgtacagtagacctttgaaaatagagttgtaagtctggagagagatttgtatgcaggcrtatcttggagcatcgtgaaaatatagttgatagctgaaactggagaatgtcaagcaaagaatcagaagggaaaattatcaaggataaactttaagaagtt

SEQ ID NO: 73361 - DNA, 201 bp, Bos taurus
gagaggccatattcacataacttctgttagagtatattgctataatggttctatttgattattagttactgttgtttgttttttactgtgcctaatttacrcactaaattttatcataggtatgtacagggaaacatacaaaaaaattacatacaagtggacccttaaacaacattggtgtgaactgtgttggtcctctta

SEQ ID NO: 73362 - DNA, 201 bp, Bos taurus
aactttcaccatagtataaatggtgctgacagctgcagcatctcataaccataacgtaatcaaaaggtaaaggaataaggccactatacgtaggatttcayagtattcaaatattataaaaatgttaaggcaagaggctctttctgacaacacgttaataatggtggggacaattaacctatgtccagaagaaatgggccc

SEQ ID NO: 73363 - DNA, 201 bp, Bos taurus
tccatgtgtttgagaaacagcttggaggccagtgtgaggtgagtaagggagggagtagtgggaggtccgggaggcatcctggagtcaaacctcataaaggytcggaggccacaggaggggctttgagttgcgtcctaaaagttgtgggaagccaccatcgaaaggtttttaggaaggcagtatcatgatttgacttagttt

SEQ ID NO: 73364 - DNA, 201 bp, Bos taurus
atatatgcccggccattcattataggccttgtgtacgtcctttaaattgaacgagatggaaaatactacatgggattttggagggttgtttggaacacaarcctagatttgaatgaagaattgaacttcgacatgagagtgtggtgcaaaaggactggcagagcaaagccacaggaggaggcagattgtggtgtctgccat

SEQ ID NO: 73365 - DNA, 201 bp, Bos taurus
taggaaatgaagtagataatgtttctagaataatatcctgttaaaaatacttttaactattagccaaacatttttatatatgcttcttcacaaattaatgytttcattgcaaatgatcatatttataaggaaacatgatagttaacaatagttaacatttattaaaatgaagggaaagaaattgtcaggttggctaaaata

SEQ ID NO: 73366 - DNA, 201 bp, Bos taurus
tctcaacttcctttccaaccacagagtgatttaaacttgagacttctgtctcctaaggagtccaactgcagtaccagcatgcgaattagctgtgtggcctyctggaagaccccacgcaggcttccctggttctgtgtggtgttttctgtcgaaccagcagacgagtgtgtgtgtgtgctgaccctgtcttctctcatttca

SEQ ID NO: 73367 - DNA, 201 bp, Bos taurus; identical to SEQ ID NO: 33671

SEQ ID NO: 73368 - DNA, 201 bp, Bos taurus; identical to SEQ ID NO: 33672

SEQ ID NO: 73369 - DNA, 201 bp, Bos taurus; identical to SEQ ID NO: 33673

SEQ ID NO: 73370 - DNA, 201 bp, Bos taurus
aaaaaaaataaaaatacaaacaactaattttctccataaaacactgtaggaaatccatgggtactcagagaaaagcaaagcaaagaaaccaacacaaggaratgatacttgtgaaaaaaaaaatgttttcttagtaaacttttgtaaaacctaggttaagtaaatgaagctcaaagaatgtaagacatatagaaaagatag

SEQ ID NO: 73371 - DNA, 201 bp, Bos taurus; identical to SEQ ID NO: 33674

SEQ ID NO: 73372 - DNA, 201 bp, Bos taurus; identical to SEQ ID NO: 33675

SEQ ID NO: 73373 - DNA, 201 bp, Bos taurus; identical to SEQ ID NO: 33676

SEQ ID NO: 73374 - DNA, 201 bp, Bos taurus; identical to SEQ ID NO: 33677

SEQ ID NO: 73375 - DNA, 201 bp, Bos taurus; identical to SEQ ID NO: 33678

SEQ ID NO: 73376 - DNA, 201 bp, Bos taurus; identical to SEQ ID NO: 33679

SEQ ID NO: 73377 - DNA, 201 bp, Bos taurus; identical to SEQ ID NO: 33680

SEQ ID NO: 73378 - DNA, 201 bp, Bos taurus; identical to SEQ ID NO: 33681

SEQ ID NO: 73379 - DNA, 201 bp, Bos taurus; identical to SEQ ID NO: 33682

SEQ ID NO: 73380 - DNA, 201 bp, Bos taurus; identical to SEQ ID NO: 33683

SEQ ID NO: 73381 - DNA, 201 bp, Bos taurus; identical to SEQ ID NO: 33684

SEQ ID NO: 73382 - DNA, 201 bp, Bos taurus; identical to SEQ ID NO: 33685

SEQ ID NO: 73383 - DNA, 201 bp, Bos taurus; identical to SEQ ID NO: 33686

SEQ ID NO: 73384 - DNA, 201 bp, Bos taurus
atgagcagtagagctcttttgattcatagtacctctctcatgcagtcttgaaattaacccctgaaaaagatttcagttcttccccaattgggtcatatccytattttcaggccagtcactttgtttgtgggggtggtggtgttttggtgagttagcttgggtcacttgtccacccttgaagtgagggagatgttgacattg

SEQ ID NO: 73385 - DNA, 201 bp, Bos taurus; identical to SEQ ID NO: 33687

SEQ ID NO: 73386 - DNA, 201 bp, Bos taurus; identical to SEQ ID NO: 33688

SEQ ID NO: 73387 - DNA, 201 bp, Bos taurus; identical to SEQ ID NO: 33689

SEQ ID NO: 73388 - DNA, 201 bp, Bos taurus
ttatctgagtgatatttgtaacaatgaatttaaaaattcctaaccttctggagtgattacttccgattaataacagctggtatcttttgttcttttgaggrtagcactgttagttggtaggctatgctttctatatattttgtttttgttttccccaaacttccgcaaataggaaaacaggcctaattctatgacattact

SEQ ID NO: 73389 - DNA, 201 bp, Bos taurus
ggcagacctgctcaggctctgcattcagactttccatggccagggctaattcttaccacacaacactcaggtaagaagactgggagtgacagcaccccagrtaccatgtaagtattactctctagttatcagccagtgatccttaccctcatgttaaaagctgatccccctctatctgaatatgatcagaatttttgtaag

SEQ ID NO: 73390 - DNA, 201 bp, Bos taurus; identical to SEQ ID NO: 33690

SEQ ID NO: 73391 - DNA, 201 bp, Bos taurus; identical to SEQ ID NO: 33691

SEQ ID NO: 73392 - DNA, 201 bp, Bos taurus; identical to SEQ ID NO: 33692

SEQ ID NO: 73393 - DNA, 201 bp, Bos taurus; identical to SEQ ID NO: 33693

SEQ ID NO: 73394 - DNA, 201 bp, Bos taurus; identical to SEQ ID NO: 33694

SEQ ID NO: 73395 - DNA, 201 bp, Bos taurus; identical to SEQ ID NO: 33695

SEQ ID NO: 73396 - DNA, 201 bp, Bos taurus
cctgcataataaaagcatgacaacacttgatctctaaggcctcttctggttccaacattctctgtcaatctactcatgttaattttcaaggtttagtttcyaggtctgcaatgtggcctttctacactggtaggataaaattctctatttggttcaaagactgaatatgttcatgttgttgactaatattttattgacagt

SEQ ID NO: 73397 - DNA, 201 bp, Bos taurus; identical to SEQ ID NO: 33698

SEQ ID NO: 73398 - DNA, 201 bp, Bos taurus; identical to SEQ ID NO: 33699

SEQ ID NO: 73399 - DNA, 201 bp, Bos taurus; identical to SEQ ID NO: 33700

SEQ ID NO: 73400 - DNA, 201 bp, Bos taurus; identical to SEQ ID NO: 33701

SEQ ID NO: 73401 - DNA, 201 bp, Bos taurus
ggtcactggcgttgctcaggccggggagagagtggcaggtggtccctgcttctatttccctcatcctcaccctcccattaatcaccctcttctggaactcytctcatgcaaattctctggccctcaacacataaggatataagaaaggcttttgtgtaacttggaaaaggaaggttgcagcccagaattgacacaagtttt

SEQ ID NO: 73402 - DNA, 201 bp, Bos taurus
ttaactgctttaagtcaggaaacagctgtcattaattgacatgcatctcctgtatgtagtcaacatgattcagagatcttcatcactagcgaaacattctracacttctacaaagagttatacaatttggctcattctgtatcaatagctcatctgtataagattttggaaaagtaataaaatatacagaatcctaagaat

SEQ ID NO: 73403 - DNA, 201 bp, Bos taurus; identical to SEQ ID NO: 33705

SEQ ID NO: 73404 - DNA, 201 bp, Bos taurus
taagggcccaacttgctgtcatccgcgagcccctgggaggaggaggaagccgcgcagcagcataccgctcggttccaggtcctccagccagggatccgggygagggaagcggccgagagcgaaacgcccggagctcaggggtgggagaggctcactcacccagcagcagcaacttgagctcgcggcgcgcgtccttcttgt

SEQ ID NO: 73405 - DNA, 201 bp, Bos taurus
ttctgcatatttaaatatattttaaattaaatacattcaatataaatataaaattgttttgggaggatccttgagaatatcgtgatatgattgggggtgamagggagaggaagtatatagtttgataatttaaaccattctcatggggtagataaaaaaatacttttttcccctagagaagtccagaaataccgatatggt

SEQ ID NO: 73406 - DNA, 201 bp, Bos taurus; identical to SEQ ID NO: 33708

SEQ ID NO: 73407 - DNA, 201 bp, Bos taurus
ttgcaggaaattagaccagccagtttgacaccagttaaatctcagaagcatttttaaaagatcaaatgctggaacatttaaaaagcacagcttgataacartcaattaaggtagcctcaggatgtggccaggagattttagtaatttgtgtgtgtacagcatggatggaaattctaaaaggcattgccataagagtcaaga

SEQ ID NO: 73408 - DNA, 201 bp, Bos taurus
atcctttttcctttacccctttcctcttctgctctcaccatcttttattcgtgatatgattttgggtttcatgggaaaagcaaagctagattaggaagaargaggaaatcgggcattccagaacagcatatactcaaaattcagggataaataacaccctcaaaactgaatattcttggatcaatgaaaagtgtcattctt

SEQ ID NO: 73409 - DNA, 201 bp, Bos taurus
caagtgtgtacctgagaaaataccttgctcaggcatacagtgctaccaggtacatagtctcaggcaggagaacgttattgatagcattgtttgaagtagcraagagatgaaaacaaactagaaatgaataaaaagaaagaatatgtataaaatgtaaaatattctcatgagggtctattccataggattccaaagacttaa

SEQ ID NO: 73410 - DNA, 201 bp, Bos taurus; identical to SEQ ID NO: 33710

SEQ ID NO: 73411 - DNA, 201 bp, Bos taurus
gtagtgactgcaccaatttccactcccacctatggtggaggaagattgttttttctccatatcatcttcatttgttagatttttttgatgatggccagttygacaagtgtgaggtaatatataattgtagttttatttgcattcagcaatgttgaacatcttttcatatgcttgttggccacctgtatgtcttctttggaa

SEQ ID NO: 73412 - DNA, 201 bp, Bos taurus; identical to SEQ ID NO: 33714

SEQ ID NO: 73413 - DNA, 201 bp, Bos taurus; identical to SEQ ID NO: 33715

SEQ ID NO: 73414 - DNA, 201 bp, Bos taurus
gaagcttaattaacttataatatgtggtcaatttggatggcaaaacccatctttcttccctgtgactcaaacctcctgggctttcctcataaaacacccaygtcctatttgctacccatgcccagttgccgttcgtttgtgttgacagtttcattgtttcctgctgacccctgtccatccacaattactgtggtatgtagc

SEQ ID NO: 73415 - DNA, 201 bp, Bos taurus; identical to SEQ ID NO: 33730

SEQ ID NO: 73416 - DNA, 201 bp, Bos taurus; identical to SEQ ID NO: 33731

SEQ ID NO: 73417 - DNA, 201 bp, Bos taurus; identical to SEQ ID NO: 33734

SEQ ID NO: 73418 - DNA, 201 bp, Bos taurus
ataaagagataggacaatatgaacttataaatatatatctgctctcataatttatgctttacagacatagcaatagggcctatagcataggatactgaaartatgactccccaaacccaaaattacagttctagaacaaactattcttgtcagttaggccccctccagcttagaagcaattactggagccacagcaaaaac

SEQ ID NO: 73419 - DNA, 201 bp, Bos taurus; identical to SEQ ID NO: 33737

SEQ ID NO: 73420 - DNA, 201 bp, Bos taurus; identical to SEQ ID NO: 33738

SEQ ID NO: 73421 - DNA, 201 bp, Bos taurus
gaattttttgtggaactctctctccagtataatcactaagacaattcattgatcagatgtctaagttgaagatttgaatattctaactccaaaatctaacrgtgaagtctgttatattacacagatacagcttcagtgagcctttagcactctgggtattgtgcatgtcctctagtaattcatcatctgtgaatcttgagg

SEQ ID NO: 73422 - DNA, 201 bp, Bos taurus
ggccagctgttaccaagccagcccctttcattcagggcacacagacaaattacattcccagaattcactgcagttagttgcggtcatgtgaccgggccctsaataataaaatgggagaggaagtgatattctctactttcagaattggcaataaaacctcccctgtgattctccactagcactctttcctcataggccagt

SEQ ID NO: 73423 - DNA, 201 bp, Bos taurus
catgttattatttaaattatatcattctctttaaaatgctttcattgtctacataaagcctcatatcagaagaagctggccaagtctttttaaatatgacmattttggatattctcatttgtcactctgatccactcttcatttacccccaccctgctttctggcctaggaacctgacttccatggagagtaacaccatga

SEQ ID NO: 73424 - DNA, 201 bp, Bos taurus
gatatcatacagtatttgtccacgagaacttgaagttttcttatctttttaaagatgacaacaacactttcccaagctgatagagttgttactgggagtcmataaggcaacatttgcacagaggtgatggaatagctagaatgctacatcaacagtaggttttaaaaaacaatacatactattaaaaatgttatctatcaa

SEQ ID NO: 73425 - DNA, 201 bp, Bos taurus; identical to SEQ ID NO: 33745

SEQ ID NO: 73426 - DNA, 201 bp, Bos taurus; identical to SEQ ID NO: 33746

SEQ ID NO: 73427 - DNA, 201 bp, Bos taurus; identical to SEQ ID NO: 33748

SEQ ID NO: 73428 - DNA, 201 bp, Bos taurus
cagtataaacttaggagagtctctgtaggatgatataacaaagcatggttatttccataattgcatttggtccagctcttgggccaccacatttctgatgytccagtgaagtagaaaagagctcatagattttcaaggctgccacccaagccagaggtaggctgttaacagttcaagacaggagaaaattgtaatatatgg

SEQ ID NO: 73429 - DNA, 201 bp, Bos taurus; identical to SEQ ID NO: 33750

SEQ ID NO: 73430 - DNA, 201 bp, Bos taurus
aaggtcccacgtgctgcatggcacagccaaaaaaatcaaaaacatcaagaacatgcaggaatgcttctaatgaccactggtgttttttgattaatagatamgtgatttgttttaaatgttaaaatttggtaatgaacaaagcatttgttccttaaataagatattgactgcaagtttaatacactctggtcgtctttccaa

SEQ ID NO: 73431 - DNA, 201 bp, Bos taurus
tatcaataggtgcagaaaaagcatttgacaaaattcaacatgcattttcagcaaactaggattaggcttcccacctgacccaaactatcactggatagatrttaaagtcctgacactcctccaggcttcctctgataccatcccagcagggaggtggaagaataaactccggggggctggaagtcccagctccctatgtgg

SEQ ID NO: 73432 - DNA, 201 bp, Bos taurus; identical to SEQ ID NO: 33753

SEQ ID NO: 73433 - DNA, 201 bp, Bos taurus; identical to SEQ ID NO: 33754

SEQ ID NO: 73434 - DNA, 201 bp, Bos taurus; identical to SEQ ID NO: 33755

SEQ ID NO: 73435 - DNA, 201 bp, Bos taurus
ggccatactgttgccagagatgggaatgcaggctgatgggaactcaggctgagccctcagtgataggttttcctgtgagtgaaggatgggagaacttcctytccaggcctggaagccctctgggtgagaacatgctgggaacttgcccagaagtggctctgggctctaggttcttgattcccgtcagatccaaggtctctt

SEQ ID NO: 73436 - DNA, 201 bp, Bos taurus
tctgctccagaggtgctggccctccctgcagtccctcagcatcatactgagctgagtgaggattacaggctaaagcagaggacatgaggggccaagagagmtctgggtttggtgaaagagcaacagggtcatgctgtaggtggaagttgctccagagttacaggccaagcaggtgactggcttctggatagttggagatct

SEQ ID NO: 73437 - DNA, 201 bp, Bos taurus; identical to SEQ ID NO: 33757

SEQ ID NO: 73438 - DNA, 201 bp, Bos taurus
gcctctctgattttaagcagatgacttctgtgagcctcagctttcctatttataaaatgattgggctggatgagataaattctataagccctgattctctrtagccttagagtctaagtctggcctaaaatcaagtaagcaaaatgaatgtattcataatcctggatgccattagagtagtcaaatatatgtgtagacaga

SEQ ID NO: 73439 - DNA, 201 bp, Bos taurus; identical to SEQ ID NO: 33758

SEQ ID NO: 73440 - DNA, 201 bp, Bos taurus
gtatcacctttcctattgagttcaaccaccggcccctgctctcttttcatcaggacaacatcctctgcgtgtacagccaccggcagagtgtagagatcaayctgcagaaggtaaaggccaacaagacaaccacctcagtgcctcttttgcccaacaactgccccttggatgtgtcccatgctatatgctctgttggagaca

SEQ ID NO: 73441 - DNA, 201 bp, Bos taurus; identical to SEQ ID NO: 33759

SEQ ID NO: 73442 - DNA, 201 bp, Bos taurus
agcagtcacttgggacctcagagtttcctgccacattgccttgtgaagaaattctgagacctttcctccagcatggcctctggttccaggtttatgtaggygggctcctgggaaggatcataacactccagcccccagggcacaagccaggccctctctggagagtcagccttgttggaccctgcatggtcaaagagctgt

SEQ ID NO: 73443 - DNA, 201 bp, Bos taurus; identical to SEQ ID NO: 33761

SEQ ID NO: 73444 - DNA, 201 bp, Bos taurus; identical to SEQ ID NO: 33763

SEQ ID NO: 73445 - DNA, 201 bp, Bos taurus; identical to SEQ ID NO: 33764

SEQ ID NO: 73446 - DNA, 201 bp, Bos taurus
gctggggccgcgggctgctgacatgccagcccatccctgcccagccctcccctcccacagaaaggccaagtcaggtaccagggcctctgagaagcaaagcrtagctccgactcttattcgtaagcctctgccggttctggtatcacctatgccctgcccctctcctgggccatcaggatcacagaagggagactgcaacac

SEQ ID NO: 73447 - DNA, 201 bp, Bos taurus
caaaagtgctccataatctacaaagtgctactgccagtattgtcagaggggaagaactgctaagaattctgaatggcctcactcttccaggaagccctccyggacttcccctcttgtgttcctagaaccctaaagtgcatgcacatccctacagctgcacttaacactctgtattgtatacttcattatttaagggccctc

SEQ ID NO: 73448 - DNA, 201 bp, Bos taurus; identical to SEQ ID NO: 33774

SEQ ID NO: 73449 - DNA, 201 bp, Bos taurus; identical to SEQ ID NO: 33775

SEQ ID NO: 73450 - DNA, 201 bp, Bos taurus; identical to SEQ ID NO: 33776

SEQ ID NO: 73451 - DNA, 201 bp, Bos taurus
ggaactttcagatcagaggcagagagagcatccaggcctggacgcagcatgctgtgtgcgtctgcaggagtcactgcccttcctccttcctgcctgctgtmcatcttgctctcgtagcttagaggacaggatagaccgcacgtaactgtgatgcgcagcaggatgaatcccttttgaggagagtcaaagcattaggctcgg

SEQ ID NO: 73452 - DNA, 201 bp, Bos taurus
cacttgatgagtaaaatacatggggggctatggttctccagaatgagagaaagagctcaggaacaataggctcccataaggccaaatcattctcacctccrtagctcacaggtcctccctacagcccacagaggcaatgaccaggcaggttggtagattgggcattggagctgggctttgacagatgagtaggagttcagt

SEQ ID NO: 73453 - DNA, 201 bp, Bos taurus
aggacagaggggccattctgggcaagattgctgtgttcttcccgccctgctccccacaacctgtagcatggagcgggacattgatcacggggccaggtgtkcagagcactcaggctactggttaaccaggtgaaggacttcagtccactgtgtgatcaggaacccagggcgggggagttccagacactccctcacctagca

SEQ ID NO: 73454 - DNA, 201 bp, Bos taurus
caccccctggctgaagtcctccaacatgctggggccatccgagctcctgtcttccgatttgccctggtcacttgcccagtgggatggcttcccaggctccyctctctgctgttcaaagagaatgacaactccatggaattccaacagggacacagaaaagacaagttgaaagtatatagggaacttggaactccagtagtc

SEQ ID NO: 73455 - DNA, 201 bp, Bos taurus
actttacactgttttgtgctttctgagctagagttccccataacgttgaccaggtaaatgtccaactaaacaggaggccggggggattggaggcccagtgrgatttggaggacagagaactatggttttcaaaacaggctgtctctgcgagtagggggcaaccacctggaaacccagcgtccctcaagccaatgggagatc

SEQ ID NO: 73456 - DNA, 201 bp, Bos taurus; identical to SEQ ID NO: 33784

SEQ ID NO: 73457 - DNA, 201 bp, Bos taurus; identical to SEQ ID NO: 33785

SEQ ID NO: 73458 - DNA, 201 bp, Bos taurus; identical to SEQ ID NO: 33786

SEQ ID NO: 73459 - DNA, 201 bp, Bos taurus; identical to SEQ ID NO: 33788

SEQ ID NO: 73460 - DNA, 201 bp, Bos taurus; identical to SEQ ID NO: 33791

SEQ ID NO: 73461 - DNA, 201 bp, Bos taurus
cagaccttacctgtaccagattccagccttggagggactctgcgatgatggacgtaacagacggacagactcctccaaacaccatcaagtggttcggcccrtattttattgcatcgtagaaggctttcaacccttttgcattatcacactggggagcaacacagaaagagtagccaaaattagaaacagctttccccaggg

SEQ ID NO: 73462 - DNA, 201 bp, Bos taurus
cttgaaactgagtcactgtcacgacaaggtcttagtatagtactgtctatagagctttttgcaacgatgaaaatgttctatatctgtgtagtctaacaggrcaactactggccacaaatagctataggatacttgagatgtggtagtgctactgaagtgctacattttttactttaattaaattcaaattaaataactacc

SEQ ID NO: 73463 - DNA, 201 bp, Bos taurus; identical to SEQ ID NO: 33916

SEQ ID NO: 73464 - DNA, 201 bp, Bos taurus
tgttttataccaacatgtttgcagagtataaacatcacagtgcaaactcttgcacccaagaaccctgtgctgctagtggacaatctttggaaaagtttgartttgtaaactgataatacatataattccatgggctccatatggttcctgttatgctgagggaactatacacatttgccttgccccaggatgaaaagataa

SEQ ID NO: 73465 - DNA, 201 bp, Bos taurus; identical to SEQ ID NO: 33918

SEQ ID NO: 73466 - DNA, 201 bp, Bos taurus
ttcttttgtgccatgcaaagtgctcaaaacgttgtagtgctcaagactgaaatgacaaaacccagagtgatccagaaagaactataaggatgccagttccrtaggaagatttatacacttatttttctccaggcttctctctggtcctggtgcattttcagaaggtcggcaccttgcagcaccaggggccttacaggcaag

SEQ ID NO: 73467 - DNA, 201 bp, Bos taurus; identical to SEQ ID NO: 33920

SEQ ID NO: 73468 - DNA, 201 bp, Bos taurus
agaggaaggtggaggcctggcctctaccttgtcctccccgaggccactttgcaggaaggaagggctgacatctccttcggcagtgtggcttctccgaggtyggtgtttagctttgtgaggccgtggttttctaatcctctttggtttctagtcatttgttcagggcatgttccctggcagccccatatgtaccaagcagcc

SEQ ID NO: 73469 - DNA, 201 bp, Bos taurus
tggcctggggagtagcttgctgaggttggagcaaccaaacaagggacagacccctctgagcctccatgggatatcctgagggtctcctgcaactgtggctrtctggggcaggaggccccaatctccagtcccctgacaaggtcaccgttcataaaatgtgtgagttgctcctgacatgacaccctctctttgtaaaggcat

SEQ ID NO: 73470 - DNA, 201 bp, Bos taurus
cgtgtttattcctcgctggttgtttccacctggcaaagagaagcatgccacgtgaaacgcttcagcaaatgcaggcagggccccttgtacctttcagtccyggtgggcacagtgaaataatcacacaaagactgacctcgttttcggcttgcttccgtgaagcaggccccgaactgcgttttccagagcatctgcttggta

SEQ ID NO: 73471 - DNA, 201 bp, Bos taurus
tgaacattggggcatgaatggctacataaagatggccaaagaccggaacaaccactgtggaatcgccaccatggccagttatcctactgtctaaatctcaraggctggattaagaacaatatccaaaggaaggattttctcttaaaactgaccagactttattgtgtgggaatgaaagacttgaatcattgaagatccaag

SEQ ID NO: 73472 - DNA, 201 bp, Bos taurus
ggattctggagacttgaggtggtggaggagaaggtcaggcagaattggcgtggagctgtcatgtcaatagacagtcttcccacagagggacaacccaaccrtccctaaaagttctcacaggacatttggcagcatctccagtaactcagccaatattactcactactgtaccaacctagtgtgcaaaaaaatatatataaa

SEQ ID NO: 73473 - DNA, 201 bp, Bos taurus; identical to SEQ ID NO: 33923

SEQ ID NO: 73474 - DNA, 201 bp, Bos taurus
caactgtggctagagcaggccaaattggattttccttatagcttttccttcacctctgagagtgatgtcattaaacggtcaggccatgaaatgctaaggayagcctgtttccactgtaccatgggtcatgctggaatgccagggaaatataccccagaatgtcataaagctttaaagacatacaataaaacctgcatggag

SEQ ID NO: 73475 - DNA, 201 bp, Bos taurus; identical to SEQ ID NO: 33926

SEQ ID NO: 73476 - DNA, 201 bp, Bos taurus; identical to SEQ ID NO: 33927

SEQ ID NO: 73477 - DNA, 201 bp, Bos taurus
atacaaactgataccagatagtgggctgcagacaacacatctttgcagaaaggaggggaatttagaacggctcctaggccaagtcaggtaaaatggcagcraaactcctgttcctattatggaactggaaaccagaagtccatggaagagggtaacacagatcaatgaggcatcaccttcacacaagggccctgaatcatt

SEQ ID NO: 73478 - DNA, 201 bp, Bos taurus
tttattggtccgatgggggtactctgtttatgagccactgtatgcataacctctaccaggccttaagtgtgatgaaaaagcagcaactcatgtttactccygatcatgtcgtgctttctgtcatcagttactgtcaggggttccaccatagccagagtactcacacgaaaatagaggggatcctctacacggcacaaccat

SEQ ID NO: 73479 - DNA, 201 bp, Bos taurus; identical to SEQ ID NO: 33930

SEQ ID NO: 73480 - DNA, 201 bp, Bos taurus; identical to SEQ ID NO: 33931

SEQ ID NO: 73481 - DNA, 201 bp, Bos taurus; identical to SEQ ID NO: 33932

SEQ ID NO: 73482 - DNA, 201 bp, Bos taurus; identical to SEQ ID NO: 33934

SEQ ID NO: 73483 - DNA, 201 bp, Bos taurus
ccgccaaattaggtttaccttctccctttggggaaaaaaagaattaaattatgttttggctgtattgatggaaaacatgaaaagcaaactccggggcctcrtgcctcaagggcacttgatctcccgttagctgcaaacaagaaagtccgcgagcccctctgtgagcagcaagcattgggttgccgatctccaccgggccct

SEQ ID NO: 73484 - DNA, 201 bp, Bos taurus
aaattacccctgggctcatccaggagcaagcctcctgaggccaaaaatgggacaacttcttgaggaaacatattaatcttgaattttttattttcctctamagcagggatccttacttttttcagtgccatgaactacaatggcagtctatagatggctacagcctccttctccaaataatgtttttaaatgcaagaaata

SEQ ID NO: 73485 - DNA, 201 bp, Bos taurus; identical to SEQ ID NO: 33936

SEQ ID NO: 73486 - DNA, 201 bp, Bos taurus
acagtcaagagggttggaaaaagcagagagaataaggaacgagaaggatggaaaatctactgtgactaatcttaaattctccagggcctttacacattatkaagagcttagaatttcagcattttgctttttcctttaaaagtgtgacttaaaagcttattaattgtgtgcatggggagaagacagtttggggattcttct

SEQ ID NO: 73487 - DNA, 201 bp, Bos taurus
gtttttggtatacctcaccaatttattgagcatatttctcagatgcaatggtttctccaggactcagaaagctgtcatggatcagacaccatcaaacagtrcccaagaccttttttagtgcaagtttggctttgaaaagagctttgaagcttcttcttggtccaccactgagttggtcgtcaacagttgtataaaatccac

SEQ ID NO: 73488 - DNA, 201 bp, Bos taurus
agcacctataaaagaacgtgaaaatcagaatgcttttcagtttaagtcacacaccaaatctagttcttaaaatatttagccatcttcatctttagtgcctytaatttaagaagcaatactcaacttaaaaggtgctctgtaattacctcctttaccaataaataagatattcttaaaaagaaaacaaagtatctcatttta

SEQ ID NO: 73489 - DNA, 201 bp, Bos taurus
caatcatattacacgtatgtatcaaagtaacacattgcatagctttaatttatacagtgttgtaaggaatatttgttcaattttaaacatagagtttatgktagaagtttttagtcatgcagtatcagcttaacttctggagaccaaggtcagctttctggggtgttaaccatgaagctccagtaaacactctggatactg

SEQ ID NO: 73490 - DNA, 201 bp, Bos taurus; identical to SEQ ID NO: 33938

SEQ ID NO: 73491 - DNA, 201 bp, Bos taurus; identical to SEQ ID NO: 33939

SEQ ID NO: 73492 - DNA, 201 bp, Bos taurus; identical to SEQ ID NO: 33940

SEQ ID NO: 73493 - DNA, 201 bp, Bos taurus; identical to SEQ ID NO: 33941

SEQ ID NO: 73494 - DNA, 201 bp, Bos taurus
atgatacccagaggcatctgagtcagacactcagggtgtaactttggagtttgttcagtggccaaaattttcagaatagcggatgttttcatattcaattygagtcatggatattgcgctgatacggtctgtgcaacttagatcctactcttaggcatgcagagaagtaagacatagtctaaagtgaaaacaaaagacact

SEQ ID NO: 73495 - DNA, 201 bp, Bos taurus; identical to SEQ ID NO: 33942

SEQ ID NO: 73496 - DNA, 201 bp, Bos taurus
agcctccacacccggaaccacttggggcacgcagagcagtcggttaaactttaacccaccttgcggccagcatcgcctggtcctcggacagcattccagcyggttggggtgtatctttttgtatgtgagggaagggaagaaccagtgcggaaatgcaaatgcactgtcgtttagtgacccatattgcgaaaaccagcaaaa

SEQ ID NO: 73497 - DNA, 201 bp, Bos taurus
aagtcaccccatggaaggctgaggtccacagcccctcttgctcacggctgggattggaacacaggctttgacctgacaggaggctggggcggagtagcacrgtgatctggccctgcagggtggtggcagggagcccagagaggtgctaagtgtgccgcacttcagcttctcagcctgacagcagctggaggttcatggatg

SEQ ID NO: 73498 - DNA, 201 bp, Bos taurus
gccatgttcagaaagtggttgtgtcctgttagtcagaagctgtggtcagacccatcgatcctccctgcccgcccccccccccccgctcccgctcttcatcrgaacagagacgggcgagggccaagcctttctttgtgcacacgaacagtgaggtctgctgtgcttttctcacatgtccatcagcagcaggccggatgtcgt

SEQ ID NO: 73499 - DNA, 201 bp, Bos taurus; identical to SEQ ID NO: 33947

SEQ ID NO: 73500 - DNA, 201 bp, Bos taurus; identical to SEQ ID NO: 33948

SEQ ID NO: 73501 - DNA, 201 bp, Bos taurus; identical to SEQ ID NO: 33949

SEQ ID NO: 73502 - DNA, 201 bp, Bos taurus; identical to SEQ ID NO: 33953

SEQ ID NO: 73503 - DNA, 201 bp, Bos taurus
tgtgtgcaggcaccatcctgagtcgtgaaaaacagaaaagtgcttggagatcttgttctggaggggaaacagacatgaataagaagaagacaaaaaatgcrtaatgtgatttctagggatatgtgccaagagccctggagcagggaaatgggggaagtgggttgggggcctaggttgaaagctaccatacaatcatgggca

SEQ ID NO: 73504 - DNA, 201 bp, Bos taurus
ctgcagatttgccttttcgcagttttggaggaacagagaaaacgggtattgggtggagctggatgagaagccacagagggccctgggaatctggagatgamctctggctcctgcctcctctctgagccttaaggaccccaatatgattgaggaaggccagaggctttgtaggtctctctcttcatcatcaggggaatatta

SEQ ID NO: 73505 - DNA, 201 bp, Bos taurus
ctcactagggctactccttagcactcccactgagcaccatctcacacagttcataccctctccccttggagaccagccatctcaggccttgttctttcaarctgtcccctttcagccctgtcttggtggcaggggactgccaaagcctgaagtttctctaccttggcacacttgagtcccagcaagaacaccttccccgcc

SEQ ID NO: 73506 - DNA, 201 bp, Bos taurus
ttctggtaccatctcttttcagatgtgtgcacacaccccaaggccacagtcttgcttgtcctgatgtggctttgcacatttatgttgatcatgtgatctcmtcagttaaccactggactggcatggccatgtgggtctgggctaccaccatgatctctggaaatcacagaagacctcctagggtaactgaacatggggagg

SEQ ID NO: 73507 - DNA, 201 bp, Bos taurus; identical to SEQ ID NO: 33960

SEQ ID NO: 73508 - DNA, 201 bp, Bos taurus
gccagaaattttgcctaaaactggattaagcaagaaaagaaatggctcagaggaggatatgcagattccattgcttatgtgacaaggcctcagtgtctgcytgtcagctctacctccaccccccccaaccacacccccaactccatccgcaggtgtttctctcactcaagcagcgagcaacgtgcagcatagtatgtgaga

SEQ ID NO: 73509 - DNA, 201 bp, Bos taurus; identical to SEQ ID NO: 33961

SEQ ID NO: 73510 - DNA, 201 bp, Bos taurus
ctggagtggggtgctgtgccctcctccaagggatcttcctgaccctgggatcaaacctgggtctcccacattgcaggcaaactctttgctatctgggccaygagtcagctggatcacagattctctgagtgagaatattcctctaaggtcagcatttctgagcccatgggccttgcagggacacaggagcagacacacggg

SEQ ID NO: 73511 - DNA, 201 bp, Bos taurus
agaaaacacatatgcgtgtacattcttagatcacagattctctgattcagttttgaggcgccaaaggaggaaaacagagggaagctgttctccaattcatrgttattaaatggaaaagcaagtttggtataatgatacagcacatttctctaacagtggtctacactgtttttttctgatatatctggtgacttgcagcag

SEQ ID NO: 73512 - DNA, 201 bp, Bos taurus; identical to SEQ ID NO: 33965

SEQ ID NO: 73513 - DNA, 201 bp, Bos taurus; identical to SEQ ID NO: 33966

SEQ ID NO: 73514 - DNA, 201 bp, Bos taurus
acatttatttctcacagttctgggagccggaaatcaaagatgaaggcaccagaagaaacagttcctggtcagggctctattcttggtgtgcagatggccamcttctggttgtatcttcacatggctttccccagtgtgtgaacatgaagaaagagagacagatcttataagcacactaaccccataacgagagccatatga

SEQ ID NO: 73515 - DNA, 201 bp, Bos taurus; identical to SEQ ID NO: 33968

SEQ ID NO: 73516 - DNA, 201 bp, Bos taurus; identical to SEQ ID NO: 33970

SEQ ID NO: 73517 - DNA, 201 bp, Bos taurus; identical to SEQ ID NO: 33971

SEQ ID NO: 73518 - DNA, 201 bp, Bos taurus; identical to SEQ ID NO: 33972

SEQ ID NO: 73519 - DNA, 201 bp, Bos taurus
acacacacacacacacacacactttctgctctagcatcctgaacctggtaatacctacatctccttctgatctcgtgcctttgatccagggccctcccctrctcccttcccattttccgtctgagttcctcaccagctgactctcacaaattcttcttagaaatggcaaaagtcagatatcatctcctctatgaggccaga

SEQ ID NO: 73520 - DNA, 201 bp, Bos taurus; identical to SEQ ID NO: 33973

SEQ ID NO: 73521 - DNA, 201 bp, Bos taurus
ctgggcacacaagaaaagattacctttgatattcccaaactacagtcaagagatacttgattgtaggctgtcattgcaataggccacggcccctgtggttycagcaggtcaaactgggagccagtcttccaccttgcctcacttccatcatacagaaacatgaggcagcaacccagcaacccgctcagcagtgtctacaag

SEQ ID NO: 73522 - DNA, 201 bp, Bos taurus; identical to SEQ ID NO: 33976

SEQ ID NO: 73523 - DNA, 201 bp, Bos taurus
cctcctcataccaccttccttctcaccaactctaagccaccatactggctctgttggcacagccaagttcaggtggggcctggactccatggctccccaamtgcgcccttgctcagagtgcccgttgcctgagaggacctgttgagaggtcacctccccagggggcctggcctaaattctcacaactctccaacagtccat

SEQ ID NO: 73524 - DNA, 201 bp, Bos taurus; identical to SEQ ID NO: 33979

SEQ ID NO: 73525 - DNA, 201 bp, Bos taurus; identical to SEQ ID NO: 33980

SEQ ID NO: 73526 - DNA, 201 bp, Bos taurus
gcgctggtgcccctctgtcctgctgaggatggggctccgaagagccaggaccgggctagccagagggctgtgtccaggacctccctccgtggccatcaccygactctgatcttgttgggtccctttatagtgagtggaagcttctacacctgcagccacacctggacccgctctgtccagcaccgtggccgacaccattca

SEQ ID NO: 73527 - DNA, 201 bp, Bos taurus
taggtaagaatcacctggtaggcctaagcagatatagcttatgcaaactcagagggctgtggagggctgagaatgtgcccacaggacaggactctgctggmacttctgctggcccggcctggaactttgtgtcgccttctagacctcgggtgctacaggggtttagaggagctcagaagggagtggcagtcgctggcttgc

SEQ ID NO: 73528 - DNA, 201 bp, Bos taurus
gtattggagtttcagcttcaacatcagtccttccaatggacacccaggactgccccatgcatcatgcacacatatgtctgaggcatccttggaggatctcygggatggcccagtaggcaatccctggcaacactgctctctctggagaagtagtgctcttatgagcatggtgtgttttggagggatgggtacctgtcagat

SEQ ID NO: 73529 - DNA, 201 bp, Bos taurus
atttataaacattcaacaaaattagcctcatgtggtatttaatattgttggtaattgctgtgagtgttttttccttagaattctagcattaagtcataagrggatgatgaaaaggaaggctaatgtaattcaaagggcgtaaaacctcagagttgatcctaggaagtttttatacttcttcctcccatggggaagccctct

SEQ ID NO: 73530 - DNA, 201 bp, Bos taurus
gagtcaaactctggggtggagagggcttagcactctgggctcaacaaggccttcgggtgcttctgatgtgtgctcaattttaagagccattattctaagcwtggtttccttcatgtgccttttaaagtgaaagtgaagtcactcagtcgtgtccgactctttgcaaccccatggactgtagcctaccacgctcctctgtcc

SEQ ID NO: 73531 - DNA, 201 bp, Bos taurus
tcaccacatagtccttcaggtccatcgtctccccccgcatcctcatctgtgtgcatccatcccagctgtgctgtctctcctcatgtgcatgaaggcctccygccaccgcgtgccctcgttggacttcctgcgagagagggaccgaccaggctgcggggctaggcaccctggcctcctccacccccgcgacgtccaccacag

SEQ ID NO: 73532 - DNA, 201 bp, Bos taurus; identical to SEQ ID NO: 33982

SEQ ID NO: 73533 - DNA, 201 bp, Bos taurus
agttgagtcttagtgcttagaattgccacatttggtgatgacactttacttgccctaggaaataagcaaacaacttgctccaaggccataggatacctcargattcattcagtaagactctctttaactacaatgaggtatctcctcacactgtttagaatggccatcatcaaaaaaagtctacaaacagtaaatactgta

SEQ ID NO: 73534 - DNA, 201 bp, Bos taurus
ccatgagcagaggagcctggcgggctacagttcacagggtcatgaaatagttggacacgacttagagactaaacaacaacaactagactataatccccatragggtagcagtcttgttcagtgttgttatttgccaccatctagaataggtcctggcacataagtggtgttcaataagcaatggttaactgaatacataaa

SEQ ID NO: 73535 - DNA, 201 bp, Bos taurus
cgtctcctgcattgcagatgaattctttaccactgagccattggggaagtctaaagggatacccccaggcattaaaagcaggagaagattcatgacccatygcttgcaggaccagttaagaagagatgtctgacccttgaaccattgaaggagacttactgttatggtaggattctggttatataactctctgatttagaa

SEQ ID NO: 73536 - DNA, 201 bp, Bos taurus; identical to SEQ ID NO: 33983

SEQ ID NO: 73537 - DNA, 201 bp, Bos taurus
gaggaagaggtggggaaggattccttaggtttcctggccctgtagcccccaccactgtgtgctgctctgatctccccctcctagtggccaaagtggtgggkggtcatgcctagagactggagttatgtcctctcatctccctctgcaccagccaggatctgaggtctgacccccagtggtccttgctccctggaggccacc

SEQ ID NO: 73538 - DNA, 201 bp, Bos taurus; identical to SEQ ID NO: 33984

SEQ ID NO: 73539 - DNA, 201 bp, Bos taurus; identical to SEQ ID NO: 33986

SEQ ID NO: 73540 - DNA, 201 bp, Bos taurus; identical to SEQ ID NO: 33987

SEQ ID NO: 73541 - DNA, 201 bp, Bos taurus; identical to SEQ ID NO: 33989

SEQ ID NO: 73542 - DNA, 201 bp, Bos taurus
taggccttgccggtactgctaatataaaacacaaagggctagtgtttagaaaattagtgcatagagtgttatgaacataaactggaaaaacaaaaaccccraggctgtgtactggccttcattagattggttgagaaagctgaaagctatcggttagcgtactgcataaataacacttgccagcaatgtgttgaagaccaa

SEQ ID NO: 73543 - DNA, 201 bp, Bos taurus
agtggccgtggagatggaaatcagaaccaaattcaaagggaaatgcaggaaccaatgacttggaagtctgaaaaagcactctagtccctctgaccttaatracataacacattcccttggccactttacagaggtcccagttcaaacaggcactcctatttacctctcctccctgtgaatctcaaaaaaaattttaaaaga

SEQ ID NO: 73544 - DNA, 201 bp, Bos taurus
cagtgtgcactctccagtgctccataatctctggcatttcctcagctggccttcagctccctcgttcactctgaaatccatcggtcacaggcagaactccygcagccttgggatggggcagggagtccctctgttttccctcctggtgctcctgtcttgtgtgctccttcattttccctccctcattttaccaaagtgttg

SEQ ID NO: 73545 - DNA, 201 bp, Bos taurus
tggagctctgatttggacattccattccttttcttcttggggagaaaagtgtgaccaatgatgatggtgggccttcaaagatatgtgccgaggaatattcygtaaatgaagatggcaaggataactccttttaattttcttgtattctgcagtccttgcctaatttatcctcatagcatcccggagaaatagaaaagagat

SEQ ID NO: 73546 - DNA, 201 bp, Bos taurus; identical to SEQ ID NO: 33994

SEQ ID NO: 73547 - DNA, 201 bp, Bos taurus
atatcctgtaatcctttcaaatgaggacacagaggtcatggcaagcagcctgtcaaactccacataaacatacattaaactttagatctgtccaacacgargactttgctctttgtttcacagtacattgtcccttactgggaggttttccttcaattcattttacagaatctagtatgagaatgtttgtatggtcttatc

SEQ ID NO: 73548 - DNA, 201 bp, Bos taurus
aatttatttcattattatttaaatttggacgtgagctcaaaatgtgttgttttaaaaacttagtaaagagttaactgcaaacacaggggccttcatatccktagctgtaaaggataagaaaagtgaattataatttcagtcagtaacctacatcccacctcacccaacactctgtcaagttgcagataatatggaaagatt

SEQ ID NO: 73549 - DNA, 201 bp, Bos taurus
tttgtaaacatccaagggctcgcatttcaaagcagcatatatttattgctacataaaaagtaagttaggacatgatacatgttgggtaaagcaaaaggccrtgccaaaattcatattgttaaaaagaaacttgaggggaattccctggtgatcaagtggttaggactttgcagtttcactgacaagggccagggtacaatc

SEQ ID NO: 73550 - DNA, 201 bp, Bos taurus
taacaaaccagttaaacattctttgcttcatttatatgtagtattaaatgaggatattcttatccatgttgtctatgtaactattatattatggtattgartagacagtgcctttagaacaaaataagaaatagagccagccatagagtattctggtaatgaaataaaactaattctgccttttttctttcaagaaatgtc

SEQ ID NO: 73551 - DNA, 201 bp, Bos taurus
caaggatgactttgctaccattcaagctcaatgggaggtgttagaattcctataagaaaggtcattataaagataagtagctttaaatccaatgtcattaytttcatcattcataattgctgtttgcacttgctttagtacacatttgctttgttgatttatgttgttattcctcccatatgagcgaattaaattgctaca

SEQ ID NO: 73552 - DNA, 201 bp, Bos taurus; identical to SEQ ID NO: 34003

SEQ ID NO: 73553 - DNA, 201 bp, Bos taurus
ctatccttgcttgatcctcacaataagaagtataacaaaagtaatccagtcattcctttctaaaagagacattcctgaaattcagtgttcgtatatctagratttatgttgtgataataacattgtttagcattactataactttaacctaaaaagaaatgttactatctataggtgttacatcttccagaaattcttaac

SEQ ID NO: 73554 - DNA, 201 bp, Bos taurus
ttgatgcattttgtttgtccttgacagataataacaattcaaccctgttttcaagacgttgatttgtattttaccctagacaagaacaatttacactgatmtagaacaagctttctgtatcgttacccatttcacctgttcccaatataattgccctattaactgtactttaaaagaaagagcagatgttttcaatgtgtg

SEQ ID NO: 73555 - DNA, 201 bp, Bos taurus
agggactagattttcaggtagccatcctctccttgtgtccttacatggcaaacagtgagagaagcaagctctctcttcttagaagggcactaatcccatcrtgagtactatctcccaaaaggccccatctccagaaaatgtcacactggggattaggcttcaacatataaatttgatgggtgggggagagacataaacatg

SEQ ID NO: 73556 - DNA, 201 bp, Bos taurus
atatatttgccaatcactattatttaatatcattattattaataaagacttggcatataagagaatacaggttggtctggatacaagagttggcccacaayaggaattgaagaagcagagaatagaagaaggcagatgagcaattatgatgtgatgagcatgattggggtttagagtgtgaagtcaggaaataggagacat

SEQ ID NO: 73557 - DNA, 201 bp, Bos taurus
catcttagttctttatgtgggcaaggttgcattaagccatggcccaccagaatacaggttcatcctgtatccacccactcagccacattgagatatgtatyagaaaaagagtaaggcctatctgaaaggagaaatattaagcctgactaatttcagcctttggggcatcagagttctctactccctagtctatctcattgc

SEQ ID NO: 73558 - DNA, 201 bp, Bos taurus
cttttttctctaagattacaattttgtttgtatgacatgtaaggatgtgtcttctcacatgtgttgcatgacccacaaccaacacaaaccagaattccagyggcctagaggaaaaaaaaaaaaaaaaactgttttaactatttaaatcatgattgaacttgaaacatgaaagaacatgcaacatcattatttttttcttat

SEQ ID NO: 73559 - DNA, 201 bp, Bos taurus
tcgatctcagcttgtggaggacgccgggctgacggggcgctcagccccaccccctaccccctctggaggaggagccgacccgcccagagccggcctcccgmagttgtgcaggcgctgctccctgcaagtcaggaagacacaagaagaggaatttaaggaagagtgccggccgttgcccttctcagccctcgaagccgcatc

SEQ ID NO: 73560 - DNA, 201 bp, Bos taurus; identical to SEQ ID NO: 34012

SEQ ID NO: 73561 - DNA, 201 bp, Bos taurus
aaatacattctcgctaaacagaaaaagttgagagaaaggctgaagttacaggaaaatatatagaataagataattgttacaatgttaaggacattgttcayaacatccacagtagatatcatttattaatcatttaaacttgtgccaggaattagcacaaatagatgtaactacatttaattacaatgctattaagtgggt

SEQ ID NO: 73562 - DNA, 201 bp, Bos taurus
tgggcctttgagtgtttcactgacctccagttcacatagcatttgaataggtttgaatgctagaagtttgatatgacttggaggctggtataaaaatatcrttttagaataaaacaagaagttcataagttattgacaggtcaaactcctaagaatatgattgtattagatttaaaaagcaaaacaaaactaagtcaaagt

SEQ ID NO: 73563 - DNA, 201 bp, Bos taurus
ttacatacttatttattcaacaaatacttatgtttcatgcctgcaatgtataatgaaggcagatgttgttcctgttgtccctgcatgtaaaggccatcatrttctaaatcagtgcttttcaaatttgaatgcacatatgaaccacccgaggatcttaaagtgtggattaaatatagattctgaatcactgggtctgcagta

SEQ ID NO: 73564 - DNA, 201 bp, Bos taurus; identical to SEQ ID NO: 34015

SEQ ID NO: 73565 - DNA, 201 bp, Bos taurus; identical to SEQ ID NO: 34017

SEQ ID NO: 73566 - DNA, 201 bp, Bos taurus
acaaaatgtataaatgatatgtagagtttctcctttaacatatgaactcgggggaagatgctgaattaaagggaagatgccttggtgcaaaataaagtgarttaggctgccagcagaagtgctaacagggagacattttataatttatcacgttttaagtggttgtctctgtctcaccaataaacagcagagttattcatt

SEQ ID NO: 73567 - DNA, 201 bp, Bos taurus; identical to SEQ ID NO: 34018

SEQ ID NO: 73568 - DNA, 201 bp, Bos taurus; identical to SEQ ID NO: 34020

SEQ ID NO: 73569 - DNA, 201 bp, Bos taurus
cttccacgaaggccgaaacagtgtagctggcattcagttgaatgaatgactgagggaacgaaaagctcataaaactgttatgaaaatcagaatgaacaccrcaggaaccttgtgaaccatgaataggtgggcctgggcaaggggctgttactgtgattgccatgagcacagtcccctggtcttcgtagcagtgttcccata

SEQ ID NO: 73570 - DNA, 201 bp, Bos taurus
agcttgtgttttgtgagtttcgtttttagataacagcccaactgccgctctgatttgtgcagtttttgcacatgctattgtttgcacacacgttttggccrggacctcatctgatgagccatttgttagttctgattgagtaggtcacttgtgggctcaattaaccacttgcccttcatctgatggtgcaagtggccaatt

SEQ ID NO: 73571 - DNA, 201 bp, Bos taurus
actaggctccacctgtgacgtccaacagtgttgtataagggttcccttttcttcacaccctctccagcatttgttagttgtagactttttaatgatggccrttcttatcagtgtaaggtttgatttgcacttctctgataattagtgatggtgagcatgctttcatgtttctattggccatctatatttcttcttcttatc

SEQ ID NO: 73572 - DNA, 201 bp, Bos taurus; identical to SEQ ID NO: 34021

SEQ ID NO: 73573 - DNA, 201 bp, Bos taurus; identical to SEQ ID NO: 34025

SEQ ID NO: 73574 - DNA, 201 bp, Bos taurus
ggctctgtgttgattattaacgtctgcttgcaattggggacagaaaaaaaggaatccaaccagctgaaagccgggaaatcacacacaggggcctgagatcygtgtaaatgaaatttaataataaatggtacgtgctcccagattaagaagtaaataagagacagagaaagaggccattcagattatagaggccggaagagg

SEQ ID NO: 73575 - DNA, 201 bp, Bos taurus; identical to SEQ ID NO: 34029

SEQ ID NO: 73576 - DNA, 201 bp, Bos taurus
atcgagcaaatccaatctggatcaccctaaatcctggctttgtgaggccccgatgccttccacatttcaacaattattcttttggaataaatacagttcartccagattggttctgggcctccccatgccaaaggctagctgcatggtcctataaaccctccctctatgatccatttcattatctgtaaaacaaaggtaat

SEQ ID NO: 73577 - DNA, 201 bp, Bos taurus
ctctatcattatgtggggctcatgggaggaatattagtgacaggcctcctccttgatgagaaagtcaggggcccctcagcctagagttacagcctttttaygagcagaggctgtccagggttggcacaggagttcagaaaaagctagaggacccattgatctctgatgcctataaaactgtagcagccatacttgcatgga

SEQ ID NO: 73578 - DNA, 201 bp, Bos taurus
gggcatggttttcaaagaatactgaaatatccagagcagtccagctgatacttgtttaccagggtagcaagaagacaaggccaaagtaaaaagggttctgracttgcgggtcctgcgctttgtggaccctcgaattctgggctcacataagggccctagaacactggtgggaggaaaaatggactaacctgaaggagcttc

SEQ ID NO: 73579 - DNA, 201 bp, Bos taurus; identical to SEQ ID NO: 34032

SEQ ID NO: 73580 - DNA, 201 bp, Bos taurus; identical to SEQ ID NO: 34033

SEQ ID NO: 73581 - DNA, 201 bp, Bos taurus
agctgcagccctcaactggacgttattaggcttctgaccctgtccctctgcaatgtgtgggactggtggtctccaaaaagatatgtccacaccaaactccyggaagctgtaaatactgccttatttgggcaaagggtcttttcagaggtaattacaactcttgagatgagatcatcctggactacctgggtgggcctgaaa

SEQ ID NO: 73582 - DNA, 201 bp, Bos taurus
ctctgacttttctaaagtaaaccttcagaatattatttttggatgattatattttggatcaactctctcatccagaagcctgataaaacctgtttttactytgaacctggaaattacttttttttcctagtttcagaagtttaagacttcatggtttagatttcattccaagttcagactgctcagaggcccggtgggatc

SEQ ID NO: 73583 - DNA, 201 bp, Bos taurus; identical to SEQ ID NO: 34039

SEQ ID NO: 73584 - DNA, 201 bp, Bos taurus
aatgagccacaactggcattttaagcgaagaaaagagaaagcttaagggtgctttgcacttactactgtttcaagaaatgtctgcttcagtaatttacatrtatctgtgtaatatattacaaagcaaaatatatatgtggggttgtgataaaaaaaaattcccactggttaaaaacacacacacacataatccatcatgac

SEQ ID NO: 73585 - DNA, 201 bp, Bos taurus
tgcaaagcatgtgagatcctagttccctggccagagatcaaacccactctccccattggagagccaaacctttatcgctggatcaccagggcagtctttarcacaaagcgctggccatgattatcctatgatggtctcgggagttactgtaatgtgtggggtcgtgtgttcctagactgaaggactccaaaatgatgttgt

SEQ ID NO: 73586 - DNA, 201 bp, Bos taurus; identical to SEQ ID NO: 34042

SEQ ID NO: 73587 - DNA, 201 bp, Bos taurus; identical to SEQ ID NO: 34043

SEQ ID NO: 73588 - DNA, 201 bp, Bos taurus
cgcttctggctgtggcagtagaaaccatgtcccgagggaagtggcccagggactcaagagtagtgggatgccatccgccaggagtgactcaggcctctgcrttttgtcacactcctgacttcctctggcacccgggaccctcagggtcccctcaccctttgtctccagtagaagccgtttatctttgaagcctctagtcaa

SEQ ID NO: 73589 - DNA, 201 bp, Bos taurus; identical to SEQ ID NO: 34046

SEQ ID NO: 73590 - DNA, 201 bp, Bos taurus; identical to SEQ ID NO: 34049

SEQ ID NO: 73591 - DNA, 201 bp, Bos taurus; identical to SEQ ID NO: 34050

SEQ ID NO: 73592 - DNA, 201 bp, Bos taurus; identical to SEQ ID NO: 34051

SEQ ID NO: 73593 - DNA, 201 bp, Bos taurus; identical to SEQ ID NO: 34052

SEQ ID NO: 73594 - DNA, 201 bp, Bos taurus; identical to SEQ ID NO: 34053

SEQ ID NO: 73595 - DNA, 201 bp, Bos taurus; identical to SEQ ID NO: 34054

SEQ ID NO: 73596 - DNA, 201 bp, Bos taurus; identical to SEQ ID NO: 34055

SEQ ID NO: 73597 - DNA, 201 bp, Bos taurus; identical to SEQ ID NO: 34056

SEQ ID NO: 73598 - DNA, 201 bp, Bos taurus; identical to SEQ ID NO: 34057

SEQ ID NO: 73599 - DNA, 201 bp, Bos taurus; identical to SEQ ID NO: 34058

SEQ ID NO: 73600 - DNA, 201 bp, Bos taurus; identical to SEQ ID NO: 34059

SEQ ID NO: 73601 - DNA, 201 bp, Bos taurus; identical to SEQ ID NO: 34060

SEQ ID NO: 73602 - DNA, 201 bp, Bos taurus; identical to SEQ ID NO: 34061

SEQ ID NO: 73603 - DNA, 201 bp, Bos taurus
tcacatcttctggattctggagtcttttcaccctatcagaggtttctttccttgggcctccttatcccaccttgagtaggcattgctttagaaaccttcamaaacacttaggcacctagggtttgggcacatcctctctagtctcttctagtcagtcaaacttttaatttctttaggtggaaaagcagctcttatgttaac

SEQ ID NO: 73604 - DNA, 201 bp, Bos taurus
aaggagtattcgggaacattcttccggactttatggatgctttggcttgatgaatcttaatcgcctctctgcacaagacttgtgaactgatgggatggccrtgcttttcctcgttgattttcattccctaacatctcagtctctaaaattgttactgtcctttccatcattttagcttactgttttatcctttgaatcttt

SEQ ID NO: 73605 - DNA, 201 bp, Bos taurus
tgtgtcatcttccaacacctgaccaataccaggccagtggaaggaacacaggcaggaggttagagaattccgcagaccattgatgggctgctgtggagcgyggaggcttcccaggtggcccagtggtaaagaatccgcctgacagggcaagggacacagggtcgatcctgggtcgggaagctctcctagagtaggaaatgg

SEQ ID NO: 73606 - DNA, 201 bp, Bos taurus
aactgagccaatatttgcctaatttctccccatagatctagagaaaggacattttataatatatccctatcattccacagagttgtataaattcccctggytttattatttttttgaacttgagaaaatgattcttaagttcaagatgactgatacatatatgctttcaaaacaggaagaaagagaaaggagaggtgacag

SEQ ID NO: 73607 - DNA, 201 bp, Bos taurus; identical to SEQ ID NO: 34063

SEQ ID NO: 73608 - DNA, 201 bp, Bos taurus; identical to SEQ ID NO: 34064

SEQ ID NO: 73609 - DNA, 201 bp, Bos taurus; identical to SEQ ID NO: 34066

SEQ ID NO: 73610 - DNA, 201 bp, Bos taurus
ttctctgttaaatttgtcttttttctaggtgtacttttttaaagctatcatcatagtgcatacaattttatatcctgcttttttcacctaacactgaaacmgcagtaattttagccagctacatggacgtcagtaattgtgttttattggctccatggttgctgcagggggtctgtcatttgagctcttacactgtcttgc

SEQ ID NO: 73611 - DNA, 201 bp, Bos taurus; identical to SEQ ID NO: 34077

SEQ ID NO: 73612 - DNA, 201 bp, Bos taurus; identical to SEQ ID NO: 34078

SEQ ID NO: 73613 - DNA, 201 bp, Bos taurus
tagccttattgcaggggagatggcaatggcctttagaggcaatgaccgcatcccaagcatcctttgacaagactggagagccccattctagacacatgagrggcctggagggcaaatccaggaggagaagggctctagttaaggccctcagcagggcaagttccactgcaccccgacctgagtgacatctacccggtgggc

SEQ ID NO: 73614 - DNA, 201 bp, Bos taurus; identical to SEQ ID NO: 34079

SEQ ID NO: 73615 - DNA, 201 bp, Bos taurus; identical to SEQ ID NO: 34080

SEQ ID NO: 73616 - DNA, 201 bp, Bos taurus; identical to SEQ ID NO: 34081

SEQ ID NO: 73617 - DNA, 201 bp, Bos taurus
gatgtggcttttctggaggtagaaagagagatttcaccatcagtgtctttccgattgctcttctcccagcatatagaagctggtggcccagactcctgggrtattttattttttttggctgccaacaacagctcagcaagtgccagttgtgaggatggacctggtggaatgcatggggcttggagtcttcggaggccaggg

SEQ ID NO: 73618 - DNA, 201 bp, Bos taurus
ctcatatctggttcttaggattcaaagggacacgatccaggcaaggtaacatttctacacatgctggataacaaaggaaatgtaatgccaagctcctgagktttggctccaaggcccttctgaatctcctctgtttacttagcatcgccccacccaggcataattaagccaaacaaacctgaatgttagcagttgtcttat

SEQ ID NO: 73619 - DNA, 201 bp, Bos taurus
actctcttcttcactctagaagccagactgatgaaaacagctaatgtgtatagtattgctggcaaccttggcataaggaaaaaagagatcctccccacccygatgtcaccttgataatcgaataaaacagcctggaagtgacacagattatttctgcacacaactcgttggactgaactgattacttgcactgacccaaaa

SEQ ID NO: 73620 - DNA, 201 bp, Bos taurus; identical to SEQ ID NO: 34085

SEQ ID NO: 73621 - DNA, 201 bp, Bos taurus; identical to SEQ ID NO: 34086

SEQ ID NO: 73622 - DNA, 201 bp, Bos taurus
cagggttcttccccaagggactatcagcttagtcgagggagggagagcattggggccaccagagcttctgtcattctagggatggccctgctgtccccagmgtcccctttccaattatcctgctccatgtgcacctgccttcttccaagactcccgtttcccagagacacgcccgtgcttcctaccgccccgccccacggc

SEQ ID NO: 73623 - DNA, 201 bp, Bos taurus
ggcaggctgtgtgtgtcaataacatacgacccgtcagagaaaagcctgcctctccgtgtttcacttttacttgtgacatttcccatcaggccagcttcccygtggcagtcagtatgtctcctagagctagcatgggctgcggagaagtgctcatctctcagctgctttggcaaagcttcactaaatactggggcctgagaa

SEQ ID NO: 73624 - DNA, 201 bp, Bos taurus
tccctcgcctaaactcctgggtacaattgctaaactcttgcaactctacagaacatgatctgaaaaccactgaacacagcatcacttagcttccagttcaygttattggccatgtggctatgggcaagtcacttaacccttcctcttacggaaactgatctttgcctctatgatgggtgtaagatgtaaaacaatgttaaa

SEQ ID NO: 73625 - DNA, 201 bp, Bos taurus
ggccttgtaacctgtgttagctgacccttggatttccttcatgctgttccctttccctagaattcctggccctctgttcccatctatacttgttctgagayaccacctcctctgcgaagcatttccccacttataactgacctccctctcctctgtgttcccaggatatgtttcatgaactttaataaatgcaaaactttg

SEQ ID NO: 73626 - DNA, 201 bp, Bos taurus
tgacttctacttctctgctgtaaccaggaataccaacctgttggtaaaactgctttgagatgaatagtatgaaatggggaatgaggattgaggacagaagyggcagttgccatggaaatgcaggggtttttgtagagcccagttttgggtgatgccactcataaaggtctgtgaaatgagaatgttctcctgtgatggtaa

SEQ ID NO: 73627 - DNA, 201 bp, Bos taurus
gaagaagaggaggagcgggggagggaagaagaggagaaggggagtgccgaagtcccgtttgtgaccttgcttagctttttcaatccaaaatggcggttggrtgtgagaggagtcatctggctgaggggtaaggggatgaatagaaccagagcaaacttctaatgaagagacaggctgacacaaagggcagaacattggctt

SEQ ID NO: 73628 - DNA, 201 bp, Bos taurus
cacaattttgattagtgttgaccaaaaaggattattactattgtcactcatccgtgttactactgcggccataggaccctgtcaaaaagtaaattaaagayacacgtgatgcctcttgggctacaggatgcctggatgctcagagcctgaggccaaccgtgctaggaccacagaggggagagaggctctgccctcctcttt

SEQ ID NO: 73629 - DNA, 201 bp, Bos taurus
ccctccatctatagcattttccaggcaagagtactggagtagggtgccactgccttctctgggtatggatatgtagtcctggacatattagtcttttttamattctcagatctgtcagggcctttctagtaccaaggcttttcttactccttcactgtttcctcctgctacttaccctccatcatgtccctgcatggctct

SEQ ID NO: 73630 - DNA, 201 bp, Bos taurus
ctcattatgaaaccgtccccagtggtggcctgcccagtgagaggtggcaaactggtgtgattaagctcctccctgcaggtggcataaatagtaagtatatyggaaaataaggagtcctttaaggccagacttcatgcccaaacaatgagctgctattctgcttcccacaaaatttattacaattagatgtggacccaggat

SEQ ID NO: 73631 - DNA, 201 bp, Bos taurus
gcgtcagctgttgtggaactttctcttcccttggtcttgcattgatttacctccacatagtctcccaatacactcccaactctacccttaaccgaagtttrggagaagggaaaaaatgaggacagtggcttttgggagttctcatatctctgggaaccctattcctggggccaaataacacaccacttctgtttatataca

SEQ ID NO: 73632 - DNA, 201 bp, Bos taurus
catataaacttttttaccagagagtttttggtttctatcaaatatgtatgtcttgaatgacatgaaagatacttgtgcatactcagaaaataccagaaacmtaagcacactaaagcttacattctctctctctctctttgcctctatccctgcccagttctctctccttagattctagtatggaaataggcacttggaaga

SEQ ID NO: 73633 - DNA, 201 bp, Bos taurus
ttgaggttaagtttaaatgaagattaccagagtactgatgacataacagtagatataggccttgttaactttggaaattgcccattgatggtgaaacaaayaaacaaaaaaaacccaaaataaacagaaaccctctacactgacacatttttttagtttctgctgaaagtggctccatttgaatgcatgctcagagggaca

SEQ ID NO: 73634 - DNA, 201 bp, Bos taurus
ggccaaagagaaaaaagaaaggtattcccaacacatggttttcagtgggaaagggaataatacaagtgaaaaatgaaatacctccccgaaagagttaaaayggagggggaggcctttcatgctttgccttctaagtaccattaaccattttctcccatcaactccctaagacccaaccactctacctgttttccagggaaa

SEQ ID NO: 73635 - DNA, 201 bp, Bos taurus
gcctctccagcatggcttgtcaggataactggactttgcatatggcagcaaagggctcccagggagagttttccaagggacaagaggtaagtgccaccacsttcttaagacctgggcccagaaactagcaaaacaccatttccaccacacttcattgttcaaagcagtcacagggactatccaaactcaaatgaggcaaca

SEQ ID NO: 73636 - DNA, 201 bp, Bos taurus
ggcatggaagggtagacagaaatttgtccatggcccccatccaagtctgagtcaagttaccactgaaatgaatgcctttggatcttagagaagaaagcacraagcactggaaagaatgtaccattaggaatgcaatgtggccttgagtggcctatgaggtccagcacccataatgggaaatggacgagtgagtgagtgccc

SEQ ID NO: 73637 - DNA, 201 bp, Bos taurus
agctggcctcattcttcctccattccagacattatacaattattcctcatataccatttcctgagtgtcactgtatagacagtatatgctacatgttttastttttaatgctactctggttcagttcagttcagtcgctcagttgtgttcgactctttgtgactccatggactgcaacatgccaggcttccctgtccatca

SEQ ID NO: 73638 - DNA, 201 bp, Bos taurus
ggccttttccctgtcaaacttcaaaaggtggaaagacatttgagtggttgaggtcccacctgaccatagggctgcagtgtgtcaaacattatgtggatctyagtgtgaggggccagcatctcagacagatggccatggtggcatccagtccccagaaatgttctgtttgatctttccaccattgaaacaattgtcaaattg

SEQ ID NO: 73639 - DNA, 201 bp, Bos taurus
tctagcaaacactcagtaaatgtttgtcaaataaatgattcagggaatgatcattccagagctggtggcttcatatgatttgagttattgcattttttttyccgctatctagaaagaaaagctcccagacgacccctcggcagtgttcagatattgtaaataattgatcataaagatgaaacacacaagctggacggggac

SEQ ID NO: 73640 - DNA, 201 bp, Bos taurus
gagaaggaaacggcaacccactcctgtattcttgcctgggaaatcccatgcatggacagaggaccctcgcaggccacagtccctggggtcacaaagagtcraacacgactcagagacgaaacaactgcaacactggatcacacgcctcattccagccaagtccccctccttacgcattcctgcactgtgcctgcacactgt

SEQ ID NO: 73641 - DNA, 201 bp, Bos taurus
ctctcaggcacccagtgtatgccacccaaagggtcagggacggaccacgacctccactcacggactttccagaaagctcccacaggctgagcaccatccaygtgccaggccacgtactcagaactagcgatgacgcaggcgctgactgttgccctgtgtttctatctgaatccgaggctagcccaagtcctgaccactgta

SEQ ID NO: 73642 - DNA, 201 bp, Bos taurus
agaatgaaaacaaaggatgcgctttgctgactgtgcccccttgattgtgtatttgtcaagtcaagattagtcacagcaattcaggaaatttatcctccaasctcctgcaattccaaacaccacggctgacatttcgggccgcgcggtcgggctgtccgtcttcccgtggaggacacgctttccttggcgcttacctttcgg

SEQ ID NO: 73643 - DNA, 201 bp, Bos taurus
ctgcagcccagatcccagggccaggcctggagtgcgggcatcacaaaacatcaagtgcatcctcccagaaacgacccaaacttgcggaaacctacaggcakacctgttgacctaagaaggcctccaaagcccgtccacagcaaaggtaatttccacagagacccccagaacagatgcagccttgacacgtgtgcggggctg

SEQ ID NO: 73644 - DNA, 201 bp, Bos taurus
cctttcgggagctgtccccaggccaagcagagagcctgcacaaagcgctcagtgtggctggacgcacgaatggactcctcctttgccaagccagacacagrggccacgaaaaggcctgggcttatttgcgtcactccaaaagcaacggcaatagcagctgctgagtgggaggctctagttaatgaagagcttagttaacag

SEQ ID NO: 73645 - DNA, 201 bp, Bos taurus
agagaaagcccgggtgcccaacaaagacccagcacaacccaaagtaaaatttctgtaccttattctacccaattaagggagtccttacactgttagttttsaactaacagttgggctatatgaggtatttagcaatgtcagaaatgataacaaaaaataaccaattttcattactactcccccagactgatcaatcatgtc

SEQ ID NO: 73646 - DNA, 201 bp, Bos taurus
gtgaacagtcacaaaatgttgccaacagctaattaatcctggccaattaaaaatataaccaaaacacgtgcccaggaatcatgttttaccgtgaagaagtkgggggaggggcttcttctatcacatctgcccggccacacacatcaagtgtgccacatacacatcttaggaatactgacatttgtgtacaatgaactgtta

SEQ ID NO: 73647 - DNA, 201 bp, Bos taurus
cagatcgccagagatgttgccaggtacggggaaggggcttacgtactgccccagggggctcaggagccaccaggaggctccagaggggccacttcgggacwctgcttttgcttttgacaaccccatctgtccagggctgaactgcacagctgtctaattggggcgactggagaggcacgcgtgaatggcccttggatggat

SEQ ID NO: 73648 - DNA, 201 bp, Bos taurus
tccgcaaggcctgcgggatcgggggctcaggtggctcctccctgtccttcctcatctcgggcgtcgcgctcctctccccttctctgcctcaaccagccccygagagctcggcctgcaggacagcctcaccccgcccccaggggacccttatggtggcaacacagggttccacagccctggaatccggagagctcctgcagg

SEQ ID NO: 73649 - DNA, 201 bp, Bos taurus
ttattaataatttcaagacaggaacaacagagccccaaacttagcgtggggccctgcagagtgccaggccctgctccgctgcataggcttcaggcccacaragccggttctggagcagctaagccaggaaggaactcacatgtgaccccaagggcaagtctcagcacatcacacagaggcctcctcgaacaacacagggca

SEQ ID NO: 73650 - DNA, 201 bp, Bos taurus
gtgacagatgtgaggctagagagacagggccacatcccgcgggctctcatagatcgtgataaatatttcatttattacagacccatagattaaccttttaratagatcactctggccacaatgtagtgatggaagaggaagggaagagagcttatagacaaatcagctagaagctgttatagtagtctgatgagtgtgtga

SEQ ID NO: 73651 - DNA, 201 bp, Bos taurus
tgattgacgtgttcttatacagaggttcatttagattcacagtatttagtttttggcaagaagaaggtagtgtccataggcacttccttttgcgtcaccargacacacatcatcatgcctgtttgtgtcttttgtgactttgggttaatcagtagattcagatattgtcagccatagtggaaaaggtttttaaaaaattgg

SEQ ID NO: 73652 - DNA, 201 bp, Bos taurus
ataattcaaatatttggtttatctttatattgatatcagttgattgccttttctcattcaggttgtgacttttctggttcttggtatgatgagtgattttyttgtatcctggacatttcgagaattaagttgtgagactctgcaccccatttaagtctttctttcagcaggcagtcaccctgtttatgcttagggcagagt

SEQ ID NO: 73653 - DNA, 201 bp, Bos taurus
gggccccagcaaggcaggacaggcacgcggtgcccacagcccaggccacgattatgccagtaggtaacgcaggcaccaaatccatttcctagaaaccaaaytgcatgcccaggactttgataatctgcaaagggaaaccccctccacacccacttaactcaagctctcgaattcacttggccactggtgtaactacttcaa

SEQ ID NO: 73654 - DNA, 201 bp, Bos taurus
gggcgctgcacagcaagaaaagtcacagcaatgagaagcccttgccccaacgctagggagcagccccactgggcacacttggggaaagcccgctcagccaygaaggccccgtggagccaaacacacaaatgacagtttttttaatgtttatattaaaagtctttttaaaaatcggacaccgtcgacattctcattaaatca

SEQ ID NO: 73655 - DNA, 201 bp, Bos taurus
cgcagtcatggggtgtccccggggacacctcggttacctctggtgagagctggatgccttcacagctctatgcgggagtaaattaatttatcacttaggaycctaagtgtgtatggccatcaatggtcatcttagtaggaacacatgcaggtcagtccattttaaaatattctaaaattgcaaaagatcagaaatcatatg

SEQ ID NO: 73656 - DNA, 201 bp, Bos taurus
gcaggagcctcgtgtggggaaatcctgttggcctgggaaccaggcggccttactaccagccatgcagcttgagatggcctccttggccatccggggcctcygtttcctgctctgtgcaataaggggacgctagatagctggtaggattggggtgcaggttaaagcgaactgtgaaaacacacgctgtgtttccgagggccc

SEQ ID NO: 73657 - DNA, 201 bp, Bos taurus; identical to SEQ ID NO: 34087

SEQ ID NO: 73658 - DNA, 201 bp, Bos taurus; identical to SEQ ID NO: 34088

SEQ ID NO: 73659 - DNA, 201 bp, Bos taurus; identical to SEQ ID NO: 34089

SEQ ID NO: 73660 - DNA, 201 bp, Bos taurus; identical to SEQ ID NO: 34090

SEQ ID NO: 73661 - DNA, 201 bp, Bos taurus; identical to SEQ ID NO: 34091

SEQ ID NO: 73662 - DNA, 201 bp, Bos taurus; identical to SEQ ID NO: 34092

SEQ ID NO: 73663 - DNA, 201 bp, Bos taurus; identical to SEQ ID NO: 34093

SEQ ID NO: 73664 - DNA, 201 bp, Bos taurus; identical to SEQ ID NO: 34094

SEQ ID NO: 73665 - DNA, 201 bp, Bos taurus; identical to SEQ ID NO: 34095

SEQ ID NO: 73666 - DNA, 201 bp, Bos taurus
caccatatagcatgtggtactgtgtgtgtggctgcgattctctcagcttgggctccagtggaagattgggaaggcagtggacagtttgctgagtagcattkaaagtgcgttacaggcagtgagttcccatttaccaaacaaggcagcacagactgccacgggaaccgtggggtgggttttcctgactgacctgaaggcgaa

SEQ ID NO: 73667 - DNA, 201 bp, Bos taurus; identical to SEQ ID NO: 34098

SEQ ID NO: 73668 - DNA, 201 bp, Bos taurus; identical to SEQ ID NO: 34099

SEQ ID NO: 73669 - DNA, 201 bp, Bos taurus
ctggaccattctgaagaaggtatgtcttcttctttcaaatcagatgttaaggtcaaataacctgtaaaatacttccaacctggcataagttcagacatggraacagaagtcggtattgaaaatgattgagttgctgaaactgcagaaaatattacaggagaggttacttctgagaaatcagacatagagtctatgtgtggt

SEQ ID NO: 73670 - DNA, 201 bp, Bos taurus
tgttgtagcctaaatagtcccgtttatagtgttatttaagaatctttagcactcagtgaaacgacagttttcccattatgagtaaattgacagtaaaaggraaaatctctgtattacaaatgtgagcacttctcctggagttgttctaaatctgtgggatggtcactgttcccagacggtttttatacttaggaggggtgc

SEQ ID NO: 73671 - DNA, 201 bp, Bos taurus
cgagtgaggttccttagcatcacacaggaaagaattcaattaaatgactcatccacaagcaccatgacagttccaaggcctgtcataaaagaccaaaaaayggatggtgtcccagctcctggaaatccccgccccttcacttcactatgacttggttcatttaattgaaccaagtcatagtaaagtgaaagaaggtttatc

SEQ ID NO: 73672 - DNA, 201 bp, Bos taurus; identical to SEQ ID NO: 34105

SEQ ID NO: 73673 - DNA, 201 bp, Bos taurus
tgggcatgacttagcaactgaactacaccagcaatcacacaatctgcagttgaattcaacccaaggtaatggtgccagtgatatggcagaatcaagaatayggaagaatctgatataggaaggctggctatatgctattcacagattttccactgtactgactgccatgttcaagggtcaactgcatttgaattttgcacc

SEQ ID NO: 73674 - DNA, 201 bp, Bos taurus
tctcctctctcacatcctctcggtccatctctccacggtcaacaccagccctcaccctggaatttctccacaatccctaaactccagctcccagctgctgygcctgccagaggacctgtgttcctgtacagggtatccttgctgtatggttgcagcaaggactgtctgattctcattccatttaagttgccacagatcagc

SEQ ID NO: 73675 - DNA, 201 bp, Bos taurus; identical to SEQ ID NO: 34107

SEQ ID NO: 73676 - DNA, 201 bp, Bos taurus; identical to SEQ ID NO: 34108

SEQ ID NO: 73677 - DNA, 201 bp, Bos taurus; identical to SEQ ID NO: 34111

SEQ ID NO: 73678 - DNA, 201 bp, Bos taurus; identical to SEQ ID NO: 34113

SEQ ID NO: 73679 - DNA, 201 bp, Bos taurus
ctccaggacgtttggccatgcagcacttcagcgggagttttcaatttgtaaaggttgaaaagtcatttttcctttccagctcataaaaggtgaagctttayggccagagggcattttgttcagatctcagatcccagtcttctttgcttcatgtgtgaatacattaccctggtttcacagttacttctaatttctatttat

SEQ ID NO: 73680 - DNA, 201 bp, Bos taurus
aatacatggtacacacagacacaaacgaataatgattacttatatatataaacggtggtaagtacaaccattatttacagaaaatttccaacaaatgaatrtataagtaaggagaaaaatagatcaccataaaaaaaaaactaatgctgcaataattgctataggcaagatccactgatgaatgttaaaatcagtggatac

SEQ ID NO: 73681 - DNA, 201 bp, Bos taurus; identical to SEQ ID NO: 34114

SEQ ID NO: 73682 - DNA, 201 bp, Bos taurus; identical to SEQ ID NO: 34115

SEQ ID NO: 73683 - DNA, 201 bp, Bos taurus; identical to SEQ ID NO: 34116

SEQ ID NO: 73684 - DNA, 201 bp, Bos taurus; identical to SEQ ID NO: 34117

SEQ ID NO: 73685 - DNA, 201 bp, Bos taurus; identical to SEQ ID NO: 34118

SEQ ID NO: 73686 - DNA, 201 bp, Bos taurus; identical to SEQ ID NO: 34119

SEQ ID NO: 73687 - DNA, 201 bp, Bos taurus; identical to SEQ ID NO: 34120

SEQ ID NO: 73688 - DNA, 201 bp, Bos taurus
ctgtaaatttcaatcaatgttcatttgataaaattttttctcacattgtgctgtttaacatattctctggtttcctctctgggaagatgctatgcaggccyggaatgcaagaagtttggattctgcactaagacaacttttgagttcagttcagtcattcagtcatgtccgactctttgcgaccccatgaattgcagcacg

SEQ ID NO: 73689 - DNA, 201 bp, Bos taurus
tttataggcctcaggctagaattattgttcagctatggattcgtttgtagttagagtttgctacgcagaaaagtatggtggatgtaagacagtggacgatkattaaggttgtagggcctatgtaccttcaaggtgtttggataagaatggctatgatacaagtgccatgtggctgacagaggagaatgcaatgagtgattt

SEQ ID NO: 73690 - DNA, 201 bp, Bos taurus
attcctgcaggcattcactgggctctcaggcagtccagcaacccagctccagcactggcttgtggacacattactcccaggttctgcagctctattagctrcttttgtaggcttggtaaggattttcattaaatgcagccttagtgctagaaacttgaaatatttgttaatttggaggctccctccattagtactactatt

SEQ ID NO: 73691 - DNA, 201 bp, Bos taurus
tgtagcttgttgacctgggcagagacaaaacaggttagacaattgataatgcatgaaacagtcataagcagaatcaatatggtgtaacacagactagtagrggcattagccaattctaaattcccatgaccaggatggctcaagtccctccttgttcagggatcagaagatttatctcttgcctgttttgtagtacagtcc

SEQ ID NO: 73692 - DNA, 201 bp, Bos taurus
aacctctttcaagagcacttatgccaacatgctgcacctcccaagattgctgttgctagtgctcctgatccagtgaaggctactgtcaatccacagttctkccagagactcccaaacacttataggcaagattggcacattattttgtggggtcactgttccttttccctgggtcctggtgctcacaaatgtttgtttgtg

SEQ ID NO: 73693 - DNA, 201 bp, Bos taurus
tcttcagtggtgcttaccaggaaagagttttatatactcccttgtttctttcagattatttgtggcttgtggcatttaacaggggtccacctatgggtaarcccagagccttagtgccaatcttgcatttccatttctctctgccctctctcagttgagtaaacaaccaaaatcattttgttctgtcattttgttctgtag

SEQ ID NO: 73694 - DNA, 201 bp, Bos taurus
gagtcttaactgtacaattgatatgttacactaaggcagcagtgaacatgaaaatgttaaaaaatatactcagttataaattgaataatttgtccagaaasaggttactcaatttctgagaagctcagagggaataccccatgtggggtacaattttttgattgtacccattgtaaatatgatagccctccaaaatggaaa

SEQ ID NO: 73695 - DNA, 201 bp, Bos taurus; identical to SEQ ID NO: 34121

SEQ ID NO: 73696 - DNA, 201 bp, Bos taurus; identical to SEQ ID NO: 34122

SEQ ID NO: 73697 - DNA, 201 bp, Bos taurus; identical to SEQ ID NO: 34123

SEQ ID NO: 73698 - DNA, 201 bp, Bos taurus; identical to SEQ ID NO: 34125

SEQ ID NO: 73699 - DNA, 201 bp, Bos taurus
acatgtgatctatcctggaggatgttccatatgcatgtgaaaagaatgtgcattatgctgtttttggatggaatggccaattaagtccaactgatctaatrtgttattgaaaaacaatgtttctttattgatttctgtctggataatctggccatttatgtaagtgtgatgttaaacacccatactaatattgtgttaatg

SEQ ID NO: 73700 - DNA, 201 bp, Bos taurus
ccctggcccctcggtcattgcccctctgcccggtggcagcaccacaaagacttgtttctgcggcaggtccaatgcccaaaatgacagtgccatccactgayattaggcctggtccttctgtgccctgttctttactatgtcgagagtacctgctgactcggaatttcagggcattctgctttcactgaggcattttattgt

SEQ ID NO: 73701 - DNA, 201 bp, Bos taurus
tccactgaatgaatgaataaatacagtgtgatccaagtacatttactttagagcagttaccaaaataccactttatgcatgctaatcataccctaaaaacraaagaagtctgatcattttataagaatctggactcaagatctggactcattggagcaaatgatgagaaccctcaagcaactaagtatgtaactgaagaca

SEQ ID NO: 73702 - DNA, 201 bp, Bos taurus
atattacgtgaatgatacctgtcttgaaataatttgaaagcgtctcttctttgtaatagggaaagacattcataattttctattttcaacccttgctttartgcataataattaagatgctatttgaaaacttgataatgatgggtaaccctgaatatgtctgagacttctcacaaggagataataaaccaaatactttag

SEQ ID NO: 73703 - DNA, 201 bp, Bos taurus
actgagactcacgcgctgtcccttggcaaccataatgtggtactcttctcggaaccagtaggccatcactgctatggtgatttcaggccatgacaaggtgkcagtttcaaactaggctgatgatctggtttgaggatgtttttgcagttatctttctaggtaggaaggggcccagatttcagcatctaaatttttcatttg

SEQ ID NO: 73704 - DNA, 201 bp, Bos taurus
acagaaataagtttgctgacccagctgccgaactcgagaacaacagtcacaagtaccctgtgactcctgggtgctggaatatagttagtttgagctggggkatgctgcaggtgtaaaatgcactctaacttgcacagaatgtgaaaaaaagtaatgtctcattaataacgtttttgactatctgaaataatatttcgaaca

SEQ ID NO: 73705 - DNA, 201 bp, Bos taurus
tcttgcctggagaagtccatgcacagaggaacctggagggccaagtccatgaggtcacagagagtcggacgtgactgagcatgcacaatttgtatgtttcrtgagccaaagttattggccaactacacaaggcactgtaatagaacactttcagccattctttacagtttttgtttttgtttttttttaatctgtgaagtt

SEQ ID NO: 73706 - DNA, 201 bp, Bos taurus
tctgaacttgcccatgttagaatgcgactctcctgcgggccattcacttttccagagatcgccctcgtggtttcctaaaagtgaattgtagagacatctcyactctaggaggccacttggaaatccccccaccagctgcaggaaacactatggtcacttaaaatctgcctctccctgctaagctcgcctattattctacta

SEQ ID NO: 73707 - DNA, 201 bp, Bos taurus
gacacccaagagccagggcagtggctgaggaggagccaccctgactggccctgggggctgatcacctcccccttaaatgacttatcagccagcaaggagarttagtgcagctgatgccaaggcctgggttccaaggtgaccttgttctgccaaggccacttgctcagacaggagcctccgctcttacattctcatggaaag

SEQ ID NO: 73708 - DNA, 201 bp, Bos taurus
acgctggctcgcagaaaccagggggacccggggggcctggggggccgggcacaccggggatgcccgccaccccaggggggcctcgctcgccgtcccggccrttcctcccgtagctggcaggacccgggtcacctgaaacacacagaaggcacgctcgtgagcaggagacccgcagacgcagacgcagaaggcactggctcc

SEQ ID NO: 73709 - DNA, 201 bp, Bos taurus
tcaaaacgggtattatgaggaggcagattactcctctctggaggccgcgggagatgctcactgtgcagatggagctgacctgggaggagaaagacttgccragtctgaaagactggccggcgactatctgagcgatggcataaccatgcctactgtctgtacttctggctgtctgtccttcccgtctgcaccacgagagtc

SEQ ID NO: 73710 - DNA, 201 bp, Bos taurus
cagtccatgggggcgcaaagagtcagacacgactgaagtgacttagcacgcacacatgcacgtgattgacttcagctggataatccaggccaatgtccccrtctcaaactgaaccgctttgaccaagtccttcttgccgtgtaatgtaaggtagtcataggttctgaagattagagcagggcttctttgggggccactata

SEQ ID NO: 73711 - DNA, 201 bp, Bos taurus
caccaggtgctgagtcccctgcaggtgcctctggggcctgcgtgtggcagagccagcacccacactggacacggacagctggttgcaggagagaggctgtraggtgggtgtggggaggggccggagccccagggagctgcctgtgatgtgtctgtgttcccgggagactgctgaggtcggggtccagagtgtccaagggct

SEQ ID NO: 73712 - DNA, 201 bp, Bos taurus
gtgtctcttgtttcttgagtggccactgatacctgtgcgaccctgggtgagtcagtgaacaccttcacctgcttccccaaagcatgcatagctgaaaccgygtggccgtaggtaagagcctttcaccatcagctgtctcaccctgatctttcaggacactggaaagaatttctcctatgactgcttgaacagagacttctg

SEQ ID NO: 73713 - DNA, 201 bp, Bos taurus
aatattgtgtacatgttaaaataaagaaaaaactgacacatatgggagacaaatgatttggagaacagagagttagagatgcatatggatattctttaatmatcatctctaaaagatgatgctgttaaaatgctgcacttaatatgccagaagatttggaaaactcagcagcgtccacaggaatgcaaaagatcagtttca

SEQ ID NO: 73714 - DNA, 201 bp, Bos taurus
ggaaggtttaatctaagaaggatgtattttgaaatgattgtattggaattgtaactttggtttcatctatccaaaccttaaatgttcggggcctctgggaragaattcctttcctgtgtcagtaggttaatctctgatcacctgaactgagatgtctgtgtgactagcagtgtgtggcctgtgcacgtgtggtttgaggat

SEQ ID NO: 73715 - DNA, 201 bp, Bos taurus
tcaaagaaaatgttcatcgcaaaaagaggctgaatttttatgatatagctctgaatttttttcatcttcatcatatatcaattttttttccaggcagacamatttcagatgttttatgtaagatcaaactacaaaaccaaatataagcataatcctataaaatcctttaattgtactcagatgatacataattttagttct

SEQ ID NO: 73716 - DNA, 201 bp, Bos taurus
tttctaattgtgtaatgaatgtagtttccttaaaaggaggcctttggggcatcaacaagctggttaaggggagattgggggagttagaaagttccttctcrggtggcaccaggccttctgtagctgatggtaaagattacctgatttaggacttgctgttggtgtgggggaggctcctcatacagccccccagtcccgtga

SEQ ID NO: 73717 - DNA, 201 bp, Bos taurus
tgtagagtaataccaaaaaagggactgtgaaattaggagtgagagctttctctggggagagtaactggagttcccagtgtctcctttggggataagaaaayagggctggggagggagagctccttgcgctgctccccggggaagcccttcttgggggaagtgcctgtccgccccaggctgttcataagaagcagaaatctg

SEQ ID NO: 73718 - DNA, 201 bp, Bos taurus
catggtgtccccctttgcctggcaaagcaataaagttattcttttctacttcaccaaaaactctgtctctgagattcgattcagtatcagtgtacagagayagagttttcagcatcagctagggaatgaaagatttcagcttagataccagttttaagttcttttcacactacaccacacacagtgccctgaatagatctt

SEQ ID NO: 73719 - DNA, 201 bp, Bos taurus
acccaaacctttttcctacaaccacttttctagggtgctgcaacaattggagggctgttagcatcaggatgggatcaatcaggactctgctctacatgagygtttccctgtggttcctttgaacagcatcttgaagtagtttctcttataacaattatatcatgtgcaatatcacgagcatgagactatactggcaatatt

SEQ ID NO: 73720 - DNA, 201 bp, Bos taurus
agctttctcaacatagctgatgaatagaatttttgagttctgttccaaagtttaggaatgttttcctcataggtacataaaggcaaatcaataaattagartagggtaatactaactctacaaatgtatggatgtgagagttggactatgaagaaagctgagcaccaaagaattgatgcttctgaactgtggtgttggaga

SEQ ID NO: 73721 - DNA, 201 bp, Bos taurus
ggaagtctagataagaaaggtaagaaattgatttatttagagagaaacatagtgcacaaatagagggtaagccatctcaaaaggcgagaggccctgaaatrtgggatggtcagcttttatgagctgagtaatttcataggctcatgagcaggagcctatgggctgtttattccaactatttgggggaaggggcagagattt

SEQ ID NO: 73722 - DNA, 201 bp, Bos taurus
acacgactgaagtgacttagcacgcaagcgcactggctccatagtgactgttcccaatctttgtgctcagcacagcacgacttctgttctcagtagggccygaccgtcacgctcactatgacttggttctcgtcctgagtatgctctgattctggtcctctctatggcttgactctagtcctttcttaatcctgaatctgt

SEQ ID NO: 73723 - DNA, 201 bp, Bos taurus
atatggttatgagttggtgttggccacaagagacactttatgtgactttggaagccagcttgaagcagaagtcgtatttttcactctgaaggttggtgccrggcgctaggcattggccaccagcccagattgttactgctgtgctagctgacttggtgggtgtggggcggcagtggggcccaagttcctccacttctcagg

SEQ ID NO: 73724 - DNA, 201 bp, Bos taurus
accagaaccagtatactttttcacagacagaaatgtcccctatccctctttcgtttggatcttgatttctgttagtgagtcctgttactgaggcctaactsccttcaatatcagcaccctttaccaagcgacatcccttagctgttctggttgcctcgatatttttcagtttactcccaactaaagagccttttggagaag

SEQ ID NO: 73725 - DNA, 201 bp, Bos taurus
tgggtgaaagttataagggaaatctttatattatttttgatatttaaagatatttaaacatatctttatataaaataagattaaaaaattagaaaaggagrggttgattgaagagagtttaataaagggacaaagacaggacaagatagggatggtaaagcatcagggttggcaacaggatgacactgttaccttgaaaga

SEQ ID NO: 73726 - DNA, 201 bp, Bos taurus
ccacaggaatgagagttctgaactcaatgtcagcaccctcatcctagccatcgagcactggaaaggtgagcccccagaatatttggctttgaaggccagcycggctcaattacaggagctccaagggactgagggaaatagagacttcactctggaaaggtgtacagaaaacctcacatgcaccagaccaaaggccaaagc

SEQ ID NO: 73727 - DNA, 201 bp, Bos taurus
tcctttcccttcttggctggaattaaggccacctaattgtcttctgctgagacacttaagcataaacttgactcaacatggggctgtgcacagagagccaragccatgggccctcaggcccaaaggaaatggaaaatgcagtaaggccgatgtagaatgtcaggaaagagacactaatgatgtgtatttcttccttcatct

SEQ ID NO: 73728 - DNA, 201 bp, Bos taurus
caggggaaatcttacttgatctttgttttcttaacaccaagaggtttgagaaaactccccctctgttttacacatattcagttttgacttttgacttcctmctatgtgcagcttcaaaattcacttcatatctaacagtatatactggctgtgtgcttgagacctctagtttcgttgcatccatctccatgactcacaaat

SEQ ID NO: 73729 - DNA, 201 bp, Bos taurus
gaaacaaactctcacttcaaaatgttgaattgggtttataaaccagcagacagaaagggttatgttcaacagccaagccttctggtgaaccatagttagcrctgggcctggcttcacatttaatgcaaggaagaaatgcctcacttcccagcatggaaggttctgaggatcatctgccaagtgtagattaaatgctacaca

SEQ ID NO: 73730 - DNA, 201 bp, Bos taurus
gcacatattgaatatattatgggccatattctcattcttttcccttcttttgatatgtaagaggatacttttccttcctttgagtctgaatcctttaacayactgatggttcattctttggccgctcatgaacataaaaactggttctcctcttgctgcttttccagagacagtctctttaatcttaccctatatgtgatg

SEQ ID NO: 73731 - DNA, 201 bp, Bos taurus
ctaattgttcaagcacaataaccactgaagcctcaggttggaagtgactttaaatctaaactgacagtcttattgttaggagcattttctaaaatcaactyatgtaccataacatctttgcttttcaattttaaatgcttataggatatacattaaaagccaaacttacttctgttagtaaactttgtctatgagggttgt

SEQ ID NO: 73732 - DNA, 201 bp, Bos taurus
ggcccacatgctggggtggggccgaaaccaaagctgagtcccacttgggccaaaaccaaagcacagcccccacaaaaggactgtgcgactaaagaagtctrtttagctatataagctgaggatgaaatctaagtattctcctcagtaaaacctgcatttgtggaatatctgaatggacgataagtgctcccacagtttagc

SEQ ID NO: 73733 - DNA, 201 bp, Bos taurus
gctaagcccagagggccctcaagagggagaacaatacttgcaatccagcagctgccagctgacatcattctctacaataaacaagaacttaaggatgtgamtaatcaagaagtaggatgctggccccagatagctgagatgcacatgaaagaaattatttcagtgcacccagacacttgcatcttcccatacatagaagag

SEQ ID NO: 73734 - DNA, 201 bp, Bos taurus
aaaaaaagcttaaattgaatgccccaacactgatgtgataagcaagtcttattagtttctgttttacacagaaatgtggctttaggctgaccaagggaatrgaggaaccagagcctgaaaggaaggcacagatttgaggaggaaataggaacagaggctatatattatccacttgtaatcttcaaaggtacagaatcaagt

SEQ ID NO: 73735 - DNA, 201 bp, Bos taurus
aactccaaggagcttcagagggaaggcatccccctatagtgtttagcagactactgatcagcatgtgcatataaagaaattaccctagcccaaaggaagarctgtctaaggattaaaggaaaacaagaccagtgctcacacaaaacatgaataatgcctgcagatagaataaccacacaattcatggagatttgggtagag

SEQ ID NO: 73736 - DNA, 201 bp, Bos taurus
tcaatcaaacaatcctggattgaattcaagagtgaaaatgaagaacagcagtataattctaaaacagatcttgatttttgtataatcaaacatcaacatayttgattttattctgtattttctcaaccagatttagttgaaaaagtctgccatgcctctaaattgacacatctagtctcccagattttttgcaaatattta

SEQ ID NO: 73737 - DNA, 201 bp, Bos taurus
gcttactcccttatgacgaagtacacctctatggttctcatgtgaaaccagaatagaaaatgctgtattcggagcgatccaggcttcacttagacagcccycagcacccctcactccccacccgcaccacccccaggcctcccaccctgagtcacaagagaacccggtggagaaaggattttcgcctcacatgtgcggccc

SEQ ID NO: 73738 - DNA, 201 bp, Bos taurus
tgtggtgtagggggctgggtgctcctagatcctccccaagttttagaatgaattgtatgcaatataagagcagaacccatggacctattgagcctggaccragacaggcctggtgtatacattcttagcatatagaaatggcatgctggggaaggccagtagacattctgtgcataagccttgtggaaggatgaaatagaa

SEQ ID NO: 73739 - DNA, 201 bp, Bos taurus
tattaacccctctttgagaaaggcaaggtagcattgttgtcccatttacagagaaagactgagaaaacttagaagtcctactcaaaatttacttgggctcytccctaaaattcagttttcctaacttatccattttacttccaccaagacccccctaccccaaagttgttgcttctctgccagggcttctttcactcattc

SEQ ID NO: 73740 - DNA, 201 bp, Bos taurus
actggagtgggttgccatgccctcccccgggggatcttccgaccccagggatcaagcctgcgtctcattcatctacctgctttggcaggtggcttctttaytactagcgccacctgggaagagagttggtgatgctatattatttatttacttaatctctgcctctcctactggattcctagcaccttaaaagcccaattt

SEQ ID NO: 73741 - DNA, 201 bp, Bos taurus
tcttctgttattagaataatcatccaatcatactttttccttttagggttaattacaagcttaagacttgccatcagcctctctccctagtaccattactrtatcctagaaagtttcattgtgattctgacaaagcagaatcttggcgctacatctatcttttctgttctgtttttggaagggaaacgagttaaagtgact

SEQ ID NO: 73742 - DNA, 201 bp, Bos taurus
tgatacccagctttggagatctagatccttgaaggctacatttttcaactggctacttcagctcttttagctcttcatctaggattgctggacagttatcyctttctaacctaattaaagtcagtgaaattgtaattcactggacatgtaaaatgccttatcacctttgaatatccaactatagatgcccaagtatttctc

SEQ ID NO: 73743 - DNA, 201 bp, Bos taurus
atctgggagataaagtttgatcactgaagagctgatatcttgaagaaatgtcaatacctaattaagaaaagtgaaaacatcatttgaaattaagatttttyctttgtgccaaattttatttgcacaccctttgttttggaaaattagggtttgtgagagagtggggagtattcgtactgctaataaaaggtaagggagccc

SEQ ID NO: 73744 - DNA, 201 bp, Bos taurus; identical to SEQ ID NO: 34132

SEQ ID NO: 73745 - DNA, 201 bp, Bos taurus
aggaaatggcgagggacagggaggcctggtgtgcagtggtccacccgtcacaaagagtcagacatgcctgggtgactgaacaacaacagcattctgtattytttacactgaaatggaaaggccccttgctccatattcattgttcaagtgttttaattctcatacctgtattttttttttcatgttggtacctcaagttgt

SEQ ID NO: 73746 - DNA, 201 bp, Bos taurus
agctctttatatggttgctgttgatggtgtaacaaaaaagaaagttcaccaaagtaaattttaaaaatatactaagctttactgaatgattcatggacccrgaagcctcccatctaatgagtagaggggaactgcaatggtccacagaaagggaaaggttttcagaggcaggacaaagaggtaataaacaaaaaacacaat

SEQ ID NO: 73747 - DNA, 201 bp, Bos taurus
aggcactgggagatacaaggggatttagtgaaaatttacagagtgacaatttctgcagtttactccttagaagccagtgtgcaggcccatgcccattatgsagaagagtggatagttcccctctgatccatcctacataataaatgtctagacacttaggcttgtgagtcaccgatgaaaaagtggccacaaccctataag

SEQ ID NO: 73748 - DNA, 201 bp, Bos taurus
aatcaataataataaaaaaataccacacagtttagtaatagagtaagaaagtgatttgttaattagcctttggatatagttcctgtcagcatagggtaaayagtacttctacagccacaaggctacagataaagccaacattattgctggcataagagagagatgggaagaacctgagaactcagcttattgctaagcaaa

SEQ ID NO: 73749 - DNA, 201 bp, Bos taurus; identical to SEQ ID NO: 34133

SEQ ID NO: 73750 - DNA, 201 bp, Bos taurus; identical to SEQ ID NO: 34134

SEQ ID NO: 73751 - DNA, 201 bp, Bos taurus; identical to SEQ ID NO: 34135

SEQ ID NO: 73752 - DNA, 201 bp, Bos taurus
tcacaatatctgctaattggaggccatgtactaattagtcatgtgtttgtatcatcacccttgtccattttccccacagtccttttccttcttctctgcartgacatccatcatcagcttattgcttatgctttatttctagcttagtcttaatatttcaaaatatttcataaccagaaacatcactagaagacatcagga

SEQ ID NO: 73753 - DNA, 201 bp, Bos taurus
ataaaggctttcccagacaaatagaagccaaaggagttcatcaccactagacatgccttacaagaaatggtgaagggagtttttctactgaattgaaaagrcaaaagtacacaaaactttaagtaaggtcataaattgacagacggaactagaaaactgctactctatatcagaaaaggttgttaattacaacataaagat

SEQ ID NO: 73754 - DNA, 201 bp, Bos taurus
taataataattattataataacatcttgaatttatatagcacctttagcactactgtctcatcagtcagctgctatttctttgatggtcttcctcttgatrcttacataaaaaatggagagatggagagaacagaacccttgaattataaatattactttataggatcatttagttgaatacggcgatgcccagaatacat

SEQ ID NO: 73755 - DNA, 201 bp, Bos taurus; identical to SEQ ID NO: 34143

SEQ ID NO: 73756 - DNA, 201 bp, Bos taurus
ttagcgtccctgccctcgtggggttatgggattggacccagggcctgggcagctcattgttttgggacctaaatcaggcaagagtgtgtgtgctgaatatyctggtcaggtgaggccagcagttttgccctgcagacagggagagacatgggctatactctctgttcaggtgccatgtgaactgtcatgtcagcagggctg

SEQ ID NO: 73757 - DNA, 201 bp, Bos taurus; identical to SEQ ID NO: 34145

SEQ ID NO: 73758 - DNA, 201 bp, Bos taurus
tcgtgagtaactgaagccacagaaagcaaagccgtggataatggggaccactgggcacattctcaactattcccacatctgtgaagttgatgtcataatarcactattttattgagacattttgaagatggactgacataatagctataaagtatctagtgactgatacaggccaagtgcccaggagatgtacctgtagtt

SEQ ID NO: 73759 - DNA, 201 bp, Bos taurus
caccgagctgagctccctgtgttatacagcagcttcccactcgctatctgtcacacatgctagtgcgtatatatcaatgctgcttcccaatttgtctcacyctctctctctcccactgtgtgcacagctctgttctgtgcatcctgtctctattcctgccccacgagtaggttcatcagtaccatttttgtagattctctg

SEQ ID NO: 73760 - DNA, 201 bp, Bos taurus; identical to SEQ ID NO: 34146

SEQ ID NO: 73761 - DNA, 201 bp, Bos taurus; identical to SEQ ID NO: 34147

SEQ ID NO: 73762 - DNA, 201 bp, Bos taurus; identical to SEQ ID NO: 34148

SEQ ID NO: 73763 - DNA, 201 bp, Bos taurus; identical to SEQ ID NO: 34149

SEQ ID NO: 73764 - DNA, 201 bp, Bos taurus; identical to SEQ ID NO: 34150

SEQ ID NO: 73765 - DNA, 201 bp, Bos taurus; identical to SEQ ID NO: 34151

SEQ ID NO: 73766 - DNA, 201 bp, Bos taurus; identical to SEQ ID NO: 34152

SEQ ID NO: 73767 - DNA, 201 bp, Bos taurus; identical to SEQ ID NO: 34153

SEQ ID NO: 73768 - DNA, 201 bp, Bos taurus
taacttctgtcctgctagtatttctatgccacattagactgattggctttagaaccagtttatttctagccaaagaagtgatgaccagaaaattaataacrtgggagatgcctttcctttgtggacttccaggttggaagtctgaatatttacagtatatttcaagctctcccttgctttcatcccattctttttacacgt

SEQ ID NO: 73769 - DNA, 201 bp, Bos taurus; identical to SEQ ID NO: 34154

SEQ ID NO: 73770 - DNA, 201 bp, Bos taurus; identical to SEQ ID NO: 34155

SEQ ID NO: 73771 - DNA, 201 bp, Bos taurus
catgacatggaagacttaattttcaaagattttttttttttagatcttgaaacaaaattcaaatcataaaaattttacataacactttgaatgtttttttycaatatatacagacaaatattcagagttgagatgttttagtaccatgctcactcattattcttcccttttcatattgatagttcttttttttgaagtaag

SEQ ID NO: 73772 - DNA, 201 bp, Bos taurus
tggacctgcccatgaacaagcagtaagcagaagccaaattcctatgtggctcccaagggacaggcaggaactattccttctgattatttattgatgagccractccaaaggtagtagcctgtttcactgaatagggcatcttcacaatttggtcttcatcttgaatggcagccaaggaattcctaccaggagttaccaaga

SEQ ID NO: 73773 - DNA, 201 bp, Bos taurus
ctatatggacctttttcagcaaagtgatgtctctgctttttaatatattgtctaggtttgtcaaggattttcttcaaggagcaagcatcttttaatttcayggatgcggtcagcatcttcagtgatgttaatatttagccaatagaaatttgctgtatgactcagggtactcaaactagggctctgtgataacctagagga

SEQ ID NO: 73774 - DNA, 201 bp, Bos taurus
aaaactaagcattttcatttattgaagctatatgatctgctttctacaagaagtttgaaggagcttatagtggagagaagatagcataaacagggcaatgraaaagaaatggaaaagaaaacttgaataccaaagtaaaagatatgaagattacaccaggagagtaagcagattattgtatttgtttctgattttctgaca

SEQ ID NO: 73775 - DNA, 201 bp, Bos taurus
tataacaaataaataatagaaaaattaaagtttaaaaaagtttgtggttagtttaaaaactgaattattaggtgtggctagagtaggccactgtgtctgcrtgtgtaagagagtcagagaaggcaaagcctaagaagcagaaagggtgataatgttgcaaggaaatagaagtttggggtcttgtcaaactaagaatttgtt

SEQ ID NO: 73776 - DNA, 201 bp, Bos taurus
tgaatactttgtgatgatcaaaaaatctgtgtgctcctagaccccaccagacctatagctttcattttaaaattgctttttcctgggacagtattgaagaragcccaggtaaacaggctttgccagagactctactaaccacaggatgttgaatggaaattattatcattatttttatatttaagtccttgacactatcag

SEQ ID NO: 73777 - DNA, 201 bp, Bos taurus
ggaggggccaggagacttgtggtgctctcctgggcatcaggccctgggaggttcagatgatgctcccagtctctggcttcagggaattctctctcaggacrtctaccttgaggcccagttaaatgtatctgattccaactgtctcctggactcctaaacaggtatatccatcctccagctggttgctggtgaggggtgacc

SEQ ID NO: 73778 - DNA, 201 bp, Bos taurus
ttattggttaattcataaaacatatggcacgcttcctctgccagaagtgtttgggcaaaggaaaacaaatgaaaacaagaagaaataaatgatacaacatraaaacaatgcttttgaagcagagcagaaaggtcacctaattagggtttaattgatctagtaaagaggaaatcccatttctgtcctaggtatatctgtgca

SEQ ID NO: 73779 - DNA, 201 bp, Bos taurus
gcattactctgtagaaagcttggatgtttggcatcattgcctttgcttggaacttcagctaagactatgaactatgggaaattcttacttaatatccttcyacaacaatttaaggaagcaattatatttggggtaataagaaacattccattacccattaatttttgatttatcagtatatggtgtatccaaaggcatagg

SEQ ID NO: 73780 - DNA, 201 bp, Bos taurus
aataaaaaaatctgaatagctgggttcatttattaatgagatgtctctaagaaaatgaaagggatgttttcctcccagagtaaaatcaagtatcacataaygctctaaggaattccactttctaaaacaagatctgccctcatgctgtaaaaggtattgcccaatcaaagaccagttaatcaaatgctttgtcagcaaaaa

SEQ ID NO: 73781 - DNA, 201 bp, Bos taurus
ttttttgacacaagagaagccatttggggcctaagcttctgtgatctaagcctgcacagtgctcatccttcaacagggctcagtgattattttaaggaacraaagaatgcaggcctaaatgactaatatcaggcaagagaagtgaaaatagcagagataataaatcacttataaagactaccagttaatggtaatgactag

SEQ ID NO: 73782 - DNA, 201 bp, Bos taurus
aacagtgtgcctggaagagaaaacaatacttggggattcagggaagatggcaaagacaaggtatggttctaggagagctgaaaatagagtctggttgttgrtcaattaatttaggccacattaatagcactgactggattgtattaccttctttcttcacagatgccaggtcattacttttggagctgggtttttccctcc

SEQ ID NO: 73783 - DNA, 201 bp, Bos taurus
cctgagtatcagccccacccaacccacctggcctgctcctccaaagcagctcttgcctaccctagccagcagatggctccagctggcaccagtgcccctcyaaagccactcccactcctggcgaccagccctgcacaccaacatacccaccatagccacagctagtcctcttagctgggttaggaccaactctgccaacca

SEQ ID NO: 73784 - DNA, 201 bp, Bos taurus
ttgcctcagacataggcagctcctctacattccatttacttcatttggaggaagttctcctaacattcatttactcagtcattcattcaacaaatccttaytgagtttcctctctgtagctgttagacactgaaataagtggtgggtatactatgatagtttctgcttttaaagagattatagtcatgggcaggggcagtg

SEQ ID NO: 73785 - DNA, 201 bp, Bos taurus
tggcaaccctctccagtattcttgcctggagaatcccacggacagaggagtctagcgggcaacacccccatggggttgcaaagaggcagacacaactgagkgactagcactaacacaccccgggtttactcgggggtaatttttttctgctttcctcagtagttgacctgtttcagattcttccagagagcttgttaaaat

SEQ ID NO: 73786 - DNA, 201 bp, Bos taurus
ggaagaactagcttcgtctaaacacatcaacccatcgtcaaggatgaaggagggactagcttgggaggctatagctgttgatcctactagttagccgtggraaagctctatggaaacatcacccaggcaataatgagatgctgtaacaagtggtcctggggcaggactacttaggtgcacatgtacagaattctgtcgagt

SEQ ID NO: 73787 - DNA, 201 bp, Bos taurus
agtgactgaactgaactgactggactcatagaggtggagagtagaatggtggttgccaggtgctggagggagggagaaacagggagtggctaatcaaagcrtataaggttatggctgggaaagatgagtaagttccagagacttgctgtacaacattgtgcctataattaacaacgctggaatataacatataaaataata

SEQ ID NO: 73788 - DNA, 201 bp, Bos taurus
gcagcagtggccttctgggcagcggacataatggcaggcagcagggcccatatattattgccctatacacgccagttccactgatcacacatctgaagcawaaggcagagcgggcatccagccaggccaaaaggcctcttgctttctgatattacagagctacctatcagaattagtctttctcccccagttttcctgata

SEQ ID NO: 73789 - DNA, 201 bp, Bos taurus
tctgggtcatggaagatcaaaggcttggctggtctatggcagaacagttagaaaactatgaaatttaaggtaatatgaggggaaaggattcacataggacrtgaaaaggcaaggtcattgtctggactaacaaactaaaattgaaaacaaacataagatttagaattttaactccgtgtgcttgaaagcatcctcttcttc

SEQ ID NO: 73790 - DNA, 201 bp, Bos taurus
gacacttaatgatggaagtgccctagagacacttaatgatggaagtgcccaagaataacaccacttctttccctgcaagaagtcaaaggcactaaggacaygaaacagtgatgaaaacaaggataaagaagaattcaattactttcccacatataacactttcctcagaccattaagatttgtcctaatatttacatgaaa

SEQ ID NO: 73791 - DNA, 201 bp, Bos taurus
ggaggtgtgggtcggcggggctccccagagggacgggggcactggaaggtcccctttggtgtaaagtctctgacagtaaccctgctatagagcccatagaycacagggctgggtcacctcaggcaaaactaccagggagggaatgcaagcccactcatcggcagataactggattaaagctttactgagtaggccctgccc

SEQ ID NO: 73792 - DNA, 201 bp, Bos taurus
tccctgcctcgtggcctttgctcttgctagtcctcctctggagcacttgtcccctacatatctacatggtttcctcagtcccttcaagtctttgctcaagygtcatttgtcatctgaggccttcactaaccatgccatggaatacagcaattactattcttcctttacacatcttccttactctctataggtcctccttac

SEQ ID NO: 73793 - DNA, 201 bp, Bos taurus
cgcacttgggaatgttctttggactcacaggataatgaaagctccatcaaattctgctgaacccctctgaagctcccttccactggtggcctgacagtctytgcattctctcctccacctgtgagaactgatgagtccctccctccttcctacagccacgcctcagtctgggctctcatgcccccaggcctctctgctcac

SEQ ID NO: 73794 - DNA, 201 bp, Bos taurus
accacacaaagcaaagatccagcttctagcttctctctgctgggaatggcacatcacaagatctcttagaagacatcggagccttcttaaagatgcataakagagaaatcttaaggacatatgggagaacaggggagggggacaggaggatcctcacacacttggcacaaatggaagagaaagcaggaaaaagagctatgc

SEQ ID NO: 73795 - DNA, 201 bp, Bos taurus
tcaccgaaattctccaagccagttggcatcctacaattttgagctaatgaagccttctatttggattttgaaaacggttccaaaaattttggctaaatgtmttgttttgaatctgaatgaatttttaatatgaatccttcctgtagaaaactcaactcttcatcactggggtggttgttacaaatattttaagaagtaaac

SEQ ID NO: 73796 - DNA, 201 bp, Bos taurus
caatcatcagttgaattttaggacaatgaccacagtaagtgtctatgctttgtggaaacctgaagggcttacagataataggattatggctctactttcaytctctgtgaacttcttctggggcaaatgcagaggcaaagtctctttttcactctctgggcctgtctcactgaccgtagacaatttgctgaactttggacc

SEQ ID NO: 73797 - DNA, 201 bp, Bos taurus
acatgatttaatctcttggaaaaaggggaggatcttaccttgtcagaacacaatgctgacagatcaatatttgaacaaaagagcaaggtaagcacatatgygtgaggagaggttagaatggtttgattagatcactaacagcatctatcagagataccaattagggagtagaactctgtgagatattaagatggggaatct

SEQ ID NO: 73798 - DNA, 201 bp, Bos taurus
gatgttatcttctccaagagatgattcatttttgttttaggcaaacaggctgaaggcagataactaatccaatcaggaattgaatcttttctaaattcttyaggagggttagtctagtctgtttctcccttgctttcaaagagcagcccagtagaagtttcatctggcagcttggattatatgtcagatctttttcttcag

SEQ ID NO: 73799 - DNA, 201 bp, Bos taurus
ctagtccagcattctccccttttccatcttatcttcttattctatcctgctctctctttcttttcccatctcccttctctgtcctgtggagttaggggctrtgaggaacagactgagatctgaaatgccagcaaccatggattcaaattccaaaatgctaacttacacgctttgtgttaagtgcagtgtttgggtagtgtt

SEQ ID NO: 73800 - DNA, 201 bp, Bos taurus
ttgccgtatgcccttaggacaatatccagagactaagtgattattgtttttataattcccatcagtaatggctgtttcactggggattggttctgtagaaytcctcatgcctgccagtctgcatatataatgcttttatattagaattgtatatggttcatttccagataaatgtacagatgttgtgctatcatgttccca

SEQ ID NO: 73801 - DNA, 201 bp, Bos taurus
agggacagtgcagtcacagagcagctggcttcaggaaatgctccgcacagggcccagcactgatgatgcaaccagcaggggccaaggtttgtgaggcctcmgtaggcaatttctaattctggtctcgtttgacccttcagctgtaaccaacactactaaccagatgttttccagccttcttgacacctcccctcctggtct

SEQ ID NO: 73802 - DNA, 201 bp, Bos taurus
cagttgtttctcacatgaattctctccatccaggaacatattttccaagacctggttagtcagtggggtgatgtttagttgaccaggatcaactggctgartcattgtgtccacagtcatttcgtgactggtgaatttaatgaagctgatggaaaccaggatccattcagactctaagtctttgagggtaataccaatctc

SEQ ID NO: 73803 - DNA, 201 bp, Bos taurus
cccttacaaattaaaaatcagtatagtaaacatgaagaaagaaggtatcttagggtccctaatggtgtacttccagaatttctagtgggatatagacaaargatagatgttacggtgctccttttccctcaatttctaataaaatataaactaataaaaacatcccattgatttacaaagaatgatttttaaagtaatcaa

SEQ ID NO: 73804 - DNA, 201 bp, Bos taurus
attgttttcattttcctgatgaggaaatttaggcactacgaagttaaaaatattaagaaattcatcccaaggcacacagatagtaaatggccatttcaagytgcaaacttagatctgacttcaacacacttattaagggttacaaatgatgttcatattgcctctgacttcacttttctattatctatcaaactggcaggc

SEQ ID NO: 73805 - DNA, 201 bp, Bos taurus
aaagtactggagtttcagctttagcatcattccttcccttagcagtcaagaaaaaagggtgagagaaaatgatctcctgaaattatgttgctgatagactmaggcctccctcttaaaaaagagatttattcttctttacaaaggaaagttcgcaacattcctaaaggttagtgagaccataatcatctgtatttattaatt

SEQ ID NO: 73806 - DNA, 201 bp, Bos taurus
gaatcccagatggcatgaactggccccgtttaccccaggctcctctgggctcccagccaacccacatcttcagggtgctcctgaaggctctgaaaactgcrggcacttgaggatagacaggccttgttcaccctatggctacagtgccactgcccaggcccatgtgagtggcttgctttgtggcatcattttactgagcta

SEQ ID NO: 73807 - DNA, 201 bp, Bos taurus
ggccatcagcaaagacctgggagaggtggctcattcagggaaggaaataagtggagtggatgtaagaataaagacatatcttctcataaatctctatcaamgagcaagcagaccaggccacccgcacattacaggagaaaatgctaccaaattccggtagcttttatttctatgaatgagactttcatttgtccaggtaaa

SEQ ID NO: 73808 - DNA, 201 bp, Bos taurus
ctttaatccaattttctgccgatgggtcaggctgtttgttgtttggcctagcatgccctatcctggagtctacagactatggtaggcctgggacgacctcmagaaggacttatttcaatacacacctcccaggattgctactgcccatgcccctgtccgtgtggtaggccactgccaacccaggtctccacagaagagcct

SEQ ID NO: 73809 - DNA, 201 bp, Bos taurus
cacaccggacctgggcattcagtgggcagcaggaggctgccaaggaggcataaagtgaaccccgctagaggacctggggaggacactgcagtgataatttytactttaggagctttgcccagggctgacctgcttaaggtgcaaacataaataaatcatatacaataaagactctgttgccaagagctgcagggcagaaaa

SEQ ID NO: 73810 - DNA, 201 bp, Bos taurus
ccaaaagacatctggccccaatggctctggttataatagaaatcaatgtgtcatagtggtacagaattcaagttttggaattggaaagtcaagtttgaackctaactagccatgttactgcaagaggtaacctaattgctatgaatctgtttctttatctatagattagggatattgtattacatagctcctaagattttc

SEQ ID NO: 73811 - DNA, 201 bp, Bos taurus
tggacaaaaacaaattcattagttatcaaaacagtatatataatgttagggctcagaacaggctgctccaatgtaggccacaatggtatattgattatttygaactaaagttacttgagaaatagctggtggggaaaatcacataaaatacactctgaactccacccaccccggcccctgtcttcctcaaaagtgggaaat

SEQ ID NO: 73812 - DNA, 201 bp, Bos taurus
cagaaataaggggataattctaagtacaggcaacaaactgaacaaaggcaccaaagtagctactgttaggaattgcgggataaagcagtactttactagaycacaggataggagtaggaaatgaagcatgcaggagtttaaggaaaggaatactgattacagacagtcttgaatactctgataagaactacgagcaaaatg

SEQ ID NO: 73813 - DNA, 201 bp, Bos taurus
agcaattcctaactacagaagtgagggtcagcagaaacaaaggaaaaactattaaatgagaaaactaatgacaataattaagctatgaaacagagtcctartttctcctcaaaggataacaacatgatggatatccttgagctgttcttcttgaactaagaccaactcccttccatccagatggaggatggaaactatatg

SEQ ID NO: 73814 - DNA, 201 bp, Bos taurus
tttacagctaacacaactcgtttatgtgtctggccttgtcttttatagatgacgtttggaatctctgctgtacccgctgtattccacagcactacaactcygctctgttctcctccatttgtggcccgttatcttacaatgctttggagcttaagcctgcactagagatggcaaaggatctctcctggataattcctcttc

SEQ ID NO: 73815 - DNA, 201 bp, Bos taurus
ttttctgggagataagaggcaagcactggttgtttcctgagtcctgacgaaagcagtgtttggatttcacaggctctggcaatgtggccttgaggacttarggactaagtgatcacagggtcatatttatggcagtgcacacttgtggagcactgccatgctgctctgtgctctgggtgtcagtcattgtccactctctgt

SEQ ID NO: 73816 - DNA, 201 bp, Bos taurus
ttacagacaagccagcaaatatctgagtctaaagagatatgttatgcagaagctggtgtattaacttctgttgcacaaaatgtcttcactcctctgtattytttgtcctaaaaattaatatcaccattcacccatgttattcaagctaaaaagttaggagtcattttgacctaaagtggtatgcacccctgactggacctt

SEQ ID NO: 73817 - DNA, 201 bp, Bos taurus
gctgcgattcatggggtcgcaaagagtcggacacaactgagcaactgaactgaactgaaaattaagtttattattatcaatatatgaattgatgtcaatayaggccaattatgtgagattggatttaaaacatgcaggtaaaaagtaacacaggacatcactttttcttttaattacatatgattaagaaaatggttttaa

SEQ ID NO: 73818 - DNA, 201 bp, Bos taurus
acttctcagtaattgtagtggtagttgaatttctacttcactgactgaaattaccggttttaaaaagcacttattctatgccaagcatcctgctaagtackttacataaattatctcatttaactcttataaaaccctatgatataaatgttgttttactcactttacaaatggtgacactcaagcttagaacaaaggtta

SEQ ID NO: 73819 - DNA, 201 bp, Bos taurus
tatgctggttgacgtccgaagctggtagaattctgaatttggcaataaatggtgcatatcaaagaaactcatgaaaatgaaaagttgtctggccttctgarcttagttgtttcattttattccaatacatcatactgtctaacacttgcttgtacagtatatagagcccaaggccaaaaaatgtaagatgccaagcaggaa

SEQ ID NO: 73820 - DNA, 201 bp, Bos taurus
gtgtggaggcctcatgcctgctcctgccaaccccacagccccagcaaccattactctccaaaatcctaggttcttgtgggtgtgtgctcagttgcatccarctctgcggccccatggactgcagcccaccaggttcctctgcccatggaattttctaggcaagagtactggagtgggttgccatgccctcttccaggagat

SEQ ID NO: 73821 - DNA, 201 bp, Bos taurus
ctgtgtggctcggtaaaggtcccgtgtgcagaggttatgagcatttcactaaggagggtgatgcttcttcaggtccaacagcattctccatgtaagatgaygtatgagaactattctcatggtgcttttagcaaaaactgcctcatcaatatgtgttttcatacacaagttccttgctacctttgaattccatgatcagtg

SEQ ID NO: 73822 - DNA, 201 bp, Bos taurus
atgataaccgtactgtatcacacatcaagctccagtgtaattgcctgccttctcctgtttttcctgtcccttagtgtgcatgggcttccctgataactcarttggtaaagaatccacctgcaatgcaggagaccccagtttgattcctgggttgggaagatcccctggagaagggaaaggctacccattccagtattctgg

SEQ ID NO: 73823 - DNA, 201 bp, Bos taurus
gaaggagatgatgtcatgtggctcttctggcccactgggtttctaaacctgtatacttttgagcagactggcaccaaatgtggtcttatgagtctgaatgyttaatttggcccccaaagatttcctaatggggagtgcacttcctaactccactatatctgttatttctctcctacaatccattcttcacgtaacaaagtg

SEQ ID NO: 73824 - DNA, 201 bp, Bos taurus
acatgtatccacgtactctgtattttctctccaagcttagaagctattatggtggcaaccttgacccacagttctcatttgaggtgtttttctttaccttytgagtatgtaaactctttcaattttcattttctttttgaatcatgtgcttctggtactccagagcttaatgagtgtggactctgtccagagctacagtca

SEQ ID NO: 73825 - DNA, 201 bp, Bos taurus
gttttttattcttcttccatgggggaagctacttgctgaaagaatctgtgtatgtgtttagtgatgtgtctctacatgtctgaagacaatgatgtgacaargttctgtgatctcgggtgatacactatcatagtatgtggccatgtttaaataaaactaaaaattgatccttattaaaatcatcaaaaggatgaaaaccac

SEQ ID NO: 73826 - DNA, 201 bp, Bos taurus
tggctcctttgaacaagaagccaattatcaacttaggttccaaatcctatacagctgttccctcaccttgagctagctgacttcactgttaacttgaaaaktttgatgtgtttgtgtctgtgtgtgcacagctcaaatttacatttccaattaaaacaatgtccggacacccataaaatttaggtaaaagaaaaggtaatt

SEQ ID NO: 73827 - DNA, 201 bp, Bos taurus
tgttacctttattatatgggagaagaaaaataatctgccctgtgctctagaggaagattatcaatctgccaaggctgtttgctatgcaaatactttgggargatagttctaaacatggcaagtcatttcttctgctcacaagatgtgagacacccatagaaaattgtcccccaatatggcctctatatggcctctcactat

SEQ ID NO: 73828 - DNA, 201 bp, Bos taurus
atgaaatagcctttcttactgttttatgcagacttaggccataataactctacctcactttagcacaggttcctgcacagaagtctggtaccaggaaaacrgcgaaaccagaaaggagcaaggccctgaatagcacccgggaattgtccccagtggccttgtttgaagatgctcatgatgtgagccctggtctgcactgcc

SEQ ID NO: 73829 - DNA, 201 bp, Bos taurus
ttcaaaactgagcagtaaattctaatgtttttctttaatttttgtaagaccccctctcccctgtggtgaatgactttgagtgggctcagttgtgaccattyctcttatagttacaacagctagatgtgctttgggtagtattcacacccacattcaattaacataacccatgttcaatctgtcagcaaatgctataggttt

SEQ ID NO: 73830 - DNA, 201 bp, Bos taurus
gtcttcattcatgcattcattttctactcatgtatttaggtatttattggactgagtgctttgccgagttctatggatgcctacataccttagagaacttmctatatagtataaaatacaaataaataaatacaatatggcaatatagtatgctaaatttatgatacaaatcatagagggttcgtacaggctaacttgggg

SEQ ID NO: 73831 - DNA, 201 bp, Bos taurus
aattcagcattatgttaaaacattcaacttcatacatgtccaaaatgatgaaacttactagaaaattgcaccaggtacgtatttcctaacaatttgtatcrctgcataagacaatcagtgatattttagggaagatcatgctataaatgaaatgcaagaagatgatgtctgatgttgaaagaaggaagaagggatagaaaa

SEQ ID NO: 73832 - DNA, 201 bp, Bos taurus
atgaagaaaggcatcttcaacctcaaaagggcactgtttggtctggtcttctttcaaagagtagagagtccaagatgaaagcaaacctggcgcttttaccrcagtcaactgggggaagatgtcatttaatctactggataatagtgggaataagtgccagagtcatttcctagaattaatgagaaaatggcacgcaggcac

SEQ ID NO: 73833 - DNA, 201 bp, Bos taurus
atagaataaggaatatagatgtaggagcataaacattttgagagaaaaagaggtcactgaacgagtgaccacagcaaacaaaaaatagaacactcatttgkaaaagttaaaaaaaaatgttcctctttgttaccttgtatccacaaaatgcatgttttaaagcaaaaacccacatggaataaaaatatagtgaattttaaa

SEQ ID NO: 73834 - DNA, 201 bp, Bos taurus
ctttatataaggcctctagtttgcatatccaatttgcatttctgacaggctcactaagattaatttgtcctaaaaaacaactcttgactctcctacttttmttaaacctgctcctactcacacatctccccactctcccagttacccttgacaagaacttaagcatcattttttattcctctcctattcctccctaacaca

SEQ ID NO: 73835 - DNA, 201 bp, Bos taurus
agaaatgtggagtctggtggcacaatgtccagtgatatattgtgatgacaggagaagtgtgcacttgggtgcccaggaacagtgtaccttacctctccccyatcccgtattgccactgagggctttcggttctttgagagtgaaaggcagtgcagtatctcatcattttctccagaaactcttacaaaggttaagatagta

SEQ ID NO: 73836 - DNA, 201 bp, Bos taurus
tctgttaagattatggcattttctacagcaaacacaacagtaatgattatcgaatgctcccattagaatatttcatgagtcattcactcagaagcaaacamacacccaagattaatctaaagtagattgcttattactggttcttggcattatgctttcctaggggtaccagactctcctgtgaacaccaataaaagtatc

SEQ ID NO: 73837 - DNA, 201 bp, Bos taurus
tggcccccaggctggaacttccctgacagttaaaggtacaccctaatgctggcttcagggggttgttgtttttgtggctgttagattaatcctggacacartgcaaaaggctgaggcctctcagaaggtgggtgggaaggggcagcttctagagagtgaaccaatgccctggggtgcagtacactcggcagacacaattcg

SEQ ID NO: 73838 - DNA, 201 bp, Bos taurus
ttagtatggatcactgtaggaggcctctgggaatcccacaactttttttcattgtcaccatagcattccaactgccttaaccttcatgcctgtaaaaacargtactttttcaaatttgggccatatctcccatgtggcagtgttctgggttctttgtcctcaatgtggttatgaccactctggaaattcaagaaagacata

SEQ ID NO: 73839 - DNA, 201 bp, Bos taurus
atgaaagcttggtgtgtttgctgatgtaacacctgattccagttagtgtagttttcttgcctgaatttatgtctttctgaagttctcatgatttctgcttygtgagagctgttcattgattttttaccatctctgttctttggaaactttcctgagttttctaatttgtgatctttgtttttccttgttggatttgcttca

SEQ ID NO: 73840 - DNA, 201 bp, Bos taurus
tttcagtttcctcaactatatgatgtagttagtattccttaagtttcagaagaatttaagatgtattatgtgactataaattatatcattacattgatctrtttttatatactattcccaagtttcctgctttgtgaatatgtaagagcttttgggatttaaaaatgaggcaaacgtttttcacttggaaatgaaaatctt

SEQ ID NO: 73841 - DNA, 201 bp, Bos taurus
aatccaaatcatcctaaatgtctggattgtggtaaactagacaaaaacagaaagaggtggtcaagtggagaaaagcctgtgctctgctgcagatctatagkcaggctccaggatgctatgaggagggcttgctcagctctgaatcttacattcaggcggtgtgtgggggatggggagacagaggaagctgggggtcactca

SEQ ID NO: 73842 - DNA, 201 bp, Bos taurus
cttgcctccaatttgtctatcatttttgactgtgtgagaaggaaagtgctgggtaaaaagaggaaacaggagaagagataggaaacacacaggaaaaccaytgggagagaaaaggtgggaagtgattctatcctgagatttcacaggcatattcaaagctctagaataaaatatgcactcatttctggggcaagcatctgc

SEQ ID NO: 73843 - DNA, 201 bp, Bos taurus
ggagactcaaataagctcattttgtcatttgttggcagctctggttaaaagtttggcaaggtagtgcattaaaagcacgcaatgaaagtaaacttgatcakgtacctctcatttacccaggctctttcaggctcccagtgctggggttaaattgtaagctggcagaactgcacttgatatcttatattatggcagtgaaaa

SEQ ID NO: 73844 - DNA, 201 bp, Bos taurus
ataggttttcttttggaaacaacactagtttccatttatcatgtagatttaagcccttattgcattgctattaatatactatgacaatgaatgcaaaaccrctggagaaactaaaacttctctgaagcataattagaagtgagaaatgttctgagtcccaggggttttttttctgaccatttatattctgaccaacataaa

SEQ ID NO: 73845 - DNA, 201 bp, Bos taurus; identical to SEQ ID NO: 34156

SEQ ID NO: 73846 - DNA, 201 bp, Bos taurus; identical to SEQ ID NO: 34157

SEQ ID NO: 73847 - DNA, 201 bp, Bos taurus; identical to SEQ ID NO: 34158

SEQ ID NO: 73848 - DNA, 201 bp, Bos taurus; identical to SEQ ID NO: 34159

SEQ ID NO: 73849 - DNA, 201 bp, Bos taurus; identical to SEQ ID NO: 34160

SEQ ID NO: 73850 - DNA, 201 bp, Bos taurus; identical to SEQ ID NO: 34161

SEQ ID NO: 73851 - DNA, 201 bp, Bos taurus; identical to SEQ ID NO: 34162

SEQ ID NO: 73852 - DNA, 201 bp, Bos taurus; identical to SEQ ID NO: 34163

SEQ ID NO: 73853 - DNA, 201 bp, Bos taurus; identical to SEQ ID NO: 34164

SEQ ID NO: 73854 - DNA, 201 bp, Bos taurus; identical to SEQ ID NO: 34165

SEQ ID NO: 73855 - DNA, 201 bp, Bos taurus; identical to SEQ ID NO: 34166

SEQ ID NO: 73856 - DNA, 201 bp, Bos taurus; identical to SEQ ID NO: 34167

SEQ ID NO: 73857 - DNA, 201 bp, Bos taurus; identical to SEQ ID NO: 34168

SEQ ID NO: 73858 - DNA, 201 bp, Bos taurus; identical to SEQ ID NO: 34169

SEQ ID NO: 73859 - DNA, 201 bp, Bos taurus; identical to SEQ ID NO: 34170

SEQ ID NO: 73860 - DNA, 201 bp, Bos taurus; identical to SEQ ID NO: 34171

SEQ ID NO: 73861 - DNA, 201 bp, Bos taurus
aggccaattcactgcttgagagcattaaacatctgggtaactgctcctgggaaatgagagtgtgggtgtatgtcagactagtgcgtggctgtcctcaggcrtaggccatcatgagaattaaatgtacaacccataattacctcattcatacacttactttcttttaaacaaaacttactaagttgcaggtattttcatcaa

SEQ ID NO: 73862 - DNA, 201 bp, Bos taurus
ataaatctgaacttccaggtatgcaccacagatcctaaaagttatttcatggtgaacagcctcatctctagccttttttgtgcttcttacttggcctgttmaaagcaccagcaccacttagagcagcagcaggtaaagagcagtgctctagaaatcacaaatgtggagtaggccccagctttacattatttattgaaatat

SEQ ID NO: 73863 - DNA, 201 bp, Bos taurus; identical to SEQ ID NO: 34173

SEQ ID NO: 73864 - DNA, 201 bp, Bos taurus; identical to SEQ ID NO: 34174

SEQ ID NO: 73865 - DNA, 201 bp, Bos taurus
tgtcatatgctgagttccattttatagccataaatgattgtggaatgctgaaatcacagttgtttattagttaatatgtttggctaaggtaaagaaatcaytcaaagtcaagtcaataacatatgaatcataaaccataggtttaaagccaaaaggattctagaaaacaaaagcttagagaagcagatgtttaatatttca

SEQ ID NO: 73866 - DNA, 201 bp, Bos taurus
aggacggctcacactgactggagttaggtattcccttttctcatggtcaattaggctttgattgtattctagtagatttggatctggttaattagtttctyctgcttactccttgaaagaaaagttatgaccaaccaagacagcatactaaaaagcagagacattactttgccaacaaaggtccgtctaatcaagactatg

SEQ ID NO: 73867 - DNA, 201 bp, Bos taurus; identical to SEQ ID NO: 34178

SEQ ID NO: 73868 - DNA, 201 bp, Bos taurus; identical to SEQ ID NO: 34179

SEQ ID NO: 73869 - DNA, 201 bp, Bos taurus
ttgttcttggcccctttctaatttgttttttattcatttatagaccaccatgatttttttaacaaccaaattgtatggttttattttctcaattgcgagtyaacctgaacagactattggccctaattatggacagaattaagaactggaaatcaactgttttgtaatgaaggaaattattactgctaaatatacccaact

SEQ ID NO: 73870 - DNA, 201 bp, Bos taurus
cgacttagcgactaaacaacaaccacaaatacttaagtactcttttacctgaaagagtaatatgatgttcagggtattttttctaagcttttaatgttaastcatgaagttcatgcattctcaaaatgcttaataaaactaaacctgctgggcttgaactgaaaaataaatggtttatatgagttttaatctaataaaaat

SEQ ID NO: 73871 - DNA, 201 bp, Bos taurus
cttgcctgggaaatcccatgaacagaggagcctggtgggctacagtccatggggtcgcaaagagttggacacgaatgagcgactaaaccacctcaagtcaycctagtcagagatcacatttgtctgtctgtttcatacagtcctcctttggccagactgttctgataagcctgccgctctgccctcctatattgctagctt

SEQ ID NO: 73872 - DNA, 201 bp, Bos taurus
tactcagaagtcaggagctaagtgaagataagagggaacctctgtgtgctgtaggagccactgtcctcccacctctcaaatgcagggctgtgtgctcatgrcgtcactggccttggatgcacagacctcccccacagctggtgtcagcctccacggttcctgggctgggcagcccatcacaccatagagtctgcgctccag

SEQ ID NO: 73873 - DNA, 201 bp, Bos taurus
cgcagacgtcgtcggcagggtggtgagcggagggtgagaagtccagcccccagcaccacttaatggaaaattaattggacctggaggactgaagtaataaytcggatttgtcttagaacacagtgttgggctccctacctcattaacttcttggctcaggcattgagtagttattttattcagttttgacctcttgagttt

SEQ ID NO: 73874 - DNA, 201 bp, Bos taurus
ctttccctatatatggtctgattttttttctttttagtttattaaacagctttatattgagatataattcacataccacacaattcatccatttagggtaygattcagtggtttctagtcactgcagtcaattttagaacattatcatcaccccaagaaagaaaggcctgtactcagtagtggtcactcccaatttcctct

SEQ ID NO: 73875 - DNA, 201 bp, Bos taurus; identical to SEQ ID NO: 34206

SEQ ID NO: 73876 - DNA, 201 bp, Bos taurus
tagcttttaatagggaggcctgggcaacttctgcagattcagggcttacagttatatctaaggattcaacatttgaacttaaccctgtcaagttagggtcmagtatttccccaacattggccctaaatttgccttggcaaacctgttttggttttaaccttatctggaccttagccattcagactattaaattcttggcct

SEQ ID NO: 73877 - DNA, 201 bp, Bos taurus; identical to SEQ ID NO: 34208

SEQ ID NO: 73878 - DNA, 201 bp, Bos taurus; identical to SEQ ID NO: 34209

SEQ ID NO: 73879 - DNA, 201 bp, Bos taurus
ccttgaactgtctttgtcgccatcaagtttaaaacagacacatgttctacagaagaggattagaataaattttgaggtcttcctactctcttcatgccatratcctatagtagacaagacttccaccaccattaccagagcagtaccaccaccacacattaatcatctaacttaaatgattctaaaagaagaaactgaggt

SEQ ID NO: 73880 - DNA, 201 bp, Bos taurus; identical to SEQ ID NO: 34211

SEQ ID NO: 73881 - DNA, 201 bp, Bos taurus; identical to SEQ ID NO: 34213

SEQ ID NO: 73882 - DNA, 201 bp, Bos taurus; identical to SEQ ID NO: 34214

SEQ ID NO: 73883 - DNA, 201 bp, Bos taurus; identical to SEQ ID NO: 34215

SEQ ID NO: 73884 - DNA, 201 bp, Bos taurus; identical to SEQ ID NO: 34216

SEQ ID NO: 73885 - DNA, 201 bp, Bos taurus; identical to SEQ ID NO: 34217

SEQ ID NO: 73886 - DNA, 201 bp, Bos taurus; identical to SEQ ID NO: 34219

SEQ ID NO: 73887 - DNA, 201 bp, Bos taurus
ccaatttccagtatacaagttttccaacttttcaagatacctcctagcttgctcctaggtatcagctaccagcatattcagggatgtcccacaagaatccstccacttggttctaaacgtcctctaaatcccccttaactagcacacgctaatttgttctggcgttccatctcaacaatggtacaaaggagagaagaagaa

SEQ ID NO: 73888 - DNA, 201 bp, Bos taurus; identical to SEQ ID NO: 34223

SEQ ID NO: 73889 - DNA, 201 bp, Bos taurus
aggatcccccgtccctgggattctccaggcaagaacactggagtggattgccatttccttctcctccatcagagtctagtcagtaaataaactttccctaragtagggccttaggaagttgcagctcctgctgtatgctccgtataggcaggacctcatctcttgtgcattcttctgctaaaattcatggctcacctcaag

SEQ ID NO: 73890 - DNA, 201 bp, Bos taurus; identical to SEQ ID NO: 34224

SEQ ID NO: 73891 - DNA, 201 bp, Bos taurus
agactgtgtcaggagagcctgttccctgctcccaggcccctggtgctttctcccccagagcacttccggtactatctctgaatggtaggcttgactgtctmctcagctggactgggtgccaggcctggtggataagtttctgtctctagagcccgaacaagcccctggtgcatatgaggcttttagcaagtgtttgttgaa

SEQ ID NO: 73892 - DNA, 201 bp, Bos taurus; identical to SEQ ID NO: 34228

SEQ ID NO: 73893 - DNA, 201 bp, Bos taurus; identical to SEQ ID NO: 34231

SEQ ID NO: 73894 - DNA, 201 bp, Bos taurus; identical to SEQ ID NO: 34232

SEQ ID NO: 73895 - DNA, 201 bp, Bos taurus; identical to SEQ ID NO: 34233

SEQ ID NO: 73896 - DNA, 201 bp, Bos taurus; identical to SEQ ID NO: 34235

SEQ ID NO: 73897 - DNA, 201 bp, Bos taurus; identical to SEQ ID NO: 34236

SEQ ID NO: 73898 - DNA, 201 bp, Bos taurus; identical to SEQ ID NO: 34237

SEQ ID NO: 73899 - DNA, 201 bp, Bos taurus
tagaaatatcaaaacttggtcttttggtgtgagagacaggaagaagacaagatgcttgggggagctgaataggtggacagaaggagttatggatcaagatygctggaggtaaaggaaaataaaccaattagcagggaagctgagcctgcctaaagtcaattctttgagccattcttgctttacacagctctcttttctttt

SEQ ID NO: 73900 - DNA, 201 bp, Bos taurus
ctgcacccaaatctacaggccaggctcctctgtcctaggatctagatctgcttgtcctagcccatacactggtaatgtgttgacattaggacattgagttygcaatttgtaaccttgcggccatgaaaactcacttccaagctgtgtcctagtcatctgctgcccaaatctctgatgcctgcttctttcatccccactcat

SEQ ID NO: 73901 - DNA, 201 bp, Bos taurus
agtatataaatataaatgtatattttctcttgaagtgcttatttatttcacgtctagtgaaactaagcatatgttgtttattgaacatttgtagttcttcrtgtattactaatcaaattctcttaatcatatgagtagtcaatggacaattttattcctacttgtactattaaagcttagtagatacaattacagtgtaat

SEQ ID NO: 73902 - DNA, 201 bp, Bos taurus
agaacccaaggtccagagagagtattgccaagggtgcaaggttccatatgtctatccaaaagatcatttgttctgcaaaataactttggtatttgttcctrtaagtataaattacaagcttgaatctctagttttttttaagagatttcttttaatatcctataaatgctgggaaagattgagggcagaaagagaaggggg

SEQ ID NO: 73903 - DNA, 201 bp, Bos taurus
acaccaccgggataatatgtgcatgagggtcaaatttttaaaacattctcttttttgtctgcagggttaagagaagaaaacaaggaaaagataatgcctcrtgtttatatactcattgtttgtcaaataagaatattcttcctcaaatgaagaagaatccttttgaactttaccaactcaagcatgtagcttaatgattat

SEQ ID NO: 73904 - DNA, 201 bp, Bos taurus; identical to SEQ ID NO: 34243

SEQ ID NO: 73905 - DNA, 201 bp, Bos taurus; identical to SEQ ID NO: 34244

SEQ ID NO: 73906 - DNA, 201 bp, Bos taurus; identical to SEQ ID NO: 34247

SEQ ID NO: 73907 - DNA, 201 bp, Bos taurus; identical to SEQ ID NO: 34248

SEQ ID NO: 73908 - DNA, 201 bp, Bos taurus; identical to SEQ ID NO: 34250

SEQ ID NO: 73909 - DNA, 201 bp, Bos taurus; identical to SEQ ID NO: 34251

SEQ ID NO: 73910 - DNA, 201 bp, Bos taurus
aagtccaaatcaaggggaaaactgaagaaaagagggaaacaatcatataaaaatgaattaatttgcttcctctgtctaaaatgtggtaaaacttgaattgrtatgcaaaatagacttatgaatagtatttgatggatagaaaatgtgcatctgaattctttcccagatttttctctgataatatagaaggaaactaataat

SEQ ID NO: 73911 - DNA, 201 bp, Bos taurus
ataattgtggcctcctggcatctgctgccaagccccacatcccagactcatctctatggatagaaacaaacccaactctgtggcctcctctgccacactcrggcctgcactgcagagaaggccaccaccaaactacttagtgatgctggcacccagaccagtacatgcctcgtggccttgctgaatagttctttactcggt

SEQ ID NO: 73912 - DNA, 201 bp, Bos taurus
ctaattgaagggtgagtttggtgttattaagcttatacatttatatgttttgttgtttttaaagtttgagccttcaaccaattgactagggtaggctttcmaaagacttaagaggcctttgtttgttgaacaaatactttatattcaccactggaaaataggttaagcctgctgtgtcaattagcttaattgatgagaact

SEQ ID NO: 73913 - DNA, 201 bp, Bos taurus
ggactgagtggagccagagcattggcttggtctgggctggggcacatggtgagatgctcttaggacacctggcattcaccagagcagacttttctccactyggccttggggccaagtcgcctttgtctctcatggttcttcactgacctcagcctctcctgctttccctctgtgttaaactgccctgcaggggagtatgag

SEQ ID NO: 73914 - DNA, 201 bp, Bos taurus; identical to SEQ ID NO: 34262

SEQ ID NO: 73915 - DNA, 201 bp, Bos taurus; identical to SEQ ID NO: 34265

SEQ ID NO: 73916 - DNA, 201 bp, Bos taurus
tactgaccactgcagctctgacattctttggttataccttgagtgacctagattaaggatgcttggtagcaataatatattaggctgacaagaacagcatrcaatgacatttattagttttaagatattacacatttccaattttctgaaccatggttaaatatctgttatcagtaatacttttactaaagctatcttaag

SEQ ID NO: 73917 - DNA, 201 bp, Bos taurus; identical to SEQ ID NO: 34267

SEQ ID NO: 73918 - DNA, 201 bp, Bos taurus
tctgctattatagaagattggttacaaagatgtttggaaggttgcaaacaaaaaataattattgagataccaaagtattaatcactacaggaagggaacartactcatttagttggagaaacaaaggggacattagaatccagattcttggaggaggatggtctcccagacacaaattggaggcaggttctacccggctgt

SEQ ID NO: 73919 - DNA, 201 bp, Bos taurus
gttcattatctcctcattacaattaaattagctttgccagataagaagtacccatcatataccaatggcgtcacaattctgatcaagaatatgtagggacraaatccctgttcaccttggcaagaaggatccaggatgaaaaaaaaaaaaaaatcaacccaaactccttccttctcatcgtttctacactccctaataatc

SEQ ID NO: 73920 - DNA, 201 bp, Bos taurus; identical to SEQ ID NO: 34268

SEQ ID NO: 73921 - DNA, 201 bp, Bos taurus
gaagaaagaagtctgaaaacttgaggaggaaagagagggcacatcaagaaaagacatagaacggaatatgatagactataccactcaatgtagtaaagatmaatcaagttaaacaaaccaataatttatgcaatattctttttctacattatagttaatgacttgctaagagaaagaggcagtgagagctagaatgttgtg

SEQ ID NO: 73922 - DNA, 201 bp, Bos taurus; identical to SEQ ID NO: 34269

SEQ ID NO: 73923 - DNA, 201 bp, Bos taurus
catgcttaagcagatctcatgttttcttaacaacagaacaagcaaaatcaaactatacagcatatacattattccatatcaatttgtatactcagttattygggggctagaaaataaaatttacttggtagtagcaatgcccttgtattctaaaccaagtcaatggtagatatgtagtaacttaacaaatgtatacatgta

SEQ ID NO: 73924 - DNA, 201 bp, Bos taurus; identical to SEQ ID NO: 34272

SEQ ID NO: 73925 - DNA, 201 bp, Bos taurus; identical to SEQ ID NO: 34277

SEQ ID NO: 73926 - DNA, 201 bp, Bos taurus
agtagtacaagtataatgaagtctagatgtttgtgatcttctattatggactttatgccctgaagggcttctgatagggtgttgcctaattctgggagagrtttcaaggcctctatttgaatcttgatggaaggcatgctatgaattttgtcactatcacctggagatttgacctataaagagagtggtagctaattaaaa

SEQ ID NO: 73927 - DNA, 201 bp, Bos taurus
gtaatagtttacacaaatatcagaaatgtttaaactcaaaaccacttatgacaattgactgaggtaattcttaaactggaatcacattcacatttactacrtatatttctttggttacttaccaactggaatgcaatcctgagaaaaagtgagtggcagttttcagagaggctttaaatatatatggtccacaggagttgt

SEQ ID NO: 73928 - DNA, 201 bp, Bos taurus
attcaaaaaggccatttttgtttgtggatttcagattccttgaattcttggaaagcaaaacagaagaatcctgactaaaggctttctggtaagtacctacsaaaagctatgattcctatacctaacaggatgaagagagactaggataagcctctctggtgttgctgagtagataaaaggtagaggccatctgtcatcaaa

SEQ ID NO: 73929 - DNA, 201 bp, Bos taurus; identical to SEQ ID NO: 34280

SEQ ID NO: 73930 - DNA, 201 bp, Bos taurus
caaacataaggaatttcccttctagcagcttccgatcttgatgtggaatataaaagaagagtatttaaaacaaaaattaatgatgcagataattagattayagaattagggaggacaaaaatcctggtagcttgataataatcataaataaaatgtaagacaagaagtaatattgttaacttgattgaaggattggacttg

SEQ ID NO: 73931 - DNA, 201 bp, Bos taurus; identical to SEQ ID NO: 34283

SEQ ID NO: 73932 - DNA, 201 bp, Bos taurus; identical to SEQ ID NO: 34284

SEQ ID NO: 73933 - DNA, 201 bp, Bos taurus
tcaaaaacacatgatgaaaatcaaaaaggagtacctaggccagttgaataggaggctgtcacagtaaccaaagaaggaaaatttcctgagtcagttgatcrtagaattaaatgtcacaggaggtcaacagaatggaggcaagaataaagtccaaggatttaacaatttcaagccgtgagacacaattctgatagacaactt

SEQ ID NO: 73934 - DNA, 201 bp, Bos taurus; identical to SEQ ID NO: 34286

SEQ ID NO: 73935 - DNA, 201 bp, Bos taurus
ccattatgatttatcacaggatattgaatatagttccctgtgctacacactaggactttgttgcttatccatttggagtttgtagttattggccaaccttwacacattagatttttattagcatatctgtttatttgttactataacatcaattaaaatatgtaattttatttcatatatccttatttttctgggggccaa

SEQ ID NO: 73936 - DNA, 201 bp, Bos taurus; identical to SEQ ID NO: 34290

SEQ ID NO: 73937 - DNA, 201 bp, Bos taurus
tttatattttaaccttagaaaaataaatgtatcagaccataagaatccacagagagagaggcgacaagggagaaatgtcagttctcccttgggaaaagagrttctccttaggggaagggaggttgcaactgctttttgacacttagcagtcagagtaagtgacaatgaaaagtagataatgcttgtgacaataatagcaat

SEQ ID NO: 73938 - DNA, 201 bp, Bos taurus
aaccatacccactatgcttggtaaactttgttgtcacatactctcaattgttttccaactatggtgcatccctcatgtcttatcacactttttagatatayaagggtgtttaactcatggctttggaatgagctgaagctaagtggctcaagctgagattgcttctttggttttcttaacatggtacattcaaaagctgga

SEQ ID NO: 73939 - DNA, 201 bp, Bos taurus
gaaggggacaggtaatgattgattttttgaggacttgagagaaattatgatcaaaagcataggaaggataattagctttgaaggatggaaatatttcattkaactgatagtagtgggaaatgatagggattggagaagatacggagattattagcttggtaaaagattttttgctatattaactctgataaactgtgtttt

SEQ ID NO: 73940 - DNA, 201 bp, Bos taurus
tgcttatttactcttgagtgtacactggctaatgaaaagccacacaaatgtggtttgaaatgttgtcacacatgataaaactgtcacagaaattttatcayaaacatgactaaagcacaggaaattttctcggggtcatccttccaagtttcatcgtttctccacagattcttgagagactattttaataggaaatgtatt

SEQ ID NO: 73941 - DNA, 201 bp, Bos taurus
gtttatttgtcagagtttggaatctctagcgcagacactgaggtggaatttgagatgcaagatactttttggtactcaacacctgtgaaaaaaaagagaaracacaggattgggtagaaggagaaacaagcggatgttagctggttgaaatctcagtcaggccagcaagaaatttggcaggcctgttgcctaccaggatgg

SEQ ID NO: 73942 - DNA, 201 bp, Bos taurus
atacttcatgttataaacatctgcaggataaaatgtcagataataatcataggaaattaaaattcagtttaaccacatcatattgaacctatattttgccwttataatttactaaatttgatcctttctatgtgttacttgttgattttttaaaaataaacaaccttattcatatctgtcgctttttcaaaatcatctttt

SEQ ID NO: 73943 - DNA, 201 bp, Bos taurus; identical to SEQ ID NO: 34295

SEQ ID NO: 73944 - DNA, 201 bp, Bos taurus; identical to SEQ ID NO: 34296

SEQ ID NO: 73945 - DNA, 201 bp, Bos taurus; identical to SEQ ID NO: 34297

SEQ ID NO: 73946 - DNA, 201 bp, Bos taurus; identical to SEQ ID NO: 34298

SEQ ID NO: 73947 - DNA, 201 bp, Bos taurus
gaatctcagtgcactttgctagttgatgatgggaaggtaactaacttctgatgccagagtattcatgcaagttctcgcccatttctccaactggctctcaytgccactttgcatttatcccagaatgcccaactcttcctcactgtattcctgtggaaacctttgtgagcccagttcaattgtccatgactgccatgtaaa

SEQ ID NO: 73948 - DNA, 201 bp, Bos taurus; identical to SEQ ID NO: 34299

SEQ ID NO: 73949 - DNA, 201 bp, Bos taurus; identical to SEQ ID NO: 34301

SEQ ID NO: 73950 - DNA, 201 bp, Bos taurus; identical to SEQ ID NO: 34302

SEQ ID NO: 73951 - DNA, 201 bp, Bos taurus; identical to SEQ ID NO: 34304

SEQ ID NO: 73952 - DNA, 201 bp, Bos taurus; identical to SEQ ID NO: 34305

SEQ ID NO: 73953 - DNA, 201 bp, Bos taurus; identical to SEQ ID NO: 34306

SEQ ID NO: 73954 - DNA, 201 bp, Bos taurus
ccccaccctaggccttccctaccagacactctggggctgagacccaggaatctgagttttaacaagtcctccagaggggccagggagggggagcttgcagrttcaagaagctgaggatctctgttttagggaaaaggagagatcctgccaggggagtaagaaggttaaagcaatgcaggaccccacagggtagtgtacaca

SEQ ID NO: 73955 - DNA, 201 bp, Bos taurus; identical to SEQ ID NO: 34310

SEQ ID NO: 73956 - DNA, 201 bp, Bos taurus; identical to SEQ ID NO: 34313

SEQ ID NO: 73957 - DNA, 201 bp, Bos taurus; identical to SEQ ID NO: 34318

SEQ ID NO: 73958 - DNA, 201 bp, Bos taurus; identical to SEQ ID NO: 34319

SEQ ID NO: 73959 - DNA, 201 bp, Bos taurus; identical to SEQ ID NO: 34320

SEQ ID NO: 73960 - DNA, 201 bp, Bos taurus; identical to SEQ ID NO: 34321

SEQ ID NO: 73961 - DNA, 201 bp, Bos taurus; identical to SEQ ID NO: 34323

SEQ ID NO: 73962 - DNA, 201 bp, Bos taurus; identical to SEQ ID NO: 34324

SEQ ID NO: 73963 - DNA, 201 bp, Bos taurus
gaatggagacaccacccaggttcagacgatgctcatggccctagaaggtatgaccaaaacaaacggattccatacaaccatttacattggagctaagtacrcagaaaaacaagatgttctgatgaaggaaaattaaaagctggccaaagtgtaaccggtttgtagatgggagccaacaaatgggccaggcgagtagggaag

SEQ ID NO: 73964 - DNA, 201 bp, Bos taurus
gtaactattattttgggaaaataattcttaaggcaatgcttttattttgggggtaatatacttcatgaatacacagtgtgtgaagtaccagcacagaagcyacacacaaaagtgggtacaaaatgaacactggcctttatgagcggagaaccaggagccccaggacctacttggctaggcttcaaatcagctttcccattc

SEQ ID NO: 73965 - DNA, 201 bp, Bos taurus
aactcatcttggcggtcaatacattgagtgcctgtgtacttttctgtgttttaaaatatctctacaaataattaaaaggttcaaataacaaaagagcaaayggaagagtctgttgtaggaattgcccaaagactacctttttttgtttgattccacagaccttattctatctctaaatcaaaatgctgcatatgaaatagg

SEQ ID NO: 73966 - DNA, 201 bp, Bos taurus
ctctggttaattggtattttttttaaagacttctaaaacacatgcatgcaaattactgtttttccaattcttagagactcaagcaaagctttcaaaattayagcctccaagctatgtttgaagagactgggcctcccctatacagacagaatacaccctcggagccttgccaacaaaaccgggggcaaagcgtgacagaga

SEQ ID NO: 73967 - DNA, 201 bp, Bos taurus
ataaactgagaagagatgaagacatttataagcactgaaatatttttgtggttgtatgtaatttaatgtgatgcacctgttttatattttgagaaacttaytcttctgttttaaaaaattgatacgcaactgtgcttttctaacaagaaccatactagtctgttttttgtctacctctctctcaccaatctcccatgtctg

SEQ ID NO: 73968 - DNA, 201 bp, Bos taurus
cattaaaattatctgggaggcttttaaaaacattaatgtccaggttccattctgcccagatcagcacctctgagatggggcctggatattgggttttaaartattttatttattttaaagtctttgttgaatttgttacaatattgcttctgttttatgggttttggccaacaggcatgtaagatcttagctccctgaaca

SEQ ID NO: 73969 - DNA, 201 bp, Bos taurus; identical to SEQ ID NO: 34326

SEQ ID NO: 73970 - DNA, 201 bp, Bos taurus; identical to SEQ ID NO: 34327

SEQ ID NO: 73971 - DNA, 201 bp, Bos taurus; identical to SEQ ID NO: 34329

SEQ ID NO: 73972 - DNA, 201 bp, Bos taurus; identical to SEQ ID NO: 34332

SEQ ID NO: 73973 - DNA, 201 bp, Bos taurus; identical to SEQ ID NO: 34333

SEQ ID NO: 73974 - DNA, 201 bp, Bos taurus; identical to SEQ ID NO: 34334

SEQ ID NO: 73975 - DNA, 201 bp, Bos taurus
tgcaactcttctgacaccactcctacaaagtataggtctttttcaaggtaaagcaccacgtttatcttagttatgtacgtcttaaccactagatataaaaytgtactgcagttcttacaagactccatgggtgacactgatgaagttttgagtgttgtacctttaaccccatttcccccataagccttgtgatttttgttg

SEQ ID NO: 73976 - DNA, 201 bp, Bos taurus; identical to SEQ ID NO: 34335

SEQ ID NO: 73977 - DNA, 201 bp, Bos taurus
aggactcagtgcttttaccatgggcttggttttgatccttggttgtggaactaagatcccccagaccacacagcatggccaaataaataaataaaacattktagagataggtcaaagacagactcagtgacaaatagtagataagttcagctaaaattaatcctttgtccaaaaactttgggaaacattgtttggatgagc

SEQ ID NO: 73978 - DNA, 201 bp, Bos taurus
gaggccctttctccagtacagtcacgtgagggttagggctttgacatacggattttagtgggacagtttggtccattgcagtggcacacaaagccagtctygttgtcaacaacagtgacataggaaacatatagagttttctagcttcctttcactacagttttttaacactttgtttcctttttcactttttcaattgca

SEQ ID NO: 73979 - DNA, 201 bp, Bos taurus
cagtggccataatgtttctaagacaaaggcggtatttccatgccacagagtccagttgctatctataataccctatgagtcaatggtaattgccatgtttkgagtgaatgggccaagggcattccttttattttcatatgtaaaagggggatctgatttgcattgcccaagttcaggtaggttcatcaaactttcctttaa

SEQ ID NO: 73980 - DNA, 201 bp, Bos taurus
actttgtgaaactcagagacagtacaataaacatggtaatagaagggacaccaggatgtgaaaggccctaggagaacctgtcctaatcttggttgccaggraaggttccccagaggatgtgttgtttagggggattgtaggatgctcagaatttaaggtacagatgggctgaagaaggaagcaggtatttcatgagtagga

SEQ ID NO: 73981 - DNA, 201 bp, Bos taurus; identical to SEQ ID NO: 34338

SEQ ID NO: 73982 - DNA, 201 bp, Bos taurus; identical to SEQ ID NO: 34339

SEQ ID NO: 73983 - DNA, 201 bp, Bos taurus; identical to SEQ ID NO: 34340

SEQ ID NO: 73984 - DNA, 201 bp, Bos taurus; identical to SEQ ID NO: 34343

SEQ ID NO: 73985 - DNA, 201 bp, Bos taurus; identical to SEQ ID NO: 34345

SEQ ID NO: 73986 - DNA, 201 bp, Bos taurus
tagcaaaggccctaagatactagttttcattagttcaggtgtttgcctcctccagctgtttatttttgaagataaagacaatctgctgtatattttcttgrctgcttcaaggtcactggctttcaagggttcagggcccccccttttttcggtatctgtccaatattaagtcctctgaggtggcctggtccctctccaacc

SEQ ID NO: 73987 - DNA, 201 bp, Bos taurus; identical to SEQ ID NO: 34347

SEQ ID NO: 73988 - DNA, 201 bp, Bos taurus; identical to SEQ ID NO: 34348

SEQ ID NO: 73989 - DNA, 201 bp, Bos taurus; identical to SEQ ID NO: 34349

SEQ ID NO: 73990 - DNA, 201 bp, Bos taurus; identical to SEQ ID NO: 34350

SEQ ID NO: 73991 - DNA, 201 bp, Bos taurus; identical to SEQ ID NO: 34351

SEQ ID NO: 73992 - DNA, 201 bp, Bos taurus; identical to SEQ ID NO: 34353

SEQ ID NO: 73993 - DNA, 201 bp, Bos taurus; identical to SEQ ID NO: 34354

SEQ ID NO: 73994 - DNA, 201 bp, Bos taurus
tcaattaagttcatcattttttaaaatgttatatcattgtatttaagattttaatatgaattttctttaaccaccaagtttttgagtgagtgagtgaagtygctcagtttccgactcttcgcgaccccatggactgtagcctatcaggctcctccgtccatgggattctccatgcaagagtactggagtaggttgccattt

SEQ ID NO: 73995 - DNA, 201 bp, Bos taurus
gatagtcataccactgagttttcattgtgcagagttcaactctttgactaatgctcacccagctgcagagagggaggatcaaaagctataatgagatgaayatagcttatgatattttaaaagattattatatattatgaagctttggtggaaggagaggttgaatctagagccctaaaaagatctggcacccattctatg

SEQ ID NO: 73996 - DNA, 201 bp, Bos taurus
cctgttttattaagtgtggcataaaatgataggattttatgctaataaacttaaaacaaccatctttgccatcagcatataagctttgtaatgggccacarcaaaaatggcatcagaagtttacacagagatacaaggagatacttacacaataattttaattatataccaaatttttaacaatgaatactgatggccaat

SEQ ID NO: 73997 - DNA, 201 bp, Bos taurus; identical to SEQ ID NO: 34357

SEQ ID NO: 73998 - DNA, 201 bp, Bos taurus; identical to SEQ ID NO: 34358

SEQ ID NO: 73999 - DNA, 201 bp, Bos taurus
ctccagtactcttgcctggaaaatcccatggatggaggagcctggtaggctacagtccatggggtcacaaagagtcagacatgactgagatattcacttcrctacttccaattacttccaagggttaagaataaagagaaaaaaaaaaagaagcaccagtgtgagaagacggtggtatgtgaaatacagagggcctgggca

SEQ ID NO: 74000 - DNA, 201 bp, Bos taurus; identical to SEQ ID NO: 34359

SEQ ID NO: 74001 - DNA, 201 bp, Bos taurus; identical to SEQ ID NO: 34360

SEQ ID NO: 74002 - DNA, 201 bp, Bos taurus; identical to SEQ ID NO: 34361

SEQ ID NO: 74003 - DNA, 201 bp, Bos taurus; identical to SEQ ID NO: 34362

SEQ ID NO: 74004 - DNA, 201 bp, Bos taurus
tcagattggcaatatattttcacatggaacaggaaagaaatcctttgtgttacttattcacttctccttatgtttgagaatttttttgaagtttaaaattractataaaaaatgaacaataattgcaataacattgaagttctcaattgatgctagagatagaagggtagtggcttcaaaattatgagggaaattgttttt

SEQ ID NO: 74005 - DNA, 201 bp, Bos taurus; identical to SEQ ID NO: 34364

SEQ ID NO: 74006 - DNA, 201 bp, Bos taurus
caacaagctaagggactgaatggctgacttgcaagttgagaaacaccaacttgaaagtctaaattcacagaaatcttctagcactgataattttcaagaamaagtaagacagtgggagacagaaacggggaggggaagaaagaacatatttttccactcataacccggcagcggctagcttgtcactttccctgttcaatc

SEQ ID NO: 74007 - DNA, 201 bp, Bos taurus; identical to SEQ ID NO: 34365

SEQ ID NO: 74008 - DNA, 201 bp, Bos taurus; identical to SEQ ID NO: 34367

SEQ ID NO: 74009 - DNA, 201 bp, Bos taurus; identical to SEQ ID NO: 34368

SEQ ID NO: 74010 - DNA, 201 bp, Bos taurus; identical to SEQ ID NO: 34372

SEQ ID NO: 74011 - DNA, 201 bp, Bos taurus
cccatgaaagactgtccccatctctgcttttttttaggggcagtgggcaacataaaataggcctgccagatggctacaactcattactgcctggcagcagrctggggaaaatgagagtaaattaatcagcattcaggaggaatgaatggcaaaggggcgatgtgtattgatgctattttaacgcaagtcaaattaaacctg

SEQ ID NO: 74012 - DNA, 201 bp, Bos taurus
ttgccattgccttctccagagtcaagactgcctgggatcaaatcctaaatccatcagtttctatgatcttgggcaaactgcctcattttgattctctacaycttcttttgttcatctgtgaattaagagtaagtgactacaacataagaattaaacaagacccacaaaggtcttttcacagtgtatggcaccaaagtgatc

SEQ ID NO: 74013 - DNA, 201 bp, Bos taurus
ttttgatcaagagggaaaaacagaatacaaccgctcaacaatttgttaagaataatcttctaattccttggtcaacatttttctaaaatgtcaatctttgrcatcccttgggtaacctttaggaatcatggattctccccctatgcttaattatcttcacatttttccttaggtttgctctaaattttgtgatttattcta

SEQ ID NO: 74014 - DNA, 201 bp, Bos taurus
gattgctaaaagtttagcctgcctggattataatagctcttgcaaatcttttttttttaatgagaaaagagtgcttggttagcatgataaaagattccaartgcatttatctcataaaaggaaaaatgaaagttttttaggatgttcatttgaacattactctttctcttattatgactatcatgtcccccaaaagatgga

SEQ ID NO: 74015 - DNA, 201 bp, Bos taurus
acattaaaaattttgtggaacatatttattatttatatttatcagtcaagatttcagtaccaatagtttttatgcttctgtgctttaaaatataatcatcrtgaagtcttgaaatgttgattcaaaattcatttcagtgtaattttattttgtgaatataaaaaaagcgttttcatcagtgaaggcctatatgatcacagc

SEQ ID NO: 74016 - DNA, 201 bp, Bos taurus; identical to SEQ ID NO: 34373

SEQ ID NO: 74017 - DNA, 201 bp, Bos taurus; identical to SEQ ID NO: 34374

SEQ ID NO: 74018 - DNA, 201 bp, Bos taurus; identical to SEQ ID NO: 34375

SEQ ID NO: 74019 - DNA, 201 bp, Bos taurus; identical to SEQ ID NO: 34377

SEQ ID NO: 74020 - DNA, 201 bp, Bos taurus
actccagtattgctgcctggaaaatctcagggacagaggagcctagcaggctacagtccatgggatcgcaagagtcggacatgacttggagactaacccayacaacattcaaacttcaactcgaacattaggtaactgagttccaaaggtgttcttctgtctctcctccactgggaaatttacaatggccccctctctcta

SEQ ID NO: 74021 - DNA, 201 bp, Bos taurus
cactcagtcatgtctaactctttgcaaccccatggactgcagcatgccaggcttcgctgtccttcaccaactgctggagcttgtgcaaactcattcccatmgagtcggtgatgccatccaaccatctcatcctctgttatccccttctcctcctgccttcaatctttcccagcatcagggtcttttccaatgagtcagttc

SEQ ID NO: 74022 - DNA, 201 bp, Bos taurus; identical to SEQ ID NO: 34399

SEQ ID NO: 74023 - DNA, 201 bp, Bos taurus; identical to SEQ ID NO: 34450

SEQ ID NO: 74024 - DNA, 201 bp, Bos taurus; identical to SEQ ID NO: 34451

SEQ ID NO: 74025 - DNA, 201 bp, Bos taurus; identical to SEQ ID NO: 34452

SEQ ID NO: 74026 - DNA, 201 bp, Bos taurus
gaatgatagtaaaataaggtcataagtgtggggacttgataagacaggaatcatgttctttataagaagggacacaagagatcgcccctggctctgtgcaracacagagaaaaggccatgtaaacacagtgagctggtgaccgcctacaagccaaaagaagaatgaaaccttccctgctagcactttggtcttggacttct

SEQ ID NO: 74027 - DNA, 201 bp, Bos taurus; identical to SEQ ID NO: 34455

SEQ ID NO: 74028 - DNA, 201 bp, Bos taurus; identical to SEQ ID NO: 34456

SEQ ID NO: 74029 - DNA, 201 bp, Bos taurus; identical to SEQ ID NO: 34457

SEQ ID NO: 74030 - DNA, 201 bp, Bos taurus; identical to SEQ ID NO: 34458

SEQ ID NO: 74031 - DNA, 201 bp, Bos taurus
cttaatttcatgggaaggacacatttcctctgctgttatgatgaaagcaatcattctctagacagctaaaaagcgaagaccactgaaaagtgcctacaatrtaatgaaaagtaaaacagcaagatgtaaaacttcatgaggaaagacttcattctataatgggtgcacagaaaaaaaaatagtatgccagtatgttaatga

SEQ ID NO: 74032 - DNA, 201 bp, Bos taurus
gtgtatgtatatataatgatcataatatataccataatcagaagagcatggtaaaggagcatactagtgtctaaagctaatttttataattaatgaactgrgcatattcagaccttctattgccttttatgtcactgagaactactgagttgacttcaaatgaattggtcaagttctgaaagcctcacagaatgacacagg

SEQ ID NO: 74033 - DNA, 201 bp, Bos taurus
cttataagccagaaaaagagtcacagaaataaccacccacaatccatcagcaccttctgctggctttacatccaaattatatttcaggtatgacacatccygcaatcttccctgccagaatccagtttaagacatcatgactttgaatccagactatgactgtgctcttggcctgcttatggtctgttccccaccagctgc

SEQ ID NO: 74034 - DNA, 201 bp, Bos taurus
gatgggatgtcattttaacgttgcttttaattgacaagggcctcggtgactgtgtgcgtgtggctacatgcctggcataggatgggcagtggaattagaartcgttacctgctccttctggccaagaacctggagctgtaattgtgtcaactggctagaacacattgtgttaactcgtcatcaaaggccttattttgctga

SEQ ID NO: 74035 - DNA, 201 bp, Bos taurus; identical to SEQ ID NO: 34462

SEQ ID NO: 74036 - DNA, 201 bp, Bos taurus
ccgcacaagatgctctctttgctttggtggctttactggggggtactttgggtttcagccaaacagtcagccaaaaccagcccccaaatggaccttcccaygggggcactgtgcccaggttatcatccagattcaggctaccctggaaatgggcatcttgccggggaccctgggtgtcctttcccatctgacccatctcag

SEQ ID NO: 74037 - DNA, 201 bp, Bos taurus; identical to SEQ ID NO: 34464

SEQ ID NO: 74038 - DNA, 201 bp, Bos taurus
ccttcaaaatattttgcagcaacaatgagaaaagagcttctgcaggaaaaataaaaagcaaaaccctgactctaattccaaggccaatgacaccacgctgyatataatacagtttcttttgtgcaaaagtaagagcatgagtacaaagggaacatttatgagagccagcatgatcaatttgaagaaaacagtggccagaaa

SEQ ID NO: 74039 - DNA, 201 bp, Bos taurus; identical to SEQ ID NO: 34465

SEQ ID NO: 74040 - DNA, 201 bp, Bos taurus; identical to SEQ ID NO: 34466

SEQ ID NO: 74041 - DNA, 201 bp, Bos taurus; identical to SEQ ID NO: 34467

SEQ ID NO: 74042 - DNA, 201 bp, Bos taurus
ctatcattaggataatttaagtgcactttccagtgtttttcaacattcactttttccctacctatccggcttcacttttcttggtaatttctttttctttrtaattcttctgtcttttgctattttattgtccccaatattcttcataatttatttcatttgaaatttgtatctattgttcaaattgtgctttttaatact

SEQ ID NO: 74043 - DNA, 201 bp, Bos taurus
gaccaagtgccaaaggccccacagcacccagtggacacccaggcaccacagcgggatccctgcgggtcctccctgactcctctctcaccgttactctccayggcactcgacggccccaccctacaacttgacccttgaaaggtttcttaatcttcgttctcccacccattccacacctcaatccccgctcaactcatccgc

SEQ ID NO: 74044 - DNA, 201 bp, Bos taurus; identical to SEQ ID NO: 34469

SEQ ID NO: 74045 - DNA, 201 bp, Bos taurus; identical to SEQ ID NO: 34472

SEQ ID NO: 74046 - DNA, 201 bp, Bos taurus; identical to SEQ ID NO: 34473

SEQ ID NO: 74047 - DNA, 201 bp, Bos taurus; identical to SEQ ID NO: 34474

SEQ ID NO: 74048 - DNA, 201 bp, Bos taurus; identical to SEQ ID NO: 34475

SEQ ID NO: 74049 - DNA, 201 bp, Bos taurus; identical to SEQ ID NO: 34476

SEQ ID NO: 74050 - DNA, 201 bp, Bos taurus; identical to SEQ ID NO: 34477

SEQ ID NO: 74051 - DNA, 201 bp, Bos taurus
tgagagccaggtctttgcatgttttgctctttgctatatactctagaaaaagccagacatcagggaaggccaaatatttgctgaaagattgaatgagttamtttccttctttagaaaagtcatgtttccccctcttgagaactagggccccagatctctggtttgaggtaacaactgtggtgatcagatgctggaagggcc

SEQ ID NO: 74052 - DNA, 201 bp, Bos taurus; identical to SEQ ID NO: 34479

SEQ ID NO: 74053 - DNA, 201 bp, Bos taurus
agcatcatctctctgcctcactgaataacttcgtcgatagcaagcgtgcctgccaacagtggcttttttgttgctgttttttctattcagtttgtaccatrtgactcacagtgtcctagcagataagaacagagagacctggttgtccagtgttggcttttgtgcagagcgctgtttcttgtgaggtcaccaacagtgttt

SEQ ID NO: 74054 - DNA, 201 bp, Bos taurus
ttactgcacaagcatttgtcactttcataacatgaaaatacaataaatagagaaatgataaactgaaaggatttgagaaaatgttttgtgagggccagttrgttgcacaggagtcagaatacgtgtatggcaggtagacttaagtgggtagagtcatcttgtccttcctggctgcctcgtagtgttttaacacctggactc

SEQ ID NO: 74055 - DNA, 201 bp, Bos taurus; identical to SEQ ID NO: 34480

SEQ ID NO: 74056 - DNA, 201 bp, Bos taurus
tcaacacttgttttttacactgtactggcgcctaattctccttggggaaaggtgacttgatctttcatgagatgaaagcacatacgatatagatttctagycaatactccagaacgttgcctaaacactctaattctcctaagtgtttgggaattaaagtcattaatctttttcttttcttttttggttttgaatcacagg

SEQ ID NO: 74057 - DNA, 201 bp, Bos taurus
ctagtgaccccatggactgcagcctaccaggctcctctgtccatggggtttgccagacaagagcaccggagtgggttgccattgccttctccaagtaccayctgggaaaccctttatttaattcagtatgtccaaagcattagcttttcaacgtgccattagtataaaatattatgaatcagctagtttgcattctttgtt

SEQ ID NO: 74058 - DNA, 201 bp, Bos taurus; identical to SEQ ID NO: 34488

SEQ ID NO: 74059 - DNA, 201 bp, Bos taurus; identical to SEQ ID NO: 34489

SEQ ID NO: 74060 - DNA, 201 bp, Bos taurus
tttatactacgtatttcaatgtttcctcatgtacaattaaacaattgaaaatatcaccatttcctggttctcagattaaaatctattacttccacatagargaaatgaatgcaatttaatattcaagtaaatagaagtatatttgttccagctccctcagatatgtgaacttcttttttttttttaaagtagaccttataa

SEQ ID NO: 74061 - DNA, 201 bp, Bos taurus; identical to SEQ ID NO: 34491

SEQ ID NO: 74062 - DNA, 201 bp, Bos taurus
tatacttcttgccttaccatgtgtggttttggctaggattgtgaaaaattagagaatttatgggtttaggaatttgcctttattcacctgatttaatcttyatcaaatctatatctgtcctaaagaagattacacttttggaggagattatgtgctcatacatatgcaaacatatgtatacaacatatgtctatattgcta

SEQ ID NO: 74063 - DNA, 201 bp, Bos taurus; identical to SEQ ID NO: 34494

SEQ ID NO: 74064 - DNA, 201 bp, Bos taurus; identical to SEQ ID NO: 34495

SEQ ID NO: 74065 - DNA, 201 bp, Bos taurus; identical to SEQ ID NO: 34496

SEQ ID NO: 74066 - DNA, 201 bp, Bos taurus
cacttagctatttattaaaaactattaattaaaacttcccctcaccttattcaaagttagagctgtacaagaatccctccccatattactaaaatgactcrtgtgtgagtgtatattttgagagaggagtttttttctgtgtatttttcaggattagtatcagtttaatcctccagaaggagatggaagtgaagcaaccca

SEQ ID NO: 74067 - DNA, 201 bp, Bos taurus
cataatagtggtcggtatatagtaactcaaattatattgataaagaccattgtgtgaatgaggaaaactttgaaaaaaaggttagcactagtagaatagayacatgtcttctaacactatagattatataagtaaaataaaactttttaaaaagctcacgtggtaaaaaaatagctataacattgaacaagctaacagaag

SEQ ID NO: 74068 - DNA, 201 bp, Bos taurus; identical to SEQ ID NO: 34499

SEQ ID NO: 74069 - DNA, 201 bp, Bos taurus
aataaaacatcatttctggacaagaagacttactgttataaaggtatctattatcctcaaattgattgaagagttggacttgttgactgaacaacatcctmgaattaatatttaatctgcaattccataaatcaaaattccagttgattttttgagggattcagtaaacctacaattaaaggcaaagtgaaagaattaaag

SEQ ID NO: 74070 - DNA, 201 bp, Bos taurus; identical to SEQ ID NO: 34502

SEQ ID NO: 74071 - DNA, 201 bp, Bos taurus; identical to SEQ ID NO: 34504

SEQ ID NO: 74072 - DNA, 201 bp, Bos taurus; identical to SEQ ID NO: 34507

SEQ ID NO: 74073 - DNA, 201 bp, Bos taurus; identical to SEQ ID NO: 34508

SEQ ID NO: 74074 - DNA, 201 bp, Bos taurus
atcaacaatcatagatgaaagaactaaaatgacccaacgtcgatgacttgggaagtctctcttcgctatatgtttagattgaagtcttgagtttttatgtytggaccaaaacaccatcacatcgcatcattttccagttcagaatatttgaacttttctttcactgtacagcttgaggaaataaacatcctctcaaacgga

SEQ ID NO: 74075 - DNA, 201 bp, Bos taurus
gttgaggctcagggaaacagactccccaagcatatacagagggcctgtgagctctctgcaccaaggaatggatccacacctcagcctgaccatcttagacracatctgaagacacggggcccaggacccaggctctccacaaacagaagtagaaggaaatgggcatttccatagagcgggtatttccctaaactccaacac

SEQ ID NO: 74076 - DNA, 201 bp, Bos taurus
agacccggaacagccaaaagtaaataaataactctaaaaaaaaagaataaactgtatatgtgtgggaatatgtatatacaacatctatttccaaattttcyaatcccttctagtgaaatattgatatatagatttataccacactaccacattgccttgaagctgtagctttataataatatttatttatttattttggcc

SEQ ID NO: 74077 - DNA, 201 bp, Bos taurus; identical to SEQ ID NO: 34511

SEQ ID NO: 74078 - DNA, 201 bp, Bos taurus; identical to SEQ ID NO: 34515

SEQ ID NO: 74079 - DNA, 201 bp, Bos taurus; identical to SEQ ID NO: 34516

SEQ ID NO: 74080 - DNA, 201 bp, Bos taurus; identical to SEQ ID NO: 34517

SEQ ID NO: 74081 - DNA, 201 bp, Bos taurus; identical to SEQ ID NO: 34518

SEQ ID NO: 74082 - DNA, 201 bp, Bos taurus; identical to SEQ ID NO: 34519

SEQ ID NO: 74083 - DNA, 201 bp, Bos taurus; identical to SEQ ID NO: 34520

SEQ ID NO: 74084 - DNA, 201 bp, Bos taurus; identical to SEQ ID NO: 34521

SEQ ID NO: 74085 - DNA, 201 bp, Bos taurus; identical to SEQ ID NO: 34522

SEQ ID NO: 74086 - DNA, 201 bp, Bos taurus
agacgcgttcagggtggtatggccatagacaagccttaatatttcttagactgtccatctggaaaacgtgctgtgctgatgcccttcgagcctctccagcyacagaagtacctgcaaggccagacgattctttaaggaggaggccaggtgccatctcagctttttacctggtatttctcaggaaagctgtccttacctcat

SEQ ID NO: 74087 - DNA, 201 bp, Bos taurus
ctcagcagagcatgtgggcgacccgcaacgatatgccttatccctaccagaacaggcaaggccctggcggccccacgcaggccccgccttaccccggcatraaccgcaccgatgacatgatggtccctgatcagaggataaaccacgagagccagtggccttcccacgtcagccagcgtcagccttacatgtcctcgtcag

SEQ ID NO: 74088 - DNA, 201 bp, Bos taurus; identical to SEQ ID NO: 34523

SEQ ID NO: 74089 - DNA, 201 bp, Bos taurus; identical to SEQ ID NO: 34524

SEQ ID NO: 74090 - DNA, 201 bp, Bos taurus; identical to SEQ ID NO: 34527

SEQ ID NO: 74091 - DNA, 201 bp, Bos taurus
ggggagatttctgggacccctggagtgggtagcacatcccttctctgtaagttacattctctgtccagattgtcagcatcatctggccctccaacttcccygtcccattggctgggtctccccatcattgccctggctcagaaatagagagccgtgtccagcccactgtggccagtgggcccaggtctcacatcctaagcc

SEQ ID NO: 74092 - DNA, 201 bp, Bos taurus
aagaccaacagcagatgggcagggcagtggagggtctgggcagttaaaagccagaggctacacaaaaaaatacagagacagagaagcagacagcgcacagmggatgtgtggtttccgggccacgcgggcacagccggtgctcagacgcactgatgatggaatgacgctgggaatgcggcgagcgataagatctgggtttga

SEQ ID NO: 74093 - DNA, 201 bp, Bos taurus; identical to SEQ ID NO: 34531

SEQ ID NO: 74094 - DNA, 201 bp, Bos taurus; identical to SEQ ID NO: 34532

SEQ ID NO: 74095 - DNA, 201 bp, Bos taurus
tcttttaaagtttttgaaaatattgtttacacatgttaatatttcctgaattattctccttctttgatgtctctggcccttcatttcacatcagagatcaygagcttgccgatgtgtgcggcgtgcgcagacgtctccttaccgtgccagtgacgggcctccgacatctcctggacggcctgcagtcgggctgctctgtca

SEQ ID NO: 74096 - DNA, 201 bp, Bos taurus; identical to SEQ ID NO: 34534

SEQ ID NO: 74097 - DNA, 201 bp, Bos taurus; identical to SEQ ID NO: 34535

SEQ ID NO: 74098 - DNA, 201 bp, Bos taurus; identical to SEQ ID NO: 34536

SEQ ID NO: 74099 - DNA, 201 bp, Bos taurus; identical to SEQ ID NO: 34540

SEQ ID NO: 74100 - DNA, 201 bp, Bos taurus; identical to SEQ ID NO: 34541

SEQ ID NO: 74101 - DNA, 201 bp, Bos taurus; identical to SEQ ID NO: 34542

SEQ ID NO: 74102 - DNA, 201 bp, Bos taurus; identical to SEQ ID NO: 34544

SEQ ID NO: 74103 - DNA, 201 bp, Bos taurus; identical to SEQ ID NO: 34545

SEQ ID NO: 74104 - DNA, 201 bp, Bos taurus; identical to SEQ ID NO: 34546

SEQ ID NO: 74105 - DNA, 201 bp, Bos taurus
gagcacaagcaggggtcagagggagccctctgggccagacatcacccaactcacctgattactttcaccaactagcccctacactcgctgggtaatgcgcrggctctgcaaaccaggccttcccttgtggctcagctggtaaagaatctgcctgcaatgcgggaaacctggattgggaagatcccttggagaagggaaggg

SEQ ID NO: 74106 - DNA, 201 bp, Bos taurus
attcacatcaaagctcttactcattgcaaaacctcagggaaggtgtttaatttctttgtgcctgaatttctcatgtttaaaacgtgaataggatgactatkctcagaggactgctgtaaagagtaaatcataaaatacaggaatgttttttgacacctagtggctctttaataggtagtatattgttagctattattgttc

SEQ ID NO: 74107 - DNA, 201 bp, Bos taurus; identical to SEQ ID NO: 34547

SEQ ID NO: 74108 - DNA, 201 bp, Bos taurus
gatactgaatctagttccctgcactatatggtaggtccctgttgtttatccattcacagacaagacttagatgatgtttctggttttgttgactggaagcrttcaatgtctgcaatggaaaatatgtggataatgaggccaagtttccccgatgcattttgcatgcaatattgtgaaggctgctaaactaactcatgctaa

SEQ ID NO: 74109 - DNA, 201 bp, Bos taurus; identical to SEQ ID NO: 34551

SEQ ID NO: 74110 - DNA, 201 bp, Bos taurus
tcgttcctattaatatttagctcctataatatttccttggcctccagatttataggttagaatcttcatgactgtagctttgttccccgtttcccatttcygacccttctatcctcaggcccccggcctctgttccttggtcaggctctgcagagctgtgcagctcggacttaaaaggcttgctcctgtcactcaagacac

SEQ ID NO: 74111 - DNA, 201 bp, Bos taurus
aattcacaaatatgtatatataatataatgaacttttgaatgtgatacagctaactggcctttaattgtatctaaaatttttcatcttggccactcttctyaccaacatttagtcaataagtgtatcttacatagtcaagctccaccgaatgagcttctgaacaccagcgcatttgaatgaatagacatgtacttaatttt

SEQ ID NO: 74112 - DNA, 201 bp, Bos taurus
gtggctagcgtgccctggatacaagggtggtgttcgtaaggctgaggcccagaactggcccagagtcacttccgctacattctgatgactaaaaagatcayggggtcagcccacattcaagttgtcgttgttgagtttgctaagtcatgtccagctctttgtgaccccatggactgcagcacgccaggcttccctgtcctt

SEQ ID NO: 74113 - DNA, 201 bp, Bos taurus; identical to SEQ ID NO: 34552

SEQ ID NO: 74114 - DNA, 201 bp, Bos taurus
ttcttccatgctcagctttctttatggtccaactctcacatccgtccatgaccactggaaaaaccatagctagtgcttatattcatctatgatcctggagmgtcgatgtccacagccccacaggcctgcacatgtccaccagcgccatcctcaccctgagcagacagggcagagggagatggaaaccaaactctgatccca

SEQ ID NO: 74115 - DNA, 201 bp, Bos taurus
agagtcagacacggctgaggcgacttagcacacacgcacgtcctcgtgagaatgaggaagctgatttatagaaaaagcaacttggctgcctcagaaacggygacattttcagactgtgacagaatacttccacttgagctcaaaaatacgtttttcttggaaggggcctttttgctttttcttttcaacgttcataagaca

SEQ ID NO: 74116 - DNA, 201 bp, Bos taurus; identical to SEQ ID NO: 34556

SEQ ID NO: 74117 - DNA, 201 bp, Bos taurus; identical to SEQ ID NO: 34557

SEQ ID NO: 74118 - DNA, 201 bp, Bos taurus; identical to SEQ ID NO: 34559

SEQ ID NO: 74119 - DNA, 201 bp, Bos taurus; identical to SEQ ID NO: 34561

SEQ ID NO: 74120 - DNA, 201 bp, Bos taurus; identical to SEQ ID NO: 34568

SEQ ID NO: 74121 - DNA, 201 bp, Bos taurus; identical to SEQ ID NO: 34569

SEQ ID NO: 74122 - DNA, 201 bp, Bos taurus; identical to SEQ ID NO: 34571

SEQ ID NO: 74123 - DNA, 201 bp, Bos taurus; identical to SEQ ID NO: 34572

SEQ ID NO: 74124 - DNA, 201 bp, Bos taurus; identical to SEQ ID NO: 34576

SEQ ID NO: 74125 - DNA, 201 bp, Bos taurus; identical to SEQ ID NO: 34578

SEQ ID NO: 74126 - DNA, 201 bp, Bos taurus
agggctgatctccttcagaatggactggttggatctccttgcagtccaagtcttcccaggaatccttttaagcaggtaaggcacataaggtatggaaataraactgatttcaagtcaatatctttcacttgaaaaagtcccttaacttgtctgagcctcacttttgtctgctgctgctgctgctaagtcgctttagtcgtg

SEQ ID NO: 74127 - DNA, 201 bp, Bos taurus
ttgagtagtatcagtacagaaaaggacgtagggattatcaaattctaacactttgcttttcagatgagtaaacaatagtctataaaagccaggtcacagcrcaagctatcacaaggctatgacagaagcaggagtggaggtgtcttctcagctctggtccaggctcttccaccacttatcctggttttgcacaatttgggg

SEQ ID NO: 74128 - DNA, 201 bp, Bos taurus
agcagattattaatagaaactggagtcataaaaccatgatgtgaaggaatagatgaggatttaattaaatgggaagtcaaaactcagctagagttctccckgagggtcagtggtaaagaatccacctgccaatgcaggagacacaggacacccagattcgattcctgggtcaggaagatccccaggaggagtaaatggcaa

SEQ ID NO: 74129 - DNA, 201 bp, Bos taurus
atgaaacaactggccatatttcatcacacattttcctgtacccccctttttctagagttccaatttattcagtatatattcagtatattcagttccagtawatatttggcctcctgatgcttcatatcttactgagtctctgtacatttttttctcacattaggttttttctgagtttgtttgtttatttgtttgttttta

SEQ ID NO: 74130 - DNA, 201 bp, Bos taurus; identical to SEQ ID NO: 34579

SEQ ID NO: 74131 - DNA, 201 bp, Bos taurus
aaaccctttctaaactgcaggcctggaataggtgttaattcagcctgcaaatatttatgagcacttcatatactggccacctacccatatgaggatcacarctcttcataagaatagagttctctagagtattcagaaggaatttccattgtcagtcatgccatcttttttcctaggcctattaaattcatgtgattgctg

SEQ ID NO: 74132 - DNA, 201 bp, Bos taurus; identical to SEQ ID NO: 34580

SEQ ID NO: 74133 - DNA, 201 bp, Bos taurus
acattcaggctccatgtcctcagccatctccaccttccacctgcagctgctgaggctgggagttgctctggaaacagacaaacattccaaggccctcctcyggggctcctctgttgccaggcaaccggggcacagtcccagccaagggatctctcctctgaacctctcttatgcctctggccttcttgaacagggagtact

SEQ ID NO: 74134 - DNA, 201 bp, Bos taurus
agttatccagtgggagctgcccacggccctggcatttccacaggccagagctgagccagtgaccgccgtcgtagtcaacaaggctggagagcacttttctrgagccagacctcaggggccagcgcttccgtaggaccacgaaggagcggggaccactgagcagcacgggcagaagacctgggcactgcgcgctggaaaaag

SEQ ID NO: 74135 - DNA, 201 bp, Bos taurus; identical to SEQ ID NO: 34584

SEQ ID NO: 74136 - DNA, 201 bp, Bos taurus
gtttgtgtctctccaaatccacccattgaaaccctgacctccacgatgatggtattaggagatggcgcctttggcagtgatgagcacgagtggtccccttrtgagtggggttagtggccttataaaagtgaccccaaagagctccctcgccccttccagctatgtgagagcaatgagaacttagcagtctgtgaccccccc

SEQ ID NO: 74137 - DNA, 201 bp, Bos taurus; identical to SEQ ID NO: 34585

SEQ ID NO: 74138 - DNA, 201 bp, Bos taurus
ataatactccactgtatggacataccgtactttatttatccaccagtggatggatattgggcatttgtccactttttgtctactgtgaattgaccgatgckgctatgaacattcatgtacaagtttttgtgtagacatatgttttcatttctgttggttatatacaaaggattggaatagttgagtcatatgctaactctg

SEQ ID NO: 74139 - DNA, 201 bp, Bos taurus; identical to SEQ ID NO: 34586

SEQ ID NO: 74140 - DNA, 201 bp, Bos taurus; identical to SEQ ID NO: 34588

SEQ ID NO: 74141 - DNA, 201 bp, Bos taurus; identical to SEQ ID NO: 34589

SEQ ID NO: 74142 - DNA, 201 bp, Bos taurus; identical to SEQ ID NO: 34590

SEQ ID NO: 74143 - DNA, 201 bp, Bos taurus
tggatgcggacaatgacgatgctgtggtcctgggcggacacccctgcccattgaactgcactgacgctcccgctgcagacgggcctcccctgggagcctcygctggtcacctgccccctccatcctgccccaggggagggggtggtcctgcttccctagccccgtaaggggcattcccccaaacccgggccacttctgtgc

SEQ ID NO: 74144 - DNA, 201 bp, Bos taurus
cggccgaggagaacgtggagcaggtgcctccagggtttcctggggctgcgtgaccctgggcgagttactaggcgtctctgttcctcagtaagaagcgaatractcgggcctcggctggcactatgtcatggcttcccctccctctccttgcgtcaccacagaccctcgggactgtcaccatcagctagctctttccttgaa

SEQ ID NO: 74145 - DNA, 201 bp, Bos taurus; identical to SEQ ID NO: 34593

SEQ ID NO: 74146 - DNA, 201 bp, Bos taurus
cagagggctgatcgcagtaggccagaagagaggagcgggcgggcagacagacggacggagccctgaaggtgctgcgggagtggggaatagtaatgggatgygtcgggggaaagtcatcaggcctggctctcggggaagctgtctatccgagggcagatggcacagtgatgctgccaggcgctgcctctgatcagacatgtg

SEQ ID NO: 74147 - DNA, 201 bp, Bos taurus
tcagccaaagggagtttccattcattcacattcatgctggggttggggttagcgttgcccctttgaaatctcgggacagatgggccctcagggtcagatgsgtgtgcacctcggagttctgtgcatccaggcttaattctagacttgctttgatcctgcttgaacgggatactcaggctttgtgcgttttagtggccagat

SEQ ID NO: 74148 - DNA, 201 bp, Bos taurus
ccctccccgccagcggctcaggccggagcccgtgtttccgtcccatcctgagagtttgacccatcgctgttcacacggtgatgctctgacgtccagaccaygagggcccgccgtccgcagtctgagcgccttgtccccttccccccgtcctccccgcaggcaccagcgtgagctttcagaacatgcgcctgggctgcaagt

SEQ ID NO: 74149 - DNA, 201 bp, Bos taurus
ctgtgggcagcgcccaagtgttacagcatcggtccaagcgccggctcacacttccgcaacaacgctggctgggtgctgatgttaggcctgctttacagacrtgaagcctggggtccagaggaggtgagccgtgaaccatctgtgtccactcccacccactaccttgaatatgaggaatccaacgccccctgcccctggggc

SEQ ID NO: 74150 - DNA, 201 bp, Bos taurus
gatgcaaagagacgcctgggtagatatttaacctgaactcaggccggagctgccgctggaccctgaaccgctgcatctccaagagaaagcccgttccctgstgctgagagccaggcccctgtgcccctcggctgggagggagatgcctgccccagaccccacctaggcgcccgcctgctccctgactcagggtctgcatcg

SEQ ID NO: 74151 - DNA, 201 bp, Bos taurus
ctgagtgttgtcttgcccacccacccgcgctggccatgtttctgcccagaggagaccatctgagaggaggacagaggccctgagggcgtctctgcaccccrtcacaccttcctgttccccagctctcagtggggctccagcagttccagggccctctgctctgcaaacgctgtggcttgagtgcagcctgcaaacagggag

SEQ ID NO: 74152 - DNA, 201 bp, Bos taurus; identical to SEQ ID NO: 34599

SEQ ID NO: 74153 - DNA, 201 bp, Bos taurus; identical to SEQ ID NO: 34602

SEQ ID NO: 74154 - DNA, 201 bp, Bos taurus
agttttgaatacaaatttaatttctgtgataggttatctattcctcactgagtaagctctggatgtatagctctttcaggagggttttttaaaatttcgtygatttattgaatttagtggcataaagttggttgtaaggtctcttgctgcagatttagcgtctacagagtctgcggtgcttttgcgtctgccgtctgccgt

SEQ ID NO: 74155 - DNA, 201 bp, Bos taurus; identical to SEQ ID NO: 34603

SEQ ID NO: 74156 - DNA, 201 bp, Bos taurus; identical to SEQ ID NO: 34605

SEQ ID NO: 74157 - DNA, 201 bp, Bos taurus
cattcacagcagggtggctcacagcagctgaagtgtggaagcaacccccatgtccatagatggatggacaaacaaaaagaatgtggcccatccatgcaacrgaatagtagcattcagccctaaacggacgaaagtcctggcacctgctacagcacggtgggcctcgagctcattatgctcagtagaacaagccagttacag

SEQ ID NO: 74158 - DNA, 201 bp, Bos taurus
aatatgcacaataaaatgtttaaaccccactttgattagtttgtcaggtgactagattattgcagtgatttaggtttttactctagagactcaaataaatkagtgtgttagctttaaagagttactgaaagcaagtctgaaatgtaatcatttctccacacttgcctgaccgtgaactaaagtcccctgtctacacccgaa

SEQ ID NO: 74159 - DNA, 201 bp, Bos taurus; identical to SEQ ID NO: 34610

SEQ ID NO: 74160 - DNA, 201 bp, Bos taurus; identical to SEQ ID NO: 34612

SEQ ID NO: 74161 - DNA, 201 bp, Bos taurus; identical to SEQ ID NO: 34615

SEQ ID NO: 74162 - DNA, 201 bp, Bos taurus; identical to SEQ ID NO: 34616

SEQ ID NO: 74163 - DNA, 201 bp, Bos taurus; identical to SEQ ID NO: 34617

SEQ ID NO: 74164 - DNA, 201 bp, Bos taurus; identical to SEQ ID NO: 34618

SEQ ID NO: 74165 - DNA, 201 bp, Bos taurus; identical to SEQ ID NO: 34619

SEQ ID NO: 74166 - DNA, 201 bp, Bos taurus; identical to SEQ ID NO: 34620

SEQ ID NO: 74167 - DNA, 201 bp, Bos taurus; identical to SEQ ID NO: 34621

SEQ ID NO: 74168 - DNA, 201 bp, Bos taurus; identical to SEQ ID NO: 34622

SEQ ID NO: 74169 - DNA, 201 bp, Bos taurus; identical to SEQ ID NO: 34623

SEQ ID NO: 74170 - DNA, 201 bp, Bos taurus; identical to SEQ ID NO: 34624

SEQ ID NO: 74171 - DNA, 201 bp, Bos taurus; identical to SEQ ID NO: 34625

SEQ ID NO: 74172 - DNA, 201 bp, Bos taurus; identical to SEQ ID NO: 34626

SEQ ID NO: 74173 - DNA, 201 bp, Bos taurus; identical to SEQ ID NO: 34627

SEQ ID NO: 74174 - DNA, 201 bp, Bos taurus; identical to SEQ ID NO: 34631

SEQ ID NO: 74175 - DNA, 201 bp, Bos taurus
ataagcattgtctcactggagaagcccccagaatgaaaatatattcacatagctgttttgatacctgttcaccacacagttcctgagggcagtggaatgckgggtcctcctaggccaacctggaggggcttccgtaagactaggcagactgagactaggcagtcctatccagaaaggcagagcagggacttcacagcggtg

SEQ ID NO: 74176 - DNA, 201 bp, Bos taurus; identical to SEQ ID NO: 34636

SEQ ID NO: 74177 - DNA, 201 bp, Bos taurus
gctcatggccactagaggactctcctcaacaggaaggaagtgctgaaggtaaggctgtgacatttctatccaaacctttgcctcctcttgattctcactgmtcattctggcccttaattttccaatggccttgttcccagtgatttcaaattcattttgatctacattaatcctgcaatagatgttcagaagaaaaaaata

SEQ ID NO: 74178 - DNA, 201 bp, Bos taurus; identical to SEQ ID NO: 34637

SEQ ID NO: 74179 - DNA, 201 bp, Bos taurus; identical to SEQ ID NO: 34638

SEQ ID NO: 74180 - DNA, 201 bp, Bos taurus
aaatcaaagaggaaatcagaaaatatctcaagacaaatggcaatgaaaatacaaaatctgtggaatgcagcaaaagtagttctaagatggaagtacatagyaatataggtcttctttgagagataaggaaaaaatgcaaataaaaacctaaactaccacctaaaagaattagcaaaagaacaaacaactcaaagtcaacaa

SEQ ID NO: 74181 - DNA, 201 bp, Bos taurus; identical to SEQ ID NO: 34639

SEQ ID NO: 74182 - DNA, 201 bp, Bos taurus; identical to SEQ ID NO: 34640

SEQ ID NO: 74183 - DNA, 201 bp, Bos taurus
tatatataaaatatcctctggcttcctggatatttaaaaatccacaaagcaattattcaaaagttagcagtggctatcactacttagtgggagttcaaatracttttatattcttcttcatacttttctaaattttctgaattttttaaagcatgtactattattagaataagagggaaaatttttaacttatttttattt

SEQ ID NO: 74184 - DNA, 201 bp, Bos taurus
attgagtgggagtgatccctttaacctgtggcatttgatactaactctaggtagatagtgtcaaaattgagttaaattgttgttgctggagtattggaccrtgtaaggggaaaaaaatccacacgtttggaggccagaagtgaagtcttaagagtagtgtgtgtggagagaaggaaaacaatatctttttcctttcaaagc

SEQ ID NO: 74185 - DNA, 201 bp, Bos taurus
ggcgatgtgcacggcccctcgcagatcataaagggctgcgaagtgaggataactgtcctctaatccactaatcaatctcagagatcctgctctgccagcayctggcctccagccgaggggaggaggggggtgtgtggggcgcagtgagcagatgaccgtgtgaacaaacaaaatgcgatagagtcctttccttaaaaatga

SEQ ID NO: 74186 - DNA, 201 bp, Bos taurus
agagacatttggcatccagccaagggcctctgaattcttgacgtgttgggatgagccaggatggaaccagggtgtcttcactggtagaaaggaggcctgcrggggctgaggaactctcttgcggagcagggaaggctggtaacccgcaaagccttgagcaaacagggtctcaactctggacgcatttattgggcccccgtt

SEQ ID NO: 74187 - DNA, 201 bp, Bos taurus
ggttataacctacaaaaattccaaggtttccaagggaagctagataagtcaactttagggcagtgagattaatttttacgtgtgatgctgcattaataggycttgactgtggccatgtggagctagaatggcagccagaagctgggagctgtagtttactacttactacttagtaagtaaataagtagtaggttagtaagt

SEQ ID NO: 74188 - DNA, 201 bp, Bos taurus
gcatttccctcgatgacgggtacctgagagtgagcagaaatgcggggttcagggcccagtgctgtttctggggtgacctagttctggaggcctccacaggktgagaaacttacccgggtgtatggatctggagtttaaaggtaaacacaattccgtcatgctggctcttatgtacgcacagtagtactgtgtgtgcgctca

SEQ ID NO: 74189 - DNA, 201 bp, Bos taurus
cctggtcaggatcaggtctaggggactttggagtctcgctcttgcatttaaatcccagggcagcatgtcattctggtcactctgcactgctgcagtgagtytcttttcttacctgaaaataagagatggtaacacactccctttgtactagacatcccgaggcctctgtgctttgttcaggaatgggaaaacgacaaaata

SEQ ID NO: 74190 - DNA, 201 bp, Bos taurus
cccaaattcaccactagggcccgtttccaaactgggactgggccagagtgaacttatcaaccatcaccttcttgttctagcttttggagctgtttggaggytcaagaggcggtagtcttgggcccctgtgcctctcagaatgccctgtgctacaggaaggagtgtggcctttgctatcaggcaaacctgggttctggtctc

SEQ ID NO: 74191 - DNA, 201 bp, Bos taurus
catgtccagttctaactgttgcttcctgacctgtatacaggtttctcaagaagcaggtcaggtggtctggtattcccatctctttcagaattttccacagyttattgtgatacacagttgcccttcaatcagtaaacagttaagtaaactggtaatccatacatggaatactacacacagtaaaaggaaataaattactaa

SEQ ID NO: 74192 - DNA, 201 bp, Bos taurus
tctttatacccatacaaagtcatcaagtatcatcaagtgtcaggtttaactttctttttatgaatgaggggacccaccaaggtaaaagtgccaaggccctstgaatgttgtgatgcagcccacttcttttgaactctgaagacaaatgctttttagacttgttgccataggcctggaggaaggtgtcagtcatgttacgga

SEQ ID NO: 74193 - DNA, 201 bp, Bos taurus
ccttgcccttcccttttctgctgcttcagaggatttccatcttcctctgtgaggtgccccagcaaagacacgtgtgagggtagaggccagagtgtccaagrtaagcaccgccagccagcctgtaacacacccaccctgaagttcactttaatctctgctaagctgctctggcctccacttttagtgctaacaaggcgtgtt

SEQ ID NO: 74194 - DNA, 201 bp, Bos taurus
atgtgggcggtaattcatcatggcggccacaggaaaccaatataggtgcctgggagggatgccccgaaggatggagcagctgcacgtggcctcttcgcacrgctttggctgctcatagggtggtgactactttctgtgatggagcttcctgagagcaagtgtcccaggcctatgagatcaaggcagaagctgcaaggtttc

SEQ ID NO: 74195 - DNA, 201 bp, Bos taurus
aagtgaggaagcagaggcctagttatcaatagatgctgtctcactcctcaccttcccccactacatgcgcctttgtatttccagctgcttctcttcaaggractgggcagagggggccgtctgctgccccgccccccaggtccctcagaaggcactcagtccatctggctccactgcccccttagctgaggctgttctgcc

SEQ ID NO: 74196 - DNA, 201 bp, Bos taurus
atttccttagtgactgaaatggctttattactctccatgggccctgataatttatgctaacaacatgacctacggttgacccctagtttaataatgggatractcaggttgtgaggctggccatttcacaaagaccaaggaagtgactagaagtttggggcttagagccaggtgggcttattagcttccctggtggctcag

SEQ ID NO: 74197 - DNA, 201 bp, Bos taurus; identical to SEQ ID NO: 34645

SEQ ID NO: 74198 - DNA, 201 bp, Bos taurus
gtggccaatattttgaaagtcatgatttcatatacttggtctgaatttacagttgttaaatattaatatgaaggtaaatttgacatcagttactccttttyggccaaaaatgggaatctctgtatactcatgaaaaaaaaattattattgggctggtttggatctttcttgcatcaggtgagatctttccttgcggtgcat

SEQ ID NO: 74199 - DNA, 201 bp, Bos taurus
atctcatctgatcttggaagctaagcaaggttgggcctgattagtactcggatgggagaatccacaaacctctgaacctcagagtccagtctttctgcctyggacaggcctggcacacagatgtgctgactgttctgatcactggcgagagctctgtagctttcaacattcaccttcactaacagctactccctgagaaag

SEQ ID NO: 74200 - DNA, 201 bp, Bos taurus
gaggccttcagaatgtggtgtgtgaatggaataccatggcccaggcattgggaaggaattataacagtttcaaaagaggcttagtaggaatataaaaggartgaaaaggctgatatggccacccatgattccatcctcgcagcagacgaaggtacctcttacaacccactcccgtattcttgcctggagaatcccatggac

SEQ ID NO: 74201 - DNA, 201 bp, Bos taurus; identical to SEQ ID NO: 34646

SEQ ID NO: 74202 - DNA, 201 bp, Bos taurus; identical to SEQ ID NO: 34649

SEQ ID NO: 74203 - DNA, 201 bp, Bos taurus; identical to SEQ ID NO: 34650

SEQ ID NO: 74204 - DNA, 201 bp, Bos taurus
acagaggaaggtagaaagagaaaagacccattggtagatggggggagacacggaattgggtgattctgattttttacctgctgagcttgaggtgacagttrtatttatgacaaaaggcaggcgctggtcatgtctgcctcccttgctatggtattccttggttctctgttggcttttgcactcagcctcacactgactaga

SEQ ID NO: 74205 - DNA, 201 bp, Bos taurus
aggatattaaatgcagtttcctgtgctatacagtagggccttgctgttgatcccgtaattataatttttgatgcacctggctcttctgctaaaccattagygccttgagggccatcaccatgtttctatttgaatacgtttgttcttatttttgccactgtgtctgataaaatccacacatcattttttcccacaaattga

SEQ ID NO: 74206 - DNA, 201 bp, Bos taurus
cggcagacgtactcttcgtgtgtgtgcttccgttcaagatcagctactacttctccggaagcgactggaggttcgggtctgccatgtgccgcttcgtcacrgcggccttctacgggaacatgtacgcctccatcatgctcatgacggccatcagcgtcgaccgcttcctggccgtggtgtaccccatccagtccctctcct

SEQ ID NO: 74207 - DNA, 201 bp, Bos taurus
actccgggagttggtgatggacagggaggcctggcgtgttgcaattcatggggtcgcaaagagtcggacacgactgagcgactaaactgaactgaactgascatttcatggtgtagatgtactttgtagttttacatctgtattacttcctgatttttgtcttcacaaagccagctaagatcgtgtttcctggcttctgct

SEQ ID NO: 74208 - DNA, 201 bp, Bos taurus
acgttaatttacaagctgattttgtccaaaatcacaagtatcctatatctgaatcttttaaatgctacaaatgcctttaaaagtagaaacatatatactgmattattgaaatgattacaacactattgtatttatacttatgctattataaagtacttgcacactttatttctcctttctcactatacttttatgagtatt

SEQ ID NO: 74209 - DNA, 201 bp, Bos taurus; identical to SEQ ID NO: 34654

SEQ ID NO: 74210 - DNA, 201 bp, Bos taurus; identical to SEQ ID NO: 34655

SEQ ID NO: 74211 - DNA, 201 bp, Bos taurus
ttaaagctattctatgacacttaaaaaaaaaagcaatgaaagattagctatagccttcacagattaaattcctcatacaaatataaaaaggccaactttgyttaagaaaaatattttatgaaagcagtatcacacagtgattcagagcactgactctgcagtcagactactgcctttggccctatacaggctgcacaaact

SEQ ID NO: 74212 - DNA, 201 bp, Bos taurus; identical to SEQ ID NO: 34656

SEQ ID NO: 74213 - DNA, 201 bp, Bos taurus; identical to SEQ ID NO: 34657

SEQ ID NO: 74214 - DNA, 201 bp, Bos taurus
gcctccaatcttagagtatcaacagtgcttccaccccagggttagaagggtccagaaggaacactgggctcagttattcataatatctgccacaggcttgrgagtgagttagaagcattttggccagctgcctgccagcccaggcgtgggatacaggctggtaacaggggtcattagttctagcactgtttctttccattc

SEQ ID NO: 74215 - DNA, 201 bp, Bos taurus; identical to SEQ ID NO: 34659

SEQ ID NO: 74216 - DNA, 201 bp, Bos taurus
gagctgtaagaccactgtacccacctttcctacaactggaaactgcttttaggaaaaataaaaagaaggtgatttttctttctattcttcagggccttttrgaacatctggatagtggggaggttgtggttggagatggcagcttcctcctaactctggagaagaggggctacgtgaaggccgggctctggactccagaag

SEQ ID NO: 74217 - DNA, 201 bp, Bos taurus
cacacctgtgaccagacaaacggtccggctcagccattggctggtgctgcagtgggccacgcccacaagcagccagctgttaatgaggggccgttaatgargtgatcccgacaatggtcagggtagtggtgaccagtggtcaggtggagagtgaggtaagggccagatcctggccttctccctggggccctcaggtctgtt

SEQ ID NO: 74218 - DNA, 201 bp, Bos taurus
cttgtcagatttccatgaggctaagccagcgggtacagtggcagaatcgccttgtaggccaacaaggaggataaccaattgccttctatggcagtcagccyagaggatggtcttcaagtcaagtgcagaagccaaaggaagctgtgggggccaagttttggactcgggttagctagatgagtaagagaggccctggagggt

SEQ ID NO: 74219 - DNA, 201 bp, Bos taurus; identical to SEQ ID NO: 34661

SEQ ID NO: 74220 - DNA, 201 bp, Bos taurus
cttcatttatataaaagattatatactcctctggggcccctacaaagcaccaaccttaatcttcaaggtagcttggaaaataagtcatggttttgttattytggggccaaaacattctgaagagattgatcacaagctcctggagccaagtctggtgaataaatacactagggttgactccaggagctaatgggtcgtttc

SEQ ID NO: 74221 - DNA, 201 bp, Bos taurus
tctgtttctactgattctgcttttgtgtcagagtattcagccccacaggattggaactatgaactagagaagcaagaagctgagccagtttctttacctcrtgtgaaagctgtatctgaacatgcagttttgtcagaagaagaggacgataaatttgagccttcttccccaacttcagcttctatatttgtctcaccctcc

SEQ ID NO: 74222 - DNA, 201 bp, Bos taurus; identical to SEQ ID NO: 34664

SEQ ID NO: 74223 - DNA, 201 bp, Bos taurus; identical to SEQ ID NO: 34667

SEQ ID NO: 74224 - DNA, 201 bp, Bos taurus; identical to SEQ ID NO: 34668

SEQ ID NO: 74225 - DNA, 201 bp, Bos taurus
attaaaactttgtttgctttgcagtaagtaatgaattttctcccatatatgtaaaactttgataacttttaaaagagattacttggggggaaaaaaatcartgcgtccctgtaaaacagcatttagatagctctccccagaattttcattctacagaattccactattcgaggcttgcagtcgaacagtaagtgcaaggcc

SEQ ID NO: 74226 - DNA, 201 bp, Bos taurus
gacccagcacagccaaaaagaaactcattttacaaaacaatgataccctctgcaaaagaaagacacccaaaacataagacagaaaagtttaaagtaaaaaratgttaaactatatacattttgcaaatataaccaaaagatagctagcatggcatattaatatgagaggaaaaaaaaaacctttaaggcaaaaagccctac

SEQ ID NO: 74227 - DNA, 201 bp, Bos taurus; identical to SEQ ID NO: 34669

SEQ ID NO: 74228 - DNA, 201 bp, Bos taurus; identical to SEQ ID NO: 34670

SEQ ID NO: 74229 - DNA, 201 bp, Bos taurus; identical to SEQ ID NO: 34671

SEQ ID NO: 74230 - DNA, 201 bp, Bos taurus; identical to SEQ ID NO: 34672

SEQ ID NO: 74231 - DNA, 201 bp, Bos taurus
taggggaagactaactggcagccctaaccagatttccacaatacagaagaggtgagccttacagaagaaatctagattctgtttgctaagaaaagggagcrtgggtgtggagagggaaaaaaaaaaaaacagcaaagagaaaatctatgaatcctcaaaacaccacttgctgtgctcctacctagccttttatccttttca

SEQ ID NO: 74232 - DNA, 201 bp, Bos taurus; identical to SEQ ID NO: 34673

SEQ ID NO: 74233 - DNA, 201 bp, Bos taurus; identical to SEQ ID NO: 34674

SEQ ID NO: 74234 - DNA, 201 bp, Bos taurus; identical to SEQ ID NO: 34675

SEQ ID NO: 74235 - DNA, 201 bp, Bos taurus; identical to SEQ ID NO: 34677

SEQ ID NO: 74236 - DNA, 201 bp, Bos taurus
ttcatcagccacagctgattggaccagacacagacatctgcctcaaactggactttttcccagggtttagaatgggatcacagaaccatgagtgaatataygaatttaagagttagaggactcgctcagccatgcgcagtggtaaaagacaacatgcagagacagaaaaatgaagcagacaagctgggggaagcagaagag

SEQ ID NO: 74237 - DNA, 201 bp, Bos taurus
cttggaacgtcagacattggcacctaagtggaaagaagaatctaaaggtcagttgcactggtgtggtcagagcagctggccttggcctaaagggaggcgcrctctcagaactacagcttctgaagaggcgtggtgtcttcagttagctgccttctctaggccctgtctggggataataatctcccttgggggccctctcct

SEQ ID NO: 74238 - DNA, 201 bp, Bos taurus
ctcatgttcacactaggtaacacacaggtcttggtttctttattaattacaggcagctgttgaaatcagtctccccaacttttcaccatcaagaagccttrttggtgtcccctgtctgcaaagctctctcaatttgagagacactgctgtccccacgcgctggtgtccaaggccagtcacgtactgaacaggtgcaatttg

SEQ ID NO: 74239 - DNA, 201 bp, Bos taurus; identical to SEQ ID NO: 34679

SEQ ID NO: 74240 - DNA, 201 bp, Bos taurus; identical to SEQ ID NO: 34682

SEQ ID NO: 74241 - DNA, 201 bp, Bos taurus; identical to SEQ ID NO: 34683

SEQ ID NO: 74242 - DNA, 201 bp, Bos taurus
gaactttgtcttccgtgagtgttttaccttcaacatcaagataaaagtttctgtgccattgagtgccaccaatccctgatttggatggtgggggaggagaytgggtagatatttcacatatttgtgaaatgttttatcactaagtttgcatttatgtgcaattaggtcagtatggaaagtggtttttcagatactggatca

SEQ ID NO: 74243 - DNA, 201 bp, Bos taurus
ttatcaagagatactgagattgagaaagagagaggagacagaactgactggaacttttagaggaattcacttttgtgattgtggaagcctgttaaggccaraagcttcagggtaggctggcaggctggagacccatgaaagagttgcactataagtccaaaggcagtccgctggaagaagaattctactgctggtaaggcc

SEQ ID NO: 74244 - DNA, 201 bp, Bos taurus
gacagatgtcttcatggagagctcactccttgcccagccgacgaggaggagtcactagaaggacttctgctctggtgagcagagtgtgtatgcaggcagcygggcctggccgctctgcatttcagactcgtgttgtttgtgggtcttgtccagaaagaatcctgaaagaattcactgtaaggccaacctggaaatggacct

SEQ ID NO: 74245 - DNA, 201 bp, Bos taurus; identical to SEQ ID NO: 34687

SEQ ID NO: 74246 - DNA, 201 bp, Bos taurus; identical to SEQ ID NO: 34689

SEQ ID NO: 74247 - DNA, 201 bp, Bos taurus; identical to SEQ ID NO: 34691

SEQ ID NO: 74248 - DNA, 201 bp, Bos taurus; identical to SEQ ID NO: 34692

SEQ ID NO: 74249 - DNA, 201 bp, Bos taurus
cctaagctgaaggcccggtggtgaggattggagatttcagggagtggagccaggcgcaaaggactatcaggaaacaagcaactctctggagctggagcccygtgggtgcagggacaatggagggaccagcccagtgttgctttttggaaaagcgatagcttggttttctgaaggctgatgttgtgtgggtccgcacacacc

SEQ ID NO: 74250 - DNA, 201 bp, Bos taurus
tggcatgtacataggtcacttcggatagtctgaaatttctattgcactattggctcatgatcacacttcttaaaagggcctttagtagttactactgtatmctttaatctcacatgtcacccaggaggggccaatacctagatagctgagaccctgaaagcatggtattatacacatgaagggtagatttaaaacagtgag

SEQ ID NO: 74251 - DNA, 201 bp, Bos taurus
aaagctcagattctcctgcctcaaatacaggcctctctcccctaagctaggtccaactggtaggcaagagtttctgagaaaccctaaaagatacaaccatyattcttgaagacatgctccctccactgtttgccactctcgcttcaccaacccaaatcttgaccatcccgtgaagacaactgttaagacctgctttcgtct

SEQ ID NO: 74252 - DNA, 201 bp, Bos taurus
acaccagtgtctttcatggcacacactactctggggacccacagttgcttccctttcgagatgacagtaccactgacctgaaaaggccaggaaaaggagayggcacagacccagggtcagagggacctgtacctgaacgccagccctgggtgagaacgacagattaacctctctgtgagtcagggcctcacctgcaatggg

SEQ ID NO: 74253 - DNA, 201 bp, Bos taurus; identical to SEQ ID NO: 34696

SEQ ID NO: 74254 - DNA, 201 bp, Bos taurus; identical to SEQ ID NO: 34697

SEQ ID NO: 74255 - DNA, 201 bp, Bos taurus; identical to SEQ ID NO: 34698

SEQ ID NO: 74256 - DNA, 201 bp, Bos taurus; identical to SEQ ID NO: 34699

SEQ ID NO: 74257 - DNA, 201 bp, Bos taurus; identical to SEQ ID NO: 34700

SEQ ID NO: 74258 - DNA, 201 bp, Bos taurus
caggtatagtcagaccgaatgtctgtgttagttcaccctccagtaggaaaaacatctgtgcctgagtgggagactccaggggcgggatggatgcttgggcycctctagcttatcttttctagacaagagccctaagcctagtgaaaggagggagcttctgaagccatgagaatcagacaggaattccaggaatctttctga

SEQ ID NO: 74259 - DNA, 201 bp, Bos taurus; identical to SEQ ID NO: 34702

SEQ ID NO: 74260 - DNA, 201 bp, Bos taurus; identical to SEQ ID NO: 34704

SEQ ID NO: 74261 - DNA, 201 bp, Bos taurus; identical to SEQ ID NO: 34706

SEQ ID NO: 74262 - DNA, 201 bp, Bos taurus
gatgctgctggtctgggggcccccactttgagaacacagacacgtcataggggcgacacattaacatacactaggactccttatttttctgatctttgccygttggatactgaggccaggtgggctctcagtgttccctgtctgtgtctccaaggctggagctgtgcctgggtgtctggagtttctgggtggaggaattgg

SEQ ID NO: 74263 - DNA, 201 bp, Bos taurus
tcaggaggcctcccagcctcccagatgggtttccctctgctcaagtatccattctgggtgggggacagagtgaaggacaggccatgtggtacaaacaggcrctgaggctgaaggcattcatagacgggcgtgggaagggaagcagagataggctttgaacacagcacttgttaaaatttgctcaatgtgtggtcctctggg

SEQ ID NO: 74264 - DNA, 201 bp, Bos taurus; identical to SEQ ID NO: 34712

SEQ ID NO: 74265 - DNA, 201 bp, Bos taurus
ctctcaacacacagaggcatatgcacacacacacacatatgtacacacacacggccagcttctttttccctcttacacatccttgcaggtcctttgacctrtgctgcttctgtatctagaccgtggcccccactgtgcttccagatcctcagagagagctgagactcttgggcgatgactttcagtgctaacagcctccct

SEQ ID NO: 74266 - DNA, 201 bp, Bos taurus
tgcgatctagctccctgaccagggactgaacccgggcccctgcattgggagcacggaatgcactggaccaccggggaagtccctcaagaagtgcttctgayggaggaggtcttctatggcctattgaagccagacccttgcttggcttcatgagaggtaaaggtttctggttgctggggttctctgaccctcctccatgaa

SEQ ID NO: 74267 - DNA, 201 bp, Bos taurus; identical to SEQ ID NO: 34713

SEQ ID NO: 74268 - DNA, 201 bp, Bos taurus; identical to SEQ ID NO: 34717

SEQ ID NO: 74269 - DNA, 201 bp, Bos taurus; identical to SEQ ID NO: 34719

SEQ ID NO: 74270 - DNA, 201 bp, Bos taurus
aaagtggggagggcagcagcaggagcatcaccagtgtgttttaggaggaaaaagaaagtgagttcccgtctctctggttcatgatggccacggacctagtyggaggcagacacagagccagtgacttccccgtctgccttacttaaagtcatctctcatctgcctctgaggttccctggaggagctcaagggagcagttgc

SEQ ID NO: 74271 - DNA, 201 bp, Bos taurus; identical to SEQ ID NO: 34722

SEQ ID NO: 74272 - DNA, 201 bp, Bos taurus; identical to SEQ ID NO: 34723

SEQ ID NO: 74273 - DNA, 201 bp, Bos taurus; identical to SEQ ID NO: 34724

SEQ ID NO: 74274 - DNA, 201 bp, Bos taurus; identical to SEQ ID NO: 34725

SEQ ID NO: 74275 - DNA, 201 bp, Bos taurus; identical to SEQ ID NO: 34726

SEQ ID NO: 74276 - DNA, 201 bp, Bos taurus; identical to SEQ ID NO: 34727

SEQ ID NO: 74277 - DNA, 201 bp, Bos taurus; identical to SEQ ID NO: 34728

SEQ ID NO: 74278 - DNA, 201 bp, Bos taurus
gtgtaatccaggcatgaatgcatgtacagacacacacacacacacacacacacacacacacacacacacactcagatatgccaggtccaagcctccacccmgagatgttacatgctgggcacactcacaaatgtacagacacaccaggcacagacactgcagacaagcaagctggctaggggcacacaggaagacagagat

SEQ ID NO: 74279 - DNA, 201 bp, Bos taurus
gctgggccgctcgctgcccgtcctccgtgtctgcggggtctccctggcacagccgagtcggggtctccccgagcttgacagccccgtcacagtccttgctyagtagatgacctcataaaccgtggccttcttgtcaccagagcctgttacgatatatttgtcatccgccgaaatgtcacagctcaagactgacgaggattc

SEQ ID NO: 74280 - DNA, 201 bp, Bos taurus
ggccggatttccaggccagtgccttctgctgtctgcctctggctgctgcttcgcccgtgaccgttatctgcttctagtcttccttccccagcagccacgaratgaaggaaagctaccagaatggcctgccagccgtggtggactctgagaagccaggaccagatgtgggaatggtcccttgccttctccctcatcccctgt

SEQ ID NO: 74281 - DNA, 201 bp, Bos taurus
aaaaatgaggccagacccagggcacacagagggtcaatgacctgcccaggacatgtcagcagtaggcaggtccgcaccaggaaaatgggaatgactctggracgctggagccttaaagggcccgagcctcaacatgtaggagagggatgcaggggcagctgctgcaggttgggtgcagcttctggggctgggagggaatga

SEQ ID NO: 74282 - DNA, 201 bp, Bos taurus
aaccatggtgagcttcctcctctttcatggaggaagccagcgtggctagtgtgactctgaagcagaaagagcaggcttaccagggctgtcagcagggccayaccaggtggtgagtcataggatacagtaaggcatttgcccttgatctgaggcagtgaggaggcttcagggctttcaaacatgtccgcatagtgaggaagg

SEQ ID NO: 74283 - DNA, 201 bp, Bos taurus; identical to SEQ ID NO: 34729

SEQ ID NO: 74284 - DNA, 201 bp, Bos taurus
gcaattaacagcgtctaatcagtcagttctcaatgccaaattcaccttccccatcttgagaaggggctgtgcaactcagaataagcacgtgtctcttccamatttaggtcgttaaaactgaaaacacagtggacatttctgcgtatttattgtgcttaaaactaatctatttgtgtcatttatttcctcttctgggttttg

SEQ ID NO: 74285 - DNA, 201 bp, Bos taurus; identical to SEQ ID NO: 34731

SEQ ID NO: 74286 - DNA, 201 bp, Bos taurus; identical to SEQ ID NO: 34733

SEQ ID NO: 74287 - DNA, 201 bp, Bos taurus
tgttaggggactgcagaactataaagaagacaaccatgcagtatgtgccttgatggaaatcagagaaggtgaagaaacaggccatccatataaaaataagmtgttaaaattctgcaagagtttttgaggggtttagggggctgtgtgagtgtgtattggccaaatatttttcaaatgttttataatggttgtgagattctt

SEQ ID NO: 74288 - DNA, 201 bp, Bos taurus; identical to SEQ ID NO: 34734

SEQ ID NO: 74289 - DNA, 201 bp, Bos taurus; identical to SEQ ID NO: 34735

SEQ ID NO: 74290 - DNA, 201 bp, Bos taurus
gctgggtgatggggtcactgaaatgctctgtactctttttatagctttttgtgagtcttaaatgaaaagttaaaacaataagaaggtaatgtgataggaaratgggccagaatatttattcacttactgtgtgtacagtgttaaaatagtctgtgtgtgagagatacatgatgtgtttgatactccataatgttgaaagag

SEQ ID NO: 74291 - DNA, 201 bp, Bos taurus; identical to SEQ ID NO: 34739

SEQ ID NO: 74292 - DNA, 201 bp, Bos taurus; identical to SEQ ID NO: 34740

SEQ ID NO: 74293 - DNA, 201 bp, Bos taurus
caagagaaggtggcccaagaggcagaaagaaaaccaggtgcataggttgtcgtggaagccaaaggagtgcttcaaaaaggaggaatgggaaagcaggaagyttgctgggaggccaaactgcaggaaggctgaaaggcagtccacaaccaggagaggatccatgcggcagtggcgagtctgaatccacagctgaagctctgc

SEQ ID NO: 74294 - DNA, 201 bp, Bos taurus; identical to SEQ ID NO: 34741

SEQ ID NO: 74295 - DNA, 201 bp, Bos taurus
acaggaattatagattttctccaagattcctcccttaaatgcaggactttagaaggtgctaaagcctgaggattaggccatacgaagctcagggcaagtaraggagggaatgtggaggctaaagagattctcctgccttgggctctgtgcacagaccatgtgaggcctgcccctctggctcctggacttcctctgggtgag

SEQ ID NO: 74296 - DNA, 201 bp, Bos taurus; identical to SEQ ID NO: 34744

SEQ ID NO: 74297 - DNA, 201 bp, Bos taurus; identical to SEQ ID NO: 34745

SEQ ID NO: 74298 - DNA, 201 bp, Bos taurus
gcttccacggggcccagccccttggttgttctctctcctgtttcttcattctcttcttttgccaaccaaataccccccaagcaatcggatgttaaaacaarcacacaacaatggccgacagtgacacctctttgactttcctccagttctagccaccatttttttatccctatagactgatgcagtccccttcttagctgc

SEQ ID NO: 74299 - DNA, 201 bp, Bos taurus; identical to SEQ ID NO: 34749

SEQ ID NO: 74300 - DNA, 201 bp, Bos taurus; identical to SEQ ID NO: 34751

SEQ ID NO: 74301 - DNA, 201 bp, Bos taurus
tcactctttattatatatatgagacttgtccttattattgtttgcatttgtagattgtctgttctcattttggaatatatcacaatttgcttagaagttgyattgttgatgatgtttgagttacttccaatttttagctattagaagtatactgctgtgaacatcttagtatatctcttttggtgaacacttgttggagaa

SEQ ID NO: 74302 - DNA, 201 bp, Bos taurus
aaaactcctagcctcgtctctggcccacagaagtctgcggcaccttagctattaccgtctgtaactgatggagaacgggtcagagaacaggtgcaggggcrggatgtgccaaggcaaaggcctgacccccatcaccctgcaggctggaggtccaagcctgacccagccccgtctcctcccaggctggagttgagtcctgga

SEQ ID NO: 74303 - DNA, 201 bp, Bos taurus
taatcctgggcaccacgctcctgctccacatcacagcagtctactggttcttaactctggctgcaccttagagtcacttaaggaagttttaataatagcarttcccctggccccatccctagaagtctgacgcagctagatgagatcactgctaaatagctgatgtgtgtaccccaggggcttgagcctaccttacaagtt

SEQ ID NO: 74304 - DNA, 201 bp, Bos taurus
ccaaacctcacccgaacccagtaaccccattcctgacaaatcccatcctataggaagtcggctatggcatctcttcctctgtctgggcctctcagagcctygcctgccttccacttcctctgctcatcaccccatgtccagaccctgcctgggggatgggggagctctgaggcttggcccctttcccagctgggtgccatt

SEQ ID NO: 74305 - DNA, 201 bp, Bos taurus
gacagaggagcctggccagccacagtccatgggtcacaaagagtcagacacgactgaaatgacttagcataaagcacggctttgcagagctgtactagacrtgctcaacctttggccaaagaaacatcagaatgttctcatcagacaatgatcatctgtgaccatgatgatgtcaccaactagacttgggttggtgtcccc

SEQ ID NO: 74306 - DNA, 201 bp, Bos taurus
tgtgagaggcagatccggcccccactgactgagctgcccccgtctgggcctgagactcccggcttggaagaactgacagatttgatgcagaagtgctggarccatgagccccagaagaggccttccttccaaggtgtgctggccatccagctggcagtcgagataggcctgaatttgtcagcaggggcttttcccccggaa

SEQ ID NO: 74307 - DNA, 201 bp, Bos taurus
tgtcccctgctctctgtcaggccacctccccagtcctgactcccaggctgtccctgcctccacctccactcttctcacctggcctctccttggtccggccycattccctatatgtatataccgcagggcaaaagtgagtggaggggagtaaggtctagtgggcagatctacttacccagctgggcgggtgcagggttgggg

SEQ ID NO: 74308 - DNA, 201 bp, Bos taurus; identical to SEQ ID NO: 34756

SEQ ID NO: 74309 - DNA, 201 bp, Bos taurus
tgtaaattctcatgctgccaggttcgttgcaggtagtggctctagaatggagatgtttcacgggaagggtactcactgtccctgactctactgggtcagtrccggctccacttgccctggggtagcacccagatgccagccttatgcagaaaatcccagaatctcaaagtcattgggatctctctttattgaggtatttaa

SEQ ID NO: 74310 - DNA, 201 bp, Bos taurus; identical to SEQ ID NO: 34757

SEQ ID NO: 74311 - DNA, 201 bp, Bos taurus; identical to SEQ ID NO: 34758

SEQ ID NO: 74312 - DNA, 201 bp, Bos taurus
ccaaagaaatagtgatttgtgacacttgttatgacccttcttctacacacacacatagaaatagcttggaaatcccatccacattttggaggccttactgyagggattccaatattgaaaactcccacatgccgcagatgggtgtggggctttccactactcggatccaggcatggctccgtacatggtggccaaatgcct

SEQ ID NO: 74313 - DNA, 201 bp, Bos taurus; identical to SEQ ID NO: 34760

SEQ ID NO: 74314 - DNA, 201 bp, Bos taurus; identical to SEQ ID NO: 34761

SEQ ID NO: 74315 - DNA, 201 bp, Bos taurus
caggtgacagcgactctgatccacaggtcaacctgctgttccccatcatctacttgctgttctgggctttcctgctggtcttcagcctgtggtcagagccygtggtgtgtggcatcggcctggccatcatggtgacaggggtgccagtctacttcctgggtatttactggcagcacaagcccaggtgtttcaataagttca

SEQ ID NO: 74316 - DNA, 201 bp, Bos taurus
aaagtgggaacggggaggagctgggccctcctccgggagctgaccggggagtgccagcagcctctccctgggaagctttgtgggaagcccccacgggaggrgagaggggccaggtccctgcactgcccatgtcagtcagcagtcatcagcagcatggttcagccgcctctgggcagctgtggcccgcgggggcagggaggc

SEQ ID NO: 74317 - DNA, 201 bp, Bos taurus
atctgtagccaatgtacctataatcgtgtacacgcagctctatgagcagcagggaacaaaagggagtaaacaaacaaaaaaatcaagctaaagatggcgtygggcggccttgaaaaagcctcgcagtcgtgtccctccctaaagaggcccctcccctccctgacttgttgcgtgattgtggattgcggccagtaaagtccc

SEQ ID NO: 74318 - DNA, 201 bp, Bos taurus
tgcacaggattcctgcgccgacacccctgttcctctcgcgttcggcgctccgccctccaggaaagtagatccggccaggcagacaaaagtttgggagagargttgagtcggtgctgagtgtgagcgaggggggcgggggccggagagagtgggggctgccgcgcgagtctacgcgtgaacagatagacctgcggacgggac

SEQ ID NO: 74319 - DNA, 201 bp, Bos taurus; identical to SEQ ID NO: 34763

SEQ ID NO: 74320 - DNA, 201 bp, Bos taurus; identical to SEQ ID NO: 34764

SEQ ID NO: 74321 - DNA, 201 bp, Bos taurus; identical to SEQ ID NO: 34765

SEQ ID NO: 74322 - DNA, 201 bp, Bos taurus; identical to SEQ ID NO: 34766

SEQ ID NO: 74323 - DNA, 201 bp, Bos taurus; identical to SEQ ID NO: 34767

SEQ ID NO: 74324 - DNA, 201 bp, Bos taurus; identical to SEQ ID NO: 34768

SEQ ID NO: 74325 - DNA, 201 bp, Bos taurus; identical to SEQ ID NO: 34769

SEQ ID NO: 74326 - DNA, 201 bp, Bos taurus; identical to SEQ ID NO: 34770

SEQ ID NO: 74327 - DNA, 201 bp, Bos taurus; identical to SEQ ID NO: 34771

SEQ ID NO: 74328 - DNA, 201 bp, Bos taurus; identical to SEQ ID NO: 34772

SEQ ID NO: 74329 - DNA, 201 bp, Bos taurus; identical to SEQ ID NO: 34773

SEQ ID NO: 74330 - DNA, 201 bp, Bos taurus; identical to SEQ ID NO: 34774

SEQ ID NO: 74331 - DNA, 201 bp, Bos taurus; identical to SEQ ID NO: 34775

SEQ ID NO: 74332 - DNA, 201 bp, Bos taurus; identical to SEQ ID NO: 34776

SEQ ID NO: 74333 - DNA, 201 bp, Bos taurus; identical to SEQ ID NO: 34777

SEQ ID NO: 74334 - DNA, 201 bp, Bos taurus; identical to SEQ ID NO: 34778

SEQ ID NO: 74335 - DNA, 201 bp, Bos taurus; identical to SEQ ID NO: 34779

SEQ ID NO: 74336 - DNA, 201 bp, Bos taurus; identical to SEQ ID NO: 34780

SEQ ID NO: 74337 - DNA, 201 bp, Bos taurus; identical to SEQ ID NO: 34781

SEQ ID NO: 74338 - DNA, 201 bp, Bos taurus; identical to SEQ ID NO: 34782

SEQ ID NO: 74339 - DNA, 201 bp, Bos taurus; identical to SEQ ID NO: 34784

SEQ ID NO: 74340 - DNA, 201 bp, Bos taurus; identical to SEQ ID NO: 34785

SEQ ID NO: 74341 - DNA, 201 bp, Bos taurus; identical to SEQ ID NO: 34786

SEQ ID NO: 74342 - DNA, 201 bp, Bos taurus; identical to SEQ ID NO: 34787

SEQ ID NO: 74343 - DNA, 201 bp, Bos taurus; identical to SEQ ID NO: 34788

SEQ ID NO: 74344 - DNA, 201 bp, Bos taurus; identical to SEQ ID NO: 34789

SEQ ID NO: 74345 - DNA, 201 bp, Bos taurus
atattttaattttctaatactatttagatttttcagaagagttgcaataatatccttcacctagctttctctaatgttaaataacatcttaaacatagtayctttatcaaaattaagaaaatcacattggcatacaacagacttcatttgaattcccctgttttctccccactgatgttttttctttgttctaaagcagga

SEQ ID NO: 74346 - DNA, 201 bp, Bos taurus; identical to SEQ ID NO: 34790

SEQ ID NO: 74347 - DNA, 201 bp, Bos taurus; identical to SEQ ID NO: 34791

SEQ ID NO: 74348 - DNA, 201 bp, Bos taurus; identical to SEQ ID NO: 34792

SEQ ID NO: 74349 - DNA, 201 bp, Bos taurus; identical to SEQ ID NO: 34793

SEQ ID NO: 74350 - DNA, 201 bp, Bos taurus; identical to SEQ ID NO: 34794

SEQ ID NO: 74351 - DNA, 201 bp, Bos taurus; identical to SEQ ID NO: 34795

SEQ ID NO: 74352 - DNA, 201 bp, Bos taurus; identical to SEQ ID NO: 34796

SEQ ID NO: 74353 - DNA, 201 bp, Bos taurus; identical to SEQ ID NO: 34797

SEQ ID NO: 74354 - DNA, 201 bp, Bos taurus; identical to SEQ ID NO: 34798

SEQ ID NO: 74355 - DNA, 201 bp, Bos taurus; identical to SEQ ID NO: 34799

SEQ ID NO: 74356 - DNA, 201 bp, Bos taurus; identical to SEQ ID NO: 34800

SEQ ID NO: 74357 - DNA, 201 bp, Bos taurus; identical to SEQ ID NO: 34801

SEQ ID NO: 74358 - DNA, 201 bp, Bos taurus; identical to SEQ ID NO: 34802

SEQ ID NO: 74359 - DNA, 201 bp, Bos taurus; identical to SEQ ID NO: 34803

SEQ ID NO: 74360 - DNA, 201 bp, Bos taurus; identical to SEQ ID NO: 34804

SEQ ID NO: 74361 - DNA, 201 bp, Bos taurus; identical to SEQ ID NO: 34805

SEQ ID NO: 74362 - DNA, 201 bp, Bos taurus; identical to SEQ ID NO: 34806

SEQ ID NO: 74363 - DNA, 201 bp, Bos taurus; identical to SEQ ID NO: 34807

SEQ ID NO: 74364 - DNA, 201 bp, Bos taurus; identical to SEQ ID NO: 34808

SEQ ID NO: 74365 - DNA, 201 bp, Bos taurus; identical to SEQ ID NO: 34809

SEQ ID NO: 74366 - DNA, 201 bp, Bos taurus; identical to SEQ ID NO: 34810

SEQ ID NO: 74367 - DNA, 201 bp, Bos taurus; identical to SEQ ID NO: 34811

SEQ ID NO: 74368 - DNA, 201 bp, Bos taurus; identical to SEQ ID NO: 34812

SEQ ID NO: 74369 - DNA, 201 bp, Bos taurus; identical to SEQ ID NO: 34813

SEQ ID NO: 74370 - DNA, 201 bp, Bos taurus; identical to SEQ ID NO: 34814

SEQ ID NO: 74371 - DNA, 201 bp, Bos taurus; identical to SEQ ID NO: 34815

SEQ ID NO: 74372 - DNA, 201 bp, Bos taurus; identical to SEQ ID NO: 34816

SEQ ID NO: 74373 - DNA, 201 bp, Bos taurus; identical to SEQ ID NO: 34817

SEQ ID NO: 74374 - DNA, 201 bp, Bos taurus; identical to SEQ ID NO: 34818

SEQ ID NO: 74375 - DNA, 201 bp, Bos taurus; identical to SEQ ID NO: 34819

SEQ ID NO: 74376 - DNA, 201 bp, Bos taurus; identical to SEQ ID NO: 34820

SEQ ID NO: 74377 - DNA, 201 bp, Bos taurus; identical to SEQ ID NO: 34821

SEQ ID NO: 74378 - DNA, 201 bp, Bos taurus
tggagatttcaattgcctgagatcaagttctctaccactgcctaatcatgtgatcttgggtaaaaaattttttaacatatttaagtcctgttttgcttacrtgcacacagggaaagataataatagcaactacaatttatagagttgttactaggattgaataaaataatccacttaagaggctgagcattgtaagtgctc

SEQ ID NO: 74379 - DNA, 201 bp, Bos taurus
tcagctaatatccttattaactttatgaggtatatgctataattatcctaattttgtgaatgcagaaattaagacgattaaggccacaaaattaaggtcayaaagctagcaagttgcaaagcagaagttggaatctaggtagtctggctgcagaatctgtgctttaactgtgcattataagccctgtggccaagcacttca

SEQ ID NO: 74380 - DNA, 201 bp, Bos taurus; identical to SEQ ID NO: 34825

SEQ ID NO: 74381 - DNA, 201 bp, Bos taurus; identical to SEQ ID NO: 34826

SEQ ID NO: 74382 - DNA, 201 bp, Bos taurus; identical to SEQ ID NO: 34828

SEQ ID NO: 74383 - DNA, 201 bp, Bos taurus; identical to SEQ ID NO: 34830

SEQ ID NO: 74384 - DNA, 201 bp, Bos taurus; identical to SEQ ID NO: 34831

SEQ ID NO: 74385 - DNA, 201 bp, Bos taurus; identical to SEQ ID NO: 34834

SEQ ID NO: 74386 - DNA, 201 bp, Bos taurus; identical to SEQ ID NO: 34835

SEQ ID NO: 74387 - DNA, 201 bp, Bos taurus; identical to SEQ ID NO: 34838

SEQ ID NO: 74388 - DNA, 201 bp, Bos taurus
caccagcaatatgtgaaaaggcctattttcccaccaggctgagattttgaaagagaaaagaaggaggcaatgtctaggctctgaagaagcaagggaagaakaaggccaagtccggagcacaagcccagagcactcagcttggcagatgaggtgcacagatagcagaggactgtgtggtccaggccatggtgtttcatttgt

SEQ ID NO: 74389 - DNA, 201 bp, Bos taurus
ctgaagaaaggcccgcgggaggacgaggccctgagccgggaatgcaggatggcggcgatgcagaaggaaaggggtgctccgaggtaggtaccggagaaggrcggccgggagctgggcctgcgagctcctagggtgcctggcagtgacagaggctccgctgagagcagtccaggagaagagcaggcccaaccgaatcgtcct

SEQ ID NO: 74390 - DNA, 201 bp, Bos taurus
gtggggggccaggaccccatttcctgcctcccaggtcatattttttccctccacaaatatgtgacacttattcagagaggaggggaggaggagcaggatgktagcttggagagggcctcaaggccccagagaggccccacatggttccagcctccaccttagcctacagctgagggaggggctccagtgtccgagggagct

SEQ ID NO: 74391 - DNA, 201 bp, Bos taurus
tggccatattgggatttggggcatttcccttattcttttctggggccagtgccatcttttccttttattcctgtccttgaggctaggatttggggctggarctgattggtggtcaaaccttccaaacttggacctttttagatagctggggatcctccacttccagggatccccagttacccatcccttgattatatgaaa

SEQ ID NO: 74392 - DNA, 201 bp, Bos taurus; identical to SEQ ID NO: 34839

SEQ ID NO: 74393 - DNA, 201 bp, Bos taurus; identical to SEQ ID NO: 34840

SEQ ID NO: 74394 - DNA, 201 bp, Bos taurus; identical to SEQ ID NO: 34841

SEQ ID NO: 74395 - DNA, 201 bp, Bos taurus; identical to SEQ ID NO: 34842

SEQ ID NO: 74396 - DNA, 201 bp, Bos taurus; identical to SEQ ID NO: 34843

SEQ ID NO: 74397 - DNA, 201 bp, Bos taurus; identical to SEQ ID NO: 34844

SEQ ID NO: 74398 - DNA, 201 bp, Bos taurus; identical to SEQ ID NO: 34845

SEQ ID NO: 74399 - DNA, 201 bp, Bos taurus; identical to SEQ ID NO: 34846

SEQ ID NO: 74400 - DNA, 201 bp, Bos taurus; identical to SEQ ID NO: 34847

SEQ ID NO: 74401 - DNA, 201 bp, Bos taurus; identical to SEQ ID NO: 34848

SEQ ID NO: 74402 - DNA, 201 bp, Bos taurus; identical to SEQ ID NO: 34849

SEQ ID NO: 74403 - DNA, 201 bp, Bos taurus; identical to SEQ ID NO: 34850

SEQ ID NO: 74404 - DNA, 201 bp, Bos taurus; identical to SEQ ID NO: 34851

SEQ ID NO: 74405 - DNA, 201 bp, Bos taurus; identical to SEQ ID NO: 34852

SEQ ID NO: 74406 - DNA, 201 bp, Bos taurus; identical to SEQ ID NO: 34853

SEQ ID NO: 74407 - DNA, 201 bp, Bos taurus; identical to SEQ ID NO: 34854

SEQ ID NO: 74408 - DNA, 201 bp, Bos taurus; identical to SEQ ID NO: 34855

SEQ ID NO: 74409 - DNA, 201 bp, Bos taurus; identical to SEQ ID NO: 34856

SEQ ID NO: 74410 - DNA, 201 bp, Bos taurus; identical to SEQ ID NO: 34857

SEQ ID NO: 74411 - DNA, 201 bp, Bos taurus; identical to SEQ ID NO: 34858

SEQ ID NO: 74412 - DNA, 201 bp, Bos taurus; identical to SEQ ID NO: 34859

SEQ ID NO: 74413 - DNA, 201 bp, Bos taurus; identical to SEQ ID NO: 34860

SEQ ID NO: 74414 - DNA, 201 bp, Bos taurus; identical to SEQ ID NO: 34861

SEQ ID NO: 74415 - DNA, 201 bp, Bos taurus; identical to SEQ ID NO: 34862

SEQ ID NO: 74416 - DNA, 201 bp, Bos taurus; identical to SEQ ID NO: 34863

SEQ ID NO: 74417 - DNA, 201 bp, Bos taurus; identical to SEQ ID NO: 34864

SEQ ID NO: 74418 - DNA, 201 bp, Bos taurus; identical to SEQ ID NO: 34865

SEQ ID NO: 74419 - DNA, 201 bp, Bos taurus; identical to SEQ ID NO: 34866

SEQ ID NO: 74420 - DNA, 201 bp, Bos taurus; identical to SEQ ID NO: 34867

SEQ ID NO: 74421 - DNA, 201 bp, Bos taurus; identical to SEQ ID NO: 34868

SEQ ID NO: 74422 - DNA, 201 bp, Bos taurus; identical to SEQ ID NO: 34869

SEQ ID NO: 74423 - DNA, 201 bp, Bos taurus; identical to SEQ ID NO: 34870

SEQ ID NO: 74424 - DNA, 201 bp, Bos taurus; identical to SEQ ID NO: 34871

SEQ ID NO: 74425 - DNA, 201 bp, Bos taurus; identical to SEQ ID NO: 34872

SEQ ID NO: 74426 - DNA, 201 bp, Bos taurus; identical to SEQ ID NO: 34873

SEQ ID NO: 74427 - DNA, 201 bp, Bos taurus; identical to SEQ ID NO: 34874

SEQ ID NO: 74428 - DNA, 201 bp, Bos taurus; identical to SEQ ID NO: 34875

SEQ ID NO: 74429 - DNA, 201 bp, Bos taurus; identical to SEQ ID NO: 34876

SEQ ID NO: 74430 - DNA, 201 bp, Bos taurus; identical to SEQ ID NO: 34877

SEQ ID NO: 74431 - DNA, 201 bp, Bos taurus; identical to SEQ ID NO: 34878

SEQ ID NO: 74432 - DNA, 201 bp, Bos taurus; identical to SEQ ID NO: 34879

SEQ ID NO: 74433 - DNA, 201 bp, Bos taurus; identical to SEQ ID NO: 34880

SEQ ID NO: 74434 - DNA, 201 bp, Bos taurus; identical to SEQ ID NO: 34881

SEQ ID NO: 74435 - DNA, 201 bp, Bos taurus; identical to SEQ ID NO: 34882

SEQ ID NO: 74436 - DNA, 201 bp, Bos taurus; identical to SEQ ID NO: 34883

SEQ ID NO: 74437 - DNA, 201 bp, Bos taurus
gaacacttctggaatccccatacaagtgctttttgacaaatacaaattttcaggccaaaaaatcatgtctattcttaaagatattttcatcagaatctgayagtactgcaagggccttctgcctatattcattttattaaatgttgacttcacatcaccaaccatttccatcttttagaaaagtttctgctttccttaaaa

SEQ ID NO: 74438 - DNA, 201 bp, Bos taurus; identical to SEQ ID NO: 34884

SEQ ID NO: 74439 - DNA, 201 bp, Bos taurus; identical to SEQ ID NO: 34885

SEQ ID NO: 74440 - DNA, 201 bp, Bos taurus; identical to SEQ ID NO: 34886

SEQ ID NO: 74441 - DNA, 201 bp, Bos taurus; identical to SEQ ID NO: 34887

SEQ ID NO: 74442 - DNA, 201 bp, Bos taurus; identical to SEQ ID NO: 34888

SEQ ID NO: 74443 - DNA, 201 bp, Bos taurus; identical to SEQ ID NO: 34889

SEQ ID NO: 74444 - DNA, 201 bp, Bos taurus; identical to SEQ ID NO: 34890

SEQ ID NO: 74445 - DNA, 201 bp, Bos taurus; identical to SEQ ID NO: 34891

SEQ ID NO: 74446 - DNA, 201 bp, Bos taurus; identical to SEQ ID NO: 34892

SEQ ID NO: 74447 - DNA, 201 bp, Bos taurus; identical to SEQ ID NO: 34893

SEQ ID NO: 74448 - DNA, 201 bp, Bos taurus
ctctcaaaaacgctcattcattttcagtctccctgaaacatcacacatgttcttgccttcccttcattctgcccaggccccaacaccctgcctcagggctrcacactttctagaactttcctgagacgtggcacctctatcaaaatgcctgtggcctgagttctggtaaacaaggaaaggcatgtaaggacctgtgggcgt

SEQ ID NO: 74449 - DNA, 201 bp, Bos taurus
taaatgcacattttcaaattgtcccccagaaagtcttccctgaacttaatattttaaaacacaatttcaaataattaagtaaccttttagcagggagtctmattaagcaaccagcttcatttttctgcttgtggtaggaatttaagtctgatttttaatcctcagtgacttcactcctttcaagacatggcagaaaaagac

SEQ ID NO: 74450 - DNA, 201 bp, Bos taurus; identical to SEQ ID NO: 34902

SEQ ID NO: 74451 - DNA, 201 bp, Bos taurus; identical to SEQ ID NO: 34905

SEQ ID NO: 74452 - DNA, 201 bp, Bos taurus
tgtggtgggggcagggcagggtgccttgggccacagtcaagttggtgtaggtatcccggggtgccatgcgatgaaccggggatgtcaggtagtgaattgtktcaagcttccaggcccatctgccagcttgaaagctgcttcctatctgctgctgctaagtctcttcacttgcgtctgactctgtgtgaccccaaggacagt

SEQ ID NO: 74453 - DNA, 201 bp, Bos taurus; identical to SEQ ID NO: 34907

SEQ ID NO: 74454 - DNA, 201 bp, Bos taurus
ctgtctttgcctgaacagtgcctgacacctagtagatcctctgtgaatactgttaaattaacgtgcacttttatgctcatgttctgaccctccttacaccrtacttagaacccaagggcttcaagtgagggtcaacaggtaacaggagaattagggaagcccagccgacccctggattggatccacagcgatggcacgagg

SEQ ID NO: 74455 - DNA, 201 bp, Bos taurus
acactactatacataaaatagataaccaataagaatctattggatagcacagggaactatattaatatcttgtaataatgggaaggaaagaaagaaaggaragagggagggaggaaagaaaaaaatgaaggaaggaagaagggaaggaaagaagaaagaaaaaagtaaaatagaggattaagttggggaactgttctatca

SEQ ID NO: 74456 - DNA, 201 bp, Bos taurus; identical to SEQ ID NO: 34909

SEQ ID NO: 74457 - DNA, 201 bp, Bos taurus; identical to SEQ ID NO: 34910

SEQ ID NO: 74458 - DNA, 201 bp, Bos taurus
ttactcagacaccagtcatcctgtctctctggctcagacgctatgaatggggtgaggagatcaggggccatagctgggctggtggtggtggggtcagcttyttgggcacaagtgaatacaggctgaggtggctccagccctgtctctccctgccccagggcatgtccctggattgtgtggagatgtctctgggccgtgtgt

SEQ ID NO: 74459 - DNA, 201 bp, Bos taurus
tacccttaccgctgaaggtggcagccaggctcctgtggtctccatcttggcagtcttctttgccttcaaaaagcttattgctctaaagaaggcagggtgcmggtgcggtcactctgtttaaggccttaggggtttaagaaggcagcttggggtgagggcaaggcctaacccacaagagtgcttcctccgaggtgggcatta

SEQ ID NO: 74460 - DNA, 201 bp, Bos taurus
aatgaggctgtcttgttggaccttctgagcatcttgatagaaacatctcctttcagagggtatgggtggcaggtgcacgctagcgttgggcacatgaagaygttggcctagaagcagggttctgcacgtccccatgcgtaccagggccctcccagcctggacctctttttccatttcaacctgaggatatggatctttcac

SEQ ID NO: 74461 - DNA, 201 bp, Bos taurus
ccttcactctcagttatcactaccaaagcagcttatagacctttaggtcataggtccttctcatatagtcctcttaaaagctcccgttacattctttcccytccaatgctagtgattaaactggctgggcactccctcccttaactgaaaagaagctaagcaatggctcactgctcctaactaatccattataacaacagg

SEQ ID NO: 74462 - DNA, 201 bp, Bos taurus
ttggagaaaatcactactataaagatgggtggaatacagtaaattggcaagagattgatgttttttatcttcaatatactgaagtaataggccctgaagtytgcttggtggcacagagctgtgatctggatatgtttgtaattccaacagactctggctgttcagacacgtggccataggcagacgacatttttaaaatta

SEQ ID NO: 74463 - DNA, 201 bp, Bos taurus
tcctgcctgaagaatcccatggacagaggagcctggtggcctacagtccacagggtcaccaagagtcggacacaaccgaagtgactgagcacatgtgcaaygcttggtatgatgatgaaaatggccctttacttccgcggttatcttctcaaaaacccgtaacctttattttatcgtaagaaaaacttcagacaaattcct

SEQ ID NO: 74464 - DNA, 201 bp, Bos taurus
ataaaagctcaatgctagaaataactcaaatttcttcagttagtgaaaaaacaaattttggtatatccatacaatgaaataatactcaacaataagacaakaagaagaaagaaactgctaatacatgcaacaacaagaacaagtttcaaagatgtcattctgagaggaagaagctgaacacacaagaataaattctatatg

SEQ ID NO: 74465 - DNA, 201 bp, Bos taurus; identical to SEQ ID NO: 34913

SEQ ID NO: 74466 - DNA, 201 bp, Bos taurus
tcctctcctcttttgtgtctgcttgaggcccagagttaacattcccccaagtgctaagctcctgggggcgggttgcagagaccaagggcagccagagccgygctcaggccctggggtcccagagagaagattaggcctgtctgtcgtgtgtttgtactgagctgtcagctctgaaggcagggccatatctgctctcctatt

SEQ ID NO: 74467 - DNA, 201 bp, Bos taurus; identical to SEQ ID NO: 34915

SEQ ID NO: 74468 - DNA, 201 bp, Bos taurus; identical to SEQ ID NO: 34917

SEQ ID NO: 74469 - DNA, 201 bp, Bos taurus
caccttcttattctcactcttcctcagtcttctttgtcttcatgtcttactgccccccagcccagtgtcctgctccagctcagtcagggtccgtgtgaatraattcctgaaggctggccttgtgatcccatgagggcctctttcctctaggtctgtaactgtgcagatcttttttgtcacctagaaattcctcaagctatc

SEQ ID NO: 74470 - DNA, 201 bp, Bos taurus
acagtcctgtgggacctgtgagcatgatccctgctggccaccagagtcaggtgatataaaggtgtcccctgaaagcacctacaaaaacctgagggccagayaagggtgtaagcctcttgctggaagatactggtgagctagggcaaggctgaaggtgagcacaaaggttgtatccactggcctccattccctgagagcaac

SEQ ID NO: 74471 - DNA, 201 bp, Bos taurus
tgcctttctccctccctcccgtctcgctattccctgagatacaatgatattcaaattaggatacataacaacccttaatggcctctaagtgtttaactgasagaagagtcacaagtctctcattttaaatcaaaagctaaaaggattaagcttagtgaggaagatatgtcaaaagtcaagagaggccaaaagctaggcctc

SEQ ID NO: 74472 - DNA, 201 bp, Bos taurus; identical to SEQ ID NO: 34922

SEQ ID NO: 74473 - DNA, 201 bp, Bos taurus
accaacgcaggggacatgggtttgatccctggtccaggaagattccacatgctgtggagcaactacgtccatgggctgccgctactgaagtctgtgcactygaaagcctgtgctccaaaacgagagtggccaccagaatgagaagcctgagcaccacaggaagagcagcccccgttcgccccgtttgctgcaactagagaa

SEQ ID NO: 74474 - DNA, 201 bp, Bos taurus; identical to SEQ ID NO: 34924

SEQ ID NO: 74475 - DNA, 201 bp, Bos taurus
gcggggacagagcagagacgggtgggctttctgatgtgtcattttcctggggcctcaggcaatgggcaaggaaaggccccatttggtgatcaggccctcarcttagagaaaggtgccctccaaagtgggcaaatgtacaaccagtggtagagacagattgatctagagaactagggcctggcccatcacccacagccctct

SEQ ID NO: 74476 - DNA, 201 bp, Bos taurus
tttcattccagccaagctaaaatgatttctgctttaaaagatctagaacgtaaaaaattgacaagtcgaaagagtggctggtctgatggcggccactactyctagtgctcgaaccttctcacagggaaggcacccatgtgtgcacacactggtgtgccatcaccctggggcctctgtcgtggttctccacccccaaaggga

SEQ ID NO: 74477 - DNA, 201 bp, Bos taurus; identical to SEQ ID NO: 34925

SEQ ID NO: 74478 - DNA, 201 bp, Bos taurus; identical to SEQ ID NO: 34926

SEQ ID NO: 74479 - DNA, 201 bp, Bos taurus; identical to SEQ ID NO: 34927

SEQ ID NO: 74480 - DNA, 201 bp, Bos taurus
aaagagtattcttcatagtttgtaattcctaaaattatcaatgagtttatcagttagattagtgaccgcattgccatcagtccctttcgtcctggggcccrtaatactccaaggagtccctggggatgaaggacagaaagaagccttgccaagggggaaggtcagggtcactccagggagcatgcatcaagtaactggcca

SEQ ID NO: 74481 - DNA, 201 bp, Bos taurus
aggagcaggcactgaatatatgtttattaaataaatttctctaccattatttagataaattaactccttcagctgaatgtggcccacagatacccaatttrcaaccaataaatgactagggcactgagaggaataaaactaaactaaggagggccaaatctataaaaactaatttctgtccttttgcaacatctgcatatg

SEQ ID NO: 74482 - DNA, 201 bp, Bos taurus; identical to SEQ ID NO: 34933

SEQ ID NO: 74483 - DNA, 201 bp, Bos taurus
aaacactacatataagccctgcctttggtaagttatcgtaagattaaaagggaaagatcatggggctgttggtggtttttgttttctggtttttgatgttrttgttgctttaaggcatttctgtattccagaagttttcatgaaatgcattgtctttttaaatgaagcttgtctttcacagtaagagcatttccatcgaag

SEQ ID NO: 74484 - DNA, 201 bp, Bos taurus; identical to SEQ ID NO: 34943

SEQ ID NO: 74485 - DNA, 201 bp, Bos taurus; identical to SEQ ID NO: 34944

SEQ ID NO: 74486 - DNA, 201 bp, Bos taurus; identical to SEQ ID NO: 34945

SEQ ID NO: 74487 - DNA, 201 bp, Bos taurus; identical to SEQ ID NO: 34946

SEQ ID NO: 74488 - DNA, 201 bp, Bos taurus; identical to SEQ ID NO: 34947

SEQ ID NO: 74489 - DNA, 201 bp, Bos taurus; identical to SEQ ID NO: 34948

SEQ ID NO: 74490 - DNA, 201 bp, Bos taurus; identical to SEQ ID NO: 34949

SEQ ID NO: 74491 - DNA, 201 bp, Bos taurus; identical to SEQ ID NO: 34950

SEQ ID NO: 74492 - DNA, 201 bp, Bos taurus; identical to SEQ ID NO: 34951

SEQ ID NO: 74493 - DNA, 201 bp, Bos taurus; identical to SEQ ID NO: 34952

SEQ ID NO: 74494 - DNA, 201 bp, Bos taurus; identical to SEQ ID NO: 34953

SEQ ID NO: 74495 - DNA, 201 bp, Bos taurus; identical to SEQ ID NO: 34954

SEQ ID NO: 74496 - DNA, 201 bp, Bos taurus; identical to SEQ ID NO: 34955

SEQ ID NO: 74497 - DNA, 201 bp, Bos taurus; identical to SEQ ID NO: 34956

SEQ ID NO: 74498 - DNA, 201 bp, Bos taurus; identical to SEQ ID NO: 34957

SEQ ID NO: 74499 - DNA, 201 bp, Bos taurus; identical to SEQ ID NO: 34958

SEQ ID NO: 74500 - DNA, 201 bp, Bos taurus; identical to SEQ ID NO: 34959

SEQ ID NO: 74501 - DNA, 201 bp, Bos taurus; identical to SEQ ID NO: 34960

SEQ ID NO: 74502 - DNA, 201 bp, Bos taurus; identical to SEQ ID NO: 34961

SEQ ID NO: 74503 - DNA, 201 bp, Bos taurus; identical to SEQ ID NO: 34962

SEQ ID NO: 74504 - DNA, 201 bp, Bos taurus; identical to SEQ ID NO: 34963

SEQ ID NO: 74505 - DNA, 201 bp, Bos taurus; identical to SEQ ID NO: 34964

SEQ ID NO: 74506 - DNA, 201 bp, Bos taurus; identical to SEQ ID NO: 34965

SEQ ID NO: 74507 - DNA, 201 bp, Bos taurus; identical to SEQ ID NO: 34966

SEQ ID NO: 74508 - DNA, 201 bp, Bos taurus; identical to SEQ ID NO: 34967

SEQ ID NO: 74509 - DNA, 201 bp, Bos taurus; identical to SEQ ID NO: 34968

SEQ ID NO: 74510 - DNA, 201 bp, Bos taurus; identical to SEQ ID NO: 34969

SEQ ID NO: 74511 - DNA, 201 bp, Bos taurus; identical to SEQ ID NO: 34970

SEQ ID NO: 74512 - DNA, 201 bp, Bos taurus; identical to SEQ ID NO: 34971

SEQ ID NO: 74513 - DNA, 201 bp, Bos taurus; identical to SEQ ID NO: 34972

SEQ ID NO: 74514 - DNA, 201 bp, Bos taurus; identical to SEQ ID NO: 34973

SEQ ID NO: 74515 - DNA, 201 bp, Bos taurus; identical to SEQ ID NO: 34974

SEQ ID NO: 74516 - DNA, 201 bp, Bos taurus; identical to SEQ ID NO: 34975

SEQ ID NO: 74517 - DNA, 201 bp, Bos taurus; identical to SEQ ID NO: 34976

SEQ ID NO: 74518 - DNA, 201 bp, Bos taurus; identical to SEQ ID NO: 34977

SEQ ID NO: 74519 - DNA, 201 bp, Bos taurus; identical to SEQ ID NO: 34978

SEQ ID NO: 74520 - DNA, 201 bp, Bos taurus; identical to SEQ ID NO: 34979

SEQ ID NO: 74521 - DNA, 201 bp, Bos taurus; identical to SEQ ID NO: 34980

SEQ ID NO: 74522 - DNA, 201 bp, Bos taurus; identical to SEQ ID NO: 34981

SEQ ID NO: 74523 - DNA, 201 bp, Bos taurus; identical to SEQ ID NO: 34982

SEQ ID NO: 74524 - DNA, 201 bp, Bos taurus; identical to SEQ ID NO: 34983

SEQ ID NO: 74525 - DNA, 201 bp, Bos taurus; identical to SEQ ID NO: 34984

SEQ ID NO: 74526 - DNA, 201 bp, Bos taurus; identical to SEQ ID NO: 34985

SEQ ID NO: 74527 - DNA, 201 bp, Bos taurus; identical to SEQ ID NO: 34986

SEQ ID NO: 74528 - DNA, 201 bp, Bos taurus; identical to SEQ ID NO: 34988

SEQ ID NO: 74529 - DNA, 201 bp, Bos taurus; identical to SEQ ID NO: 34989

SEQ ID NO: 74530 - DNA, 201 bp, Bos taurus; identical to SEQ ID NO: 34990

SEQ ID NO: 74531 - DNA, 201 bp, Bos taurus; identical to SEQ ID NO: 34991

SEQ ID NO: 74532 - DNA, 201 bp, Bos taurus; identical to SEQ ID NO: 34993

SEQ ID NO: 74533 - DNA, 201 bp, Bos taurus; identical to SEQ ID NO: 34994

SEQ ID NO: 74534 - DNA, 201 bp, Bos taurus; identical to SEQ ID NO: 34995

SEQ ID NO: 74535 - DNA, 201 bp, Bos taurus; identical to SEQ ID NO: 34996

SEQ ID NO: 74536 - DNA, 201 bp, Bos taurus; identical to SEQ ID NO: 34997

SEQ ID NO: 74537 - DNA, 201 bp, Bos taurus; identical to SEQ ID NO: 34998

SEQ ID NO: 74538 - DNA, 201 bp, Bos taurus; identical to SEQ ID NO: 34999

SEQ ID NO: 74539 - DNA, 201 bp, Bos taurus; identical to SEQ ID NO: 35000

SEQ ID NO: 74540 - DNA, 201 bp, Bos taurus
agaatacgaaataacaaagaatcaaagcagtaagggaagcttggtaagtgtgcgtgtgtgtgtgtgtgtgtgtgtgtgtgtgtgtgtgtgtgtgtgtgtgkatgaaaggccctagggttttgtctcatgttccctcccccttggcttcctatctgtccctaggtcagctcatctagatttgtagaattaattacatctata

SEQ ID NO: 74541 - DNA, 201 bp, Bos taurus
aaggtggatgctctatcaagttacctcatcttttcagttaaagagaattcaaggtgtttgtaaaccaaaggaatgaaatgacttcaagtggaaaaggaaaygaggtgtaactatatactacaagacagcaatgcaatttagagctagaaggatctaatgtactctaaatctatcagaagtttgcactataaacatataggt

SEQ ID NO: 74542 - DNA, 201 bp, Bos taurus
tcactactttaaaaccatcaattgcttgtcacacattcagtagcatagagaaatttaagcccattaaggtgacttgcctgaccaacggcaacctgaccccyactataacttctgtctctactctccaacaccttccatgctcttgccactgagactacttataatttctaaacatatctaatgccccatgtcttctgatca

SEQ ID NO: 74543 - DNA, 201 bp, Bos taurus; identical to SEQ ID NO: 35004

SEQ ID NO: 74544 - DNA, 201 bp, Bos taurus; identical to SEQ ID NO: 35006

SEQ ID NO: 74545 - DNA, 201 bp, Bos taurus; identical to SEQ ID NO: 35007

SEQ ID NO: 74546 - DNA, 201 bp, Bos taurus; identical to SEQ ID NO: 35008

SEQ ID NO: 74547 - DNA, 201 bp, Bos taurus
gcccaccacttcaagcctccacattgcccaagccctcacactgctctagagtgggtatgtgaaccaaaagggcacagcatcccttgaaacctctatccttygttctttgcaaccaaagtgttacatttacagtgacttgagggataagtaacaccttgaacaaagacaaaatccttgtgaccagctggtctgtagctctgc

SEQ ID NO: 74548 - DNA, 201 bp, Bos taurus
tccaatattcttgcctggagtatccccgaggacagagaagcctggcgggcttccatggggtcacaaaagagtcagatagaacttagcgactaaacaacaaygacaacagtgtacttattgctctgtgtctcaatggctgatgctaaaagttagtaaaaaagcttaagaccttagcatattttatctcggctgatttatctt

SEQ ID NO: 74549 - DNA, 201 bp, Bos taurus
ctattataatcgagtgtaataagccacaagaagtggaagctttccactggaaagtattgtttttggtaatcattaacagataatcttgtaatctcttctcytcactaaaatttataactgtttgcactcaattttggagctctgatttgtgaagtctattttggctttttggacatttttgtcttatttctccaacttctt

SEQ ID NO: 74550 - DNA, 201 bp, Bos taurus
agaaatctttgcatgcttaacaactgagtgcatgatttaactaaattttaagcaaagagctatttgcctttaagaatatccatggatagtatctgaaattktcccccattgaatcactggactaggataaagactgccttcatcaagtcctgatggtatctggggataattctttggcagatatgaacatattaggattca

SEQ ID NO: 74551 - DNA, 201 bp, Bos taurus
tcactgaagttataagtgaaagataccaatttgtttcctttaaactttactcaggtcagaaaaaaagaggctgttaagataatttcatattttttatgcckaatttccaatttaataaattagactgcttgttaactttaaattttaaagttctaaagatttgtctttgctggaatgaatctatgtaaatagagttttctg

SEQ ID NO: 74552 - DNA, 201 bp, Bos taurus; identical to SEQ ID NO: 35010

SEQ ID NO: 74553 - DNA, 201 bp, Bos taurus; identical to SEQ ID NO: 35011

SEQ ID NO: 74554 - DNA, 201 bp, Bos taurus
gaaaaggtaagtcttgttccctgcagagaattccagcaaatctcaaagaggtactaatagtagaaaccatgagcttgaaacctggtgtgtgagcttcaagrtctattcatggttctaatattctggctgggaagccttctccctgcagcagcacttacgatcctgtaaacacaaaatgacgcttcttcaaagcccaaagtg

SEQ ID NO: 74555 - DNA, 201 bp, Bos taurus; identical to SEQ ID NO: 35013

SEQ ID NO: 74556 - DNA, 201 bp, Bos taurus; identical to SEQ ID NO: 35014

SEQ ID NO: 74557 - DNA, 201 bp, Bos taurus
ttggaaggctggaaaggtcatctggaagatgagggaattataagtagcagaccgaagagcagattgaggataagaaaggtgaacctaattttcaaagttaytcaactctcaaccttgccagtgcatatatataccaggttccccttccagccccccatccgtactccaggcttttctcccctaatagcctcaaaagggaga

SEQ ID NO: 74558 - DNA, 201 bp, Bos taurus; identical to SEQ ID NO: 35015

SEQ ID NO: 74559 - DNA, 201 bp, Bos taurus; identical to SEQ ID NO: 35016

SEQ ID NO: 74560 - DNA, 201 bp, Bos taurus; identical to SEQ ID NO: 35017

SEQ ID NO: 74561 - DNA, 201 bp, Bos taurus
tcttctgattctgaaatttcacactgtgtggttggagagagttaggggttttcctaaattctgcagatgtttcctgggtggattaaaagctgaatataaayagatcaaattgtagatgatgtagtggaggttctttgagttttagctaaagacttggtagttgtttaacagtgaagtttccatggtgattagcatttagtt

SEQ ID NO: 74562 - DNA, 201 bp, Bos taurus; identical to SEQ ID NO: 35020

SEQ ID NO: 74563 - DNA, 201 bp, Bos taurus
aaattatccagaaatcccacctttcctgattatcctttcctaaatatttccatgactagtacacttcttttgaaaaaaatcaatgagaaccattttccccraggccgtaatatatgtcattgacggttgaatttagaaactgaaaacaggaagaaaaaaaaacccacccacacatttcctggaattactgtttctgtttca

SEQ ID NO: 74564 - DNA, 201 bp, Bos taurus; identical to SEQ ID NO: 35024

SEQ ID NO: 74565 - DNA, 201 bp, Bos taurus
ccttaggccatagtttgttgactcctgatctaaatcctcagcttttacaccatggaagtgacccagttcaaggggtgggaaaggcaggtaacccctgccaygatcaagctaaggccttcaaggagatacagcatccatgcaagcagaagctgtgactacggtaatgtgacttttgtcccctgtaaataagataaggtacag

SEQ ID NO: 74566 - DNA, 201 bp, Bos taurus
actaaaattcatttggaagagtaaaggcaagaataatcaaaacaatttctaagaaaataaaatggggggaacttccctatggccaatcaagacttactacrctgctgctcagccctgagatttctttggaaggaatgatgctaaagctgaaactccagtactttggccacctcatgcaaagagttgacttattggaaaaga

SEQ ID NO: 74567 - DNA, 201 bp, Bos taurus
ctccctcatatagtaaatttctgaagatagaatcggaataagattaaaacacaacaggtgaaaaaagctaatgatttgctattgattttcatcagagtttkttttattatatgataccaaaatattttaaaatatgcaaaagcaatgaaaagatactaatataacagtagtattaaatatactgtttttaatggattttag

SEQ ID NO: 74568 - DNA, 201 bp, Bos taurus
tttctctgagacattcttcaacctttcttcaaccaggagatatttggtacctctcctccacagtcctatactctgtgtgtgagagaatatgcatacacacrctatattttatacagtttatcacacagtgttataactgttaactgacttccttctcctgtaagaatgtaaataaaaaagaacctattcttgcacttacat

SEQ ID NO: 74569 - DNA, 201 bp, Bos taurus
tttttattgatttgtgggagtcagtacattctgaataggagcaaacacatatttgtattataaaaataaatgcatttttctgatactattagaataccacraactccccttactttggccccaatttcactaatgattctctgggaggtaatgtagtcgacttcatattctctctaaaacaatgtgtgccagggaatctgt

SEQ ID NO: 74570 - DNA, 201 bp, Bos taurus; identical to SEQ ID NO: 35031

SEQ ID NO: 74571 - DNA, 201 bp, Bos taurus
tccaggtctttaataatccaggtatgtagaatctcttccaaatgtcacagtcctgccaaggatgttttgccagagcttaggatggaaattggtgacctgaragtcaggttgatgtagatggcaatattgcactatcttggctcaggggacaggagggcaggggaggagatgggagtagaggaggagggcaatgttggtaaa

SEQ ID NO: 74572 - DNA, 201 bp, Bos taurus
catggggccctaggatgcaggtatttctgaatcatcacaacttcactccatcttatccccaggttaaaaagaaaaaaatccacctagcttgatggtttggrgcttgaaggccttttccgttatccctttccaaatacaatcccacatacctccccctacaaacagccacaacccaaagtgattacaatataaggctgacat

SEQ ID NO: 74573 - DNA, 201 bp, Bos taurus; identical to SEQ ID NO: 35033

SEQ ID NO: 74574 - DNA, 201 bp, Bos taurus
attgttgtgaaagctgaggatggcgacgtgatacaggattctaagatggcaagatgatcagatcttggccactctggccgaggtgtaaaaggtatatgatrtagcgagtaaggagactagaggcagggggacttggaaggctaatataggagtcctggtgagagtgcatgatggtcagagcacagtggccggggagatgtg

SEQ ID NO: 74575 - DNA, 201 bp, Bos taurus
tcactgtaagtgtaaagtgttccctggtgaacaaaatcaagtcataggaaaaacaccttttcctaaagcgctttgcacgaggaattgctggaacttgcgtmtatccttacaagtcgttttccatggtgattgcggagcctttaaatgggagccctggtgtgactccccctggggggatgcctccttttctgttaccacttt

SEQ ID NO: 74576 - DNA, 201 bp, Bos taurus
tttaacactcgcccactcttgctgtgaattcctgaggactgacttatcactgtctcctttgccacttaagcttctactttccagtattgtgtctgttgttyattgtactgaaccggatgtcaaacaccctgacctccctccaacttctacacgcctctgccccctccccaactaccaaagtagactttgaagggaaatgga

SEQ ID NO: 74577 - DNA, 201 bp, Bos taurus; identical to SEQ ID NO: 35036

SEQ ID NO: 74578 - DNA, 201 bp, Bos taurus
tccacctccatttagtctcacaaaggtctcttcctacatggttagcacccttttgactttcagctcttattctggagaatacattcaagggctccatcccrctcagttgtccttcatctcttttataggctggttttgtgaagtgccagggcagttttgttagtcactaacctttctttagggagaaagtcactttatggg

SEQ ID NO: 74579 - DNA, 201 bp, Bos taurus
tctctctctctccttctccctttgctgccatacgaggacacagcaagaagctagctgtttgcaagccaggaagcaagatcataacaggaaccaaattggcyagaaccttggtctgttgtttaaacccccagtttatcatatgttgttatagcaacccaagcaggtaggcacacttcctttccatatatttgtatcttcttt

SEQ ID NO: 74580 - DNA, 201 bp, Bos taurus; identical to SEQ ID NO: 35038

SEQ ID NO: 74581 - DNA, 201 bp, Bos taurus
tgggcatcttgccaggccactaatttcttctccatcatactctaaggtattcaactacaaaagaaaaataaatagctagtgtcacatctgttcaatgtacmtgtttgaaggcaatactgctttatttgtactgaaattctatgggaaaaattctgtctttattctttcatagtgttagagataagacacattactagattt

SEQ ID NO: 74582 - DNA, 201 bp, Bos taurus
cttaaccactgtatagtactaactgttctaagtatactaatattcaaatattctcccaaataatgacatccattttaaagaggatactcttaatggcccaratacattgtattcataaacatcttctttgtttataacacattctgcaagaccatgatggtaaaggccagtgttactcatcttagtatctccctcaaactg

SEQ ID NO: 74583 - DNA, 201 bp, Bos taurus; identical to SEQ ID NO: 35039

SEQ ID NO: 74584 - DNA, 201 bp, Bos taurus; identical to SEQ ID NO: 35040

SEQ ID NO: 74585 - DNA, 201 bp, Bos taurus; identical to SEQ ID NO: 35041

SEQ ID NO: 74586 - DNA, 201 bp, Bos taurus
ttttctcatttctctgattaaagttattctttggctaaaattattcctcagacaaaaggcaggctgtagacatgatcaggggaggactgtaggttcctgcyctgtttcatatggctaccccaggtttggtgtttttttttgcatgaaatatctttttccatctcttcgctttcagtttgtgtgtatccttacatctgaagt

SEQ ID NO: 74587 - DNA, 201 bp, Bos taurus
atatgtcattgtgcaataggtagttcacctcgtgcttcaggtgaagtgaaatatatacgcctactctgaggaatctagaaactatttggggaagtaagackaatgaagaaattgctacagaatactgagatgcaattttgagttactgtaatttcaggactaacaaataatatgaccttgttttgtaactcgagaaagaaa

SEQ ID NO: 74588 - DNA, 201 bp, Bos taurus; identical to SEQ ID NO: 35043

SEQ ID NO: 74589 - DNA, 201 bp, Bos taurus
cttgtccttttacagaccctaaaatgccatactatcttatatctttataggttgattctgcctatctttcaaaacccttataaaatgtcatcttctttgtrgagccattgctgattttctccaattaaatgtacctccctccactgcttctttgctttccagttgactctgctttagggtagttatctataagtttgtgtt

SEQ ID NO: 74590 - DNA, 201 bp, Bos taurus
gcaatgcaagttaaagtggtgggtggtccctgcctttgtacataactgtaccactttgttaccataatagcaaataacccataaagactatttctagtcgmaacttcaacagtctttgaaccagatacccatttgatgcagaggtcaatccactgtgatgctagtctgactttctagtgcagaaaacacctcacaattaac

SEQ ID NO: 74591 - DNA, 201 bp, Bos taurus; identical to SEQ ID NO: 35061

SEQ ID NO: 74592 - DNA, 201 bp, Bos taurus
ccatgattttcccttagcttttttgaccagtgggtctcaatacataagcctggatctgaatcacctgaagaggttttcaatgacacagtttctgattccartagatttagggaggggccctgaatttgcatttctaacaagttccgaggtgtgcagctccctacatttggagaacctccctttcttcccttccctgtcctg

SEQ ID NO: 74593 - DNA, 201 bp, Bos taurus; identical to SEQ ID NO: 35063

SEQ ID NO: 74594 - DNA, 201 bp, Bos taurus; identical to SEQ ID NO: 35064

SEQ ID NO: 74595 - DNA, 201 bp, Bos taurus
gtgtgttttatctgtgtcccccttcttcccatgaaagtggtggtgagcctatagtaaagtacagttccaaacacaagagtagatcatacagagttttggcyctgtgttagacctttggtttcctctgatattttttacccctaggcatttccctttggttcagtatttagatatgtctaagatatttgaaggcttttaaaa

SEQ ID NO: 74596 - DNA, 201 bp, Bos taurus
gtcctaacctctggatcactagggaattccccaaattcatttctataccttgagggttatctaaggtggtgcctttaccacatagcacatgcaccagatartatttctaatgtatgtggatgtaaactgaaaagactgctcatggcctttgggctaccccaggccttactgggctgctttcagcaaactactgggaaattg

SEQ ID NO: 74597 - DNA, 201 bp, Bos taurus; identical to SEQ ID NO: 35069

SEQ ID NO: 74598 - DNA, 201 bp, Bos taurus; identical to SEQ ID NO: 35070

SEQ ID NO: 74599 - DNA, 201 bp, Bos taurus
gccagtaaatacaactctgtcaagttcatgcccgtattatcaggttatatccaaatctgcgatctgattctggactcacagcattgtcaccgtaatatagytgtcaaacccaacagaatttggccaaaatgatgctagcaatgtaacgttttttcaaaaatattttcataaatttatatacagtaaaattgactcttttgt

SEQ ID NO: 74600 - DNA, 201 bp, Bos taurus; identical to SEQ ID NO: 35072

SEQ ID NO: 74601 - DNA, 201 bp, Bos taurus; identical to SEQ ID NO: 35073

SEQ ID NO: 74602 - DNA, 201 bp, Bos taurus
tatcaggcttgaatgatatttttttctggacagtgtgactctgtaatagctctagactgagcccagttcttcctctgtgtgcactttcccttattcggacyttaacatttacctacagcataattatcgatatgcgtgactttctttctcccaccacacagtgagttgctaaaggatgggggctgtgtgttaccaatcact

SEQ ID NO: 74603 - DNA, 201 bp, Bos taurus; identical to SEQ ID NO: 35077

SEQ ID NO: 74604 - DNA, 201 bp, Bos taurus
cctggactggacgtgctttcagatgggggcctgtgctggtatataaggcatcgtgtcctgggctgtgctcctgtggatgtgcaggggagctgcagtgaagraagacaggggccttgggcccggccagcagtattccgtctgcaggagaaccctagtctactgtgggtcttctccattctatttttcttgtcctagaggagc

SEQ ID NO: 74605 - DNA, 201 bp, Bos taurus
tcacttgcaggacttggagcagcctgtcttcctttccgaggatgctctaagtagggtttatcccaccccagctgtagtactatgtgctctgcccagacctyggcttctgacttgtttccagtggccaccagccttggctggacttggggagtgctgtctgttgtactgtgggctttaaggaaagcctgggccatcctggaa

SEQ ID NO: 74606 - DNA, 201 bp, Bos taurus
ctccttgatttgtcctccccaaaacccctagttcagatgatactcagcttattggcccatactacctcatataaccccaaatcaaattgttttgaagtgtkttaaagtgatattgcattcttgaccaaatcctttcctccgaggaagttcagaagatgccagtaaaagttaccacaattttaaaacggcagcttctctatg

SEQ ID NO: 74607 - DNA, 201 bp, Bos taurus
tgaaaagaccatgttttgtgcctttactgagtactgtggttcccagtgaacagagatgttataagaaggagtattatgttcctaatggatagctgtttctratttatcctagttctacctgtgagataggtagtatgctttatcttaactgatcagatgtttaaatagtattagtttttcttggaaagttctgaggaatga

SEQ ID NO: 74608 - DNA, 201 bp, Bos taurus
gatagaattacaaacagggcaatgggaattttatagaaaaaaactaagaatcttatctcatgctggacatgttcatgaaagtgtcatttattcatttaatrcatattaaaatcagccacatggcagatcctgtgccaaacacagaggacacaatagtgagcaagacagaaatagtctctacctgtaatggtgccttcccat

SEQ ID NO: 74609 - DNA, 201 bp, Bos taurus; identical to SEQ ID NO: 35083

SEQ ID NO: 74610 - DNA, 201 bp, Bos taurus
tccaggggatcttcccaacctagggattgaacctgggtctcctgcgttgcagacagacgctttaccgtctgagccgctagggaaaccaaaagctctcattratctgattctcctgcctacttctgcagccttacctccccactagcctgcctgtacaatgtcaagcattttcttatctctgtctttgctttttcttcccca

SEQ ID NO: 74611 - DNA, 201 bp, Bos taurus; identical to SEQ ID NO: 35102

SEQ ID NO: 74612 - DNA, 201 bp, Bos taurus
ctaaatataaaattaaaaggagaggtaaaggaattgagctctagaaaatgaagaaagaatgcattgattttttttttttggcctgggatagttttatttgktgacttaggaggagtgcctaggtccctgtcagccttactatgccaagtagggttgtggacccacagcatggacttcactgggagcttaggaggcctgtgg

SEQ ID NO: 74613 - DNA, 201 bp, Bos taurus
gtgggtccccttgtttcacaacacaaggatgtctcacatcccctcatgtgagaaaggtgatgggatgcccatgtaggacaagaccagcctttggtcttgartggctactccttacatgcctttccttcctttcctgttcttcccccgacaagctgaatgcagatttgatttggatgtcctaagttttgctgcttagtgata

SEQ ID NO: 74614 - DNA, 201 bp, Bos taurus
actacagttgaaagctttatgtcccaaggcattctcaggccctggagtagttcttaaatattgctactctgcaagtaaggatgaggacatctttttgagayctcagggccattcatcaaccaaattattattcctctattcccagtagtacctaacccaaataaacatctgctgccaattatatctgaagttatttgtttc

SEQ ID NO: 74615 - DNA, 201 bp, Bos taurus
aacttccacctgccaattcactttttaaaaatgattttttgagaacaaatcttaagtaaagtgataatcaccataaacttcccagaaataattaaattttkatcacaagcattcaaaacattttcacacattctctcagcaatcagtaataagtcaatagtacatacaaaatttctgcattacacactgcaatacctttaa

SEQ ID NO: 74616 - DNA, 201 bp, Bos taurus; identical to SEQ ID NO: 35105

SEQ ID NO: 74617 - DNA, 201 bp, Bos taurus
agtgtaggcagtaaaagtaaacatggaattatctcataagctcctaagtttccaagagtcatgtactattctatctatatcccagtgttagaaacatagcrgatcctcaactgatgttgaagtgaaagtatatgtaaatggggaaaatattattccaaaagtcattttctaaaggttacctctctatggaagtaccaccat

SEQ ID NO: 74618 - DNA, 201 bp, Bos taurus; identical to SEQ ID NO: 35107

SEQ ID NO: 74619 - DNA, 201 bp, Bos taurus; identical to SEQ ID NO: 35109

SEQ ID NO: 74620 - DNA, 201 bp, Bos taurus; identical to SEQ ID NO: 35111

SEQ ID NO: 74621 - DNA, 201 bp, Bos taurus; identical to SEQ ID NO: 35113

SEQ ID NO: 74622 - DNA, 201 bp, Bos taurus; identical to SEQ ID NO: 35114

SEQ ID NO: 74623 - DNA, 201 bp, Bos taurus
aaatgacagtgatctatggtatgaataggtcactgtgtccttgcccaatcccctactttcttgcatacatactgcttttttccttaggataaaggcctgcraatgacattgctgcctcaaagatcacacaccttctctaaaccttatgattgccaaatttcctccccaaggccatccctaaagcatgctacctctgtctgc

SEQ ID NO: 74624 - DNA, 201 bp, Bos taurus
cctgggtgtggggcgaagggtagtaggtgaaaggatgacgtcagccgcctccacacctggacccagcctctctgaagcaaaatgttttctggagtatctcygagcgctggcctgcacagctcctcctgcacagactacttactgccttcttggcctgccggcccctgaaggagggctggaagggagtgttagtgagacctg

SEQ ID NO: 74625 - DNA, 201 bp, Bos taurus; identical to SEQ ID NO: 35118

SEQ ID NO: 74626 - DNA, 201 bp, Bos taurus
accagcggacattgttttgagaaatgccagtgacatcccatgtctgacacagctcagaaaactcaagttctcagcagtacatggccttgtctgaaatcacrtccataatgcctcctagtattaataaccttaaatgtctcaaccacagcgactccattttgactttcagtttcatttttctccttaattggccaaagcagg

SEQ ID NO: 74627 - DNA, 201 bp, Bos taurus
cccaggcccaggcgcacactgaccctttgtcctctgcaggtgaccctgccctcagcatgagtcgctggatgtttcaccagcaggccctgcaggagtacatyctgatgtgctgccagtgccccaccggggggcttctggacaaacctggcaagtgagtgccttgtctctggggagggcggggcgagggggctgagcacgcag

SEQ ID NO: 74628 - DNA, 201 bp, Bos taurus; identical to SEQ ID NO: 35120

SEQ ID NO: 74629 - DNA, 201 bp, Bos taurus; identical to SEQ ID NO: 35121

SEQ ID NO: 74630 - DNA, 201 bp, Bos taurus
aactttgctttcagaaccctgccaccttggagacaagcccaggatagtattaatctctggcagaagaatagaggtcacatggatgaatcaagtgccgtttrtcccagctcggggccatcatagatcacctttcatctactgaccccagacacgtgagagtccagccatgatagggacagctgccgcccccaccttgagggg

SEQ ID NO: 74631 - DNA, 201 bp, Bos taurus; identical to SEQ ID NO: 35122

SEQ ID NO: 74632 - DNA, 201 bp, Bos taurus; identical to SEQ ID NO: 35123

SEQ ID NO: 74633 - DNA, 201 bp, Bos taurus; identical to SEQ ID NO: 35124

SEQ ID NO: 74634 - DNA, 201 bp, Bos taurus; identical to SEQ ID NO: 35125

SEQ ID NO: 74635 - DNA, 201 bp, Bos taurus; identical to SEQ ID NO: 35126

SEQ ID NO: 74636 - DNA, 201 bp, Bos taurus; identical to SEQ ID NO: 35127

SEQ ID NO: 74637 - DNA, 201 bp, Bos taurus; identical to SEQ ID NO: 35128

SEQ ID NO: 74638 - DNA, 201 bp, Bos taurus; identical to SEQ ID NO: 35129

SEQ ID NO: 74639 - DNA, 201 bp, Bos taurus
agagctctattgttctaaattctgggccccagactgactgtgtcaaatctggcaaggctttcaagtttcagctcagacataatgaatcagaatctccagartaaggcccaggtattttaaaaagttctttgcgttaaaataacacctctggaaaaacagatgtatacgaaaaaagcctatagggagagataatgatgttat

SEQ ID NO: 74640 - DNA, 201 bp, Bos taurus
atcctggtgtattcgcgtgattcaacaacaacctttcaaccacacactgctcacaacgcaccgcccccctccccccaaaaggagaaagttcaggcaaagcwaaaggcctacctcttgaccaaccatgagataaccaccatgaaattaccaccacgagtcaaagtgttagctgttctttgcaaccccatagactgtagccca

SEQ ID NO: 74641 - DNA, 201 bp, Bos taurus; identical to SEQ ID NO: 35134

SEQ ID NO: 74642 - DNA, 201 bp, Bos taurus; identical to SEQ ID NO: 35135

SEQ ID NO: 74643 - DNA, 201 bp, Bos taurus
actgcaattgccatctgtctctgttttgctaactcattagttcggacaccacattgtgttaatccccacttcccctggctatgagcttgatccagatctcyaggagatagtggaactgcttagcctgactctcctgtcagctggctactgccttccacagtgggcagcttgccaggcctgcacctttccagaagactcttt

SEQ ID NO: 74644 - DNA, 201 bp, Bos taurus
gcgagggctacatgaacctgggctatggccttggtgctcaccactgcctgtctgccttgaagcacatctccaaagctgccttttgcagacttgggccacaygaatggtttggatggtccacgagtgcctttgttccccgtctaccggaaagcctttggttttcccttttcctccctctgaaggcccttgacgccctgcaag

SEQ ID NO: 74645 - DNA, 201 bp, Bos taurus
tgcaccttttgtgtcttccccttgatcaaaagaacatgtaaggcccctctgaggcatctaacatgaccagtctattcactctccagggttgacattttccyagagtttcactcgacccttgcccaaatacaatgtgccttttctcagcccaccttggaacgcagcgccaaagcctccagggccttgctcctgggcccgtcc

SEQ ID NO: 74646 - DNA, 201 bp, Bos taurus; identical to SEQ ID NO: 35136

SEQ ID NO: 74647 - DNA, 201 bp, Bos taurus; identical to SEQ ID NO: 35137

SEQ ID NO: 74648 - DNA, 201 bp, Bos taurus
cctggccctcctctgctcccatgaaaccagcaggagggaagtaccccctcaagccagaggtgatggaggggttggagggcccctccctgggctctgactcyaggatgactccagttatggtttccccaggaggaaacgagcctgggcaccctttttccccttctaggacggcacaagggaatgacttggcccatccctgca

SEQ ID NO: 74649 - DNA, 201 bp, Bos taurus; identical to SEQ ID NO: 35138

SEQ ID NO: 74650 - DNA, 201 bp, Bos taurus; identical to SEQ ID NO: 35139

SEQ ID NO: 74651 - DNA, 201 bp, Bos taurus; identical to SEQ ID NO: 35140

SEQ ID NO: 74652 - DNA, 201 bp, Bos taurus; identical to SEQ ID NO: 35141

SEQ ID NO: 74653 - DNA, 201 bp, Bos taurus
ttgaccccctctgcatcctctctgtgagccccaatctcctgtgttaccccagatcccacattagatttgagaccccaggagcactgatctgtctcaggacrttgttgtcggccctgtccacaccccactgccctgtctgcagcataggtggtgcttggttgagtcagcctgaaaagctgcctttaattcccagctgctcct

SEQ ID NO: 74654 - DNA, 201 bp, Bos taurus; identical to SEQ ID NO: 35151

SEQ ID NO: 74655 - DNA, 201 bp, Bos taurus
acctcctctacttcaggcctcctcactcacccggcttcagccatactggcatccttgctgttctgacacaccagacacattcccaccttaagagtctctgmaatggccttaacaaatctaaataaaaagtgaaagtcgctcagtcgtgtccgactctttgcgaccccatggactatacagtccatggaattctcccggcca

SEQ ID NO: 74656 - DNA, 201 bp, Bos taurus; identical to SEQ ID NO: 35153

SEQ ID NO: 74657 - DNA, 201 bp, Bos taurus; identical to SEQ ID NO: 35154

SEQ ID NO: 74658 - DNA, 201 bp, Bos taurus
gagtccgagctgcaccgtgcccggcgcgcgcgcgcgcgcgcacctcggagtctgaatctgcacaactctccgccaggcgcctgtgcgagaggccgggagayccgcgccccggtccgggtagctgcgcccactcagccgctctcgtttccacccggctgacccttccccttcagtcacctgggtgagcgctttgcacgctgt

SEQ ID NO: 74659 - DNA, 201 bp, Bos taurus; identical to SEQ ID NO: 35155

SEQ ID NO: 74660 - DNA, 201 bp, Bos taurus; identical to SEQ ID NO: 35156

SEQ ID NO: 74661 - DNA, 201 bp, Bos taurus; identical to SEQ ID NO: 35158

SEQ ID NO: 74662 - DNA, 201 bp, Bos taurus; identical to SEQ ID NO: 35159

SEQ ID NO: 74663 - DNA, 201 bp, Bos taurus; identical to SEQ ID NO: 35160

SEQ ID NO: 74664 - DNA, 201 bp, Bos taurus; identical to SEQ ID NO: 35162

SEQ ID NO: 74665 - DNA, 201 bp, Bos taurus; identical to SEQ ID NO: 35163

SEQ ID NO: 74666 - DNA, 201 bp, Bos taurus; identical to SEQ ID NO: 35164

SEQ ID NO: 74667 - DNA, 201 bp, Bos taurus; identical to SEQ ID NO: 35165

SEQ ID NO: 74668 - DNA, 201 bp, Bos taurus
tatcctgcatttattatattagagagtaggattattttctctaaagattcttaaaagccattaaaataatatcttattccaaatcaaatggagctacttaytgccagaattttgtacctttttcaatgattaaagaaagcaagcaagatttatagacaatgcaattttcatgacacatcaaaaaatgtgttcttatagctg

SEQ ID NO: 74669 - DNA, 201 bp, Bos taurus
aaggtattagagatggagtggcctcaacagcataaacttattgtctcaaagctccgtgtctagaagtttgggatccgaaagtccacagggctggttccttmcgagggccgtgagggaaggatgtgttccaggcactctcctgagcttgcagatgactgtcatctctctgaatctccacatggacttcctgttccctgtctc

SEQ ID NO: 74670 - DNA, 201 bp, Bos taurus
tgtctgcactcctggtccccttccccgggcttcctttcagcattcacagtgaggggttataggatatttccccaacctgcacagcgcagagcaggccaackagaggctgctggctctggcttgctttcaagaggcttcgagtggggtgtgttccccggtgagagcgccctctggcctggagctctctgtgaggctcctagc

SEQ ID NO: 74671 - DNA, 201 bp, Bos taurus
gaaatcatattatgtaaaatatgtaggatcaattccaacctgaaatagcaccaaaaacaagtctccataagtattcattagaaaatactttggctcaaatktctagcagttctctatattcatacacacatacaagttctaatatttacatattgcaaaaatacataagaagcttcagctatagagaattcatgcacagtg

SEQ ID NO: 74672 - DNA, 201 bp, Bos taurus
tcccattcctgattttcatttgctgtggatcaggccccaccacaatgcggatgctacttatattactaagtcttctcactacagcccaggacctcccccaygcccttgaggctcatctttatgggcttcaaacctagtgtcactggcacctctgaacttttgttctggcattccccactattgccgtcagctgccgccttc

SEQ ID NO: 74673 - DNA, 201 bp, Bos taurus; identical to SEQ ID NO: 35168

SEQ ID NO: 74674 - DNA, 201 bp, Bos taurus; identical to SEQ ID NO: 35169

SEQ ID NO: 74675 - DNA, 201 bp, Bos taurus; identical to SEQ ID NO: 35170

SEQ ID NO: 74676 - DNA, 201 bp, Bos taurus; identical to SEQ ID NO: 35171

SEQ ID NO: 74677 - DNA, 201 bp, Bos taurus
atgaagatgaagggcatgctttttaaagaaatgtctgataaaggagtaaaaagatactcaaatctcattaatgagtagggaaattcaaggagaaacgagtwttttttttttacttatcagattggaatgatggtgcggatagaaggaaggggcatacctagatactcttggtgggaatattaatttgtacagtaggtttgg

SEQ ID NO: 74678 - DNA, 201 bp, Bos taurus
tctaacccctcctaaggtcaagcagataccatgtggctcaagactcccaccgtggatcagattgttaatgtgacccaaggcctcctgtaaacagaaacagycttaataggcaggctgttccagggacttaaaggttatctcctaggagccaggccaaatctttctatggtgtatgcaggttttggacacccctgacctgct

SEQ ID NO: 74679 - DNA, 201 bp, Bos taurus; identical to SEQ ID NO: 35172

SEQ ID NO: 74680 - DNA, 201 bp, Bos taurus
acagtgcagtaagtcacttctggcctgagtgaacagttgttcctctcgctagagactgggaagtctggagtggaagctttcttaagacagacggatcaagytgttgagtgtctctgtgcagaaggccaaactggtcagacagttgtcctccacccctgccgccacgcaaggagcaagtccgtctttcagagtagttaggta

SEQ ID NO: 74681 - DNA, 201 bp, Bos taurus
cttaacaaccaaacaacaaaaacagcatgaaggagggtctcttgctatccaccggagatcttctgaactatcagttaattttaccatttcataaaaagcakctggccaatgaaaaagtaaaaaaaaaaaaaaaacttatcctcattaggaatgaaggaaatgcaaaataagactacacacgacattaaacattctcaaaat

SEQ ID NO: 74682 - DNA, 201 bp, Bos taurus
agtcacgaaacttatcttggctccagaccacgcctgatctcgtcgtgtctccgggcgcgccccagtcgccctgagacaaaactccagcagccgtccgcgcytcctcatttagagtacggacggaggctgtgcgtctggaatgacagtgaccgtgatgctggagccggccggccgctgccgctgggacgagcgcgtgcatat

SEQ ID NO: 74683 - DNA, 201 bp, Bos taurus; identical to SEQ ID NO: 35179

SEQ ID NO: 74684 - DNA, 201 bp, Bos taurus
ttgaagaaataagaaataatattttaaagttattacaatatttagaagatagtattacaaatatatttggcttttgttttttgtttataacgtgtaatatygattcttaagatatgcttttctgttttatgtgaaaagcactgacctattgcatcataagtcagctacccgacatctaacctgaaccacaccaagcttaag

SEQ ID NO: 74685 - DNA, 201 bp, Bos taurus
acttaaagtcaataaaaaatattttgtatgataaaataactaagaagtacatgcaactaaagttattatgcacatatattaagaaataaccttactacagkcaagtttttgtgtttataaatgagtctacacacaacagatgacttggactgactttcaggttcacagtaaccaattttttagaatgaattctaaatataa

SEQ ID NO: 74686 - DNA, 201 bp, Bos taurus
atgatattaatacttcatttcccatccttaccacagtcttccagaagtagaagttgggtaacaaaaggagtgggaagctcttgagtcagtggcaagaaatrattcagtttgtgaaagaggcatattttcataagcaaacattggccaagattttgttcagctttgttttcagcctttctttgtagctgaagaactgaactc

SEQ ID NO: 74687 - DNA, 201 bp, Bos taurus
tcctaaagtgaggtacataatcagagataaactcagttcaagtatcagagtactgacccatgtttaagaatttctaagttaatagtaactgaaagggctgktttttttttcccttaatcattcggtatgattattttgtacctactatatagatgtactctgctgagcacagggttatagagaagaacattctggtcctga

SEQ ID NO: 74688 - DNA, 201 bp, Bos taurus
tcttctataaatctagttaaatagataaccatttaacacatggatttaaaccaaactaactagggttttatgtgctcctttttgctagaaggagctgctcrtacagttaaggaaggttgctgccccaactagtacccaggtttgagcctccagaataaacctgttacacaaatgcaagacagtcgtgtttcccttcatgtt

SEQ ID NO: 74689 - DNA, 201 bp, Bos taurus
gtcacggaagtttcccagggtctcagaactcagctcttcgcagcgatgaggaggcctctgggtccctgaggggctggcctcactgccagccccgtcacccrccatcctcaagaagaatccagctctgtaccgttcccaaagtggactgcatcacatctttccaagctcctgagacccagggccccaactgagcacccccgt

SEQ ID NO: 74690 - DNA, 201 bp, Bos taurus
gaattcagggaaggatgctccctgggcctgccaggaaacataggcagagctgccctctagtggacatcagaggctacagcaaggtcaagcttctctgagcytgaagctgggactggaaagggtgtgctgaaatatgttgtcagaagtgctgagtgcgtgtggagtgcgaggtcgttaaatcacgccagcaactagcgcaga

SEQ ID NO: 74691 - DNA, 201 bp, Bos taurus
tatccatctatttccccctggccagggggcaggagtcctgtgttttagtggagatgatcttatttaccttgatgctcaaggttgctcctcaaatatttccraagtccagcagcactcaggcccttgggtggctcatgggccctgagcatcacctcatatctcaccccccctggctgttccatttttgcctcattctcacca

SEQ ID NO: 74692 - DNA, 201 bp, Bos taurus
ctgtgctttcaaccactgtgttaggctgcgactcccagctggctctgagcagaaatgttaggacagggctggagaggatgaaagagggaaaatggccaggygctggtctcagatgtgatgtgggtgggggacaagggtggaaccatggtagctgctcagatgtcatgatggtaccattcattgagctgtggaaccggggtt

SEQ ID NO: 74693 - DNA, 201 bp, Bos taurus
gaagaggaaatccaactagttggggtctgatggtgactttattctcccgaaagttctggagatgacatccaggttctatcagtcagcagaacgccccctgyccaggaagtaaggcctgtaggctccgggcagaacaccccacctccccagccctgggtttaatcacctggtttcccctggccatgtgctaacctgtgaaac

SEQ ID NO: 74694 - DNA, 201 bp, Bos taurus
ggggaggaggacgaaggatggtggcaggagagcctgggagccggggaggctcctcggactacagcaccttacagttggcgcccaccacctcctggccaccrtcacagcctgggaagggatggaatggagatttcctgtctgttttttcaggaagaaagagaagtcccccagagagcacactttctgctatctttgatgccc

SEQ ID NO: 74695 - DNA, 201 bp, Bos taurus; identical to SEQ ID NO: 35186

SEQ ID NO: 74696 - DNA, 201 bp, Bos taurus; identical to SEQ ID NO: 35187

SEQ ID NO: 74697 - DNA, 201 bp, Bos taurus; identical to SEQ ID NO: 35190

SEQ ID NO: 74698 - DNA, 201 bp, Bos taurus
gccagccacagaagaaccttcacagtcctcaggtactattcctgttgttcagtgtactttaaaaaaatagactaatttattttccgctgccctgagtcttygttgctgaacaaaggccactttctagttgtggtgtgtgggcttctcactgtggtggcttctcttattgcggagcacaggctctagagggtgggctcagta

SEQ ID NO: 74699 - DNA, 201 bp, Bos taurus
gaggcctggcgtgctgcgattcatggggttgcaaagagttggacacgactgagggactgaactgaactgaactccttttagagactagagcagagggcagrggggcctgccctttggaaagggcgcagtgatgccagaagaaagtaatttctttctctctcctacagatagtcactgactgtgtatcaggtgaggtatgag

SEQ ID NO: 74700 - DNA, 201 bp, Bos taurus; identical to SEQ ID NO: 35193

SEQ ID NO: 74701 - DNA, 201 bp, Bos taurus; identical to SEQ ID NO: 35195

SEQ ID NO: 74702 - DNA, 201 bp, Bos taurus; identical to SEQ ID NO: 35196

SEQ ID NO: 74703 - DNA, 201 bp, Bos taurus; identical to SEQ ID NO: 35197

SEQ ID NO: 74704 - DNA, 201 bp, Bos taurus; identical to SEQ ID NO: 35198

SEQ ID NO: 74705 - DNA, 201 bp, Bos taurus; identical to SEQ ID NO: 35199

SEQ ID NO: 74706 - DNA, 201 bp, Bos taurus
ctgagtagataaccatgttgaaatttgagataataaactcatgtcctttctttctccccccactttttttttgtcttccaatattttgagcagattcataytcaaaggaccggggaccttggatcgtaaaaccagtggcctcttccagggggcggggcgtctacctgatcaacaacgtgagtttgtaatgggggcacactt

SEQ ID NO: 74707 - DNA, 201 bp, Bos taurus
tcagcttttattggtgactttgcaaatagtgaagaacctactagctgtgtgctctgctaactggtaggtaacagcgtgactttatccatgagcagtccacrgggtaattacttaaaggcttaagaagctgtagattagttccatgtactgtgtgagaccattttaccaggtggactaataccttcaggatcttcagtacgt

SEQ ID NO: 74708 - DNA, 201 bp, Bos taurus
ccagaccccatgcaactcgtggcataaattcgtgagttgaccagcctaggtttagtagcatagtctctgattattagcccagagaagccagctggcccaayggcgactatgctgtcaaagtcacttcagttgtgtccgattctgtgtgaccccatggactatagcctgccaggctcctctgtccatgggattctccaggcc

SEQ ID NO: 74709 - DNA, 201 bp, Bos taurus
tcagcaccttgaaaacatactggaaaaccagaaatgtctctcaactattttgccctctccatgcaagcaccctgaggcccgaagcagctcaaacccagacracacgccttgggtgggctctgcaacatctggaaagcccagcagtcagagagctcatgctcatggccaccaaagttcatttcttttaggggaagtgaagac

SEQ ID NO: 74710 - DNA, 201 bp, Bos taurus; identical to SEQ ID NO: 35201

SEQ ID NO: 74711 - DNA, 201 bp, Bos taurus; identical to SEQ ID NO: 35202

SEQ ID NO: 74712 - DNA, 201 bp, Bos taurus; identical to SEQ ID NO: 35204

SEQ ID NO: 74713 - DNA, 201 bp, Bos taurus; identical to SEQ ID NO: 35206

SEQ ID NO: 74714 - DNA, 201 bp, Bos taurus; identical to SEQ ID NO: 35207

SEQ ID NO: 74715 - DNA, 201 bp, Bos taurus; identical to SEQ ID NO: 35208

SEQ ID NO: 74716 - DNA, 201 bp, Bos taurus; identical to SEQ ID NO: 35209

SEQ ID NO: 74717 - DNA, 201 bp, Bos taurus; identical to SEQ ID NO: 35210

SEQ ID NO: 74718 - DNA, 201 bp, Bos taurus; identical to SEQ ID NO: 35211

SEQ ID NO: 74719 - DNA, 201 bp, Bos taurus; identical to SEQ ID NO: 35212

SEQ ID NO: 74720 - DNA, 201 bp, Bos taurus; identical to SEQ ID NO: 35213

SEQ ID NO: 74721 - DNA, 201 bp, Bos taurus; identical to SEQ ID NO: 35214

SEQ ID NO: 74722 - DNA, 201 bp, Bos taurus; identical to SEQ ID NO: 35215

SEQ ID NO: 74723 - DNA, 201 bp, Bos taurus; identical to SEQ ID NO: 35216

SEQ ID NO: 74724 - DNA, 201 bp, Bos taurus; identical to SEQ ID NO: 35217

SEQ ID NO: 74725 - DNA, 201 bp, Bos taurus; identical to SEQ ID NO: 35218

SEQ ID NO: 74726 - DNA, 201 bp, Bos taurus; identical to SEQ ID NO: 35219

SEQ ID NO: 74727 - DNA, 201 bp, Bos taurus; identical to SEQ ID NO: 35220

SEQ ID NO: 74728 - DNA, 201 bp, Bos taurus; identical to SEQ ID NO: 35221

SEQ ID NO: 74729 - DNA, 201 bp, Bos taurus; identical to SEQ ID NO: 35222

SEQ ID NO: 74730 - DNA, 201 bp, Bos taurus; identical to SEQ ID NO: 35223

SEQ ID NO: 74731 - DNA, 201 bp, Bos taurus; identical to SEQ ID NO: 35224

SEQ ID NO: 74732 - DNA, 201 bp, Bos taurus; identical to SEQ ID NO: 35225

SEQ ID NO: 74733 - DNA, 201 bp, Bos taurus; identical to SEQ ID NO: 35226

SEQ ID NO: 74734 - DNA, 201 bp, Bos taurus; identical to SEQ ID NO: 35227

SEQ ID NO: 74735 - DNA, 201 bp, Bos taurus; identical to SEQ ID NO: 35228

SEQ ID NO: 74736 - DNA, 201 bp, Bos taurus
taaacatcaaaattcctcatgttccagaaaaattgtctctattataaagttatggattttatagctaacttcactaggctcctgtaaaattttattttatyacaggtaatgtgaaatgagagtgcatcctaccaccactaaaagagatcagtgctacagctctgaggaggagagttagatctcagctgtcagcctgtggct

SEQ ID NO: 74737 - DNA, 201 bp, Bos taurus
cttttgttttctgaaaagtgactgtcccctaatctcagcagtcaggcagggatgatctacttaatgttgatctcctgagccggagtgctccagattctttygttcctcttttggggccactgcgcctgcagttcactctcaggagagcctgtcaattatgtggtttttctggtaactagcacttggggcctgaaacatttg

SEQ ID NO: 74738 - DNA, 201 bp, Bos taurus
tttaattttcttgtccatatcgtgtggcgtgtgagatcttagtttcctgactagggactgaacatgcaacccttgcattggaagcacagggccttcaccaytgcactgccagggaaatccaccctctccacagttacacatcaaagtcccaacccacagcgtgactcatctggagacagggcccttacatgtgtgttgtga

SEQ ID NO: 74739 - DNA, 201 bp, Bos taurus
ggctgtaaaaaaaggccattagagagagtacacagactcaacttcaccgcatctggtgggcaaactcctgtttgagcaaaaggaaggcagaatacccatcmgggcccgttttcaactgagagcaactacgtcagctgtcctgaagctccccacgtgaagattatctgtcctttggatccttttgtattattcggggtagat

SEQ ID NO: 74740 - DNA, 201 bp, Bos taurus
gaatctgggaacatctatcctccggtggatttcctctatttataataactcgggttcggcaagattcaagtgttcttctctgaatggcttttaaaggctcrgtctctcttagttcgaaatggagatggggaaggaaggagtcggttggggacgtctgagtgtgcgctctgagtggccctttgggggccgacgctgacagcg

SEQ ID NO: 74741 - DNA, 201 bp, Bos taurus
atgccgatatcctctgtctgtggtgaagcctgggaatgtggatgctcccggtactggagatcactaactgatcatctttagaacttttcctaagccagagkctcagtggttttatagttgtctggctaaagtcacttgtgaatttctgaaagtatttttttctatatattctgccacctaggaaatgtcgctccatttaac

SEQ ID NO: 74742 - DNA, 201 bp, Bos taurus
aggccacatcccaaaagccaggaacagggtgggcatgaaggggctttgtggtaggggcaatgacaaaaggtatcagggctgaggagaggcgcaatgcagaygagggcctccgtggtatcctgaaagggtaagtaacagagctggggaatgtgactggccttttgtcatggccactgacagtcgatgtgaccttgacttctg

SEQ ID NO: 74743 - DNA, 201 bp, Bos taurus
ttacgactaaagtttttatcctgttctcagacttcatagtgccctggaaaggatgaagacaggaagcctgagaaactgagtggccacaaaacagtaaggayccagatctactctgaaaacagccctgtggattgcccagttctaagtttcctactaagacctctgtggccatggatagtaagtcagctcaattgtctctct

SEQ ID NO: 74744 - DNA, 201 bp, Bos taurus
catgcagaacgagcaagaaatcagtgttggttgtggaaagtcactgggtttaaggattctttgttactatggcatagctgtacatcctgcctgaaaaagayggtaaggcatgctctattacctttacagggttgggttgaaaaatcaaatacagacatgtaattggaagcttttagtcaatgtgaaacatctagcttcttc

SEQ ID NO: 74745 - DNA, 201 bp, Bos taurus
cacagcgtaggaagtatctttactcctcagaaaccatttggcctgactctaattaatacttcacctaatcttctagtaatgctactaattgttcacaaacyggcaatttaatcaacactctactaacaggcaaagttgtgggttttttatcccctctccactttttttttgtgctctgacacagtgtgaacttaggcatgt

SEQ ID NO: 74746 - DNA, 201 bp, Bos taurus
cctcctataaggtaggcagcaatccggtcatggtttcaggcatcaggttaaaacttgaagagtctatagccacaaatggtatgttttctgcatgatttgtyggtcttctttgtcacggagtctgaagaggcagacaaaccacttttttatgaggatatctcttccttattgggggctttaaataataacagattccctaat

SEQ ID NO: 74747 - DNA, 201 bp, Bos taurus
ttgagaatctgaggctaaatactagggcataactaggtctcatgacaaatggagtaagaaaagtttgacatcaaggcccacactagtgtagaatccttgcrggacattctaatctgaagagtctattggagaattcagatatgcctgatctacagattgcaggcccattagaagtgggcaaagggttaatgtgaagcatat

SEQ ID NO: 74748 - DNA, 201 bp, Bos taurus
atagatgtaggaacaacgtcatattttggcattcactacaactggtgacactgatagattgatcctgatcattattccttgggaacattgaccaagaaccrgcaatgttacaatttcatagattatttgaatttctattgtgcttgatatttttcagaatattttatttgccctatatgagaccattttcaaaaaaaacac

SEQ ID NO: 74749 - DNA, 201 bp, Bos taurus
atgcagagtcttggtttcccatcaaactttatgccatttcccaatcttccatttcactcatatccaatctattatcatattttgtgggtgtcttcttaacrtctcctgaatctgtacctttctccattttcataatacatttcctaattctggtgtgcgttacatttccttgaaccattgccagagcctctcttctgtatt

SEQ ID NO: 74750 - DNA, 201 bp, Bos taurus
atatgaagaacatatatttttaagagtttctcatttgcacactcaaattccatgatcccctccttcagctaaggtggacataccgatagacacgtgttagytaccaaaccacaaagtctaccaactgccctagcatgtctgtctgcagagggctgcatcgggaacacgttcagggccatatccagtctcctctgtcaaccc

SEQ ID NO: 74751 - DNA, 201 bp, Bos taurus
cagtgcttagagctttgtgacctttcagttactcatttcacttcctgaacaatggttgggtattccatacaaaataaggccaatgttagttcttaaattartgtattattttacacagttcagttcacttcagtcgctcagtcgtgtccgactctttgtgaccccatgaatcacaccacgccaggcctccctgtctatcac

SEQ ID NO: 74752 - DNA, 201 bp, Bos taurus
actattctttattttccattaaggaacacttgatcccttagactgtccagtgcataatttagctacagatgccatatatttagcaaggctttcttattcayttgaaattagtactcaatactagggcaaagttcactgaagctggagtcctcttagattacccagaagttatcataaggatccttatgtttagccttcctt

SEQ ID NO: 74753 - DNA, 201 bp, Bos taurus
tggtagacattaaacaagatgctgtggaatttaaaaaaaaaatacataaaacgtctacacttgaagaatttaaaatacaggaagggaggcagacacatgcrtatacaattacaatatgcaatgagaaatatttgattagaattgaagctacatggttctataggtgaatggtgaattcagagaagaaaggcattgacattg

SEQ ID NO: 74754 - DNA, 201 bp, Bos taurus
atgtaaagagagtatataaaataatttcttttccgttggcagggaactcattgacaaaagtttaaacttgcctccagttaactctccttagctccgacatmttaataaacctttccactcatctgtaaaaattaataataagaatagtagttattgtaataaaaggtttacttcccttacaaactcagcagacctcagggc

SEQ ID NO: 74755 - DNA, 201 bp, Bos taurus
aagagtcagaacaaaagaaggatccttgactgcaatcagcatgtttcacaataggtataaacaactaaagcaggaattttgaaaatgaataaagttggggraaaaagtcttggtaagaacattagagaacaaaacattagaaaacattagaataacaaaaatgtgcatgaagattttacagttctgagaataccatgttgg

SEQ ID NO: 74756 - DNA, 201 bp, Bos taurus
tcattttaacaaaagaatcctgaaattgaagcttttatgtaaaacagtgccttgctaattttgctactctgtctggcctgccttaacaagataccacagaytaggtggcttaaaaaacagaaatgtattatttcacagatttggaggttacaaggcccaaatcaagatgttaatagggcttattccttccaagggctctga

SEQ ID NO: 74757 - DNA, 201 bp, Bos taurus
ctggataggaattgggatggtcaggatctcggagccagcgggggagccccacaaagcccaaaagaggcttctgatgaacagggccagttttgcatccctcrtctctgatgggacactctgagtcgctacctgctctgtgtgctgtaacaaatgggaggcggggctgcccctggggttgctgtgtgtgctctgctggaacag

SEQ ID NO: 74758 - DNA, 201 bp, Bos taurus
ccatcaccaactcctgaagtttactcaaactcatgtccattgagttagagatatgcattaaatacttcattacgatctacatattcagtaggtgggtttcycaggtggccaagtggtaaagaatccacttgcaatgcaggagactcaagagacacaggcttgatccctgggtcaggaagattcccctggagaagaaaatgg

SEQ ID NO: 74759 - DNA, 201 bp, Bos taurus
gagttttatggctttgggctttaaatttaggccttcaatccattttgagtttatttttgtgtctggtgggaggaaagcttttagtctcattcttttacacrtagtggcccagttttcccagcagcacttattaaagaggctgacttttctcattgtatcttcttgccgcctttgtcaaaggtcaattgcccttaagtgtgt

SEQ ID NO: 74760 - DNA, 201 bp, Bos taurus; identical to SEQ ID NO: 35232

SEQ ID NO: 74761 - DNA, 201 bp, Bos taurus; identical to SEQ ID NO: 35233

SEQ ID NO: 74762 - DNA, 201 bp, Bos taurus; identical to SEQ ID NO: 35234

SEQ ID NO: 74763 - DNA, 201 bp, Bos taurus; identical to SEQ ID NO: 35235

SEQ ID NO: 74764 - DNA, 201 bp, Bos taurus; identical to SEQ ID NO: 35236

SEQ ID NO: 74765 - DNA, 201 bp, Bos taurus; identical to SEQ ID NO: 35237

SEQ ID NO: 74766 - DNA, 201 bp, Bos taurus; identical to SEQ ID NO: 35238

SEQ ID NO: 74767 - DNA, 201 bp, Bos taurus; identical to SEQ ID NO: 35239

SEQ ID NO: 74768 - DNA, 201 bp, Bos taurus; identical to SEQ ID NO: 35240

SEQ ID NO: 74769 - DNA, 201 bp, Bos taurus; identical to SEQ ID NO: 35241

SEQ ID NO: 74770 - DNA, 201 bp, Bos taurus; identical to SEQ ID NO: 35242

SEQ ID NO: 74771 - DNA, 201 bp, Bos taurus; identical to SEQ ID NO: 35244

SEQ ID NO: 74772 - DNA, 201 bp, Bos taurus; identical to SEQ ID NO: 35246

SEQ ID NO: 74773 - DNA, 201 bp, Bos taurus; identical to SEQ ID NO: 35247

SEQ ID NO: 74774 - DNA, 201 bp, Bos taurus; identical to SEQ ID NO: 35248

SEQ ID NO: 74775 - DNA, 201 bp, Bos taurus; identical to SEQ ID NO: 35249

SEQ ID NO: 74776 - DNA, 201 bp, Bos taurus; identical to SEQ ID NO: 35250

SEQ ID NO: 74777 - DNA, 201 bp, Bos taurus; identical to SEQ ID NO: 35251

SEQ ID NO: 74778 - DNA, 201 bp, Bos taurus; identical to SEQ ID NO: 35252

SEQ ID NO: 74779 - DNA, 201 bp, Bos taurus; identical to SEQ ID NO: 35253

SEQ ID NO: 74780 - DNA, 201 bp, Bos taurus; identical to SEQ ID NO: 35254

SEQ ID NO: 74781 - DNA, 201 bp, Bos taurus; identical to SEQ ID NO: 35255

SEQ ID NO: 74782 - DNA, 201 bp, Bos taurus; identical to SEQ ID NO: 35256

SEQ ID NO: 74783 - DNA, 201 bp, Bos taurus; identical to SEQ ID NO: 35257

SEQ ID NO: 74784 - DNA, 201 bp, Bos taurus; identical to SEQ ID NO: 35259

SEQ ID NO: 74785 - DNA, 201 bp, Bos taurus
ccattccttcctccaggggatcttctcgacccaggaatcgaatctctatctcttatgtctcccgtattggcaggtgggttctttaccactagcaccactgkggaagcccttcccaagtgtgaaccaggttctgaaccacaagcaaatcttttacctctttgtctgtgctgcctctggcattccattagatgcgccgtcttc

SEQ ID NO: 74786 - DNA, 201 bp, Bos taurus; identical to SEQ ID NO: 35260

SEQ ID NO: 74787 - DNA, 201 bp, Bos taurus; identical to SEQ ID NO: 35261

SEQ ID NO: 74788 - DNA, 201 bp, Bos taurus; identical to SEQ ID NO: 35262

SEQ ID NO: 74789 - DNA, 201 bp, Bos taurus; identical to SEQ ID NO: 35263

SEQ ID NO: 74790 - DNA, 201 bp, Bos taurus; identical to SEQ ID NO: 35264

SEQ ID NO: 74791 - DNA, 201 bp, Bos taurus; identical to SEQ ID NO: 35265

SEQ ID NO: 74792 - DNA, 201 bp, Bos taurus; identical to SEQ ID NO: 35266

SEQ ID NO: 74793 - DNA, 201 bp, Bos taurus; identical to SEQ ID NO: 35267

SEQ ID NO: 74794 - DNA, 201 bp, Bos taurus; identical to SEQ ID NO: 35268

SEQ ID NO: 74795 - DNA, 201 bp, Bos taurus; identical to SEQ ID NO: 35269

SEQ ID NO: 74796 - DNA, 201 bp, Bos taurus; identical to SEQ ID NO: 35270

SEQ ID NO: 74797 - DNA, 201 bp, Bos taurus; identical to SEQ ID NO: 35271

SEQ ID NO: 74798 - DNA, 201 bp, Bos taurus; identical to SEQ ID NO: 35272

SEQ ID NO: 74799 - DNA, 201 bp, Bos taurus; identical to SEQ ID NO: 35273

SEQ ID NO: 74800 - DNA, 201 bp, Bos taurus; identical to SEQ ID NO: 35274

SEQ ID NO: 74801 - DNA, 201 bp, Bos taurus; identical to SEQ ID NO: 35275

SEQ ID NO: 74802 - DNA, 201 bp, Bos taurus; identical to SEQ ID NO: 35276

SEQ ID NO: 74803 - DNA, 201 bp, Bos taurus; identical to SEQ ID NO: 35277

SEQ ID NO: 74804 - DNA, 201 bp, Bos taurus; identical to SEQ ID NO: 35278

SEQ ID NO: 74805 - DNA, 201 bp, Bos taurus; identical to SEQ ID NO: 35279

SEQ ID NO: 74806 - DNA, 201 bp, Bos taurus; identical to SEQ ID NO: 35280

SEQ ID NO: 74807 - DNA, 201 bp, Bos taurus; identical to SEQ ID NO: 35281

SEQ ID NO: 74808 - DNA, 201 bp, Bos taurus; identical to SEQ ID NO: 35282

SEQ ID NO: 74809 - DNA, 201 bp, Bos taurus; identical to SEQ ID NO: 35283

SEQ ID NO: 74810 - DNA, 201 bp, Bos taurus; identical to SEQ ID NO: 35284

SEQ ID NO: 74811 - DNA, 201 bp, Bos taurus; identical to SEQ ID NO: 35285

SEQ ID NO: 74812 - DNA, 201 bp, Bos taurus; identical to SEQ ID NO: 35286

SEQ ID NO: 74813 - DNA, 201 bp, Bos taurus; identical to SEQ ID NO: 35287

SEQ ID NO: 74814 - DNA, 201 bp, Bos taurus; identical to SEQ ID NO: 35288

SEQ ID NO: 74815 - DNA, 201 bp, Bos taurus; identical to SEQ ID NO: 35289

SEQ ID NO: 74816 - DNA, 201 bp, Bos taurus; identical to SEQ ID NO: 35290

SEQ ID NO: 74817 - DNA, 201 bp, Bos taurus; identical to SEQ ID NO: 35291

SEQ ID NO: 74818 - DNA, 201 bp, Bos taurus; identical to SEQ ID NO: 35292

SEQ ID NO: 74819 - DNA, 201 bp, Bos taurus; identical to SEQ ID NO: 35293

SEQ ID NO: 74820 - DNA, 201 bp, Bos taurus; identical to SEQ ID NO: 35294

SEQ ID NO: 74821 - DNA, 201 bp, Bos taurus; identical to SEQ ID NO: 35295

SEQ ID NO: 74822 - DNA, 201 bp, Bos taurus; identical to SEQ ID NO: 35296

SEQ ID NO: 74823 - DNA, 201 bp, Bos taurus; identical to SEQ ID NO: 35297

SEQ ID NO: 74824 - DNA, 201 bp, Bos taurus; identical to SEQ ID NO: 35298

SEQ ID NO: 74825 - DNA, 201 bp, Bos taurus; identical to SEQ ID NO: 35299

SEQ ID NO: 74826 - DNA, 201 bp, Bos taurus; identical to SEQ ID NO: 35300

SEQ ID NO: 74827 - DNA, 201 bp, Bos taurus; identical to SEQ ID NO: 35301

SEQ ID NO: 74828 - DNA, 201 bp, Bos taurus; identical to SEQ ID NO: 35302

SEQ ID NO: 74829 - DNA, 201 bp, Bos taurus; identical to SEQ ID NO: 35303

SEQ ID NO: 74830 - DNA, 201 bp, Bos taurus; identical to SEQ ID NO: 35304

SEQ ID NO: 74831 - DNA, 201 bp, Bos taurus; identical to SEQ ID NO: 35305

SEQ ID NO: 74832 - DNA, 201 bp, Bos taurus; identical to SEQ ID NO: 35306

SEQ ID NO: 74833 - DNA, 201 bp, Bos taurus; identical to SEQ ID NO: 35307

SEQ ID NO: 74834 - DNA, 201 bp, Bos taurus; identical to SEQ ID NO: 35308

SEQ ID NO: 74835 - DNA, 201 bp, Bos taurus; identical to SEQ ID NO: 35309

SEQ ID NO: 74836 - DNA, 201 bp, Bos taurus; identical to SEQ ID NO: 35310

SEQ ID NO: 74837 - DNA, 201 bp, Bos taurus; identical to SEQ ID NO: 35311

SEQ ID NO: 74838 - DNA, 201 bp, Bos taurus; identical to SEQ ID NO: 35312

SEQ ID NO: 74839 - DNA, 201 bp, Bos taurus
gggtcctatccttgacatggccagggaatctgagacacatttctagagttctttctctgcattactctgcattactttatactctggcctttttgggtgtsttcatggtctcccgtcttgtggctctcttctttgtgggtaagctcctgggcgacctgagccccactgactttctctccttcctgcacacaggccccaaag

SEQ ID NO: 74840 - DNA, 201 bp, Bos taurus; identical to SEQ ID NO: 35313

SEQ ID NO: 74841 - DNA, 201 bp, Bos taurus; identical to SEQ ID NO: 35314

SEQ ID NO: 74842 - DNA, 201 bp, Bos taurus; identical to SEQ ID NO: 35315

SEQ ID NO: 74843 - DNA, 201 bp, Bos taurus; identical to SEQ ID NO: 35316

SEQ ID NO: 74844 - DNA, 201 bp, Bos taurus; identical to SEQ ID NO: 35317

SEQ ID NO: 74845 - DNA, 201 bp, Bos taurus; identical to SEQ ID NO: 35318

SEQ ID NO: 74846 - DNA, 201 bp, Bos taurus; identical to SEQ ID NO: 35319

SEQ ID NO: 74847 - DNA, 201 bp, Bos taurus; identical to SEQ ID NO: 35320

SEQ ID NO: 74848 - DNA, 201 bp, Bos taurus; identical to SEQ ID NO: 35321

SEQ ID NO: 74849 - DNA, 201 bp, Bos taurus; identical to SEQ ID NO: 35322

SEQ ID NO: 74850 - DNA, 201 bp, Bos taurus
ctcaatattacaggttagggatagctgaatgaatctttcaagggggaaattttaaacgaggagagtagtgggaggtagtcttagttgtccatttagctgamcagttaaggtctgttcttgtccttggcaaagagattttcataaatgcagccaaattataactgcccaaggagagatcataaaagttaaccttatctttct

SEQ ID NO: 74851 - DNA, 201 bp, Bos taurus; identical to SEQ ID NO: 35324

SEQ ID NO: 74852 - DNA, 201 bp, Bos taurus
ttgtgtatgttgatgttcatatcatgtttaaaactatattttttagatttatcagactttaaatcatcttaaaaatataagcgattataatgttgtattcyccccaaaagtgagatattatttctgtctttatcccaatttgttgattattaactgttttgtgtttgatggattgatataattagttgataaaatcaatat

SEQ ID NO: 74853 - DNA, 201 bp, Bos taurus; identical to SEQ ID NO: 35325

SEQ ID NO: 74854 - DNA, 201 bp, Bos taurus; identical to SEQ ID NO: 35330

SEQ ID NO: 74855 - DNA, 201 bp, Bos taurus
gggccttccgatgtgaatactgcgatagcgggtaccacatgaccccaggaggccagtgcgagggtgagtctgctgagaggaaggggagaccacagcccttygcagtgtggagcacacatgtccatgacatgcagggctagttccagaacttgaggcttgtaggcatctggcctggtacgggttttcctccactgccaatcc

SEQ ID NO: 74856 - DNA, 201 bp, Bos taurus; identical to SEQ ID NO: 35332

SEQ ID NO: 74857 - DNA, 201 bp, Bos taurus
tgccagcgattatgacttgggacaagccagtgtgtaggcttgggtttacagtgcagaaaggtcaaacttcggttaacaggccacatcattagcacacagasagcactatatgtaaggtttaaaagtagctacattaacacttttgtgagcttcgtgtaaactggatggtgttcatccaggccaaaaagtttgctttatata

SEQ ID NO: 74858 - DNA, 201 bp, Bos taurus
tatgtgcttacaggttacacagtacagccgccacttgacactcattgaaatataaatgacatcagattgctgaagcggtagagtgcagtttaaagaaatayagatttcacaaaacctacaatttgtaatccacaacttgtaggatgtattgaaggaggacatggggagaagcgtcccacgccaggcagccatacccacctg

SEQ ID NO: 74859 - DNA, 201 bp, Bos taurus; identical to SEQ ID NO: 35335

SEQ ID NO: 74860 - DNA, 201 bp, Bos taurus
ccggtgagacgtggcttcaggctgcagggaaacaggtaactcttgttttgaagctgtgtggaccttgacatcgccgtgtgtcctgcataagcccctgctcrtggccaactcttcctacgaggcctgggcccggggaccatcccgggatagcctgaacgccgagtcccgcagcccctgacgtgcacctcgcgtgggatcacc

SEQ ID NO: 74861 - DNA, 201 bp, Bos taurus
gaaaatggaacagaaaaccattaggaaagttaataaatgcgtgacaactgacttagtagtctaggtactctctgggaggatcatcactgttgaatatggakaattcctatatacagaaggtttgaagtttcagaatttagagaatttaggctctgtaaggtgcggggtggggatgtgggagaaagctgaagacagtcagca

SEQ ID NO: 74862 - DNA, 201 bp, Bos taurus
cctctaatgtatgttcttgacaagcatcaggtcaagcatcaagcattcaccgtagtctagaactctgaaaattcctgggacaaaggaaataaagaaggccyagttatttcctttatggagctcacactgaattcagaccataagtgataaataatgttacaccatgatgtaataaatgcaggtataggggtcggcccagag

SEQ ID NO: 74863 - DNA, 201 bp, Bos taurus
caatgcccaaagtcagggcggcggctgagaggagctaccccatgcccaagctcaggggccgcagccaagaagagcaccacaacccaatggtaaggagcagyggctgctctctgctggagtgcatgtaagagaaggtaagagaaacctgaggtaagataaatgctgggctggaggaagcacatgctggaatcaagattgctg

SEQ ID NO: 74864 - DNA, 201 bp, Bos taurus
tttatttggttgccttttttctgactttctctgattttgccattttattattagaatttttttttaatgtagtcctgggtgaaattgtgaaagcaggacayactgagaagcataaaatcatcaaatgcttatgctatggacaaaatagaattactcagcttgggatacagccatagatacttgccactgaaattttaatgt

SEQ ID NO: 74865 - DNA, 201 bp, Bos taurus; identical to SEQ ID NO: 35341

SEQ ID NO: 74866 - DNA, 201 bp, Bos taurus; identical to SEQ ID NO: 35342

SEQ ID NO: 74867 - DNA, 201 bp, Bos taurus
ggaaaattccatggacagaggaggctggcaagctacagttcatggggccacagagagtcagacacaactgagcaatcaagcacacacacatacacacagtratatggggaaaactgttggccaaaacgtggtaaaaatggtaccaaatatatcgatagccaaaataagtatagagtacataaacttaactgttgaagagaa

SEQ ID NO: 74868 - DNA, 201 bp, Bos taurus
ataagtatccgaatgcaaaaattgccctcattgaatcaacaagaaactattccgcaacttaatatcagcactgtatatgaaatactgttttacataaaagragagtcatttagaaaacaaacaataaaaagatgctaacttcactattaatcaggcaagcaatagagagatattttaccacatccataaggatgaaaaatt

SEQ ID NO: 74869 - DNA, 201 bp, Bos taurus; identical to SEQ ID NO: 35344

SEQ ID NO: 74870 - DNA, 201 bp, Bos taurus; identical to SEQ ID NO: 35346

SEQ ID NO: 74871 - DNA, 201 bp, Bos taurus; identical to SEQ ID NO: 35349

SEQ ID NO: 74872 - DNA, 201 bp, Bos taurus
ggtatgatttgccgtgatgatatatttatcagaagcagtttatttttctactacaaaatgctctttgatatcattaacctacagaaataactgtggaaagwaaagcaaggccattcaaatggtgaggtaacaaagaatttgttttccactcctgaagtctgcatgaattaatgcagcaaataacagtcctccagaatccag

SEQ ID NO: 74873 - DNA, 201 bp, Bos taurus
gggctgagagagaggccagagcctcaggtgctgttgatacaagtctttcctaagcatatccacgaagctactaccgtatcattcttgatctagtgccacamataaacagcaacccctgggccctgggctatgttctctgaacagcaccaggattgttctgcacaatgctctgattgtctgtggggcagggcagctggagag

SEQ ID NO: 74874 - DNA, 201 bp, Bos taurus
tgttttaagttttgacaactgcatgagaaagtactccagagttatattattcttgttcattttcaagatgtgtaaaatgttttaaatttttatatattatrtaatatataattattctaatctcccaaatagaaaagacagccttgatacttgaagtgggggcaaagaacctctcacactagatgaagtggctgagatgtg

SEQ ID NO: 74875 - DNA, 201 bp, Bos taurus
actttgggttcattagtcaggattttcagatccacttggctgccaccttcctgcagccagaccatcttggatcaaaaggtcagcaggccattcccatctcrcacctgccacaagatctgatttttcttttcccccacactgatcctagtcactttctgttaattcgctaattttattgaccctgtaatacattctgggaat

SEQ ID NO: 74876 - DNA, 201 bp, Bos taurus
tataattttcatggttaattcttccttctctcagcttggtttaggcgtcaagcaccttgctggtacttttcatccttttctgttctattggagcttgaatrcgttgtgaggtaaatggcagctcatcatacctttcaggagatagtgggaaggaatgagtcttagtggctctggtcctgaaccctgcatgattacaaaaag

SEQ ID NO: 74877 - DNA, 201 bp, Bos taurus; identical to SEQ ID NO: 35354

SEQ ID NO: 74878 - DNA, 201 bp, Bos taurus; identical to SEQ ID NO: 35356

SEQ ID NO: 74879 - DNA, 201 bp, Bos taurus; identical to SEQ ID NO: 35357

SEQ ID NO: 74880 - DNA, 201 bp, Bos taurus; identical to SEQ ID NO: 35358

SEQ ID NO: 74881 - DNA, 201 bp, Bos taurus; identical to SEQ ID NO: 35359

SEQ ID NO: 74882 - DNA, 201 bp, Bos taurus
actaacacttgaaacttaaggaaggtcaaaacactttattccacaaacaactgagttatgagaaaaacagaagggacaaaaagaaaagtaaaaccgatatygtcctagaaataacataagtaccactcggttgtacaaaagatatataatactgccctaatgtaaataagagtattcttctttgtattaaaagtttaaatc

SEQ ID NO: 74883 - DNA, 201 bp, Bos taurus; identical to SEQ ID NO: 35360

SEQ ID NO: 74884 - DNA, 201 bp, Bos taurus; identical to SEQ ID NO: 35361

SEQ ID NO: 74885 - DNA, 201 bp, Bos taurus; identical to SEQ ID NO: 35362

SEQ ID NO: 74886 - DNA, 201 bp, Bos taurus
aacagccactggcccacgtgcactgcggccagcaccgagagcagcagaaggagcatggtctgctggaccgacagaagggtcggcgacaggtgatcgtccgkgctgaggccagtggccatgctggggagagaagggcgaaggcgtgacactcaggtaggcagagaaagaagagggcgccccaagctcctatccacctgcctc

SEQ ID NO: 74887 - DNA, 201 bp, Bos taurus
tcagagcaataatccaagagagagaaacggggaactttcataacatagcctcagaagtcaagcaccatcatatccagtacccaagtagttatgcaggtcakcccaattcagtgtgggaggggattatttataagtgtgactatcagaagcaagaatctttgggtaacgtcttgatatttagaatattaaaagtattccagt

SEQ ID NO: 74888 - DNA, 201 bp, Bos taurus; identical to SEQ ID NO: 35366

SEQ ID NO: 74889 - DNA, 201 bp, Bos taurus
ttgaaaaccaggctcaactaaagagaagggaagctgtatagagtacaaatgaagcttccacaatgagagaaatgagaagggtccactacatttctcgacayagtgaaactaaactcataaaggcaatgtacaatgtcttcaggctttttttgcttttcccaacatttccatgcataacacatgtgcaacaccaaacaacat

SEQ ID NO: 74890 - DNA, 201 bp, Bos taurus; identical to SEQ ID NO: 35367

SEQ ID NO: 74891 - DNA, 201 bp, Bos taurus; identical to SEQ ID NO: 35370

SEQ ID NO: 74892 - DNA, 201 bp, Bos taurus; identical to SEQ ID NO: 35371

SEQ ID NO: 74893 - DNA, 201 bp, Bos taurus; identical to SEQ ID NO: 35372

SEQ ID NO: 74894 - DNA, 201 bp, Bos taurus; identical to SEQ ID NO: 35373

SEQ ID NO: 74895 - DNA, 201 bp, Bos taurus
gtcagtagtgcctggcaccatagtaatcccacaaagtattatttactgttgttttgagtacatttttataatgttttaaaggggaacagtcatgaggatcyggtcccatcacttcatggcaaatagatggggaaataatggaaacagtgagactttattttggggggctccaaaatcactggagatgatgactgcagccat

SEQ ID NO: 74896 - DNA, 201 bp, Bos taurus; identical to SEQ ID NO: 35374

SEQ ID NO: 74897 - DNA, 201 bp, Bos taurus; identical to SEQ ID NO: 35375

SEQ ID NO: 74898 - DNA, 201 bp, Bos taurus; identical to SEQ ID NO: 35376

SEQ ID NO: 74899 - DNA, 201 bp, Bos taurus; identical to SEQ ID NO: 35377

SEQ ID NO: 74900 - DNA, 201 bp, Bos taurus; identical to SEQ ID NO: 35378

SEQ ID NO: 74901 - DNA, 201 bp, Bos taurus; identical to SEQ ID NO: 35379

SEQ ID NO: 74902 - DNA, 201 bp, Bos taurus; identical to SEQ ID NO: 35380

SEQ ID NO: 74903 - DNA, 201 bp, Bos taurus; identical to SEQ ID NO: 35381

SEQ ID NO: 74904 - DNA, 201 bp, Bos taurus; identical to SEQ ID NO: 35382

SEQ ID NO: 74905 - DNA, 201 bp, Bos taurus; identical to SEQ ID NO: 35383

SEQ ID NO: 74906 - DNA, 201 bp, Bos taurus; identical to SEQ ID NO: 35384

SEQ ID NO: 74907 - DNA, 201 bp, Bos taurus; identical to SEQ ID NO: 35385

SEQ ID NO: 74908 - DNA, 201 bp, Bos taurus; identical to SEQ ID NO: 35386

SEQ ID NO: 74909 - DNA, 201 bp, Bos taurus; identical to SEQ ID NO: 35387

SEQ ID NO: 74910 - DNA, 201 bp, Bos taurus
aaagttcctgcagagaattcggttgatagcctcatgtgggttcccttctaattcactctgtttttctcttgctgcctttagaaacttctctttatctttakctttggccattttgattgttgtaggtctttgtatgagtctgttggggctcatcttctttggggccctctgtgcatcctgttggagaaggcaatggcaacc

SEQ ID NO: 74911 - DNA, 201 bp, Bos taurus; identical to SEQ ID NO: 35388

SEQ ID NO: 74912 - DNA, 201 bp, Bos taurus; identical to SEQ ID NO: 35389

SEQ ID NO: 74913 - DNA, 201 bp, Bos taurus; identical to SEQ ID NO: 35390

SEQ ID NO: 74914 - DNA, 201 bp, Bos taurus; identical to SEQ ID NO: 35391

SEQ ID NO: 74915 - DNA, 201 bp, Bos taurus; identical to SEQ ID NO: 35392

SEQ ID NO: 74916 - DNA, 201 bp, Bos taurus; identical to SEQ ID NO: 35393

SEQ ID NO: 74917 - DNA, 201 bp, Bos taurus; identical to SEQ ID NO: 35394

SEQ ID NO: 74918 - DNA, 201 bp, Bos taurus; identical to SEQ ID NO: 35395

SEQ ID NO: 74919 - DNA, 201 bp, Bos taurus; identical to SEQ ID NO: 35396

SEQ ID NO: 74920 - DNA, 201 bp, Bos taurus; identical to SEQ ID NO: 35397

SEQ ID NO: 74921 - DNA, 201 bp, Bos taurus; identical to SEQ ID NO: 35398

SEQ ID NO: 74922 - DNA, 201 bp, Bos taurus; identical to SEQ ID NO: 35399

SEQ ID NO: 74923 - DNA, 201 bp, Bos taurus; identical to SEQ ID NO: 35400

SEQ ID NO: 74924 - DNA, 201 bp, Bos taurus; identical to SEQ ID NO: 35401

SEQ ID NO: 74925 - DNA, 201 bp, Bos taurus; identical to SEQ ID NO: 35402

SEQ ID NO: 74926 - DNA, 201 bp, Bos taurus; identical to SEQ ID NO: 35403

SEQ ID NO: 74927 - DNA, 201 bp, Bos taurus; identical to SEQ ID NO: 35404

SEQ ID NO: 74928 - DNA, 201 bp, Bos taurus; identical to SEQ ID NO: 35405

SEQ ID NO: 74929 - DNA, 201 bp, Bos taurus; identical to SEQ ID NO: 35406

SEQ ID NO: 74930 - DNA, 201 bp, Bos taurus; identical to SEQ ID NO: 35407

SEQ ID NO: 74931 - DNA, 201 bp, Bos taurus; identical to SEQ ID NO: 35408

SEQ ID NO: 74932 - DNA, 201 bp, Bos taurus; identical to SEQ ID NO: 35409

SEQ ID NO: 74933 - DNA, 201 bp, Bos taurus; identical to SEQ ID NO: 35411

SEQ ID NO: 74934 - DNA, 201 bp, Bos taurus; identical to SEQ ID NO: 35412

SEQ ID NO: 74935 - DNA, 201 bp, Bos taurus; identical to SEQ ID NO: 35413

SEQ ID NO: 74936 - DNA, 201 bp, Bos taurus; identical to SEQ ID NO: 35414

SEQ ID NO: 74937 - DNA, 201 bp, Bos taurus; identical to SEQ ID NO: 35415

SEQ ID NO: 74938 - DNA, 201 bp, Bos taurus; identical to SEQ ID NO: 35416

SEQ ID NO: 74939 - DNA, 201 bp, Bos taurus; identical to SEQ ID NO: 35417

SEQ ID NO: 74940 - DNA, 201 bp, Bos taurus; identical to SEQ ID NO: 35418

SEQ ID NO: 74941 - DNA, 201 bp, Bos taurus; identical to SEQ ID NO: 35419

SEQ ID NO: 74942 - DNA, 201 bp, Bos taurus; identical to SEQ ID NO: 35420

SEQ ID NO: 74943 - DNA, 201 bp, Bos taurus; identical to SEQ ID NO: 35421

SEQ ID NO: 74944 - DNA, 201 bp, Bos taurus; identical to SEQ ID NO: 35422

SEQ ID NO: 74945 - DNA, 201 bp, Bos taurus; identical to SEQ ID NO: 35423

SEQ ID NO: 74946 - DNA, 201 bp, Bos taurus; identical to SEQ ID NO: 35424

SEQ ID NO: 74947 - DNA, 201 bp, Bos taurus; identical to SEQ ID NO: 35425

SEQ ID NO: 74948 - DNA, 201 bp, Bos taurus; identical to SEQ ID NO: 35426

SEQ ID NO: 74949 - DNA, 201 bp, Bos taurus; identical to SEQ ID NO: 35427

SEQ ID NO: 74950 - DNA, 201 bp, Bos taurus; identical to SEQ ID NO: 35428

SEQ ID NO: 74951 - DNA, 201 bp, Bos taurus; identical to SEQ ID NO: 35429

SEQ ID NO: 74952 - DNA, 201 bp, Bos taurus; identical to SEQ ID NO: 35430

SEQ ID NO: 74953 - DNA, 201 bp, Bos taurus; identical to SEQ ID NO: 35431

SEQ ID NO: 74954 - DNA, 201 bp, Bos taurus; identical to SEQ ID NO: 35432

SEQ ID NO: 74955 - DNA, 201 bp, Bos taurus; identical to SEQ ID NO: 35440

SEQ ID NO: 74956 - DNA, 201 bp, Bos taurus
cttgaagagctcagctgctgagtggctggataagagtgaggtcttaacacagtctctgaaagcctttggctccctctgcagagccagagcaagatgacttygcagtcttgagggaccctgagtgtgtgtcttttgccagctctgtaccttctccctgctcctgccacctccctgctcagctctgctcagtggagactggct

SEQ ID NO: 74957 - DNA, 201 bp, Bos taurus
ttatactgagtcctgagactgtgtgtgtgtaaccctttggtgtcagctacgctgcgctggtgtatttgtacgcacgtgctctgtgttgtgcttgttgatarttgcagaaggggattgctgcagaagatttatctttcaaatccctgctggtgatggtgatacagatgtaaccatgaataaaaattcatcaagctgtataat

SEQ ID NO: 74958 - DNA, 201 bp, Bos taurus; identical to SEQ ID NO: 35441

SEQ ID NO: 74959 - DNA, 201 bp, Bos taurus
aatgagcagtttatagttttgttctatgcagcattgaccctggaagttgttcccagctcttaaaaggctggagatagcaacttggttgatgaaggctaagraaccatctggcagggccacactgacaaggaataggctgtcttgggacagaagagaagcttctgttctcagctaagggccactttctcagacactgtggtg

SEQ ID NO: 74960 - DNA, 201 bp, Bos taurus; identical to SEQ ID NO: 35442

SEQ ID NO: 74961 - DNA, 201 bp, Bos taurus; identical to SEQ ID NO: 35443

SEQ ID NO: 74962 - DNA, 201 bp, Bos taurus; identical to SEQ ID NO: 35444

SEQ ID NO: 74963 - DNA, 201 bp, Bos taurus; identical to SEQ ID NO: 35445

SEQ ID NO: 74964 - DNA, 201 bp, Bos taurus; identical to SEQ ID NO: 35446

SEQ ID NO: 74965 - DNA, 201 bp, Bos taurus; identical to SEQ ID NO: 35447

SEQ ID NO: 74966 - DNA, 201 bp, Bos taurus; identical to SEQ ID NO: 35448

SEQ ID NO: 74967 - DNA, 201 bp, Bos taurus; identical to SEQ ID NO: 35449

SEQ ID NO: 74968 - DNA, 201 bp, Bos taurus; identical to SEQ ID NO: 35451

SEQ ID NO: 74969 - DNA, 201 bp, Bos taurus
tcaaccacagtgggtaaactcaccagtccctgcccaactttgtgctctctgtatccttacctttgtcttggtttatgcctacattgtgaactttctttaaycaattccttcatcacctcatcacattaatctgcttatttaaattttactcatccttccagattcatcacaaatgccaaccctgccttagtgcttctcttt

SEQ ID NO: 74970 - DNA, 201 bp, Bos taurus
aaagaaatacaaggtcacttacactaatatgccttttaaaggatttaaacaggggagaaatatattgctagataaagataaatgtgtttcatttttcttcraaattctaccttgcaaggataaacaaaatgaggaaaaaggcagcagaatggacattagcctgtattttcttctcagatagtagagaatacaaatttcaga

SEQ ID NO: 74971 - DNA, 201 bp, Bos taurus
agaaatatcaaatatcagatcagaaagggtacaatagaatagaaatgatagatgatgatataaactcactgaaataaaagaaagggccagtaaagggactygagttcttaattctactggggtgaatttttttgaagcaggagcctatcagcctcattaagcaaggcctgatttttctttcagcagctgcctcaactttct

SEQ ID NO: 74972 - DNA, 201 bp, Bos taurus
tcagaagtgtgtcatgtactagtaccacaaatacaatttttcaaataattctactcattaggcttttgctggtgtcttttaatataatcaaggtcaattaytgtatctttttagtagtcttacatagcaatttaaaaagttagactctcaatttgagggttccttcatgagcgagaggcatgcttcagagtccgtgtctat

SEQ ID NO: 74973 - DNA, 201 bp, Bos taurus
tcaatgtatcatttatgtgaaggaaatggattaggccatgtccaaccattaatgatttggtttagagccttgctccccagggaatgtcagctacctgtctytacctgaacttaatgacttatatttatttgtttcttaagtttttattttatatcagaatattgctgattaacaatgttgtgatagtttcagatgcacagc

SEQ ID NO: 74974 - DNA, 201 bp, Bos taurus
tagctgggtatgtgactactgggagaatgctttaaaaaagaaacaaatcctgtagaggccaataaagagaaaaagcgacaactgtaatcaaagtctttctygccttctggcaatttatactgcagataggcccttgatgctaaattcttgagcagagaggaaggagaggaggattcagactaagttttcagtttacagagt

SEQ ID NO: 74975 - DNA, 201 bp, Bos taurus; identical to SEQ ID NO: 35455

SEQ ID NO: 74976 - DNA, 201 bp, Bos taurus; identical to SEQ ID NO: 35456

SEQ ID NO: 74977 - DNA, 201 bp, Bos taurus; identical to SEQ ID NO: 35463

SEQ ID NO: 74978 - DNA, 201 bp, Bos taurus
tttttggggggctagcggggaaatatacgggagttgaggcctcggtgcagaagagaagtgttttcatttggctgcagcatttgatctttgaggcccaagarctggagaggggatcttggggcagaaagcaggcttttccctgctcaggagaaggacagggtcttctggccttgccattgtacttgagcctcagagtcccag

SEQ ID NO: 74979 - DNA, 201 bp, Bos taurus; identical to SEQ ID NO: 35518

SEQ ID NO: 74980 - DNA, 201 bp, Bos taurus; identical to SEQ ID NO: 35519

SEQ ID NO: 74981 - DNA, 201 bp, Bos taurus; identical to SEQ ID NO: 35521

SEQ ID NO: 74982 - DNA, 201 bp, Bos taurus
aatccccttaaaatgtttacaaatgaaagatttcagctccacatattttgcttggtacttctgcgttctgtagacagattaattcttgcgccaggcccaartatttccggatgttctgttctactctgtctacttcctgtttggttgacttttatttcctgtactctttgttgaagttgtaaacttccattttggcctagg

SEQ ID NO: 74983 - DNA, 201 bp, Bos taurus; identical to SEQ ID NO: 35525

SEQ ID NO: 74984 - DNA, 201 bp, Bos taurus; identical to SEQ ID NO: 35526

SEQ ID NO: 74985 - DNA, 201 bp, Bos taurus
acagggacccccctgcctttggcacggggagccctgagctcaactgcggccagactccggttcaggggagttactgctatcctcctcaacttctccccacytcccagctcatctctgcctctggcctcaccctcctctctgtcctccacatttgcaggaggtcttcccaaacataaactcaaaggtagtggaaaaccctgc

SEQ ID NO: 74986 - DNA, 201 bp, Bos taurus; identical to SEQ ID NO: 35529

SEQ ID NO: 74987 - DNA, 201 bp, Bos taurus
tcccggtaactctcacaggtcactaacctgcgggccgcccggggttcgctgtcctctggtgcctgatgctgcacgctccttgaactgggatacctctcctytctcactggcccagggtgtacacgtggggctttacggaaatgaaatgaaaaccccgtaaaagtagtctagcctggaggcttatgtaccattttaacaaag

SEQ ID NO: 74988 - DNA, 201 bp, Bos taurus
acagtgagagtcaggggatgttacaggaggggctggtggaggagaaccaactcggagctgtagagactttacaaataggataatatttgaattggcccatrgaaccaataggatgcatgtgtgtgtatatatatatagacagattcattttaatgaattgactcatgtgatcattgggctagcaagcccacgatctgcagg

SEQ ID NO: 74989 - DNA, 201 bp, Bos taurus; identical to SEQ ID NO: 35536

SEQ ID NO: 74990 - DNA, 201 bp, Bos taurus; identical to SEQ ID NO: 35537

SEQ ID NO: 74991 - DNA, 201 bp, Bos taurus
agacggccctgaggtccatctcattggcagctctcccaccccagcccctcccaccccagagacaccactagaatctctccttcctccatctacacactaamaatgtacctttccacggcctatttgtctccagtaattgtaaagtatttgaatgaagactcccagaaacaaattttccatgaaattgaaaaccttttatca

SEQ ID NO: 74992 - DNA, 201 bp, Bos taurus
aaaaggcctctcctggaacctctaattttcttagttccttcttatggatccagcattccagaatttgtctagaattgttaaagcagatgaatctgtgagcrcattgcacctcatagacaggccagcagatgtgaatggagaggtggggctgttctgtgttcctctgtgcccctcgctcgccccgagtgttcacccaaaacc

SEQ ID NO: 74993 - DNA, 201 bp, Bos taurus
cactgccctggtccaggcaggctcctctcttattcttctgcctcctctcctgctcacagggcctctgtggtcacaaaggcctacaagggtgttccctcaarataagctgatcagtaacctccttccccccatgtttccccacatagcctaacatattcacaggtttccaaggaggaagatgtggacatctttgggggccag

SEQ ID NO: 74994 - DNA, 201 bp, Bos taurus
ccaccctcttcctcctcaccactccatgtccataaatttgttaattcatttcataaatgtttattgattgcctaacctgggccaggtaccagggacactakagtaaacaggacacgtgtgcccccaacacctaataagaacctactgtgttgtatagggaaatcaactcaatgctctgtgatggcctatgttggaaaagaa

SEQ ID NO: 74995 - DNA, 201 bp, Bos taurus; identical to SEQ ID NO: 35539

SEQ ID NO: 74996 - DNA, 201 bp, Bos taurus; identical to SEQ ID NO: 35540

SEQ ID NO: 74997 - DNA, 201 bp, Bos taurus; identical to SEQ ID NO: 35543

SEQ ID NO: 74998 - DNA, 201 bp, Bos taurus
acctgaaagttttctcttggccccattcattctttcatcctccatgcctgtgttcatactggtccatctatctaggctactctctccttttctttgtgtgrggaactcttgctcatccttttaggcctgactcaaacatcatacaacttgaccctcagtctccagagcaaatcttgtcacccctcttagctgctcctttca

SEQ ID NO: 74999 - DNA, 201 bp, Bos taurus
gatctctaagcactaatgcagggaaggcagtcgggcatggatcagacaacagtgaagttcaggctgcagctacattcttcccttcccttctgccagtcctyggggttattcagcccacgtggactccctgggtatggctttctttagggagagagggtttccattctgaagtcagttatatcctggccacctcgaaaatgt

SEQ ID NO: 75000 - DNA, 201 bp, Bos taurus
ggacacaactgagccactaacagacatgaagggaaaggttgttcacatcttgcccaaaacctcagaagacaagagggcctcttccttatgccaaagactarcccattcctctatcattttccagaaatcttctttgtattagcctcccgtgtgaagtcagcttatgagaacaaaggaagccccatttttctggccgtctca

SEQ ID NO: 75001 - DNA, 201 bp, Bos taurus; identical to SEQ ID NO: 35544

SEQ ID NO: 75002 - DNA, 201 bp, Bos taurus; identical to SEQ ID NO: 35549

SEQ ID NO: 75003 - DNA, 201 bp, Bos taurus
ggccaattcttaaccactgaactaccagggaagtccttctatttatacttataaaaggaagttagctctacaggcttaataaattcatgtgcaatttccgyggccaaagtactttattatagctgcagcatgcctcatgtcacatcacaacaaagctctcagagtctgttgttcctatttcatgatgctaagatcaatcat

SEQ ID NO: 75004 - DNA, 201 bp, Bos taurus
cttactgagcgcctactaggtgtccagtgttgcacggatgctgaagagacagcaattaacaaaaagggctgtacttgaactggtggcagctcagacccacrgtgctttaggataaaggacagatgaccctgtcttcatgctactcaagaagggccaacctgcaggggttagaagtgcaaatagatgaacatgagagccaaa

SEQ ID NO: 75005 - DNA, 201 bp, Bos taurus; identical to SEQ ID NO: 35552

SEQ ID NO: 75006 - DNA, 201 bp, Bos taurus; identical to SEQ ID NO: 35554

SEQ ID NO: 75007 - DNA, 201 bp, Bos taurus
cagagtacgcttgctatccaacatgcaaatatttttcctcattttctaaaatcattactacatttttcttatacataatgtaatttcccttaacaagagtrgctctgcttttattcatctggttgctgtgatgatggaagtatttttcccttgggaggtcatttatatttaagtaggattaataggcttaacagaatctat

SEQ ID NO: 75008 - DNA, 201 bp, Bos taurus
aaccagggtgtgtctgggccaggaagtcttcgagtcaggacgaaggcaaggatctacacaaagaccccaaagcccctctgaactgtctgtctctggagggrtcccactggggctttcttagaagggcctggggagtctgtgtattctcggccctactatgtgcacatgagctcatgactgggatcctagagaggatcacag

SEQ ID NO: 75009 - DNA, 201 bp, Bos taurus; identical to SEQ ID NO: 35555

SEQ ID NO: 75010 - DNA, 201 bp, Bos taurus; identical to SEQ ID NO: 35558

SEQ ID NO: 75011 - DNA, 201 bp, Bos taurus
gtggccatggcaccacagcctcctcctcctcgacgctcgtctctaccatctccctcacccgctcagccctttgaggcctttgtatataaggttcacctggraaacaggggtatagcgactcaacttacagcactgcccatgatggagcttttgtttctccatcttctcccctggtccaggcccgctttcacactttgctga

SEQ ID NO: 75012 - DNA, 201 bp, Bos taurus
cccaagtgggcctgggagtatgcaggaagcagagcaaactttcagggcaaaactgtagaggtgtatctttggggtcctcctttcaggcccactcttccttrttttgcccaaaggttacagcatggttgtcactgatctatctcctcagtctaccctagggtcagttctttaccttgttgttaacaaaggcctttaaaaaag

SEQ ID NO: 75013 - DNA, 201 bp, Bos taurus; identical to SEQ ID NO: 35559

SEQ ID NO: 75014 - DNA, 201 bp, Bos taurus; identical to SEQ ID NO: 35561

SEQ ID NO: 75015 - DNA, 201 bp, Bos taurus; identical to SEQ ID NO: 35562

SEQ ID NO: 75016 - DNA, 201 bp, Bos taurus; identical to SEQ ID NO: 35563

SEQ ID NO: 75017 - DNA, 201 bp, Bos taurus; identical to SEQ ID NO: 35564

SEQ ID NO: 75018 - DNA, 201 bp, Bos taurus; identical to SEQ ID NO: 35565

SEQ ID NO: 75019 - DNA, 201 bp, Bos taurus
agtgaagtaagttgttcgacatgatagcaaagaacttttcagtgggagtgaatttactttgtcacaggaaagcaaaagtcaccacgttaaaaatcccatgmtaattgccaatgctggctttccagtccccaaattctgaaaacaaaattattgcaattcccactgggactgtctgcatgctcatttatagcactagatagc

SEQ ID NO: 75020 - DNA, 201 bp, Bos taurus; identical to SEQ ID NO: 35570

SEQ ID NO: 75021 - DNA, 201 bp, Bos taurus
aggactgcagatattcagactcgatacctagacattagggatgaccctcacaggatacctgcagtgggtatgagtccgactcataagcagatggaatctayggtccttgcatttgacttgttttgctacaaacaaagcaaaatctcctatttctttaggcatgcatgttaaatcagcctggctactctgtatatttctgta

SEQ ID NO: 75022 - DNA, 201 bp, Bos taurus
ctataggatgtaagcatcacatgatatgaaacaagttacattaaaaaaaaagacattctatgggaagattctgggtcactgataagtgatcttgatctggkagttggtatataggtattttgggtccagaagatcccctggaggagggcatggcaaccagctccagtattcttacttggagaatcccatggacagaggagc

SEQ ID NO: 75023 - DNA, 201 bp, Bos taurus
cagagacggcaggtgctgtgagcatgctcaactgtaacatctgagattccaggcatatgtgctgagcagtgactgtcccagggcagcccctgaggtgtgcrgaccatgtacctctctgtgtagattcagaacgctgatcgatggtgagcatcgtgctaccctctaataaaggcttttactaccactattactgactcctaa

SEQ ID NO: 75024 - DNA, 201 bp, Bos taurus
agctggatacgaatgactgactaacactcatgttgggagtagggtccttcaacaggaaagattaagtgttgaggttttcaaggcctatcccttggcacttraggagaatagacagctgctagttggagagagctttcttgtgttatctcctgtactctgtcttccatgttaagactatgaatattctggcctggaaagggc

SEQ ID NO: 75025 - DNA, 201 bp, Bos taurus
ggtgtccagtaatggtataacatatctttgtttgggttttttttttttttgctatgagagtacaacttccaatgattcctagctggtatctcagttccacytctcttcatcaattttctattgagaagaaagcattattttgcatttgttctggaaaaattcaataggtttatctgagaacagattattgtgctagatttg

SEQ ID NO: 75026 - DNA, 201 bp, Bos taurus
taacaagagcactggcctgtggtactttacaaaactccatcattgacttttagataagtcagttaatgtgcttgggattaggtttcctgttttgaagaatraagactttgaaatcaggaaatttctgaagggtctcttaaagccccaatttttatgcttgtaacagaacttgagtagttgagtcagcattttttggtcctc

SEQ ID NO: 75027 - DNA, 201 bp, Bos taurus
ggttattaaagataggatgtgactagcttgtggacatgcttctgattggttggtggtgaaggaaccctggagtcaacttcatcaagctgctggttccagtygttctgggatctacatgcttgagggcagcatacagttaacttctacctggtggggatttcagtatctgcaaaatagctcaaaggatatggctcagaatat

SEQ ID NO: 75028 - DNA, 201 bp, Bos taurus
agaagatatatgtgcttccatatccttatgttcatgtgtttttatttctcctcagggtgaatctctgatgatgaataagaaatttattctgggaggatttyctggtgtattacagaataatttctatttctctgggcttccaactgctataacctgggccatcttatttagttagaatgcataagtggttttttagagtcc

SEQ ID NO: 75029 - DNA, 201 bp, Bos taurus
aatgaagtgatggggtcagatgccatgatctttgtcttgtagaatgttgagttttaagccagcttcttcaaaaggctgctgctgatgaaagaaaaccaggyatctcaaggactgtagggttttttcatgtatgggaagatgcaaaatctgggcttgtttaaatcattcctttgattttcagctcagttatctggagccagt

SEQ ID NO: 75030 - DNA, 201 bp, Bos taurus; identical to SEQ ID NO: 35577

SEQ ID NO: 75031 - DNA, 201 bp, Bos taurus; identical to SEQ ID NO: 35578

SEQ ID NO: 75032 - DNA, 201 bp, Bos taurus; identical to SEQ ID NO: 35579

SEQ ID NO: 75033 - DNA, 201 bp, Bos taurus; identical to SEQ ID NO: 35580

SEQ ID NO: 75034 - DNA, 201 bp, Bos taurus; identical to SEQ ID NO: 35582

SEQ ID NO: 75035 - DNA, 201 bp, Bos taurus
accagtgggtctgtggggagttttgtatctcagagggcaacataaccaggaggaaaaacaacaacaacaaaacccacagaatatgggcctaatcacaactmccagtggagaagtagcccagacgctcacgtaccagcgagagggggctgaacagagagtcgcaggttgcatgcttagggtaaggactgggcctgaatgccc

SEQ ID NO: 75036 - DNA, 201 bp, Bos taurus
ctggaaatttctcaggctgtgtttttgtaccttgctttggtctgtgtgtttgccttaccattctccttaatttcagttccttggataagtattgtggctgytccctctaatttggccagttcagagagctgccagctgggagctggcctggcctcagagtttgactgtggtcctcattactcaacagagcaacccacagaa

SEQ ID NO: 75037 - DNA, 201 bp, Bos taurus
tttaaagtgttttcatcagaccctcagttgtgctctctccattagaaccatcaataacaagagagacaaaaattatcaatctgtaactaggcaacaaggamaaagctaatgaacattaggccagagatggtagcctttataaataaaatccaaataacaccttagctgaatatatttttccagtttattgctgttttgaca

SEQ ID NO: 75038 - DNA, 201 bp, Bos taurus; identical to SEQ ID NO: 35584

SEQ ID NO: 75039 - DNA, 201 bp, Bos taurus
atggttgtttaatttctctcagtggcttttaaaattttcaatacatgggttttgtatctacattattaaatgtatccctaggtagttcctgtttgcttctkaatgaaatatgataatttttatgtttaatttttcatttgtttttcattgttgcatatagaaatacaatttatatctcataataaccttataagtcagtaa

SEQ ID NO: 75040 - DNA, 201 bp, Bos taurus; identical to SEQ ID NO: 35585

SEQ ID NO: 75041 - DNA, 201 bp, Bos taurus
ctagctgctggcaagcaggaaagcagaaatatcagttctataaccagcaggtactgacttctgccaacaacttcatgggcttagaagaggaccctgagctmcagaaaggagctcagcctggccaacaccttgacttaagcctcggaatgccctgagaagagatgctcaacaactgacctacagaaacattgatgttgataa

SEQ ID NO: 75042 - DNA, 201 bp, Bos taurus
gcagaatgtctccactggctcaggtgttcagcttctggcctagagactagaaactcagtcagtgctcacatcacttatctttggagataaggaaccatctytccaattgaaatcttcatggccttcaggaaaattatattatcaatacaaaaaattgactgcttacataataagtgttgcatagtagaaacagctgtaaga

SEQ ID NO: 75043 - DNA, 201 bp, Bos taurus; identical to SEQ ID NO: 35587

SEQ ID NO: 75044 - DNA, 201 bp, Bos taurus; identical to SEQ ID NO: 35588

SEQ ID NO: 75045 - DNA, 201 bp, Bos taurus; identical to SEQ ID NO: 35590

SEQ ID NO: 75046 - DNA, 201 bp, Bos taurus; identical to SEQ ID NO: 35593

SEQ ID NO: 75047 - DNA, 201 bp, Bos taurus; identical to SEQ ID NO: 35595

SEQ ID NO: 75048 - DNA, 201 bp, Bos taurus
acaataaagaggacaatgacaaatagaagtcaagattatggggtgattattacaggaaatatagaggatcctatgaaaaactttaagaacattcacacaakctgcctccagcttcacagtacctgagctcttactggttgcatgtgagtatgactctgagagacagcatgggtgtgtgtgtgtacagatgcatgtgtgtgc

SEQ ID NO: 75049 - DNA, 201 bp, Bos taurus
aataccatctaatagactccagtcttttgtggttaaaatgtagttccaggacttattttgtgcctaaagatcaggaaagtggacaggagttgataccaacyggcacatcatccttataaaggaaatcatgagaatgagtaacaggacagagatcagactgagaataagagaatgaaggagaccatgaaacatgcttaaact

SEQ ID NO: 75050 - DNA, 201 bp, Bos taurus; identical to SEQ ID NO: 35597

SEQ ID NO: 75051 - DNA, 201 bp, Bos taurus; identical to SEQ ID NO: 35598

SEQ ID NO: 75052 - DNA, 201 bp, Bos taurus; identical to SEQ ID NO: 35599

SEQ ID NO: 75053 - DNA, 201 bp, Bos taurus; identical to SEQ ID NO: 35600

SEQ ID NO: 75054 - DNA, 201 bp, Bos taurus; identical to SEQ ID NO: 35601

SEQ ID NO: 75055 - DNA, 201 bp, Bos taurus; identical to SEQ ID NO: 35602

SEQ ID NO: 75056 - DNA, 201 bp, Bos taurus; identical to SEQ ID NO: 35603

SEQ ID NO: 75057 - DNA, 201 bp, Bos taurus; identical to SEQ ID NO: 35604

SEQ ID NO: 75058 - DNA, 201 bp, Bos taurus; identical to SEQ ID NO: 35605

SEQ ID NO: 75059 - DNA, 201 bp, Bos taurus
tatctttaagcttatcaatagtaaatgaaacatatttgatcaatgtagaaaattccaaaagttatagaaacaaagaaatataataatcatgccctctccakccacaggtaagagttaattattatggaaatgtattgttatagaatcaagaatatgtttgagcatatttgtttgtataatattttcattctatactatttt

SEQ ID NO: 75060 - DNA, 201 bp, Bos taurus
aggcatctctctctgactcagtttcctgagtcataaattacacgaactactttgtatatctttgaggaagttaaacaattttatagaagaaagcagctagyatgtatttcttgatagaaatctatctgttctagtccattattatctatctgatgaggtttgaaacttctgcccttcttatgtcactttgtcaaataatat

SEQ ID NO: 75061 - DNA, 201 bp, Bos taurus; identical to SEQ ID NO: 35608

SEQ ID NO: 75062 - DNA, 201 bp, Bos taurus
gttttctgaaagtgtctggaaaccttaataatgagctatatggtctcaaccacatcttttatgcattaagtctcattttcctcatttctaatttagggccygtaaacacaacatctccaataaacaaagtttacctaattattcatttaaaaatacttattaaacacctgctacatggccatgctgcccttatggaattca

SEQ ID NO: 75063 - DNA, 201 bp, Bos taurus
taaatagaagagacagtttgacctatttagatgtattaaaagtttggtaagatgtaatgagactgattattttacttacagagagcagtccagttattctmtggtcaccacatttcactgtatacctgatgaatttaatgccttctgtctagcagttctatctatacagtgagaaatagcgaaaagagaaaaccacaaaca

SEQ ID NO: 75064 - DNA, 201 bp, Bos taurus
ctcccaaggttactcacttggacctttaggaattgattctttttggacttctggcttccttcagattttgcctatgggcctcttcatagagcaattgagartataacaacatgcttcatcagagtgagcaagtgaggagaggcagagagaggaggagaggaagagagagagagggagagagagactataagaaagaggcct

SEQ ID NO: 75065 - DNA, 201 bp, Bos taurus
tagagtaatgagtgaaaacacaggctctcaagtcagactgaggttggatttcactctacaacctattacctatttgagcttgggcctttagctcactcttygtgtttttaattcctttacgtgtaaaatgagtataataataggatctgcctcaaaaagtgattgtttggggccaaatgaactaaaaatatataaaatttc

SEQ ID NO: 75066 - DNA, 201 bp, Bos taurus
gttaaagcatctatttccctatgaaacattctatcttactcttacatggcattctttggtatgaagaagcatgcaaataagaagagatggccttacattgygtcagaaaagtagctctatatctaagggtgcagtctataaataattcaggggagaaggcaaggaaagcaatggcatacaggaagtgtgagatatggccac

SEQ ID NO: 75067 - DNA, 201 bp, Bos taurus; identical to SEQ ID NO: 35609

SEQ ID NO: 75068 - DNA, 201 bp, Bos taurus
gtgctggaattgagcttcctcatttgtttgggagcaatttctgggcaatttctgaagggcacagcctgacaaatcctaggtggtatttctacaagttgatraattagtcaatacaccaggcatgcagcatctaacaatggcccaagctgaatttgaggggaaaacttgcattctgggtcctatacagaaaagtaaacaaga

SEQ ID NO: 75069 - DNA, 201 bp, Bos taurus
ttttaccaagtatttaagggactcttttaagttgaagacactgacctttccttctactatacttactttcttatttcttctgtgtattccctgagctccayttttataaatttctgtattttttttagtagtttgaataattatttgttagtcaatattttgatgaaagaaaaggttatattatcaaattatatattttgg

SEQ ID NO: 75070 - DNA, 201 bp, Bos taurus
agagcaaaagaaatgtaaccttagactaacaaggaaatgactgggggtgcaaaatcatgttgaaacagcaaaataatggggaattatgcaaatatggatartattttatctttgtgcagaaaaggtggactatgtgcaaaattctataagtaaaatacccagggcaactcaaatgtgagttcaagaaattgattgtattaa

SEQ ID NO: 75071 - DNA, 201 bp, Bos taurus; identical to SEQ ID NO: 35613

SEQ ID NO: 75072 - DNA, 201 bp, Bos taurus
ataaaggaagctacttgagaccatcagaaacaatagactgaagagaaaggtagtatccttaatctgatctttttgatgatgctgcctctcaagcttttctygttgtctgagaaatatcaaaaggaagctcttgagaaaggcttggggcctcagtcatttcctgactgtcagtcccaatatagattgcagatcacaggctga

SEQ ID NO: 75073 - DNA, 201 bp, Bos taurus; identical to SEQ ID NO: 35617

SEQ ID NO: 75074 - DNA, 201 bp, Bos taurus; identical to SEQ ID NO: 35618

SEQ ID NO: 75075 - DNA, 201 bp, Bos taurus; identical to SEQ ID NO: 35619

SEQ ID NO: 75076 - DNA, 201 bp, Bos taurus; identical to SEQ ID NO: 35620

SEQ ID NO: 75077 - DNA, 201 bp, Bos taurus; identical to SEQ ID NO: 35621

SEQ ID NO: 75078 - DNA, 201 bp, Bos taurus; identical to SEQ ID NO: 35622

SEQ ID NO: 75079 - DNA, 201 bp, Bos taurus; identical to SEQ ID NO: 35623

SEQ ID NO: 75080 - DNA, 201 bp, Bos taurus
ttttgtaggaacattatccataaatctcaaaggttgcttgtcagctactaatgttcaggaagaactctgtgttaattacttacctgatatttctcatcctkgtctccagaagttcataggtccaaattaagtggcaaaaatcttccagaagttgttcttacttcaataataagcttatgacttttcatcaagatgcctgta

SEQ ID NO: 75081 - DNA, 201 bp, Bos taurus
tgatgtagagccctcttgagtggaattcatgtcctcataacagaggcctagagagagctttcacctcttcaaacctgtgaggacacagaggtgggtgctgrctgtgaaccaggatgaggggcctcaccagaacatggccatgctagtgcctcgacctgagacctccagatgatagaaaataaactcctgttgtttatgagc

SEQ ID NO: 75082 - DNA, 201 bp, Bos taurus
gggacacatatatacctatggccgattctactgatgtatgacaaaaaccatcacgatattgtaaagtaattatcctccaattaaaataaataaataaattwaaaaaaataggccctaacgatgtggagactaacctggacttgtgggcagagtaaaggtcaagttatcttgttgaaatatatcacaccaaagatgtgctga

SEQ ID NO: 75083 - DNA, 201 bp, Bos taurus
gaattctgctagcaatcacactgggccccagacagagcagagaatccttccctattgtaagactgtggggtgtgacctgaactaggcccttaaagggtttsgtaaaaggatttgtcaggtgtcctgtatctcctccaaaaatgcactaggtcattaatttggccatatcacatatctcaggcttctatgtattaataacat

SEQ ID NO: 75084 - DNA, 201 bp, Bos taurus
tggaatattctgattttgcaggagtctcagaggcaacacactgtagccgtggttgagtgggcctgttcaacccttgtctggcagggaggggcatctacacytcctgcctgaagataaaccatgatctctcagcaagcgtgtatttccttggggcagagaatggggcttgatggcgattaagtacagtgtgaggaacaaata

SEQ ID NO: 75085 - DNA, 201 bp, Bos taurus
cttttcttttgaaaaatcctctaaaaacacaaacacagtctcttgtgtcttatgactttcagactttcttctccttctcctttgtaagtcatcctagcaaractagttaacaaaatacctgaattttaaaaggcattttaactacatatttgtaaaaattgtttccatagagaatgaggcaagagtttattttctacaatc

SEQ ID NO: 75086 - DNA, 201 bp, Bos taurus
aatcaacagattatccttttcattttcaaatttaaatttgtacttagccttttgaggttagctgttttttgttctttcttattcttttggtggagattaayttgcatttaaaggaagtagagaactatattggtgagtaaatgtagagaagcagttggaattcaagtagaccgaatggtattcagatgacatgatactggt

SEQ ID NO: 75087 - DNA, 201 bp, Bos taurus
tcattattgagatcactgtaagcaataatatacatgatatataatattttataacttagctactttaaaaattataattaaactagactctgtcagatgayaaatcttacacagtggagaagtatattattttcattttagctgaaggaaagaagcttaactataccattaaccagaaattagctcttaaaattccaaaag

SEQ ID NO: 75088 - DNA, 201 bp, Bos taurus
ataatttgaaaataattatgtactcttaaatgagacgccactaaagaacagcagcacaacattaaagtagcatgtgacactctctaattttacctgctgtmattttaatttggggttcagagtcagggtggcaatgcctcttcaaaacattctgaccttggtaaaaaaaaaaaaatccaggcagaatatctaagagaaaaa

SEQ ID NO: 75089 - DNA, 201 bp, Bos taurus; identical to SEQ ID NO: 35625

SEQ ID NO: 75090 - DNA, 201 bp, Bos taurus
acttgagcttagcttcaacgtccctctgaaaccagtttattactgtcactgaattcatgggcatggagacctaatgcataaaatgcctggccttactgatkgggcaacaggcaaggagccttgggcaagaggtctcagtaggctgaatctgtccttagctctcttcctttcattggctatatattgccctctggctatcag

SEQ ID NO: 75091 - DNA, 201 bp, Bos taurus
gccagaagtcagtcggggtcatttttggcacagtctttatgggagagaatattttatcctatagagtggtatttcccaaacttgttcaaaccagacccacrattatcaagacagtgatatctgtggagcaaactgacatgaatggatgcccttattggttgctggatgagttcactgggatctggggcttgccaggaccac

SEQ ID NO: 75092 - DNA, 201 bp, Bos taurus; identical to SEQ ID NO: 35628

SEQ ID NO: 75093 - DNA, 201 bp, Bos taurus; identical to SEQ ID NO: 35629

SEQ ID NO: 75094 - DNA, 201 bp, Bos taurus
ggcctacgctgtcaccacctacatgtttgggactttgctgttggcacatgctggggatcagggagtagaagcccagtccacgtgttgacaacttggcaaakgcggccagcggaccaagttgagatgactggacttatgctccaggctctaggtgacactggcagccaacccttcacctacggtctatcaagcccctcccca

SEQ ID NO: 75095 - DNA, 201 bp, Bos taurus; identical to SEQ ID NO: 35632

SEQ ID NO: 75096 - DNA, 201 bp, Bos taurus; identical to SEQ ID NO: 35634

SEQ ID NO: 75097 - DNA, 201 bp, Bos taurus; identical to SEQ ID NO: 35635

SEQ ID NO: 75098 - DNA, 201 bp, Bos taurus; identical to SEQ ID NO: 35638

SEQ ID NO: 75099 - DNA, 201 bp, Bos taurus; identical to SEQ ID NO: 35639

SEQ ID NO: 75100 - DNA, 201 bp, Bos taurus; identical to SEQ ID NO: 35642

SEQ ID NO: 75101 - DNA, 201 bp, Bos taurus; identical to SEQ ID NO: 35643

SEQ ID NO: 75102 - DNA, 201 bp, Bos taurus; identical to SEQ ID NO: 35646

SEQ ID NO: 75103 - DNA, 201 bp, Bos taurus
tccctcaaactagaatgttcttatcctgcatcttcaccttgacaaactgctacttatcttttaacagccagatcaaatgttcctccctcattccataaacrtttagtgaatgaagatttctcgactcctccaacgttaattgttctaactcctttattcccaaaggactatgctaatgtcagttgcacttactctgctgct

SEQ ID NO: 75104 - DNA, 201 bp, Bos taurus
tggcccaaactgaggcaccctgcctagtttttctataacttgactttaaggcaacagaaaatagaaagaggggctcataagaaaacaaagtgccatcaccrgtatactctggctctttcagggccaatctcaacctgttatcaggaccagatccagaaacctccaatgcctcttgcttattcaaaatgccctcctattttt

SEQ ID NO: 75105 - DNA, 201 bp, Bos taurus; identical to SEQ ID NO: 35650

SEQ ID NO: 75106 - DNA, 201 bp, Bos taurus; identical to SEQ ID NO: 35651

SEQ ID NO: 75107 - DNA, 201 bp, Bos taurus
gtacagtgattcaccactctgctccattaaaaacaaaaaaaagcaatgatacataaacaaagagacaaacttgggctcaaaaaccaaataaaaatctctcygaatcagaaaagaatggagatgctaagcagttaatagggctgaagctacagattcactgggattgtgtcaaaagtatgttgctgctgctgctgctgctaa

SEQ ID NO: 75108 - DNA, 201 bp, Bos taurus
tcagccttcaaagaactgaagagagttagggcctttgctctggattagaacattcacaccttggctactatttgatgcaagatgcctaacttttggcccayctaggctttcaacatgccttcctcactaaatgtaaacattcttggtttttttatttaaagtgagagacttgtgactcttccttagaggccactgtagggc

SEQ ID NO: 75109 - DNA, 201 bp, Bos taurus
ctctgcttgggtgagggggctggacagctgcctgattcaaatgtcccctcctccaccccccaccccagctccagagggtggaggacttagatcacgggccrgctgatgggataatgagtttatacaaagacagctctgaaaggacttaacgtttagcttgcaaatggatgtggccgtcacatcacactgtgccttcagtgc

SEQ ID NO: 75110 - DNA, 201 bp, Bos taurus
atgtagaaaaatgtaaaaagtaacctgggaagcagtaggtgatagaagactgggagacttgatgtgatgttagcacaagtaagaaatgcacgcagtgggtmagagtttgaactagggccatgactgctaatggtaagagaaatggacctggtatactttagaggaaaaggatctggggtttgacatttgaatggaatgaaa

SEQ ID NO: 75111 - DNA, 201 bp, Bos taurus
ataaacacaaaatgtaggacattatacctgatctcttaaaaaaagacaatgttgtaaaacaattggcgggggaccactctagacttaaagagaataaagartcatgagcaccacaagcagtgcacaaatctggattgtatctttctctgggggaaaaaaacagctataaaagatattttaaggactattggagaaatttga

SEQ ID NO: 75112 - DNA, 201 bp, Bos taurus
aaagcttaagatattctcaaagtgagagggtttatttgaattcttaaattaagctactgatccagtttccatttttacagtctgtgattgtggctaattgkggatagccaaaattgcatctcattgtttttagatgaaatttctttgattactggtgagagtaagcactttaaaatacatttttattgttattggcatttt

SEQ ID NO: 75113 - DNA, 201 bp, Bos taurus; identical to SEQ ID NO: 35653

SEQ ID NO: 75114 - DNA, 201 bp, Bos taurus; identical to SEQ ID NO: 35655

SEQ ID NO: 75115 - DNA, 201 bp, Bos taurus; identical to SEQ ID NO: 35656

SEQ ID NO: 75116 - DNA, 201 bp, Bos taurus; identical to SEQ ID NO: 35657

SEQ ID NO: 75117 - DNA, 201 bp, Bos taurus; identical to SEQ ID NO: 35659

SEQ ID NO: 75118 - DNA, 201 bp, Bos taurus; identical to SEQ ID NO: 35660

SEQ ID NO: 75119 - DNA, 201 bp, Bos taurus; identical to SEQ ID NO: 35661

SEQ ID NO: 75120 - DNA, 201 bp, Bos taurus; identical to SEQ ID NO: 35662

SEQ ID NO: 75121 - DNA, 201 bp, Bos taurus; identical to SEQ ID NO: 35663

SEQ ID NO: 75122 - DNA, 201 bp, Bos taurus; identical to SEQ ID NO: 35664

SEQ ID NO: 75123 - DNA, 201 bp, Bos taurus; identical to SEQ ID NO: 35665

SEQ ID NO: 75124 - DNA, 201 bp, Bos taurus
tgtcaggggcacgtcagagtcagagagcgggtgatggtctaatggcccctttggctccaacagctggaatctcagctgacctgggctgttctctttctacycttaaaagttttgcattgcagtggccagtcaatggatcaagtgaaatgacaaggcagtggtttatccagcatctttaatcccagcatttaaagagctgtt

SEQ ID NO: 75125 - DNA, 201 bp, Bos taurus; identical to SEQ ID NO: 35666

SEQ ID NO: 75126 - DNA, 201 bp, Bos taurus
ttaacatcctcatttagttactctgtgagggtgccagcatccataataatgaaattactttgattatcttccatagagtgtccgtgggcagttagcagctycgtaaggagcacagtacagattttctgccagtttatacttagggttggagaaggcaatggcaccccactccagtactcttgcctggaaaatcccacggac

SEQ ID NO: 75127 - DNA, 201 bp, Bos taurus
tcctcttggctcctctcctccagtgaggcccagcccatccacaggccgctgaggacctgtgttaggtccatggaaagagtccagaggccaaggcagcttarcacaaggaagagatgatcagaaaagaaatgcaaagcattcaggagcacaagagaacaggcccaacaagcagtgagcatcaacgctacctccagaagcgtg

SEQ ID NO: 75128 - DNA, 201 bp, Bos taurus
atcttttctctttaaaaacaggtaagaaagaaaacccagaaagacgttagggtctaggttaaggccatggtcaacagaaggccttggccacccagatccakatccactccagccccctggtgactcagccctgggcagacagtgaggagggaggaacgggcctgggaagcaagaaccgtgtaggctggggaagggctcagg

SEQ ID NO: 75129 - DNA, 201 bp, Bos taurus
ctccacccagagggagagcgagtctggggagagcagcgggggacggacctcggtgtccaagcatctatctcagccctccaacaagggcgggaaaggccctygctatttccaagaggctagggtggggggcaaagaggataatcaggggaacgctcaaaagtgcagcctcttaaaaaacctccagatcacagcgggcaggtg

SEQ ID NO: 75130 - DNA, 201 bp, Bos taurus; identical to SEQ ID NO: 35671

SEQ ID NO: 75131 - DNA, 201 bp, Bos taurus
cccagtgaggccctggtgatgggctcatatccgggcagctctctggagctccttgacgcacactgggatctccccagggcaagtgagagcagcatccatgrgtaagcgcctgtgtttgcccacaccaaatttatgctcctatctcccagggacccctgtgtcgttcctaacagatgtatttgctcatggcagaaatagaaa

SEQ ID NO: 75132 - DNA, 201 bp, Bos taurus; identical to SEQ ID NO: 35672

SEQ ID NO: 75133 - DNA, 201 bp, Bos taurus; identical to SEQ ID NO: 35673

SEQ ID NO: 75134 - DNA, 201 bp, Bos taurus
gccttttcgtcttcttcccgtatttaattcagctgagaccataggacttagctgtctccaccaccatctgtgtgagcctggccccgtgccacatgttagargtgatacaaaaacaaacatgagcgagacttactcttcctctctttgagttcactggccagagaaacagttctgtaggcagttcaacccattgcacaaaga

SEQ ID NO: 75135 - DNA, 201 bp, Bos taurus
gtggggtgacttggccgaccacccagccagtgcaaaagctagatctcaagccaggatccctggactcaagctagtgctcttcctcggagccatgctgcttrtccaggtcagctcccggccccagccctcatgcggcagctgctcccccggctggcgcagagcagctgcataacagacaagggccctggctctcagcagagc

SEQ ID NO: 75136 - DNA, 201 bp, Bos taurus
taggcataactccttgccagggtaattgtgcagatggccatcgccctagggagcatagagcagggcaagtcagaatgtgggcctggggggtgcatggagcraagatccatgagccactggcagaatgaagcttgggttctacctccgatacagtgtgtgaccttggaagtgtgccttccctctgctttagggcctcatctg

SEQ ID NO: 75137 - DNA, 201 bp, Bos taurus; identical to SEQ ID NO: 35676

SEQ ID NO: 75138 - DNA, 201 bp, Bos taurus
agattccattgctgggaaacgacgtggggtattatcagttagatagtttccaaggaggtcatggattttccgagctttaatgacaagtctgccttcactcrtgcgccccccacctccccacactgtcctccctgggggaggcttctggggggaaccaagagggttgcagaggaaagcactttggaatcgggccaaacagct

SEQ ID NO: 75139 - DNA, 201 bp, Bos taurus
ctgagctacttctgtgtgccctgggaggcccctggcctcatggagcttagattctaggcagctagagagggaaacatgaattcattttacaaatgcatgtragataagaatatggaaacgtgtggccaggggatctttcctgggctcatttcaagactctatgattagcaggatcctgggaaaagcctgggtgactgcaat

SEQ ID NO: 75140 - DNA, 201 bp, Bos taurus
tctagctgtaccattttgcgttcccactagcaatgaatgagttcctgttattctgtattctcatcagcatttgatgttatcagtgttttggattctggccrttctaataggtgtgtaatgttttaattctcatttccttgatgatatattatgtggagcatcttttcatatgcttattggccatcttctttggtgaggtgt

SEQ ID NO: 75141 - DNA, 201 bp, Bos taurus; identical to SEQ ID NO: 35683

SEQ ID NO: 75142 - DNA, 201 bp, Bos taurus
ctccagcccatggggtcacaaatagttggacatgactgaagtgactgagcatgcacacatggggcattttaacatcatccaaaggcccactggaccattcygctgagttgtcccaaggcagcatcaatcagttcaaaaccaactgcactgtccccatcacccatccagaaatatgggacttctcctggattcctctccaac

SEQ ID NO: 75143 - DNA, 201 bp, Bos taurus; identical to SEQ ID NO: 35684

SEQ ID NO: 75144 - DNA, 201 bp, Bos taurus
ccttccttgatcccacccacctaaacaaatccgggctcctggagccttttgttcatcattctccattccacaaacattcatccattcagccagcagacacrttttgagcccttaatataggcagtgctctaagttctagaataatagctatgtctgtgttgtacttaagcagcactctgtcatttacaaagtaatttctct

SEQ ID NO: 75145 - DNA, 201 bp, Bos taurus
cagcctctgggctatgaatagatgaggctggggccccggaggagtctaatgactcaacagctagagaggttaagctttcccagaaaagtgtttccgtttgygtttgatgaacttagggcccaacaaaggaagggtttcctgtctggaagactagggatgaaggagctggaggaacccttgcagttcctggaggctgtgact

SEQ ID NO: 75146 - DNA, 201 bp, Bos taurus; identical to SEQ ID NO: 35686

SEQ ID NO: 75147 - DNA, 201 bp, Bos taurus
cctcctccctctccttaggcccatcttttctcctcaactgtcgaatccctctctcttcccctcggaaagctccagaatcagctttaggcctctggaccttmcagccactcccactctcactcttcctcctgctcctccctgtctgtctgtctgtcgatccgtctctctgtccaggcaggctcctccagggccgccgtgggc

SEQ ID NO: 75148 - DNA, 201 bp, Bos taurus; identical to SEQ ID NO: 35689

SEQ ID NO: 75149 - DNA, 201 bp, Bos taurus; identical to SEQ ID NO: 35690

SEQ ID NO: 75150 - DNA, 201 bp, Bos taurus; identical to SEQ ID NO: 35691

SEQ ID NO: 75151 - DNA, 201 bp, Bos taurus; identical to SEQ ID NO: 35692

SEQ ID NO: 75152 - DNA, 201 bp, Bos taurus
gtgcctgagctgtggaaattctctggccgccctggaaatcacagagcctcccaggctgggcaggcttgtccctgagctcactgcgcatgcgggcaaggccyttcctgaagcaggctgtggctgctgcagctaagagacagtcaggagctgacttgcccttggggagcctgccagggcccctctccccagggcacacaggaa

SEQ ID NO: 75153 - DNA, 201 bp, Bos taurus; identical to SEQ ID NO: 35694

SEQ ID NO: 75154 - DNA, 201 bp, Bos taurus; identical to SEQ ID NO: 35697

SEQ ID NO: 75155 - DNA, 201 bp, Bos taurus; identical to SEQ ID NO: 35698

SEQ ID NO: 75156 - DNA, 201 bp, Bos taurus; identical to SEQ ID NO: 35699

SEQ ID NO: 75157 - DNA, 201 bp, Bos taurus; identical to SEQ ID NO: 35701

SEQ ID NO: 75158 - DNA, 201 bp, Bos taurus
tcagatacgactcagcaactaaacaacagcaatgcctgtattatacttgaatcaaagcaagggtgcacttaaaagttattttgtaatcatatttttctgtyacatttttatgaatctgtaccaaccttatataataatgtagaaactatataacaggaaagcaaaaatgaaaaaataaaaacatcacccacataccaccat

SEQ ID NO: 75159 - DNA, 201 bp, Bos taurus
gcttctctggggaccacctgaggaccccagtcagaccagtagctcagccagggccagcagctctgggctgagggggcgatagagcccaggcctctgcacayaccccaagaccccctgccctggatgatgccagaacaacgtgtcagtaacaccccaagaagggccactcatgactcccaaacacacctccaagggatgttc

SEQ ID NO: 75160 - DNA, 201 bp, Bos taurus
tagctgctgaggcctccggactcaccttggctgggagagccctaaggtgggacctagactttggtgatggggaggctagatggaaaactggagactgaaartgaaaagtggcccacatttaatgcagcacaggggatagacttctgccactctcttccagcccactgcctgttccttgactcccagggctcttaagtgaac

SEQ ID NO: 75161 - DNA, 201 bp, Bos taurus
taggattgtctgtggcctgaatgaggggtctgtccatggctaggcttggaaggatggctatctgtggctgaaataggggcctcagtcaatgaccaggactrgggggatgttcaattcacagctgagtttcaatactcattctggggtgggaattagagtgtaggatgttgtgaagtcctattagggagatgcaagaaggaa

SEQ ID NO: 75162 - DNA, 201 bp, Bos taurus
gatcatgtaggctttgttcatgatacttcctcagcacctagaaagaaactgcacaagagttcctcaataagatattaaaaataataattaatggaaggatygatgggtgaataggtgagtgcacagatgaatagataaaggcatccctgaccagtcttcatatgtgaatacactgctttccatcactgcctttcttttttc

SEQ ID NO: 75163 - DNA, 201 bp, Bos taurus
tttttgaaaaccagaatccactgcatgcctgccacagatcctgatgttgacccaggtattgaatatggatttattattggggcatttttattatgctttamctgtatacattttttaaagacaagctttctttttaattcaataaatgtaatgcttaaaaatgaaagacctttcataaaatgaactcaggttaaaccaggt

SEQ ID NO: 75164 - DNA, 201 bp, Bos taurus
gacctccacagaaaaaaaggcctccgcaatactatcagcgattcctgaaccaaacctggagggtacaccttctctgaaaatagcatttttcaggtcaaggrcaccggcgcccacgcagaggccgagcagcgaacacctttaggaggccgggaggtcacagagctgaggggataccgacccggatcgaaggctgtgggccgg

SEQ ID NO: 75165 - DNA, 201 bp, Bos taurus
cacctttaacagaaacaagacttcaaataatttcctaatttccaaagccagtggacattttccatcccttgattccactggacccttcttaaaattctcamttctcttagcttctgtgaggccacttgttataccatatgatcaactcttacggtttggggatgtggtaaaaagaagatcattagagactcagagacttgc

SEQ ID NO: 75166 - DNA, 201 bp, Bos taurus
tacagagtcaagttccagatccttggacccttactttccaactattttatgtctatgatacccatagctcacatctcaaagagagtatctattaggcccartgtcttctctaactggatactcacccattatcccgaattcctatgatgcttgtacatgatcttacttctttgatcaaaagaacaatccgtctaagttggg

SEQ ID NO: 75167 - DNA, 201 bp, Bos taurus
ccatcagtgtcaggtagattgatggcacatgtccatctcaagcctgtgtcccccttctatgctttgggttcctatgacatcagagcttcctgccccaatgkcagtctacagggcctctctgggcctctttggggaggggggcagacctggttgctgagatgcatacccctagacttcagggagggccaaggggcagctgct

SEQ ID NO: 75168 - DNA, 201 bp, Bos taurus
tcacacaagtgtgcttatgcaaacacacacacacacacacacacacacacaaacacacacactcttgtcaatggagcaaaagcccagagtagaaagaagayaagaagggggcttgttcccctgatgacaacatgcaagtgcgtatccccaggatgtcagcttcccggtgagaagagacataacctgcttggccctactttt

SEQ ID NO: 75169 - DNA, 201 bp, Bos taurus; identical to SEQ ID NO: 35716

SEQ ID NO: 75170 - DNA, 201 bp, Bos taurus; identical to SEQ ID NO: 35717

SEQ ID NO: 75171 - DNA, 201 bp, Bos taurus; identical to SEQ ID NO: 35718

SEQ ID NO: 75172 - DNA, 201 bp, Bos taurus
cccctaagaaagcgcacccctgcctggccactgtgcaaaaacacatgatgtcaacaaatcagcatttgatgctgaagctccactgactgagtatgtggaaygggaagggtggaaaggtaggaggaaccattctaaaagcctgtgctctaaaaactattttttgtggtgttaatagctgtttcacaaggaaaaggaaatcta

SEQ ID NO: 75173 - DNA, 201 bp, Bos taurus
gcaggacttaggccctgggtaaatggtctcccatcccgaaattctagtgtataactctctgtgggatagactctcagaactcaagcccttgatctcagccraaacctgtcttctcagtcctccacattcaccacaattggagtctaatgttccttgggaggggttgctgcatttctttttatcacatcagtaggtcctttg

SEQ ID NO: 75174 - DNA, 201 bp, Bos taurus
cctttaactgtaatcccagttaaggaaaggactgaaatacctttccttaactattacccaattatacatcccacatgaacttgttttctttcagtttaaayaatttctagaaatccataaaaatgaaaatcgatgcataacttgattatgttaaccacatgctgataaagggaagtgaaaaaactcaaatggtcatttcac

SEQ ID NO: 75175 - DNA, 201 bp, Bos taurus
tgcctggtgggataggtccttgggtgctccaaggacattccaaagcaacacaggaactgctgttgagaatgatacaacaaatccaaggaaatgaaggaagyggccacagggtagggacaggaatttcaaagaacgagaagacagaattctgcaaggctatctggtcccactggaacaaatgaaccccagtggctgggactc

SEQ ID NO: 75176 - DNA, 201 bp, Bos taurus; identical to SEQ ID NO: 35720

SEQ ID NO: 75177 - DNA, 201 bp, Bos taurus; identical to SEQ ID NO: 35722

SEQ ID NO: 75178 - DNA, 201 bp, Bos taurus
cttttattgataatgattgggttgtttccagttaggtgcattttgaaaaatgcaggtattaatatcctatgagtatgagtatatgtcctggtgcacatgtrcaagatgactctaatgcagggtgtttcaaagtgaagtgttttcatcagcaatatcattatctgggaattcattagaaatgcaatttccctggtcacatcc

SEQ ID NO: 75179 - DNA, 201 bp, Bos taurus
cagagggacctggaaggccttgtctctggagacctttcaggaaagaaaagagcattctccctggtagggagtttcccttgcagagctccacgctggtctcygaggggcctgggctgcttctgaggcagagaaagaacacctaggaaatcagctaaaacaggggtgagaagagggctgagcagaagccttgggtctcccatg

SEQ ID NO: 75180 - DNA, 201 bp, Bos taurus; identical to SEQ ID NO: 35732

SEQ ID NO: 75181 - DNA, 201 bp, Bos taurus
cacaacggttgtaccaatttatattttgtatggggccgatattaatcattgatcactttggagagagaatttcatgattaataaccagactgaaaggtctragtggccttgaccttttgtcctgttgtcttataaaaatctttctaatctctgtttttcatttgagaattaattagaaagatagacttaaggaactcctct

SEQ ID NO: 75182 - DNA, 201 bp, Bos taurus
tgtgggggaaaagtagggccagagagccccaggcattttcagtcgaagcggagcagcctgtcatggaatggatttttccagagcagggctaagtaaatgargaaggccgggccggagcctcgaaatgtctgggaaaagacgagagtccagcaaatagtggataaatctccaagggtgagaagaagttggagtctaattacg

SEQ ID NO: 75183 - DNA, 201 bp, Bos taurus; identical to SEQ ID NO: 35733

SEQ ID NO: 75184 - DNA, 201 bp, Bos taurus
aacacagtcaagttcacaactgaagacagcttgatccacatgactgctgatttatcagtccccactttgggtttttagtttcagtcccttgtagaccctckatccatacaaggaaagcctaatagatttgcatttaggaagatccatagtgttcctccagagtgtcacagctggctggtggaaattccattctgatagttg

SEQ ID NO: 75185 - DNA, 201 bp, Bos taurus; identical to SEQ ID NO: 35734

SEQ ID NO: 75186 - DNA, 201 bp, Bos taurus; identical to SEQ ID NO: 35736

SEQ ID NO: 75187 - DNA, 201 bp, Bos taurus; identical to SEQ ID NO: 35741

SEQ ID NO: 75188 - DNA, 201 bp, Bos taurus
cccattgcttttctcagtgattatttattgctataaaatactgctttgggatgggaagatcctcataaaggtagagaaaaagtaattcccttgtacttttmtatattatccactgcatccctaaaatattacagagaacttctgaataagcaaaaatctgtctatattctaaaggcattgtggccttggaaattcagttgt

SEQ ID NO: 75189 - DNA, 201 bp, Bos taurus; identical to SEQ ID NO: 35742

SEQ ID NO: 75190 - DNA, 201 bp, Bos taurus
tgactccatgaaccgcagcaagccaggcctccctgtccatcaccaacccctggagtattcttctctaaatacaaaacattcctcttacctatttcctgtcrtaccttattgtacttcagcttccctggtggttcagtggtaaaaaatctacctgccagagcaggagacatgggtttgatccatgggttgggaagatcccct

SEQ ID NO: 75191 - DNA, 201 bp, Bos taurus
aaagtgaaagtaaatttccatatccacatatcttattcttttcccatatgttactgaaactcattagggcttagactgtggcctcatattccttcagtttrcacaaaaacttgaagaatatggtaatatgtgtttccatgttattctctaccatatgtaaaatagacagccaataggaatttgctgtatgactcacttctc

SEQ ID NO: 75192 - DNA, 201 bp, Bos taurus
ataaatggcttaaaacaatactcgtgtattttctagtatgttcggcagatcagtgacctgggtgtggctcatctgctttggggcctctcacaaggctgccrttgagggttacagtcatctccaggttcaactggggcaggatctgcatccacgctcactcagtggctgtagacaggatttggctcctttaaggccgtgagt

SEQ ID NO: 75193 - DNA, 201 bp, Bos taurus
ttggaagtgtgcttgctgactcagagtgacatagaggtacatctaacaatcaaattaaatgcagttcagagttaaccatacactgaagtaataagcaggaygtatttattttccatttcctttctgtggccagagattcaaaggataaagtcattaaaaatctttcagatgtttgctttctctggtgaaatgagcgtgtgc

SEQ ID NO: 75194 - DNA, 201 bp, Bos taurus
gctttttggaggtatcatggatcaaatagaagaacagaagtgatataaagcctggacatgctcgcgaggcggtgacaagacctccaagattgctgtggcakgcagacaaagggagtccagatggcatccaggacagtgtcattcctgtgggctggtggttagaaaatacatcccacaggaagcgattgggaataataatac

SEQ ID NO: 75195 - DNA, 201 bp, Bos taurus; identical to SEQ ID NO: 35746

SEQ ID NO: 75196 - DNA, 201 bp, Bos taurus; identical to SEQ ID NO: 35747

SEQ ID NO: 75197 - DNA, 201 bp, Bos taurus; identical to SEQ ID NO: 35748

SEQ ID NO: 75198 - DNA, 201 bp, Bos taurus; identical to SEQ ID NO: 35749

SEQ ID NO: 75199 - DNA, 201 bp, Bos taurus; identical to SEQ ID NO: 35750

SEQ ID NO: 75200 - DNA, 201 bp, Bos taurus; identical to SEQ ID NO: 35751

SEQ ID NO: 75201 - DNA, 201 bp, Bos taurus; identical to SEQ ID NO: 35752

SEQ ID NO: 75202 - DNA, 201 bp, Bos taurus; identical to SEQ ID NO: 35753

SEQ ID NO: 75203 - DNA, 201 bp, Bos taurus; identical to SEQ ID NO: 35754

SEQ ID NO: 75204 - DNA, 201 bp, Bos taurus; identical to SEQ ID NO: 35755

SEQ ID NO: 75205 - DNA, 201 bp, Bos taurus; identical to SEQ ID NO: 35756

SEQ ID NO: 75206 - DNA, 201 bp, Bos taurus; identical to SEQ ID NO: 35757

SEQ ID NO: 75207 - DNA, 201 bp, Bos taurus
gatgaaggagtatccagcaggcagccgattatgtgaatatatgggtctggccctcactagacaagtctgggctggaaatccagatctgggagtcgtcatcrtacagatggtaattagagccttggggaagggtgagatcaccaatgagggcggacagaacaagatgaggttttaacgtaacagtaaaattcactgaatcat

SEQ ID NO: 75208 - DNA, 201 bp, Bos taurus
aacacattgttggattagacctgggtttcttatcacagcttttctgtgcctcctctgtaaaaattagctactacccatgagtcccttgcaagggatcctcrcatggtaaatacttattaaatttagtttcattgttttcctttcattgaacacattcatttcattaaacaggtgctgttttaagtcttgggattcagtagt

SEQ ID NO: 75209 - DNA, 201 bp, Bos taurus; identical to SEQ ID NO: 35759

SEQ ID NO: 75210 - DNA, 201 bp, Bos taurus
acatggtccctcatggaggaggttccatgccagtgaacagaggggcagtgggcagtgactcccagcagtaaacgtgcccacccagggccagtgagggaccragtctgatctaaggtggagtcaggaaaaggagggcaagatgcctgaaccttgtccagggtcacctggccactagttaacagctgcaggccaccctctgcc

SEQ ID NO: 75211 - DNA, 201 bp, Bos taurus
ggttcttcccctgctccccacctgctggcccctccgtgtccttcagacccctgaatccacatccctgagagagacctgcaggtaactcaagaatctgaacmcctcctgtgggccaggcgctgtgctctgccagctggaaaccacagcaaggacaaaacagagaagaaatccctgccctccatctcaatctaaattataaat

SEQ ID NO: 75212 - DNA, 201 bp, Bos taurus; identical to SEQ ID NO: 35761

SEQ ID NO: 75213 - DNA, 201 bp, Bos taurus; identical to SEQ ID NO: 35763

SEQ ID NO: 75214 - DNA, 201 bp, Bos taurus; identical to SEQ ID NO: 35765

SEQ ID NO: 75215 - DNA, 201 bp, Bos taurus
acccctgagccttgtctggaacccggctggccatgccccattttttgacaggtaacacaggaggaaatcaaccctgaatattcgttggaaggactgatgcrgaagctaaagcaccaatatctgggcctcctgatgcaaagagtcgactcagtggaaaagaccgtgatgctgggaaagattgagggcaggaggagaagaggg

SEQ ID NO: 75216 - DNA, 201 bp, Bos taurus; identical to SEQ ID NO: 35769

SEQ ID NO: 75217 - DNA, 201 bp, Bos taurus
tgtgcaaggcactaggaaactggccatgagggtgacagggttcttctggctcagagctcaccagctgatacacagaaactgcatgtctggccctctgatgraataggagccacttttcacaggcaaggatcccagccgcctttagtatgcatcgagtgtgtggccctgaacttgggcagtttacaaagcaatgctactgct

SEQ ID NO: 75218 - DNA, 201 bp, Bos taurus
gttggtaatggccccgggactgtttattgaaatgacttttattttccttctgctccatagtttcacctctaacataaatcaagcatccatgtatgtacagrttatttctgggtgtgcttttcaagtcccttgtgcccatcccaccctggtttaattactgtaaatgtataaaacattgtgacaataaagtaagcccacttc

SEQ ID NO: 75219 - DNA, 201 bp, Bos taurus
gatttagttggtgctgtatcgtgttctagtcatttctcgaagtgtgagtgcttcagaatatctatgctatttcaggtccgcttctttgacacgatcttctytttacaaactgagcttatcactatcgtggacgaagaaaagtttcctctccccttcagttggtctaatactcaaatcgacatgaaagagatcgacagaaga

SEQ ID NO: 75220 - DNA, 201 bp, Bos taurus
tgtgtccaaggagatttatggtttcctccaaagggccaacatgcttacacctttccaaaataagattctttcaaagcagccaatagttttagtgatggacmtgcaggacaaggggcccctgaatgctcaagcccttcggccagcaaggaccgtctgccctgtggtttgctggggtctcactgctcctggggaatctagtga

SEQ ID NO: 75221 - DNA, 201 bp, Bos taurus; identical to SEQ ID NO: 35770

SEQ ID NO: 75222 - DNA, 201 bp, Bos taurus
gagagaggaacttggaactagatatttggaagtgatgctactaccctcgtgtgatttttttgttatattatatgctaacaatgacaacaaaactcctaaayatatatgttataaaaacttaacaaaaatacattaaaatattttctaaaatgaggtatattgctttgaaccccttggataaaaatataaaaatgataaaat

SEQ ID NO: 75223 - DNA, 201 bp, Bos taurus
caccagggtagtcccatctctgtgtttctgtcacaccaattcttggacctcatctggtgcttaatggatatttcttgaatgttgatggccaccagttacaygagcttttcttcaaaacactgctttctgggatcctttgttcccacctgcagagaaggacgctgtcactagatggggcttaaggccctttcaactctgtcc

SEQ ID NO: 75224 - DNA, 201 bp, Bos taurus
aactgcaggatcaggagatggcagagcacgctcccagacagagttggcttccaagcgttctcaaagttcgctttgaaaataaagctctaaggatgtcactrcataactgggatgacagtttctccaggtaaaagaatatttgtcattctgaaggcagattccttttctcttgacgaatctggaaactcagccttctcttag

SEQ ID NO: 75225 - DNA, 201 bp, Bos taurus; identical to SEQ ID NO: 35773

SEQ ID NO: 75226 - DNA, 201 bp, Bos taurus; identical to SEQ ID NO: 35774

SEQ ID NO: 75227 - DNA, 201 bp, Bos taurus
gagagcaccaagcagatgtaacaaagttggagccctcagacccctccctcccaccaaggtgtttgggtgcacggggctctcatggccaggagactccaagytcagattctgacttccctgcaatgctggaccagggtcttcagcaagtcagcccccaggcaggacaggcaacccctgctcccctgtacctggccggcatca

SEQ ID NO: 75228 - DNA, 201 bp, Bos taurus
cccatgggggtaattgaagggtgcttgttgggtgcttcctcagggttgtagggcggggactggacatcagtgtggggccttgacacactctggctccctcygtgtcctcacagtggagccctggcgtcaggaagcttgttcttaacaagcagatcgggtgaacctgatgaagttggggccacatcaccgtttctgaaatac

SEQ ID NO: 75229 - DNA, 201 bp, Bos taurus
aggcatgtgctttggtccagtgggctgtgtggcaggtggtggctcagggaaggaggagagtataaggaatacagggccatggaagaagcaggaggccagcrggagatgctgtgtgtgtacccggggggacacacggcaagtaacctgggggaagggagccagccagtaatgcaggtatttggggccaaagctcatcatggg

SEQ ID NO: 75230 - DNA, 201 bp, Bos taurus
tcctcctgtgactagtgcacggtcagatccagagtccagctgataagctgagtcctgacagatgaaagatggagcatgcaccatctggtggtgtgagtacmagctcagcctcttcattcttactctgtgtgaagataagcgtgccctggatgcagagaaggagggcacacccctgtgtcccagctttcaggctgcagtgcc

SEQ ID NO: 75231 - DNA, 201 bp, Bos taurus
ttaggatcctttggaacacctccatgttatggagatgaagttacaaagttaggacttcatttatgacagaagttacaaaggaaatggacaccactgctttmttgagccactggacacagtgtctaggtctcattagcagatgtttgtcctgttgaggaacatggccaggctgtacctttccaactttctgtgtttattatt

SEQ ID NO: 75232 - DNA, 201 bp, Bos taurus; identical to SEQ ID NO: 35775

SEQ ID NO: 75233 - DNA, 201 bp, Bos taurus; identical to SEQ ID NO: 35776

SEQ ID NO: 75234 - DNA, 201 bp, Bos taurus
cgccaaaggtcatgcagtctaccgaggaggtcatgacctttggaagaacggcctccacttataaatagctgtgtattgagtgaaatgaatggaaacccatytatattttggaaaatgtaattgggccgatggactatgaggagaggggccccggaagagaaggggaggaggtcgctgccgccaacgtgctgggtcagtgaa

SEQ ID NO: 75235 - DNA, 201 bp, Bos taurus
ggtctggttgaagagccccagccagggccctttgtcctgctcagattccacttccaaaagaagtcagctgagttcttctgctaaacagcagggcgtctacygtggggttccaggcaggccgggggctgaccctgaagatataaagggagtccaactgtgactgtgctgcccgtggcagggggacaccagtggctccctgga

SEQ ID NO: 75236 - DNA, 201 bp, Bos taurus
acggggatattttttatcttggcacttgtctgctcacggagcattcaccgggcaccaagtgagatgcatttgcatgctctgggcgatgtgccaggccctcrgggatacagaacgagtagtgagcgccttttctgggctgctaagtgctctgcttgtgttctctgttcaccctcacggccccctccattgtggcttccccca

SEQ ID NO: 75237 - DNA, 201 bp, Bos taurus
ttcttaaccactgggccaccagggaagtcccccttcactccttaaagacacacgaacagatgttgtcccctctcctgtctcgagatgctgctgtctggggrtatgatacctgagacagctgcggccatcctgagattaggaggggaacaaacctggggacaaagccaccaagctggggagggaagaacaaaaggacggaaa

SEQ ID NO: 75238 - DNA, 201 bp, Bos taurus
gatgataggggaacctggaggagatccagactggccaggaagttcccctttgccagcacagtgtggttgacattgattagcccccaaacacaatcagcaaygaaagcacacttagtgctggcctcctttgtatgtatactgaaatgcactagattatcccagtgcataatctctgaaaacatcattgacttttgttaatat

SEQ ID NO: 75239 - DNA, 201 bp, Bos taurus
agcccttaggggcctgaaaatcagatgtgatcacctccagaaagagcattcacttcctattctctgcatcaacacctctagattcaatataaagtggtgcrtctgactggccaagtcttggtcactcacccaagctctaattcccgagggaactggaaaaacaatactgctacttttattttccataaaaataagggaggt

SEQ ID NO: 75240 - DNA, 201 bp, Bos taurus
ctgcccatggaccccctctccccccagggtgccaggagatgtgggaggtggtgctcagaaacctcccccacaccaggtttccgcaggaagggtggggtggrcactggccggtactcctctagtttgagagctcctctgacttggggagctctgctccgttcccctcccctaggtggggctgcagcgctggcctggattggt

SEQ ID NO: 75241 - DNA, 201 bp, Bos taurus
ccaggcaaggggccaggtacatacctgtccaaagtggactgtgattggccgccggtcctctcggaacttggggtccttggcctctaccagtggggacggcrcagtctttggcagctgctcttctgtggtgggggcacagccattctcagtgatgtcctgcaaggagaagtcccatggcggggttggtgtctgggttatggc

SEQ ID NO: 75242 - DNA, 201 bp, Bos taurus
caactcagatgaaacacttaaaatgatctagctgtccacttccctgtttactgtgtctgtttcactagactgtaagctccttgaggacatctgtctctagrtgctactatgggctgcctcatttcctcctttctttcttaacacaaccacgatttgttcatgccctcaccctcctccgtgaggacaagtgtttcaggcccc

SEQ ID NO: 75243 - DNA, 201 bp, Bos taurus
cagcactgcattaaaatttcagaacaagaaggccagggggatggttatccccactatacagatgagaaaagtgaaccttagctccaagtcacacagacaayagagccaggggcagaggccaaagtcaagtacaaatgtgtcttactccaaagtctgtgctattccattaattctcactgctgccaggattttttagacaag

SEQ ID NO: 75244 - DNA, 201 bp, Bos taurus
cgtgaattaacaggtccccatactgactacctaccaaataccaggcactggaccaggtactcttggcggtgtaattttaagcactcttcacaaaaatccartgagatattattctttccaacatatagataaattaagtctgggagagagtagtaactggtcaagttactactggaccccaatgcaacaccatagcccata

SEQ ID NO: 75245 - DNA, 201 bp, Bos taurus
acatggccaacattaaaatgtgtgactgtaagtctgctgggaaccgactatgtgtttatgtgtctgtatgtatctttgtacacaagcgtgctgtatgtgcrggcccatgcacatatgtgtgcctggaggtgtgcaccagtgtgtcaacacctgtagtctgtgtgtgaactcatgggtatgtgacatatgcagctgtgtgtt

SEQ ID NO: 75246 - DNA, 201 bp, Bos taurus
aaaaagtcacttctccaaggagacccaccgtccccaccctgtcaggatgaatcccatgtccatggctctccattccctggactggctttatttcaaggccmctacccgccccgggcaccgtgtttgttacctgcctcccagaatggaccgtgactccgtgtggatacgacttggtctgtgggccgcagctgcacctcagta

SEQ ID NO: 75247 - DNA, 201 bp, Bos taurus
gggcctttgtggggcccgtgctcttcgtgctgaccgtgagcggagaggcccaggggtcctgccggggtgggacaggtcgtgggagggggagccccttttgygctctgacaccagatctccaggccaacacctgcatcctggtccgggtggtgattgtcaccgtgtccagtgcccgctgccgcgcccgcatgctgagcccac

SEQ ID NO: 75248 - DNA, 201 bp, Bos taurus
caaaacataaagagacaattgccgatgggagggacaggtgggtggctgggtagctctgtgtggaccagggacaaaggagtgtggtcctgcccagaggcccrgtgaggagacaaaaatcaagtgtctccagtgtgaaatggatggtggttgaaatcccagccccactgcttagaattggtggcccgcgccctatcctctcct

SEQ ID NO: 75249 - DNA, 201 bp, Bos taurus
gactctgtggctggcagggttgccagggcccaccttggtctatgaatgagaatctgcatgccctcaggactgggctgtgggtcctgagaccttctagactrtgaggcctggtggaaactcccaggaggagatgcaggaactgggcgtctgggcagtgctggggctccaaccttgggcccgggcctctccgccatgctcctg

SEQ ID NO: 75250 - DNA, 201 bp, Bos taurus
cgtaactaaatcaataaacacggtggtagcaatgtgtcagactgcaaggtccaggtatcagcaccaaacagtgatcacaccttagctgaatattgaaggasaggggtttttaattttttttttttttaactttttgagtaagtgtatatttacaaaattttatataaaatgtgcttttcctcccttatacactccactaaa

SEQ ID NO: 75251 - DNA, 201 bp, Bos taurus
atattaataatgcttcctcataaagctgttggacaataaaatgaactaatggatataagattgccctgtgaattataatgtactgtaaaattgttacaaakgcactcaaaacagagtataaattgaaaaataccaagtacaaataaatgttgaatgtgtttatgtgggggcaatgatgatggttttgaaatattcaatgaa

SEQ ID NO: 75252 - DNA, 201 bp, Bos taurus
gatggtttaaattccagtctgggagccagcgggctcgagatccaagaagagcaaggttccagctcgcatccaaaggcaggaaaagattgagggcccaactyaagcagtcagacaggagttccttcttactcagccttttggtttcaggtcttcagtcgactggataaggccccacccatactgaggagggcagtctgtacc

SEQ ID NO: 75253 - DNA, 201 bp, Bos taurus
ctcagtacaagttttacgtatgtcagtaaacgacgcacacagtggcctcacagagcccagccctgccacgggagaagctcctccacagtccctcacagatytgttttgctgcctggtttgtaggaagcctggtttctcttttactgccccaaacagtcactgaggcaagattcttaatcttatcccaaatttagggcaaac

SEQ ID NO: 75254 - DNA, 201 bp, Bos taurus
tgaaccaacaccgtttctctccaacctcaaagatctgaaagttaagaaacctgaatactcctggctagagaactgagccaccccttctgttgattctacaytgggggccacgtgtcctgccccgaggggagaggcctctgctgatcgaggaagaacggaggtgctgggggtggggagcagttcagacggcctggctcgtgt

SEQ ID NO: 75255 - DNA, 201 bp, Bos taurus
ggggcaagaaagtcctttgaatactgtgagactgcatttcccaaaccgcacaattaagaggagattctgagccaacagatctgggacgaggccaggagttrgtgattctgatacacggtcatggtaggaactgctgctttacagtagcatgtaaatgacaggccttccctgtcttgattcttacatgggtttattggcagc

SEQ ID NO: 75256 - DNA, 201 bp, Bos taurus
aattttattcgtatttcttcctttccctagtccctgtactatgctttatacataacagctactcaaaattttctaaatctatgattaaaaagaaaaaaatyaaacaagtagctagtagcttttcttaatccagaaacaggtcctcaataccttagtgtaagatgtcagtatgaggaccatgaaggctttgcaggttgctca

SEQ ID NO: 75257 - DNA, 201 bp, Bos taurus
atccgacatactgtgtctgttaactctttctcccccacaagctccatcggaggagagattttgcctcctgtttactgctgtacctttcaggcctataacastgcataactgttcagttgctcagtcatgtccaactctttgcgatcccatggactgcagcacgccaggcctccctgtccatcaccaactcccagagtctat

SEQ ID NO: 75258 - DNA, 201 bp, Bos taurus
ttacattaaagagatgggcagaaatggagactgagaaccatcagccaggggcagacaggggaaggagttacttgtggtaacctggaggccagctgtggagrgagcttcaagatggaccagggggtggcactgccagatgctggggagaaatccaagggtgaagggatgaagccctcttcaacaggcatacccagcaggcca

SEQ ID NO: 75259 - DNA, 201 bp, Bos taurus
cagggctgtgtcctggcctggccgtctgggggcggcagaggcagaaacagggctcctattttccaggggtgtctctagggccctttgcttttttctaccckcccaacctcaggaaccagccctctctgtgcctgcagtaaccatggcagctggtcagaggtggaacaaagagagggccgttccgtgcagctctgatgtgct

SEQ ID NO: 75260 - DNA, 201 bp, Bos taurus
ttggggttttcaaacacacacacacacacacacacacacacacacgtcttttttttcctcccccaattcggagccttccctggcctgttacctgggctcaygtgagtcaagtccatctcctcttggctcctgagcacgttgtccttatcccccacccatctctgctcgggccattgctgtgtgcctcgtcttctaccagcc

SEQ ID NO: 75261 - DNA, 201 bp, Bos taurus
cttgcccagagccccacgcagacgacgctggttgacacacaggttcccgccaggcccccagccccgcagcacaggaggggcctggagaagcagagctcgtyaatactcacacagagatctaagtcccaccgtggaatgcacgttcccccgtttcctttaaaatgcctggccttctccatctgtatttcgttttcctacttt

SEQ ID NO: 75262 - DNA, 201 bp, Bos taurus
gaaggttgagcccaggccgactcaaagggatggagacatacatgcacacatacacgcttcaaggcacacccatgcggatgtgcacacgggtacctagacaygctgagagagacggagaggcccctgcgggtcagccctgccccgtcaggaaggggaaggaggccagacggggacaggggagccccctctgacagcaatagg

SEQ ID NO: 75263 - DNA, 201 bp, Bos taurus
tgggctcttctgtggactaatctgcatgccctctggcagattctagattccaggagctgctggtcatggtcctgcctcgaggaggacccctaggcttgtgragggatgttgaaggctgacttgcccctggagactcattaggggtcaaagtgtcgttggaagttgggacagttggtgggatctgggaaaagaaaacacctg

SEQ ID NO: 75264 - DNA, 201 bp, Bos taurus
agcccagaactagacccagacaaatataggcaactgacctttgacaaatgcatgagggcagttagtggagaaagggtaatttcttgaacaaatagtactgmaacggttggaagtacttttgtgtgtttgaaaaaatgaacctgcaagactttaggccttccgtaaaaatgaaataaaaattgaccatagacctaaatgtaa

SEQ ID NO: 75265 - DNA, 201 bp, Bos taurus
taggattctggggctggaaggaaagtctttagcctaagagcttggagggcgcaaatgtgtgtctccctcagaatcagtactggatttgcagcctgaaggcrgcaggttccagagaacccgagggtcagctggagccagcatgaggaagcttccagaagcaagaggaagcttccagaggcaccctggaatgaactggggtag

SEQ ID NO: 75266 - DNA, 201 bp, Bos taurus
gactcagccggggcttgatttcgggccgtgcaaacccctgttgcagggaggaaatggtcgttcgtgggtttggatgaaaggctcgacttaatggatttttwaaaaaatggatgatggagattgtggagctgcagcggagtgagggctgacggtggtcatatttggaaaacggcgtctctggtgttaataagcttggcgatc

SEQ ID NO: 75267 - DNA, 201 bp, Bos taurus
ccagtaacacgtttctagggacctgaagctgtttgtttggcccaggagagtcatgagaaactgtggttcccccaccaagtgggtctcctgtgcagctgagytccttagaaggcctgcggaagtgtctgcatcacattgcccaatgatttcatctttcttgtttgatttttcctaagtatctcacgtgtggggtgttcgttt

SEQ ID NO: 75268 - DNA, 201 bp, Bos taurus
ggctctggcttgccagctcgctcacgccacaggtcacctgctgctcagacagctgcagccccctgagctttaaatgatcacaaccgctatgcacagccctscagagggggctggacatggagggatgctgcaggcacggcacctaagcctgctggctgtggggtgaattcctgatgatgaggaaggcttggcacagggcgc

SEQ ID NO: 75269 - DNA, 201 bp, Bos taurus
agcatctcaaagagttggatatgaccgagcgactaaaccaccactacatataaagaaactgagattctcaatttctcagtcacccaaggccaggcagcaaktggagctcaacaggtacctggagctctaggtgaaccgatttgctgcagtccagaatgccccctccgggcccctccaccctcccgggtggcacacacatgg

SEQ ID NO: 75270 - DNA, 201 bp, Bos taurus
gttaggacttggtgctttcactgccaggccccaggttcaatccctggttggggaactaagatcctgcaaaccgggcagcatggccaaaaaaagagagagarggagactgtaagaagagtgggatccaggagctaaagagacagagggtgtttctgagacacaggatcgatcacttagacaagtgctgctgataggcccagg

SEQ ID NO: 75271 - DNA, 201 bp, Bos taurus
aggaccaggtcgaccagtcctcctccagtgaggcccaggcgccccctggtggccagaggctggaggacacagtggagctgggccctgtgccaagtccagcrcccacaatatcacccacaacagccccagaaaggatggggtctttcattgaccacattttctagacatgattgtcacggcctgaagtgacatcacaaagct

SEQ ID NO: 75272 - DNA, 201 bp, Bos taurus
aaaaaatggcatctgagccctgatgaatgagtaggactgagctggggagacaggcacagacttacaaggcaagagcgtgtgtaaaggccctggggtgggcrgtaggagtgtgggggctacagtgtaactgcattgtgatgacgaggcgggagaggcaggacctggagaagagggaaggggcagatcatgagggcccttttc

SEQ ID NO: 75273 - DNA, 201 bp, Bos taurus
gacctcctaggtgaggggctgacctggagaaagctggagagtgggggaggaagagaaaacttatgaatgaattcatgtggtaccaggggcctggggagaartgttagacagtaaagaagcccaactttagtccagttttcctgtggctgctgcaccagcttgattaccttatgtgaccacttcagtggccatttgaggaag

SEQ ID NO: 75274 - DNA, 201 bp, Bos taurus
agagtaggcaggcccaggcaggagtcggggagggtcatcccctggggctagtgtggagggaggtagccttccatgccctgtggatagaaaccaagtctggrctttgtcccccagggccgcagcagacgtccagtgttagcggcgaggggtctgccagggtggggtgcacaagaggccgaatgatcctgtcccccactgcac

SEQ ID NO: 75275 - DNA, 201 bp, Bos taurus
ggctgggcactgcccaactccatggatgtcattcacatagacaactctgatgacctctggacagtgcagtatggtggcctcagccctgttccaacaacagrgctcttgtgcgttcactaatgtcccgtagcatatgctgcctgtaacccgcacccctgcagtgccctgtgtgaatacccagatcacgtctgaggcctattt

SEQ ID NO: 75276 - DNA, 201 bp, Bos taurus
ccacaaccctttgtgtgctgaggagggagagctgagtctgctttggcctagactttgaggccagctttccccagctcagatccaggcctctgggcattggraggttgctgtgcttgtgtgactggctttgtccccagattggcagctgaccaaggaaaggagggacccagttttgagggagggccaagagtggaggagagg

SEQ ID NO: 75277 - DNA, 201 bp, Bos taurus
agaatccaattctgagtcagggccagggctttctctttcctgtgaatgtgaagacaggaaggaaattttctgtagccacaaaatcagtttttaaaaaagtrttttgtaggcacagaagaggccaagcagttggctttggtttaaggcacaaataacaaatggaaatggtcagtcgtggggaaggagggtctgggagtattc

SEQ ID NO: 75278 - DNA, 201 bp, Bos taurus; identical to SEQ ID NO: 35783

SEQ ID NO: 75279 - DNA, 201 bp, Bos taurus; identical to SEQ ID NO: 35784

SEQ ID NO: 75280 - DNA, 201 bp, Bos taurus; identical to SEQ ID NO: 35785

SEQ ID NO: 75281 - DNA, 201 bp, Bos taurus; identical to SEQ ID NO: 35788

SEQ ID NO: 75282 - DNA, 201 bp, Bos taurus
gctgactgaagtctttgtccggcttctgcagggatgaaccgaggctcatatgtgtatactgtccagccacaaattcaggcctcaaaagcaggacacacccyagagggtcataaacttcagctgcaaatgggtgatgtcaaccaaggacctcaccatggggtggggtcgagcccttctccccacttgcagtcacccgggggc

SEQ ID NO: 75283 - DNA, 201 bp, Bos taurus
tgaagagtttgggagaacattagatctggctgcctcagtttcccctccacttcctctgtaatagctccacagaggggggcccccatccatccacgcccccmccccaattttcttgaggggcagtgacatcttagaggaagaaacaaggatggagcacaaagtcagaggatggagacgtaaagagaggccagagggaactcc

SEQ ID NO: 75284 - DNA, 201 bp, Bos taurus
agacctagagaaccaacttatgattatggtggcagggatagtagggcgtttgtaggattgacatgtacacattgcaatatttaaaatggataaccaataaraacctactgtatatgcagggaaccctgctcagtattatataacaacctaaatggggaaataatttggaaaagaatcaatacatgtatatgtgtaattgga

SEQ ID NO: 75285 - DNA, 201 bp, Bos taurus; identical to SEQ ID NO: 35789

SEQ ID NO: 75286 - DNA, 201 bp, Bos taurus; identical to SEQ ID NO: 35790

SEQ ID NO: 75287 - DNA, 201 bp, Bos taurus
aagtcagcatcctcgcgcgacagagcagccaggtaaatgtttctcttttgccacttttatgtgatgttgttctcagagattttggagggtttaactgtgaygttaagatttagctgaagtcacaccccttttattgagtttccagatgagagcacagcttaaaaaagctgttggccaaatggctcgggtattgtgttggac

SEQ ID NO: 75288 - DNA, 201 bp, Bos taurus
catgaggtactagaatggagagatttgagagagaagagctaaccattcattgctctgtatgggcatagaagttatatctcactcagtgtcagaggaaatgrtcatataacatattttctccagtagaagtgggcagacagcatccagcatccttgaaagataaaagtgccaacctgtcagtttgccagtattttctgttaa

SEQ ID NO: 75289 - DNA, 201 bp, Bos taurus; identical to SEQ ID NO: 35793

SEQ ID NO: 75290 - DNA, 201 bp, Bos taurus
caacccctgctgtctgtgaccagctctggcagggggcctgctgcggtctgcaggcagcctccccttgtcatcctcaggaaaccctggtgccactctgtggrcacagaaggccagcacagacggcaccgcgggaagcagcgccctcagagtggtggggccgccagtgtgctccaaggctgaagcagagaaccatggacccca

SEQ ID NO: 75291 - DNA, 201 bp, Bos taurus; identical to SEQ ID NO: 35794

SEQ ID NO: 75292 - DNA, 201 bp, Bos taurus; identical to SEQ ID NO: 35795

SEQ ID NO: 75293 - DNA, 201 bp, Bos taurus
gctgagcagttgtagcaaggtgtcgaccgtgtatggagagccaggggcacaggtaagacgatccacgggcttatgggcagtgacgagtggtccagtcattyggtcaagggcctagagggaaaggctggaaggtcagcacaagaaagtctaaggtgcaaggacgttcctggtggtccagtggctgagattcctcactccccg

SEQ ID NO: 75294 - DNA, 201 bp, Bos taurus
ctgagtgcagcggggcccacaggaggggaagaagagatcaagggctggagaaccccacccctcctccctgcacagagctcctctctgtctctgggacgcgrcatcccggtagggaggcctggtgttctttcttgggccaggagtgaagctggccacgaggcagacataccgtgaggacacagccttgttactactgataac

SEQ ID NO: 75295 - DNA, 201 bp, Bos taurus
ctctgggacaggcgggagccactgcagggcttgaggcagaggcacgacgtgtctggactttcccactaaagcacgccctgagcgctggttgagactaagcragagaagcagggagggccaccaagcccagggcaggtccagaatgagaacgtggaggtcagtcggctttaacaagggcttccgatccagtggtgacattct

SEQ ID NO: 75296 - DNA, 201 bp, Bos taurus
cccatagaacacccaacgaatgcccccttttttgcatatgtgaacacaagtgtgtctcttccttgaaaccaaaaaagcccagagaaggcaaaagtaaacgytggcctgttatcacctgtggcaatccccagacaagcccattaagcatgattatttcaagcgctggagcttgtcgaggtctcactggcctccaaggggagc

SEQ ID NO: 75297 - DNA, 201 bp, Bos taurus
aaaccccaggtggaagaagttaactacaggatgaccagactacacccaggacttgagctgccacaatgccgagaagtggccacgaagaaatgggaacaaayggaccctggaactaaagatcgactgtacctacaacaaccaagatgactctggtcagaccaccaatggccagtctgaagatgactgtgctatttctgcatg

SEQ ID NO: 75298 - DNA, 201 bp, Bos taurus; identical to SEQ ID NO: 35796

SEQ ID NO: 75299 - DNA, 201 bp, Bos taurus; identical to SEQ ID NO: 35797

SEQ ID NO: 75300 - DNA, 201 bp, Bos taurus; identical to SEQ ID NO: 35798

SEQ ID NO: 75301 - DNA, 201 bp, Bos taurus; identical to SEQ ID NO: 35800

SEQ ID NO: 75302 - DNA, 201 bp, Bos taurus; identical to SEQ ID NO: 35802

SEQ ID NO: 75303 - DNA, 201 bp, Bos taurus; identical to SEQ ID NO: 35803

SEQ ID NO: 75304 - DNA, 201 bp, Bos taurus
ccagcagaggtggacatgagccatctgcggaggcctctgccttttcagggtgatgaaacacccactgtctgatgagcctttacaatcggtcacacccgttycctccccacagctggggaggcggctgaccctacatgcaaagatttcttctttccctcctggaccagatacgtccagacagtcacattccgactcggtctg

SEQ ID NO: 75305 - DNA, 201 bp, Bos taurus; identical to SEQ ID NO: 35804

SEQ ID NO: 75306 - DNA, 201 bp, Bos taurus; identical to SEQ ID NO: 35806

SEQ ID NO: 75307 - DNA, 201 bp, Bos taurus
agaggaacgcacgtggggctgtgccccgtgagggggtgaggggcagagggcagagtcagggtcgtctccgccgctgggaatccggcctgggtatgtgcccraggacagcagagcaagagtcaaacccagagactccaaagccagtgctcgcaacaaggccagggggctgcctctctcccctcctctcgactgttctgtggt

SEQ ID NO: 75308 - DNA, 201 bp, Bos taurus
ttcttcgaagagctgaggacgattctgctcttatttccaccgtcaggggttcctctttagaggatgaccatcaggggccagagcctcagagtgacttgtaygaaaggtcacatgccttaatggggaagctccgccccctctcccaggctggggagaagtaggggccggtcagagcggcagagccctagcaagaaaggcagg

SEQ ID NO: 75309 - DNA, 201 bp, Bos taurus
agccccgccctcgaccttggcatggcagtgaccccggccaagccgcgtccccattttgcagctgcgactttctgacaaccagcttgcctgtttctcccaargatctctgagcatccaggccgcccctctgtgcactgcccctgtcatgcctgtccttccagcacccccaatgtgcccagcagggacagtccttgccacgcc

SEQ ID NO: 75310 - DNA, 201 bp, Bos taurus; identical to SEQ ID NO: 35814

SEQ ID NO: 75311 - DNA, 201 bp, Bos taurus; identical to SEQ ID NO: 35816

SEQ ID NO: 75312 - DNA, 201 bp, Bos taurus
gcctggtgtccgggtgggagccccggagctgggctgcccccggctctgcgggtcctcactcttcctcaggcgggtccagctctcccgcatcgaccttcccrtctgtaaagcagggccaacaacctgccccagagagagctacagtgagacatgcgggggacaggggcagaggggtggccagaggttagatgtggtgctaaa

SEQ ID NO: 75313 - DNA, 201 bp, Bos taurus
ccccgaccccaccactgctgctctgggcctcagtcccctcgtctgacagaggggagaacttcaactctgacattaagtgaatgatgccactgtgtcactcwagtgacagtcaggaccccggccaggcggcccccacaccgccgccccgcccccgccctgagcctgcacgggcctggccacggcaggaaggcgggctcagag

SEQ ID NO: 75314 - DNA, 201 bp, Bos taurus
ctagagccaattctagaaccagccccagcacggttgcctgatacagccatgttccagcctcgtaagaggcaccagctcccaggcccgttccacaggcagarccagccatctgtccagcctcatccacagctccaccctcagcgcctatcgctaagctctggccactcccgactacaaccccagagacctcctccacctcgc

SEQ ID NO: 75315 - DNA, 201 bp, Bos taurus
tcggggatctagtgcctcagtgacaggctgccagcactctctcgggcagtggaagcaggaggtgtgggcacaggcaaggaggcccggattaggagacagayacttgcatgtgaaggcaagctggaaccataagccctcagacactgatggtcatggaaaggcctcagggataacccagcccagaccccaacttccttcccc

SEQ ID NO: 75316 - DNA, 201 bp, Bos taurus
cgcaggcacccggcagagcagaggcatcatgcagcacatgcaggcgcacacgcgtgccgcggccccgcggccccaaagccgaggccgggcaaggagcgccrgcagcagccacctaccatccagaggggacttctcctctgcgttcttgtcctcctcggccagcatgacctcctctgcgagcaagacacagcctcaggccag

SEQ ID NO: 75317 - DNA, 201 bp, Bos taurus
tccatatcaataaatggaccaaacccaacttgtgggccacccgggatcccgaccacaccaggacccagtaccatgtctgacgtgtccctgccaagacgcarccccaaacccggccccgaggagacaggaacagactgagcacttttgacaagagcaccaacccatcctcttcacggtcaagtccaggaaaacaggccgatg

SEQ ID NO: 75318 - DNA, 201 bp, Bos taurus
caaaaagtcactgctgcaagaaactcaccacatcgtctctgcccacccttggttcagagtaactcgtcaaatatggcacctgtttcacgcaaagatggccmagggtttcctcagacggatctgacacacggcggtgatggcaaaaccacggctctgcatctggctgactctcagccacggctgctgctcctcctccaattc

SEQ ID NO: 75319 - DNA, 201 bp, Bos taurus
cagccatctgcagaggacaagaaggatggccggctgcctactacagggatcaagatctgtgactgcgaccaggatctggaggcagcagactttgacatcarccttctggccacttgctctttttataatcgtgttcttcacctctggaagtgggagaacatctgagctggggaagaccttgcttggtttgacatggtaaag

SEQ ID NO: 75320 - DNA, 201 bp, Bos taurus; identical to SEQ ID NO: 35826

SEQ ID NO: 75321 - DNA, 201 bp, Bos taurus; identical to SEQ ID NO: 35827

SEQ ID NO: 75322 - DNA, 201 bp, Bos taurus
tcctggctcccacctgaccccaagctggccaggcctaaggccagccagtccaaggtgggactcctgggatcacttacgtggggaacccaaacttgatgccyaggttgccgttggccaaggaggtcaccaagaccacgggcatcttcatgttgtccttggcatccaggaagctctggtcgtccgacaccgccccaaccacgt

SEQ ID NO: 75323 - DNA, 201 bp, Bos taurus; identical to SEQ ID NO: 35831

SEQ ID NO: 75324 - DNA, 201 bp, Bos taurus; identical to SEQ ID NO: 35834

SEQ ID NO: 75325 - DNA, 201 bp, Bos taurus; identical to SEQ ID NO: 35835

SEQ ID NO: 75326 - DNA, 201 bp, Bos taurus
gctgacctgacagtgcccctccttgctggttctcagcgatgccatttccctgctcttgtgtttctctctctgtcgtaacaagaacacgaactcgggtgtcyggcagacttgggccgcatccagggtctgtcacctacgcgctgggccactgggcaggtgactcaccgcccgcgacccgccccttggcctcctcatctggag

SEQ ID NO: 75327 - DNA, 201 bp, Bos taurus
gtcctgcttcactcttagagcctgcccctccctcccaggacccgccatagcctggctccgcctcgtgtgccaacctttctgggacactcggccagggcagygggcgcaaagacgagaccaccaatttgtcagatgttctgggaacaagtgcccttcacaggtctttaaacggcgcaggcccggccctagtggggaaggcgg

SEQ ID NO: 75328 - DNA, 201 bp, Bos taurus; identical to SEQ ID NO: 35839

SEQ ID NO: 75329 - DNA, 201 bp, Bos taurus
gcctcagacactcagagctttagacacaggaataattctcgggctgttagaagcccctgccccaccgtcccagggaccaggccccccaggccacctcgccrttacctctgcagaccctgaaagatctcatcttcaccctgtttctcccaaggcctgtcttcttgccagatgttagcagagggcaaaggtgggctggagctg

SEQ ID NO: 75330 - DNA, 201 bp, Bos taurus; identical to SEQ ID NO: 35841

SEQ ID NO: 75331 - DNA, 201 bp, Bos taurus; identical to SEQ ID NO: 35842

SEQ ID NO: 75332 - DNA, 201 bp, Bos taurus; identical to SEQ ID NO: 35843

SEQ ID NO: 75333 - DNA, 201 bp, Bos taurus; identical to SEQ ID NO: 35844

SEQ ID NO: 75334 - DNA, 201 bp, Bos taurus; identical to SEQ ID NO: 35846

SEQ ID NO: 75335 - DNA, 201 bp, Bos taurus
ctatgtaccaaaaatactatgtgctcagagtgaagaaatgtgcaacataggtttatctctatgaactcataatctataaggaaagatgtaaaagaatcaarggttataatgtggtttgttactgctcacatcgtgtatgcccagatgctatgaaagcaaagaagagaattctcagttaatccataagatattgggactttt

SEQ ID NO: 75336 - DNA, 201 bp, Bos taurus
atgtatacaacataattgaatcactgctactcccatccctgggcgtccaaaatatacttagaaatttaaaattataaagacaggccaacaatggccaaagmcagatctaaagatgaaaagagaaaatcagcaaatgaagctcactgaaaaatctgctaatactgttgttgaatcctaatcatttattcatttatccattca

SEQ ID NO: 75337 - DNA, 201 bp, Bos taurus
tccttctccattcaaccatggctgaaacaatgatggtaagaacaaattaggaaggtataaagtctccatattacagagtcaaaagatctttttgcataaayaccaagaaatagatcaaaatcaagtgctgatacaaacagatcaaatcaagtgttttccatcgtatttacattttaaatatatcataaaataaaacaaaat

SEQ ID NO: 75338 - DNA, 201 bp, Bos taurus
cttgaaggtttctcaggccatatgatccctgtcatatctcctcaaatctacctcataccataatagcatggtctggttgtgtttcaaaaagttttataaaracaagcagcaggtcaaatttggcctatgggccatagtttaccaacctcctacctagggtaaagctatttacctttctttcctcaaaaactagacttagga

SEQ ID NO: 75339 - DNA, 201 bp, Bos taurus
gccacgcccacacaggtctcggattcagggaggagacaggccacagtcactgctctgctaggatcctctgcccactcacccagcagctggtcatgggaggyaggtcttcatggccccttcagcattttctatgacattttatgcagcacaccgtctctgagagcaagtagtggaaggccagcaaatacatgggctctccgg

SEQ ID NO: 75340 - DNA, 201 bp, Bos taurus
gattaatccttgagagtcagttctgttcctcagctgtccttgtttttgttactgtctccatatgctcacatggtatattctcataaatctgttagagtgartttatgttattgtacctacttatcttcactaggttagccaacatgtgccttttgagttgctgagccttttctgctgtctatagaaatttatttatatgct

SEQ ID NO: 75341 - DNA, 201 bp, Bos taurus
agcccagctctgccaagccccgcgctgtggcctgcacggtgctccctgcacgggggtcacttccgaacacctgggacgagtgtgagtctgagccaagcgcygtaggcagcatccccttggcctgaattccgaatctccatccacccgccttgcacgtagagtgtgcttcctttgcctcagcaggtaccaaactgccagaga

SEQ ID NO: 75342 - DNA, 201 bp, Bos taurus; identical to SEQ ID NO: 35854

SEQ ID NO: 75343 - DNA, 201 bp, Bos taurus; identical to SEQ ID NO: 35858

SEQ ID NO: 75344 - DNA, 201 bp, Bos taurus; identical to SEQ ID NO: 35860

SEQ ID NO: 75345 - DNA, 201 bp, Bos taurus
caaaatatgcttcaccattttgatcatgtggcctttggcaggaaagagtctacatgtgactctgggacaaagtcaaaatgctctaaacgaagtggccttcrtttaaagctgtttggttaggcttggtgggcaaagactcagttccactaagccacagaaacttaggcctctagtgacgttcagtattccatcaacatttca

SEQ ID NO: 75346 - DNA, 201 bp, Bos taurus; identical to SEQ ID NO: 35861

SEQ ID NO: 75347 - DNA, 201 bp, Bos taurus; identical to SEQ ID NO: 35862

SEQ ID NO: 75348 - DNA, 201 bp, Bos taurus; identical to SEQ ID NO: 35864

SEQ ID NO: 75349 - DNA, 201 bp, Bos taurus; identical to SEQ ID NO: 35865

SEQ ID NO: 75350 - DNA, 201 bp, Bos taurus; identical to SEQ ID NO: 35866

SEQ ID NO: 75351 - DNA, 201 bp, Bos taurus
gcatgatcttgtgggtgttgcttgaatcacttaacctttcagagcctcagattccttatttacaaaataggatgaaaatatttacctggtatgtttgttarggagattaatttgagcagtgtttacaaaatgccttgcgtatagtagatgctaaaagtgtagttctctcagcctccccactgtgtaaattaattcatgttg

SEQ ID NO: 75352 - DNA, 201 bp, Bos taurus; identical to SEQ ID NO: 35867

SEQ ID NO: 75353 - DNA, 201 bp, Bos taurus
cttgccttctgcagaagctgctggctgattgtaaccagggctgaataacaagcctggtggctgcaggaccccacgaggataatgttggcccactagtgggytgagttatcttctggagttgggtgttgtggggctgggtatccctaatctaatactggctttctggtggatggaaccagttgctgacaaggcctgcttgaa

SEQ ID NO: 75354 - DNA, 201 bp, Bos taurus
gctctttcgtccttgggtcaccatattcttccctctctttaattttagggccaattctttggccccttttgataccctgcgcatgtctaactatctacccrtttcccttctcaggcatttgggagcccagtctcaaaggtaaaggggtgatggccactctcacttcttcaggctgtacaggggcatcatggggctctggct

SEQ ID NO: 75355 - DNA, 201 bp, Bos taurus; identical to SEQ ID NO: 35868

SEQ ID NO: 75356 - DNA, 201 bp, Bos taurus; identical to SEQ ID NO: 35869

SEQ ID NO: 75357 - DNA, 201 bp, Bos taurus; identical to SEQ ID NO: 35879

SEQ ID NO: 75358 - DNA, 201 bp, Bos taurus
gacaccggggaagtccaaaattgagagttgttttatttggccaacattctgagaacttcaaactggggagactggagtcttaggttgctccaagggactgytccaagaaggcaaacagaggagttagatatacaggagctttttcaacaaagaccaggtagctgaaacattaaagattacagttaactaaagaaaatcaga

SEQ ID NO: 75359 - DNA, 201 bp, Bos taurus; identical to SEQ ID NO: 35883

SEQ ID NO: 75360 - DNA, 201 bp, Bos taurus; identical to SEQ ID NO: 35884

SEQ ID NO: 75361 - DNA, 201 bp, Bos taurus
ggttcaagctttatatttaggttttagtattgactagcccctgaagctttgaagaaaataacataggttaacaccttctacttgatctcaggcttatgcartaaagcttgaaatttgcttacatcattattcttggctagtgtaattataaatgtgattagtaagaataaagtacaattatactgtttataaaaccagtag

SEQ ID NO: 75362 - DNA, 201 bp, Bos taurus; identical to SEQ ID NO: 35886

SEQ ID NO: 75363 - DNA, 201 bp, Bos taurus; identical to SEQ ID NO: 35887

SEQ ID NO: 75364 - DNA, 201 bp, Bos taurus; identical to SEQ ID NO: 35888

SEQ ID NO: 75365 - DNA, 201 bp, Bos taurus; identical to SEQ ID NO: 35889

SEQ ID NO: 75366 - DNA, 201 bp, Bos taurus
aaatatattttcagaaagtcaaactttctcaccactatggttccctctcccaggcctcctcacctcctcacaggcatatcctgagtattcccgggcctgayttctctcaccccttcagacccactcagtctggaggactcggatgctcttatgtgctaatgacttccaaatctacctagaggccctgttctttcctggact

SEQ ID NO: 75367 - DNA, 201 bp, Bos taurus
ctatttatataatatttaagaggtcaaattttctgtattcatattttaaaattgcagtttttctatgacattttaaaaattatgccccataattatccacygtaagaatagtgctgtgtcttgcttggtttcaagtactgtgttctacaacagcaggaactagtttaacaattttcctaagacttcagctggtttcaaagt

SEQ ID NO: 75368 - DNA, 201 bp, Bos taurus
aaagaaatagcagaaaaaacatacatctatgcagtacaacacagtaaggtgagacacgattcataattcaattatctattactaaaattgcatgtgtttartatggggatgatttgtttttctatagctattccttcaaggttctatgacttttgtctcgcttttattttctttatatatggcactattctcttaggcaga

SEQ ID NO: 75369 - DNA, 201 bp, Bos taurus; identical to SEQ ID NO: 35892

SEQ ID NO: 75370 - DNA, 201 bp, Bos taurus; identical to SEQ ID NO: 35893

SEQ ID NO: 75371 - DNA, 201 bp, Bos taurus; identical to SEQ ID NO: 35894

SEQ ID NO: 75372 - DNA, 201 bp, Bos taurus; identical to SEQ ID NO: 35896

SEQ ID NO: 75373 - DNA, 201 bp, Bos taurus; identical to SEQ ID NO: 35898

SEQ ID NO: 75374 - DNA, 201 bp, Bos taurus; identical to SEQ ID NO: 35899

SEQ ID NO: 75375 - DNA, 201 bp, Bos taurus
gaagttgacatatgttaacatttctacgcagcattatctttctcttacgatccatcttttggccctgttaatggccacacttcctctttggcccaacactkcaccataggaaattagtataaagattaagagagtgggccttgcagccgcatagtttagcattagaatctatacccccttttttcttattaaggaggatgg

SEQ ID NO: 75376 - DNA, 201 bp, Bos taurus
ctcttgtgatatgtatgattctgaaaattgacgaaattgactgaatcgcatgattaaaaatggacaaatcgaatggtatgtgcataaatattaccttgatmctaaaaaagggaacaagctagtaagtgcaacaacttcgataaacttcaaaccgttatgttgagtgaatgaagccaaagataaactcatgtatactctatg

SEQ ID NO: 75377 - DNA, 201 bp, Bos taurus; identical to SEQ ID NO: 35904

SEQ ID NO: 75378 - DNA, 201 bp, Bos taurus
ctgcgatggcctcttggaggcctcctggaaagcaagggttcaaaggagaagagagtaggcagactctaaacacaggttcaggagcaatgaacaggcaggcrgtgcggcctgtgggttaaccaaaggacagatgtaattctaactcccttgtgtcatgcatgttgttactacactgtacttcgggtctaccttggtggtaca

SEQ ID NO: 75379 - DNA, 201 bp, Bos taurus
atgaggtggccaaagtactgatgcagacaaatgctgcttgattccatttatatgagttacctagaacagtcaaaatcacagagtcacaaagtacctgccasgggccgaggtgtgagggtgtggggagggggtaggagttaatgttcagtggggacagagtttcagtttaggaaagtgaaaaatttgggagatggatgatgg

SEQ ID NO: 75380 - DNA, 201 bp, Bos taurus; identical to SEQ ID NO: 35906

SEQ ID NO: 75381 - DNA, 201 bp, Bos taurus; identical to SEQ ID NO: 35908

SEQ ID NO: 75382 - DNA, 201 bp, Bos taurus; identical to SEQ ID NO: 35909

SEQ ID NO: 75383 - DNA, 201 bp, Bos taurus
cggtgtcagcaagaaacagaccttgttagtttacattatgtagatcctgacaagtacaaaggcattttggaggtgttagaaaaagcatatgagggtgaggyattatcattcctttctttgaaactgaagagtaggaaatagacccaaaagaaaaacagaaggaagtaaagacttcatcgtatgtcagagccttaatttcac

SEQ ID NO: 75384 - DNA, 201 bp, Bos taurus
atattttcctaatattttaatctttaatgcaaggtacctattagttttgccatattctattaattttaatagcatctcactatgcctttatagctaggctygtacaatttaactacagaatcttctagatgaaaagtggtttcatttttttccatactcatatataataacaactgcatacgttttctaaagaaagtaccc

SEQ ID NO: 75385 - DNA, 201 bp, Bos taurus
ttttgttcaacgtagtaatgaaaggcctagccagggcagttaaaaaagaaaaataaataaaaggcatccaaattggaaaggaagaagtaaaattgtctctrtttgctgatggcctggtattatgcatagaaaggcctaaagacagcaccaaaattatatatatatatatctgttagaactagtaaatgaattcagtaaagc

SEQ ID NO: 75386 - DNA, 201 bp, Bos taurus
gaacctgatggtatgtaaatttgaaaagaaaagaaaaacataattaaaagagtttgaaaaaaatctggacaagatttactgctaccaaaagaaaccttccraatgcactctcacaatctcttgattgatattcttgagataaaacattacccccagagagggatgtcagtctcttccccacttaccagagaggcactcgac

SEQ ID NO: 75387 - DNA, 201 bp, Bos taurus
ccagacactgtccctttctctcttctgccacctctgccaactgctgtttcctctcccctagtgaaggaggacataaaattggaattatggtgaataacctrtagtttgataaaacatgttttgtacaaatgaagtaattacagtcccgtttgaggaaatacttcttacaacccgggaaccgtccttagtacttatgtgtac

SEQ ID NO: 75388 - DNA, 201 bp, Bos taurus; identical to SEQ ID NO: 35915

SEQ ID NO: 75389 - DNA, 201 bp, Bos taurus; identical to SEQ ID NO: 35916

SEQ ID NO: 75390 - DNA, 201 bp, Bos taurus; identical to SEQ ID NO: 35923

SEQ ID NO: 75391 - DNA, 201 bp, Bos taurus
gcttggaccttcagggtatctttaagtatttcattcgtttctgtccatatctactggacttcgagcttcttgaaccaacaagtggattttattcaactccrtcttcctggtgcctagcacagtctagaagccattaggcttgttgagggaaggaagagaaggaaagagggagatagaaacggaggggaaaggaaagaatta

SEQ ID NO: 75392 - DNA, 201 bp, Bos taurus; identical to SEQ ID NO: 35925

SEQ ID NO: 75393 - DNA, 201 bp, Bos taurus
aatgttttttattttagttgttatcttagtaatgaaatatggactagagacgtgtctggctcattcattatcaactaaatgtcctagcaaaaataaacctrttttacctgccactctagaggacagctacatcatccactggtttgatttatcattgcttatgaaatgaagatagatgttactggctgaaaaggtacaaaa

SEQ ID NO: 75394 - DNA, 201 bp, Bos taurus
atggatgcatgggtggatgagtagaaggatgaatgagtagagggagggatgggtggatggatggatagatctgcctctccccagtaggccatggggaaaarcagtgtcctgggggtttggagtctaaggtttttggctccagttgagccactactggactttgagcaagtaactaaatctcccagtgtggcctgtttccta

SEQ ID NO: 75395 - DNA, 201 bp, Bos taurus; identical to SEQ ID NO: 35926

SEQ ID NO: 75396 - DNA, 201 bp, Bos taurus; identical to SEQ ID NO: 35927

SEQ ID NO: 75397 - DNA, 201 bp, Bos taurus; identical to SEQ ID NO: 35928

SEQ ID NO: 75398 - DNA, 201 bp, Bos taurus; identical to SEQ ID NO: 35929

SEQ ID NO: 75399 - DNA, 201 bp, Bos taurus; identical to SEQ ID NO: 35930

SEQ ID NO: 75400 - DNA, 201 bp, Bos taurus; identical to SEQ ID NO: 35931

SEQ ID NO: 75401 - DNA, 201 bp, Bos taurus; identical to SEQ ID NO: 35932

SEQ ID NO: 75402 - DNA, 201 bp, Bos taurus; identical to SEQ ID NO: 35933

SEQ ID NO: 75403 - DNA, 201 bp, Bos taurus; identical to SEQ ID NO: 35934

SEQ ID NO: 75404 - DNA, 201 bp, Bos taurus; identical to SEQ ID NO: 35935

SEQ ID NO: 75405 - DNA, 201 bp, Bos taurus; identical to SEQ ID NO: 35936

SEQ ID NO: 75406 - DNA, 201 bp, Bos taurus; identical to SEQ ID NO: 35937

SEQ ID NO: 75407 - DNA, 201 bp, Bos taurus; identical to SEQ ID NO: 35938

SEQ ID NO: 75408 - DNA, 201 bp, Bos taurus; identical to SEQ ID NO: 35939

SEQ ID NO: 75409 - DNA, 201 bp, Bos taurus; identical to SEQ ID NO: 35940

SEQ ID NO: 75410 - DNA, 201 bp, Bos taurus; identical to SEQ ID NO: 35941

SEQ ID NO: 75411 - DNA, 201 bp, Bos taurus; identical to SEQ ID NO: 35942

SEQ ID NO: 75412 - DNA, 201 bp, Bos taurus
tcttcttaacttcctgaagggttgggtggatcgactgtttggcagacaaccaagggattccactgttttgcccagaatgcatcttcaggtccacatagttycagggaaaacaaccaaaataaagaaacaagcccacagccttaccaatcgatggatcagaaatataactgtctggggatggggtgagcggagagagtctgg

SEQ ID NO: 75413 - DNA, 201 bp, Bos taurus; identical to SEQ ID NO: 35943

SEQ ID NO: 75414 - DNA, 201 bp, Bos taurus; identical to SEQ ID NO: 35944

SEQ ID NO: 75415 - DNA, 201 bp, Bos taurus; identical to SEQ ID NO: 35945

SEQ ID NO: 75416 - DNA, 201 bp, Bos taurus; identical to SEQ ID NO: 35948

SEQ ID NO: 75417 - DNA, 201 bp, Bos taurus
ctccagtattcttgtctggagaatcccatggacagaggagcctagagggctacagtccatggggtcacaaggaagcaggcacactgaagcgacttagcacrcatgtactgagatttccgttttcctcagagaagtaggggccactgtgacgggggaagggctggaaatgtgttctagtcagagatctcaggagaacttatt

SEQ ID NO: 75418 - DNA, 201 bp, Bos taurus
ttcagagtttgcctagcaacagtgggcagagaatcccgtgagaagagccacaggcgctgctccaataacaaagaacggccaaggcggaaataaaaaatagragaaatccaggcgcaggctgagacggcgaaacttttctccagctcttcattgtgcaggagcctccaccactggggatccgtttggccctgtgtaggaggc

SEQ ID NO: 75419 - DNA, 201 bp, Bos taurus
gtcatgagttaaaactcagtttataagaaattatctaatatagagattcattggtgccctaattgttcctcgggtgtcctaagcaatagtatttgccttgraagagaaggcataggaatgatacagagaaggtgaaactgaagtgtacattttggaagtccttggctcatttaaatgtcttctactttatccttccttcaa

SEQ ID NO: 75420 - DNA, 201 bp, Bos taurus
caccgttcaaagggggaagtcaagcatgttcgctgtcgtccaccagcctccctccccctccacattccactccaggaccactgctgacaaccgtaaaatcraattcctggcctggaaaagctgctccttaaaggcagatgtgcaaacaggagtgttaggaggaaggcctatccctcgattcagaggctctggtctcaggat

SEQ ID NO: 75421 - DNA, 201 bp, Bos taurus; identical to SEQ ID NO: 35950

SEQ ID NO: 75422 - DNA, 201 bp, Bos taurus
gcctgtggtacagtggctccctaagcgtggccctgccccatctttctctaaatatatttttgagcagtgtcacagaaagagatgtggagtcatggaaagayccagcatttggcctgaaatgatctgggctcaaatcccagcttcgcctccgagacgtcccccacatgctctgagaataataattcttacccaccccatccc

SEQ ID NO: 75423 - DNA, 201 bp, Bos taurus; identical to SEQ ID NO: 35954

SEQ ID NO: 75424 - DNA, 201 bp, Bos taurus
cgtagcagtcacacaccttgctgtcaggtgcttgaggtatccaggcttagtgggcaagataacagtttgctgagcacagaaaaggtattcactctatagcmaaagtcatacaatgagaagacaaccactgctgaagtgactcctgaaaagtttttcagagaaataaaacatttcttcagtgtttctaatgttttgaagcat

SEQ ID NO: 75425 - DNA, 201 bp, Bos taurus; identical to SEQ ID NO: 35957

SEQ ID NO: 75426 - DNA, 201 bp, Bos taurus
gcctcggaagtccacacagacaagtctttcagctgcaggtatcctgtggcattgactccattccttctgttctgctctggccctgtttgggcacatctgcygcccatgggatgtggagaaatggtgcttttcagggtatactgtagctgggccacaagtgctgccccgtcattcacctaagtgtctgatctttggaggcca

SEQ ID NO: 75427 - DNA, 201 bp, Bos taurus; identical to SEQ ID NO: 35958

SEQ ID NO: 75428 - DNA, 201 bp, Bos taurus; identical to SEQ ID NO: 35959

SEQ ID NO: 75429 - DNA, 201 bp, Bos taurus
ggaacttcctggttgccagtcacttttcgtggacctgtggttgggtcgtcctcggttttcccctttccgtcactcattcagctagtcaccaggccctatgrgtattctctcctatatagcccttgaatcctgcttttctctgttcccatgggtgtaatcccagtcctggccacgtcgccccctgggtgactgctccaactc

SEQ ID NO: 75430 - DNA, 201 bp, Bos taurus; identical to SEQ ID NO: 35960

SEQ ID NO: 75431 - DNA, 201 bp, Bos taurus
tcatctacttaatgacaaattaataaaataattcatatgttcactatttcttactctttaaactttagatgactagtgttctctgtatctctggatacttrcgttattctagtgttttcctatattttcactgaattttgaccacttttttttttttttaaacaaacactgtttataaatactatgaccagaagttgagta

SEQ ID NO: 75432 - DNA, 201 bp, Bos taurus
ggcccacatggaaactaaagacaccagctgactaccagcatccacaaccagacatgtgggtacagaaacttccaaatgactcccacctccagcattctagyactttactgaggttacagacataaaggaagaggtaagtcatgcttactgtatcctttctgatttcctgacagaatacatgaacaaaacaaatggttgttt

SEQ ID NO: 75433 - DNA, 201 bp, Bos taurus; identical to SEQ ID NO: 35961

SEQ ID NO: 75434 - DNA, 201 bp, Bos taurus
cagcaccaataattatattattctaacacgactgtttccataataaccatgtcactgggagggagaggcaattccattacgtgagagtgggggaagggtayggagcaaagaaaacagcagatgtctggtagcccatgcacatcaaggactggaaaacaatctcttgctaggtttagcaaaaccttgtttatgcagtcatcc

SEQ ID NO: 75435 - DNA, 201 bp, Bos taurus; identical to SEQ ID NO: 35963

SEQ ID NO: 75436 - DNA, 201 bp, Bos taurus; identical to SEQ ID NO: 35964

SEQ ID NO: 75437 - DNA, 201 bp, Bos taurus
ccgagctgagctccctgtgctgtacagcagcttcccactcgctatttccacagggtagtgtatatatgttaacacttctttcccagtttatctcacccccycttccccacgtgtgtctctgttcctgccctgcaaatagattcatctttaccattttcctagattccacacgtatgcattaatatatgatacttgtttttc

SEQ ID NO: 75438 - DNA, 201 bp, Bos taurus
gagagagagaactagccatttgatctggatcaattcaatggttaatttattatttatttaacaaacatttcttaacaccgatacagggccaagcactgggygtacaatggaaaacaaaatgcaatgtctctctacaagggattatggtgtaatggaacataggaagcagacataactttttcagtgtggttttccaggccc

SEQ ID NO: 75439 - DNA, 201 bp, Bos taurus
acagaggcttgaaagcccatggctaaaggacctcaggagatttggagccatgtaagcagaagagaaacacttggcttgatttcaccattcttccacttackttaaaacggcaactgcaaaattcttattgaacagattgagtagctgtctggtttgattgtagcttcagcaaatctgtgcctttgacctccatcgaattgc

SEQ ID NO: 75440 - DNA, 201 bp, Bos taurus
attttatgtgtcaaagaaggaaatatttggaacagatttcaattgcaagtctcatcactgctcttaaacaaggctttcagtgtgccctactggctgtgagrcattcctccttttacaaattttcaagtgaaaaacatagaaaaagatggttcattcagagcctagaacagagaaatcgatatgccagggaagagagtagga

SEQ ID NO: 75441 - DNA, 201 bp, Bos taurus
ggaaatagaagaacattaaataaaccataatagcaagtattatgaacttataaatatatacacagtaacttctagaaaataacttctatgatttaaatttkattatataagtgactatttcaaaattgctgggctaaaactaaattagctcttcaatatggttaaatggttgttctcggtttgtgcttacaaacctaacaa

SEQ ID NO: 75442 - DNA, 201 bp, Bos taurus
accccaaattctctctcttaggagatctgaaactgcaagccgctcttcattaagaacttgtttttcactggaaagcccattccaaacgttggccacagttyactccatctgatccacgctttttatctcttctcaaccagacaaatgcataataaagcttcatttgctgcatgatcaggcaatccattttcaagactggat

SEQ ID NO: 75443 - DNA, 201 bp, Bos taurus
agagggccccagaagttagagctggtacctcaggaaacaggtcaggatggagatgcaagtggtgaattatgaggaaagactgcatttcccagcctttcttrcagttaagtttggccatatgactaatttctggacaatgggatataagtagaagttttctgaagaaactggaaaagttccttcaagaaaatggactcagct

SEQ ID NO: 75444 - DNA, 201 bp, Bos taurus
gggccatttaaatgctatatgttaactataagaagaccgggtataaaggctaggttacaaagtggagaagagaaaactgtgattaggaggaaaaagtgatraaatggccatagtaggcagtgttacttactgtgtttgacaggataaaccacaaaagaattgaaggatatgcactttattgttaaggattctacaatctaa

SEQ ID NO: 75445 - DNA, 201 bp, Bos taurus
cacacaaagacattggactgatcagaaatgctggatgctaccagttgaagagtgagcaggctggctagtctctcactctgagaaatgtaaggccatgggaratcccagcgctctatatcttggatcacttttcctgtgcccttccattggattcccaggtctgtgttttccagattactccagtcattgagggccatctgc

SEQ ID NO: 75446 - DNA, 201 bp, Bos taurus
agcactgcaggactgcctttgctgcttggaacggcttcccagactggccaaatgctggaatctaaatcctagtatcaggattagaaatctgtggtttcttraaatcatggatataggccagggacttttaggctttattgttgttgtttagttgctaaaggtatttaactggtcatggaccaccctcatgttcatcaatta

SEQ ID NO: 75447 - DNA, 201 bp, Bos taurus
ttttttttttttttaaataaaatatcaatctaggccccagtgcacatcaattgaatcaaaatgtccactgggagggcctgaaagctgatatcctcaacaaktttctgccgatgatttttggtttcaaacagggatgagaaccactgggagagactaattctaagattaaaatccacctcccagaagtggccacccctcaaa

SEQ ID NO: 75448 - DNA, 201 bp, Bos taurus
cgcctcacttgtccctccctgacaggaccgcgggtctgtgtctccatgggttggctcttgttctagctctcgtttcgggggagaaggcccattgacctctyccgggctcctgctttttttcttcctcacccttgctcctctgcatcatcatctttctctcactcttgaagggctggtccagtgcacacaccaggccaccta

SEQ ID NO: 75449 - DNA, 201 bp, Bos taurus
cactcagttttacatctgaacaatgaacagcaatgccgggaccaggtggacagtgaggacgagggaaaggatgacagagaaagagatgtttcaaggcctamcccctgagacttcctcccgtatccccttcctggtgttccggtgcattctgctgatgaatttagatggtgatgtctacttttaattttatctgcagaaaga

SEQ ID NO: 75450 - DNA, 201 bp, Bos taurus
gcaaaatcaacaataacttcagcgatttttctaaagagtatagctagcaacagatttttttcaggaaaaagcgtttcatcactgtcatagtttagaaaagytagcacatggagataataaagaacagacagacttttcgttgattttatcattgcttttaaattctcggcaaaccatgtacctgcttattacttgtacttg

SEQ ID NO: 75451 - DNA, 201 bp, Bos taurus
aagaataatattttttatgtagccggattaaaattattatgtataacaaaatggatagtaattccttaatgtaattcgataccagctcatatacaaacttyagaattgtttccaaagtatgatttacaactgatttgtcctcgccaagagccagtcaggactgtgtcttacatctgatgtctctaaggtctccttactcaa

SEQ ID NO: 75452 - DNA, 201 bp, Bos taurus
ttaaaaaggagcagaagaatgcttatgaggtgccagtcatattttattttttaatctgagtaaagattgttgttttgtcactaagtcaaggccaactcttktgcaatcccatggagtataacctatgccagggatactccaaggatatctgtccatgggataccccaggcaagcatactgcaatgggttgccatttcctac

SEQ ID NO: 75453 - DNA, 201 bp, Bos taurus
agcaaatcatttgcaaagcattgctagttctttagttattacattatattagctccaaatatatgataattactgcaatagaacactttgatattccccgsactttctcattcttaccccactcagtagacccaggcatcctgaccaagttgtcatactcctcttagaagttagaagtgtggaaataaatgaagatcaacc

SEQ ID NO: 75454 - DNA, 201 bp, Bos taurus
ttagttttgacacttcttggacttcgaatgaatgaaagcctcataggaggtgacttttggtgtctggcttttttcagtgaacctaatttctgtgagatacmttcatactgaagtatatttcagtattttgtcctcttcatcactatgtagttttccactgtatgaacatgctactattaattcatttgctgggcacttgag

SEQ ID NO: 75455 - DNA, 201 bp, Bos taurus
acttctggcctctctcccagcaccaatgtcacttcttttctccagtgaagtgaaatgactggggctcacagacaccagcttgaaagtgcctgaatgacccraggaggccgctgtgactgtattagtcagccgtgtctgactctttgccacccacggactgcagcccaccagcctcctctgtccacgggatttcccaggcaa

SEQ ID NO: 75456 - DNA, 201 bp, Bos taurus
gtaagctttaaatgaaaatacttttgactatgttagtgatggactatgttagtgatgaaccaaataaggaagaaaaggggagaaaactagaaagataaagraggcacaatggaggcagaaggagagaaagatagatggtaggtaaagaagaaagtaaggagggagaaaaactggactgactttgaggactaaatccttact

SEQ ID NO: 75457 - DNA, 201 bp, Bos taurus
gtgaacttccttgttttaaaaagatgtgggggcttctctttcccttagaacaaaatctgaattgctaccctgggtttgtaaggctctgtaccatctggccsccgtctagctctctggcatccactgcctagtgctactctctcatttgttaactcagctccaggtgtgttgatgctcttctggtcccttgaacacacaaag

SEQ ID NO: 75458 - DNA, 201 bp, Bos taurus
ttctatggcagttattcctgaaaagtcaagttcagattacaaagaaaaaacattagaaaactaaagttctatatgaattctatggccacttcggttattgraggtataagagctcaaataactttccacctaagtttgttgttgtttagtcgctaagtcaggcccaattctttgcagaccctgtggactgtagcccaccag

SEQ ID NO: 75459 - DNA, 201 bp, Bos taurus
gcgttctggccgagcggagggcgaggtcaagagttggccgtctgcacaggtgggccgcggcgggagggcaggggcgcgcccgcggcgggccgggtaggcgygcgagactcggggcggggtcagaggggaacgaacggcttcctgagtggcttttcgccgcttccggggcctggcgcccgcgcgaggaagacggtgttcttg

SEQ ID NO: 75460 - DNA, 201 bp, Bos taurus
atgtatgtatgtatcaatcccaatcttcccattaatccctcccctctctgcccccaataaccataagtttttttccataggtttattttttacatatgtgmctctatttctgttctatagatgagttcctttggagcctttttttagatgccacatataagcaatatcatatgatatttgtctttctctgacttgcttcac

SEQ ID NO: 75461 - DNA, 201 bp, Bos taurus
agcaagctctgaataaacagtcgttgcctgttccgatttggttggcccttgtttattccacactggccccctccatatcttcccctctccagcacagagaygatctagcatacagattgggttgtaggaagagactgaagcccagaaatctgcatggggatgatgggacttgagctgtgctttgaggagaagcatgattca

SEQ ID NO: 75462 - DNA, 201 bp, Bos taurus
tgctggcttttggattccagagaaatttgtgtgttcattatctatatctatgtctgtatctgtttatgtctgtgtatcccttttctttatgttcaaggccrtcgctaagccgaaaacaatgcttggtttcctctgtgaggcttcttacggggtgagaaggtgaagctggtccctggccaagacccatctgaaagctgtggg

SEQ ID NO: 75463 - DNA, 201 bp, Bos taurus
taagcctccattaagatttagtggtaagaaggcactcttggcatttgtggatttgatagtcatgatttcagtgtttgggcctgttcctaatgattcatackgtaatgtgaaatttctgaggctcaactggaatggtgggcagtcaatctgtgcttttacagggcagccacatgccacagggttgacagagggcccttgctg

SEQ ID NO: 75464 - DNA, 201 bp, Bos taurus
cttcttcctttgctctctggaggaaatgtcactggctcttgcagttggggcagaaaccaccatagggttcctgggcctttgagagggcagtgacaggggargctcttggaacccaaaaaccccgcgcacatagcgtgtcgggcgcctctccaggctgggccccactggaccatctgttaatccacttttcctcctgctgtt

SEQ ID NO: 75465 - DNA, 201 bp, Bos taurus
cccattctcactgctcagcccgttttggctaccgaacctgacaattaatgttgaccctggaaacactgacctccccagtggaggccttcatctgctgggcrcatctggcaagcagtcagtggtgcttacctggattccttgattaatgtagatgtaaagattttatcaaggctcctggcggccgggcttcaagatgtaatc

SEQ ID NO: 75466 - DNA, 201 bp, Bos taurus
taccctgatcaccaaggaacagaccggggcgggtgggggttaggttttgaaaagacatcaggagagccatgaaatgcagtcactgagagactgagaaatgmggccctcggggtggtagctcagggcctccaggtgacggtgacctctgctgactgcctgctggggtcagggggtggctcacacccacagtacgtggccaca

SEQ ID NO: 75467 - DNA, 201 bp, Bos taurus
ttctgtttccagataattggtatgtttagggttaatggttttgtgtgtattggttttccctctacagccctgctgtgaaaactctggatggaatgcttatmtatacacatctctagccttcccagtgcctgcccagatctggctcagcaggtccacagaaccctctatttgtgaagaggacgtggctgccacgagtcagcc

SEQ ID NO: 75468 - DNA, 201 bp, Bos taurus
agcctaatgtcaaacagagcaaaacaagggaattgttaggaaaaatcatatcaactacctcacccctgaaaataagtattagcagcaatgataataatacyaaatgaataataaaagctgcaagtgggcacctccataggccagacaataagtaccatttcgctttacctttcgacagtcctgccaagtaagtggtaggat

SEQ ID NO: 75469 - DNA, 201 bp, Bos taurus
gatgatttctgacattttataagttaataatgtcatgtccatataatcaaatgtttgtgggcatctgcactcatgcatttcatgactacttgctggagaartaaaacgatcctaccaacaccagacccctccataacaatacggaagtgggagagaaaacagtttaaaattgagtgctatcagttttacattcataaaaaa

SEQ ID NO: 75470 - DNA, 201 bp, Bos taurus
accaactgagctatcacatattcttgattcctccttttgtgcctgtgcgaagcatttataggcattcaattatttatcacaggcctactatgtatcaaatyccataaaggatataaaaaatacataatatacagtctatagcaagctatgaatgaatgaggccaagacagataaatattcaacatcactaaagagcatcca

SEQ ID NO: 75471 - DNA, 201 bp, Bos taurus
ggggcggggggagggaatgagaggttagatgagccattgaaagtcatagaaaacaggaaatagaatctgagtctcttgacttctagcccaggggcctaacsaccaaactgaattatagcctcagagtatcaacagatcactgaccagcactgacaagtcaggttcatggcactcattcattcacacttccacatggccaaa

SEQ ID NO: 75472 - DNA, 201 bp, Bos taurus
gcttgggtccagtaacacttttgcccttttgaagcaagaagactgacattttccagcactaatgctatgtttattcaggccttaggatatcatttcattgrtcattactcagttctgtgaattgtgctcttgaaagacattataccttgcttgttgtctcttaaatagaaatgaaaaaattagcatataggatatcatgac

SEQ ID NO: 75473 - DNA, 201 bp, Bos taurus
ttgatttgctgacaatctttggcgttacctaacttgtagaagcatctccctgatctgtgccttcatctttacctaatgttctccctgtgtacatatacctktccagatttccccttttttataaggacaccagttaaattggatcagggggcccactcaattcccatataaccagcattaaccaatgatatctgcacaaaa

SEQ ID NO: 75474 - DNA, 201 bp, Bos taurus
tggaatccattgctcatgaatcagaggaagagaagaggtgattattccgagccaagaggtcattaagaatccttgcttcggtcagaaggccagtctcctcsttagctctttctccagcttcctggctgtggtctttcttctgggcatgctccttggagctaccaccttgtagggccagggatgtaggaagtggtctgagcc

SEQ ID NO: 75475 - DNA, 201 bp, Bos taurus
acagtcacttccaacttaaaatgaatttattgtttttaaaatatttatttattcctttggttgcgtcaggtcttagttgcaggcaggtgggattttcaccrtgtcatctttctgtttggcttatggactcactctctagatgtggcccgcaggctccagagcactcaggcacagtggttgctgcgcacgggctcagttgct

SEQ ID NO: 75476 - DNA, 201 bp, Bos taurus
cttcccacagtcagcatcctctcattaaagtcttgataacaccaaattgctttttaaatgcctcgtactctataaagctgatgagcagtgaaataaatctrttcagtcaacggagattgggtttattctcaggggtggcaggaggtgggtacgtcaaggagaagggactgaactgaatccttttcacaagaaattatttca

SEQ ID NO: 75477 - DNA, 201 bp, Bos taurus
tcagcagtaggggtctcctcaggcatgtgtctctttctatcagggagataaatttacaggagcgcctacctaacatttatcttggtcccacaggccagaamgtatacatttttctcccctagatcaatcactggagagaagaacggggttaccatttttggtttgggccagtgtgggtcagagggaagggcccaacctccc

SEQ ID NO: 75478 - DNA, 201 bp, Bos taurus
aggccacagcagagaacactggctcttgctctgggtgggaagggaaacaggagggtttgagcagagacgtgacatgaacccgtgttgcttctaaaggatcyggccttgcctgctctttcgagaaaagatgggagaggtaagggggctgggaacaggatggctggtagccgtggaagtaaggagtcagatttctggatctat

SEQ ID NO: 75479 - DNA, 201 bp, Bos taurus
gggacagagcacagacatctggacctaagggtcaaacagccctgtctgggaatctctgtaatctggcatggagccagccagcaagtaagaggccaggccaygcaaggtgctcagagaagccacggtgccaagtacaggcagcagctgaacgaggagatcacagggctcagtcactccatcatgtccgactctttgtgaccc

SEQ ID NO: 75480 - DNA, 201 bp, Bos taurus
agaagccctcacaatgcaactagagtgtagctcccatcaccgcaactagaaaaagcccacgtgtggcaacaaagacccagtgctgccaaataaataactarttaactttaaaaacattattcaaggagaaataagcccaacacaaaagaccatactatgtgattccattttatgtaatctcaaaaaggcaagagctataat

SEQ ID NO: 75481 - DNA, 201 bp, Bos taurus
ttggaggctcagattcacagcattcaccctgttggttccaaactcgggtgaacagatttctgagctcctggcaacctgttccagtgtggctacagagggtmatctggagtcacaccgatgggcctccaatcaagggctcccttgattaggacagttgtggtctgcccatatctcagctctgcttgtgcttctgccctgaca

SEQ ID NO: 75482 - DNA, 201 bp, Bos taurus
taacatcaagaaataaaccaatggaaaatcagacagtttagattatcatctgatatgacttttatggaaattaaaatctgtgtataataaaaattttactrctaagattatggaagatgaatgctttagacatgaaacgttatctaccatcttcataaaagaaaaatactaaagagaaacttgtctccttaaatagcatgt

SEQ ID NO: 75483 - DNA, 201 bp, Bos taurus; identical to SEQ ID NO: 35971

SEQ ID NO: 75484 - DNA, 201 bp, Bos taurus; identical to SEQ ID NO: 35972

SEQ ID NO: 75485 - DNA, 201 bp, Bos taurus
tgtcgcactccaaaccattcagcccctatggccccagcccagccctgttggcaatccaggaaaccccactcttcctgcccacacctagctccatctgaggrcttgcaggccaccctcgggtgaagggagaaaacagatgttgctggtttccaggagcagttggctgtctgtcctgtgcaggtcagacggacacactgaact

SEQ ID NO: 75486 - DNA, 201 bp, Bos taurus
cttactctgcgggcactaaccccatcatggagtttctaccctcgtgacctcatctaaacttgattaccttctaaaggccctgcctctacatactgtctccrtacactggggtaagaattctgttgacactcagacatggagtttgtaactcccagcagctccaaaaacccttgagtggccaaatgatttcctttaggaata

SEQ ID NO: 75487 - DNA, 201 bp, Bos taurus; identical to SEQ ID NO: 35975

SEQ ID NO: 75488 - DNA, 201 bp, Bos taurus
tgaagtcaccagtgtaggacttggatgcgacagaacttgtgtctgtatgagaggagacaccagagaacactctccatggcagacaaagaagaggtcccgcragcacacaccaggccagcggccaccctcaaaccaagagaagagccatagaaacctgcctcaccagcaccttgatcttggacatcccagcctccaaaacga

SEQ ID NO: 75489 - DNA, 201 bp, Bos taurus; identical to SEQ ID NO: 35976

SEQ ID NO: 75490 - DNA, 201 bp, Bos taurus; identical to SEQ ID NO: 35977

SEQ ID NO: 75491 - DNA, 201 bp, Bos taurus; identical to SEQ ID NO: 35978

SEQ ID NO: 75492 - DNA, 201 bp, Bos taurus; identical to SEQ ID NO: 35979

SEQ ID NO: 75493 - DNA, 201 bp, Bos taurus; identical to SEQ ID NO: 35980

SEQ ID NO: 75494 - DNA, 201 bp, Bos taurus; identical to SEQ ID NO: 35981

SEQ ID NO: 75495 - DNA, 201 bp, Bos taurus; identical to SEQ ID NO: 35982

SEQ ID NO: 75496 - DNA, 201 bp, Bos taurus; identical to SEQ ID NO: 35985

SEQ ID NO: 75497 - DNA, 201 bp, Bos taurus
gcctgcctcagtcagctcttctgtctcacctggaaaggcttgtcttcactctcatggtctcttgagtttctgtgtgcacttctgcttggtccagactgctygatgtcctgggatggcagggcctttggtgcagggcgcgtggtggggagcaggtgtctccgcgctcagggctttgtctgcgtggcctgccgtcctcggagg

SEQ ID NO: 75498 - DNA, 201 bp, Bos taurus
aacatgataaaactcaactcggcagggccagcctggggacttcctgagaccagaggatgggtaagcagggggctaggaagggagcgccccaggcaaaggtyaggagggccagcaacaccaaacagcactttggctatttctggggacctctgtcaccccataagatgggcccttcttgccaagtctgcctctggttggcaa

SEQ ID NO: 75499 - DNA, 201 bp, Bos taurus; identical to SEQ ID NO: 35989

SEQ ID NO: 75500 - DNA, 201 bp, Bos taurus; identical to SEQ ID NO: 35999

SEQ ID NO: 75501 - DNA, 201 bp, Bos taurus; identical to SEQ ID NO: 36003

SEQ ID NO: 75502 - DNA, 201 bp, Bos taurus; identical to SEQ ID NO: 36004

SEQ ID NO: 75503 - DNA, 201 bp, Bos taurus; identical to SEQ ID NO: 36005

SEQ ID NO: 75504 - DNA, 201 bp, Bos taurus; identical to SEQ ID NO: 36006

SEQ ID NO: 75505 - DNA, 201 bp, Bos taurus; identical to SEQ ID NO: 36009

SEQ ID NO: 75506 - DNA, 201 bp, Bos taurus
tttctcctcctcaaagccgcgctgcgggtctgtcgggagccttgtttgcttcctcccacagctgtctacaccgccggggccaaatggggggccctttctgyctggatccaataaatcgctcaccccaaatttagaaagataagaagcgacacaaatcatccggaaggaggccccattcgggcattctccgtcccacctagg

SEQ ID NO: 75507 - DNA, 201 bp, Bos taurus
gcctcatctgacacaaacaaccatgcctgggacctgggcgatacgttcagagcagtgtcagtgcagaagcagatacgggacatcaacgaaaaatgtccagyggcccatctcaactttttccccccaacagttcagtatgactgggggattcaataatctgcaccacaaaacccactggctgggcaccagaaactccacact

SEQ ID NO: 75508 - DNA, 201 bp, Bos taurus; identical to SEQ ID NO: 36010

SEQ ID NO: 75509 - DNA, 201 bp, Bos taurus
taaatataccacatcttctttatccgttcatctgtcaatggacacagattgcttccatatcttggctattgtaaacagtgctgcagtgagcactagggggygtgaatcttttcgaaatatggtatatttatacaacggaatattattcagccacaaaaaagaatgaaataatgccatctgcagtaacatgggtgggcctgg

SEQ ID NO: 75510 - DNA, 201 bp, Bos taurus; identical to SEQ ID NO: 36011

SEQ ID NO: 75511 - DNA, 201 bp, Bos taurus
ttattttctccaactcaatgtattttgaacagaagttaacagtttcttgcatctagtcctgcaaaaactgtgggcctgacaggcctcagtttcacctcttygtattccctgccgttggcaagcatctacacatctgatatgcacagctaagcgtttggccttagtttgcctcattcctgagttcccacctatgtcaggctc

SEQ ID NO: 75512 - DNA, 201 bp, Bos taurus
tttttaaaatgtatctgttgcactttatatattatataacaggtaatacagttaaagcaatgaaatgaattagaaaaaagacgataagtccattggatttrgaactcagttgtttgtaggaaatctttacatagcaaaactaagcatctatgctcacaggagagcctctcaaatccaaatttttttttttcatttaaaatt

SEQ ID NO: 75513 - DNA, 201 bp, Bos taurus
ccaccaccaccaccccgaggccagtggcagcggtctgcagtcaacagctggtctcctggggatcttctcctcccttccacatctctgctgttaggagactygggccaggaatcatcgccactccccaccctgtaaacccaacccaaatggcatctagatgcccactgtggtgaggatgaagcaggtctttactgaatctgc

SEQ ID NO: 75514 - DNA, 201 bp, Bos taurus; identical to SEQ ID NO: 36013

SEQ ID NO: 75515 - DNA, 201 bp, Bos taurus; identical to SEQ ID NO: 36016

SEQ ID NO: 75516 - DNA, 201 bp, Bos taurus; identical to SEQ ID NO: 36017

SEQ ID NO: 75517 - DNA, 201 bp, Bos taurus; identical to SEQ ID NO: 36018

SEQ ID NO: 75518 - DNA, 201 bp, Bos taurus
gcagaattccagacagaaacgctcctcaggcctgaggtacggcccagctctcctggggtttgcagtctgcaccctgcccagctccacctccttcccaggayggcacctcacacacccagggccctgcatcctgggtcaggggcctcctgagggcactagcacagcccctcctctcatccttggaccaccctgcggtacagc

SEQ ID NO: 75519 - DNA, 201 bp, Bos taurus
catcagtttttcacttaccaattggttttctgccaattctcagaagaaaaggtttagttgtgaaagactgctttaccgtgctgaaccctaaaacaatatcygcttcctgtggactctggagacctgagtctcgctttgaatgcagggcgggcgggacccagagcacagggagaggctgccaaccaagggcagagcacccca

SEQ ID NO: 75520 - DNA, 201 bp, Bos taurus
aaatggccccatgctcgtggaaagttaccggtgccattgtcccttcctctgggcaacatgtgggtcactctctcagggcccctctgctaacagcccacttycaggacaaatttgagctgacactgtcagtcaccctgctccccccaggcaccaaatccacaggccatcatgggccattttcaaaacagtgctgtcaccctg

SEQ ID NO: 75521 - DNA, 201 bp, Bos taurus; identical to SEQ ID NO: 36021

SEQ ID NO: 75522 - DNA, 201 bp, Bos taurus; identical to SEQ ID NO: 36022

SEQ ID NO: 75523 - DNA, 201 bp, Bos taurus
tactggccatacaggttttgggagaaattaatttactgtatatctttttttttttttttaagtcccctcaataccaagtctcctaaggagaggcatcatayattgtgtgcagtttgtgcagttgaacacttttttgcacagatatttattttcacactcaatgaagaactgttacataatgagaactgctggtgattaagg

SEQ ID NO: 75524 - DNA, 201 bp, Bos taurus
agataacgggcaccaggccacaaaggtcagtggtccctgaaaaagggaaatgaacagactgaacctgatggttacttcgtcttactgcccgaaagactttkcaggccgctacgcagggaagggaacccagggaccgctctgagttgaggaaatactgatagattctggggaagcctcatgggaagcaagcagggcagagtg

SEQ ID NO: 75525 - DNA, 201 bp, Bos taurus; identical to SEQ ID NO: 36026

SEQ ID NO: 75526 - DNA, 201 bp, Bos taurus; identical to SEQ ID NO: 36033

SEQ ID NO: 75527 - DNA, 201 bp, Bos taurus
ccttaatgttgatggctgttgcctctcaggatggttgtcactgaatgttgggttgactttggtaatgtcttaaaataagacagcaatgaactttgatgaamagatttacttttccttttagacaatttttctgtagcatataatgttgtttgatagcactgtattatcagtaagatttattttttcaaaattgaaataaat

SEQ ID NO: 75528 - DNA, 201 bp, Bos taurus
tggaagtatatagtaatgtgttaaaggaccataacttttactatttgaaaaaaaggagcaaattatgatcattctttatttttacaatgtaacggcctaartcctcttggagttcaccattactcctaccatagagcctgttaatattccttagaggttgcaaactctagcactgggctccctcaggccaaactatacaga

SEQ ID NO: 75529 - DNA, 201 bp, Bos taurus
ttaggttattttaataacatgtttttttagtccttgaggaatgcattaagctaagttttgtttgtgtattacctgagtttgtaattttgttgaaacttaayagcatgttacactatgtttcaggcttcccaggttgtcctagcggtaaacagcctgccttccaatgcaggagacataagagatgaaggttcgattccaggg

SEQ ID NO: 75530 - DNA, 201 bp, Bos taurus; identical to SEQ ID NO: 36036

SEQ ID NO: 75531 - DNA, 201 bp, Bos taurus
ggtgaaaacagactactgctgggagacccatgagcaagcaacaggccctgctcccactgattcaggaaagcatagatagcaccagcccctaggacatccaygatcatgcagtgggccttaccttcagtgctccatgaaagtgcagagagtaccagttcctaggaagtctgcaagctgggcccaggacctactcttgctgtc

SEQ ID NO: 75532 - DNA, 201 bp, Bos taurus
ggggtcacaaagagttggacatgactgagcaactgaactgaactgaagtgaggtgttcaggggtttggggatacaagccatcaatccccttgcatggcccrgcaataaacatttctctgcttcatacttttatgttttggtttgtttggcttcactgtacatcaggtaccagaacattcattccataacatgaggccctag

SEQ ID NO: 75533 - DNA, 201 bp, Bos taurus
caggcaattcagactttaaacaaagctcaagttgaaattatccagaattgaaacaaacctttaccagcagatatcagttttgaaaggcaaagaagtagctraaactaagctatggctagttatgaattgttcacttaacatttttttacaggtgctgcaaaactgaaaacgttggtaagcagagctgaaagaactattttg

SEQ ID NO: 75534 - DNA, 201 bp, Bos taurus
ctttagctctaacccttgtgctctgttgcctgtgcttagtcatgctggctctgtacctttgtgatagaatgttgcctagagcctgaaatatagatgataayccactctcaagactctgacctttaaatatataacacttttccattcacacagagataaaaagttgcagaatataaaataacaattgtcttgttggagatt

SEQ ID NO: 75535 - DNA, 201 bp, Bos taurus
aatgaagaggtgacaggatggttatctagagcagtggtttcaaactattttgctcatatatctcacagtttaaaaaataacagtcaatgcaatatctgatyttaaatatattttacctattcattttttgatcaccagttaatttagaaaatataatgtatttgatgtaaagcttattctaggaatagacatgtcatttcc

SEQ ID NO: 75536 - DNA, 201 bp, Bos taurus; identical to SEQ ID NO: 36039

SEQ ID NO: 75537 - DNA, 201 bp, Bos taurus
tttctcagttttttaataatgaatcctagtcttacatataagtctcaggtttttttcctgatgctcaaccttcccatcaatgtccattgcagcttctttayggtaggcttgtgtgtgcctgagtaaaaaggtattgttttagtttctagaaatttatttataggaaatcttaatctctgagtcaaatgctattgcaacatt

SEQ ID NO: 75538 - DNA, 201 bp, Bos taurus
ttgacatgtttattataacacccatttatttaagttttcaattatcaaagagtatgctcttatccctggaagtgtctacatagatgttattagtgtgtatrttgcatatttttatccatgaacacgatccccttctacttctggaaattactaaagatatcttacataaatacttccaacaagaatgaaataaattatgtt

SEQ ID NO: 75539 - DNA, 201 bp, Bos taurus; identical to SEQ ID NO: 36040

SEQ ID NO: 75540 - DNA, 201 bp, Bos taurus; identical to SEQ ID NO: 36041

SEQ ID NO: 75541 - DNA, 201 bp, Bos taurus
gtaagctccgggagttggtgatagacagggaggcctggcgtgctgaagtccatggggtaccaaagagtcagacacaactgactgactgaactgaactgaasttgctatgaacattagcatagatcaatttgtctaaatctactgctgcatttggcaatttagaaagcaccaagaataatataaacaatataagacaatgca

SEQ ID NO: 75542 - DNA, 201 bp, Bos taurus
aggaatcatgaatcaaagaacgtctgttacctcttaaagcttgtaagggccagaagctggattctcctccagtgcctccagagaaactctgccctgatgayacttgattttaacccagtgaggcccatggtgaacttctgacctactagattgcaagattatacatttgtattgttttaagccattagtgaacctgttagt

SEQ ID NO: 75543 - DNA, 201 bp, Bos taurus
tggttgggtgtgtgttttgtgcccttctcaggtctgagcagctcaggtaaccaagtgctttgtgagtgcactgtcctatggagactgcgtgtcttaatcasctccctggtcctagccgctctgcttcctaagtgtgccatgacagcactatcgcaggtgtgccatgtgtctcctctggggagctgatctcaggctgtgacc

SEQ ID NO: 75544 - DNA, 201 bp, Bos taurus
attttactaaggatataaaggaaagtttctagaatgaagccaaactaagtaacaaaacaggttccttatccttaaatgcaattctaatattaagtagttakgaaattaggatttgtaacaagctaaaatctagactgatggtttccaacctggctccacattaaaatcattgatcagttagttctggtcagtcgctcagtt

SEQ ID NO: 75545 - DNA, 201 bp, Bos taurus
ttgatcctaattcaggacctttgatatctagtttacattgttttcagttttccagtggaaattcatcctggtcttaaagaattatttgggactcttgtaaraaatatagatcttgaaattcccttgaattattgattcagtattctaaaagaatacattctggtgtttcactcaccatattataaaattatactaaaatat

SEQ ID NO: 75546 - DNA, 201 bp, Bos taurus; identical to SEQ ID NO: 36042

SEQ ID NO: 75547 - DNA, 201 bp, Bos taurus; identical to SEQ ID NO: 36044

SEQ ID NO: 75548 - DNA, 201 bp, Bos taurus; identical to SEQ ID NO: 36045

SEQ ID NO: 75549 - DNA, 201 bp, Bos taurus; identical to SEQ ID NO: 36046

SEQ ID NO: 75550 - DNA, 201 bp, Bos taurus; identical to SEQ ID NO: 36047

SEQ ID NO: 75551 - DNA, 201 bp, Bos taurus
caaatttagcaaaacatttaggtaactaccttttcaacaagaggagcaataagaattaattattgtttactttcacacttgttttgtaatctctgtcacakcaaaggcagagcaagcaaatttaaataagagagaccagtaccatgggtactttttactgctctagtgcctaaatgaaaaacaagtaacacatttttagga

SEQ ID NO: 75552 - DNA, 201 bp, Bos taurus
tagctcttggttggcaaaactgccccactggacattagttgttggttggcaaaacctcttccagaaaccaaaactcagaaagaatatatttcaactaaatktgaactgtatttttatcttctccccttgcctggaacaatggtatatttaatctaacatgggtttgttatttatttattagcttattaagagatatcaccc

SEQ ID NO: 75553 - DNA, 201 bp, Bos taurus
ataatttactttccctctttcaaacaaacctgatataaagcatatatttttccaaaaaatatatgaattaggcaaaaataacagctcatggaataggacayagttacatttggaagattaaactgcagaaaagagttcgcctactatgaaggagatcttggttcaatccctgagctgataaagatgttctagagaggggaa

SEQ ID NO: 75554 - DNA, 201 bp, Bos taurus
aaaaaaaaaaaaaagtcacacaaactgctggatcaacttcatccaccagggacagagactaaaagcaagaagaactataacactctagtctgggaaaggaratctcaaacacagtaggttagacaaaattgaaagaaataaaactattatgcagatgaagaaacaagataaaaagccacaaggccaaataagtgaagagaa

SEQ ID NO: 75555 - DNA, 201 bp, Bos taurus; identical to SEQ ID NO: 36048

SEQ ID NO: 75556 - DNA, 201 bp, Bos taurus; identical to SEQ ID NO: 36049

SEQ ID NO: 75557 - DNA, 201 bp, Bos taurus; identical to SEQ ID NO: 36050

SEQ ID NO: 75558 - DNA, 201 bp, Bos taurus
aagtaatgtctccgttttttaatatgctgtctagattggccacaacttttcttccaaggagcaagcatctttttatttcatggctgcaatcaccatctgcrgtgatttttggggccaataaaataagttctgctactgtttctccatctatttgccatgaagtgaagggactgaatgccatgatctttgttttctgaatgt

SEQ ID NO: 75559 - DNA, 201 bp, Bos taurus; identical to SEQ ID NO: 36051

SEQ ID NO: 75560 - DNA, 201 bp, Bos taurus
ttcacttacttgaaagtgaaataaaattatatcttatgtaagactcttgttactttggatttcagtcactaatagttaaaaatattcaaacaaaacaactyagtgagaaattgtgccattttaatggcatccaaggtcatccagagaaccaggtggccaattaaagtgctatttcctattgcataactctaaggcacttgt

SEQ ID NO: 75561 - DNA, 201 bp, Bos taurus; identical to SEQ ID NO: 36055

SEQ ID NO: 75562 - DNA, 201 bp, Bos taurus
aaatattttttaattttcatacattagagatgtaacaattcaagcatgcaagtttcaaactgagtttcaatttttctacctgaacttgaaaattttatcartgctatattcacatgaatttgtcaacatttaaactgctatgtattttttcatttattttagctatcattttattcaaattgctatgtgcatattcattat

SEQ ID NO: 75563 - DNA, 201 bp, Bos taurus
tttgttttttcttctgatacttctgttcttagggcaggtcctgtttaggcagttgagatttaattctaaccttttcttttttttttttttaaatgctaaakaatttagatttgttagtaaagcaggaatgggttctatctgcatgtcatagaattttgtatgtgactctctttgaagaatcataaaacacaacttttgtag

SEQ ID NO: 75564 - DNA, 201 bp, Bos taurus; identical to SEQ ID NO: 36057

SEQ ID NO: 75565 - DNA, 201 bp, Bos taurus; identical to SEQ ID NO: 36059

SEQ ID NO: 75566 - DNA, 201 bp, Bos taurus; identical to SEQ ID NO: 36060

SEQ ID NO: 75567 - DNA, 201 bp, Bos taurus; identical to SEQ ID NO: 36061

SEQ ID NO: 75568 - DNA, 201 bp, Bos taurus
ctgactctaattccagagggccaaagcagtggtgccatcctttccttcactgagaaatggttgtgctctggctgtggacacactgttcaggagtcctctcyggggattcttaatcacttagtggcccacacattcaggcagggcacaaggtagattcaaccagcagatttgctattttagggaaagccatctgtttagatt

SEQ ID NO: 75569 - DNA, 201 bp, Bos taurus; identical to SEQ ID NO: 36072

SEQ ID NO: 75570 - DNA, 201 bp, Bos taurus
ttttttccttcataatttgaatatactgctttattactttctccaatgtttttgctggaaagtcgagtgtcattctcatctttgatccttgatatgaaacktgttttgtcctctctggaaaattgtaggataatctttttttatggcccccgttttctataatttcaccatgaggtatgtgattgtacatctgtttttgcc

SEQ ID NO: 75571 - DNA, 201 bp, Bos taurus
gactagattccagtcttgagccacctgtgcctggcaaaggctgaaaagcaaaacgcagctgactattcaaaaagcagccatgaagtttcaggacactgtcratagcaagatttgtttgttatggctttctatggctacaaaatgcatgaagcagatacaccaaactgtggtcagagcttgggggccaccaccgtgatcaat

SEQ ID NO: 75572 - DNA, 201 bp, Bos taurus
acttctgcctcagcatacagtgggattgctcaccacaaatggccatggtaatggaaataacaagatgtcctcaggtcccaccacttggtgtgaaaaattcmaagggaatgtaaattacctaaatgatgaatcccaatcttttttacagctttcatgcttatgaaaagactgtggatttgtagcatgtaagagagggagatg

SEQ ID NO: 75573 - DNA, 201 bp, Bos taurus
aatgcaccacatagtacccttctcttgaaaatgtatgagatatgctattggattaaagaccaggaagtccaacagtatcaaaatatattggatgagatggwtggatgacatcaccaactcgatggacatgaatttcagcaagctccaggagttggtgatggacagggaggtctggtatgctgcagtccatggggttgcaaa

SEQ ID NO: 75574 - DNA, 201 bp, Bos taurus
caatccatggggtcactaaaagtcgaacacactgagtgactaacatttcacttcattctgtttacagaatagaaagtttactttgactctcaaaatgggtraagatttaactgaaagaaaattgagaatcagggattaagagatttgatcaggtagagaaaattagtaaattaaagtggtgttctggtctcaagttctcta

SEQ ID NO: 75575 - DNA, 201 bp, Bos taurus
gaagagccatctgtgagaagagctgctggaaaggaggaagccacctaggcgaaggcttaggacagtgtacatccatctgggatgtctgaggaagagcagakaggccaatgtggctgcaggcagaaggaacatgagggaagcggtagagatgagatcggaaaggagagaggggaaggcctgtggagggcatgtgggccacaa

SEQ ID NO: 75576 - DNA, 201 bp, Bos taurus; identical to SEQ ID NO: 36111

SEQ ID NO: 75577 - DNA, 201 bp, Bos taurus; identical to SEQ ID NO: 36112

SEQ ID NO: 75578 - DNA, 201 bp, Bos taurus; identical to SEQ ID NO: 36113

SEQ ID NO: 75579 - DNA, 201 bp, Bos taurus; identical to SEQ ID NO: 36115

SEQ ID NO: 75580 - DNA, 201 bp, Bos taurus
atacactccatttttagggagaagtagatggtggcttggagaagtttgttgtcctacacagagttgtggctgatacaataaataataaagttggtgctctygatatattcattcattcactcaggagtacttttgaggttccctgctaagtggtgataaccatacgaaattaaaaaaaaaagtgactagttgtttttaagg

SEQ ID NO: 75581 - DNA, 201 bp, Bos taurus; identical to SEQ ID NO: 36117

SEQ ID NO: 75582 - DNA, 201 bp, Bos taurus
ccctttggtcactggaatcagttacagctgcttccctgaggctggctaccttcgctttggctgctggcctcggaggtaaaacgtgcagcctgtagccctaytctgcactcagccttgactcacgtgaggaaggctgtctcacctttggaaaagtgactcacactactgcctgctccaaatgaaaaagctgtctcttaaata

SEQ ID NO: 75583 - DNA, 201 bp, Bos taurus
tgtctgtcttctaggagctctttctcctcctggttagcaagatgctcccaccattttggtcatttagtattgcagctgcagataaccaaagggccaacaaygctatgagaccaccaagggctctgtgatggagaactctgccatccaaatagtccggctctgctgccaatgctgtccattctgtggttgcttaaggaagtc

SEQ ID NO: 75584 - DNA, 201 bp, Bos taurus
attaagtactaaatagatatcagttttactattttttcatctttatatacatttatagagattcaatgttttgataaaagtattaaagtttatagaacaaygtgatttttctcactgattattaagattgctttgcatggttttaggttcagtggtcatttttatggttctatacaacatggaaagtgaggattacctgta

SEQ ID NO: 75585 - DNA, 201 bp, Bos taurus; identical to SEQ ID NO: 36121

SEQ ID NO: 75586 - DNA, 201 bp, Bos taurus; identical to SEQ ID NO: 36122

SEQ ID NO: 75587 - DNA, 201 bp, Bos taurus
gcctatagcaatagcatacgaggaagctagattggccccatcaagaatacaccagctagtgcgtcctgcttcacgtcagacaacatcgcagatggttcacytagtgtgctggtgtgttttggaaagaatacaatgtcactagaagacttactgaaatgatggggaaaaaattgcataaagatagtgttttggttggtggct

SEQ ID NO: 75588 - DNA, 201 bp, Bos taurus; identical to SEQ ID NO: 36123

SEQ ID NO: 75589 - DNA, 201 bp, Bos taurus
gaaaaatcaagtccccggccactactgtctaaaaactaattgtgtctttcttttcttccttggctccaaagagctgctcacagtaaatcataaattcactyagggaagcaggaactctgggctaaagaatctatggacagaaagggaaagacagcaagaaaaggattgcgttcagacacgaagcctttccatgacatgata

SEQ ID NO: 75590 - DNA, 201 bp, Bos taurus
acaagaagatggggacattagaagacagccacagaaggtggaaagcaagtttccttgaattttcaaaacctccagctatggtagcagatgtagaaaacagrtatataacaagctctcaatttcttgcagccgtaaacttattgtgaaatcaccgatttagaaagagggaggttttcactcttcaagactcactaaattact

SEQ ID NO: 75591 - DNA, 201 bp, Bos taurus
aatatggtgctctcagtgctaacatagactcactcacagggtcctctgggaccatataggaggggccccaggggagacggtgttcgcttagattaaacagmgaagaagtcaaggaggggaacactgaccaataaagctgaagaagtgggcactgatcacatcataaccaaagactataaccgttttccacttgagcatcgg

SEQ ID NO: 75592 - DNA, 201 bp, Bos taurus; identical to SEQ ID NO: 36124

SEQ ID NO: 75593 - DNA, 201 bp, Bos taurus
ctctgatgcaaggccaggcctttcacgtcctgccaaaaccagagccgttctcaagctgggtaacttgtgattattttctcctgttgccttctctttgaaamctaattgtagatgtgaaatggccatgtttaaataattcataaaaaataataaatccagaggaaagtggcaaagggtacagagaaacctgctgaagtacaa

SEQ ID NO: 75594 - DNA, 201 bp, Bos taurus
gagaacaagcatttgacaaaattcaatacacattcatgataaaaagtctcatcaaagtgggtatagaaggaatatatctcaacataataaaggccatttaygacaaaccataactaacatcaagtcaattcaattcagttcagtcactcagtcgtgtcagactgtttgcgaccccatgaagcgcagcacgccaggcctccc

SEQ ID NO: 75595 - DNA, 201 bp, Bos taurus; identical to SEQ ID NO: 36125

SEQ ID NO: 75596 - DNA, 201 bp, Bos taurus; identical to SEQ ID NO: 36126

SEQ ID NO: 75597 - DNA, 201 bp, Bos taurus
tggtacaaccactttgcaaactgatttggcattatccatggggtcacaaaagagttagtcacaacttagcaactaaacaacaacagcaactattttgtgcrggcttgtcgtttcacttttatgtttgtttttgtgtcttttttcttcttttaaaatatagttgacttacaatattatattagtttcaggtgtacagcaaag

SEQ ID NO: 75598 - DNA, 201 bp, Bos taurus; identical to SEQ ID NO: 36128

SEQ ID NO: 75599 - DNA, 201 bp, Bos taurus; identical to SEQ ID NO: 36129

SEQ ID NO: 75600 - DNA, 201 bp, Bos taurus; identical to SEQ ID NO: 36130

SEQ ID NO: 75601 - DNA, 201 bp, Bos taurus
taaaaaatagaaagaatggctaataaaatattttagctaggaaagagaaaaagttcacagtaatatttcactgagcacaccaactaggtgaaacatttgarcaacaaaatcaaaattatttgaagaataaaatcagatcttttgtatataagggcttccctggttgttcagacagtaaagaatcctcttccaatgcaggag

SEQ ID NO: 75602 - DNA, 201 bp, Bos taurus; identical to SEQ ID NO: 36131

SEQ ID NO: 75603 - DNA, 201 bp, Bos taurus; identical to SEQ ID NO: 36132

SEQ ID NO: 75604 - DNA, 201 bp, Bos taurus
tgggttgccatttccttctccaggggatcttcttgacacaggaatcaaacctgtctcctgcatctcctgcattgcaggtggattctttacccctgagccamctggaaagtcctttattaactctaagtaccttcagtttgtttttttcaaatgaggcagtgtataaacaggtgtgaattttgcctcccccagtcttccata

SEQ ID NO: 75605 - DNA, 201 bp, Bos taurus
ttcccttgttggttgaaggatgttcgtaggggctgttaattcttaggctattgtggctttggccagataaaatttacaggtaatgaaacgcaggtgtagayagctggaaatatagacaacagatattagaatggtaagtaaaaggggatttgagtgggcatcaagaccaattgtttctcacttcaaaatcttacagaaaag

SEQ ID NO: 75606 - DNA, 201 bp, Bos taurus
tagtcaagtatcacacaaaagcagaaatgagtgtgctccatgtcttcaccctcagccctagagctggatagggacttgactttgtatcagcaaggcctgcktggtagggagcaatgactacagtctgaggctaaatttattagattaaacagaacacattttcatacatagaaaataattgaatcgaggctacttaactct

SEQ ID NO: 75607 - DNA, 201 bp, Bos taurus; identical to SEQ ID NO: 36133

SEQ ID NO: 75608 - DNA, 201 bp, Bos taurus
tgtaagaatcacttagaataccctgaatagtcaacaagagtccaaaatgcagttcttggatgcaatgtcaaaaatgacagaatgatctctgttggtttccraggtaaacagtaatctaagtttatgacccaaccactaacactgaagaagcggaagttgaatggttctaggatgacataaaagacctgctagaactaacac

SEQ ID NO: 75609 - DNA, 201 bp, Bos taurus
ttttggaaacaaaaaggagattcaaagccagaaaaaacagtgacaggaatacaaaaagaacacttccgtagtcactggagggaatatggccttatgtgtgygtgcgtgcgtgctcaatcgtgtccaactctttgcaagcctatggactgcagcctgccaggttcctctgcctgaaggaatatggcctttctgacatcttaa

SEQ ID NO: 75610 - DNA, 201 bp, Bos taurus
ctccaggcctctcatatatgcactgaaggccattcctgggagggcctagcacttcagggcttctcctttgtggagctgacaccagggcccagagagtacaygcacgcagagctgtggatgctgagagctgagattggactggaatgctcagaaatactacacgctgtgggagccttgataaggcacgtatggtggccatta

SEQ ID NO: 75611 - DNA, 201 bp, Bos taurus
atgccagtggtgctggtactgcagccagtacctcagatccctctgtattgccctggtccaagagagtccttctgcccaagttgcttcactaactgtcacartcacatgaattcttggattaatttctactcattgtaacctaaagtgtctctctcagctttactcgcctggccctaaccacatagcaagtctttctctgga

SEQ ID NO: 75612 - DNA, 201 bp, Bos taurus
tttaaaaattaatttttaagtcctctttgatcccacaaggagagatataacttcaaaactcatcttataggttaatttttatgtggccaaattctgaattrttttagataaatagtaattaataggtaaagaatttttaacagaaatcacatttgtaagataaaatgattcatataacaaactgatatatactggcctgct

SEQ ID NO: 75613 - DNA, 201 bp, Bos taurus
tggaaaggaatgtaggtatgttatccatagcaattgttaaaaacatatatgatgcatttttgttcaatctgatgtaataaataagtcaatgattctatatrgactgcttatacctaactgtaaaagttcaatgagaattctcagcatggttttaaaaaataagatctgtgaaaaagatcaattatacacatggaatgtgct

SEQ ID NO: 75614 - DNA, 201 bp, Bos taurus; identical to SEQ ID NO: 36149

SEQ ID NO: 75615 - DNA, 201 bp, Bos taurus
gatgtttggagcttgagtgaatggatatactatgtttctgaccaaattgagcatttccagggacttaaaagtcataattttcagtttgctaaaatgtggtrtcctggacagcatcaactccatcttgggtttagaaagtcatttcagcatagttgataatctgaagagaggtttgcatatatacatatgaagaatggaata

SEQ ID NO: 75616 - DNA, 201 bp, Bos taurus
tccttatccttcaaggcctgctttcacacagattcaagtttagccaaaggtgaaagtttagagatactaggtctgtcttgagtatgagtacaatcctgtgyagacacctggcctttaaaatttagaaattgatttatttaaatcttactatgtctgtgggtcccttgaaaagtcttcctatatacccccatgaatgactac

SEQ ID NO: 75617 - DNA, 201 bp, Bos taurus; identical to SEQ ID NO: 36154

SEQ ID NO: 75618 - DNA, 201 bp, Bos taurus; identical to SEQ ID NO: 36155

SEQ ID NO: 75619 - DNA, 201 bp, Bos taurus; identical to SEQ ID NO: 36156

SEQ ID NO: 75620 - DNA, 201 bp, Bos taurus; identical to SEQ ID NO: 36157

SEQ ID NO: 75621 - DNA, 201 bp, Bos taurus; identical to SEQ ID NO: 36158

SEQ ID NO: 75622 - DNA, 201 bp, Bos taurus; identical to SEQ ID NO: 36160

SEQ ID NO: 75623 - DNA, 201 bp, Bos taurus
cattttaatttgttcttccaaacaagtgtgaatgagagagtcatggccaagtaaatatgcccaatcatatattccctgtgttgggtgcagaaagtgaagtrcagaagcacattagatccgattttggtgtataactctattatctcacatttgaccttttgaaatggcttagcatggagtgaaatatgagcacacattagg

SEQ ID NO: 75624 - DNA, 201 bp, Bos taurus
agtcttatttacccctgtagccactttagagaaagacagaggaaactagtaacattaggatttcttgaaaagtcaggatgtttaattagctgatttaattyttttgtaggataactttgaatccatgttaacttatctgaatacatagaaattatggtagtaaaaggattcagcttcactccaaatagaagtcttatatta

SEQ ID NO: 75625 - DNA, 201 bp, Bos taurus
gccctgcatggcatggcttataacttcattggattatgcagccccttcatgatgacaaggctgtgctctatgaaggggatattgtgaaatggacagtactrtaatgactgttgcttcactttttctgtagctattactttgtccttaatttttgcttcatctgtactgtgatggcagtagttttataggtagagatagata

SEQ ID NO: 75626 - DNA, 201 bp, Bos taurus
tttgtctaaaaaggatttcttagtgggaccagaaagtttagtagtgaaatagaacttttgaagcagttgcagtcaagttgagaagtagttttccagatgaracaagaagaacaaaacatgatagataagaggatgaagacctctagcaaaataaatcagtttcttctactgtagagggaatttgttcagtgaagtttaatt

SEQ ID NO: 75627 - DNA, 201 bp, Bos taurus
agaatatattctgctttcagagtcctggagttcaatagtgagactgtttatgcttttcactgagattttatttaaaacacactcaagttctcttttcaaarcttgctgctgctaagtcgcttcagtcgtgtccgactctgtgcgaccccatagacgacagcccaccaggctccctagtccctgggattccccaggcaagaa

SEQ ID NO: 75628 - DNA, 201 bp, Bos taurus; identical to SEQ ID NO: 36167

SEQ ID NO: 75629 - DNA, 201 bp, Bos taurus
gaaggcagggtgctacaagatgagggaaacatcaatgtcaaagcatgggggtgagatggatggggtatttgggaattgcaattaaagtctgacttgagcaytgagtttaagaataagaaatgatactgataaggcagaacttgttggcaggatccaagccattataaaatttcctgagtaaagacattaaaggaaatggtt

SEQ ID NO: 75630 - DNA, 201 bp, Bos taurus
taaatgtgtacatttcataataaataaaggtatataaataaatcaaagagcatctgaaaggaggtaatgatcaaatttgtcagatggctaacaactccaaygaatatataaaattctccatatgtacattttgcttacaaagaggtaatggatgagtgtaatgggagattcatttgagtcctgaaaattaaagcattgttg

SEQ ID NO: 75631 - DNA, 201 bp, Bos taurus; identical to SEQ ID NO: 36177

SEQ ID NO: 75632 - DNA, 201 bp, Bos taurus; identical to SEQ ID NO: 36178

SEQ ID NO: 75633 - DNA, 201 bp, Bos taurus; identical to SEQ ID NO: 36179

SEQ ID NO: 75634 - DNA, 201 bp, Bos taurus; identical to SEQ ID NO: 36180

SEQ ID NO: 75635 - DNA, 201 bp, Bos taurus
gtacagttgatataaaattatttttctcttgataacctctaactagttaaattcagaaatctccatcaataagcttcagttgcaccatgttccttctataycagtaggaatattcagtacatatgatatcaaggcagaagcctaagatataatgcatgggagcttttcatcttatttttgtgatttaaattttctccttgg

SEQ ID NO: 75636 - DNA, 201 bp, Bos taurus; identical to SEQ ID NO: 36186

SEQ ID NO: 75637 - DNA, 201 bp, Bos taurus
atctagataaatgatatttacaaatgactctgatctccacagtaatctattgtgtgatttttacttggagcataaccaaaatttgaaacaagagtgagtargcaaagatatccaaatccttgatcatagtgccctatttatttgaatatttatttatatatttataactacaagttgattaaatgactactgtaagtgtta

SEQ ID NO: 75638 - DNA, 201 bp, Bos taurus
agagaaataagccaatcaattgtgcaatttcaggccatgaccctttagtgaagctctggaataaacattatatgtcagtgtttgcccatgtttaaggcaasctaactggccttcatactcccctaacagtaaatcttggccaacttttcccaataagacccagatggtggtatgggcatagattcctaatcactgctgccc

SEQ ID NO: 75639 - DNA, 201 bp, Bos taurus
agatcttcacatttttgatcaagaaatgccctcaggcagcatattcactgggaaggacttctttcaagaaatgctgttctcaaaggtttagttctttcatrtctcaagttttaagaaaataactctactacaaactcaattcaactaaacataagcctttgaagtagtttgacatgaaacctcatccacaaatgcctataa

SEQ ID NO: 75640 - DNA, 201 bp, Bos taurus
tcaatgaaagttaacagtataaaggaaaacaatgatgacggggatgctggagaaagctacataatttgccttaaaagctattttactcatattgacaagtmactcactttgactaacttctttttctttcacagcccttaaagattttatatcctgttccaaacatgaaaatccttacagtagttagtttgcattgaaaaa

SEQ ID NO: 75641 - DNA, 201 bp, Bos taurus; identical to SEQ ID NO: 36188

SEQ ID NO: 75642 - DNA, 201 bp, Bos taurus
atatgggctagtagttgtgtcttttgtttttttaatcagcatgtgctggcctcaaaaaattatatggaaagtgtcctcctccaagagtttttgaagaattygcataatttcttcttaaatctttgttaaattgtagtagtgaagtcagctgggctttcattcttttattatgaggaagtttctgatttttcagatgcagaa

SEQ ID NO: 75643 - DNA, 201 bp, Bos taurus; identical to SEQ ID NO: 36190

SEQ ID NO: 75644 - DNA, 201 bp, Bos taurus; identical to SEQ ID NO: 36191

SEQ ID NO: 75645 - DNA, 201 bp, Bos taurus
taaaattatctagggtagagagacataactgagaaatgtattttggcaagatttatttcaatatatttaagtatttattttgataaaaagcaacatcatarcttgatttattcatcctttatatattatttgtactctggtctcagtttttaaaaaagagaatttatatcataccaaaattatatttactgattttggaaa

SEQ ID NO: 75646 - DNA, 201 bp, Bos taurus
ttgggtatagaggacagccattttgggggacttttgctacctacacctcttagcatttccacattgctgggtcctccagcatccattctgggatgtaggargcagaaagaaatccgtagaatgtaataccatgtttttttttttttcaggttacatgaaccctagctggcctgccctagaagaagaaaaaaagttcaaaca

SEQ ID NO: 75647 - DNA, 201 bp, Bos taurus
tctttctcaacaactaatccaagggagagttttagtatttccttcaaaaatgaaatagcttgctaaattgctttctaggcactaagtcaaaattcttttaratatgaattatgtgaaaagcataaaagctttttgaaaattgtgtgtgttgtaagcatttttataaaaggaagctttgattaatacaggaaagttaatgct

SEQ ID NO: 75648 - DNA, 201 bp, Bos taurus; identical to SEQ ID NO: 36195

SEQ ID NO: 75649 - DNA, 201 bp, Bos taurus
atttgaaaaatatagtatttttatgagtatgatctataagtgaaatattattcattgtcaggaattgctgatgagtttgttaagagatcttcctaacatartgcagctgaattcaaattatgtgatgaaattaagcaggctgaatgagtaatttccatgcatggacaatgggaatttgttgttcagctactccagattatt

SEQ ID NO: 75650 - DNA, 201 bp, Bos taurus
tgttcttgtgttttcattgaaggattaatcttatggataacagttactgattatgatttctttatattgaaactttctgaatattttataaaacaataatyaccaaacaacagtgagaactaataaaaaactcagtttgaatgtttatattgtgttttagaaaattttccaagtaactttaataataattatcttgatttg

SEQ ID NO: 75651 - DNA, 201 bp, Bos taurus; identical to SEQ ID NO: 36202

SEQ ID NO: 75652 - DNA, 201 bp, Bos taurus; identical to SEQ ID NO: 36203

SEQ ID NO: 75653 - DNA, 201 bp, Bos taurus
agtaacaaaaagtgacagtcataaaatgttgcactgaagggattgcttgtgttcttgtccaatctcataaattacaaacaaggaacacaaaacccgaagtrgttaaacgaaacactcacagtcatatattttgccaataacacaacagcaagagagagcatctactttctaacttccattctgtgtactttccagcatata

SEQ ID NO: 75654 - DNA, 201 bp, Bos taurus
tacttcatttacaaacaaacacacagaaagtttctcaaaaatacttgttgaaacttgagttggatacataagtaaaatctaattgtctttcagatttactmatgtgatcacttcagtggtggtgctggtggtttagtagctcagttgtgtacaactctttgagacccatgcagcctgccaatctcctctgggatttcctct

SEQ ID NO: 75655 - DNA, 201 bp, Bos taurus; identical to SEQ ID NO: 36205

SEQ ID NO: 75656 - DNA, 201 bp, Bos taurus; identical to SEQ ID NO: 36206

SEQ ID NO: 75657 - DNA, 201 bp, Bos taurus
attctgcactgatggccagaccagttcatatgaaatgaggaacgaaaagcagtaacaggtggagcctgcgagacacttgagaaactgaaccattcccagcrtctcagctcttcaggaaagtccttaaactcctgaaaagacttgctgtggagtgatccttggtaggaattgatgagtagcaggactgtttgctttagaagg

SEQ ID NO: 75658 - DNA, 201 bp, Bos taurus
agaaaattgctagtaacaattctgattagtctagagtagcctatgcactgtttgtcttcccctaaccaataaactagcagacaaaggtgcaaaagagtgcrtgtgttaaagtgcagagtaaaccaggagcagcagcatttctaatgtgcgtggtgctaatactaagtttatcagaactatgttacagtacagatgagagtt

SEQ ID NO: 75659 - DNA, 201 bp, Bos taurus
agtgtttctaaacattgtttttattaacccctgtaaagaacctttttagatatatatgtttttccaaattcagtctccttccttgaaaatttaatgacacrgatgtagtctttttatgtactgcagccctttggagggtcatgaatgactttaatatctaacattttctgtcctttttccctcaacaaacaactttgcctc

SEQ ID NO: 75660 - DNA, 201 bp, Bos taurus; identical to SEQ ID NO: 36207

SEQ ID NO: 75661 - DNA, 201 bp, Bos taurus
aaaagcgttgagatatgagctttaaaattggaattatctttaatggactcctctaaacccctgaacatgtaaagagattgatataacatgaatttcacaaycttgtgtcaactatgctttcctattgatagccatgttaatttgcctgacagtatttcagtgacttttattttggacgtttattatcctgtttttcttttt

SEQ ID NO: 75662 - DNA, 201 bp, Bos taurus
agtaaccacaagtataggaatcttagcgtcctaggcatgtataattctatggaactgggtccagctgttttctgcatagcacaactgggcttgccaagaargagctggagaagcaattttctcatatatgcaagtggacacaaattagagtccatcacacaagttgattgttttctcaggactatttgacaccaggaattt

SEQ ID NO: 75663 - DNA, 201 bp, Bos taurus
aattattatgtcatccaaggacacaataaccttattataaaacttattttcaatgtctattttacagatattctcacgattagaaaatttttcatgtttcygtgctaattcattatagcatcatcttttaacccaatcttaaaaatacctctttttctgatattttaaaatatattgtatctcaatatgtagcttcatttc

SEQ ID NO: 75664 - DNA, 201 bp, Bos taurus
gagatgggaaggataaaggctttttcaccccagcactgagcacaatactactttgccaagggtagaaacccactagttggtggactgatggaagaatgatkgaggctacattaaatacttgtcatgcttcttcctgacattactattttgaggctaataatatgaagcacacataaatagaagaagaaaatgatattgatt

SEQ ID NO: 75665 - DNA, 201 bp, Bos taurus
atcagtcatataaatccacctaatactttgtcagcaaacccacactgtctcatctctcataaagcaagtagtccaaggcattgccttgttcaagttctaaygtagagggctgtgcctgtaggacttcaccggacttcacggagattactgcatcagcatgacagggcacgtactatactagagctcaccagttacattttt

SEQ ID NO: 75666 - DNA, 201 bp, Bos taurus; identical to SEQ ID NO: 36208

SEQ ID NO: 75667 - DNA, 201 bp, Bos taurus; identical to SEQ ID NO: 36209

SEQ ID NO: 75668 - DNA, 201 bp, Bos taurus
caattgtttttacattcccacaaataaccccgaatatagagcattccaacattccttgtctgccttccttcctaccttatcagaaagttcctcttatctaytcttcaaagatgtcaatcaaaatctttaaatggtctacaaaattttcccattctcctctatacctaaatgatcttgtcataagcttccttccctaacaca

SEQ ID NO: 75669 - DNA, 201 bp, Bos taurus; identical to SEQ ID NO: 36210

SEQ ID NO: 75670 - DNA, 201 bp, Bos taurus; identical to SEQ ID NO: 36213

SEQ ID NO: 75671 - DNA, 201 bp, Bos taurus
gagatgatcatgattactcaggtgggcccaatgtaatcacaaagttcctttataaacagaaggcaggaggcagaggaggaggtgcaaagagagctagcaawgcaaaaagaattggcctgaagaggttttggaggtgaaagaaaaaggttctgaggcaagaaatctaggttgcctctagaagctttaaagggcaaggaatgc

SEQ ID NO: 75672 - DNA, 201 bp, Bos taurus
tgtcctaatagctgacatccacttgaacttctacccattgcataggagccatatcccaaccactcccttgaaagtgccctctaaaatctcagggtgtctgmtggctaaaatctaattggttttcaaatttttttcttactttatttctctgcattctttggcactatagaccacacctttattttaaaatatttcttaact

SEQ ID NO: 75673 - DNA, 201 bp, Bos taurus
ataataggaattccttgtttatactggaatctttggacctcctagggaatggtaccatatgggaaaaaaggacttaattccttgttttgtgtttgctaatkgattattttaaacttttcttacctctttgaaccccagtatccttatctgtaaaaaagggtaataatatagtgtggctcataatacttttttgtgaggatt

SEQ ID NO: 75674 - DNA, 201 bp, Bos taurus
gactacaacctggtgagtgtaatacacagaggagtgagaaaggaaaggtccccttggaagattgctgagttgatcagactggctgtgtagcagaaggtgcrtctcttgggatagcatgctcattaattttccactgtccatctttccccaactcaattttggtacccctctcaggggggtactgccttttgatcatttctc

SEQ ID NO: 75675 - DNA, 201 bp, Bos taurus; identical to SEQ ID NO: 36214

SEQ ID NO: 75676 - DNA, 201 bp, Bos taurus
tttgcacaatgagactaaattggaagtatagccaacaggtgatccattaaggacttgagtgcagctaagccttcctttgggatgtatacttttacagccartaaacctggccttactagctcctagtcgctttgcttgccaataacacagccttataatgtaacagagtccagtagagccactcctcttaggtttccaacc

SEQ ID NO: 75677 - DNA, 201 bp, Bos taurus; identical to SEQ ID NO: 36219

SEQ ID NO: 75678 - DNA, 201 bp, Bos taurus; identical to SEQ ID NO: 36220

SEQ ID NO: 75679 - DNA, 201 bp, Bos taurus
gttaaaagtgatttaacttattaagattcctctttgtgtatattttagaataaaggtggctttcttccaagcatcttcccccattggctaaacagctaccrtagacatcagtctgaagacaaaactgtgactttgtgggggaaaactggggagttctcatcccttggtgcccaaagcactaaggctgtggtagaaactcta

SEQ ID NO: 75680 - DNA, 201 bp, Bos taurus
aggtaagatgagtcatggttttaggaatctggagaacgaccctctggagccaagaaggggctggaccacagcccagatagactttgaaggatggagagagmagggtaggaagagtcatgggaggagactgtacgtgcagagaatgggagaagcaaaggcagagggtgcgttctcacagtggtgggcagatgagagcagcgg

SEQ ID NO: 75681 - DNA, 201 bp, Bos taurus; identical to SEQ ID NO: 36221

SEQ ID NO: 75682 - DNA, 201 bp, Bos taurus; identical to SEQ ID NO: 36222

SEQ ID NO: 75683 - DNA, 201 bp, Bos taurus; identical to SEQ ID NO: 36225

SEQ ID NO: 75684 - DNA, 201 bp, Bos taurus; identical to SEQ ID NO: 36226

SEQ ID NO: 75685 - DNA, 201 bp, Bos taurus; identical to SEQ ID NO: 36227

SEQ ID NO: 75686 - DNA, 201 bp, Bos taurus
aggccagctctctcccgataccacacacacacacacacacacacacagtaaagagcactgatgaaacacatgagattatgaagctctctttggtacagagracatttaaggccttgttttctcttgttcacctaaagttagaactgagtgtcttggtatctatattacttgtaacagatttatcctcacatcttactggtt

SEQ ID NO: 75687 - DNA, 201 bp, Bos taurus; identical to SEQ ID NO: 36228

SEQ ID NO: 75688 - DNA, 201 bp, Bos taurus
tgttgggaaagttagacagccacacgtaaaccagtgtagttagaacaaaaacccttagaccatatgcaaaaataaatttgaaatggcctaaagactgaaaygagatatgacaccataaaactcttagaagagaacacaggcaaaatgttctctgacataaatcgtaccaatgtttccttaggccagtttcccaaggcaata

SEQ ID NO: 75689 - DNA, 201 bp, Bos taurus; identical to SEQ ID NO: 36229

SEQ ID NO: 75690 - DNA, 201 bp, Bos taurus; identical to SEQ ID NO: 36231

SEQ ID NO: 75691 - DNA, 201 bp, Bos taurus
aattgtgcaaggccccaagtggttcatgaataggtaattaattaaaatgttatatgcagtgtcatgcagtatgtgaaggtttttatggaaattattaacayttctttgaaaatttctctttgggcctatttataaatatatgtctaaagatatgatatctttgatatataaatattctctgtgtgtatgtgtgtgtgtatg

SEQ ID NO: 75692 - DNA, 201 bp, Bos taurus; identical to SEQ ID NO: 36232

SEQ ID NO: 75693 - DNA, 201 bp, Bos taurus
tagagggccctgtgctatacattagaaccttattgtttatctagtcactgttttacttttaaactagagactattgtgcattctgtgtccctattgttttkccaagtcaaggccaagttcctgatttcataattcgaagatctctatcggttgtttactccttccctattcacagatcttagccgcagttccatcactttg

SEQ ID NO: 75694 - DNA, 201 bp, Bos taurus
cttgacttcaattgttttgcctttacatgtatgtttctagtttcttctttcttcctcccatttgcaagttaagtggaagacatgcttattgaactgagagrgaaatcgttttttttttggttttttgctttttctccctcaacgtgacatcatgaactgcttttcattttggatgggtgggcattaagtagtctgtctaag

SEQ ID NO: 75695 - DNA, 201 bp, Bos taurus
atttctcttagacttctcagcaatttaatactttgactagtcttttgctggtctcttcaacaaaactatgacttttgtcctgagtctgccctatatcttarcctgctttacgtgtaaccttcccagtccaaagggaggtgagcagactgtagaaactaagcttttacatactcagcttgggcatctttcttagacttttag

SEQ ID NO: 75696 - DNA, 201 bp, Bos taurus; identical to SEQ ID NO: 36237

SEQ ID NO: 75697 - DNA, 201 bp, Bos taurus; identical to SEQ ID NO: 36239

SEQ ID NO: 75698 - DNA, 201 bp, Bos taurus; identical to SEQ ID NO: 36240

SEQ ID NO: 75699 - DNA, 201 bp, Bos taurus
ttgttcaaaggggtaattggcctttgtacatgtacaggcatatgaacaaggcattcggctggtgattacagaaagagagagaaaaggaaaagggtcaagcraaaagcagtcctggccaccagaggcaggaaatggaagttctgacaaagggttccctggctttcaggcctagatggcttgataattaaactgactgcaccc

SEQ ID NO: 75700 - DNA, 201 bp, Bos taurus; identical to SEQ ID NO: 36241

SEQ ID NO: 75701 - DNA, 201 bp, Bos taurus
ggccccaggtaggccaaggagagcactagagctgagcagcgcacctgtggacaggtgttcagcaaagccacgcctcccgagaggtgctgggcgccttctcmgtctcctcctttgtcctttgaggcccatgatacttcttaaggaaggtgggaggggtccttgtcatgcaggggttggcagaagtcactccctcaataagcc

SEQ ID NO: 75702 - DNA, 201 bp, Bos taurus
catcaagaacggccagggcttcatcctagtctacagcctcgtcaaccagcagagcttccaggacatcaagcccatgcgggaccagatcatccgagtaaagmggtgagagggccgggggcgcgggcagggggcttcgccggtgggggcccctcagccctcctgttcggggatcagaactccctcccgcgtgctctcgggtgg

SEQ ID NO: 75703 - DNA, 201 bp, Bos taurus
agcctgtgttagtgcttccagctcacactgtggccactgcccccgtgtccctcttcctcaccatggactgtcttcacctgcccattcctccctgagaggamctgtaacttcactgccatggcctgacctggaagcagaccctgagcagcagcactgtggccaactgatggctttctcttaactcagggtctccagatgtta

SEQ ID NO: 75704 - DNA, 201 bp, Bos taurus
cttggcctcccgcctccatctggctattggtgtggacgtgggaagtatgggctttgtaaatacagtccatttccctccttggtgatgaggtaaatgctttycaagtctggccgccgcaccccagacttttagctcagacctgtatcagctttgctcgagtcctctgttgagccagccccttcccacgctgggatgctggcc

SEQ ID NO: 75705 - DNA, 201 bp, Bos taurus
aaaaaagaaagctctctgtgtaatacatatatttatgcaaaaacaaagcgagtcataaagtgtatccagctgttttgtcactttccatttaaatacaattrttgggactgtgttaaattttttttcttgaaatttcctttcaaactctattttgaccaattgcttttatgttttataacattatgtgattttttaaaaacg

SEQ ID NO: 75706 - DNA, 201 bp, Bos taurus; identical to SEQ ID NO: 36251

SEQ ID NO: 75707 - DNA, 201 bp, Bos taurus
cctttgagaatcgggaatgtccactgaactctaacaacctggagctgcttgaggaattcggggaaaccagcgccaatgggacggtggaggttttatgaagygactctggccacgatcccagggcagggaccagacatcttgggtgctggtgaccttgtcacccgacgggaaaggcatggggctctctgtccagtggccctt

SEQ ID NO: 75708 - DNA, 201 bp, Bos taurus; identical to SEQ ID NO: 36252

SEQ ID NO: 75709 - DNA, 201 bp, Bos taurus; identical to SEQ ID NO: 36253

SEQ ID NO: 75710 - DNA, 201 bp, Bos taurus
tgagtaaaaatttacaattcagctcttcttgccaaagcttgtcctctgacctgcgtttcagagctcaccctgagtgttctttattcagattcaggcctgarttgttgctgggtgcctaccttaagtccgatctggaagacccctcccagccatcctggaagccaggtatggccagcacctgcctactctgccctcgaggtg

SEQ ID NO: 75711 - DNA, 201 bp, Bos taurus; identical to SEQ ID NO: 36256

SEQ ID NO: 75712 - DNA, 201 bp, Bos taurus
tgtcgggggcgacctgtgctcagcatctccttgattccaaaccagattcagagtcgctggacaggaaactccagcagatggaagctgcggccagcgccccygcccagtgccagcgccaggcgaggctctcgtgtcaccagctccaggttatgaatcgtgatttgccgaacagatgaatttgttcctgtcgctgggtgcaaa

SEQ ID NO: 75713 - DNA, 201 bp, Bos taurus
tcatcacaactagagaaaagcccacgcagcagtgaagacccagcacaggcgaatataggtaaataaaattatttttaagagagagagagagacatgtaacractgggccttttcaacctctggaatcctaaaactcttctaaattggagaaaactaatgacaaaaccttcagaagaagccttggttttgaacgctggaaat

SEQ ID NO: 75714 - DNA, 201 bp, Bos taurus; identical to SEQ ID NO: 36258

SEQ ID NO: 75715 - DNA, 201 bp, Bos taurus; identical to SEQ ID NO: 36259

SEQ ID NO: 75716 - DNA, 201 bp, Bos taurus; identical to SEQ ID NO: 36262

SEQ ID NO: 75717 - DNA, 201 bp, Bos taurus
tttagtgaggtttgtgggtatcaatttatattctaagattctaaaattctttgcttagaattgtattcttcgtttattttatgaagccctttttgaggccrcatagaatacctggagagtgttatagaggtaatctttgcctctcatggttcactttgggcaattttctctgtgcggctggtgagccagttactgctgtcc

SEQ ID NO: 75718 - DNA, 201 bp, Bos taurus
aaggccttgaatagatgttgctccagtgaagaagcacaagtgggcaacaagcgtaggaagaggtgcttggcgtcttacttcatacatgtatctgcccttcmttcctttttatggccaaataatattctattgcatgaagatgccatattttgtttattcatttatcagtcgatggacatgtgggttgtttggctattagga

SEQ ID NO: 75719 - DNA, 201 bp, Bos taurus
tgtcttctgtgttccagactatgatctctagcttgtgggggtttttactctctgtcagagaagacacaaaaaagagaacaggccagccaccaatcagcagyatccatactcataactagagagccttgaaagaaaagctgtacacaattcatgtggccaaatatattctgtttaaaatattgagttaaaattcacataaca

SEQ ID NO: 75720 - DNA, 201 bp, Bos taurus
aaaaattcactgaactttaattattaaatgggtctatttcttcacacccaaatcaataaagcctatttattttttgaaaggcctatcaaacatcagcattygaacaaagcccttttatccatcatgattttacttgcttcttgtaaaacgttcgtaccctgtgaattataggccttgtcttctttgcccaagtgacttgcc

SEQ ID NO: 75721 - DNA, 201 bp, Bos taurus; identical to SEQ ID NO: 36264

SEQ ID NO: 75722 - DNA, 201 bp, Bos taurus; identical to SEQ ID NO: 36265

SEQ ID NO: 75723 - DNA, 201 bp, Bos taurus; identical to SEQ ID NO: 36266

SEQ ID NO: 75724 - DNA, 201 bp, Bos taurus
atattcacccttgacctaccccttctgagtcattattaagactgctgaactgggcgttttcctcatagtaaatattacatttcacttggcttcatcagccrattactcagataacctttttgggcagtctatacctcaaaggcagatgagaaaacaggggtcagataagcgagttgctcaaagttatagagtcccctaaca

SEQ ID NO: 75725 - DNA, 201 bp, Bos taurus
cctgattccaattctcctgggaggaaatgccttggttacattgtctgtgatgttaacaggcacatgctaacatgaacattgttaacattgtctgtgaattkttacaggccaacatttcattctccaagaaatagtattagtcccaaagtcctaaaatttcatagaacaatatgatacataaaaatatgtctaacttactca

SEQ ID NO: 75726 - DNA, 201 bp, Bos taurus
cttgcaagtcctagccagttttgccaccattccacatggcttgtcttcaatggttctagggctcttagtatcctcactatctactccgccaaaatgtcacrtcttctaggaactccaggagggtccaatcagcctgtttgtgttttgatttttttcccacatctgatttttctttcattctatctggctttagcaatagct

SEQ ID NO: 75727 - DNA, 201 bp, Bos taurus
agcttcccagagcagagcatcactgttgacagtccctcttccactgagatttctctagatgagagcccttggaaacctgctttgttacaaaaaggatttgktccaccctagtgaatgaaggaagcatagtcattaagaggggtcatttgctcaaatgccagtcttggttagacagtcgtcgtaatatcataattggcaaga

SEQ ID NO: 75728 - DNA, 201 bp, Bos taurus
gggtcttctgaactttaggtcacattttcttctgccctgtgtttgaccagctaagattcacggctttgttgggatggcagttcaggccttatgaatatacrgtgtatatgtttacactgcaagtcaggtattcagcatctctgtgtgccagacactggttagagggtatgacatcaagatgaataggcagggcctactttc

SEQ ID NO: 75729 - DNA, 201 bp, Bos taurus
cccgcctttccttgaaagaaatgtcctgcctctcaaagcttccccatcacagaggagctggtcaagctccccttcttcctggccttttcctaaggcttaaygagccacagtatctgtcatcagtcatccgttcgctgaaacgttttggtttctgtataacatcttaacctctgtggccaaagaccatggagtgcagcatca

SEQ ID NO: 75730 - DNA, 201 bp, Bos taurus; identical to SEQ ID NO: 36268

SEQ ID NO: 75731 - DNA, 201 bp, Bos taurus; identical to SEQ ID NO: 36271

SEQ ID NO: 75732 - DNA, 201 bp, Bos taurus; identical to SEQ ID NO: 36273

SEQ ID NO: 75733 - DNA, 201 bp, Bos taurus
aaatctgagtgtgttttagaaaacatttcatctcatacatgaatttttagcatgcacaaataaagccagattcaggacaagatgcctgtatgcatgatccrtcactcagttgtgtccgactctttgcaacgctatggactgtagggtcttctgtccatggacttctccaggcaaatctactggagtggtttgccatttttc

SEQ ID NO: 75734 - DNA, 201 bp, Bos taurus
tctcagtggagctatttaatttttaagtttgtcaacaatctggtcatcccgttaacctactatttctttcctttatcccaatcccttttcctaatgaggcragtcctgtctgcccacctcctccatatatacctctctttcttattcatactttacacccacacagggaatgctttgggtgttctggttgcagttggagca

SEQ ID NO: 75735 - DNA, 201 bp, Bos taurus
gcattcaattagtaactcacaatgatgtgtaaaattgcacagagtgttaaaagaatttgttctggtgtgcagctataactggagatgtaatttacaagtgratgagcataagtatgatcattagcatcactgctgaaagtgagccctctccctccccagtgttagaagtcactgaccaacgacctactggggatataccca

SEQ ID NO: 75736 - DNA, 201 bp, Bos taurus
ttggtaagaaaaacaagttcaatctataaattcaattaagtaattgataagaagttaattacgcagttcctatggtcaaaggctgtctcaaatcagaactyttggtgacataaattagcagaaatttccaacttaatattccagaacctccaattgtcagttgcattcaaaacatgtcccatttttgggagcaaatcagat

SEQ ID NO: 75737 - DNA, 201 bp, Bos taurus; identical to SEQ ID NO: 36274

SEQ ID NO: 75738 - DNA, 201 bp, Bos taurus
gagctgcacatgactgaagcaacttagcatgcatacatgcatggacatgtaaaactcttccaagtgcattcagttccaattcacttctaatgttgttgccrggacttgtatatatgtttctataactcacacttattatccattgccctgcatgaaaatctcttatcatgccctaaatatcgacagtggccttttcaatgg

SEQ ID NO: 75739 - DNA, 201 bp, Bos taurus
catcgtcctctgaagctgtcacattgtgtgaggtgctaaatggagatgaaggtgggtgaacatattttcacagcaggttaagtacatagagttctgggaayagggagcatgcttaaaagaagccttggcaatctatcgatctgtctatccaggcatctattgttcccggattaccgtgtgtacccagaacacctgaaagga

SEQ ID NO: 75740 - DNA, 201 bp, Bos taurus
aatacttcattgaattgagctgaagagttaatgggctttatgtaagttatacgattttaacccgctacttgtaaatagcacttgggtgggccttctacctygcagaaggaaatggcaacctgctctagcatcgttcctggaaaatcccatgaacagattctccaggccagctacagggatgagcctggcaggctacagtcc

SEQ ID NO: 75741 - DNA, 201 bp, Bos taurus
aaactgtatcttttaaagtaaaattgcccaatgctgtgagcatcttcaggaaatgagaaatgtgaaatccataaaagtctaagttggctaaaccagatgtytaaatacctcctgtgtaataaataatatgaatagatttttgtgaccaatagaacataatttgatttgaatttgatctctcctcaggattcaagtttaaga

SEQ ID NO: 75742 - DNA, 201 bp, Bos taurus
aatcttatgatcacccaactcaaataatagtgttgagtttattttgcactgtctttatgcctcttatcatttactttaggtaattctacaatttttatctraactttttgtgttagcatcgtacagtgaactatacttctctagtatacatttgtgtatttgtacaagtaattagttcatccagcacttactaagtgtgaa

SEQ ID NO: 75743 - DNA, 201 bp, Bos taurus
gggattgaagttggataaaatcattgttgtgtgggccccgagctgccttaggatagtgtggatatgatgggacagaacacggtggctgaattagggggcaycagagtggccagtggcccagaagcatgactatgagctcaggacgcgaagccaaagggcacacgcttgcccccagagtttattgaaatgtcaggttgacag

SEQ ID NO: 75744 - DNA, 201 bp, Bos taurus
gcatgatcaccatactgcctttagtcttaagcagagtgaatctgtgtggtcttagagcagcattatccatgctaaaaggggggcttcattagcttgaggcmaagatgatgctcaggctttcccaggtggcgctggtagtaaagaacctgcctgcccatgcaggagactttagagatgcaggttcaatccctgggtcaggag

SEQ ID NO: 75745 - DNA, 201 bp, Bos taurus
tgttgaatttcagatgatgctgccagctgcagacttttctgcgttactaattttcagacatcacttactttataacacttcacacagctgtctacccccarcttaaatgactttctgatttctgaacaagaagtagctatacaaataatggcttcagaccaaggtccttggcagaatgatttcatccaccaggcctggcac

SEQ ID NO: 75746 - DNA, 201 bp, Bos taurus
tctttccatatatttccatttcattgatcagttttccattttttccctttcaatggcttaagctttaaataacctttctttttatcttagggtccttgagyggaagcacaactacagtatttttgctaacataagcagaaaaggaagttaggataacaattcccaaataggaaaatcctctaaaaaaagaaaaaaaaaagt

SEQ ID NO: 75747 - DNA, 201 bp, Bos taurus
cctgaggaatctttcagtccagcctagttcccctgaaagacctcactaactgttagcggctgtggcgggcttgctgtatgctatatattatgagttaagaracgctgtgcttaatagattggatatgctcctttgcatcatgcttagaaggttggattgtcctgtgcaaagatttatacaaatgtaaaccaggtgtctcac

SEQ ID NO: 75748 - DNA, 201 bp, Bos taurus
gcccaagaatcgcctggttgtgttcattacaatcctctaacctctacaagaatggaaacatcagtacttgcttaaattctcttcatgactttggccaatcyggggaacaagcagcaagggtctttcttctccgtgtttaagtataagcttcctgcctttcctcccaggagcgtggtgggaagtgctctggagagaagaaag

SEQ ID NO: 75749 - DNA, 201 bp, Bos taurus; identical to SEQ ID NO: 36276

SEQ ID NO: 75750 - DNA, 201 bp, Bos taurus; identical to SEQ ID NO: 36277

SEQ ID NO: 75751 - DNA, 201 bp, Bos taurus
ggaggacctagcttcagaaagatggtgagttgcaacaaaaattaaggtcacacgcagaaacaactgaagttgtgcacggccgctgtgagccctggaccaayagtcaccgctacctctgcactgtgggtgctggcgactctggtggaagaagtactaagaagtccctgcttgctgtgtatgccaatggccaactgaggacat

SEQ ID NO: 75752 - DNA, 201 bp, Bos taurus
agaactgcacgtctgggagacaacattaatttgtatggcatgactcacgctgaaaaataacaagtttgtagtcaagaaccatgcattcccacttaattaayctcccttgtaactgctggggtggattatcggtgagtcacacacgttttttgtccacaggatgaaggcaggtgtgccactttggttcgctgtatgattttt

SEQ ID NO: 75753 - DNA, 201 bp, Bos taurus
aaagctaagatttaactaacaactgggtgggtaatggttatcagattaatcatgacagggttgccctcgaaggagcaaggtttgagtgtggactgggaggrcagtaaggatgaatcttttgttgctcttcatcaaagtgatggtcaattttatacgtcaacttgcctgagctaagggacaccaagaaggctggtaagacat

SEQ ID NO: 75754 - DNA, 201 bp, Bos taurus
taagaaaaaaaaaaaaagcccactaaacgcaaatatactctctgattctattgctttgcttactcagaaatcacccgtgtaaaactgctgccgctatgctrggcataacgtttttccctttctttttgatttctttaacacatggttcgtggcctttggtacatttcagcagagttaattaagttttcagctacaagtcta

SEQ ID NO: 75755 - DNA, 201 bp, Bos taurus
ggtgaagttggcagggagagaagacgggtactggagaggcctgctcagaggctggtaccctgggcgacaagaaagctatcacacaggaagaccgatagcayagcgagagcgtggggcccacttgggatgagagaaactgcatctggtaccatccaaactgcttaatggcatcaccgacccaatggacgtgagtctgagcaa

SEQ ID NO: 75756 - DNA, 201 bp, Bos taurus
tccagaaggctgtggatcagccctagagaaatcagcctaaagcgccgccagcctccaggggcctctcgtcttgacgcaaaagcctggggccgcgaggggcrtggtttagccagcagagcaactccgcatccttcggggaagatgaccgaaaatgctgacgtcaccaccccagagacagctctatcagagataagcaaagag

SEQ ID NO: 75757 - DNA, 201 bp, Bos taurus
cgcaggtaggcatttgactagtgctttgccaagttaacataaatcgtaaaaccttttcatagtcccttagcatgatagaagaaaaatgagttacaaatatytatggagagtctagtgtcccaggcagattgattataaaatgtggaaacctacataataaacagaaaaatattgggaatgttttgaacaggaaggctggct

SEQ ID NO: 75758 - DNA, 201 bp, Bos taurus
tacagcgaagcatcgccatgtttgtgatcttattaacatacactcgtaacaccaagctccggtgacatgagtatgccgttgttaatgagaaaagagtcagrattacgtctgcaaacagttgtgctacatgctcagtcgtgtgcatcccctgcctgtcactaaagctaacagccaccaccaaccaaatcaggaagctgcttt

SEQ ID NO: 75759 - DNA, 201 bp, Bos taurus; identical to SEQ ID NO: 36281

SEQ ID NO: 75760 - DNA, 201 bp, Bos taurus
ggagtgggtagctgattccttctccagggcatcttcctgacccagggctcaaaaccgagtgtcctgcattggcaggcgggttctctaccactgagccacayggggaagcctaacgtcatctgtgatactctcacaatgcagatgtggtttctgagaatggatggcagaggaccaggtgtccattacctacaatcaaaccac

SEQ ID NO: 75761 - DNA, 201 bp, Bos taurus
ctgacccatcccattatggaaagggtgttctggttaatcttccaggaggtaattacatctagggcctcagattcccctgcaatttcacccgattctcccaycccaaattacagggttaacacggcagccccctaggaggtagtttgtacattcccaggtcgattaataatattttcttatcatatttttggtttgataaat

SEQ ID NO: 75762 - DNA, 201 bp, Bos taurus
attaggtctggtacttcctacattgtcttatatcatttactaatattttctagactattgcccatctctttcattttcatcatactttttgggaaattccytcaactttagactataattcctctggtaatttttttcagcaattatagtcccagtttccaagagttctttttcacttgtctgacaatttattttacatcc

SEQ ID NO: 75763 - DNA, 201 bp, Bos taurus
gatttgtagttacttttcagtcactcggttataatgcaaacacttccaagtagatcacagactcaaaaatttgttcacggccaactgattgccttttaaayaaagaagtcagcaaaagaacaaaactgcttttttctatgaagcaaaactcagtgtaggcgtgggtctccctttggccacctgccctttgatttagatttt

SEQ ID NO: 75764 - DNA, 201 bp, Bos taurus
cctatctaccttgtcaaggagctgacacacaaacttatttttttcaaaacctgccaggcagaagctcaacgtatttagggagtctaaaagcctaaatgacratttccaaatgaatattaggagagttaatctgtttccccttatctaccgtataaatctttctcttcgtgcccaagggcttcagattttaatagaaaatat

SEQ ID NO: 75765 - DNA, 201 bp, Bos taurus
aggactgggccagcaaccacaacctggtgaggaatgataaaggattagcgatgtgggaggcttcggaggaggagagatgaactccaatctgattttcagayggcccaggatagaaggaatcggggtattcagtggcattaggaagtattcttcaagaagaccgccaatgtttaaggactctggcactcaaaggaccccagg

SEQ ID NO: 75766 - DNA, 201 bp, Bos taurus
tatttcctaatgtacaaaggcaatttcaattattttttcaaaactgaggaaaactggtaatttttttaaaagcacatttactatgaaaataagaactaaasaagaactaaacaagaactaaagagcctcttgatgaaagtgaaagaggagagtgaaaaagttggcttaaagctcaacattcggaaaatgaagatcatgaca

SEQ ID NO: 75767 - DNA, 201 bp, Bos taurus
agcaggactcttcagtgtccagactgagtcacgagggcaggccccatcctctacttctggttcagatcattctttgtatcatcccttctagttcagatacyaccctgtttatgctttctgagagacagcatggttttgaggaatgagtcctgagtcgtcagaaagtttaggttgaaaacaggtttgttactttcaaacaga

SEQ ID NO: 75768 - DNA, 201 bp, Bos taurus; identical to SEQ ID NO: 36287

SEQ ID NO: 75769 - DNA, 201 bp, Bos taurus
tttgtatataaacagactgtatatacatttctgttgtaggggaaaggattcttcataaaaattctgcatttggagaactgttgtgattcccttgggcctcrgagctgttttaagaagataacgttccatattttcaaaagcaagataacttcccaaggagaagagaagagacatggctagaaatccacatggccgtgatct

SEQ ID NO: 75770 - DNA, 201 bp, Bos taurus
ggggaatggtgtcacaaccatgtaacatcgaggtgtccagagaactaaaaggagaaattcaattactttctaacccttcctacgtttctactttacacaaygcttcatcattagaaaagttcactagttcttagttccctttcattatagactgtctcatcaaggactccaactcaaactacccacccggccaccagattc

SEQ ID NO: 75771 - DNA, 201 bp, Bos taurus
attaagatttaaaaacatgcacattgcaaatgatatggattttgaaccattgttttttccttccgaacacaaaatccaagtaagtgttagatgttaacgawaccatggctgaaattctgagtttgaaaactgatttttaaaataaaatagtgagaccgaattgtgtttttccattagcaccaatctggggctcaaaataag

SEQ ID NO: 75772 - DNA, 201 bp, Bos taurus
ggatgtggcagggtcggcagtgggggcccagcgcccgcctcagcctccgagctcctgcagcctaggcctggcttcccgggggccgcggatgagcgtttccrccaccagatccatttggctctatttaggaactaagtacaggaaggtagttattgtacaagattagtttcctgtaggccataaattggcagtagcagaaaa

SEQ ID NO: 75773 - DNA, 201 bp, Bos taurus; identical to SEQ ID NO: 36289

SEQ ID NO: 75774 - DNA, 201 bp, Bos taurus
acatgactgccttccccgtctttccacatgcagaggatgagaagagtcagagaggtgttaaacaggaaaaagggctcctgcgtccacggccttcacgttcygtgagatccagcctctttcctaagagcctcctgagcccactcagtcccttctcaccgtcgaggctggtttgggcaaacagaccctacgtggccccgcatc

SEQ ID NO: 75775 - DNA, 201 bp, Bos taurus; identical to SEQ ID NO: 36291

SEQ ID NO: 75776 - DNA, 201 bp, Bos taurus
cggccggttctgcctgtcagctcgtcccctgcagtcacagccaggagctccccccgcatgtccgtccccacgtgcacacagcccggctgtgcaggacgcgygggactgacggccgagtctgtgtgtccgtctgtctctctgtacctgccgtgacagcccccttttggcgtctgagtcgcggaattcgtcagaggccgagtt

SEQ ID NO: 75777 - DNA, 201 bp, Bos taurus
gacccacgcgtgtgcacacggccctccgtgagcgctgccgctgccgcctgcgcctggactcatggtcacccggggcgccggcactgacggcaggccccacrtcctcacgagcaacaccagcggttaacacggggtcacctgatcccagcccagggacgggagcactgcagggacgggagcactgtgtcaccgggccctggg

SEQ ID NO: 75778 - DNA, 201 bp, Bos taurus; identical to SEQ ID NO: 36292

SEQ ID NO: 75779 - DNA, 201 bp, Bos taurus; identical to SEQ ID NO: 36294

SEQ ID NO: 75780 - DNA, 201 bp, Bos taurus; identical to SEQ ID NO: 36295

SEQ ID NO: 75781 - DNA, 201 bp, Bos taurus
gactcagccccttgggaggccccatgcggtgctcagcacagggtctctccagaatcgttgtcgcgatgacagtggggaaggcttggctgggagattcttcrtgggaagaatggccagagaccctggaggaggtgacgtttaatgttcagcaagctgtgcccagtctactctcaagggagaccttagacacagattcagagc

SEQ ID NO: 75782 - DNA, 201 bp, Bos taurus
tgccagctgggggcaggtcaccgacggcctttgtccaggctggttttgcacatttgcccttaaagaatggttctggaacgtgtgtgcaaatctgggtggarcatcaagcaggcgacgcgtcaggcccagtccacaccgcctttccaggggcacgggagctgcccggcctggtgcccagcgcccagcacacccaccctcgtc

SEQ ID NO: 75783 - DNA, 201 bp, Bos taurus
atcctcagaccactgactggcccatgtaggacacgaacccaccatgccacctgcaaacgcaagctctgttcacgtttaataaggctacagacgctgcaacrttcgcagcatcctccagggccactcctcaaggtggactgctgcccgcacgtccacattagctcccggtatcctcgagaaaaacagccagagtcctccagc

SEQ ID NO: 75784 - DNA, 201 bp, Bos taurus
gttgggaaaaacagtcaccctcgagtggctcctgagtgtgaactggcggctccttcaggtaaaccgtagtccatgccactcccccggccagttcacacttragacagcccagcctgactccagttacacacgggggtctccagttcacacttgagacagcccggcctgactccccgttacagacgggggtctccgggggag

SEQ ID NO: 75785 - DNA, 201 bp, Bos taurus; identical to SEQ ID NO: 36300

SEQ ID NO: 75786 - DNA, 201 bp, Bos taurus
gtgccccagagtgtggcagcttatcctgccttacccacacgtggcccacacagtcatccccactgtgacggacttacgtgctgagggatgcggcagaggtyggggcagcgtcagggccatgagtgggcgagggacagtcacgagtgggtgaagatgggccacatgtgagtgaggacaggtgcgtgtgggtgagggacagtc

SEQ ID NO: 75787 - DNA, 201 bp, Bos taurus; identical to SEQ ID NO: 36302

SEQ ID NO: 75788 - DNA, 201 bp, Bos taurus
atgccaagtacttgccttaaaagacacttctatcatctacccaaatcacacatacacaaatcttatagaaataccacagctatcaacaaggatttgggccmtaagagtcaaaatttggctttctccaccatcagagtcagcctgaccaaagcttgcttgctttttatcacagtagtaattttggatttcttcttgtaatca

SEQ ID NO: 75789 - DNA, 201 bp, Bos taurus
ctgcatctctgactggttttgttggcagatttagctgtcatattcattagtctataacttgttatcttcatcagtaattgtaccttttcttgtgcataatkttcctttatcctgttagcactttcaatcttaaattctccttctttacattgttattacaaaatttatgttctttttagttttgattaccttggagctacc

SEQ ID NO: 75790 - DNA, 201 bp, Bos taurus
taaattaaaatgagaatccttgtacttacattttcatggaataattcttatctgtttctgtctagtgaataaaagaaattatgctgactcagtcttcccayaccagaaaactgggtcaaactgaagagagcagttaccttatacaggcaatgtcctttttccatttttgtaaaccaatattgtgaaaacccagatttactc

SEQ ID NO: 75791 - DNA, 201 bp, Bos taurus
caccaagcaattactagtattttctagtcatgaaacatatattccccctatgtgtgagtactacagttctttgtctaacttttgtctgtagctttaatctyacactcttgggaacccaaacctgccaagcaactttatagctaaggctagtccacaagaagcagtgaccaaccttcttttgccatttctctggaataaaaa

SEQ ID NO: 75792 - DNA, 201 bp, Bos taurus
cggataataaacttcagctaaaacaagctctttaccaacctctttcttctgtctcatcttactcatcttgtttagaggtttcttttgagagctctctctcraaaatcttgtgcacaagaatccctgtctcaggctctacatctagagcacctaacctacaatcgggatctctgaagaatccacaaaagcaggaaagagaaa

SEQ ID NO: 75793 - DNA, 201 bp, Bos taurus
cagagaggattgctggttttctgagccctagcagagtaggctctcttgctgagatcaggtgagcagagacatgaattaagggaaggggaaggattccaggmagagggtgcaataagagcaaagaccctgaaataggaacaagcttggcatgtttgaggaaccaactctgtgcgcagtgtggctacagcgaagtacagcaaa

SEQ ID NO: 75794 - DNA, 201 bp, Bos taurus
tgatccccagtacatatcgagttggccataaagtttgagttttttttgtaaggtgtctcaaaaaatgcaaatgaactttttggccagtccaatacatatcytcatcaataaagatgagaaaaatgagtggcagacagttaagtgacttgctcaatatcatactgttgataagtggcagggccttatagcccagataagtct

SEQ ID NO: 75795 - DNA, 201 bp, Bos taurus
cactggcctagagaatggcaggagacagaaaagctgaagatgaggagaggttagtactggacatggtatgattgaaatctaagtagagaagttaaggaaayggtgagatatatccatttggaattgagagaagtcttctggaggaaaaaaagatttgaaaatcatatataatataaagatggaagaatgcctgagcattaa

SEQ ID NO: 75796 - DNA, 201 bp, Bos taurus
taagaaatgtaagaaatgtgatgcaattcatgacattactggcaaaacagaacaaaaagcctacttttataatttcctcattctgcgctctagcaagttcrataagaaagttcagcaagttcaataagaaagttcagaaaatttatctgaagaaagaatacacttcaaacggaagaaagcaggaatattttattttaagaa

SEQ ID NO: 75797 - DNA, 201 bp, Bos taurus
aggtaaatggaaaacatcagacaccacactgagatttcacttatgcctgagtgggacagtgtaaaaacccaacctggggaggaactggccatggtcttgcrtctgatcctcccatggtttgtcccctgaccctgagggtgcagctgtctgtgaaggtgacttgaccatcatggcagtgtgaccctcagggccctgtgggta

SEQ ID NO: 75798 - DNA, 201 bp, Bos taurus
gtacattatatctcggtggagtactgacttggagctccaatagaaccccatgcagagggaaggaaggagggatggaggaaggaaagatggacataaaagcrccaccagttgtttgacctgagctgtcagagttgagtcaaactcttcgcacaatttttcttttttaaaaaaaatgatttattttaaacaaaagaaagatga

SEQ ID NO: 75799 - DNA, 201 bp, Bos taurus
aggaggggacttctgccaatattttccctctctcctttgtttctcccccaaagagaaagctggttaatccagctgggcatatattaatctttactgggccyatttcactagtgggccaagttactgtgtccccaaagcctcatctgtattttctctctttaacaacctgtttaaatgcagacacagacggtcctctcactt

SEQ ID NO: 75800 - DNA, 201 bp, Bos taurus
cattgcactggtgaatccctcatctgtaccaacatttaattttacttaactcacttctgtttctatttattttttaatattaacccaaagcctgaatcaamctagttctaatgctcataatcagatgggtctggtgcactgaaaaagtgtggctgtgctctcacagaatgacactaaagtaagaaaaagagaagtaagccc

SEQ ID NO: 75801 - DNA, 201 bp, Bos taurus; identical to SEQ ID NO: 36328

SEQ ID NO: 75802 - DNA, 201 bp, Bos taurus
tcacatggcctgaagatgaggacacagacatctttggcaggggcattgttctgtctaccctggaaccatcaagctagatcacccagaagaggagacctgcrtcttcctggaaggcccccctcaatgcccttgttgctctcccttactgacggggggcagtccccgcaagggctcatggagcactcaggcagagatccacga

SEQ ID NO: 75803 - DNA, 201 bp, Bos taurus
atgttcactctggctgctgagggtccactggagtgaccatccaggtttaggaaccagcaacttcagctgtgaaagggaagaagagtccccgagcctggtgrtagacccatccttatgtgtttgaagcccccttttctgtttggggcagaaggcagggcttttggtgatgcgtcaccaccgctggtatcacaaggcggtttc

SEQ ID NO: 75804 - DNA, 201 bp, Bos taurus
tgtttcttggcccaaatcctcgttggcaattcaacatgattaaagtgtctggagagcatcttcaagtagagcacctctggtgtcccattgtcatctggtcyttgaatagatgtatttctcttggccctcttactcaaacttttgatcgtttataaaacactgccggttgagaaggtagcctcttggcggagattttgagag

SEQ ID NO: 75805 - DNA, 201 bp, Bos taurus
gcttgaggtacaggccagtggggagtcagtgagagaaacagagtgtgtgtgacagaggaaggagagacagtggggcaggaccagcattctggttgttcccrcagggacttggtgttggggccatcaacgtaacttgggcagttctgaattctcctcttacagcatgtagaacagaaatagctaatagcaatgatgactgac

SEQ ID NO: 75806 - DNA, 201 bp, Bos taurus
gtgttgaaggagaccaatttatttagcctggctctactaggaggcagaaactatatgccctttgtcattatctttgaattagcccctttggtggttgaatyggggtcaggggaagatagataaaacaaagatttagaaacagagagagctttgattgctgccttcataatttacttattataaattattggccaattattt

SEQ ID NO: 75807 - DNA, 201 bp, Bos taurus
catcctgttgccttcctgaacatctatggcttaatcagagcttgcagtggccaaaaaaagtcatcagtcatggacaaaagcttctgtaaacactagtccaracaggacagattaggaaatcttgaaactggataatcaatcaagagaacaaatactccttagcaaacgctgtaatattcacattgggcttccagttaatca

SEQ ID NO: 75808 - DNA, 201 bp, Bos taurus
tgcccacattctcatcttcctttgagacacagaaggttctgactcacctctctattttgatcttccactgatcctaaatatacatccgaacactaagtcaygcatacatatgtataaatgctaagtcatcacaattcctattatctactcaaagctttaagtcagaatcatgacactgccaaacactgagcagctacagca

SEQ ID NO: 75809 - DNA, 201 bp, Bos taurus
gttgactgacatgcggacaaacgtttgccccaactgttccctggtgcttctatcaagaggatggagggaacttatgcacaaatgtccccaggagcaaagtycaatgactacaattcataaggtaagaatgacagagagaaaagatccctgcagacagaatttctagggggatcagaggaggtggtagagataggaagtgat

SEQ ID NO: 75810 - DNA, 201 bp, Bos taurus
gtgtgaacattagcccagaagcctggcaccaaaggcggaagccagctctgctcttcatgctcagccctggctggaattaacagccctttgaaggagatggrggtcatggaatgaatgccaagatgtttaccctaagagcctcctgtccgacttcctcagaaaaaccactcttgtccttgaactccaggttcagggttttgt

SEQ ID NO: 75811 - DNA, 201 bp, Bos taurus; identical to SEQ ID NO: 36331

SEQ ID NO: 75812 - DNA, 201 bp, Bos taurus; identical to SEQ ID NO: 36332

SEQ ID NO: 75813 - DNA, 201 bp, Bos taurus; identical to SEQ ID NO: 36333

SEQ ID NO: 75814 - DNA, 201 bp, Bos taurus; identical to SEQ ID NO: 36334

SEQ ID NO: 75815 - DNA, 201 bp, Bos taurus
acacttgggccagcaccatctcggacctcaggattttcacctgtggaataaaggtctggctcttaatctcaagggaggccacaggcctgcctcccaagtcyctgaggggattcttcaaacaatatttttttccaccttcctcctattggttgaaagtcaaggccataaggactcgagtccctgaggggagcaggagacatc

SEQ ID NO: 75816 - DNA, 201 bp, Bos taurus
tgagaacaagagatattcctgagactctatttctgctcgcattactccttaggtgcaaacctccacttcctgcctggacttccacgtgtcttgtgttttgsactgacccagtcagactgttctctggtctcattctgttgaaccattctcttcagttttatctctaaccaagcaatagcatttaccctgcttgttagagtt

SEQ ID NO: 75817 - DNA, 201 bp, Bos taurus
aattcctgatctatagaaattaagataataactttgttatttttaagtttgggctatttgtcacacagcaatagctaactaattcaggaactatggccacraactacatgaagcagagtgaggtgcctaccaacagagtgggtggggtctaccacattttctcaacacccaacctaccaagctgaagggtaggcctaaatg

SEQ ID NO: 75818 - DNA, 201 bp, Bos taurus
ttgtgcactggtgggagggtgcctatgggatgcagcaatacttatttctgtgtgaaacaacctagtgtctgtttttaaggcgtatcagtgagaaatcaaasaagtgccagctgatgaagaatatttagtttcttttccaaatgaatctccttgggtcttataaacagcatttttatagactacatgtgttacctttacaac

SEQ ID NO: 75819 - DNA, 201 bp, Bos taurus
ctttcctgctcctccttccttcaggtttatacctaaaattcacctttgtcagtacggtcttccatagcctccctacataaaatagcaacagctggccattycgtatttctctcctttccctatttgtctttatctgttcagttcagttgcacagttgtgtccaactctttgtgacccatggactgtagcacgtcaggcctc

SEQ ID NO: 75820 - DNA, 201 bp, Bos taurus
cacctgaccgtagctcagaagctcagcataggtgggaatttgaaccgtgtccttgtccttttaggccacccagcattgagtgtgcacgtttgactctgcarcatattgagcagttgttctcattttatgcgggcagaatctgaatgtcatagttttcttatgaacatcgactactttttaatggtgcttgacattgaaagt

SEQ ID NO: 75821 - DNA, 201 bp, Bos taurus; identical to SEQ ID NO: 36338

SEQ ID NO: 75822 - DNA, 201 bp, Bos taurus
gactcagtggaaagaatggagtctttattttttttcagaatattttgattccataatatgactgacacatatccatatgtcccaaagcagcatcttgggcrttatagaagttttgcctaacaattttcttcagaaagctcagaacacttagccaaatccttaatagattactctttaatagattttctaaggaaaaaaaat

SEQ ID NO: 75823 - DNA, 201 bp, Bos taurus; identical to SEQ ID NO: 36346

SEQ ID NO: 75824 - DNA, 201 bp, Bos taurus; identical to SEQ ID NO: 36347

SEQ ID NO: 75825 - DNA, 201 bp, Bos taurus; identical to SEQ ID NO: 36348

SEQ ID NO: 75826 - DNA, 201 bp, Bos taurus; identical to SEQ ID NO: 36349

SEQ ID NO: 75827 - DNA, 201 bp, Bos taurus; identical to SEQ ID NO: 36350

SEQ ID NO: 75828 - DNA, 201 bp, Bos taurus; identical to SEQ ID NO: 36351

SEQ ID NO: 75829 - DNA, 201 bp, Bos taurus; identical to SEQ ID NO: 36352

SEQ ID NO: 75830 - DNA, 201 bp, Bos taurus; identical to SEQ ID NO: 36353

SEQ ID NO: 75831 - DNA, 201 bp, Bos taurus; identical to SEQ ID NO: 36354

SEQ ID NO: 75832 - DNA, 201 bp, Bos taurus; identical to SEQ ID NO: 36355

SEQ ID NO: 75833 - DNA, 201 bp, Bos taurus; identical to SEQ ID NO: 36356

SEQ ID NO: 75834 - DNA, 201 bp, Bos taurus; identical to SEQ ID NO: 36357

SEQ ID NO: 75835 - DNA, 201 bp, Bos taurus; identical to SEQ ID NO: 36358

SEQ ID NO: 75836 - DNA, 201 bp, Bos taurus; identical to SEQ ID NO: 36359

SEQ ID NO: 75837 - DNA, 201 bp, Bos taurus; identical to SEQ ID NO: 36360

SEQ ID NO: 75838 - DNA, 201 bp, Bos taurus; identical to SEQ ID NO: 36361

SEQ ID NO: 75839 - DNA, 201 bp, Bos taurus; identical to SEQ ID NO: 36362

SEQ ID NO: 75840 - DNA, 201 bp, Bos taurus
atgtctggcccacagttagtggatcaaatcactgacgtaggtcagaaatagctggggcttccctgttggctcagaggttaagaatccttcttgaaatgcargagacatgagttcaatctgtggcctgggaggatccctggtgcagcggagcaactaaccccgtgtgctgcacctactgaagcctacgtgccctagagcctg

SEQ ID NO: 75841 - DNA, 201 bp, Bos taurus; identical to SEQ ID NO: 36363

SEQ ID NO: 75842 - DNA, 201 bp, Bos taurus; identical to SEQ ID NO: 36364

SEQ ID NO: 75843 - DNA, 201 bp, Bos taurus; identical to SEQ ID NO: 36365

SEQ ID NO: 75844 - DNA, 201 bp, Bos taurus
gcacagcttggtggagtcatcatagcttgactggaagtcatcatagctatgcccctgtctgagctgccactcaccagcagggtgagcttgggaaagccacrtttccttctgggcctcactgtctcagctctaaaatgtgggcgttggagctggatgggttggtggagatgacgtcggagagcaggtctcaaccagggtggt

SEQ ID NO: 75845 - DNA, 201 bp, Bos taurus; identical to SEQ ID NO: 36366

SEQ ID NO: 75846 - DNA, 201 bp, Bos taurus; identical to SEQ ID NO: 36368

SEQ ID NO: 75847 - DNA, 201 bp, Bos taurus
acttcttctttaagctgcaagttttggcctctgggcccaaagaggaacatttctgagattacctctaattctttttggccccaaatgaaaaatctatcacrtggactttctctgccctgtgtgaatcaggttaaaaacgtttattgttcaaattatcttggaggttctgccccacattcattactgttgcggtaaacacag

SEQ ID NO: 75848 - DNA, 201 bp, Bos taurus; identical to SEQ ID NO: 36371

SEQ ID NO: 75849 - DNA, 201 bp, Bos taurus
acatacagatttttatttctactagaaacacctgaagagtggactaagtgatttttccaccgtcagttcttgagtaagaaaaaataaccgatggccatggrggctcagtgaatagtttgagttcagtctagatattcttctgtgtgtcctgtgatattgtcctcgttcacttttggcccacagcagttttcttcttgcttc

SEQ ID NO: 75850 - DNA, 201 bp, Bos taurus; identical to SEQ ID NO: 36373

SEQ ID NO: 75851 - DNA, 201 bp, Bos taurus; identical to SEQ ID NO: 36374

SEQ ID NO: 75852 - DNA, 201 bp, Bos taurus; identical to SEQ ID NO: 36375

SEQ ID NO: 75853 - DNA, 201 bp, Bos taurus; identical to SEQ ID NO: 36376

SEQ ID NO: 75854 - DNA, 201 bp, Bos taurus
aaaacttggtcaaccaaacatggcaatagattttatgcaagaatgcattatgaatggcttaggagtaaatgcaaggttccagaagccaaagggccagggaktcaccggacgacacagcccactggacctttgcccaattgagcctgactctccacttctccccctggccctgtgtttactgatcctgtatattctacatat

SEQ ID NO: 75855 - DNA, 201 bp, Bos taurus; identical to SEQ ID NO: 36379

SEQ ID NO: 75856 - DNA, 201 bp, Bos taurus; identical to SEQ ID NO: 36382

SEQ ID NO: 75857 - DNA, 201 bp, Bos taurus; identical to SEQ ID NO: 36383

SEQ ID NO: 75858 - DNA, 201 bp, Bos taurus
tattcagttttcttcaccactaggcaaaccacatgactggtcctggtcctcaccaggtgggtgatggcaggggtctcagataatggccccacagaagccaytgatgttatgtaacaacaaacaggacacttgaactttgagtgattcatcgggtcatcttatgataatctttgggccctgtacttatgggttggttggttt

SEQ ID NO: 75859 - DNA, 201 bp, Bos taurus; identical to SEQ ID NO: 36385

SEQ ID NO: 75860 - DNA, 201 bp, Bos taurus
aaactgctacctgatttggaaaaaggatctttgtggatacagtaaaggatcctgatcatcctgatctacccggtgggcccgaaatccaatgacaaatgttyttacaagagcagagggagatttaagacactcaggaggaggtgatgtgatcagggaggcataggtcagaatgacaggccatgaggccacaagtcaaggaat

SEQ ID NO: 75861 - DNA, 201 bp, Bos taurus; identical to SEQ ID NO: 36387

SEQ ID NO: 75862 - DNA, 201 bp, Bos taurus
cagctgctgggaaatgataagagctcaacatatgttagaagcaacaatcacacgcaaggggtataacttgtctttttactatgtgtgaactggaagtttamaaggatgagtattagtttaatgtagaataacaaatattttttatcagaggataattgctttccaatggtgtgttagtttctgctgtacaacaatgtgaat

SEQ ID NO: 75863 - DNA, 201 bp, Bos taurus
tatgcttggtaacctggcgttctcagctagctgatgacaggagggtaacgaggtggatatgaaccagacaacaagtaaaaaaatgagtttctcaaactgargtctgtaggcctttggaagtccaaggttattttattcaatcaattgaattaatactgtaactgagcagaaccccatggaggcgacaggcctctccccaca

SEQ ID NO: 75864 - DNA, 201 bp, Bos taurus
ctgggttggaaagaacctaccatccaattagagtttccagaatcgtttctttctcctctttagagcaggaggcagtagaaggaagaaataattagcaagarcagcagggccagcatatttttttacaccagatgatgacgctgagttccactgcgtgaaaggaaaaagggaatttgatgggaattctgactgctaatgttt

SEQ ID NO: 75865 - DNA, 201 bp, Bos taurus
gagaagggaagcgtcctaaagggcaggaggccatctgcgagggtctggcagttctccgcactgaggggtaaagtgcacggggcagtggtcacagtgccccracgtgtgatggccagagaccacgtcctggaagatcaggccagactggggaactcaggcccatcctgagggcaacagcagccacagaagctggctgatgtg

SEQ ID NO: 75866 - DNA, 201 bp, Bos taurus
ccaggcaccactcagctaatgttgatttgcatgcttacttattttttacttttatttattccgatacaacctcaaactcaccaggaagttgtaaagacagkacaaaggccttctgaataccttttacccatctttgccaactgtttacatctggccccattttatttttttcaaatgtatttatgtgctttgtcaggtctt

SEQ ID NO: 75867 - DNA, 201 bp, Bos taurus
ataaatagtcataaatccactagtgtccacaaaagcctcttggccattcggaactgacgaagatgttgcccactcaagggatcttctcccagagctgtggmggagtttgctgggagagggctggccggggtgggttcacgggaggtgctggtccactctcttctgaagctgagaaaagacactgttctcaatgttttcatt

SEQ ID NO: 75868 - DNA, 201 bp, Bos taurus
gcacagaggtaatccacactctccccacccaggtcagtgtgagctctcaggtccagacactcaagtccaacaagcttactaataaatgtgccaaaaaggcrcgtaaaaagaaaacagcagtctttacagagaaatcaaggctgacaattcaatggcatgaagatgttaatttactattgcccttccctggtggctcagtgg

SEQ ID NO: 75869 - DNA, 201 bp, Bos taurus; identical to SEQ ID NO: 36396

SEQ ID NO: 75870 - DNA, 201 bp, Bos taurus; identical to SEQ ID NO: 36398

SEQ ID NO: 75871 - DNA, 201 bp, Bos taurus; identical to SEQ ID NO: 36399

SEQ ID NO: 75872 - DNA, 201 bp, Bos taurus; identical to SEQ ID NO: 36400

SEQ ID NO: 75873 - DNA, 201 bp, Bos taurus; identical to SEQ ID NO: 36401

SEQ ID NO: 75874 - DNA, 201 bp, Bos taurus
tacagttcctacttttcaagtagcttagtaatcctcatctattttcatgcccaaaccactcagaataaaagcaccttatagtggttacagtgacttccttkggtatggatgttgtttggacactcctctgtcctgtgtgaacctctgggtcctttaagcattgctgtgctacaggctgtgagaaaaagctaaatggactat

SEQ ID NO: 75875 - DNA, 201 bp, Bos taurus
ctgccccacatctgcaatcagtcacttcctgaagcagccttgtccttttaatagggaaaggtattcagagactgctgtgtgggtacattggttttatttcrctaagcctaaaagtgagttaaaattaagagcatcctggtctaatttcagttttcaaagtggtgcctcaaagtctgatgatttgattatttgagagtgagt

SEQ ID NO: 75876 - DNA, 201 bp, Bos taurus
aggtgatattaacacagcagatattttggattcagagggccactctaagtgtttttctctctctccctcacctccttgcatctgttccctttctccctcgmagtttgctcctgatgcaaaatgcgattgttacttgcaattttagtttgagatatgaacatttggagttatgtgtttttgaaagaaaatgaaatgtagatg

SEQ ID NO: 75877 - DNA, 201 bp, Bos taurus
tctgagcactggcctggagtccctccacattcttctcacccatttggaatttgggtcaagttgcttaaaattcttctttaattccttcagttgtgaaaccraagctttggatgccgaggccattaatgctcagattgtctcagtgtctagtgaggaggctcggctcggtggtttgcgggagttgggacattcgtgggaggc

SEQ ID NO: 75878 - DNA, 201 bp, Bos taurus
aatttctgcctggagtggttttgcaggtgatgagcagtggctgcgccagggcagggctgtgcttgttcctgcctttgggagctgaagttacttcccgagtyggcctgtgactcaggagatggtccctagggagcaagccttttcatgctcaaggagctacatcaagttctttcgtttgctctggaagtgcccattttctct

SEQ ID NO: 75879 - DNA, 201 bp, Bos taurus; identical to SEQ ID NO: 36405

SEQ ID NO: 75880 - DNA, 201 bp, Bos taurus
cttccctggtcttagccaatccaggccagaggattcagaggctgtcttgatgcagcagttccctgcattaccaaattgtccccaagatgaaataaatcccrtttggggccactcaattaacctaaactctcactctaatctagtgatgatttataaagtttttatctgggatactgtctaagtcatgtagttaagagttat

SEQ ID NO: 75881 - DNA, 201 bp, Bos taurus
tccaagatgctggatgtcatattcaggtggtggccttaactgtgtagcagtgtggagagatcaacaaaggtttgtgagaaaaagtctaacaccttctgatmtgtgattttggccacacgttgaaggacagattagcgagggaagagactggagacaaggacaccaatcaggagcttcatctgcttgtccaggggtgataag

SEQ ID NO: 75882 - DNA, 201 bp, Bos taurus
acatgaacagcagacactatgtcattaaggaattgcattcagacgcttccagaattctttgcctttcatttagccttctttattccacctaaatggtcccmgataaaacatgactaaaggaattaattttcctttatcctgtttccaattgtcttgatgatattggtttaaaagtctccaaggaaccagaaaacactcctc

SEQ ID NO: 75883 - DNA, 201 bp, Bos taurus
aaatgccctttagtcctcagaatggctgacccacctctctgatttgtgtctggaaggcaaaatggactaggatgtggccacttagtattcagaccatgtcrggatgcaagtaaaaagcctatagagcagcgctggacgcacggtcgccaggccaaacacagccagcctctcaaatcacagttaaattataagcgagtgtgg

SEQ ID NO: 75884 - DNA, 201 bp, Bos taurus
tcagttcagttcagttcagttcagttactcagtcgtgtctgacactttgtgaccccatggactgtagcacgtcaggcctccctgtccatcaccaactcccrgagtttactgagggtctgagggtctggcccacagcaaatgcttatcaagcacagctgatacaatgagtatgacaatattgacatctatgggttttttcct

SEQ ID NO: 75885 - DNA, 201 bp, Bos taurus
tgacgttgcctataattgagtgaataacagttttttcataaccttgacagtaaacatatctgaattcaccatttgattttctaaaacttgctgaaaaaagkcaaccaatagtaaagaagcattgtaagaagaaatttagtacacatgcacacacacaaacacatatatacctgtattcacatacatatgttgtctatataa

SEQ ID NO: 75886 - DNA, 201 bp, Bos taurus; identical to SEQ ID NO: 36412

SEQ ID NO: 75887 - DNA, 201 bp, Bos taurus
atgtgggatcttagtttccctgaccagggactgaacccacagcttctgcattggaaacttggcatcgtaaccactggatggccaggaaagtccagtaaatrcacttggaaatgtcaccctcctgcttcattaggtaaagaagcatttggaaagcaattacgattaagctattcattgttagaaaggcctatgaaatacaca

SEQ ID NO: 75888 - DNA, 201 bp, Bos taurus; identical to SEQ ID NO: 36416

SEQ ID NO: 75889 - DNA, 201 bp, Bos taurus; identical to SEQ ID NO: 36417

SEQ ID NO: 75890 - DNA, 201 bp, Bos taurus
gcttctgttcacagcaaaacttgttaaaaagttgtaattcttgcactcccatcttcaacttgtgttcactcctcaaccaactcatattcagccttccaaaytccactgaatcttctcttggaaagtttaccagtttcatctcaccaatgccacttaacacctttctgggcccaagttgcttggcagctcagcagtatttgg

SEQ ID NO: 75891 - DNA, 201 bp, Bos taurus
tttaaatttcctttatttctgtttactgcgttagagttttgacatttctgtatagcctttctaaccacccacgcaagttctgattcatcacccactccagygctccccatactgctctgtttatgtcaggctcttctatcttctttagttcaacctgaagtcacattccatctttctaggaatatttaaactattaaatat

SEQ ID NO: 75892 - DNA, 201 bp, Bos taurus; identical to SEQ ID NO: 36418

SEQ ID NO: 75893 - DNA, 201 bp, Bos taurus
tgtttctcctctataaaatgggaacaataacaaacccctacctcatagggtgactttgagaattaaataaattacttcatgtaaagtgattagcagagggmctgacacatagtaaaggctcagcaaatgctggtgatttgtattcctcatttcttatttatatcttatttgcctgtcctgttatagtagtggatacattat

SEQ ID NO: 75894 - DNA, 201 bp, Bos taurus; identical to SEQ ID NO: 36419

SEQ ID NO: 75895 - DNA, 201 bp, Bos taurus; identical to SEQ ID NO: 36420

SEQ ID NO: 75896 - DNA, 201 bp, Bos taurus
tctcacaagagttggacatgacctagcaactaaacaacaataacaaactacagatttaattctccaataacttactagaaattgcaatagagaatttgaarcaatgagggccatgatatgctaatgaaagctttattcagaccatgaaatgagataaaagttttacacttttaggggtttaaattcaacataattttgtgg

SEQ ID NO: 75897 - DNA, 201 bp, Bos taurus; identical to SEQ ID NO: 36422

SEQ ID NO: 75898 - DNA, 201 bp, Bos taurus
taaacttttaaatctatttttgtacctaaacatgccaaaatttcttctttgttgtaatattcctgattttttttctttgtgtcacagcccacacttctttstatccacctaatgatacctccctggggggcatctgaaatattataataggtagaaaggccactcccttcatctgatatttgctgaaagctgagtcaagtt

SEQ ID NO: 75899 - DNA, 201 bp, Bos taurus; identical to SEQ ID NO: 36423

SEQ ID NO: 75900 - DNA, 201 bp, Bos taurus; identical to SEQ ID NO: 36424

SEQ ID NO: 75901 - DNA, 201 bp, Bos taurus
caatctgctaaagggtagttcaacaaatctaggggccaaataatgaagatctgttcactaaatggacaagatgcctccatcagttgaaggtcatcagagasagtcttcaggtttatggcctgggtgatggggcaccattgacagaacaggaatagtctagaaggtaagggtcagttatccagaccagcaggggaaggcata

SEQ ID NO: 75902 - DNA, 201 bp, Bos taurus; identical to SEQ ID NO: 36425

SEQ ID NO: 75903 - DNA, 201 bp, Bos taurus; identical to SEQ ID NO: 36426

SEQ ID NO: 75904 - DNA, 201 bp, Bos taurus; identical to SEQ ID NO: 36427

SEQ ID NO: 75905 - DNA, 201 bp, Bos taurus; identical to SEQ ID NO: 36428

SEQ ID NO: 75906 - DNA, 201 bp, Bos taurus
atgagcagaggctgaagaattctgaaagccaaaaggccctctcttttgtgaggctggccccaactgaaggcagacaaaaaaggcaaagatgaaataaaacrgactttgtcttactaacctggcacacatgcctgctgatcggtggcttagctggcaaattgcaaggacctcgatgggaggttgaaaactcaacaagtcact

SEQ ID NO: 75907 - DNA, 201 bp, Bos taurus
gtcacttcagtcatgtccgattctttgggacctatggactgtagcccgccaggcttctctgcccatgggattctccaggcaagaatgctagagtgggttcscattgggatgttctacccagacccttttcggtaaactccatcttggctaagagatgcatgcgcacacatggaggatcctgagatctaccaaatgtggact

SEQ ID NO: 75908 - DNA, 201 bp, Bos taurus
tttatgacagtgagaccttatcattttagtttctttaccctctctttcactatcacttatctttgaccatctacatctaaacatgctctagtctttcctcktgaaaaaacacccagactctcttttaatccctttcctgtttgtgtgcctaagcttcagaccgttttccatgcacacccctgtttaagatcttctgtgctg

SEQ ID NO: 75909 - DNA, 201 bp, Bos taurus
aggagaatactgagaattgctgtggctgacgtcttcaccgcacctggacagtgaacgcggcagctgattcactagtataatggccttcagtgctttccagktgagtaaggccaggcatagtaaagacaattgtggaagcttcagacaaagtattccggtgtgagacctctccttttcatctgacttcacgtacaggaaaac

SEQ ID NO: 75910 - DNA, 201 bp, Bos taurus
agagttgccgaagtaagagacggaggagaaaagaaagacgtcctagaggccgaggctccattttcagcagcgccatttcgcttttcctttcgccgcgtttkgtttggttttgtttgcagcgggtggacgggcgccaacgcgtttctgcagcttcagcagctttgctccggcagacggggaggcacgcagggcccgcgctgc

SEQ ID NO: 75911 - DNA, 201 bp, Bos taurus
attttctctcactgaatgaaaccttgagtcccaggaggcctgcagaggagctggtaccgaggacccaggtctcaggaatgaggcaggagtggctggagctyagtgggagctgcagaggccgcaggccaggggctgctccaccccgacgggtgagccagcaggtcatgggcaggcgttgcagcacccctgctgtcctgtcct

SEQ ID NO: 75912 - DNA, 201 bp, Bos taurus; identical to SEQ ID NO: 36430

SEQ ID NO: 75913 - DNA, 201 bp, Bos taurus; identical to SEQ ID NO: 36432

SEQ ID NO: 75914 - DNA, 201 bp, Bos taurus
gcccgccaggtggggttcatctgtctgggttttacttaaagagccttgtccctggtgagagatgacagaggctgctctccttgcagtgtgaagctcacctyggccatgtgttccccgacggacctgggcctgctgggcagaggttctgcatcaacagtgtggcgctccggttcaagccaagaaaacactgaccacctccga

SEQ ID NO: 75915 - DNA, 201 bp, Bos taurus
ctgaggcctctacattggaaggcagattctaaaccactggacctccagggaagtccctcaacacacatcttaaaagggaaatgctattaacccagctaccratgatgaagttgaagctcaggcaggaggtgacaatggaaattggccttcaggggtgggtagggttttcgttcctggtgagttgggcatcccaggtgagag

SEQ ID NO: 75916 - DNA, 201 bp, Bos taurus
tagagaattctttagctagtgtttctggcttaagttggtccatgtcaactcttccctcaagtagggcaaggcctgggagatgaccttcttttctctctttrctcaagaatctcagtgctggaggttctgtgagctctaccagctgagaaccatttatgccataaaatttaggaaccttctgtaacatgcttggacagacct

SEQ ID NO: 75917 - DNA, 201 bp, Bos taurus; identical to SEQ ID NO: 36434

SEQ ID NO: 75918 - DNA, 201 bp, Bos taurus
gcagataaaagagtcactagtagtttcataaaccacgttaataattctgcgttaacaataaataactgcatgtttagtgttgttacctaagctctcatagycaagaccctcactgggcctggtcgttaaaagcaacggagctcttttaagcagaatctgaattaaacctgctttacctaaaatttcgtccaaagacacttc

SEQ ID NO: 75919 - DNA, 201 bp, Bos taurus
agggagtgtgtccccctgtacactgtgggatctccccccaccccaaagtgctatgggagcagtagctgtaggcatggccaccgagctgagctgggactgtrctctgaccacgcttcaactctctgtgctgggtgagcaggtggatgtctctgctgaggggccgtgattttgccccttgaggctgggggtttggggactgat

SEQ ID NO: 75920 - DNA, 201 bp, Bos taurus; identical to SEQ ID NO: 36481

SEQ ID NO: 75921 - DNA, 201 bp, Bos taurus
ctggcccaagtactaacatgctattctagattctaaatccagatgatctggaccaaatgattctaaagcttacaaggagatacaagagcacagtctctggrgtcagactgcttggtcctaatcacagcttcctctcttatcggttgtgttgccttgggcacattactcaatcttctcatgcctcagtttcctcatctctaa

SEQ ID NO: 75922 - DNA, 201 bp, Bos taurus; identical to SEQ ID NO: 36484

SEQ ID NO: 75923 - DNA, 201 bp, Bos taurus; identical to SEQ ID NO: 36487

SEQ ID NO: 75924 - DNA, 201 bp, Bos taurus; identical to SEQ ID NO: 36489

SEQ ID NO: 75925 - DNA, 201 bp, Bos taurus; identical to SEQ ID NO: 36490

SEQ ID NO: 75926 - DNA, 201 bp, Bos taurus
tcattctaaattaaatataccaaagatattaataatagttgttttcattttgctgtataatctctgctttcaacaaattacttttatctggtttttgttgktggtgatggtctcattttctcatgccagtgacagcctatgaagtctagtcattggcagatttctagttagctgcacttatttaagagaaggatgctaaaa

SEQ ID NO: 75927 - DNA, 201 bp, Bos taurus; identical to SEQ ID NO: 36491

SEQ ID NO: 75928 - DNA, 201 bp, Bos taurus; identical to SEQ ID NO: 36492

SEQ ID NO: 75929 - DNA, 201 bp, Bos taurus
aaaagggcaaaggagctctctggggcctctctcagtgttaatcccatgcgtgaggacttcactcatatgacctgctcacctccaagtcctaccttacaatmccattccagagggaatgaggacttcaaaatgaattctcattcagaccacaaaaggtggtgtccattcacagcccacgacctgaaactaaacttatcatct

SEQ ID NO: 75930 - DNA, 201 bp, Bos taurus
gtaggtatcctacatgttcaggaagagaaagattaaatggaatttagtgaacaagtaaagattaaacggaatttagtgaacaagtatcactgtcttttctrcagagattgaatttcattgtaacataggaaaagcctataagaataagttttcaattactccatgcattaaaatattaataatggttctctatgtcccagg

SEQ ID NO: 75931 - DNA, 201 bp, Bos taurus
gcatcccttagcccagtcagactgacataaaattcacaccaaccccaagtgagtagtaatcataatgtatgtttcccatagtagtagatgagagggaaaaycatctctagtataagaggacaacatgacaaaagggcaaatgtcttttggcctcgtgacatttggttattcaccttgaactatctttataagctgatgtca

SEQ ID NO: 75932 - DNA, 201 bp, Bos taurus; identical to SEQ ID NO: 36495

SEQ ID NO: 75933 - DNA, 201 bp, Bos taurus
tggggagaaagatttgaagcttagggagggcagtggggatgaagtgtgggaagcaggcacagactcccgtgcagagagaaggtgccaagaatgaggccatygtggaggaaatgatgcacaggtgactggggaagaaaagggaacaggaaaggtgagaggaagaagtgtggtctggcctctgctgcttgcattacggttcca

SEQ ID NO: 75934 - DNA, 201 bp, Bos taurus; identical to SEQ ID NO: 36496

SEQ ID NO: 75935 - DNA, 201 bp, Bos taurus; identical to SEQ ID NO: 36497

SEQ ID NO: 75936 - DNA, 201 bp, Bos taurus
caccatggccttgctgacacctgtgcgctggatctcgcaccacacacctcagggaggtcccagatcagaggcaggtgtggccacttttgctatttctcctrgggctgccccagtgctgcggctcccaggctccatgataactgctgtcagagaaccgggaagtcactagactggaggccagttcatttatactctgtctta

SEQ ID NO: 75937 - DNA, 201 bp, Bos taurus; identical to SEQ ID NO: 36498

SEQ ID NO: 75938 - DNA, 201 bp, Bos taurus
actcggagcagtcacttcctgagtttttggccttttttgactgtgaagaaccataatttcagccctgccggccacttgggaaccaggccacgctggggccygtgttccaaatcaccaagtaggctggtaaccatttgtcttctgcctccaggcttaatccttcaggtcaggggggccagtttgctgtggttttactgccag

SEQ ID NO: 75939 - DNA, 201 bp, Bos taurus; identical to SEQ ID NO: 36500

SEQ ID NO: 75940 - DNA, 201 bp, Bos taurus
ttccaggactatatagttcatggggtcccaaagagtcagacatgactgagtgactttcacttgttaccttttgaagatcagtatgtcttgcccccaaaatraaaacatatggccagaagaatttaggaaacatgatatacagagatgttcaatacacataagtagattcaccagattgattttggtaactctgaaccattc

SEQ ID NO: 75941 - DNA, 201 bp, Bos taurus; identical to SEQ ID NO: 36502

SEQ ID NO: 75942 - DNA, 201 bp, Bos taurus
gtaaaatataaggaagtgagagaaaggaagagttgacagtctctagataagaaaaccttgtgttaaaatcaaacagatggactatcagtgataagggatgragtaagatagggtgtttttgtttttgttttttttaatcttagcagaaatgaacctctgagcagtaaagaactcaggaaatgagagtagctctgctccctt

SEQ ID NO: 75943 - DNA, 201 bp, Bos taurus; identical to SEQ ID NO: 36504

SEQ ID NO: 75944 - DNA, 201 bp, Bos taurus
tgccttcatgacccagctccacggggccctctcacccaccctggcccctcatcccatttttctgcaccctgtcccctcggccctgacccctcctccctccyggcaaactccaggtcctgctctgtctctggggaaccatcccagaatttccaacaccatgatcccaacacagtcaccacacctaaggccactcagcagtca

SEQ ID NO: 75945 - DNA, 201 bp, Bos taurus; identical to SEQ ID NO: 36506

SEQ ID NO: 75946 - DNA, 201 bp, Bos taurus; identical to SEQ ID NO: 36507

SEQ ID NO: 75947 - DNA, 201 bp, Bos taurus; identical to SEQ ID NO: 36508

SEQ ID NO: 75948 - DNA, 201 bp, Bos taurus; identical to SEQ ID NO: 36509

SEQ ID NO: 75949 - DNA, 201 bp, Bos taurus
atacaatgaaaactttccctccaagctccctgccctcatcagctgcccaaaggcaaccaataatatcaactgtccttccaatatatgtatgtagtttacayccatacaagcatatacgtacatatttttaagtctccccctctttgtacatacaaacggcatatcatgccctgtttcacaccctttttctcttcatttaac

SEQ ID NO: 75950 - DNA, 201 bp, Bos taurus; identical to SEQ ID NO: 36510

SEQ ID NO: 75951 - DNA, 201 bp, Bos taurus
tgcaggtcagaagtgggggcagggctgactgggttcctcgcttccatctcacaggcctgaagtgagggtgttggccagactgggctcttatctgggggccygggaaagggtcagttcaattcctcatggtggtagcaccgaggtccccatagcctcactggttgtcagccaggccagctctctcagctcctggaagccagc

SEQ ID NO: 75952 - DNA, 201 bp, Bos taurus
ggccattttaagagctccagacatattctgaatctcacggaaatcaccgagtgaatgaagcagcacagaactgggtttcctggaagctgtgagcaccaggyggcccgggagctgctgatgcgttgacagaagaagaatggccgcaaggaagacctggagtgtcaatcagggtagttctttgttaactgtctggagtgtggg

SEQ ID NO: 75953 - DNA, 201 bp, Bos taurus
ctgtgtaagaggcctctgagcttctcttgacccactacttagatgctcaagagctagtgtgtctcttcctcttcctaatcccatgatatggccccattcayacaacctcatctaaaccaataacctcccaaagacctcacctccaaataccatcacagcctcatctctgtcttaggccctggaggcatttgataagccatg

SEQ ID NO: 75954 - DNA, 201 bp, Bos taurus
tctccccaagaggctgggaactgaagacaggcaaggctgaagatctcacaccactagttgccaaacctaaaattaggaactgtaggcctgccatcccctgytggagttggggtagccggcgggggggaagctcaaggaatagaaggaataatccatggaaaaaccaggaggagccaagtgcaggcagcggccctgcccagg

SEQ ID NO: 75955 - DNA, 201 bp, Bos taurus
gaatacagtcccctgtgctttacagtaggacttcattatttatccatcctgtgtataatagtttgcatctgctaatcccaatctcccaaaaggcccttttyctgaactaacctaacaactccttctcttgtcaataggcaagacatagacctctctcaaaagagtcaaggcctcaagaaatctattttgggtctcatatcc

SEQ ID NO: 75956 - DNA, 201 bp, Bos taurus; identical to SEQ ID NO: 36513

SEQ ID NO: 75957 - DNA, 201 bp, Bos taurus
ccccgtatacttcccttatgcagtccaggtggtgaaacattgatctatatgatggaagaagacacatcggaagaaggccaggatgggggctttccctggtrgtccagtggttaaggcttcaccttccagtacaggagatgcagattcaatccctagttggggacttaagatcccatatgtcttgtggccaaaaaaccaaaa

SEQ ID NO: 75958 - DNA, 201 bp, Bos taurus; identical to SEQ ID NO: 36514

SEQ ID NO: 75959 - DNA, 201 bp, Bos taurus
catttgaaccaaaataatgaacaaatcaagagtccacataaaaaaagacccaagtatctggcatttcttgagagatggtatctggccaaccagaaccccamgactaccctggcaatgactggatggagctgagtcaaggttgaacactgtggctggggtccgggccatccagctcatcacagcatcttggacaatgaggac

SEQ ID NO: 75960 - DNA, 201 bp, Bos taurus
tccctcgtgccacaacgaagacttggtgcggccaaacagacaaacgccattgagaaggaaattaggctcgcctgagtgggacaccctttctgccttgtcamctgctattggccagatcagaaccagtcctgaggatgagacggggtggggctgagcctggctctctcattcacctcatggggatgtctcgagggccacctg

SEQ ID NO: 75961 - DNA, 201 bp, Bos taurus; identical to SEQ ID NO: 36517

SEQ ID NO: 75962 - DNA, 201 bp, Bos taurus; identical to SEQ ID NO: 36518

SEQ ID NO: 75963 - DNA, 201 bp, Bos taurus
accctcctgcacctcctgcattggcaggagcacatttcccctgcttcttggctcagatccttaaaagaagcatttttattggcccagcttgtctttttaaktcaagccacaaaatgtttctaagcagttttctgattggttgcctaggaccaggtggccactctaacccaatcaattatactttagagtagaagatggaca

SEQ ID NO: 75964 - DNA, 201 bp, Bos taurus
tcctgtaagtggtatacaggatgtgtttttcttcatctccttttttggcttaagatatttgtgaccatccagctggatgttacttttgtaacatttgtacytattgttacttttgtacgtttggaatgtacttttgtcagacattgcagtatatggttgtactacggtttcatcaatcctttctgtgggccctgttttttt

SEQ ID NO: 75965 - DNA, 201 bp, Bos taurus
gaatgcagtgattcagagtgtgtagtattcgtggagttgctgatgtgaagtggttattaaattgcttaccttgtgttacctcagccttttgcagtgcttcragtattaattttctaactcacgttcttgccatgtgtccctttcttctgacaactgagaagaatctcttgccagctaagaaaaatcttttcttcacacttt

SEQ ID NO: 75966 - DNA, 201 bp, Bos taurus; identical to SEQ ID NO: 36522

SEQ ID NO: 75967 - DNA, 201 bp, Bos taurus; identical to SEQ ID NO: 36524

SEQ ID NO: 75968 - DNA, 201 bp, Bos taurus; identical to SEQ ID NO: 36525

SEQ ID NO: 75969 - DNA, 201 bp, Bos taurus; identical to SEQ ID NO: 36526

SEQ ID NO: 75970 - DNA, 201 bp, Bos taurus
tgtctcagatgccggatcactgggcctctgggagaagccaagcagagagtggacagggtcctcagggctcagagttgctaggggagcaagaaccccccackgcaggaggtctgttttctaaggccagatctaagcagtcttgggctccccgggtggcgctagtggtaaagaacccacctgccaatgcagtagatgtaggaa

SEQ ID NO: 75971 - DNA, 201 bp, Bos taurus
agcagctcagtgtctgcagggcagccccaaggatctgagacgggggtgtggggatgcaggggaaccccatcagaagagcccttggaccagggtcactgggwagcccccagagctgactgcatggccttgggccctctcccgtgggcgccggcggaatgaccagggagcagagccacctctggagccacgtcaacctcgact

SEQ ID NO: 75972 - DNA, 201 bp, Bos taurus
ttcaactaaaaccgtcctgtactccttgccgtttcctaccacaggtagctgctatgtttacaacgaacaagtattgaaggaaacacagaagaaagcaacayggactccccttcactttgttacctttgctcttcaaactaaacgaaagagcacaagaaaacaaatcagcatctgtaaggcattcaccggagacccctgaag

SEQ ID NO: 75973 - DNA, 201 bp, Bos taurus
cagcagcacgctttgtgccgagaatctagattttgccattcccctcgatttccttgagaaaagtccccagcagccctggcagtcttgccaactgcctttgygaacaataacccaccatccctgcccagggaacagccggtgcacagagcacacacccatctgtacatggccgggcagcagatacaacaaccacaatcatta

SEQ ID NO: 75974 - DNA, 201 bp, Bos taurus; identical to SEQ ID NO: 36530

SEQ ID NO: 75975 - DNA, 201 bp, Bos taurus; identical to SEQ ID NO: 36531

SEQ ID NO: 75976 - DNA, 201 bp, Bos taurus; identical to SEQ ID NO: 36532

SEQ ID NO: 75977 - DNA, 201 bp, Bos taurus; identical to SEQ ID NO: 36535

SEQ ID NO: 75978 - DNA, 201 bp, Bos taurus; identical to SEQ ID NO: 36536

SEQ ID NO: 75979 - DNA, 201 bp, Bos taurus
aggctctcaaggtcaagctcaaccctggcaatggcatctgttgaatggacgaagaaggctctgcttgaggccacgtggctggatggaggccccactgggayagaactcaagtctcctggagcgaatgatggagtgatggaggggaggaccagggtgggggaaggccttgtgacttcaacctcccagcaccctagggagaat

SEQ ID NO: 75980 - DNA, 201 bp, Bos taurus
caagtccatacaaacatcacaatggtttgatatatctcttaggtgtaggattcctccatctttctctttgaattaattttactttgctgaacgaactcatktgtcttaacttcttgcagattgaactcaggctgactttcttggcaagactgcttaggtggtgggtgggcgccttgtctggaggtatggtggtctttatta

SEQ ID NO: 75981 - DNA, 201 bp, Bos taurus
agtcaaagtccaggtgataggggcttccaaagggatgtacccctgatggacagaagctacagtggggtaagtgttgactcagaaaaccaaacacccagccratcttccctgggtgtgtcctgctaaggacacagaagtcattcactggagggtcagttaatgacctacttgtaatacagttttgtgaaattataaggatga

SEQ ID NO: 75982 - DNA, 201 bp, Bos taurus
atcctgtgagctgccatatagatcctagaacaccaggtggagaagttaaccacatgatgaccagaatatatccatgacataagctgccacacttctgaatratggcctcaagaaatgcaaacaaatgggtcctggaactgaagactaatgtacataaaacagtcaagatgacacgggtcagaccactgatgaccaatttga

SEQ ID NO: 75983 - DNA, 201 bp, Bos taurus; identical to SEQ ID NO: 36537

SEQ ID NO: 75984 - DNA, 201 bp, Bos taurus
tacaagttcttgtctctgtctccacccttagtcccttgtccttggcatctgtgcctatatagcccctgcagctgtaactgccattcctatttcccttgaartaatacacaccccagtcttcaggcagcctggaaatagcctggaacattgcatatttttttgtgatcagtctggtttaagggaggtaactgagagctgaac

SEQ ID NO: 75985 - DNA, 201 bp, Bos taurus; identical to SEQ ID NO: 36539

SEQ ID NO: 75986 - DNA, 201 bp, Bos taurus; identical to SEQ ID NO: 36540

SEQ ID NO: 75987 - DNA, 201 bp, Bos taurus; identical to SEQ ID NO: 36541

SEQ ID NO: 75988 - DNA, 201 bp, Bos taurus
tctaggggatcttcccgacccagggatcaaacctgggtctcccaccttgcaggcagattctattccatctgagccaccaaagaaggccagctgtacattamtatcattgacaaataaaatgcagtacacatggggtgattcatcaactgcatgctctaggtacaaatttcagtttaccttaatgtggccctgcagttgaat

SEQ ID NO: 75989 - DNA, 201 bp, Bos taurus
atcagtatgtttttaagaagaccttggccctttcttgagccttttttcttggctaagcatggatttctttttaatcacatctgaaacagggtgattacctrggacacaggccccaagttgggctagagttctcacacacctcacagaaatcactctcggcaggatgcgctattttagagcaacctcaggtttacttagatg

SEQ ID NO: 75990 - DNA, 201 bp, Bos taurus; identical to SEQ ID NO: 36549

SEQ ID NO: 75991 - DNA, 201 bp, Bos taurus; identical to SEQ ID NO: 36550

SEQ ID NO: 75992 - DNA, 201 bp, Bos taurus; identical to SEQ ID NO: 36551

SEQ ID NO: 75993 - DNA, 201 bp, Bos taurus; identical to SEQ ID NO: 36552

SEQ ID NO: 75994 - DNA, 201 bp, Bos taurus; identical to SEQ ID NO: 36553

SEQ ID NO: 75995 - DNA, 201 bp, Bos taurus; identical to SEQ ID NO: 36554

SEQ ID NO: 75996 - DNA, 201 bp, Bos taurus; identical to SEQ ID NO: 36555

SEQ ID NO: 75997 - DNA, 201 bp, Bos taurus; identical to SEQ ID NO: 36556

SEQ ID NO: 75998 - DNA, 201 bp, Bos taurus
gtttgttagctagggtcttgttgctgcagagaagactgaccagggcctccagggatccattctttctcctccagcttcctaagccattcttctgtctttgygccaccaaacaagggcggccacgtccccaaatctctaatgccacggctctgccctggctctgctcatgttcacagatttggttgcaaagctcccattttg

SEQ ID NO: 75999 - DNA, 201 bp, Bos taurus
actgttaattacaagcacaggcctctgctgttcacggggcatctgctccacacttccagggcacaccctgcgctgggggtggctcccataaaacagatgcygcaaggaagaaaggagcatggatttatctttaatgatggcaacgtccaacgcttttaagaaggacattctgagagctgaatcaaatatttgattttccac

SEQ ID NO: 76000 - DNA, 201 bp, Bos taurus
cactgggcaggtgtaaagattgctcccttgggtcccaccatgtttgtacttggctgttgccaagaacttccctgtattctgacgatggtttctccacacakacagcttttgtctctgcggctgctggtgtgtttcagggcggtctgtcagcctctgctgacaccctcacccgccatgtgacctacaaggcttgaaatatca

SEQ ID NO: 76001 - DNA, 201 bp, Bos taurus; identical to SEQ ID NO: 36560

SEQ ID NO: 76002 - DNA, 201 bp, Bos taurus; identical to SEQ ID NO: 36561

SEQ ID NO: 76003 - DNA, 201 bp, Bos taurus
aactctggccactccctgaaatgaggattcagcaggtttgtggcagagcccagggatctgaatagcttaaatgtctcatttgattctataaagggctttgyctgtatcctaccacaaggcctctagagagatcttgggagaattgagtgcttgtgggaatatttggagagaatagaaacgatgcagagtgaggtaggataa

SEQ ID NO: 76004 - DNA, 201 bp, Bos taurus
gctttagtctgcatttgttctaaagagattttctttcctaacctaaaatcagttatgaatttaaggacaaaattttttaagatcctttatagtgtattacrggaaaaaccagtagccagccatcaggtgcatacacgcatgcgcctgctgagccgaaggtgttaatggctgggctgatcaggactagcctatgaattacta

SEQ ID NO: 76005 - DNA, 201 bp, Bos taurus
aagtgaaggaaggcccagtccatcgtttcagagaccttggaaccagctcccacttcccagttccatccttgataagagctttgagcatctgtatttgtttyatttcaaacccaaaggccaaaagtgggatttgctgttgacaaggactcggtcgtgaacagtactcatttgtgacccctacattccccacccaaagccact

SEQ ID NO: 76006 - DNA, 201 bp, Bos taurus
gagtatgagatgaaacttggcagcttggcttattacaactggagtgattataacctgcacactggagaggagagaagggccttcctgggttggggatcatyagagggagagcctatagcttgggagtaggacttgtacagtgttgatccaggtggtcactggtgagcccatctctaagcataaagggtcagtgttgagaac

SEQ ID NO: 76007 - DNA, 201 bp, Bos taurus
gcacccttggctgaaccaccagtcatcagcattgagggctttataataaaatgcccaagtgagaaagacactggaggggtagcaaggcgccagggcccccragggctcgaggagagctggacccacctgtgtcctgctgcctgacctgtcgatgcgtgctgtcacctgcgctgggccacagatgcccagacaggtaaagca

SEQ ID NO: 76008 - DNA, 201 bp, Bos taurus
tattgccagttctcatcataggagctgtggctggggggagccacccaaaatgggaaattcacacaatgaaaaaattccaaatcattctagacaatacttcrgatggccagttgggcctgattcaattgggcagttgggcctgattcagaaaagttacatataacttttggttacatataaaactcacaaaacaggtcttta

SEQ ID NO: 76009 - DNA, 201 bp, Bos taurus; identical to SEQ ID NO: 36562

SEQ ID NO: 76010 - DNA, 201 bp, Bos taurus; identical to SEQ ID NO: 36564

SEQ ID NO: 76011 - DNA, 201 bp, Bos taurus
tcttctacaactataatttagaagttttctgttcgtagagaaatgcgttcttgctcattagggaaacatgcagccatagctggttacacattttcttctcytcatgctataatgcactcctaagtaacattttaatcatgactaataagcatgactgggcccttgagagtgagtttgcccttactttgaaaaggggagact

SEQ ID NO: 76012 - DNA, 201 bp, Bos taurus
tgtggggtcggaacgtgcaaacagtgtctgtagagcgttcctctcagcagcatgtgtatcggaaaggccagggctgcctaccttgtctctgaaactctgtrcagttctcatcggccatcccagccctgattccagtcagcgcagtggccagagtcagctgctgctagtggtggtgccttccgtgtgtgagcagggtgatct

SEQ ID NO: 76013 - DNA, 201 bp, Bos taurus; identical to SEQ ID NO: 36567

SEQ ID NO: 76014 - DNA, 201 bp, Bos taurus
tgaccaagtcattggtttgaagatgccagaatgtgtagccagtatggagtcactgatgtgaaaaggaccacttgggcctttggtcggccatgcaaccagaygcctacaagactttccttgtagagaagaggcactcccctgctcaggagagagggatgttctgcagcctccccaccttttagggccctggggcatccaggt

SEQ ID NO: 76015 - DNA, 201 bp, Bos taurus; identical to SEQ ID NO: 36568

SEQ ID NO: 76016 - DNA, 201 bp, Bos taurus
caggcatacataaatacatacttaaaccatataatctgatgagattcagaatgctttagaaagactaaactttttacagtgtttgtaaatgtgttaagacyaggacgaacaacttccagaatcactatcgtttaacatgcttagaacatttatctttgacccaatcttaatatttttggcttttcctcattgtcagaaaat

SEQ ID NO: 76017 - DNA, 201 bp, Bos taurus; identical to SEQ ID NO: 36569

SEQ ID NO: 76018 - DNA, 201 bp, Bos taurus
catgatacccacaagtgccaccccgataacaatcttggctgcaaagaaggtctgagtcttggtcatatcctcatcctcatccagagggaggtcataatcaycataactgaagttgaaggggagggaggaggcatgttcttggggtatactgaagttggctggaaaactagcatttccattctgggctgccatggtgaagct

SEQ ID NO: 76019 - DNA, 201 bp, Bos taurus; identical to SEQ ID NO: 36570

SEQ ID NO: 76020 - DNA, 201 bp, Bos taurus; identical to SEQ ID NO: 36571

SEQ ID NO: 76021 - DNA, 201 bp, Bos taurus
ctaaatcatcagaagtcatatagaacatagagaagaatttagtggttttgatggtgtgagaaaaagcatcctcaacatatgggtacatataagcctgtgtrcatgtgacctggtatgtctctggagttggtgggcaaattgaatccagaagctattgcttgtttccttaacctaaagcttcattatttaagttctacatgg

SEQ ID NO: 76022 - DNA, 201 bp, Bos taurus
ctgactcagtccagcacagcctgtgatgtaggtgtggcctggttcctagggcagtgatgatcggggtggacctgagagtcctcaaccagttatacctcttrgcagccagtcagatgaggcctgttttggatttattctgtatgatatatacatctcaggtggcttctgctaagtaattatcagcctaaatcttatataatc

SEQ ID NO: 76023 - DNA, 201 bp, Bos taurus; identical to SEQ ID NO: 36572

SEQ ID NO: 76024 - DNA, 201 bp, Bos taurus
atctcctctgtgcgctggggctatgttctgcttggctcccaccatgctcaggctttgttccactgtggctcctcttggcacaggcccctcacttggatggyaggctatctccttcttaggcagatctctatacatatgtaaacaacaaaaaaggaagcttagcactgagggacatgatgggcccagggcaggcagcaacca

SEQ ID NO: 76025 - DNA, 201 bp, Bos taurus
atttcttacttgtttttctcctcaatggtggaactcaagatttgaaagtttgagtgaaatactgttacaagtcactaatgggaacaataggtgctcttctkagggctttctttcatcaggaatttgttctgggtttcacttagctaaactaaactgtcatttctacattctataagttttgtaataaagataaataaatat

SEQ ID NO: 76026 - DNA, 201 bp, Bos taurus; identical to SEQ ID NO: 36573

SEQ ID NO: 76027 - DNA, 201 bp, Bos taurus
ccagaacctgagggctactgagaattataaataaatttggcttcacaagtctggagtcataaatgacatttctttaaatgatggaaggggggagaattgarttgtataggaaccttccgtttaactcccttcctcccaaatatgtccaaaatttaaagaaatctcctctaaatataatcctcagttaaaaagaagcttttg

SEQ ID NO: 76028 - DNA, 201 bp, Bos taurus; identical to SEQ ID NO: 36580

SEQ ID NO: 76029 - DNA, 201 bp, Bos taurus; identical to SEQ ID NO: 36582

SEQ ID NO: 76030 - DNA, 201 bp, Bos taurus; identical to SEQ ID NO: 36583

SEQ ID NO: 76031 - DNA, 201 bp, Bos taurus; identical to SEQ ID NO: 36585

SEQ ID NO: 76032 - DNA, 201 bp, Bos taurus; identical to SEQ ID NO: 36586

SEQ ID NO: 76033 - DNA, 201 bp, Bos taurus; identical to SEQ ID NO: 36589

SEQ ID NO: 76034 - DNA, 201 bp, Bos taurus
ttttgtcagctcctcagtacagcagattttgtttcttcctgcctcccggtgttaataagaaggtggtccagcaggttctctccgcctccttgccttttttyccccgtaattctgtggcaaagggtgttactgcatatttccctggcatgcgcccttgctttgatctgaattttcctgtgctctgttgtctggttgtgcagc

SEQ ID NO: 76035 - DNA, 201 bp, Bos taurus
tttagaccaagcatcagcacatgtggcttaccaacccagaaatcacttctgtggctatacagtcaggggctccctgctccagagacacatacctaccagcrtcaagggccttggctatacttcgatgaagcccctcgcagttccctgagctagtacaagcctggaaaatctgcatctcaggccaggtgcacaccatccctc

SEQ ID NO: 76036 - DNA, 201 bp, Bos taurus
aaaggcagagtaataacacatgtgaaagtttcaataaacagcttttgtgttgtaatttttaatcaagtttatttgacttgccaattataaatatttgtttkacttattaatattacttttggaatggagctgtggaaataaatcaacactaaaaaataaaactcaagcaaatacttaatcagacacacatttatctttcct

SEQ ID NO: 76037 - DNA, 201 bp, Bos taurus; identical to SEQ ID NO: 36591

SEQ ID NO: 76038 - DNA, 201 bp, Bos taurus; identical to SEQ ID NO: 36592

SEQ ID NO: 76039 - DNA, 201 bp, Bos taurus
ggggctgttgcaggaggggtcctggggacttgactcccctccccggagctctgagccactgctgccatgaatacaattcataagaggccactttggcctgsggtgggtactctctgagagttccagatcccaaggaggacctcgagaagccagcttgtgcgtacaggggtcctggggccccagaaataagttctcccacct

SEQ ID NO: 76040 - DNA, 201 bp, Bos taurus
gctacaacgtgctgccccaaatcattgaagccaagtacttggatgccatggatgctgaacactgacgccctgactagcaggtcctggccaccccccattcrcccatttctccaggtcttgccaggctggctgtgtagctgtgtgtgggcatccgggaatgctgctctgtgctgcaccccctcacagctgtcccaagtggcc

SEQ ID NO: 76041 - DNA, 201 bp, Bos taurus
tgaacatatatgcagaaatcctcaacaaaatactagccatctgtatcctataatacattaaaaagatcatacaccatgatcaagtgggattcatcccacaratgcaaggatgtttcagcatcaaaaaatcagtgtgatatgccatatcaacaaattgaagaataaaagccatatgatcatctcaatagatgcaggaaaagg

SEQ ID NO: 76042 - DNA, 201 bp, Bos taurus
tgttacactggataaagtatttttcagaacaaggaaaattatcagaaacaaaaaggaataatacataatgactaaaaggccaaaatagacataaaattctmaatgtgtatgctccagaaaacagcttcaaaatacaagaagcaaaaattggcctaattgaaaacagagaaagacaaatcaataaccccctctcagtaactg

SEQ ID NO: 76043 - DNA, 201 bp, Bos taurus
agccctcttgtgtgcccttcatctgacctcatatccccgatagctctccaccagtgcattcccctggcctgctcatgaccgtggcctgctcttgtcccccyaccccttgcatcttctcagtgttcctcgcctgaccttgcatgtaataccctttcctggcctcagattctgcagaatgtctgctgctagtgactctggcct

SEQ ID NO: 76044 - DNA, 201 bp, Bos taurus
tgatgtgagaatagttgaatcaccctttgggcacctgggggcaccttggcccattcttggtataaacagctgtgttggaggagtgtgatctgctagatagrgagctagattttgaatgctggccttaagctagactctctgagcctggttttgttgagaataaaatcggagctataataacagctcacaaatggctaccag

SEQ ID NO: 76045 - DNA, 201 bp, Bos taurus; identical to SEQ ID NO: 36593

SEQ ID NO: 76046 - DNA, 201 bp, Bos taurus
ctggcccttaagtgttggcatctctgagctctgtagaacagaggtggggacatcatgctgcctgggctaaatctactctggggattgaaaggagaccctcrgtctgagttcttgtgggatcttctatcctttggactccttgcagggcctccctgtgacaacccaactgcctggagtggtgtcaacctaggcttttgggag

SEQ ID NO: 76047 - DNA, 201 bp, Bos taurus; identical to SEQ ID NO: 36594

SEQ ID NO: 76048 - DNA, 201 bp, Bos taurus; identical to SEQ ID NO: 36595

SEQ ID NO: 76049 - DNA, 201 bp, Bos taurus
tctttctgcttaacctggaggttggctgcctaagtgaggtggtaggtcagccattcccaggcctggccgctctgcatccatggccccatggaatgtggtcrctgttggctcctgcagatgatccacaagagagcagagcatagagaggtaacagcaaagtgagctggaccctgatcagcagctgggtgtgtggcatgggtc

SEQ ID NO: 76050 - DNA, 201 bp, Bos taurus
gactgggcaggattgtcaggaagcagattccaggcaattcaaggcctggaacaaaaatcagggggaaggagcaggttggggctttgggggcaggtatgcgyttgggatgacgtgaggagcatctacctcggatggtctcggacaagttggcagtcccacggagaggagggcccccctgcagggtgacgtgggccacctcgc

SEQ ID NO: 76051 - DNA, 201 bp, Bos taurus; identical to SEQ ID NO: 36596

SEQ ID NO: 76052 - DNA, 201 bp, Bos taurus; identical to SEQ ID NO: 36597

SEQ ID NO: 76053 - DNA, 201 bp, Bos taurus; identical to SEQ ID NO: 36598

SEQ ID NO: 76054 - DNA, 201 bp, Bos taurus; identical to SEQ ID NO: 36606

SEQ ID NO: 76055 - DNA, 201 bp, Bos taurus; identical to SEQ ID NO: 36607

SEQ ID NO: 76056 - DNA, 201 bp, Bos taurus; identical to SEQ ID NO: 36608

SEQ ID NO: 76057 - DNA, 201 bp, Bos taurus
tgagagttaccacagtgccaggagggccctgatcccgcatatctcccagccactctgtgtaccagcagcaccacctccccctgccgactggggccaattarccctaacagaaccaaaagtcctcctcctgaccgttgctccctgggtccaaggggctcaaaatgccagggaggcagcagtggcccccccccagcccactgt

SEQ ID NO: 76058 - DNA, 201 bp, Bos taurus; identical to SEQ ID NO: 36609

SEQ ID NO: 76059 - DNA, 201 bp, Bos taurus; identical to SEQ ID NO: 36610

SEQ ID NO: 76060 - DNA, 201 bp, Bos taurus
tgaccgtgaaggatcttcactaaccagcctccaccctgaatgatggcttccattccagacaaataaccatagagctcggctctttcccagacagcctcccrctgcaacgcgacaccggcacattaaagcccatgatgcatggcacccagcctgcttatagcttctttatggcctcgtcagctgtaactggacgattacaaa

SEQ ID NO: 76061 - DNA, 201 bp, Bos taurus
ctggggttgggtggagtccctcaaagatccatgttctcacagaatcacaggatgtgaccttatttggatacaggctggggtaaggtggcccttagtgcaaygcgactggagtatgagacaagaagaggaaagcagaggtgcgcaggagaactaacaccacgtgagacagagtcaggggtgagagtgatgcggagtgagccg

SEQ ID NO: 76062 - DNA, 201 bp, Bos taurus
gcaagctcccttgcttgttaaccccaccacttacttatccggagcagtggcctccattttccctcgatcagggtcctcctgagtggagccagcctccaacytcccgtgagagtacctgggaacaccagccaacaagatctgcccactcctgagatggaccaaacattctacaagatggtggagcagaaggacgtgtgctca

SEQ ID NO: 76063 - DNA, 201 bp, Bos taurus
gacctcgggagtgtgtacgaggccaggcaaggatgaggcgtatgtaatcagggtagccagggagctctcccagacatgcagttgtttgattaaaccaagtyaccactggccagagcagacagaatcaattggccttgtttcagggcaaaaggccagggaggggaaggccggaccattctggcctcaaataatcaaatgctt

SEQ ID NO: 76064 - DNA, 201 bp, Bos taurus
cttccttcatggccacgttcccaccagcaaggaggggagagggctggagagacactccctgctctcctccatctcagcatcgactgagatgtgctgctgcrgtgtgaggtccattggccagaacatggtcacctggtcacatcaagttcaaggagggctgggaaatgtcattgtcacttagggaagccattgcccttgctc

SEQ ID NO: 76065 - DNA, 201 bp, Bos taurus
ctatgctgtcttttacttgaaacgtctggctcacttggtctaaaccgtggcctccgatgccagaaggctgggctgtgtcatgtgctgggtggggtgctggrtgagtagatgcaccagtgagttggccctatgaagaaggcccaggcaggtggttttggaaaggcctgcacccttcactgggaaagcctgtggcttttgcat

SEQ ID NO: 76066 - DNA, 201 bp, Bos taurus
ccatactgttttgtatgtgtaatcccacccaggtgcccgctttctcccagctctttaaaccattctgctttgaccttgtcattatcagtagttgtgccctraatctcacttcagatgttgatcgtcccaccctgctttctagagtagtcccaggctgtttactccactactgtctgctatgcttgttaaccctcttgtcct

SEQ ID NO: 76067 - DNA, 201 bp, Bos taurus
caggagccttgaggcatcgcagctaaactgatggccctcaccatctgaatcactggggggactcttggggtcggtggttgtctccaggccccgggttatcmaagtgagtttccaggtgtggaagggagggtgtttcatgctcaggtgtggtcagtcaggagagatggttaccagctgggtctcgcaccaggctggccctgc

SEQ ID NO: 76068 - DNA, 201 bp, Bos taurus
aatgtccccgtctctgaggtttcccagctgatgctcagcacccttatctttgccctcaaagcctcaaaactccagggaaataacaataactgaaaagaaamcaaacaaaaggctaagcctacaataaacccaaggaaactgtagcaggtttctgataagacccagagagatttcaaggccagagaaaagctgaaaacactt

SEQ ID NO: 76069 - DNA, 201 bp, Bos taurus
gaggaagcaaaatccagtcttctcagcctcagctgtccagatgtccttgaaagggactctgcagccgggggcccccgagtcccagcagtgggaccatttgytcactgcagttctcggcgccctggtggccccatctcttaacaatcagttctctcaggatggacaacgttttcaaggtatcctagcagagtggtccggatt

SEQ ID NO: 76070 - DNA, 201 bp, Bos taurus; identical to SEQ ID NO: 36624

SEQ ID NO: 76071 - DNA, 201 bp, Bos taurus; identical to SEQ ID NO: 36625

SEQ ID NO: 76072 - DNA, 201 bp, Bos taurus; identical to SEQ ID NO: 36630

SEQ ID NO: 76073 - DNA, 201 bp, Bos taurus; identical to SEQ ID NO: 36632

SEQ ID NO: 76074 - DNA, 201 bp, Bos taurus; identical to SEQ ID NO: 36633

SEQ ID NO: 76075 - DNA, 201 bp, Bos taurus; identical to SEQ ID NO: 36634

SEQ ID NO: 76076 - DNA, 201 bp, Bos taurus
actgtcctccagtgctcacacaggcgggggacactcggaaggcctggcggctcctctggccaccagactgtccggcccaggtcatttctgagcagcccacrcacccctccctgaacagagatactgatggatgtctactttgacctctgttcctccgtctgccctggatccctctctgagggctcccgacggcccaggctg

SEQ ID NO: 76077 - DNA, 201 bp, Bos taurus; identical to SEQ ID NO: 36635

SEQ ID NO: 76078 - DNA, 201 bp, Bos taurus; identical to SEQ ID NO: 36636

SEQ ID NO: 76079 - DNA, 201 bp, Bos taurus
aggtgctttcagtgccaggacctgagggttttgctctgcatggttctacccgccaaagggcacctcggcagccctctggtggcctggcaacggcttttgcmccccctgggaacggaaggagacagagctctggaagcgacaggtgacctgtgttctggagtctgctgggcctcctccatggtttggcactgagatcccaca

SEQ ID NO: 76080 - DNA, 201 bp, Bos taurus; identical to SEQ ID NO: 36637

SEQ ID NO: 76081 - DNA, 201 bp, Bos taurus; identical to SEQ ID NO: 36639

SEQ ID NO: 76082 - DNA, 201 bp, Bos taurus; identical to SEQ ID NO: 36640

SEQ ID NO: 76083 - DNA, 201 bp, Bos taurus
agagatgcctgtccctgaatgtcagtagtgtggagctgagaactctagtgtaggcagagcggcctccccctaggccaccaggtctcccagcttgggcctcrcccagtcagtcagttatacccaatgtcaccctgaccttgccactccctgattcaaccacctcaatgattgctctttatgagtaaagcccggttcctctca

SEQ ID NO: 76084 - DNA, 201 bp, Bos taurus; identical to SEQ ID NO: 36641

SEQ ID NO: 76085 - DNA, 201 bp, Bos taurus; identical to SEQ ID NO: 36642

SEQ ID NO: 76086 - DNA, 201 bp, Bos taurus
ttgtcttacccagctccgttctccctaatttattctctggtcttgggtgaagctcttgctgagatttaataaaactcatattgctctgaacccttgtgtcrgctgcgctggtccctctaagccaggagggggcagcgttttcctgtggagcaaagggctccgaaagcaggggattggggtgggggcagggggcagactatc

SEQ ID NO: 76087 - DNA, 201 bp, Bos taurus; identical to SEQ ID NO: 36643

SEQ ID NO: 76088 - DNA, 201 bp, Bos taurus; identical to SEQ ID NO: 36644

SEQ ID NO: 76089 - DNA, 201 bp, Bos taurus; identical to SEQ ID NO: 36645

SEQ ID NO: 76090 - DNA, 201 bp, Bos taurus; identical to SEQ ID NO: 36646

SEQ ID NO: 76091 - DNA, 201 bp, Bos taurus; identical to SEQ ID NO: 36647

SEQ ID NO: 76092 - DNA, 201 bp, Bos taurus; identical to SEQ ID NO: 36648

SEQ ID NO: 76093 - DNA, 201 bp, Bos taurus; identical to SEQ ID NO: 36649

SEQ ID NO: 76094 - DNA, 201 bp, Bos taurus; identical to SEQ ID NO: 36650

SEQ ID NO: 76095 - DNA, 201 bp, Bos taurus; identical to SEQ ID NO: 36651

SEQ ID NO: 76096 - DNA, 201 bp, Bos taurus; identical to SEQ ID NO: 36652

SEQ ID NO: 76097 - DNA, 201 bp, Bos taurus
tagggtgaccaagtgccctggtttgcccaggaaatgatattttagaactaaaactgagaaagtcctgggcaaaccagaacaaataagtcaccccacacccrggcactttcacctggtctgaagtcatgggtagattagaccttgtttcaaaactggatggagagtcattcagataaggtgctgggaagggagtgtcaattt

SEQ ID NO: 76098 - DNA, 201 bp, Bos taurus; identical to SEQ ID NO: 36653

SEQ ID NO: 76099 - DNA, 201 bp, Bos taurus; identical to SEQ ID NO: 36655

SEQ ID NO: 76100 - DNA, 201 bp, Bos taurus
cctcattcatgtgtctttctgtggttgttttctgccttacttttgccttactggaattcaagtttctacaagagcaggcaccatgaattgataatttctcyctcgacactttctgggaagtgatggatccgacaccagagggtgagtgtaaagtgttcatggagacagccaaggttgcttagcagagagccagcacacagc

SEQ ID NO: 76101 - DNA, 201 bp, Bos taurus; identical to SEQ ID NO: 36657

SEQ ID NO: 76102 - DNA, 201 bp, Bos taurus
acaactgactgactaacactttcacgttcgagtaaccacagctttctgagcctcagaacctgtcctctctctacagaatgggcccaataatagtaactacytcatagactgtgtgaatattagagaggatgcagactgcacgatcaatatagtaccttgtgcacagttaatgcctacgattatgctttctcagggcctccc

SEQ ID NO: 76103 - DNA, 201 bp, Bos taurus
agaaggaggaagccaagatccgcagtaagaatctctccgcgggttagttgaccctcacctggctctctaggggaagccatcaggcccaccacctcgcttcygaggcagaggggactgctaagatgcacagcgacagcttactcatcacttagcacttgcaggccctgtgtgctctgtttttacgggcatactttcagtcct

SEQ ID NO: 76104 - DNA, 201 bp, Bos taurus
actgaagcccacaggcctaaagcctgtgctctgcagtaagagaagccaccataacgagaagcctgcacactgcaatgaagtgtagtgcccacttgctacarctagagaaggcccgcacatggcaatgacaactcagtgcagccaaaaattaaattaattaattagttaatcctttaaaaaagaatatttatgttgttgttg

SEQ ID NO: 76105 - DNA, 201 bp, Bos taurus
actttctcctaggctggagagctttatcttgaagtgctagcagatttaacacaatagatttttcctccccagtgttaacaaaaacctttataccctttccrataacttccttgggcaacctcacctgtctaatgtctaacatcttaaaggaaacttccttcttttctcagtcatgtcatatctacgtcagcatttaaatat

SEQ ID NO: 76106 - DNA, 201 bp, Bos taurus
tcagccttctagggtgagatttttgttatctattcctttgtaaccaactgctccaaagtttagtagcttgaaacaacaatgtatcatttcccatgattctrtggggttgactggggttggttgggtgatttctctgctcagcgtggtgaaacccagccccctcttgaggatgcattctgctgagagcttccctggggctag

SEQ ID NO: 76107 - DNA, 201 bp, Bos taurus
atgctgagcgatccagtctatttccctcattttgaaggtgagaaaacgaaggcccaatgaggtttagtaaactgcctaaaactctacggtgactccgggtrgagtcaaggctcctgtctcctggcccaggacctttcctggagcctcccactgacactcagactgccactaggaaagtctacatggatacccccaactgat

SEQ ID NO: 76108 - DNA, 201 bp, Bos taurus
cctgttttacagatcttataaaaactgatgcagggaggctaagaggtcttgtggttcttcattcttagagaacattattttattacatgtaacaattagargaattatgaaaagtaacttctcacatttccatgtgcttacttaccaacagaacaattttttgtgaaagatcaatgaagaaacgtaacaactccgtgttta

SEQ ID NO: 76109 - DNA, 201 bp, Bos taurus
ccccaggatctaataagctcatctgagagaaggagtttgagacaaacgtgcaaccgcccgcaggaatgcatctggtttcagatttcaaatcccgtgtctcycaggcccctggattcagaactcaaggccacaaatcataggcatgaagcactttcttaagactccaccctaacgttggatggctccccatcgaatgcctgc

SEQ ID NO: 76110 - DNA, 201 bp, Bos taurus
ctggctctgtggcctgggcttgggtacactgaccgtatgacgaatgtatagagactcttgtatagaaacgtcccatgagagataccactgcaggccagcaytggtacccaccctacaccctctgcagaaaaggaaacagtcccgggaggagaaggaacctggacaggggcctcggctggagcccaggagagtaggggtctg

SEQ ID NO: 76111 - DNA, 201 bp, Bos taurus
gccatctactttgggtaaggaaggcccatcacagaggggtaggcctctaggaagccaaagagaaagtcaacacagagcggggagtgagaccccggctgacygctgcctccgggctgtgtggccttagagtggtagtttaactccctgggccgcagttgccttaactgtgaaatgggccacggcgcctccatcacaggactg

SEQ ID NO: 76112 - DNA, 201 bp, Bos taurus
agtttgcatgtatgaaaggccagagcacgggcatcagtattagtaaggcaggtgtcattggctacaggtgaaaacgagggtagtaatgaactgccagccartccccagcctccatggcccacagggcaggcctggtctcccacagcttccagctctgcactcggcaccatgacccagaccaggcttttccaccatgaacac

SEQ ID NO: 76113 - DNA, 201 bp, Bos taurus
actgtggcccatgtcccagctccttccagaagcctctgctacctccagccctgggtgccctctgctgagccagcgtcttgggagtttaattaattctcttkcactgtcccctgtaggtggaggccggccagaccatttccctgattccaccccagcttctgattagctggaaggcccatttggatagtgtggcagacatcc

SEQ ID NO: 76114 - DNA, 201 bp, Bos taurus
actcagggcccccttcagcccagcgctttctcttcttccagatgtgccctgccattgatgcagtcctggtgtatgtgaacaagaagtgggccagcctgaayggtatgtagccctagccatgccttgctcccacatggggtcagcaggatggctagaatttttggatgtcccactccccattcaagtacctgctcctggccc

SEQ ID NO: 76115 - DNA, 201 bp, Bos taurus
tggcccctctcacaccctcacagatgtctggaagccccagcccagaagccttacccagtggcattcttggtctcagccctgtccaaagtaaactctgagcmacctgggcccctcatctgcggctcagcctaagggagcaggggttgatcattcacttcctatatgtggggtccaaagagcacgctgaaggcctgtgggtgg

SEQ ID NO: 76116 - DNA, 201 bp, Bos taurus
gaagtacaaactttccccagagtgaggggccccgtccagcctccattcctggaggcacacaggtgacccagaaggcgagagggacccagggggctgggackcgtccctgggggtctgaaaagggccctaaggaatgcggagggacagattggtgagaggataaagaggtgaggcttgagatatatacagtccttggttgga

SEQ ID NO: 76117 - DNA, 201 bp, Bos taurus
ctacagacatcacttcctcctccttgaaatcagtccttcccttggccacgctcccttgcctgttctcccaccctgctaagcattctacctctgcccctttrcaggcataatgttttcatattggccaatcagcgtatttcttcacccccgccactgtgattggctcagagctcggcatgtgactccagctggaccaatggg

SEQ ID NO: 76118 - DNA, 201 bp, Bos taurus
gcctgcaccagcagctacttcacccaagggctttctacttgatgaaggctgcctcacaaggtcaactcacgtcagggaacccttgagcccctggggttatrtccggggccttcaaccagctctcctcagctctgccgagcggaccttaggtcaggctgtgctggggctaaagacaaggcatagggtgaagggttggccaaa

SEQ ID NO: 76119 - DNA, 201 bp, Bos taurus
taccagctggcctcaaggtgatctgagtgaaatgtccttccctggggacccaaatgctgggccctttccttgtgagatcttggccagtcacctcccttccrtaaacctctttcctcagcagaaaatggggctttctgaacctcctcacagagttgtcctgagcaccagttgggaaagttgacctgcagtgccaagcccagg

SEQ ID NO: 76120 - DNA, 201 bp, Bos taurus
tctcccccacttaggagggagccagtgttgcaggaagagcaagaccacacctctggttccagaagagggagcaaagccattccctttggctcttatccaakgctgcaggccaagtcagcacttgtccccgtggtcctgcaaacactatccatccatctgagcctctgcagacgtggccaccgatgggagcagctgggctga

SEQ ID NO: 76121 - DNA, 201 bp, Bos taurus
tcacagagagggggatgaagggcagcagtgatgaggtcagggtgatttgaatgggaagattcattttgaggatccctaagaagtaggtcaaggcagaaggrcaaggctgggtcatgaagcgctctgtatgtgtgtgttagccattcagttatgtccaactcttttcgacttcatggactatagcccaccaggctcctctgt

SEQ ID NO: 76122 - DNA, 201 bp, Bos taurus
ccagactcttcctccccctccccacaggccatcttcaccaggtcccatcagtgacctcctggcaaccctcacctgctccctctctttccatcctcacaccyactggccgggctcatagtccactttctgaacctcctccggctttccctgactcagacctcactgccttcactccattctccccctgcagcagggagattt

SEQ ID NO: 76123 - DNA, 201 bp, Bos taurus
agagcagtggagccttagagattggaggccaggtgtgcatcccagaatgcaccacagtctccccacctgcctgatttagggccagctggtttgctcccccyacagcatgtctgatccttgagccctggcaactctgaccagcagggaatctgagactcagcatattcacctgctgccctcaccacaaggcagggccgtgcc

SEQ ID NO: 76124 - DNA, 201 bp, Bos taurus
ataggccacggcagagagggtggattttatcctccggcagaagggagtctttgagggatttgccctgctttcccagccagagcatgtcctggaatttcttytcccaggccctgcgagagactgacctgtgcttcttccccagcaggcccatggatgtagacctcctaggatctgggctgtctggccctgggtctagggctg

SEQ ID NO: 76125 - DNA, 201 bp, Bos taurus
agatagggcagacacaaggaaagaaggcatttattctttaactacaaactccctaactatgtagaactgtcatcctaaatgcagaggggccgattaaatgkttatgttttatcacttgtacgtctagccaatttaaaatccactagaaaattttttttctttttttttttagtcagaggcttttactgcctgcttgcatgg

SEQ ID NO: 76126 - DNA, 201 bp, Bos taurus
catctctcagcagtgagggggttgcacaggggatgagtaatgctggccactggggagggaatgggtgtttatcaggggccagtacagttgtagggagctcrggatttgacattcacatctcttctgagagggaaggagctggctgacacctccctggcctacaggggaggcctccttaacttcgccttttggtttttctac

SEQ ID NO: 76127 - DNA, 201 bp, Bos taurus
ctcttatcatcaacctttatttagcactgttttaacagatttttgtagtaatatacaaaggggagatgggggaagaggtaacttggcaataggccagggcraacagagtcaggcacccagtaagatgtgcccagatcagatcagatcagatcagtcgctcagtcgtgtccgactctttgcaaccccataaattgcagcacg

SEQ ID NO: 76128 - DNA, 201 bp, Bos taurus
atgaatataagtaatggttaggttgtccttcactgctgatatgtttctgtctctaagggttattgcaatcagggatgaacattgctcctcaagccacttaygtccccactgtggtggagtagagtgggattcctggcccatcgcagccctcttttagttgggtgagttgtgtttcctctctgagcctcagattcttcatct

SEQ ID NO: 76129 - DNA, 201 bp, Bos taurus
tatgctttgcaacacataaacacacaattgagttacaaaggtgcacatatttcttctcttctgtccatatccatacttaccttcccttataccttgaggtyatcttacttcctcctcctgccatgtacccacacacttgtcctcccatacccttgtcccactgttttctgcctagatacccagaattgagtgtgctgtgca

SEQ ID NO: 76130 - DNA, 201 bp, Bos taurus
ctccaaggccctgctggccaatcactccaatgtttacagaaattaatcaaaaacttaagggagttttccagcggtagttcaatacctatggctcgtacttwaaagtcaaatgtcattttaggccgtttggatttaaataaactgcgataaacctgaccaaaaagggacttgaggaaatttgctgaggtacaagtaagacag

SEQ ID NO: 76131 - DNA, 201 bp, Bos taurus
ggactcttcgcctgcaaaagaaaacagccacagtgtggacagtgactgcccggggagagtgggacttggggtgaaaagtgggggcactgctgttatttttygcaaggttcatgatacccagagattctccaaatcataatcgaaatagtcagcttcacacggaatttcttttactactaccagtttgtcttacaaggcact

SEQ ID NO: 76132 - DNA, 201 bp, Bos taurus
gctagtgactgctataacttccggtgtatctggtcaactctctgcaagagggtgagagcccaaggtttagacttggacttaggtgagggtgaaggccttcrgaggcttttaggctaggttctgtgctccaacactgctggtcagaagcatgcaccagagcatcggcactggccaacctaattatagaagagtcccttatct

SEQ ID NO: 76133 - DNA, 201 bp, Bos taurus
ctgctggcatcttgttttaaaaactagggctgctgctcagtgtcctacaatgtacaggacagaccccaacaacagaattatctggccccaaatatcaatayttctggagtggagaaaatcttctatagcaaattctgaccagcgatcgttcatcctcaccctgagtgcttcaagttgttttcatcaaatacataggtgtct

SEQ ID NO: 76134 - DNA, 201 bp, Bos taurus
ttgtcaggaagggctctccaaggagacgtctctggtaagaaagccaggggctaacaggggagctgctatttggtggctctcctgtgtcactgatgctttayacacgtggccttactctttgggggagcctcagagacaggtgacatcaggaaccttagccaatgaaagtcccagccagggtgaggagccggccaatgggag

SEQ ID NO: 76135 - DNA, 201 bp, Bos taurus
gagattgaggccagcggtagagacttgggagatatcaacagttagaaaaagtgggctcctctaggcaggatgttgaacggcagaggaagtgaccttagagyatgacctttatcctcaggtcagggccatgtcttagtcatgtttgcactgagcacaaggtctgcacacagtgggtcatcaggagagctgggtttactgctg

SEQ ID NO: 76136 - DNA, 201 bp, Bos taurus
gaatgggagcaaaattccctctcccaagacccagttaccttgagagtggtgagtgcttttttctgggatacaaggcctttgacttcaggctcactctggtygtgggcttccccatccacagaaatggggtgaatcccatctgggaatagcagaaatgccccattagaaactggtgtggggcttcactggtgatctagtggt

SEQ ID NO: 76137 - DNA, 201 bp, Bos taurus
tgctgggaggaggctgggaatacagtgaagtcactccctgtagactcgggaaggcttggtctgatctttctgccactcataacctccttggtggttttgcygaggccaagcattgactgggcagtctggtgggcaggggctgtagccagagtggagagccctggctgctggcattgggtgtcccacatgactgactcacag

SEQ ID NO: 76138 - DNA, 201 bp, Bos taurus
gtatttctgaacagctgcaacacttaggatgcttttagttacaagtaacaggaaacccagttcaatttgattttgcaataaaggggatgtgtgagtacgcrttaatagggaagtctggggaaggtgtactgctccaggactgtcggttgtcttagcatgtcacctctcactgctgtttttacattaaacccttgtggtcag

SEQ ID NO: 76139 - DNA, 201 bp, Bos taurus
taaaaaagaaatgagaattaaattctaaatggactccatacaaacaaacttgtgaccttgagtaagtcagcatattttttgaagggtatactcctctgtayttctatacaagagggatgctaagctttgcctagaggaatgctgtcagaacccgtagaccatgtagcagatgtacagcagacattcagtcaacctcctctt

SEQ ID NO: 76140 - DNA, 201 bp, Bos taurus
gggcctcagtcttcttgtctgtcaagtgggaataatgttctaggttttcttatgagtttgtcctaagattgcagttatgggaaaactttgaaaaattgccmatgagatggtacatctgggccacccactgggaagatggggcctctctgatcttttctcccacctgctcctctcaggcagcccctggaattttgccttcac

SEQ ID NO: 76141 - DNA, 201 bp, Bos taurus
cacacttaatttctcacagttctgggggctgggaagtccaaggtcaaggggccagccaatctggttcctggtgaaggccctcttctggtttgtagacagcyatcttctctgtgttcttatgcagtggaaagcagagaagtcatctttctcatgtctcttacaaaagcacgcatcctgtttatgagcacctcctaaaggccc

SEQ ID NO: 76142 - DNA, 201 bp, Bos taurus
ttcagaatatccctgatgtgatattgttgcccccactgtacttatgaggaaactgaggctctgagaggcaaaaagaagttgccctggttcaaaagaaagtmaaagcttctctcccagttttgtccttatttcccacagatgtcttccatgctcatagtcattggaaaagaccctgatgctgggaaagattgagagcaggaa

SEQ ID NO: 76143 - DNA, 201 bp, Bos taurus
ccccagccctgtggggaagcgaggctgccagggtacagaggagccctgtccctgctggtcccactggacacctgtctcctgagacagacaccaggcccccrtctcctctggggcgtgacgtcaatcattaagtggcttctgagatgagctgggattgcgtgggttctgaggtgcgtgtgtgtgcacatggccctaggtgca

SEQ ID NO: 76144 - DNA, 201 bp, Bos taurus
atggctctgtggacaagttagggcccttaccctctgggcaagtttcttcacagctggccagctgtgctttctgtggaaaccattcctcccatgaacaggcrtctcttaggtgtgctggtgggggctcaactaagtcctcagtttcttcagtgtccacattcccttggactaagagtcgttcagtagctaagtcgtatccaa

SEQ ID NO: 76145 - DNA, 201 bp, Bos taurus
cttccagctgccaccgatgctagtgacttcctttgaaggcaaacacggcagtgtcagatactgcatcaaagccaccctccaccggccctggtccctgcccrtcggacaaagaaggcgtttactgttattgagcctgtggacagcaacacaccggctctgctggcccctcaagccggagctcgggaaaagatcgcccaatcc

SEQ ID NO: 76146 - DNA, 201 bp, Bos taurus
gaaataggaaatcaaacacagtgtaactggctagggccgccagctgccagtggcaaggagctctgtggcccagtgtcagctattccaggagtctcacagcrtgctaagctgagtaacacctccagcttgtacacaccatgtctgtgtaaacaaacacacaaaagagaacagaagacatgcttcagtgggctttggaaaaca

SEQ ID NO: 76147 - DNA, 201 bp, Bos taurus
ctctcaggcctgaagctcagcaccgcttcagccttcagtttctgttcctacacattgcaatctgcttcctttgcagttgtctgcccttgaacccttcactyagcactctggcctgttttctccctctgttgactcctggagaaagagacatgaatgtgtagttttcaaccctcaccgatggtgagtaaggcttgaagagct

SEQ ID NO: 76148 - DNA, 201 bp, Bos taurus
caggggtagggcagggaggacacgtggggccagcgccaaatgtcccagggccactcgagtcctcgtccagctttgcccctccctgggcctctcttcccccrctcactgctgtctaacaaatatatgaacagcgccatggaaactgtaaagtcctctggattcggccgtgtaaatgacaatggttactagagtggaaactta

SEQ ID NO: 76149 - DNA, 201 bp, Bos taurus
ggcttttcagtctcaggaagggtgaggccctcccctagctgggtggctctcttgcagccatcgtgcccatctcacacctgacccacctgcacagagagggyggccttcccgaccaccttgcctaggtgcttgctccgacttttccttctcaggacactctttccagcatttgtcaatggcctattgactgaccatctccct

SEQ ID NO: 76150 - DNA, 201 bp, Bos taurus
ccaaatagtcggaattctcattgatcaggtgctgcagggagtcgtagccacaagcctggcagatgtctgtcatggtgccgatggccgcctgactgatgagyagggtttggtccccagccttctccagtactggatatagggctgacatcaagagcaaacggaagtccttccctagtgcgtgtgcgaagtggcctatccctt

SEQ ID NO: 76151 - DNA, 201 bp, Bos taurus
tttggaattatccccctatacatatttatttcctgttataacaatcatgggtccccaagaccacttccaggttggtgactttctaggaggactcaccggayttagtgtgtagttgtgttcatggctgtgagttattacagtgaaaggatataaagcaaaatgagcagagggaaaagaggcaagggctgcagtccagaggag

SEQ ID NO: 76152 - DNA, 201 bp, Bos taurus
ttcgagtgggacctaaagactctgtttacctctcacggtcagaggcttgtagcctgggaggccttggcttttacacattggctcagctggccgcacactckaaccatatatggagcagccagtaaaaaggaagaatgttctaagttaacatgattctgagctcttggccagagcactacctgctacaggcctgaaccccag

SEQ ID NO: 76153 - DNA, 201 bp, Bos taurus
tgaaggagcagtgagcaggccataccctggatttaagggctgcacacggcaggtgctcagtcagtgatgggagagaaggaaaggaaggcagccagttaccrtagtccaggcccttctgggtgatcctggccacaatgccagggttggtagtcgtcacagccgtgcccagggcggccagcaccaccagggttgcccacctcc

SEQ ID NO: 76154 - DNA, 201 bp, Bos taurus
gatgggagagaaggaaaggaaggcagccagttaccgtagtccaggcccttctgggtgatcctggccacaatgccagggttggtagtcgtcacagccgtgcycagggcggccagcaccaccagggttgcccacctccgcgcggtgtcagggcctctggccatgtcttcgtcctgcagagctgccaaaacctcgaggtcttgg

SEQ ID NO: 76155 - DNA, 201 bp, Bos taurus
tgttgggtgcaagtcctcagtgacctctggacttgaacagccctaggggctggcccaggcatatttgggctcaaggcccagagaggacaaatcaaggtcayggaactggtgtgcagcaaagctgagggcaagatgtaggtgtctggatgccgagtctattcagttagacagcaaatggttagatgcttggccaagggtcaa

SEQ ID NO: 76156 - DNA, 201 bp, Bos taurus
ccccactgccaatcagtgggcaagagtttcaggggtgtgtaggtggagggaccgggctgcatgcagaagcggcacagtcagctccgccagtcatcctggarttggccattcagtggtctgatcagcatcatcttgactctttttaagtaaaattagtctatagttacagagttggtttgttcccatttcttggaggctgat

SEQ ID NO: 76157 - DNA, 201 bp, Bos taurus
ttaacctatagtgaaaaaaacaaatcggcagtaacctagggaggggacaaaaaggagtagggggaagttttgggtttttttcctggggaagtgttataaargttcatgagaagattaaggggtaatgaatatgtctaccgtcttgattgtggtaatagtttacaggtgtatacttagtccaaaatttatcaaattgtacac

SEQ ID NO: 76158 - DNA, 201 bp, Bos taurus
cccatcttgaggcaccagtacatgcagaaatggagtatttcctgccgtatcagtaaacaaggatgtcacagtcaccagcgattgcagccaccacagatgaygggccagtgagccctgagggagctcaggaaggaaagaacacctgccatctagcagccgtcagactgcagccactccctatactgagccttgaagaagtgc

SEQ ID NO: 76159 - DNA, 201 bp, Bos taurus
gaggtggcacactgaaccaccaggggcgcgcggccactaatcagccctacatgtatgttgagcaacagtgtcatcattagaatgacaggcctgtctccctytgtggaaacagcagtgtgggcgaggtagtgaggagcactgcccctgtggttctcaaggtctggggcccagtctaggctctaccacgagcttcccccggga

SEQ ID NO: 76160 - DNA, 201 bp, Bos taurus
agtggctgaaggcttcatggctgcaatagcatttgtttactggtatggcaggtgacattctctgtccacgttattatctcatttaattttcaccactaccytgtgaagcttccctggtggctcagatggtaaagaatctgcctgcaatgcagatttggaagactgagcaactaacactttctcactttctttcactttact

SEQ ID NO: 76161 - DNA, 201 bp, Bos taurus
ttaaattagccatatccctatttttggatatttaggtagcttgcatgttttcttcagtgttataaataatactggtatcttcaaacatatagcctttctayatttaggaattttactttgagtacattcttagaattaccaccgagttaaatacataaactcttttttatttgtctggaaatctattgcctagttttgttt

SEQ ID NO: 76162 - DNA, 201 bp, Bos taurus
tattctagtggccagtcaaggtgtgtcctactgcattactagctgacctgagatataataaaaacgctgaaaatatcagcaactgtgatttgctcctttgsatgcctttccattccccaaagcaggccagattctgcaagttccttataccttttcattggaaaagaccctgaagctgggaaagattaaaggcaaaaaaag

SEQ ID NO: 76163 - DNA, 201 bp, Bos taurus
ggatttcccaggcaagaatactggagtgagttgccatttccttctgagtggagctcaaggaattgctaaacatcttccaatgagtaggacaggccctgtgygtaagagcattactcagcccccaatgcatggaagttgagaaactttactacagaggaaaggcttggctatctaagcgatcacctacctggtcctgtccca

SEQ ID NO: 76164 - DNA, 201 bp, Bos taurus
aaagggggcaggatgggaaaatgaggtctatggactggttggggttcttctacctatcacaagctatggactgcacctggtacactgctttatcaatgacrtgtgctaatttcaaggcccatgatgatacaaatatggatagttcagagcaaagccagctctgttacataaagaaagggatatcattttgtacattttctg

SEQ ID NO: 76165 - DNA, 201 bp, Bos taurus
ggaaaggggaattcagggaagaggcagatggtaccaagttctaaattgggaactgagcttagcagtttcaaggcagaggaagatcaagaggccagtgtaayttgcagacatttaacaagaaggaaggtggcatgaagtgagaagcagagaccaggtcagggagcaccttgtaagccatacgggagatcaggagattggatg

SEQ ID NO: 76166 - DNA, 201 bp, Bos taurus
gtgggatgcattgatggccagaaaggatctggctgcaacccaaacccactcctctgactttgagaacagagactacacactagccttccaatggcccatcygacaatgatgagaccatggctgacgggaattgtctcaactgtgtcaggaatgagcacacacttgctaatggcctatttccttccccactgacatccctac

SEQ ID NO: 76167 - DNA, 201 bp, Bos taurus
gctttggcccaccagggagtggagaagtttgccaaagtgtgcacatcttgggtgctggggtaagcagcccatggtaaaatgccatgcccctggtggtgagygccaccgggtgtcccctggcctccttcctctagagaagcaaagactcaataacagaaccaagatggaacagcccctttccagtccagtgtctctccagcg

SEQ ID NO: 76168 - DNA, 201 bp, Bos taurus
gaataatcagtgctcttaggataaaaaccaaaagccttgacatgggccaataggcctcatgtgatgcagttcctgatatttctccagcctcagctcacaawctctcatcagtaactctgctctggccgccctggattactttccaggctttcctaccacagttcctttgcatatgctcttccctatacctagaatcaacta

SEQ ID NO: 76169 - DNA, 201 bp, Bos taurus
cctggttgccaaagcattccaacgatgcggtccaaaaattagtcaagcccccaaggtgctcggagccagacttcaccgtggcctcctgcggcttgcattcragaagatgtagcttcagctgctgctctgctggttcctttggaggacttggcactcccccattcacggatgcatcacccccattggcctggttgtcctcct

SEQ ID NO: 76170 - DNA, 201 bp, Bos taurus
agtatatgacaaatacacaaagaaacagctttcagtgtcaatgagagtcaggaagaactgtagaaattatgtcaaagccagggctttaagaacacaggccraaatggggagagagggcatacattcctgatggatggagcacagtgtgctaaggtataggtattgggggctttgctggaagcacaggaggccccacagtaa

SEQ ID NO: 76171 - DNA, 201 bp, Bos taurus
tcctgccaacttttgaccttgtgtatctcttgtcgtttttaaacctgaccctcagagtggagtgaaaaatttgtggaaatccaggggagatagaaaagcartgctgtgaaatatagtaagggaagtgctttttcagccctgttggtagtactaatttatacagtcagtgtgagaataaggatgcttttgatttctgccttc

SEQ ID NO: 76172 - DNA, 201 bp, Bos taurus
gggcccgggagggctcctttgaagctcgctaccagcagccctttgaggacttccgcatctcccaggagcatctcgcagaccattttgacggtcgggatcgmaggtgaggggtgggggcaaggtggcctggaggagtggtcctgagaggctgggggttggccggccgccctcggttcccctcgcccgtccccccaggcttca

SEQ ID NO: 76173 - DNA, 201 bp, Bos taurus
ggtctccatcctctcctccaattcatttgaaatttaaaatcatgtttcttacttcaggaaagtattttctttcacatttgattttttttttaatgcttgcrttgtttttttttcttcctgttgctgttcagttgtggcttgaccctcccgtggttctgagtgaattgcaggctcttactcctggctgttggtttcctttgc

SEQ ID NO: 76174 - DNA, 201 bp, Bos taurus
ttaaggccatgagcactgcccaatgggaagaaagagagggaatgaaccactgccctggggaatctcaaagcaaagttcaaacgccaacacttgcggtcctyggggaagactagcactgtctggggccagagccaactgcaggtctgggggaagggatggcgagggaggcgcctggggatcccactcactcactgtgattat

SEQ ID NO: 76175 - DNA, 201 bp, Bos taurus
cctggaatctgggggcggtggcttagttgcatagttccaatttagggtttttcatgaggttgcaatcaggatgtcggcctaggctgtgatcatctgaacaygtaactgtggctgggtgaactgctttcaggatggcgttctcacatggctgttggcaggaggcctcagtttctcactgtgcgctactgatgaggcctcctc

SEQ ID NO: 76176 - DNA, 201 bp, Bos taurus
tctctctctttttgatgtggactgtttttaaagtcttctattgaatttgtcacgatattgttcctgctttatgttttggcttccttggccacaagtcacaygggatcttagttccgtgacgagagatccgtcttgcaccctctgtaccataagctgaggtcttagccactgggccgctggggaagtcccctaccttcttct

SEQ ID NO: 76177 - DNA, 201 bp, Bos taurus
agcagggccatccctcgtgaagactcacgttaactgaggttaggatactgacattaaaaaccagtataggagttttctctccagggccaagtttacctgasaatgtcctggaagagtctgctttcagtccaagggagacattccttgatgtttgaggatgccaggctgagacatgttcactgtgccgtagggccggtctga

SEQ ID NO: 76178 - DNA, 201 bp, Bos taurus
ctaacactctcacttcactcacaacgcacttcaacatcaatgggatggaattctgagcaaggcattcacttcaattgtggaggttccatgacttgggttcrctattttgttcgtttggtcactcggtccttcaatattcaatcaacaggtattaactgagcatctactactcggtataaggccctagagatacaaaagtgg

SEQ ID NO: 76179 - DNA, 201 bp, Bos taurus
agcctgcatgctgtgttactgaagagcttagagaagatgctgatatactgacagagagataaaagatgctggaaaaaaataaacccttgcaactgctaggmgtggccgcctgagctggtccagccctcccagttcctgagggagcacacccactccctgactcaccgtcctcctccgtctgcaccaccagctcctcgctct

SEQ ID NO: 76180 - DNA, 201 bp, Bos taurus; identical to SEQ ID NO: 36659

SEQ ID NO: 76181 - DNA, 201 bp, Bos taurus
ggatgcggccgcccaaaagggagaaccacagtgggagtgggaaatgtcatgagaaactgcttcacatgcagtcaatcagccacgcagaacacaagtaagarcaatgaacaaggagtcctggaggccagtgaggggtcagaagcatgcagaacagagacaagaggagaaactggactccaagtagtcaaggggctaactccc

SEQ ID NO: 76182 - DNA, 201 bp, Bos taurus
agcggggcaggcagcaggtgtcagagtgatggccttcagccagctaagagacggtgtgtgagaatggcttcaaggtctctgttgtggcattaactcctgcrtgccaggtgccagggcctctatccacccctactaccttctcttctccaggtgagaaacatcccctctcccacaaccattccaggccaggtactgccactc

SEQ ID NO: 76183 - DNA, 201 bp, Bos taurus
ccaactcagccctgaggaccctggaaagtgagagagggccccttgggggtagccctgcccctccactgcccagaccagagcaggctgttccaatgggccaygctaggagtagagcccaagaggcaataagaatacctcctgctccaaaacacacaggttcagttcagtcgctcagttgtgaccgactctttgcgaccccat

SEQ ID NO: 76184 - DNA, 201 bp, Bos taurus
tcaattaacttaccttcacatgggcccccatcttgggtctgtttctagggaacccaaccccaaacaggaaagttcacattaaataatctcttctttccagytcctcttgaaaactgcttctttcccacaaggaagcctcagctcacctcgaagacttgctgccccactgaaacagtcaccaagaactgccactggtttatc

SEQ ID NO: 76185 - DNA, 201 bp, Bos taurus
tattttgagaagtatcagtggacctcccacccacagataaaatctgtgttcttgatggtaacaaaattctgcacactcaggccagcctttgaatgctccayagatcaaatttaggtgggcaacagagcctttggggtgagagcgcaattgtttctgggctctcacaaggcagccaggcctgggtttctgctgcagtggttc

SEQ ID NO: 76186 - DNA, 201 bp, Bos taurus
gagagaagagcctaatgctgatcaattttgtgtcatctactgcataaacagcttcatccaacaacttcacggcaccttttggaggcatgaagtattggccycttttcagaaatgaagagaatgagctccagagagatttgaagtagtgtcagaaatggcaccactaatatgcggtggcatcagaactgaaggccaggatat

SEQ ID NO: 76187 - DNA, 201 bp, Bos taurus; identical to SEQ ID NO: 36667

SEQ ID NO: 76188 - DNA, 201 bp, Bos taurus; identical to SEQ ID NO: 36669

SEQ ID NO: 76189 - DNA, 201 bp, Bos taurus
ccagccatcgtgtgcctccaactctgaaagtctggggtccaggtcacagctttcctacccactggctgtaagcctgtggcttcacctcaagggcctgcggkggggatagaagcagacctagctcagaggttaacgccagttaccagccctatgagctcaggctgaccacctgacctctccccgatatcacccacatcttgg

SEQ ID NO: 76190 - DNA, 201 bp, Bos taurus
ctcttcagcctctttccctgggcgcccttgggtggtttatgtgccctctctgagccctgctttttgcatccgtgaatgggggctgattgggtgtctcaggrttatgtctttagatgggttggcctcttccaccctctgcctgaaccccagaagggacagtggtcttttcaactgaccagagactggcctcccccagctggc

SEQ ID NO: 76191 - DNA, 201 bp, Bos taurus
tacaacaaaaataaataaaaacttattttaaagttccagtaaccatgctatcatgatatcggcacaaagatagacacctagatcaataaaaatgatattcytttggggagcgaatatagaaagaaatatgaaagttaagtttcttcaaggaacacatgtcacagacccaggtcatgtgacagcagatattactcagggctc

SEQ ID NO: 76192 - DNA, 201 bp, Bos taurus
ccacttggcgccctggtgggtgcgggctggcagccgtgggaggggtgtcacaggcggggtgggacccaggcaggggagcgctgctgggagctggccccccrtccagggtggtgggtctaagaagaggagttttcttaccttgggacctctgttacatcccactaactctgggttccctttacactatctgtgtttttattt

SEQ ID NO: 76193 - DNA, 201 bp, Bos taurus
ccttgcaagaacatcctctcagatcattctctctctcccgagaggcagccttctgctccagagcggaggggtcatgtcctgcctgtgccagctgtggtagragaaatccagtcgtcccacagacagttactaaccagcttttccagttttatctgctctgcatcttggcttttggagattcccggttcctccaacccctga

SEQ ID NO: 76194 - DNA, 201 bp, Bos taurus
taaaggaaggaaagggttttcatgagtgctcctcatgcagcctcagggtgcccttcacagatagattgaacttgggccatgggtggccttgaatgtcaagrcgaggaatcaggcaatgggcagtcatgggaggttttagagcagagggcagccttgagggtaactgtcaattaggcaagagttaactgtcaggtatgaaga

SEQ ID NO: 76195 - DNA, 201 bp, Bos taurus; identical to SEQ ID NO: 36673

SEQ ID NO: 76196 - DNA, 201 bp, Bos taurus; identical to SEQ ID NO: 36674

SEQ ID NO: 76197 - DNA, 201 bp, Bos taurus; identical to SEQ ID NO: 36675

SEQ ID NO: 76198 - DNA, 201 bp, Bos taurus; identical to SEQ ID NO: 36676

SEQ ID NO: 76199 - DNA, 201 bp, Bos taurus; identical to SEQ ID NO: 36677

SEQ ID NO: 76200 - DNA, 201 bp, Bos taurus; identical to SEQ ID NO: 36678

SEQ ID NO: 76201 - DNA, 201 bp, Bos taurus; identical to SEQ ID NO: 36679

SEQ ID NO: 76202 - DNA, 201 bp, Bos taurus; identical to SEQ ID NO: 36680

SEQ ID NO: 76203 - DNA, 201 bp, Bos taurus; identical to SEQ ID NO: 36681

SEQ ID NO: 76204 - DNA, 201 bp, Bos taurus; identical to SEQ ID NO: 36682

SEQ ID NO: 76205 - DNA, 201 bp, Bos taurus; identical to SEQ ID NO: 36683

SEQ ID NO: 76206 - DNA, 201 bp, Bos taurus; identical to SEQ ID NO: 36684

SEQ ID NO: 76207 - DNA, 201 bp, Bos taurus; identical to SEQ ID NO: 36685

SEQ ID NO: 76208 - DNA, 201 bp, Bos taurus; identical to SEQ ID NO: 36686

SEQ ID NO: 76209 - DNA, 201 bp, Bos taurus; identical to SEQ ID NO: 36687

SEQ ID NO: 76210 - DNA, 201 bp, Bos taurus; identical to SEQ ID NO: 36688

SEQ ID NO: 76211 - DNA, 201 bp, Bos taurus; identical to SEQ ID NO: 36689

SEQ ID NO: 76212 - DNA, 201 bp, Bos taurus; identical to SEQ ID NO: 36690

SEQ ID NO: 76213 - DNA, 201 bp, Bos taurus; identical to SEQ ID NO: 36691

SEQ ID NO: 76214 - DNA, 201 bp, Bos taurus; identical to SEQ ID NO: 36692

SEQ ID NO: 76215 - DNA, 201 bp, Bos taurus; identical to SEQ ID NO: 36693

SEQ ID NO: 76216 - DNA, 201 bp, Bos taurus; identical to SEQ ID NO: 36694

SEQ ID NO: 76217 - DNA, 201 bp, Bos taurus; identical to SEQ ID NO: 36695

SEQ ID NO: 76218 - DNA, 201 bp, Bos taurus; identical to SEQ ID NO: 36696

SEQ ID NO: 76219 - DNA, 201 bp, Bos taurus; identical to SEQ ID NO: 36697

SEQ ID NO: 76220 - DNA, 201 bp, Bos taurus; identical to SEQ ID NO: 36698

SEQ ID NO: 76221 - DNA, 201 bp, Bos taurus; identical to SEQ ID NO: 36699

SEQ ID NO: 76222 - DNA, 201 bp, Bos taurus; identical to SEQ ID NO: 36700

SEQ ID NO: 76223 - DNA, 201 bp, Bos taurus; identical to SEQ ID NO: 36701

SEQ ID NO: 76224 - DNA, 201 bp, Bos taurus; identical to SEQ ID NO: 36702

SEQ ID NO: 76225 - DNA, 201 bp, Bos taurus; identical to SEQ ID NO: 36703

SEQ ID NO: 76226 - DNA, 201 bp, Bos taurus; identical to SEQ ID NO: 36704

SEQ ID NO: 76227 - DNA, 201 bp, Bos taurus; identical to SEQ ID NO: 36705

SEQ ID NO: 76228 - DNA, 201 bp, Bos taurus; identical to SEQ ID NO: 36706

SEQ ID NO: 76229 - DNA, 201 bp, Bos taurus; identical to SEQ ID NO: 36707

SEQ ID NO: 76230 - DNA, 201 bp, Bos taurus; identical to SEQ ID NO: 36708

SEQ ID NO: 76231 - DNA, 201 bp, Bos taurus; identical to SEQ ID NO: 36709

SEQ ID NO: 76232 - DNA, 201 bp, Bos taurus; identical to SEQ ID NO: 36710

SEQ ID NO: 76233 - DNA, 201 bp, Bos taurus; identical to SEQ ID NO: 36711

SEQ ID NO: 76234 - DNA, 201 bp, Bos taurus; identical to SEQ ID NO: 36712

SEQ ID NO: 76235 - DNA, 201 bp, Bos taurus; identical to SEQ ID NO: 36713

SEQ ID NO: 76236 - DNA, 201 bp, Bos taurus; identical to SEQ ID NO: 36714

SEQ ID NO: 76237 - DNA, 201 bp, Bos taurus; identical to SEQ ID NO: 36715

SEQ ID NO: 76238 - DNA, 201 bp, Bos taurus; identical to SEQ ID NO: 36716

SEQ ID NO: 76239 - DNA, 201 bp, Bos taurus; identical to SEQ ID NO: 36717

SEQ ID NO: 76240 - DNA, 201 bp, Bos taurus; identical to SEQ ID NO: 36718

SEQ ID NO: 76241 - DNA, 201 bp, Bos taurus; identical to SEQ ID NO: 36719

SEQ ID NO: 76242 - DNA, 201 bp, Bos taurus; identical to SEQ ID NO: 36720

SEQ ID NO: 76243 - DNA, 201 bp, Bos taurus; identical to SEQ ID NO: 36721

SEQ ID NO: 76244 - DNA, 201 bp, Bos taurus; identical to SEQ ID NO: 36722

SEQ ID NO: 76245 - DNA, 201 bp, Bos taurus; identical to SEQ ID NO: 36723

SEQ ID NO: 76246 - DNA, 201 bp, Bos taurus; identical to SEQ ID NO: 36724

SEQ ID NO: 76247 - DNA, 201 bp, Bos taurus; identical to SEQ ID NO: 36725

SEQ ID NO: 76248 - DNA, 201 bp, Bos taurus; identical to SEQ ID NO: 36726

SEQ ID NO: 76249 - DNA, 201 bp, Bos taurus
gcacgtgaggcgcgggcccctgtgcgttcactccacacacaaccactgccgggaatatgatgctgcgggtcaaatgcagcccctgacctcgtggcgcttaygcttcagcagtgggacaggccttaaatttgttctgcaaacaatcatttaattacggggacctgatctgagagaacaatgcccatgtgtgtggtctcagag

SEQ ID NO: 76250 - DNA, 201 bp, Bos taurus; identical to SEQ ID NO: 36727

SEQ ID NO: 76251 - DNA, 201 bp, Bos taurus; identical to SEQ ID NO: 36728

SEQ ID NO: 76252 - DNA, 201 bp, Bos taurus; identical to SEQ ID NO: 36729

SEQ ID NO: 76253 - DNA, 201 bp, Bos taurus; identical to SEQ ID NO: 36730

SEQ ID NO: 76254 - DNA, 201 bp, Bos taurus; identical to SEQ ID NO: 36731

SEQ ID NO: 76255 - DNA, 201 bp, Bos taurus; identical to SEQ ID NO: 36732

SEQ ID NO: 76256 - DNA, 201 bp, Bos taurus; identical to SEQ ID NO: 36733

SEQ ID NO: 76257 - DNA, 201 bp, Bos taurus; identical to SEQ ID NO: 36734

SEQ ID NO: 76258 - DNA, 201 bp, Bos taurus; identical to SEQ ID NO: 36735

SEQ ID NO: 76259 - DNA, 201 bp, Bos taurus; identical to SEQ ID NO: 36736

SEQ ID NO: 76260 - DNA, 201 bp, Bos taurus; identical to SEQ ID NO: 36737

SEQ ID NO: 76261 - DNA, 201 bp, Bos taurus; identical to SEQ ID NO: 36738

SEQ ID NO: 76262 - DNA, 201 bp, Bos taurus; identical to SEQ ID NO: 36739

SEQ ID NO: 76263 - DNA, 201 bp, Bos taurus; identical to SEQ ID NO: 36740

SEQ ID NO: 76264 - DNA, 201 bp, Bos taurus; identical to SEQ ID NO: 36741

SEQ ID NO: 76265 - DNA, 201 bp, Bos taurus; identical to SEQ ID NO: 36742

SEQ ID NO: 76266 - DNA, 201 bp, Bos taurus
attttcctttgaatgagaattggggaatttaacacatggaatgtaagtacgataattaaaggtgtggattttgcatgaaaaggtttgtgtttacatctcarcaccaaagcttcctagctctgagaccttgacctgtctttcctgttccggaaacaagagcaacattactaactgcccgtgggggttctgcgagaagtcatt

SEQ ID NO: 76267 - DNA, 201 bp, Bos taurus
ggccgggtgtgcaagtggagacaccctgagcagcgtccgcgggtggggaggagctgctgtgctgaggagcagaggagactggtttccccaccggagtccgwgaatccgtgggcctggggactcccagggactgccgtgcaacgtggacaatcctagatcttcagacccgtggggagcctctgagacttttttttaagttag

SEQ ID NO: 76268 - DNA, 201 bp, Bos taurus
ttgtgcatgaaaagtttggccagttttaggtggtcatgatcgtctctaggcatctttgtgaaatttatcttacacggccgtctcttcctaagtttaagaayattcagtgtgatttcactcgtggtggtggtagtggtggtggtttactttctaactcttgtctgactcttttgtgaccccatggactgtagcctgccaagg

SEQ ID NO: 76269 - DNA, 201 bp, Bos taurus
ccctcaagtgcagcagtgaccaccaaaatccctggtggcagagggagcgcatgcccctcaggtgatggccactggtccgtgtaaacctccagtctctctgygttggcctctctctcactcccgtagactcctcaggctgcacaaaatagttttcctccccactctctctgtctccatcctgtcttgtctctgcatgccctt

SEQ ID NO: 76270 - DNA, 201 bp, Bos taurus; identical to SEQ ID NO: 36748

SEQ ID NO: 76271 - DNA, 201 bp, Bos taurus
tgcaaggaatggagctgagattcgaagacgggctcctcggattcctgagcctctgttctttgtccctgtgctccactgcctaaatcttcaattacagatgmttttttagagtaaattatagtatatccacacaaaggaacattgtacagttataaaaagtaatattatagaagtatgattatttagatgaaaagagggaca

SEQ ID NO: 76272 - DNA, 201 bp, Bos taurus; identical to SEQ ID NO: 36749

SEQ ID NO: 76273 - DNA, 201 bp, Bos taurus
cctccagctatgacttatgcctatatttggaaaacttaacaaaacaataaagctctttagaaatgactgccaacttgcctggaaataggaacccctggatkaaacacactgggtacagagccctaaactgtgggcaggacagcctccaagacagtgaaaagcttgagaatcacaaaggtctgaatcgttgactgcttcacc

SEQ ID NO: 76274 - DNA, 201 bp, Bos taurus
acgtaaccaactcaagcacagtcacacccttctaaaatgattccccagggcactttagcttaaccttagcttcaactcctttattaagacataaacaacamcacctaacctagatagagaaggcaatagagaaggcaatggcaacccactccagtactcttgccaggaagatcccatggacggaggagcctggtaggctgc

SEQ ID NO: 76275 - DNA, 201 bp, Bos taurus
accccgcctcccaaaagcacgaggctgcatggaggcagtggccccagactctcgctgcagtgcctccggggtctgcctgcctggtggaggccatgcccttycccggagctgggcacagtggggtgggtgtgcagacgcctactcagtgctggacactctgttagtaacattagctcctccctggggtaaactgagctctgc

SEQ ID NO: 76276 - DNA, 201 bp, Bos taurus
tcctgggtcttcaacatgcagattgtagtccatgggacttctcttagcctccataatcacatgagccaattcctatggtaattcaatctctctctatagakagattttttcctgattgtcaggaaaaccctggctactagtagaaatgttgagaaacagaattttaaagatgagatttcttattatttattgaagtgtagt

SEQ ID NO: 76277 - DNA, 201 bp, Bos taurus
attctatataactaagagaagtacaacttcctccccaagatttctgaaaattcttaccattctccaaagtactccattaaaaggctgttcttgcctttaayggccttgtttttaaaaataatggcaagtggttactgcaaagaacaaaagacatccattaaagtaactatctgatgtcactttctaatttccttagctatt

SEQ ID NO: 76278 - DNA, 201 bp, Bos taurus
gtgtcttctttatttgatcagtctgattagaggtttatccattttatagataaaacctgcattgagcacataagataacacaagggcaagcagatgagatrgttttaagagtttgccttgtaatcccaagaggctcttcaaacaagcaattgctgaagtatgaaggaacactagtaaaacaattggtttcaaagatgaacc

SEQ ID NO: 76279 - DNA, 201 bp, Bos taurus
gataggttaagacagttttctggagcctgctcctggcttacctttacccgcacaatccctctgaatcctacttgaccttctaagggcaggagttggaaagrgggctgcgaggactggaaatggattgcaagccttctttaaattctggcccttcatcctaccttgttaaatgagaaggacgagcacagagagaggagactc

SEQ ID NO: 76280 - DNA, 201 bp, Bos taurus
gtaaattttgcggaaagtgcactatctaaaatgttgtggggggaaaatcaatttcagttatctctattaaagagaaaaaccaaaattaagggtgttacttrgactactacgaaatgtccttggtatttcacacggtctgcttcatttaatggaaaacaaaatctacgaggaaattgttgtcaatattcccatttatacttc

SEQ ID NO: 76281 - DNA, 201 bp, Bos taurus
actggggcaactctaccagagtctccacatcttagtccttactggtagactaccttgggttcacgtattcattaaccagtgactcattgagtttcctctayacctggaagtgtgggtaatggcttacctgtccagttcacatgcatgactaatttttgatatcagtgatctccctctcctgagagagcaaagttcaatgat

SEQ ID NO: 76282 - DNA, 201 bp, Bos taurus
aagtaaagtttggaccagcatattccaaagaccaagtggtttgcgaaccaccgatatacagaaattagaacaagattaaaagacacatgatttaggccatrgcatttactcttccatgtccatgtgatattgagcaaattagtcgtcttttctgtacttgagttccctactcttaaatgacctaatggccttggtattcca

SEQ ID NO: 76283 - DNA, 201 bp, Bos taurus
taacccacaagcaaggaagggaaggaccagtgcccctgccttgcagcctggtcagccaaaggtctctggcaggcgtgggggcctccctgcatgacaacacracccagggcatcagaacagcaaggctcagccagcagcatccttgcaaattcctggccggacgctctgagccttcgccagcacttccaggtctccctcgtc

SEQ ID NO: 76284 - DNA, 201 bp, Bos taurus
aaactagtcaggtgggactggaacggtgcctctgaggtatttcacaaacacagggaacaaacacatttggtgtcgcaatcctggccacccggagctgccgygttggctgttttttgagaatagacagtggataaggagcttgagagaggacggggtgggaggcctagggtggccatcttagagacatgtcagctctcagga

SEQ ID NO: 76285 - DNA, 201 bp, Bos taurus
agctagaggatcagactgggctggagcacaggatgaagaggacagtagaaaagatgagggtggagagatggagtccagcccaaatcatgaaaggccaggargcacaggtaaaggagcacagagcttgctctaagcacagggaatccaggggagagtttccagcaggaggagtaagagatatgaatgttgaaatcccagggt

SEQ ID NO: 76286 - DNA, 201 bp, Bos taurus
atattagcattccatattgtttcccagaggaaatggctctgaaaggttttttgtcctttttagcaaatattttgtagtggctgtgaaaataacttatttakaaaaatcttttaaacgctagtcattatgacagcaaagtcaatctagtcctgtaactattgttaagtagttatgaatgtggaaataaattcgagctgtttt

SEQ ID NO: 76287 - DNA, 201 bp, Bos taurus
gactgagatgactttttacagaaaaggccacaagcagtgctttactgaggaattttgtctggaaagcctgtttaagccctctcttcttttggctgatgggyggccctggaatttgttcgttttccagtgttaggccatttaagggcatgatggttgaaccagtaagcaaactcacattgtgctattataagtgcctcatgg

SEQ ID NO: 76288 - DNA, 201 bp, Bos taurus
gctgagtggtggttaccaagggacagggggacaggaataggggagtcgttcaatgcatataaagttacatttatatgagatgggtaagtttctgggatctyccgtacaacataaagcctatagctaacaataagatgtcatgtgcttaaaatttgttaagaaggtagatttcatgttaggtcatcttaccaaaagccaaaa

SEQ ID NO: 76289 - DNA, 201 bp, Bos taurus
taggtataagagagaaaaagattgatgtcaatagatatttaacaggtaaaatatggtactcataatatgtatttatttatttgttctgtcattaactgtaygtaatttgtacacgtgtgtgtgttgccaataagaaaacacaaaagcctacacaattaattttacatgttatgtgttttttattttgttttttccccatta

SEQ ID NO: 76290 - DNA, 201 bp, Bos taurus
accaaaggacaaccaaactacataatttgtccagaaccatgaatgtctcaccagaagtagctcagcgctccctgccaggccattcaagcagtacctttagragctagggtgtgatggacttgcatcctctattttactggatgtttggaaacatgccatttttacagagctagaagctaggcctgcttgcaggatgggtgg

SEQ ID NO: 76291 - DNA, 201 bp, Bos taurus
aaaaattatactagaattctatcctttaaaaataactgaaagttcttgcaaaaaaagatgtttatacagtaatgcttattgtagcaccatttatagtagcraaataaatcagaacaaaaatatcaggggctagttaaatattacatgatacatatcacataactaaacagtggggtcaaccattagttaccactgtagaaa

SEQ ID NO: 76292 - DNA, 201 bp, Bos taurus
gcccaaggaattgacaatccactctgctctctggaagggggctgatgtttgtttcacaaacatacaaggttgtttgcctggaaccctgagtcagtcctcarggatactcccagcatgatgcccagtgtgaaaaggcttcttgatgaaagttgatttctcctcctcagccacatgacatccacagtagagagaggacacagc

SEQ ID NO: 76293 - DNA, 201 bp, Bos taurus
tactgaatgtgcccgtgtctgtaattaagaaacagttcgctactctcctctccataactgcccacacttaatgggtgaagtccctgctctattgagatggmaagaatctctaaggggagaaaaagacaataatatttcacagcacacaatgaattgttgaggacgccatgtgaaatttgtgggtggaaagtgctggccaag

SEQ ID NO: 76294 - DNA, 201 bp, Bos taurus
tgcttttctctagcaagtaaacataatcttaaatctttattaacctattaaggcaatgtgtctaaagtgagggtacgggttagtgaaaaaacaggtcaatmaggtgtctgctgagtgaagcctgaattagatcctgtgcattcatgaggcttagctgtagtgctgagaaagaaaagtgacggaggatccgagttccctggc

SEQ ID NO: 76295 - DNA, 201 bp, Bos taurus; identical to SEQ ID NO: 36750

SEQ ID NO: 76296 - DNA, 201 bp, Bos taurus; identical to SEQ ID NO: 36751

SEQ ID NO: 76297 - DNA, 201 bp, Bos taurus; identical to SEQ ID NO: 36752

SEQ ID NO: 76298 - DNA, 201 bp, Bos taurus
ggctgcccctagcgccctcctgtgttccagctcttttcttcctcatcttgtctctgttcctaatacgttccaggggcctgctgctaccatttcttgatcaytgacttatggagtctcttttttttccccctaaagattctggttctgaaatcagagctggatcaccctgggcctcagttttctcatctgtaaaacagggat

SEQ ID NO: 76299 - DNA, 201 bp, Bos taurus
gtttgttggactgaaatgatgtacttcagagtccattttggtgaatctaagactgaaagcccatggatggtggtgttggccacgacctgagagctgtgatrgcgaacctgcgcctggactgtgtgttgatttcattcagtgtgaattcctgccccttcctgccctcctttcccccagtcttttgatcttttccttcccagg

SEQ ID NO: 76300 - DNA, 201 bp, Bos taurus; identical to SEQ ID NO: 36755

SEQ ID NO: 76301 - DNA, 201 bp, Bos taurus
tgtcccatttcaccagagagtcattgatccctggaactgctgacaaatcacaactagaaaaaaattgctcctgacaatgagaactggaattcgattgctcrtttcctggcccaggcagaaactaccttgattgctttccaaggagcctaccctccaaactgttttgggggaaaacaaggcaaacaaaatttaataacattt

SEQ ID NO: 76302 - DNA, 201 bp, Bos taurus
caaacagatgaaactaaatgcagtgacatttgcctcatctaagatgaatctcctcttctctggttttcaaaagtaggccatgtctagaatttatgggaaarctagactgttaagaaaatcttaaagtaagacaagttgtgtcacagagtaaaatgaacataaatattaagactcaaacaggcctggctttgagtattctta

SEQ ID NO: 76303 - DNA, 201 bp, Bos taurus; identical to SEQ ID NO: 36756

SEQ ID NO: 76304 - DNA, 201 bp, Bos taurus
gagacacatgagacggcggtcccactgcacacccaggaaactgaatggctgggatgggggaggtgataagatgcaccactcatctggggagtgtgcactcrccatgcacctggtcgcctgagctgctcggacttgggaagggcacaaagtgcaggcccaactgagtctctgcctttgtggactacccgagaacctgaacct

SEQ ID NO: 76305 - DNA, 201 bp, Bos taurus
ttctacaatctaatgattaggtctcaatattttagagggccagtgcccttggactgtgaatttcacacttgcttttcaatttcccctcattctcaggtggrcaggatgacaagagtgggccagagtttggcatttccctccccacacatgaaacgttgaagttggctggggtcgggtattttctttccccagttcagttgg

SEQ ID NO: 76306 - DNA, 201 bp, Bos taurus
tactagaatctctagtaaaggaggaactcatggttaaaaagctcattttaggcactaaaatattttggctaaatttatggaatatagatctctaatggacraaacaaaaatcacatatttgtagaattttcctaaaaagcttttgatgtgcgagtctgctaagactttgatatgatataatttgtcaaaatatatcttctt

SEQ ID NO: 76307 - DNA, 201 bp, Bos taurus
caaaagaagacacctagtaagcaagacttccacaagactttgctgtggaaaggtgcattctaatacattcatattttaatgttccactattattatagaayactttactagatgattaccctttcattaattatcatatggaagaagaaacaaagttccttgacaaaacaaaatctgtgtaggacagctaaatttttgcaa

SEQ ID NO: 76308 - DNA, 201 bp, Bos taurus
gctctttgcatcaggtggccaaagtattggagcttcagtttaagcatcattccttccaaagaatattcagggttgatttcctttaggattgattcttggtkgtggggggcaggggccgtgtgccaatttttaacaggttggggcagccaggaagtaggaagtaggaggggcagtctggcttcttgccctgagaaagggcac

SEQ ID NO: 76309 - DNA, 201 bp, Bos taurus; identical to SEQ ID NO: 36763

SEQ ID NO: 76310 - DNA, 201 bp, Bos taurus; identical to SEQ ID NO: 36764

SEQ ID NO: 76311 - DNA, 201 bp, Bos taurus
cctatttcctccttttggagacccctggcctttctgcctgttaccctgtcattagaatgtcaactttgtggacacttgcctacccctatgctccttcttgraggccatgagacagaggaagtaggagataaattctctcctcactggatgcccagggaagaacttcacagttaggaaataggtagaaaatagtaaagatat

SEQ ID NO: 76312 - DNA, 201 bp, Bos taurus; identical to SEQ ID NO: 36765

SEQ ID NO: 76313 - DNA, 201 bp, Bos taurus
tcaggaagggtaaggatttccacagaccagccgaaggtggcagtgcatctgaacactccttgcccctccacctctggcccagctgcagggctgtgggcagragccagtgagcgacagccacgaggctgctgctcgcgtcctgagagcacactcaggcttcacacccaggacttcatgagaggccacagccccacctgcaca

SEQ ID NO: 76314 - DNA, 201 bp, Bos taurus; identical to SEQ ID NO: 36766

SEQ ID NO: 76315 - DNA, 201 bp, Bos taurus; identical to SEQ ID NO: 36767

SEQ ID NO: 76316 - DNA, 201 bp, Bos taurus; identical to SEQ ID NO: 36768

SEQ ID NO: 76317 - DNA, 201 bp, Bos taurus; identical to SEQ ID NO: 36769

SEQ ID NO: 76318 - DNA, 201 bp, Bos taurus; identical to SEQ ID NO: 36771

SEQ ID NO: 76319 - DNA, 201 bp, Bos taurus; identical to SEQ ID NO: 36772

SEQ ID NO: 76320 - DNA, 201 bp, Bos taurus; identical to SEQ ID NO: 36773

SEQ ID NO: 76321 - DNA, 201 bp, Bos taurus
ttaatgttgttgctctgtgtataaatttccctaaaccatctattggttttgaatgttgaatggtactctaaggcatatatttttctgggccttgattttcytggttaggattctgttgtaagataggtctttgttgaggcaagtaacaatagttcaccatttcaataagggagtggcctttcggggttctcccaaatttga

SEQ ID NO: 76322 - DNA, 201 bp, Bos taurus; identical to SEQ ID NO: 36775

SEQ ID NO: 76323 - DNA, 201 bp, Bos taurus
acccagcttcccagccactcaggcatcccactcccttataagggatgctcccgacacactggccattgtccagctccttttcttggccaggtttcccacartgtgatctttctgcctcaagtatcattcacatcgaccactaacccttcctcgcaggacatcttcctctgcttcttcccaatgcctgacttcttttattca

SEQ ID NO: 76324 - DNA, 201 bp, Bos taurus
ttgatgaagatgtaaatgaattggatctcccttacattagttatgggaatggaaagttgtaaagccacatgggaaaacagtttggcagtttctttaaaaayaaataaataagcatgagctcaccactccacccagcaattgaccctctgggcatttatcgcccaggaattttttttttttcttttggtctggccctgtggc

SEQ ID NO: 76325 - DNA, 201 bp, Bos taurus; identical to SEQ ID NO: 36777

SEQ ID NO: 76326 - DNA, 201 bp, Bos taurus; identical to SEQ ID NO: 36778

SEQ ID NO: 76327 - DNA, 201 bp, Bos taurus
ataacaacgttatacagtcaacacgatactgtccactgcagacaagtgggcaattatcctaacgtaaagctcccaccaagcgttacttagggaattaaagygttccagaatctggtaaagctatgtgaaatatttcctcttttacaaccctgattcaaataggattcaagcacattagcaatttgtcatcttgggcaagat

SEQ ID NO: 76328 - DNA, 201 bp, Bos taurus
caggctaaaaaaggctattgaaaagttgattcactcattgtgtggggccagatccaagtgtaattgcagtggagaaattagcattccattattgcagagcrgttctgaaaaactgtgtcttggccaatttgtttctcaaatctgtgtaacattatcgaacgtgagtcaggcggtaatatttttcaggctatgcctacttag

SEQ ID NO: 76329 - DNA, 201 bp, Bos taurus; identical to SEQ ID NO: 36781

SEQ ID NO: 76330 - DNA, 201 bp, Bos taurus
attcacttacgtttcccacccgacccctgaagatactaagtgtttaacacctgttccaaaagttagggttgggagccatccagtgtaagcaacatcaactkacaaaaggcagcaggttctagttacaaagcgagagcaaactgaagcccagcacccaggtgagcagtggtttaaatcttaaagtaaattaattaattctca

SEQ ID NO: 76331 - DNA, 201 bp, Bos taurus
caggccacaactactgagcctgtgttctagggcccaggagtgacaactaccgagcctacacactgtaggctcagcccacacacagtaagctcagcccacaygccctagggcccgtaatctgcaactagagaagcctgcacactgcagcaaagagcagcccccacgtgccacaactagagaaaccccatgcagcaacaaaga

SEQ ID NO: 76332 - DNA, 201 bp, Bos taurus
agaattccatggactacagttcatggggttgcaaagagtcagacacgactgagcaactttcactttccagtcagtcctgtttgctggtgagcacaccctcrgttcttctagacagctggccccaggctggtttaactcattgctctctttctctttcacccccttgagcctcgtgcccaacttaaagggggacctgcacac

SEQ ID NO: 76333 - DNA, 201 bp, Bos taurus; identical to SEQ ID NO: 36782

SEQ ID NO: 76334 - DNA, 201 bp, Bos taurus; identical to SEQ ID NO: 36783

SEQ ID NO: 76335 - DNA, 201 bp, Bos taurus
ttgaagaagaacttcacatagaatgcctcaattcatatcaactcattttgtatgaaaatctcaaggtctttataaaagggacagttcacctagacacactrctcagtgtcaagactgctagtattcaccttttagtcagcactttcccccaccagtcgtagtttctcaagtcctgaactacatggccaagccatttatttt

SEQ ID NO: 76336 - DNA, 201 bp, Bos taurus
ctgttgttttccctgtttcatagatgagcaactgagctgagttccgatgcagtttaacagcttcccctggtcatgcggttcccacatgtcgggcccaggcrtaaagccaggcattctctgactttacgttttggaccggtgcttattgatcatagtgcactgcccatccccggctgggccagaccagtgacttttaattct

SEQ ID NO: 76337 - DNA, 201 bp, Bos taurus
ccttctccagttgagggtattagaaggatgcaaacccagtgtgacatacaggtcaccatgggacccttggcttatgggttggagaaatgggccatgaccarccatggggacctccagcactgactccactagactcatgtgagcagcaagtcatctccagcctcaccgcgtagacagaggtgggagagacagggaaacaga

SEQ ID NO: 76338 - DNA, 201 bp, Bos taurus; identical to SEQ ID NO: 36786

SEQ ID NO: 76339 - DNA, 201 bp, Bos taurus; identical to SEQ ID NO: 36787

SEQ ID NO: 76340 - DNA, 201 bp, Bos taurus; identical to SEQ ID NO: 36788

SEQ ID NO: 76341 - DNA, 201 bp, Bos taurus
gaacctcagatttgggatctcccttacaaatgagctacaattttatttttaataattacacttttgaaaaaagaggccccagatttgtcattagaattaaygtttgttatgacaaaactatcatagcagactctatcacttaatatttgaaaactaattatttgataaattctccagttgtaaacagtgtgtctgcattac

SEQ ID NO: 76342 - DNA, 201 bp, Bos taurus
cttcctcatgtcatgtgttaaaaggatgtcttgtgtgcatctgtcatccagggaacttaaaatggtttcagaatacagataacccaggcccatggtctctkgatggttccccaaagacacagcatcatcctatgaaacatgaatatgcaaatgaacaatggccaggatgtatatatacatacacacacacacagacacaca

SEQ ID NO: 76343 - DNA, 201 bp, Bos taurus
tagttgggaaccaagggaactagaatacagtatactgcaggcccttttcgtggatgactcacattctaaatgactgctttttaatgccacagtttaaatartactgacacgttgtaggaacataacaacaaacccaacgccaggttacagttagatcatgcatgcctatttcgggtcccttcagctgaggattgtatacag

SEQ ID NO: 76344 - DNA, 201 bp, Bos taurus
tgtggcccctagacaggagagcttgctgcagtgggatgctaggagaagcaggggaagggccaccaagggcagaaagcccaccatgaagaatcctggccagyccgcttgcaagattcctcaaggactttccctgctgtcccagaagaaactgttaacaagtttaaaggtcactcaggccacaaggatccttggcctaggtca

SEQ ID NO: 76345 - DNA, 201 bp, Bos taurus
gagattcaaagaggcatttgggccaggaaggaacttagaattggaaagacaaccatgtaccaaagaaataactgtagaacagcacagaaatcatcacaatrggaggccagggagtataagtgcctgcgtggagagcttcagcctgagaacaattgtcctgcagacctgagatcaaaaggtgtgatttgcttgcacaacaga

SEQ ID NO: 76346 - DNA, 201 bp, Bos taurus
gtaagctactcattacccctacatttaagtagattatttactctagagtcctttgtctgtgttcttttttacagaaaaagtcactgaacttttataaagtygacttcagtctgcaacagttctttccttaaattattgttctccctccaacaaaggacacaaacaaaaggaagggaaaacaaaaaccaaaattatcattat

SEQ ID NO: 76347 - DNA, 201 bp, Bos taurus; identical to SEQ ID NO: 36789

SEQ ID NO: 76348 - DNA, 201 bp, Bos taurus; identical to SEQ ID NO: 36790

SEQ ID NO: 76349 - DNA, 201 bp, Bos taurus; identical to SEQ ID NO: 36791

SEQ ID NO: 76350 - DNA, 201 bp, Bos taurus; identical to SEQ ID NO: 36792

SEQ ID NO: 76351 - DNA, 201 bp, Bos taurus; identical to SEQ ID NO: 36793

SEQ ID NO: 76352 - DNA, 201 bp, Bos taurus; identical to SEQ ID NO: 36795

SEQ ID NO: 76353 - DNA, 201 bp, Bos taurus
taggtagaaccaaactccttacattaaacaacaggcatattgtacttattttccaaactcatttgcccctaattattgccaacaaaatgagagtccttttmaaatgccactctctgaaatgaccacatggacagcatgccgtgtataggtaaagggacaagcccactccttgtaagtgttgtgcttgcctgaaaagaaagc

SEQ ID NO: 76354 - DNA, 201 bp, Bos taurus
gacctcaagagtaataacagccacagagcaactactatgctctttaaaacagatggtaaaaaaaaaaatcacaatcaactgtgtttttgataaaaataacrtgcataaaatatgtgaaatttgactcagttttccctttaagtatagggatcttaggatcttgatcctaaggatcttggaaacctggacttgttactaaag

SEQ ID NO: 76355 - DNA, 201 bp, Bos taurus
gcaatttgcaagaactctatcactgttacttagaaagtagagtcttcacagtgatttttcacaaatggaccactttaccaggcctacctagaagtggtttkaagttctaactcatcaactgctaacagcaggcaacacaatggtagtcagattttatctctataaacacaactgaaagctctggccacctcttaagatatc

SEQ ID NO: 76356 - DNA, 201 bp, Bos taurus; identical to SEQ ID NO: 36815

SEQ ID NO: 76357 - DNA, 201 bp, Bos taurus
taccacctagaacatttctcacacttatgtaaatgagaaaatcacctccttggtgctttggaagcattaattcctcctcctagaaaagccaattgacccayaagaaaaactgcattcacatttcttttctgtggatatagaaaaccaagatctgtggaagtataggtttttcttacctagtccctgtattttccaaactgc

SEQ ID NO: 76358 - DNA, 201 bp, Bos taurus; identical to SEQ ID NO: 36816

SEQ ID NO: 76359 - DNA, 201 bp, Bos taurus; identical to SEQ ID NO: 36818

SEQ ID NO: 76360 - DNA, 201 bp, Bos taurus
acagttagatgtcagccccacctcccacctgccactcgaccttggccatgagtcagcctccccccttggccctctgcatttcaccagccaagtggtgacarttgtgatcacctgtcttcctcacctgatctttagagctttcacgggtctcattttcagagagtgtttccacatccttgacagggcatcgctaccctacgt

SEQ ID NO: 76361 - DNA, 201 bp, Bos taurus
aaaacatcattgggtgtctgtcaaggacatatacagattcctttattcagaggggctgcctggcgggacaatcctgagccaatccccttgtagggtctgaygcccacaaacaatcccggtgcttgcaggcactgggatgctcacaggaatggtgcatcaaaattcaaggatcacacgttaagttctccaaataaattttga

SEQ ID NO: 76362 - DNA, 201 bp, Bos taurus
ggtaggaaatatattaatttatggactagtttggagacagtttatgtttttaccatataaagattagctattcatacacataagatgttttcttttattcyagcttttaaaatgctcttcagtaaagttttacataaggtcttgtgcttttacattatttttgtattttatggattttgttgctattgtaaacaggttttt

SEQ ID NO: 76363 - DNA, 201 bp, Bos taurus
aagttgcctgtttcagtgatgcattcctttcctagaggtgttggatttgaaactggaggggctagtgtgttgtggtggtttcaagacatatgaaacatgtycttattgattattaacagtgtattttctgttgattttgagaaccttaaaaccagaactgtctgtattttatgaaagagctgtcctatgaagtcaaatgac

SEQ ID NO: 76364 - DNA, 201 bp, Bos taurus
atatttttcttttgcttacaagaaatgtcctcataagaaactgaaattctcatttccttgtgcttgaagctcacaatactaacatatgtatgtttagataygtagtatttctgaaccccgccctgccacacactttccaataaagctcaacaagaattctttgttgagagatgtaatatttggaggggaggataggggaat

SEQ ID NO: 76365 - DNA, 201 bp, Bos taurus
ttgtgctcccagtgctgggggccaggttttgatccctggtcagggaactagatcccacatgctgtagctatgtcattaggagtaaaactaaagactgaatygatatttggtgattgctggccttaggctctttccaactgtattggcagctttcaccttcacagactgtgtctaggacgtttctagaagcttaccacgtca

SEQ ID NO: 76366 - DNA, 201 bp, Bos taurus
gtgtgtggtttgtcttctcattctcttaacactgttttttgcagagcagaagttttaaatttaaatgaagtgcagcttatctgacatttctttcatgggtyatatttttggtattggatctaaaaacccattgccttctttcatttctaatattagtaatttgtgtccactctctttttttattagttgttctggctagag

SEQ ID NO: 76367 - DNA, 201 bp, Bos taurus
gtccttttgaaatgaggaagtctcttttagcacatatgactgaagcagaggtggacgtgtcttaacaacctatgtaagggctggtgcactggtcatagcaracaccctcttccacaacacaagagaagactctacacacggacatcagcagatggtcaacaccgaaatcagattgattacattttttgcagccaaagatgg

SEQ ID NO: 76368 - DNA, 201 bp, Bos taurus; identical to SEQ ID NO: 36819

SEQ ID NO: 76369 - DNA, 201 bp, Bos taurus; identical to SEQ ID NO: 36820

SEQ ID NO: 76370 - DNA, 201 bp, Bos taurus
catgtatatatcactagcttccccaattatcaactcgtggcatacatatccttttccatgttatttttgggaaaatcccagacactgtattattctatccrtaaatatttcagtacgtatctctaaagataaccacagtattattaccaaacctaaaattagccgtaattcattaatattatcaaatatctcatcagcatt

SEQ ID NO: 76371 - DNA, 201 bp, Bos taurus
ctacgattggcagcatctggatttctcaaggtttaactctagaattaaaacatggcattttcttctgagcaatacatccattggatatatcatagaaaatkaatcaacaggacttcatttagggataatctagtcaattaactataggacaagatcaattaaatctcacccatcttccttttcggccgacagaatcatttc

SEQ ID NO: 76372 - DNA, 201 bp, Bos taurus
aagttccaggtagtaattagagtattttaaattgtgatgtgtgaaagttatgaatgatgatgattcttttgctttttcattgttttttttccccaaaggtytgtttggggttagtatcaagaacatcttattcttgtaaaaattaaaagactgtgctaaatgtgcaatttttaaacacttgtctcactgtatggaaattca

SEQ ID NO: 76373 - DNA, 201 bp, Bos taurus
gcgccagagcgccctctgctgcccgaaagaggcatgacatcacttacaaaagccagatggcactgagctgcaataagcggtgaaaatattaagctcttagyagcatttaatctgtgaaatttgaaaactctcatcatattgtatgaagggacaacctgattttgatttcgagtactcctcggataattttcttcattctgg

SEQ ID NO: 76374 - DNA, 201 bp, Bos taurus
caaagcctcactctgttccttgcgggcttttccctggataaaatctctctcacattccagtggatttaccctaggttgtccacaagagcctcttcagtgcragctcgctgaagctgctggtacaggggatgagacaggacatgctggaggtcaaggtgcccttcccagccgcctcctgggcttgcagagctccttcatcaa

SEQ ID NO: 76375 - DNA, 201 bp, Bos taurus
ggttgcatacactagccctttctgtctctataatcaggttcctagtggaaagaaaaagaaggaagttagaggctaggatgagtggcttcagaggtaagaawgaggacatagatgataataatgaacaagctccttgattttagcaaatctaactactggaagaaaggataaacatccttcattaagaaaattcggagactt

SEQ ID NO: 76376 - DNA, 201 bp, Bos taurus
ttctagctaggagagtataactgggtctggacttgtcttcctgctataaataatcaaaactggacaaaaatatatgggcctgctttcagccattgagtaayagccctgcaggactgcgatcccagagaacaactgccctggctttctgcctggaggcactttcctacctggcatgcagggcattgactgagtcagggccac

SEQ ID NO: 76377 - DNA, 201 bp, Bos taurus
tggcagccaagttcatgaccagccactcatgtcttgaagggagacaatcacctccctctagtacatcttctcagtgcatcttctctcctcggggttacaayttccggctcatcacttagacagatgactgggattagggtaatagaagccacatgctggagacatgtgtggtattggagggttcaagttattctgtgggca

SEQ ID NO: 76378 - DNA, 201 bp, Bos taurus
aaggctgcatggagggacagctgtgtagacgcgatcagagtcctttctaggaggacaggcctgagtgggggcctgggaggggaagagacactggtcaccaragggcagagagaaagagaacaggaagagagaagaagaaaaacagaaggcggggaagtgggagggaggctccgccactgaggtggcctttactgtcctcac

SEQ ID NO: 76379 - DNA, 201 bp, Bos taurus
gtctcatcataaactacttattcgggagcaaacagtcactgtagtcacttggtattaaaaggtacaactcacagctgctgttcacatccccaccccaagayatttagcttatcagatttcaagcctccccttaataccaccataagagaggaaaatctagtagtacgaagagcacataggtggaaataagtattcctaccg

SEQ ID NO: 76380 - DNA, 201 bp, Bos taurus
gtcttagttctgagcctgggcctcaagaggcttatgtgctcctgctcttttggaaagtttagagcttgaagaattgagtcatcccaactaaaccaccctcyacctggttgactgtatacttatgagcaagcccagctgagatcatctgagtccaggctggaccaaaagaacccacccagctggacctagcctaaattgcca

SEQ ID NO: 76381 - DNA, 201 bp, Bos taurus; identical to SEQ ID NO: 36827

SEQ ID NO: 76382 - DNA, 201 bp, Bos taurus; identical to SEQ ID NO: 36829

SEQ ID NO: 76383 - DNA, 201 bp, Bos taurus; identical to SEQ ID NO: 36830

SEQ ID NO: 76384 - DNA, 201 bp, Bos taurus; identical to SEQ ID NO: 36831

SEQ ID NO: 76385 - DNA, 201 bp, Bos taurus; identical to SEQ ID NO: 36832

SEQ ID NO: 76386 - DNA, 201 bp, Bos taurus; identical to SEQ ID NO: 36833

SEQ ID NO: 76387 - DNA, 201 bp, Bos taurus; identical to SEQ ID NO: 36835

SEQ ID NO: 76388 - DNA, 201 bp, Bos taurus; identical to SEQ ID NO: 36836

SEQ ID NO: 76389 - DNA, 201 bp, Bos taurus
taaacatgatcagcaaggatgatttctcttgttttactaacactgatagagttctaatgtctgagtcaggcttgtaggttacataagtcaccaaccatgcrggtgctcaagcagttgtaaatcctgcagctgtctatacctgcacctcccagagccacagaacacactggtattttacaagtgaggtgcagactgcactgc

SEQ ID NO: 76390 - DNA, 201 bp, Bos taurus; identical to SEQ ID NO: 36837

SEQ ID NO: 76391 - DNA, 201 bp, Bos taurus; identical to SEQ ID NO: 36838

SEQ ID NO: 76392 - DNA, 201 bp, Bos taurus; identical to SEQ ID NO: 36839

SEQ ID NO: 76393 - DNA, 201 bp, Bos taurus; identical to SEQ ID NO: 36840

SEQ ID NO: 76394 - DNA, 201 bp, Bos taurus; identical to SEQ ID NO: 36841

SEQ ID NO: 76395 - DNA, 201 bp, Bos taurus; identical to SEQ ID NO: 36842

SEQ ID NO: 76396 - DNA, 201 bp, Bos taurus; identical to SEQ ID NO: 36843

SEQ ID NO: 76397 - DNA, 201 bp, Bos taurus
ctttcctctcattcttagaacttgcttcccttccatttggctggtttcaggcagagggaagaaaatctgttaataagccaatatctataatatgagccccrggtatccctcccttcccaggtggtgctagcggtaaagagctcgcctgccaaagcaggagatgcaagacacctgggtttgatgcctgagttgggaagatct

SEQ ID NO: 76398 - DNA, 201 bp, Bos taurus; identical to SEQ ID NO: 36853

SEQ ID NO: 76399 - DNA, 201 bp, Bos taurus
gcccaggtttgtcagtttttgaccatcagcaaatgtgctccagtatgagagcacattgagctcctgaaccactaacctgctgaccatgaatagaaacagcrgccaccaggacccaaaatacattataagtgattactagccatagtacaatcctgcttgcttaaatctaatgagtatttatatatatatttcaaagtagac

SEQ ID NO: 76400 - DNA, 201 bp, Bos taurus
gggaccagaggagcaggccaatgtggtgaagaaccacactctcctgcaagtgactgctccaagcgtaggtgtggggccagtagggcaaccagaatccttcyctgggcttgtatgaatggaagcatggagagaaaaccacctttccttttgcatcagcaagttggaatgttaaaagtctggtactacctgaggccacgctcc

SEQ ID NO: 76401 - DNA, 201 bp, Bos taurus; identical to SEQ ID NO: 36856

SEQ ID NO: 76402 - DNA, 201 bp, Bos taurus
cacaggcaaatgatttctttagcttagtgttctaaggcagtatttcaacatcaagagtcgcaactattagggcaaaaacacatttgggccctggacaattwaattttatataaggttaagtttctaattaatacgggtctctttttggtattaaacatacaacctaaattaaagggtttaatttaaaaatttacttgcatt

SEQ ID NO: 76403 - DNA, 201 bp, Bos taurus
acaagcacaacctagctaagacagtgggcagcaaatgtggtaaaagggaaagcctgagaaggctcccttaatttctgcctcgatctaaaagaaactatttmttttttacctttaagaaaacgaagcggtgagcaagcagagaatgcattcttatatatatggtaccatcatttttagaaaaaagccatatttatgcctctt

SEQ ID NO: 76404 - DNA, 201 bp, Bos taurus
agtcgcgttaagtcctgaacccgtattctgattggaactagcatgaaaactcctctctggtagatttgcaactgcatttaataaggtgactaaaacgtccrccctggccgggacgtttctcacgtggagacagagtgcaattttatcttgggaaagcactgaggacacacttcttgaacacatacaatactgaggacattt

SEQ ID NO: 76405 - DNA, 201 bp, Bos taurus
aataatgatgaactttatagtatttcagtaacaggacatcaaaggtgaaatagaaacattccccaagaacctggccttctcttgtggggaagaggttggtrtgttttcagttgtatgaaggatagctgcattgtggtatgtagagttatgactttgttattccttttatttggaaactgtgatttttaagagatgggtgtt

SEQ ID NO: 76406 - DNA, 201 bp, Bos taurus
tggactgtagcctgccaggcttctttgtccatggaattctccaggcaagaatactggagtagattgccatttctttttccagggttttggtattatacccrctgccaagtccaaggtcttaaagattcacccctacgtttacctctaatagtttcatggttctggatattatatttaacgcataagtcacttaggcatttt

SEQ ID NO: 76407 - DNA, 201 bp, Bos taurus
gtggatgctgaaataggggatgcattttaatttcccatttaccctcacctatctttttcaaatctcagctactattttttagcggattgcttagtgtgtgytgtgcttagtcactcagtcatgtccaactctttgcaaccccatggactataacccgccaggctcctctgttcatggagattctccaggcaagagtactgg

SEQ ID NO: 76408 - DNA, 201 bp, Bos taurus
aaccagaggcaggatgtttcccccaaacccggcccccagcctggagagaacctacttttcccactcagcacctctagcttgggagcttataaagggctaaygaagaagctctataggccaacataccttggttctgtttccagcgccctcactaaagggctgcttggtgacctcaggcaaattacttacctactctgatcc

SEQ ID NO: 76409 - DNA, 201 bp, Bos taurus
tttttgcaaggccatctgatagggagcaatggccccaaggagatattccacccaaagtccacagatttacagtcacatacatgtttattttagggggaaakaaccccaaatttagtcaatatgatagtataattaaaatttgaaattactgtcaagaaatgcaaggtataattggataaatgtttagtgttaaaacaattg

SEQ ID NO: 76410 - DNA, 201 bp, Bos taurus
gcatggcttctggagaagggtgaaggatcttggacctgctcaccacctccatggccgcctctatggccaccagcctgtccaagccatcatggcctcccacyggggtgacagcaacagctcctaagtagtctccctgtttcttctgcttgccaagtcagtgctcagttgcttagtcgtgtctgactctttgtggccccacaa

SEQ ID NO: 76411 - DNA, 201 bp, Bos taurus
ctttctcctcagaagtaatccccaccctgacttttgtggtcttctttctcttactttgctgcattgttttcccacatttatattttaaaacatactgtttytttattgcatcattttgaagctacataatgtgaaattaggtggcgctagtggtacagaatccacctgccattgcaggagatgcgagagatgtgggttcag

SEQ ID NO: 76412 - DNA, 201 bp, Bos taurus
ttaaaagcgtgcaggccctgcacacactctaatttttatcagcaaccctgccctggaacaactgccataaaacacttcaccaaatcctcccaggttgggayatacagttttgaggggtaggaggccgctgtccccctttgcctggcaaaccaataaagccattttttttctactacacccaaaaatctgtctctgagattt

SEQ ID NO: 76413 - DNA, 201 bp, Bos taurus
ggtatggaaaaaacagatagctggcttcaacttgagtagattttcattgttttgttttatgcctaatagatacaaagagcaattcttctctagaatagatkgggcttttcttctgttttgctcctataccatacttaccctttatgacattaaaattttagttagtcacctgcctacatttttgtttaatttgtgtctttt

SEQ ID NO: 76414 - DNA, 201 bp, Bos taurus
ttgcacagagaaatcccatggacagaggagcctggcaggctacagtccatggggtcgcaaagagtcggacacggctaaagtgacttagcatgcaccaggcrctgaggtttgtcaatcccctggcattattttatcccttccttcagatggagccagtaattagaaatctaagtcagttctgaattaggtattcatgataac

SEQ ID NO: 76415 - DNA, 201 bp, Bos taurus
tttttccagccaacaaccttaactatctagggacagaatcctcattttctccatcctgaatccattgggggtggagaaggggacggctgcagtggctgacrgcttgatggctgttttctgatacagcaggtgacattctatgtccacagtttaatagtgaggcgtgtgtgcctggctaagtcacttcagtcatgtccaact

SEQ ID NO: 76416 - DNA, 201 bp, Bos taurus
atgggaaggggatagcgccaggggattggctggcgggctaggcgcccgggcgggggaggggcaagtgagggcacagtgaatggcgctgtccctaccttcgstcgcatagagctctccggcctccaccagaccccactgtctaccttgatcacttaggaaacgctgctcgggttctgacccgaaccacggttgttatttttt

SEQ ID NO: 76417 - DNA, 201 bp, Bos taurus
agcaccgttttttttttttttttttttggctacagactcttcagaagtgtcagttggggtttttggtccctttgtctctcttgggttcagaatttgccccmactgctagttagttttagtcccatatagtttctctgtattttgttgctggagaagagatgtgtccaggtccaagcactgcagcaaagggttccaggtccc

SEQ ID NO: 76418 - DNA, 201 bp, Bos taurus
ttgtattgtctgaattttcctcttgtaaatcaagcaaactaataccaatttatatgggaagcttgactaaccctatggataaatgctgaaagccaaaagaraagttatcacatttaacaaattcagtagtgataacattaacacatatttagtatcaggatactgatatatcaatgttaaaaaaatgcttactaaacagtg

SEQ ID NO: 76419 - DNA, 201 bp, Bos taurus
cagagcccataaggccacgctttctaccctggaaacacccgcaggtgaatgtgcagagtatacatccctattcctggtccagtattggccagcccgatgaygtttcttgtcaagggtcacacaggtctacttttccttgaggaatcaagagctggcatggcctgtgctctgtgtcataggtctgcctagtccaactttccc

SEQ ID NO: 76420 - DNA, 201 bp, Bos taurus
cttgctaggctgtctactggccttgtgaccttcttatgccttggtttcccacatgctcagtgttgctatggggatgagaggagacgactgatgacaaggtygcggcacgggtccaggctccaggtaactggccaaaaggtagcaccccaactgctatcctcacaccaaaaggggaagggcgtttgcactgatgtgtgatat

SEQ ID NO: 76421 - DNA, 201 bp, Bos taurus
tactagcagcccttcctcttgggccatatcatcaggcagatcctttggtgttagtgtttggtgtaggtggtgagaaaagatgcaatgtgaagactgtggtraggcccagtggagggatcacaatgcagggctctggagtgctgacacaaggccatagaatctgcagaagagaattatagaatttttgagaaacagttactt

SEQ ID NO: 76422 - DNA, 201 bp, Bos taurus
ctgatgtccccattaaatggattgcaatatgattttatcctttctttctgatttcaaattttgtgcttttgttttctctccttgtttatcgcctctttctrctttgtgtctatccgcttgtttctgatctgctgcctaaatttagtcttgcctttgtccctactcagtgtttctacaaagtcagttcttatgccaatgtat

SEQ ID NO: 76423 - DNA, 201 bp, Bos taurus
gttacgtgactgattgggttgttcatattccacatgtttggcatgtataagcagactctggttatgttttcagatagggaaatgcaatgtgttacatgtgytctcttgggaccccaaaactaatggtgtcaaatggatttttctcatttgatccccatgaagacagtttaatttcactcatttttctagtcccacaaaaat

SEQ ID NO: 76424 - DNA, 201 bp, Bos taurus
tccatgtataaattgatgcaggaaggaaaggcagaagaaaatatgcaggaatgaaaacaaatatttgaatgcagtgaagtagttctaagccaaaatatgtygaggtatagtgatttttaaaaagatcttcaacttgcagaatactttacaacattccctgccaaaaattccaggtatgcatcagggtcttttatcatttta

SEQ ID NO: 76425 - DNA, 201 bp, Bos taurus
atggagagaggactcatatctgcctcaataaaatgagacctaaatttggctcactaggaatcttatttctaaacaataattaaaagaatggggtgattttyttatttttgttggaaggctgatttattgatactagcattttctcattcagcatccaattgattttaagactctgtgtcacttaaacttttatgggtattt

SEQ ID NO: 76426 - DNA, 201 bp, Bos taurus
gacgaggtgcagaaagcacacaatctaaagttaccctcttgacttagctctttctcttttctttcaacagatagatgcagacaaacctttgataactgtgytccctgaattcattcccctaacatcattcctaaaggcaacctctagtctaagctgctatatatcactctcatgcatgttttataacttctttattattgt

SEQ ID NO: 76427 - DNA, 201 bp, Bos taurus
ggcagtgaaagggaaaaatgggtgtattgatagtataaaaaataaatagaaaaaataaatagaaaaaatagaaaatcttaatgtgatatttgggatccctrcatactttgttgttatttttgttcagtcactaaggcgtgtccgactgtttgcagtcccatggagtgcagcatgccaggctattatgtcttctgctatctc

SEQ ID NO: 76428 - DNA, 201 bp, Bos taurus
tttgaagggatatcatattatgagccttattagtgtgctcatgtgtctcagactagccagccctccttactgcagactctggacagactttgaaagaataygctatagtttcagataattacttataataagaccaggcagacaatgaagctccaaaccaaaaatacaaaatcagcaagaaaaatttatacagtattttcc

SEQ ID NO: 76429 - DNA, 201 bp, Bos taurus
atgttcattaattggccattcatgacctcccagatttctattgaagccccatacttttcctttgtatagactggggagtaattgatggctctggtctcttwggaatgaggagtaattgccaagttactggcccttttggaggctgtgtctgcttggttatttccgttcagtaactccatattccctttctgatgatcccta

SEQ ID NO: 76430 - DNA, 201 bp, Bos taurus
gaattttgtgagtggtaggatgcagagcacattgtcagaaaccagcagtggtactatcaaaacgtggattaattagtctctgtccaaaactacggtaaatkatgttctccttcagagaaagacattatgattcagctccttgtggatgatgtttaaatagctgatttctgtgtaggatcctttaattctatcaaagtacag

SEQ ID NO: 76431 - DNA, 201 bp, Bos taurus
gtactaaacctgcttttagctttaattttttattcaaaagttaaatgggaaacatgaaatagtttggatcaaatatcacaacaaatgaaaaacgtgcagcrgatgattcttttaaatgcattattcttatgtcctgggccagacgactttgtcagacaatcctgtttatgtctgttggaaaagagaatatttcttatatat

SEQ ID NO: 76432 - DNA, 201 bp, Bos taurus
gagcatctggggaagaatcaggtttttttttttattcagattgttgaccagattcagttgcttgctatggtagtattgaggcccctggtttccttgccagytattagctgagggatgttcccagcttctagaagccattcacattccttgggttgtggccctcctgctctatcttcagtcacctgtcgtaggttgagatcc

SEQ ID NO: 76433 - DNA, 201 bp, Bos taurus
taccaaaccacatcagtatgaactatctctctattctctgtaaaatttgttcatatctcaacaatagcctgttctcatgtgtatcattgtaatttatttayatattatctataaagacaactgtatgcattagtcttatatacatttttattcacagggcaatataaggaactgaacagataattaacaattaatgaaaat

SEQ ID NO: 76434 - DNA, 201 bp, Bos taurus
ggtatctggaaataatattagaatggaaaagatatgaaatagtccttgggagaatgaaataataaaattattattaggtagcactaaggagtcatctgacrtttaaagtcataaatttaaaataagactgatcagggactcccctggctgtccagtggttaagacttcacctttcaatacagagggtgcagtttcgatccc

SEQ ID NO: 76435 - DNA, 201 bp, Bos taurus
atctccttgaacttgactgctttagcaccaacatctgcaacattaaagcatctaaacaatatttggtaacatttgatgcttttttatttgtgctcacagartgcctaatgtccaggtaactcttaggtgacttgaatcattgttattctttataaatgacttcatagtggatgactcattctccatttcttctttaaaaac

SEQ ID NO: 76436 - DNA, 201 bp, Bos taurus
attgaggggcaaggattaactgagctaaagtgaatttgaaaataccaaattagcttgttcaacaattatttccttagatccagctttgcctctaacactgmtcttatgtttaaatggtgaacacaataacaatccttgccctcaaaaaggttacattctagaagggagtcagataacaaaaaaagaaaaaaaatgttcaat

SEQ ID NO: 76437 - DNA, 201 bp, Bos taurus
tgttttagtctatggaaaaatgaattcattcatcgttcatttgttcttgttatgtattcatgcaacggatcagtcaaaaggtatttattgaatgcgttagkgcaatgcattacactgtattttgattttcatattgagttatattttggtagatattcaccaccaccaaaagatttcagacagttttaggtaggtttaggt

SEQ ID NO: 76438 - DNA, 201 bp, Bos taurus
ttctccacatgtgagcacttgctgaccaccgggatatgaactgtcctaatactgatgcttttatcgacccatttgacacttatgatgcttgcagaaatgaygaagcaaaaactaacgcatcactaagagaagtgggacatgtgggaattggtatgttgcagctcactaagtcttaaggcattaagcctaaggattaaccca

SEQ ID NO: 76439 - DNA, 201 bp, Bos taurus
gaaatatgaaagaaaagacactttcattttatttcctgtacacttattatttcagctgctattctttcatttctaatattttaagtagattttggtagcaktatctttctgtctgaaataattatttaagcaattacttgagagtatgtctactgaccaaaaaattctctaagattttctacacttgagaatgattttatg

SEQ ID NO: 76440 - DNA, 201 bp, Bos taurus
ccaggactgccgcagggagctcattgaaagttaatggccttcctctgagtggaggctgagggcggcaagatagaacactcctgaccttccttccctctttyaaacccaggttaccagttaatgaccgtttaacctctcctgctccattctttctcagattcaaagtggtaatggtaatttcttttccctgtgattaaaaaa

SEQ ID NO: 76441 - DNA, 201 bp, Bos taurus
atgcagaaaatggtataataaatgcatctgccccatatggttaatgtgaacattaatggaatgtgagagagtgcatgttaagcattagcacagggcctggytcttgttagtcgtacctgctcttattgtcagttattcactttatattcccggtttcaacccagtgcctaatatataatagttgttcaacacatatttact

SEQ ID NO: 76442 - DNA, 201 bp, Bos taurus
actctccattcatgtctgccgcctccctaccgccagcctttgctggagccccggggtgtgtctccagccttgaactgctgatactttccttggccactttscttggtttccctaggtaaccgtttttccatttctgcagcatcttttatgggaagggtgccgagagcatctcccgaggaagtgtcactggccagttttaga

SEQ ID NO: 76443 - DNA, 201 bp, Bos taurus
tagcttccaggtgacagcctaaagtgcctagaactcagtttaatgattatgtgactttttaaattctcttttctttgttatgtatgatcttatcacttatragtgagcacataacaagtttattcagttttaaacaagataactaaaggagagtgcttctgaaagcagcaataagaaaaggtatgtgtgatttttattatt

SEQ ID NO: 76444 - DNA, 201 bp, Bos taurus
tcatcactatgtgccatgtaagaaggaagaatagcaaagtagatgagattattctactcaaaatcacaccatgtgtccagcagcacctgggtccaaatgcyttcagtgtgggttgatggaagaaatgcgagacagatcttcatgggcagactcttggcttaaaagtttttctaataaagcccattattttacccataccaa

SEQ ID NO: 76445 - DNA, 201 bp, Bos taurus
ccacagattcatttgttaccccacccagtgaccagtaacctgactctaacaatacaacttaactttatatttggagagaggattataattaagttcttackattataccagatttgtcatatattgatgtttttccttattaaagtactttaaaatatttcaaagtttatcttcattttttcatttttttaaaatttgaaa

SEQ ID NO: 76446 - DNA, 201 bp, Bos taurus
gactttgataatctatcactcaagcaccatgttaaatgagaagcttctataacaaccttttgttctggcttggtcactctttaggaaacaacatctaagtrtctgcatttcttggtttcagttttcacctagtttctttggctttggccatcctctggtacctgcaagcatttaaagtataattatattttctgtgatttt

SEQ ID NO: 76447 - DNA, 201 bp, Bos taurus
actggagaacgttttgttaaaactcaaaaattatattgcaagtgtgacaaataatttaactggaacagaaatttctggaggccaaattgactatctttccrggaagccagggtgagtgaacattactggggatagtttatttctctggctctctcttatttctctggctctttccatttggccaaagtctgggaaagggca

SEQ ID NO: 76448 - DNA, 201 bp, Bos taurus
aaaagtcagacagtgtcatggccagacaactctcatatgtaaatatctgacaggaataataagggacactcttaacacatggaagtggtccagaattacayggctgaatttttctgaggccgtattttctgacccttatcattatttattaataccatgaactgaagtcatagagatgtcaggatcatcttttcctccttt

SEQ ID NO: 76449 - DNA, 201 bp, Bos taurus
gtgttcagtaatttgatgagataaggatgaaactaagtctcagaattataagaagaaaaatgccacagcatttcactatagccacactctgcaggacttcraaagtcaaaaaaccaagaacaagttagagaggattaatctttataacaatatcttatactagttaacacttcagtttcacaaaacatcatttaattcggt

SEQ ID NO: 76450 - DNA, 201 bp, Bos taurus
caggggatcttctcgatctagggattgaatccgtgtctccagcattgcaggtggattctttgtcactgagccacctgggaagccccaaattgaagaatgcrcatattaaataaagagaaataactatgacataagtggaatacacacatgcaattgattaatacttttggaagaaactaatctctgtaagctttgtcttgg

SEQ ID NO: 76451 - DNA, 201 bp, Bos taurus
ttatctgtgtaaatctctggtttctcattagatcaaatgctccctaagatttgtcactgtgtttacatctgcatcctttcagggccaaagcagcaggaacrcaaatgtatgtcaacaaattaacaagacacttgctgacaaaagccaccacctcatcgacagtctagatgctccattctcttggctttagctgctgtgtgg

SEQ ID NO: 76452 - DNA, 201 bp, Bos taurus
gagccttggaacctcaaactaacccctagcccctccttagtgctctcctgtggacacccccaggcgtctgctgagtcatgacccaccctcctcatggaacrgggtggaaaagtaaagtaactgtttgttgaactggcaaaaactgcaagttttaaatgccccagaagaggtttatttcctacacagctggttctaagcaga

SEQ ID NO: 76453 - DNA, 201 bp, Bos taurus
cgctctatttctaaacgatattgtggaggcaatgtggcaaattacggtgcgtccccgccacgacctggctcaagcctcccgccccggtgaatatgggctcygtgctctaataaccggcctatgagctcaggtggaaatcctgggtgggaaccaactgaagtcccttccagcgctttctgccttgtctgtcaaagaacttct

SEQ ID NO: 76454 - DNA, 201 bp, Bos taurus
atgatggaaatgaggctgaacaataagcaacaaaacgccacactgggaaaacctctgactatcatgttggggtctggaagggccagccttccccgtggcartttgcaggacccaacagtcaggcttcaagggagacagagccccttcatcttcctggaagttcattcaaactgggttcatgcctgaggcaggccattcata

SEQ ID NO: 76455 - DNA, 201 bp, Bos taurus
tgctgatctcctaaagttttaaaaatgcttttagcatctttcattagcatatacagtataaaagataagcaatatcttcattccaaacccggtttcccctygtaccttacctcccttctccatcctaaaccatatcctatccatgactttaacttcttaatacctctttcactaaatattttctggattaatacattgatt

SEQ ID NO: 76456 - DNA, 201 bp, Bos taurus
catacggagctgcctgggctggaacacaggcctgccatttactcagttgggaatggaacctccctgtgtgcttctgttaaatggagataaaaaacaggacyggcctcatggattcttgggaggactggcaaaggtaaataaaatacatgcaccgagaaaagtgcctggcatgttgtaaatgctcaaaaaactattgttgtg

SEQ ID NO: 76457 - DNA, 201 bp, Bos taurus
ctggaaaaaccaaggaagttggatttttatagaaaagctatgataaagtcacaagactggtttcctcttgccacatattaaatataccttttatctttacrgttacatcacaaaccaaaccctaataagattcctcttcctaagggattgttacataaacagcatttgatcactgagcattgattatgctgctcattcagg

SEQ ID NO: 76458 - DNA, 201 bp, Bos taurus
gcacattttttcataacttaaccaggaacctaaggattttctttgtccctttaccattacatctaatggatgctaagttctggccaagcagtctcctaagyagctctcgcctttgcctcttccttttcagatccatggtcacacatggcttcagtctggcctcttattagctcaagcctgaccaaggtcagtagtaacctg

SEQ ID NO: 76459 - DNA, 201 bp, Bos taurus
taggactctgggccttcaagatggtctgtttcccccagttttatagacaaaaggtttctacaaccctggacttgcaccaggacccagcacctttgttgccyaaggccatcctaccacttcatccttaagctgttccgaaagcagtggctgccgccactagaatacatcccgtttgcctctaaaaggaaggctttttttggc

SEQ ID NO: 76460 - DNA, 201 bp, Bos taurus
gacttagcaattaaacagaaacaacaatccaatatccagtgggaaatcttaagaagaaatatgacttggggaacaatggggaacttggaaaaatcccctcyacttagtctctgtggcctcaactcattctcattaacacaggatgaaccagaagctctttcttctctgtctgttccttctctctaataacagtgactctgt

SEQ ID NO: 76461 - DNA, 201 bp, Bos taurus
agtcttttccaactggtgaaaatacactggatcacagctggaaggtaagccaaactttgggtgttcctctctgactatttccacccaagggaagaactacyacgaaactgctgtttctctggctgatactgaggccctgtaggaattaaaatagtctaaggaaagtaaacagctgatggcgcaagtctcaagattaagctc

SEQ ID NO: 76462 - DNA, 201 bp, Bos taurus
acaaggcacatcttgcctgcttcattctctccctcccaggtgcgatctaaatcatctcctatgtcccatttttctttaagttctctgagtttggcagacaygaggattgagccctagatcataccttcaggtttatgaggacagtaatctgtcatcagcacctgcagtaccttttatcggcctccaactgcatgaattcct

SEQ ID NO: 76463 - DNA, 201 bp, Bos taurus
ttagttcactattggatgtatgtgattcactttggaccaaagagaaaaacccaagtttggaggaggattgagggaggaaacctatggtcaaccgagctgtmtctattgctagatgtgaactagaagcttgtagctgtagtgccatgtggggacccaggcttaaggtgatgttatggatggtagaatggagaagtgaaaagg

SEQ ID NO: 76464 - DNA, 201 bp, Bos taurus
tcaaagcagtcagatggaaaaggggttctcttacccaagagggtcagttttgttattctgttcaactttgtttctttgttgttccggcctttagccaatakgttggtggaactgaccatttacatcaggaggacaatctgctttactcagtttactgactcaaatgttaatctcatcgaaaacaccctcatagaaacaacc

SEQ ID NO: 76465 - DNA, 201 bp, Bos taurus
cattgcagctttggtgtgaattgttttaatatattgggttggccaaaaagttcatttgggcttttccaaaacatgggttttaacataatatggaaaaaccygaagaaacattttggccaacctgctattatctcccccaggataattgatgtggtgaaagaggaggtatctgcaaagcagctcatctcgtttacttaaaat

SEQ ID NO: 76466 - DNA, 201 bp, Bos taurus
ggggccaagatctatagtcagaaagctgggaccccaggacagccaatggtgtagtcccagtccaaacattggcaggctgaaaacccaagaagagctagtgytacagttcaagtgcaaaggccgggaaacaagccagcgtcccagctcaagacaagtcaggcaggaggggttcacttttacttgagggggggatgaaccttt

SEQ ID NO: 76467 - DNA, 201 bp, Bos taurus
ccctggagaaggacacagcaatccagtccagttattcttagcctggagaatccttaagacagaggagcctggcaggctacagtctgtgaatctgcagagtyggacatggctgaagtgacttggaataatgctagttatttttattcctgccagcctgatctaggctctcctgcaggccttgggtagattctcttttcatct

SEQ ID NO: 76468 - DNA, 201 bp, Bos taurus
gggtcccctgctctgaacttggcacttgatgtgtgtaacttaaactggaagttctttgaagacaggaactgtttaatcctcatctttccacatctgggccygacttccttctcaggagtcccttcccaaagttttgcagagttgaaataaacttttctatatcactcagcatgctcttggggggacttatttgagctccag

SEQ ID NO: 76469 - DNA, 201 bp, Bos taurus
tggagaattctggctttcagtgtgagtaaaggaaagaagaggtaaagattggtttgaagggaataaagggaataacaggaataattgtgagtctaggtcarttccatattggtgactaagagaatatttaggagcctgggcctcatacatttaaaaagcaatttcccaccttaaattaataagaccaactggtgcacatca

SEQ ID NO: 76470 - DNA, 201 bp, Bos taurus
tgccaggtggcctaagggccaatggcaaagtccacacgggaacacgagatgttaataattaaaaagccccaggtctcccgctcccctggatggatgcctgrtgctgagacaagtttcaggcctgcttctggtcctcctgccacggctcagctctttgtattgacaaagctttttgtctgcttgccttatgatcccaagtta

SEQ ID NO: 76471 - DNA, 201 bp, Bos taurus
cccacaatcctgtttgacccttacttatcctttagcccccagtttaatcccttcctcctgactaggtcaagttcctctttcatgtcctcccttaggaccaytagtctctccttggaacgctcaccacagcagttgattttattatggttaattatttaatatcagtctcccaaaagagactgtcagttccataagataaag

SEQ ID NO: 76472 - DNA, 201 bp, Bos taurus
agtgggccttgaggtcacctagcaccaccgaccctggcatctaagccagctgtggtctgagtctggtcttgttgccttgagccctcaggggttgggatccrcctgatgtccttgaaggcaggcctatcgtcaccatgttggtctagatctctaacatgattttttcccctggattttacatacacctgtaagggtgtctgt

SEQ ID NO: 76473 - DNA, 201 bp, Bos taurus
tcaatgttttccaggtagacaaagcagttgtgagtgaagagtgtttcaagaagagatagcaacatgtgaaatagcatagtggtgtgaatcagtattcattwaaaaaaaaataattcaatcacctttagtgagttcctactaattgccaggctctgcaccaatcatggaactgctgggattccattttgccctgcaggcagc

SEQ ID NO: 76474 - DNA, 201 bp, Bos taurus
accgactgcctgatggacagacagacagagggatgattgcagcatgtgaagaaaaatgtaccagtggggttgtatgtatcgggcagtgggaacacaaggtrggaagcatcgacatttgtctgcaggaggtgaaacttaaattaactcccgcaaaatgagtcattctgcattacacagaaaaggaaggcatgagaagacata

SEQ ID NO: 76475 - DNA, 201 bp, Bos taurus
cagtgtagcatccaaaagcctctggcatttccagaaaagagttttccttgtcaggtcccatctacacactttaactgggcctgcacatggcagctgtacartggcatgatagttgcatgtttgatcacctcaccctgcaagcccagggagtaccctcaccaaggaatgcagccaggtctgtcagatcccgttatctaggtg

SEQ ID NO: 76476 - DNA, 201 bp, Bos taurus
tattgtgcagattcagatagtaaaatttagataatgaggaacttctgtattatcactatcttcactctatagatgattaaagtgcagcttggagaagttcrgtgactttaaggcaacacagcaagtaaatattctcccctaatccatgctccttatgcaaaggagtggataaaatgggggttaagagtgaatctgtttccc

SEQ ID NO: 76477 - DNA, 201 bp, Bos taurus
tattctgcttggcctgtgaggctgtgagagctttgaaggtggccaccaagtcttttgtgtctttataatgagcgtctaagaacagtgttgacacataagcrtttgtcaaatggatgtcccacacaacaagggaatgttgggctgattctgaatcacgtctcacagactgtaagaatttagaacaaaaccatcaatccgtaa

SEQ ID NO: 76478 - DNA, 201 bp, Bos taurus
tgtttctctttctctgtaatgtacacatttgttgctgaaacagaatgaattcccaacacctcatcaaaagaaatatttgaatgtagaaaaataatcaatckctttggagttgataccatttgtttcacatagctcagaacttctttgcctagtctgaacctctataatgtcatcaggaaggaatcagacttccttaatcca

SEQ ID NO: 76479 - DNA, 201 bp, Bos taurus
agaatggtcttctcaccagtagtcaactgttaggctcactttacactatgacatccctcctggttcactccccaacaagggccagcatcctacatccctgyagaatgtgtgagaatgtcttgataccttccatactgcacagatggagtcctccctttgcataaacactgtccaccaaggattttgttctgagatggccac

SEQ ID NO: 76480 - DNA, 201 bp, Bos taurus
ccatggatttttgcagggttgggggagtgtctattcaatcccgtgcaagtcacaggccctacgatgatattgagaagaacaaagacacagttaccaagccyttgtatggttttgttcagctcccagtcacaaagctgtttataagtaccttgacccagccagtaatctacagtactttttccagctgtttgttttggcgtt

SEQ ID NO: 76481 - DNA, 201 bp, Bos taurus
agttctactgaaactaacttccacctgtgatagcattcactagaggtgttttgtaaagggtgatatataagcatgcagaataatcgttagataaactaacrttgtaaaagaaaatatacatgacattaataatagtttaggttttaaattgttaaattgttctactagcaaaatgcattagtatgtgcatgccagttgact

SEQ ID NO: 76482 - DNA, 201 bp, Bos taurus
gggagaacttgtaaccatcccgtaacaggggatgaaaggagaaaaggagatttttctgttcctttcctagaaaataatctacacagatgagataaaagcayacacccttacaggctcccactgaaaattttattaaaaatggtggtttctttgttcctaatggttaccaaagaagaaccatccttcacttgtatgtcatga

SEQ ID NO: 76483 - DNA, 201 bp, Bos taurus
ccccagcctgtagagagagtttaattcattgaactggttctcatcacagggttttaaactttctctctgataattagtcctttagggggtacacttattcrtgttgattgtctttagccaatctgctttttccattactcaggtgaatactgttactggtagcttttctcttggtcattgtagagaactggctgtagcagg

SEQ ID NO: 76484 - DNA, 201 bp, Bos taurus
acttgctatgtggaggatcttgggtgagataacttaatcgctctgaatctcagtgtcctctgctgtggaatagaggtaataatacatgccttatattgtcrtttaaaaatgaacgcacttcagctgaagactactgggaaaacatctgtagttacacaggttgggtttattacttgttgcaccgaggagaacacacacttg

SEQ ID NO: 76485 - DNA, 201 bp, Bos taurus
tgtatttctcgagggctgtgtgtcaaaaggagggtctccatgttagctttcatgagaatatgctacttgatagtggtgacagttggccagttagaggttayaagataaatactcttatttttctagcatgtactgtatagaaaactggcaacgaaaccaaggaaacatatatattgccatatatattgggctggccaaaaa

SEQ ID NO: 76486 - DNA, 201 bp, Bos taurus
atatatacacacatgtgtgatacacacacataaagattacaattgttcccttccctttggttaaaaagagggtgtgttgaaagagatataaattgggagayggggagagagaggaaagagaaaatcaaaattggctcttagaaaggatctgataaattttcattgaactgttaacaatgaaatatatttagtgggtccgaa

SEQ ID NO: 76487 - DNA, 201 bp, Bos taurus
agctcactacccaaatctttgagaaaggttggcctggaaacataaggatatcactgtgaattttgatattcgtccagagtgatccagtcaggtatagtcartggcccaaaggcacactgtactgaagtcctgcaccaggatccaagacccactgggaccctctttcatcctctagtcctcgtagttagaccctcttagttc

SEQ ID NO: 76488 - DNA, 201 bp, Bos taurus
taatgtttctgtggaccttgattttttgtttctgtcacatctgaagacaaatactatgactagcttagatttctcccacttagcaagggttgaggccacakaacttctagagtaattcatcatcagatatcactctcagcggaggaagtggtgatgctgatgattaagcagaaggcattcccctatcccaccccacctcca

SEQ ID NO: 76489 - DNA, 201 bp, Bos taurus; identical to SEQ ID NO: 36857

SEQ ID NO: 76490 - DNA, 201 bp, Bos taurus; identical to SEQ ID NO: 36858

SEQ ID NO: 76491 - DNA, 201 bp, Bos taurus
tttgtaatccttatagttttcatatatcattaactatgggagtactcactaaactgttaaaaaatggtattcctaaggccttgttttaacttaacttaaakaattatatttaggatatatacagactggaattctagctgtcaggtattatagggaagaagggaatcagtttattccaaaagactagctggtggtgttccc

SEQ ID NO: 76492 - DNA, 201 bp, Bos taurus; identical to SEQ ID NO: 36859

SEQ ID NO: 76493 - DNA, 201 bp, Bos taurus; identical to SEQ ID NO: 36861

SEQ ID NO: 76494 - DNA, 201 bp, Bos taurus
taaatgacatccaaagaatacaagtcctccccaggtcaggaaaccagagccctacaaccacaggcttttgtcaagggtctaccatgacttgcagtcttttyattcccatataaacctggctggtagttgtgtttaagaaagataatccaatcaaagtgtgttcagcaattccacataagcatatctatatgctaacctcag

SEQ ID NO: 76495 - DNA, 201 bp, Bos taurus; identical to SEQ ID NO: 36862

SEQ ID NO: 76496 - DNA, 201 bp, Bos taurus
gaaaatgatatctaacattattatgacagagcctaatacagaattccatgattaaagtaaaaaccattcattctatagttgtatgttgcagataacacttyattgtgtgaaacacgataagtttttagcaatgcaaatatttataaaattaaattaaacatttatttttcaagtaaaaaaatgtccttaggaagcaatatt

SEQ ID NO: 76497 - DNA, 201 bp, Bos taurus
gttaagagttgaaccaagacctaaaaaataaaggagttaaggatactaaaatttagcagaaatgtgtcctaagaggagatggtgcaaaagacctagggcasacaaatttctgaactgtttgagaaccagcaataaagctgacctaactagaagagagtgagtgaagattgaatatctgagagttaataaggagtggagcag

SEQ ID NO: 76498 - DNA, 201 bp, Bos taurus
tcgtggatctcttgtgtatcatgggttttcccatgatagcctgaaaatgcattcagttcctagcctttcaaaaggaatattttaccacaccactaattacraagtattttgttcaaggggtgagagcagttaaaatatccccatctgtttcaagaatctcattaaggtgcatctatactagttcactgagaaactatttca

SEQ ID NO: 76499 - DNA, 201 bp, Bos taurus
ctgaacagagtaaaacaacaccaaagaccaaaatttacccctgagaattcagtgtcaaaagcccattccacagaaacacgctgtccagtttgggatatctmtgcttttaagccttttcttgactgattgtaaatttttagtgctcacagagaacatgcaaaaagttaatttaaatgttttgtggacaaacagcttaaattc

SEQ ID NO: 76500 - DNA, 201 bp, Bos taurus; identical to SEQ ID NO: 36863

SEQ ID NO: 76501 - DNA, 201 bp, Bos taurus
attgtgtttaacaatgaatattatataaagcaattggccataacataaacctattcaatttttctagacttaaaaatacctgaaactgattttgagtttcycagttcacctggctactattgtctgcaagacagacacaattgcttgctcagagcaaggaattttataaacatgagtgaaagcaccatcaaaatataatac

SEQ ID NO: 76502 - DNA, 201 bp, Bos taurus
cctatgctgtgaaacaggccacgaagctgtgaacaatgtttatatgtcaagatgcagagaaggagttcacaatcacaagtgttctaaggaaatgctcttaygggagtcatggcctggagccaagaggaagcctgtctgaagtttagtcaggctgagagaatcattaaggttgccttggtccacttctcgatttatatcaca

SEQ ID NO: 76503 - DNA, 201 bp, Bos taurus
ttacattagagtcagagagagtaggaggaaccaggtacacagaataaaaatgagattcaattaggtagaaagaaatccaagaaactgagtcacagatgctmagtgaagaaatcatttcagagaggaagcagtttgactgttttgaatgctgttgaggtgttgattgaagaaaaataaggaaaagaaatatctttgggcttt

SEQ ID NO: 76504 - DNA, 201 bp, Bos taurus; identical to SEQ ID NO: 36864

SEQ ID NO: 76505 - DNA, 201 bp, Bos taurus; identical to SEQ ID NO: 36865

SEQ ID NO: 76506 - DNA, 201 bp, Bos taurus
aagaagctaagcaggatgtgactttaggtgatagttcaaacccacttaatcccttgagaagaactggaatataaagtacagttggccctcagcatccacaygtacaccattcatgaaatcaatcaatcaccatagaacttgaccctgtgaatacagagagctcagctgcactacaggtacttgagcagcctcagaatctgc

SEQ ID NO: 76507 - DNA, 201 bp, Bos taurus
aagttatagtttgctgctagaatgaagaaataaaagtatgtatgtaaatatgtatatggggcttcctaggtggcactagtgctaaagacaccacgtgtcartgcagaggatgtaagagacgtgggtttgatccctgggccaggaagaacacctggagaaggaacggcaacccattccagtattctctcctggagaatccca

SEQ ID NO: 76508 - DNA, 201 bp, Bos taurus
caagaaagacttagagattcataatataagaagaaaagataaattgaaagagaaaccttgaaacacataacagacaagcagtctagaaagagttcatatamatatataaattaaagacaagtgagacagaggcaaacagctcaataagaaaatggtaaagaataggaagagataataaagaggtgtaaatatctacgaaac

SEQ ID NO: 76509 - DNA, 201 bp, Bos taurus
tctgtaggtgatttcctaaaatgctccatctgtcccagaaatctcagtgtccatttccccatcatatgtaaccctcattaaaaaacacataagataaatamagattaaagaagatgaggcttccctgatggtccagtggttgagaaactgcctgccaatataggtttgatccttggtctgggaactaacccacatgctaca

SEQ ID NO: 76510 - DNA, 201 bp, Bos taurus
cccatccttgaattttcttcctcttgactgaatcatacttgtacacttcttaagtattctcaacccctaccatggggacctgacttcttatctaaatggtktatttgaaatatttttaaatgaactactctgtgcaaatacaatgaatagccatataaaaataaacaaatatcaataaaatcagaacaaaataaatatttc

SEQ ID NO: 76511 - DNA, 201 bp, Bos taurus
taatctatctcggataggggcaagaaaaaattttcagggctagtgtattgttttcatgtgataaatctcaaaaggttatgatatgctttctctcagtatcyctttcatagctgttgatttgcagttcaggctttatcaatgtggtgtttctcaaaaatggggtcttttgcaaatcacaattacttgatgcactctataaaa

SEQ ID NO: 76512 - DNA, 201 bp, Bos taurus
accaaaccattctatcttggtgaattactctatcatttgtcttcatagggatggatggacacatgacctggagaaagccaatcataaagggcacttttccmttactacaatttctggtagaggtatggactaatcagagacctttcctcatatttttctaattaaaatagaatggtagaactctcattcttttctaatttt

SEQ ID NO: 76513 - DNA, 201 bp, Bos taurus
taacatggatgatattacatgtgcatgggttagttgtttgatctctcaagccagtaattaaagaaaaaaaaatgaactatttaaacaagtgacatatgtayatataattacccgacagtccaccgctatctgaaaatactaaaaacatcctcttagaggtaaagctgttattgtgtcttaaaacagtaaaatagcctttcc

SEQ ID NO: 76514 - DNA, 201 bp, Bos taurus; identical to SEQ ID NO: 36875

SEQ ID NO: 76515 - DNA, 201 bp, Bos taurus; identical to SEQ ID NO: 36876

SEQ ID NO: 76516 - DNA, 201 bp, Bos taurus; identical to SEQ ID NO: 36877

SEQ ID NO: 76517 - DNA, 201 bp, Bos taurus
agctctatcagatttgagacccactatccttctgccttcatttcctaccactcttactagcttcatttctatcactggccctctcaaaggtcctgggcccrtagaactcacttctgcctcagggagcttgaatctgcttccagtgttccttctccagatagcctcatggctgatttactcacttctttcagtccttgttct

SEQ ID NO: 76518 - DNA, 201 bp, Bos taurus
tgcaattatatatttgtgacaaattgctccaaagtagtaagctccttaaggatgaggaatatgtaataaaattcttcatatccttatgttctagcagaatrtctaacatatagaaaatgaatgcatattttggaaaattcatatttttctggtaacattttaaacattacacaattttatgtgatctttgaactgaaataa

SEQ ID NO: 76519 - DNA, 201 bp, Bos taurus
ttttttcagcaagaatactgaagtgggttgccatttcatcctccaacattctagagggtgaggataaaatatacagaatagttaacaaatactataacatktgtgcagcaaataaatatacatccgaaaaatgaaaaggggaaaataatagtatttagagagcatagtgtgggggggtggggtgggggcgaaaatccctca

SEQ ID NO: 76520 - DNA, 201 bp, Bos taurus; identical to SEQ ID NO: 36883

SEQ ID NO: 76521 - DNA, 201 bp, Bos taurus; identical to SEQ ID NO: 36884

SEQ ID NO: 76522 - DNA, 201 bp, Bos taurus
ttataattaatacaagaaacactgataacataattgcccatgaaagaaggaatgaactgtaagtccttaaatataaattatatcacacatattagcatggytgtaaacagctttaaaccttttataacatgttatgagacaaaagatgtctctcatcaaggatgattctcaaggtattcaggagactattaacaaaaagcc

SEQ ID NO: 76523 - DNA, 201 bp, Bos taurus
gtattgattttgaatagtcacccaatgtcattcattgagcttcagctacattctgaaatccatctctgtatttccaaatcttcaagtgttggtagtatgtyaaataatgaatatcatgtattccttgactcataactttccatcacaatgtgtttcctaaataaagttgaatatataatgtcatttttcacgataacttca

SEQ ID NO: 76524 - DNA, 201 bp, Bos taurus; identical to SEQ ID NO: 36888

SEQ ID NO: 76525 - DNA, 201 bp, Bos taurus; identical to SEQ ID NO: 36889

SEQ ID NO: 76526 - DNA, 201 bp, Bos taurus
agtcatacatagatattgcccccatgtttctaaaagccagcattcaataaacttcatctccataacctggatgagttgaaatattgtatcatttttactgrccatgttctaatgtcctgttgggaatagtttttatgtacttcataacaaaacttacagatccctggcattcaagaaaagagatccttaatcatttcaagg

SEQ ID NO: 76527 - DNA, 201 bp, Bos taurus; identical to SEQ ID NO: 36891

SEQ ID NO: 76528 - DNA, 201 bp, Bos taurus
cacctcgctgcctgcttcaacaataaaggaaatcaatgcttgtgttgcacgaaccttgagtgttctgtgtcatcagtaatttctgtctatactgcctaccyttcaaatcctgaactcaggagttttataattaaccttgactcagaataagacagccacacaaatgtcgtttgatattactgattatttcgggataaagag

SEQ ID NO: 76529 - DNA, 201 bp, Bos taurus
ccaatttacaagaaaagatttttcccaaagggataggctgacctttccaagttgagctgttcagaaaggagaaaaaaaaaatgcaatacactcagatgccrggcgtttctggcatttgtggcagaagaaaaaggaagtctgtgatttgtgtttgtcttaggccctgccttagtcgtggttgggtctgatacattttttctc

SEQ ID NO: 76530 - DNA, 201 bp, Bos taurus; identical to SEQ ID NO: 36896

SEQ ID NO: 76531 - DNA, 201 bp, Bos taurus; identical to SEQ ID NO: 36898

SEQ ID NO: 76532 - DNA, 201 bp, Bos taurus; identical to SEQ ID NO: 36899

SEQ ID NO: 76533 - DNA, 201 bp, Bos taurus
gtctttcctgaaaacaaatgtatccttttgaagacgagtgaagggaacagccatggccaaggccagccacaccagcacatccagcctgtgatcatgtgttrcaaagtgcctaaacagacgaccaagaacccacttgaactcttcaaattctggtctacctgaaaataaagaaaaatatttctgatcagtattaatattttc

SEQ ID NO: 76534 - DNA, 201 bp, Bos taurus; identical to SEQ ID NO: 36901

SEQ ID NO: 76535 - DNA, 201 bp, Bos taurus; identical to SEQ ID NO: 36902

SEQ ID NO: 76536 - DNA, 201 bp, Bos taurus
tggcatttagaaggtacccagagctgccaaatcaataaaggaataaagtgagggaaactctcagatcttcttggagaaagagggatttgaaatgccttctyacaaggcaacttcttggaggtggtgccttcataggagtaggggaacttgatgataacaatataatgataaataagggaacaaggggaaaaagaagaaagt

SEQ ID NO: 76537 - DNA, 201 bp, Bos taurus
gtacctgcctgatgaactcaaatttagtcatctgaatgccaatcctactggctgtacttaggagcatatttaaatgggtgaatgcaaaactcttactgaargcacttatttattaaagcataggtgcgaatctaaatatggggtaggatggcaatggttcagatttgcggggggacagggaggcatggctcagctgctgac

SEQ ID NO: 76538 - DNA, 201 bp, Bos taurus
tcactttttaggccccttctatctacaaagtatgtaatttcaccagaaaaagttttgcaatcttaaattgctaggcatggcctattgttgctatttgttcrttgatgtattctactttgaaagaggtaatgcattctccatgtggcacataaggccatccaatcagagatttggagaggacgaattttaccttcactgatc

SEQ ID NO: 76539 - DNA, 201 bp, Bos taurus; identical to SEQ ID NO: 36905

SEQ ID NO: 76540 - DNA, 201 bp, Bos taurus
ttttcctctcctttactcctttctgttttccactgagttcttttcagcaggtatccagagcccgtgatcagaaagtatttgtgccaacatcaccacctctrtctttgggggtaaagtattttgaatttagtaaccacagataatttaaggagccaacaagcagtgggaggaaactgttcttaaaaatgaattcccaaaggg

SEQ ID NO: 76541 - DNA, 201 bp, Bos taurus
ctttggaaaacattagtttttatttttttaaaaagaaggtttaccataatctacaagcctaaaagtgtaagcagctggtaaaatttggagttgaccaaacracttcaagttaatacttctcaactgtttgtcaaattctgtagtctttatgtagagacccatttcattcaacagatctctcacgttgtaaccctttgaaaa

SEQ ID NO: 76542 - DNA, 201 bp, Bos taurus
ggggagttcatgaaaccagtccctgtgtaccccaagatgctggggaattagacttttcctgcctgtttgtgtggaatggaggaaaggctttggtttaatayccaatttaaactgatttttaaaataaaaagggctcgtgtcgtaacagccatcgcggcggccgtggcggcgtccctgccctcctcaagtgagctggcgccg

SEQ ID NO: 76543 - DNA, 201 bp, Bos taurus
atacatttgggaagatgccccaaaactggctctgaaggctcctctcagggtaagccagctctgagctgcctgcttcttctcgggtccaagccctaggcccraggagttctgcatcctgaccttgggcagaagggtcatcgatcagtgcggcgcagagtgacagcgacagctaggcagacgggtctggctctcgaagcatgg

SEQ ID NO: 76544 - DNA, 201 bp, Bos taurus
acatctgcccctattggtaatactaatttttatcacttgtggagataatttctctattttgaaataaatatttaccccattataacaaataagcaggctayaggaacacattttaagaccatgtaaatatctttcttctcagcaaaatattctcctggattttgccttcactaactgttctttcctggttcaatctttact

SEQ ID NO: 76545 - DNA, 201 bp, Bos taurus
ttctaccacagaaggtaataattcatccaaagtaatcttgactttgatgagactcttcaagatataatagggtttcaatagaaaactgccaaaaagaaacygtgaagttgctgatgtctacatggttatcccgtttctctgtttttttttttttttttacctgctccgtgtgggaatataattatgtttattcctactatt

SEQ ID NO: 76546 - DNA, 201 bp, Bos taurus
tcacaagagactagctgtcactataagtcaatatatgagacttagacttcccaatctcattcctcaacttttctggtcttgtaactgaataagatgagagrcaaggtgggcagtggggcatagaatgtattggtcatcataagtgctggaactgttacattactggtctcttgatgtgacagatttagttcttggagatca

SEQ ID NO: 76547 - DNA, 201 bp, Bos taurus
ggaaatgctcagtgagggcagagggcctggaagaggagacaagagtgtattcctcaagcagatgccagaatgacaatcatactacgcatcctgaagcctayttcagaggcctctaacacccctaaacctgtacccttaataccaccccatcctcataagcatgctcacatacatacacacacacacacacacacacacaca

SEQ ID NO: 76548 - DNA, 201 bp, Bos taurus
aggctacctaacctactgaccatctgtcaagtctctgcctcaccgccaccaaaaaaaagatacatggggtgaggagatgaatttaatagaaggttttaaawttacatcttaaatatagaagggcatgtgcacatgtgctcagtcgtttcagtcgtgtccgactctttgtgaccccgtggactgtagtctgccaggctcctc

SEQ ID NO: 76549 - DNA, 201 bp, Bos taurus
agatacagatatttttaaagggcctcaatataggcttatgaagggttaattaaaaagaacttagagataagttttcttcttttatgaactgtatagtactyctatgtgtaaaactctgttctgggccaaaagattaagaaaatatgtaagataaagcaccagcatttaatgagttattgtaccccattgcccaagtgaagc

SEQ ID NO: 76550 - DNA, 201 bp, Bos taurus
taggatttcatcagggctcaatcctagcccacttctaggggccaaccatatatagaggagagcaataagcaagcccactttagatgagttttctggcatamtttggttttcttcagggtgtggttcatctctcagcctttcccatagattggggtctgcatgatgaatgaagtttccattttatacctaaagctttactta

SEQ ID NO: 76551 - DNA, 201 bp, Bos taurus
aagtagcaaaaggggcttaaggttgtagatggaatacatatgtgggtgaaatgaattaaggctgctactcagttggccttgagatggaaaattaacctgaygggtccaatgtaatcacaagggtcctcctaagtggaagtgggagacagaaggctcagggcctgtgtgattccacgttagaaagacatgactgattgttgc

SEQ ID NO: 76552 - DNA, 201 bp, Bos taurus
gagatgtgactggcccaaggtcacatggctggtaagttaagggcaccagagtagtgttctaattctatacccagcagataagcagtagggctgaatcaacrtgcttatccctggccctttgtcttaaacatgctactatcattctgggaactaagtacttagttaatataatttgatttaacatttagaacagcattactc

SEQ ID NO: 76553 - DNA, 201 bp, Bos taurus
tggcctccagtaagtcactcttaccccaggggtgtttctacactgtacttaaaacaatcacaacacttatagattatattgtaattaactgattgtttgtytacaagctttttaagagaggagcctgtattctgtctacctggcaaagtacttgagagtttctcagaatctgttgagtgagtgaaagcccaggcaagactg

SEQ ID NO: 76554 - DNA, 201 bp, Bos taurus
atggtgatttaccaatgccataagttcaaaaaagaaagaaagtcacaagaaaatagctcaaacctctcttagtctgatgtggcaagaatgtccaagagacyatggtgtattccatatctcattttttttcttattcttgtgaacagatgggagctgtactatttgaggaagagtaaatcctggtatttggccattatccaa

SEQ ID NO: 76555 - DNA, 201 bp, Bos taurus
acaagattctaaaaatatatattaaattaataactgatttgtggcaaaaccttaacattttcagaggtgaatagcttggccctggggccatggtcaaataycatctagtctttgataatttaattgaaactaacattggtgataaaaatacaggctgtttttcagggacaacgtttgatttgggagactgggaggggcctg

SEQ ID NO: 76556 - DNA, 201 bp, Bos taurus
ctcccaatcgattattccaagtgtttgcactgccaagaatgggatttctcccagggactctgaagagtggtgcttaattattcatcatgaaatttaatttyagagcttgtaatcatgtaactgtttaaaatggaatttgtcactgaaacacgatgcaagaaaatagaggattatttaacttctactcatctcacttcaaga

SEQ ID NO: 76557 - DNA, 201 bp, Bos taurus
gcctctgccaggccacccaaatttgaccctaacaagattaaagttgtatacctgaggtgttccagtgggaaaatcagtgtcacaggtaccctggctgccayagtcattctcttggatctgtctccaaaggaggtgggtgatgacatggccaagacaactggtgaaaagttgggagtacagtgaaactgaccattcagaaca

SEQ ID NO: 76558 - DNA, 201 bp, Bos taurus
cactggagtattcatctaggggcccttccttccctagccaagtggcagagatgtgacccaatctaggctgataaagcactcccttcctgaacctaaatccygaacaaagaaagacaaaggccaaaatttgctggagctcattcttgcctatggaagtgccttgataagattgcacagtggttcccactatgggacacctcc

SEQ ID NO: 76559 - DNA, 201 bp, Bos taurus
aaccccaatattacagttttcatcattttctcaattatatgatccaagatatatggatcaccaaaacagggtaacggtggctgataagatagaggacttartcactgaccatcacagaacaggggtccctatcccaggctattaagatcttattcttattctggggaaataaaggaatcagggagccataacagcattaag

SEQ ID NO: 76560 - DNA, 201 bp, Bos taurus
actaattctaggaaatggccagccacagactgaacagcctcttcctctctggaaaactcccaaaactgttattctgttcagttgcaatcaaacagggacarccaaatatacctaaaggccaatcacaaacttctccacactccttctgaaagtcttaacctaatagactgtccccttttaactttatttagttcactctcc

SEQ ID NO: 76561 - DNA, 201 bp, Bos taurus
gagcttacattcaagcaaagccacaggattggttcatgacagcgagccctgctccaccccatctctctgaccactagtcttggaggttcccagagccccaracactccctaaagctctgtagggataacacagtgcaaggccttcaaaatctctgcaactactttcagagatagtacctgctaattcctccatcatttttc

SEQ ID NO: 76562 - DNA, 201 bp, Bos taurus
taaatgcaaccctgattcccaccttttgaagctcacaccttattattaatatatgtgtttgcatgtgtgtatgtaaaaccatactgtatataaacatatawgtgtgtgccccttctctattcactccattctctattcactgtgatatttcttttattgtaaatgtttgtgtatagatatataatgtatttatgtatattt

SEQ ID NO: 76563 - DNA, 201 bp, Bos taurus
aataagctattttgtgtttcttctagcctgaaggtgggtgtagttctgcactgggtttggtgtaatggtccaggagagagaagaaagagagaggcatcgtyagtgtgattaagagtgtccagctttgtcctccactgtaatcagaattgaggcagtgttgtctgatcaaaatggataaacaaacaggttcttttagctctg

SEQ ID NO: 76564 - DNA, 201 bp, Bos taurus
agtcagacgtactgtaataacacttgtgaaggtattccaacatgcaattgttaggggcagcggaggtccagaataaactagcgtgagagattattccatcrctggcatgtaacttctcacaggtgaccaagcagtgtcacaccattcacatggtgaccgcgtcagccaatccgagggcaggtccacggggagtacagagtg

SEQ ID NO: 76565 - DNA, 201 bp, Bos taurus
tgctttttcaggaggtatccaggttcatggccattaccttccctttatcccaaattcaaacaagtccagcatcctttcagcagaagcccaagctcaccagyggcctgggtgtcacaggcataataggaaatcatttcacaggcatcagagaagcactgaatgtatgcagtggcctggactgggggctcctgggtcatcacc

SEQ ID NO: 76566 - DNA, 201 bp, Bos taurus
caacagtagactaggctctctttgtctagaactgagtcaaggctgtcgaaagctacaacgaaaagatgagcttttcattctgtaggttccacagtagaaamgaatatatagcagaggaacagagtaactaaagagctacagtggacacttagtaagatcacaaagagtatctttatgctcatgatctgttgactattactt

SEQ ID NO: 76567 - DNA, 201 bp, Bos taurus
atcagcaattataactgaaaacgtaagcagtcatctcagaaactgctaaaacaagtagacaaaaacacacaatagaaaaaaaaaaacacaatagagagaaygaaaaaggagggagagaggaatacagatgatgatgatagatagatagatagatagaatgtaactaataagccagagctatcccatggatggaggaacctt

SEQ ID NO: 76568 - DNA, 201 bp, Bos taurus
gcccttcctcttgggagctgccatagtatcctacaggcatcaaaatgtactgcagtgatttgttttcatgtacatgtcctttaagattgcgctcctccttrtggccttcttctggggggttcttaggagaattgaaagtaaattaatttaaaagcatgcaaggcatttgcaatgttgtgagtgttccataaacattagcag

SEQ ID NO: 76569 - DNA, 201 bp, Bos taurus
ctgtgaccttcagtagaagaatgcagcctaccaaaggcaacctctgcaagaataaatattaatatctgcatctgctctcttctgtccctttcatctgcctrggctcaccaccaacccaactcaactagaagctagaggcaacatcagacttctagggcagaacatggtagagaagagtggactctggttctggaaaggaaa

SEQ ID NO: 76570 - DNA, 201 bp, Bos taurus
aaatggaaacatgttaacaagtgtggctgtgactttggatctagcacctatcttcataactggctggcagctgcttttcatctaccaggactgagacaaaygggactcaggtcaacttgagctctttattttgacattgatttatctggagtagaagcattatttttgaggggggggtgggaaacatacaacacatcatgt

SEQ ID NO: 76571 - DNA, 201 bp, Bos taurus
aaagcatatgccatgaatttatcactgattaaatatatggcccaacatgttttattatggtaacgttggggaaaaaactgacctgactcttagtacaacayggtccacagacctgtagcatcagatccctgggagcctgttacaaatgcaaaatcttgggcctcaacccccatccctactgagttagaagctctggggtag

SEQ ID NO: 76572 - DNA, 201 bp, Bos taurus
gatttggtgaccatgtttgcattatttttaaggctctgttggtaccaagtgctttaacagtcttgaagtacgaagaaaggaatgtacaaacaagacctctrcactacgtatgtgaaggggaaatggcctcgtggaaaaagagtcatttaaatggagaaaaggtaagagatctgaatcatcccccaacacaaggaaatacag

SEQ ID NO: 76573 - DNA, 201 bp, Bos taurus
caccatggaaactcgctcctgagcccacattcctgagttcagctcactgccatgcacccctctccttgtcccaccacccgagggggccactccaaccaggytctgcctctgtggcttgaatgtggctcaggcatcagtccctttgttcctccaactccagagggtacctgttgagctctctgcaggccttctgaagcctca

SEQ ID NO: 76574 - DNA, 201 bp, Bos taurus
agactgtttctgtagtcaatactgtgacagtctctccaaattccctttcaagtctgaaggatttctattctcagctgttgagcgggctgcaggcaggcagygctcggctatcagcccacctcaaaattgccgcagctgaagagcctcattactcaaggtcatacccttttcactggggcatctgaatccagagatgagtca

SEQ ID NO: 76575 - DNA, 201 bp, Bos taurus
gagccaccttgggaacctagctgatgataggggggttccatctcctaacttgtccatgtaagtattttcacatctgtgcagagggtgagggagggtcttayagaagtaaaggagagttgttgttcagtcttttcagaactctaaattgtgtttaccacttactccctccccaactatttttgggccatacattgcagcttg

SEQ ID NO: 76576 - DNA, 201 bp, Bos taurus
aaattcaaggagagcctatctcttctacgggttgtgtcagctaggcctgcttgaccaggactaggaactccccaggtggagtcctggtcctggctggtgaytgggataccttctccacatggccattctcccttcaaacattttctctttattcagtaagttagcctagcctaagcaacttctgcctggtggctggtttcc

SEQ ID NO: 76577 - DNA, 201 bp, Bos taurus
tgggctcacacctccttcctgctccaggcctctgctggtcggcagaagagccagtgcttacgggggcagccacgaggtgctggcagagggcagtccgcgcycctggccccagttctgttttgttctttggagggagagggtctggttctcagcctccccgttctgacaacaggacttttctgtgtgttcagcgacagagct

SEQ ID NO: 76578 - DNA, 201 bp, Bos taurus
tatgaaatgaatgtcccttctgtccagcttttctgccacaatttctcctcagagactctgctctaaataaaagccttcctctaggcttttatctgtcattytcatggtcaagtcatatccatctcgtgagatcgcttttcctcttttttttttcctgaggaaaaagggctctacctctctctaacttctgtttataaacca

SEQ ID NO: 76579 - DNA, 201 bp, Bos taurus
atccaataacgtttttttaaggaaagaattaacattgtctcataaacagtagttgctcaataaatatttattacatttaattaaaaaattcagatatttamtataagtagccctaagtacctttcttattcttatctatttcataattgattgtctttactttctggttttattcattatgcgcagaaggagatctaaaaa

SEQ ID NO: 76580 - DNA, 201 bp, Bos taurus
tgttattagactatgaaagatagaaggaaaaacaggccccatataatatgaaaggggaagtctgtttgctagccatgatttggttctgttctctattctcygctccctctttcactgggcccctgcttcctgctgcaggattgtgaggtgtgttaccaatatctggaatgaggtcttgagctacaaagttctcaataaaga

SEQ ID NO: 76581 - DNA, 201 bp, Bos taurus
ctctggctaagaaatccttttgaatttcagacaagagttgcagtaactgagtccggtttattcaggaagagtggagccagaatgggtctgctgtgaataaratgacaggcctgctttcttcacaggcgacttcttccctatgaccgaattctttgatgttaatgtaattctcattaattgctaacgccaaagcaacagagc

SEQ ID NO: 76582 - DNA, 201 bp, Bos taurus
gagggttctttaccactagtgtcacctggaatggaccccatggattttgaagtaagactcacttagagtcatgttggttgctgccacttactagctgtctyatcataaggccatcatttcaagactctaaatctcaatttcagcatcagtaaaatggggataataggtgcctcatggaattgtcatgaggatggaatgaca

SEQ ID NO: 76583 - DNA, 201 bp, Bos taurus
ataattaagtatccatccatatgttttcaaatagagacaaatactgattgttcagataattgattccctgcaatgacttcccattcagtcatgtttttaargccaaaacatctaataaagtcaatgtttttttagaaaaaaagaatagagtgtagatgacttctcagcaattttgtagtaagttcttggagtatcatgtag

SEQ ID NO: 76584 - DNA, 201 bp, Bos taurus
attcaatttaactaataattatttagagtctaccaagattctgttcaggccatgtggggtttcattgtgtattcttctacatgaggctaactataatgtayacaaaaaactaagggattgggccaggctaattttgccttttcaacggtaatttaaaatttagagggaaaaaaattgatttattatgagatgaatagaggt

SEQ ID NO: 76585 - DNA, 201 bp, Bos taurus
tctaggacatcaagccaagagatatgagtgagtggttgcccattgggagcattgagatatggacagcaaaaactctagggcagtcgtctatggggacagaygactttcgctgctggggacaatttgcttttattacgctggtcttggtacagccccttccctcccctgcatcacatgttgtcagttcttccagggggtctg

SEQ ID NO: 76586 - DNA, 201 bp, Bos taurus
gaaacggtcctttgctgacacttttataattaggagttcaagagaattcattcttttctccttgggagaaaagcattgagctgttggtttatggggtgacycatggcaggcaagagcctggatggggggccttctttccagggaagagcccagaaggtacaaaccttgtccaagaggacctgagatcagctggcaggaaat

SEQ ID NO: 76587 - DNA, 201 bp, Bos taurus
aactcttagggcccttagcacacatccctgtctcaacctgctctagaaattgctccagcgctgtctcacatatgtttctcccaatcatattttaaactccytgagggcagggccatgtctggagccgctccacagggtgagctcatgttgattcccataagcccttgctcctttcatggacttggagctaaggtcctcctg

SEQ ID NO: 76588 - DNA, 201 bp, Bos taurus
ctggagaatcccaaggacagaggagcctggtgggctacagtccacagggttgcactgagtcggaccagactgaagcgacttagcacgacaacacacatacraggcctgacataaagggagtagtcgtcactgttactgtctgttaccaaacagccctggagtgcctgtctgaccgacccagcgaacagtcagtcccactct

SEQ ID NO: 76589 - DNA, 201 bp, Bos taurus
agtaaactgtcttagtaatttaacacagtgtcacacagctagtgtcagaatctgaacctgaacccaaactttgtgactccaaagtcccatgctctactctmtgaataaaaacaagctattattaccctatatttgttttcagaattttccttccaagctactcttaagttattccctcattttatctcatcttgggtaaga

SEQ ID NO: 76590 - DNA, 201 bp, Bos taurus
gctaccactgtaagcagatttggcaccccaatcagacctgtgatgctgctcgacaggagagggctcagagtttacgtctgagaactatacgttcttcatcyattagttacagtcaagagtctggagcagcaggtatttacagctaacttctagtaaaatatttggcacatacagaacacctgttattttaattcaaaaatg

SEQ ID NO: 76591 - DNA, 201 bp, Bos taurus
ttttactattttctgtgatggaaaaaaactcatttctgtcaacttgagtaatacctgaattatatatttctttttaatagcctttgagcttgagtgttcartttttgggactgttaaatcattaaaccatgactatagataggtattaatccttatgataattagtaatatttctttgtcttcagttgtaccatcgaaaca

SEQ ID NO: 76592 - DNA, 201 bp, Bos taurus
tgccaggactatcagcagtgtagcaactacccatctgtcctcgtagataaacagttctgaattctttgtccaggggttgctaaagctgggccattcattgkccctttgcccactcagtgccaccagtcaacctaagaaaaggatacagaggaagtgcattccctgtaattatgtacatattaaagagatggtagtattagc

SEQ ID NO: 76593 - DNA, 201 bp, Bos taurus
ctttcattattttactttgttgcttaaatttttggccattgggaatcccttcaagttgattcccatgtcattctgatatatccctatcattttttgataayttctttattttctggccacaagatgtttcaggctcaatagtatttttttccccatcccatctctagcattagtcatttctgcagagttttgatttctttt

SEQ ID NO: 76594 - DNA, 201 bp, Bos taurus
gaaattctccaggccagaatactggagtggatagcctttcccttctcaccccagggatcgtattgtcagtggattctttaccagctgagccaccagggaarcccaagaaggtcactgggcccaggacaccatcagggactcagtttgtaacaggaaaaaaagtgtgtagggtaatgaaagaacatgaactctggaggtaca

SEQ ID NO: 76595 - DNA, 201 bp, Bos taurus
tcataatcctttgaatttcctggccatcatttataagcatggaatatgatgaaacactctaacaagttacagtcaagtttagaatcaaaattagtatatgrgaaaaattatgtgctatatagtgtgatatttaactcatgcacaatagttgaagataagactaatggaagctatggtattgtaaataccgaacaacaacaa

SEQ ID NO: 76596 - DNA, 201 bp, Bos taurus
ttaaaatatattgtacaacttaaaaatattttatttacttggaattactcaggaaaacaatgcatccctaaaacagaatatctatggccacacaaaggaaytgaatagctctcataaatcacactgtagaaagactattacaaaatatcctcacagaaaaaaaaaaaaaaggggatactttaaaaatgaatgtaacagggc

SEQ ID NO: 76597 - DNA, 201 bp, Bos taurus
tgggaacacagccacagacagtacaaaaatgatggctgtagtcctgttccaataaaatgttatttacaaaaacagtcagtgggtgtatttggcctttgggytgatcttgttctcaagttcacttgttctcagactttggtgtgcatcagaatgacctgagccacttgtgacaacacaagctgtccagaccccagattctga

SEQ ID NO: 76598 - DNA, 201 bp, Bos taurus
atccagagttaaatgagcagttagaaaaaatggaactctagcacttgaaggtaaggttccactaactcagaaagtgtggaaatgttggctaaaaggccctrcgcctggctcagaactgactcctcctgcagtcacagtcataattctgggatgagtcaaagtactcccgtggggtccacccaccagtagctggccatggtg

SEQ ID NO: 76599 - DNA, 201 bp, Bos taurus
tgctctcataactggcctctctgcctccctctcactaggaggtttctttctttgtcttaccattcataccatggagcctggagatagactccatctcctcytgattcttcttgccatggccaaatcattctccttaccttcttcctgaaaaccctggatttgaatttcaatcagattgtaacctgtatttctcctgtgaca

SEQ ID NO: 76600 - DNA, 201 bp, Bos taurus
ccagccctctctctaggccccaagtctgcacaagtagagcaggcacctttcaatgtggaacacgatggtgttcttggtcaatggttttccctgaacttgtkcaactgttgtggccccgcagccagaccaataaaatctcagtctttcggggtagggcccaagtgctgatatgttttaaaaagcctccaggtgattttaaag

SEQ ID NO: 76601 - DNA, 201 bp, Bos taurus
aggctttgaaaacggcccctgtaaggaaaataacacatgagtcaggaggcaaacgagttctcagtagcctttgtgtgtcattttatcctaggcaatacctrtggcatttctgcagggtgggcctgctttcatcagctgccagggcatcgtgggaagacactagctctcaaagatctggctggaaaaacaccccacagcttc

SEQ ID NO: 76602 - DNA, 201 bp, Bos taurus
tttaattttggggtggggggaggtatactttcaacacagcaaagaagtgactgtgcaatctcacagaaaggagaaacctccctgactcaagggccacagtyttctatccagccacacccctccatccgcacacatgacgtcctacttcaaaagctgatgtccaaactcgggcctcccaacaggtgctcaacacatagctgt

SEQ ID NO: 76603 - DNA, 201 bp, Bos taurus
ttagagaatgtgctgaagtgctgcaatccactgcatgatcatctaacacattgtaagagttctgaacgtgccctcaggagaccatcagggtcagagcggcwgggcccccggtgtgctcagtgcctctgaaacacagtctgtagacctctccatgttcctagtagagtcaaaggcagacctaaaaagtattgatctagttga

SEQ ID NO: 76604 - DNA, 201 bp, Bos taurus
aaatcccttatcagaaccaagtgtgcagataaactcttaggtgtcctttctttggacaaacaagtattcgagacacataaacaggagcaggccattttcayacacggggtggggggcttcatgggattcatcatttaaaaggcaaaagaaaccaaattggaagcaaaaattccaggctgtgagtggctcaaatattagcac

SEQ ID NO: 76605 - DNA, 201 bp, Bos taurus
cacacagcaggggcctgtcacggggcactcaggaaaggcccggtgcctttttgcaccgtgtacctctaatctacatcataaatcaagtgacgggctcacgrtctgtcctaggcccaccgtaactaggtgctggaggttaaagagtgagtaagacacactgctggctcttgaggctctcacagtcccttagggaagtgcatt

SEQ ID NO: 76606 - DNA, 201 bp, Bos taurus
acaggtttctttaaaggagaagaaagtgtgctgaattcccactgattttaatgtgaccctggtcggtttgaaggtctcggcttccataaatcaagtgcctmcagcggcttttcccttttcacctctctaacccttcccacagctccatctcaggtccggacttgcacgactgagtgaggcggccggctgcccagcggtcag

SEQ ID NO: 76607 - DNA, 201 bp, Bos taurus
ggtttccagtctctaaagactgccctggggtgggtggatactggtgaataagaaggaagacacagataggcccggtgttcacgacgggacaggtgtggtcrccctgcttcgcgggtatccctgcagcatgagccagacccagaagcttttggaataccacttggaaacttcttggcaaagcctaacaatggaaaagcataa

SEQ ID NO: 76608 - DNA, 201 bp, Bos taurus
atgatcattgcctggaatttcttggactcctataatttcttgactctctaaaagctaatagcacccctgaaatctagcagtggcctccatgacctttcttytggcattcttctggtggttttcagaagaaaaaccgctcagtcatgtgtgactgtatgtgaccccatggactgcagcacgccaggcctccctgtccatcac

SEQ ID NO: 76609 - DNA, 201 bp, Bos taurus
aaatggaataaaacaggtacagaaattaaacttgttaaattttttgtaatcgttgtaataggaagtgacatctcataaacttgtctaggaagaaaatcctracctcctgtaataaagtcaatatgtgcagagaaatggcatgagggtcaaattaagcgttgatctgccttccctggaagaaataccaggccacctttggtc

SEQ ID NO: 76610 - DNA, 201 bp, Bos taurus
ggatggaagggagagggaggaaatgaggggaaaacagggacagagaaagaaggagagatagtaagaataacagaccctgtttatggttctggacttctagrgactacacgcttacaggccaacgtctaacagaagaaaatggagcagtactttattaaaagcagagcaagcacagttctctggcaaactaggctagaatcc

SEQ ID NO: 76611 - DNA, 201 bp, Bos taurus
tctccagaaaattacccacttcagctgaatgttaaattgagattttgacccaaatttggttaacttcaaagcctatactcatttaggcctggagcagagayggagggcagagccctgtgctcaggatgccagaagacagctgagtcagcccttcagctgctgttccagttccctgttggctgcctgggcaaccatgagccc

SEQ ID NO: 76612 - DNA, 201 bp, Bos taurus
ctgctgttggtgtcaaaatcacaggtgttgttacttctagtgtatgttgttgcctagattcatcattgaaggagattcttcatttcagttagaggttagtragaataaacggtctaatttttttttcctatccaaggtcacaaaccccatgaatttgacccacagaccatcaaggggtccaagggccctggattaagaggc

SEQ ID NO: 76613 - DNA, 201 bp, Bos taurus
gtggaacctggcagccacaacccctggagcccacagaaaccagctcggtgagaagtccgctcacggcaacaaagaatggccccgactcactgcaactaggragagcctgctcagcgaagacccagcaaaaatcaatcaaccaatcatttctttttttttttaaagaaagatttgagaaagggaaaacaaaagagaatagct

SEQ ID NO: 76614 - DNA, 201 bp, Bos taurus
ggtattaagatggtgctgtagcttctctttttattcatcttagcagtgaattcggtggagccgtgcaccagagaggttggctgcatgtttgagggcccgcrgtgcagaaggctgtgctgtcggttacctaaccctgggctcggttagcccctgcttcctgcacttccccccatctgtctgcagaggaggaagggtaagggg

SEQ ID NO: 76615 - DNA, 201 bp, Bos taurus
cataatttaatcacacccattaattgtggacttcctgcaaacacagctgcaactggagcttgccttctgcaaagaaccacaaagattcacacactgaaaakgtaagtatactatttagttcaccgatttatatcaattctgaaataccaaggaacttaaaatgggttgtacacttaagttttaatgtcagttctaatttca

SEQ ID NO: 76616 - DNA, 201 bp, Bos taurus
tggatgaggacataaagatgaggaataccagggcattttgaggctgtacgtttggagtgataatacttgtctgtaagaccaaggaatttggcctagtgtcyagcactagagaagtgaccactgaaaagaagggaaatactaggttggtgcaaatataattctggttttggaccgtgaattttaagttattattaataacta

SEQ ID NO: 76617 - DNA, 201 bp, Bos taurus
ccactggccctccactgtccttccaaagtcatggacctcagtgggttttagattaatcagttcaggagagcagaaataggaggtctaggactaccatgtgrggatagtgaggcccagaatgagttaaatgactctttacagcatttaagaacctcaggcttacagggacaattgatagctctttgagagtgttaaaaatgc

SEQ ID NO: 76618 - DNA, 201 bp, Bos taurus
tgacatcccaggatcgtgtgaccaggaagaggaaaggctgaggtttgacctggccttcctaacgctgaatcccctatccgttctttctgcccttgcagggrtcatcaaggcaaatgctctgggggccaggtagctaatctaaatgagagaagctgactggagtagaagacattagggagtagtcaggactctggggagtca

SEQ ID NO: 76619 - DNA, 201 bp, Bos taurus
cttgggtgagaagggggtgtggtatcctctgagacttgctaagatgtcccctgggaaaagtcattgctgtcgttcaggatgaagattgcatttccagtacytcttcccttctttcataaaaaggcaaaatataccccagcaacaactcgacttcctgtttgtttgtcaaaggaactctctggaaaggagagtggggtcccc

SEQ ID NO: 76620 - DNA, 201 bp, Bos taurus
tggtgcacacgtggtgatggagttcagagcccggcagcatgttgtcatttaagatccctgttgttagaagttgttggcaagcttcgttgtcatggccaccrtgatcacaaacaagacagttagttgtatttctcaagtctccctttcagactcaaaggcttctactgtatgactgtgaaggaacttttggaaagctttgtc

SEQ ID NO: 76621 - DNA, 201 bp, Bos taurus
acaacaggggttcaaggcttctccatctatgattcaacccgagttcctcccgttccatgccagggtggcaagaccccacctcttcatctccaagtgggccyctctgtcattggggctacaaacgagtggagggtctgtgtctgcttcccccggcagggtgggctatgggagcccccaggcacccccatgcagccccaggtc

SEQ ID NO: 76622 - DNA, 201 bp, Bos taurus
tcgtccccttctcctcctgcccccagtccctcccagcagatttatacattaaaaaactagctgaggcggttgcggtgggagagcagcaggccaagagtgtragttgctcaccccaggggctgcctgctgtcccgctgccctccgagtgcagccatgtccgaaggagaagccccaggagggagtgaagatggagaaggacca

SEQ ID NO: 76623 - DNA, 201 bp, Bos taurus
tgaaaatggctggtagtgactttgagttcgatatggttcagaaaattcatgaaggaatgagtctgaaactgtatccacaaaggccactcagctccatctcrgatgccggaaacatctgtcagaacaaagaatgaacgtcaaactcctccaaggtttccaaagaggcagagagcatgtacacggtgcgtcagcaggaccctg

SEQ ID NO: 76624 - DNA, 201 bp, Bos taurus
cagacagagacagtagctcttgagatggttgtggtgggtttgaagccattgaatggatcctatatttcaagatatcccctttctaggcctcagaatgtgaragattcttttcttgctactaatatgattttctgagtgtctgctgaagacatgcaacttgaagccaagctgtaggactatggccttttctggagggagtga

SEQ ID NO: 76625 - DNA, 201 bp, Bos taurus
attcatctccaacttctttaattattgtatctttccttctaaccctgggtaaagaatagcttaaaccttaattctaatgctttggaattttatgagtttcrttaaaaccccagagagtcatttaattttatggggttcaatgctaatattcaaatgcatttcttctgcaatagatttttaccttgtattatagagactgag

SEQ ID NO: 76626 - DNA, 201 bp, Bos taurus
gtagacggaaagagctcgggtgcctcaggctcaccgagaagcaagttccctaggaaagctgtgtcactaggaatctctgccctggtttttgaacgaacaargtactactgtatattgtgcaagaccactgaaaattggcattgcttgtcgtggttactccgtcctagtacattccagtgaaatggtaaaaacactttcact

SEQ ID NO: 76627 - DNA, 201 bp, Bos taurus
tttgcacagataattggaggaggaaatggcaacccattccagtattcttgcctgggaaatcccaaggacagaggagcctggcgagctattgtccaagggtygcaaagagtaggcctagactgagcacatgtacacacacatgggcagataatacaaggagctcttacatatcctttacccaacttcccctaagttcacgtc

SEQ ID NO: 76628 - DNA, 201 bp, Bos taurus
cataaaggtaaatctcctttatgctccctggccccgaggagcccacaacccagagagaatgacaaatataaaagcaagttattactacctagtgtgcccawtgtgatcagtgctctaagagcagtaggaaaaaaggtgctcaggaggcactgaaaagaaattgatcagttttccaggagagtgagaagaaagtttgaaaga

SEQ ID NO: 76629 - DNA, 201 bp, Bos taurus
tgtgtgagtggctggccgagcctgcttgcagaagatgccggagagtaaccacacaagctttgggcaattggacatctcatgggtgccccagaagacacgtrtacacacaggcccgtctctctaggtcgagctccaaagatggaagccccggcagcggggcgagtcagagcaagtggtacctcaatctaccactcaagagcg

SEQ ID NO: 76630 - DNA, 201 bp, Bos taurus
ttagcttcgtttgtccttcccaacctctcctctccacagctccacccctgccagtacttgttcaaatacacttataggggaaaagaatattgaagacattyccacttagacaccttcatatgaggaagaaggaatgttagaaaatgtatttaactaacaattgtttagcacctgctgaaactgtaaaaaatgtttgatagg

SEQ ID NO: 76631 - DNA, 201 bp, Bos taurus
tttaagtagaagagtaatgtgttcatattgcattttggaaatatggccgtgtggagaacattcacaaaaacgaggcagcctagagaccatgaatgtaacakagggatggtgttgcgtgcagaggacttcagatgtgaagcaaaagatattgccaatggcttggaaagcactgggtgtttagtggtgcccttccagctatgg

SEQ ID NO: 76632 - DNA, 201 bp, Bos taurus; identical to SEQ ID NO: 36906

SEQ ID NO: 76633 - DNA, 201 bp, Bos taurus; identical to SEQ ID NO: 36907

SEQ ID NO: 76634 - DNA, 201 bp, Bos taurus; identical to SEQ ID NO: 36908

SEQ ID NO: 76635 - DNA, 201 bp, Bos taurus; identical to SEQ ID NO: 36909

SEQ ID NO: 76636 - DNA, 201 bp, Bos taurus; identical to SEQ ID NO: 36910

SEQ ID NO: 76637 - DNA, 201 bp, Bos taurus; identical to SEQ ID NO: 36911

SEQ ID NO: 76638 - DNA, 201 bp, Bos taurus; identical to SEQ ID NO: 36913

SEQ ID NO: 76639 - DNA, 201 bp, Bos taurus; identical to SEQ ID NO: 36914

SEQ ID NO: 76640 - DNA, 201 bp, Bos taurus; identical to SEQ ID NO: 36915

SEQ ID NO: 76641 - DNA, 201 bp, Bos taurus; identical to SEQ ID NO: 36916

SEQ ID NO: 76642 - DNA, 201 bp, Bos taurus; identical to SEQ ID NO: 36917

SEQ ID NO: 76643 - DNA, 201 bp, Bos taurus; identical to SEQ ID NO: 36918

SEQ ID NO: 76644 - DNA, 201 bp, Bos taurus; identical to SEQ ID NO: 36919

SEQ ID NO: 76645 - DNA, 201 bp, Bos taurus; identical to SEQ ID NO: 36920

SEQ ID NO: 76646 - DNA, 201 bp, Bos taurus; identical to SEQ ID NO: 36921

SEQ ID NO: 76647 - DNA, 201 bp, Bos taurus; identical to SEQ ID NO: 36922

SEQ ID NO: 76648 - DNA, 201 bp, Bos taurus; identical to SEQ ID NO: 36923

SEQ ID NO: 76649 - DNA, 201 bp, Bos taurus; identical to SEQ ID NO: 36924

SEQ ID NO: 76650 - DNA, 201 bp, Bos taurus; identical to SEQ ID NO: 36925

SEQ ID NO: 76651 - DNA, 201 bp, Bos taurus; identical to SEQ ID NO: 36926

SEQ ID NO: 76652 - DNA, 201 bp, Bos taurus; identical to SEQ ID NO: 36927

SEQ ID NO: 76653 - DNA, 201 bp, Bos taurus; identical to SEQ ID NO: 36928

SEQ ID NO: 76654 - DNA, 201 bp, Bos taurus; identical to SEQ ID NO: 36929

SEQ ID NO: 76655 - DNA, 201 bp, Bos taurus; identical to SEQ ID NO: 36930

SEQ ID NO: 76656 - DNA, 201 bp, Bos taurus; identical to SEQ ID NO: 36931

SEQ ID NO: 76657 - DNA, 201 bp, Bos taurus; identical to SEQ ID NO: 36932

SEQ ID NO: 76658 - DNA, 201 bp, Bos taurus; identical to SEQ ID NO: 36933

SEQ ID NO: 76659 - DNA, 201 bp, Bos taurus; identical to SEQ ID NO: 36934

SEQ ID NO: 76660 - DNA, 201 bp, Bos taurus; identical to SEQ ID NO: 36935

SEQ ID NO: 76661 - DNA, 201 bp, Bos taurus; identical to SEQ ID NO: 36936

SEQ ID NO: 76662 - DNA, 201 bp, Bos taurus; identical to SEQ ID NO: 36937

SEQ ID NO: 76663 - DNA, 201 bp, Bos taurus; identical to SEQ ID NO: 36938

SEQ ID NO: 76664 - DNA, 201 bp, Bos taurus; identical to SEQ ID NO: 36939

SEQ ID NO: 76665 - DNA, 201 bp, Bos taurus; identical to SEQ ID NO: 36940

SEQ ID NO: 76666 - DNA, 201 bp, Bos taurus; identical to SEQ ID NO: 36941

SEQ ID NO: 76667 - DNA, 201 bp, Bos taurus; identical to SEQ ID NO: 36942

SEQ ID NO: 76668 - DNA, 201 bp, Bos taurus; identical to SEQ ID NO: 36943

SEQ ID NO: 76669 - DNA, 201 bp, Bos taurus; identical to SEQ ID NO: 36944

SEQ ID NO: 76670 - DNA, 201 bp, Bos taurus; identical to SEQ ID NO: 36945

SEQ ID NO: 76671 - DNA, 201 bp, Bos taurus; identical to SEQ ID NO: 36946

SEQ ID NO: 76672 - DNA, 201 bp, Bos taurus; identical to SEQ ID NO: 36947

SEQ ID NO: 76673 - DNA, 201 bp, Bos taurus; identical to SEQ ID NO: 36948

SEQ ID NO: 76674 - DNA, 201 bp, Bos taurus; identical to SEQ ID NO: 36949

SEQ ID NO: 76675 - DNA, 201 bp, Bos taurus; identical to SEQ ID NO: 36950

SEQ ID NO: 76676 - DNA, 201 bp, Bos taurus; identical to SEQ ID NO: 36951

SEQ ID NO: 76677 - DNA, 201 bp, Bos taurus
gctacgtctgaaagtataaaataccgaaaggttttgcctcttttcatttgcatttcacttgttaagcactcggaggtgaggatcagccttgttatagaggyggtgataaagtggcactgagtgcaaactcagcacatgtgagacacatgaatattcaggacgtgtgtacggagcacctgggtgtgtaagaagggcacccat

SEQ ID NO: 76678 - DNA, 201 bp, Bos taurus; identical to SEQ ID NO: 36952

SEQ ID NO: 76679 - DNA, 201 bp, Bos taurus; identical to SEQ ID NO: 36953

SEQ ID NO: 76680 - DNA, 201 bp, Bos taurus; identical to SEQ ID NO: 36954

SEQ ID NO: 76681 - DNA, 201 bp, Bos taurus; identical to SEQ ID NO: 36955

SEQ ID NO: 76682 - DNA, 201 bp, Bos taurus; identical to SEQ ID NO: 36956

SEQ ID NO: 76683 - DNA, 201 bp, Bos taurus; identical to SEQ ID NO: 36957

SEQ ID NO: 76684 - DNA, 201 bp, Bos taurus; identical to SEQ ID NO: 36958

SEQ ID NO: 76685 - DNA, 201 bp, Bos taurus; identical to SEQ ID NO: 36959

SEQ ID NO: 76686 - DNA, 201 bp, Bos taurus; identical to SEQ ID NO: 36960

SEQ ID NO: 76687 - DNA, 201 bp, Bos taurus; identical to SEQ ID NO: 36961

SEQ ID NO: 76688 - DNA, 201 bp, Bos taurus; identical to SEQ ID NO: 36963

SEQ ID NO: 76689 - DNA, 201 bp, Bos taurus; identical to SEQ ID NO: 36964

SEQ ID NO: 76690 - DNA, 201 bp, Bos taurus; identical to SEQ ID NO: 36965

SEQ ID NO: 76691 - DNA, 201 bp, Bos taurus; identical to SEQ ID NO: 36966

SEQ ID NO: 76692 - DNA, 201 bp, Bos taurus; identical to SEQ ID NO: 36967

SEQ ID NO: 76693 - DNA, 201 bp, Bos taurus; identical to SEQ ID NO: 36968

SEQ ID NO: 76694 - DNA, 201 bp, Bos taurus; identical to SEQ ID NO: 36969

SEQ ID NO: 76695 - DNA, 201 bp, Bos taurus; identical to SEQ ID NO: 36970

SEQ ID NO: 76696 - DNA, 201 bp, Bos taurus
actgctgtctccacttcagggccccagggcagcctcttctccccaggtctctatttctttgatttccctgaaaaacaagggatctggggccatagttcccrccttctttttccaactatccccatgtgtcctcaatggcaagaactgtttagtctgtgagatctgggaaatccatgttggcactagggctgctacttcagg

SEQ ID NO: 76697 - DNA, 201 bp, Bos taurus
cagtggcatgttcagaaaacagcaagcagcccagcacaggaggcgtgctggtgaggctgggactgggagggagaggatttgagagcagccagtggctgtgwagggcctcacatgtcatggtaaaatgtttgcaggaagtggtagaggagtccaggacaacttctggactttagtcctgtggcttgagtgactaaagtcagt

SEQ ID NO: 76698 - DNA, 201 bp, Bos taurus
tgcctggggggatcacacaggttgttgcctatattaaatacttgacggagcagaagcagtgattcttattacagtctttgaccccttgtttggcctctacrtaaggtaggtaatcttgggctgcatgcataggactgggagtcagaaaagcctccagtttctcagcagaagtgctagaaggcagacgagcagtgctggttg

SEQ ID NO: 76699 - DNA, 201 bp, Bos taurus
tctacaccttagtatttccagttgaacttagaaggtcccttaggtttgacagcaatctttctttgtatcttttcttttttctgctagaaaatatcttagcmgttaaatgattgtactcttaaaatcatgatgaattgtttaagagaactcaatgtagactatttataacagatcttcctgtttataaaacacagatctatc

SEQ ID NO: 76700 - DNA, 201 bp, Bos taurus
ttgagaactatcctctcctcaacttctacatgcacttaaaaaataatttaaaaagcatgtcagttgcttcctgttaattttcctttgcacatgatagttcrcaacataaaaataggtttcacagtttagtattccattaaaatgcagccaccttccagatttcagcagcccattctctgggaaagcaaattttctttgtta

SEQ ID NO: 76701 - DNA, 201 bp, Bos taurus
tcagaatcctccctcaagctgattagcatgaaaacccaaccatcccaaacccaacccaaacccaaccatggcactagtagcgagatgcctcaggccaaacrgctatctgggtgagaccacagctccatgtgccaccagggaagctgcttcaggacacccctgagtccccagctgctctaagacccagccctgctcatcaga

SEQ ID NO: 76702 - DNA, 201 bp, Bos taurus
agttagaagaagtctatgaaggaaatgaaaaataagaaatcacaaatttatgattcagtcatcaatttagcatttataatcagacatgtcttatgtattgmtgtttttgttgtttagttgctaaggcatgtcatactcttggtgattccatgtattgcagcatgccaggctcctctgtcttccactatctcccaaagtttg

SEQ ID NO: 76703 - DNA, 201 bp, Bos taurus
agttcatgctcattctactctactgcttgaaaggaaaatcactggttaagcacttcttccattctgctctactgatgggatgttggccattatacctttaygcatgataagtatacttatacttcatggaaatagaagtaggtcttaagagattatagaaaattgattttgtgttaaaaggccacttcttaaagcaaacca

SEQ ID NO: 76704 - DNA, 201 bp, Bos taurus
gactggtaataagcccctgttcccctagatgatttgtcttagattcaggaaaagaggcttctcgggcctcctaaccataatatggccccagaggagcccakaagatctctccagagcactcaattcatttcagttcagtccctcagtcatgtccgacattttgcaaccccatgaattgcagcatgccaggcctccctgtcc

SEQ ID NO: 76705 - DNA, 201 bp, Bos taurus
tgcctctcttggcttggcccacttctcccttgaggtgttctttcagttctttcttcagtgaacttgcctttgccagggctaagacctcagatgctttgtgytcttatttagaactgaggcctatgagaaagggtgttcttcgactctctccatcccaggtaacagaaggataaaaaagtccaaaggagctgaggattggga

SEQ ID NO: 76706 - DNA, 201 bp, Bos taurus
aaagaagacatatggatggtcagcaaacacattaaaagatactcaacatcattaatcatcagaaaattcaaataaaaaatagaatgaagtattacctcacmcttgtcaagatggccatcatcaacaagtctacaaagaataactactggagagcgtgtggcaaaaagggaacccttctacactattgattgggaatgtaaa

SEQ ID NO: 76707 - DNA, 201 bp, Bos taurus
ttttgatttgaagagagagacactcatataggaagctagtccagcaaggaatatgcaggacaacttcctatctgaaagaaagagaaaacacagaaggctgrgcaggaggaagcccttgtgattacagataagcagagggacagagcgtgtgaagtccacagatatgatttgtgatggttgtgagcagcgggaatcctcgta

SEQ ID NO: 76708 - DNA, 201 bp, Bos taurus
ctgttgtacatcttaaagagacctgtgatcatttcctttcattccatctgctgaatgacatattcatgtgtttactgttgctgtttcctaagcacctccaytctatgctttactatttaaagttttgatttgccataagtataaagcatttcaacagttatgtgtaatgttatcttacagagcagttccaggtgttccccc

SEQ ID NO: 76709 - DNA, 201 bp, Bos taurus
aaactgagcacccaccatcacaagtgtttgcacgagctgcaaatagcacagaagcaaactagacacaggctctgccagaaaggaacccagtgtactcactycttcatttgaatatagccaagaggctgttgttagcacaatgtgagggaagcacagaagaaaagaaaaaactgactaattctgtggaggaaagagatgtct

SEQ ID NO: 76710 - DNA, 201 bp, Bos taurus
cttccagcttcctcctcacgcttcgcctacccagggttcagtgaacagtgtgaagagtgagacaaaatgaaacccctcctttgtagacagtgtttggcctrcttcttttatgtactgtgctgaccttgtaggcatcttaagtgactctgtgtctaagggtattatgaatatgtctagtggccttgaagaaaggatagttat

SEQ ID NO: 76711 - DNA, 201 bp, Bos taurus
attcaggcctttgatgctttattttcatcttgactctcctctcagagagaagttgtagtttgatttttttttagttgcttattgtggaaacacagagttamacacacacccaaaagggccctcacctcccagacagttaactctgaaagaatctgaaggtccttttgttagtctattgtctctctgcacagaggctgttac

SEQ ID NO: 76712 - DNA, 201 bp, Bos taurus
gtgatgcaaagtgttctgtagtgatacctgatctgccacaggctcgggtgcctgctaatcttgcactgtacccaaagctcttataaagaaggggatgaggraaaaaaaaaacaacaagggaatgagcttgtttgggagttattcccatttgagcatggagaaaatacagctttgcatattttctcttattttgtcctcttc

SEQ ID NO: 76713 - DNA, 201 bp, Bos taurus
ccataagaaaaaaaggaaatgtaatacatgacttaaagaaagtagcaagtgataacatatgctatagttaatgacacgttctccagttttccaatctttamaattcttaaatgaaaatgtttccatatttgtaagtcccataccagtattttttctgtcctatattaaaaacaatcacaggaacaaagaggtacatgaggg

SEQ ID NO: 76714 - DNA, 201 bp, Bos taurus
tcggtatctgcatgtcccccgcgataagtgggggtggggtgctgaggctcaggctccgagggttggagcccaggcagaagaccgggattggctgtgtactrtctggaaatggcagtatggcacagatgagggggccaggaaaaagcctggccctgccaggaaggcaggagatgattgtcgctggaaccctctaactccaca

SEQ ID NO: 76715 - DNA, 201 bp, Bos taurus
ctccaggcctccccttcccgtggagagccagatgtgggacccaagtttgccgcgcttgccccgcagccaccctgccccttctgccacacagccctcacccsctctgctctggcctccgactcttcctggctctacctgagccgaccgttccctctacctgaaatgttcctccccctccacgcagaagagactcactccgtc

SEQ ID NO: 76716 - DNA, 201 bp, Bos taurus
ggcttaggcagccccagctcactcctcagtagctggcagacagtcctcaggaacagaacaggagatgaaaactcaacagcatttcccccaaggcccgggtmctatgttccaagaggatctaccagaagatgcctttaaatggtaaacacctctatggtacctcagggccccaagaatttgctcagcctctcctagacacct

SEQ ID NO: 76717 - DNA, 201 bp, Bos taurus
cccaacttctgaaatttgacacatagctgtgaaagttgaattgaactgggttgaagtttaactgaatctttgaatcagtcagtcaacacattcttcttgartgtttagcacagagctggacactgttgagaaatgcaaaggcaacttcagatatggtctctgccctcatggaatggttactctctttgggaaatgcccctc

SEQ ID NO: 76718 - DNA, 201 bp, Bos taurus
attagatcaataaggtggggttaatatgatggccaacatcatctcaacaacacctgagataacatggctagaagctaaagttctctaaggaaatcctgaaragtcaaggggcctgtgagtacttatggagaagcaaggtttttgaatctcatcctgaaaaaaataatgaattggggcagatgggaaaggaaggaaggagat

SEQ ID NO: 76719 - DNA, 201 bp, Bos taurus
aggatttggccctagaggaggaaaagtgacctaatttttcctacctgcatgtgtacatagggaaaggggttaaccataaacagtgacttcttataattgtyagtcatgactgtatgaatatcccatgtcccaatctacatgggatttttttgttttaatcaagttccaaactcagttttaaaaaaattaactgatttgtat

SEQ ID NO: 76720 - DNA, 201 bp, Bos taurus
cttctcttgaaaggagacccagaagttaggacctggggacaaggaggcagagaaggtgggagaagccataagtgtttataatgtactctcttttcttttaytctcatcccatgatgaaattctcatatattatttacttggggtggactacatgaaagttctttggaaaaatatgtggcgagttgtaaagggaaaatgatg

SEQ ID NO: 76721 - DNA, 201 bp, Bos taurus
gccagaaatgtggattctggctacttcattaacttttctgggtcttttttgttgtcgttcgagtcgaggtaggtgttagttctttaggcataaaatgttayggtgattctaaaccacagtgcaccttcatattctctgtactttcaagacagcaggtatagtaataaattggaactgttctggtgctttctttcctgaagt

SEQ ID NO: 76722 - DNA, 201 bp, Bos taurus
gagttgttagtataatatatgttatcagttaatctgtagtaaaaccatcttttcaagtgagctttatcaacaagtcttcaacaacaaaccatgtcattctrtagagctgatggtttttagaggtatcatctcccaatttttgttactacaacaaagtccttttggtttttcttttgagtcttatatgtacaagagtgaatt

SEQ ID NO: 76723 - DNA, 201 bp, Bos taurus
atctgttatactgtgtacgatgttaaaactcacaagccactaacttatctttgttaatactgtctggatttgttttcatttcctgcagcatcattatgttstctttcttcctaactttgcttaccactttataatatttggtcaactgaaggtattgcctccataaactagttaaccataaggtttctacagcagaacctt

SEQ ID NO: 76724 - DNA, 201 bp, Bos taurus
taatgtgtgtaagactggcctggagaccttgaaagaatgcagattatgacttggtgtgtctggggaagcctaggctgctggctttcaggccatgatttgakcagtgagggataaccctaagaagactgaacagataattcagtcctggtgtgaatggtccatagtgggctaactgggagctgcctctaagtggaccattag

SEQ ID NO: 76725 - DNA, 201 bp, Bos taurus
actggtgggtcagtcatcttaaaggccacatgccatccagtgagactgtcctgtcagctttccccacttcctgctaccatctcaatacagaggtcattcarggtggcctaggttggaaatgacctttctatgatagtcaggtcttgtaactgttttccttacttattctttataacaaagatgataattggtgaatgtgag

SEQ ID NO: 76726 - DNA, 201 bp, Bos taurus
tctccaagggaacttccgtacatgaactggggtctcctgcattgcaagcaggttctttaccagctgagctaccaggaaagccccagaaagattaagcctayacttagtctgaaaaatacttaaaaaaatgtgccttggtagatcagagcatgaactccagggaaagagctacagggtataggttgaacattcttgaaaatg

SEQ ID NO: 76727 - DNA, 201 bp, Bos taurus
gctttttgggtcctgggcatttcttgccagcacaggacctctcttggggcactctgtgcccagctctcaatcttcctacctctccctctttcacaagtgarccaagcctcatggtctggaagctttttctgccgtctgctcacccttcccattatctttcagaggcatgattctgaacacatttcatatttctgacactgt

SEQ ID NO: 76728 - DNA, 201 bp, Bos taurus
atatttttaatcctcacataatcctttaaaataggtacaactattactcctattttaaccaaagcatgaagtagttaaggcatttgcccactgtttaatamttaatagaggaatattcaaacacagctctaattctaacatctctcttctctaccactgttctcccctgctcctgggaatgtaaagtcatattagtcctag

SEQ ID NO: 76729 - DNA, 201 bp, Bos taurus
aatcttatttccgaatcaaaatgaactggccagcaatacagtaaaaactgcaaactctaatctaagttggagtctctcctctgcgcttgctcagcactgcytggggcctgaagcctgtagggaagaaagaacaaggtcacctccttctcaccctgctcactctcgggagaaccattagagctacttttgaccttttcaggg

SEQ ID NO: 76730 - DNA, 201 bp, Bos taurus
tgcggtaggcggtttggaagccttcgggtcagcgttggtaactgcaggagacctggcccttgtcctcatggggcctggtggaggtggcggctgtgtactcrgaaggaagcagatagagcaatggagaagaactacagaaagacataatcatatattctttcatccattcagcagagatttattgaggcagtaccagacact

SEQ ID NO: 76731 - DNA, 201 bp, Bos taurus; identical to SEQ ID NO: 36972

SEQ ID NO: 76732 - DNA, 201 bp, Bos taurus; identical to SEQ ID NO: 36973

SEQ ID NO: 76733 - DNA, 201 bp, Bos taurus; identical to SEQ ID NO: 36974

SEQ ID NO: 76734 - DNA, 201 bp, Bos taurus
cggtcacctagccattcttctcaaaggaaaatacctaaggtttgttatctatctatctatgtatctatctgtcatctatctaacgtgtctaaagtcaactrtgtcttcatccaaggattattcccgttaatattttgctattattccttcatctatattgtctagtaaagcctatggtttttccagtagtcatgtatggat

SEQ ID NO: 76735 - DNA, 201 bp, Bos taurus; identical to SEQ ID NO: 36975

SEQ ID NO: 76736 - DNA, 201 bp, Bos taurus
atgtgttgggggaggtggtggtaaaggccctaaatctaatttaaagaaaatatgtccctattagaatcatatggaacatgacatatgcatctgggatgacrgggagaatgaaaaattaaaggcctatattatgggtcacagtctaaagagtacctgggtcagtcataacagtaagagacttaggcacctgggaactaaagc

SEQ ID NO: 76737 - DNA, 201 bp, Bos taurus; identical to SEQ ID NO: 36981

SEQ ID NO: 76738 - DNA, 201 bp, Bos taurus; identical to SEQ ID NO: 36982

SEQ ID NO: 76739 - DNA, 201 bp, Bos taurus; identical to SEQ ID NO: 36985

SEQ ID NO: 76740 - DNA, 201 bp, Bos taurus
gtttatttcaaatatatttttctctagaaaggtaccatgcatctctgtagtgggactgcccatgctacaacatagctaccttgtggaatgccacctgttgygcatggcaactcaggaagaattcaacaatatttcacaacttacgttagggagagattttaatgtgtgatagacataattacaagtcctagatcagcaaga

SEQ ID NO: 76741 - DNA, 201 bp, Bos taurus
gtgctataaaaaatatagcacaatttatataatttaattcttaagaaaatattgagctgaagggtatgaatgtattagtgaaagagccagactagtttggraaaacatttccgtggagttttgtgcttttcaattgaagcactaaaactaaattttagtcttgttgacaacaccatggctttaactacactcattctttct

SEQ ID NO: 76742 - DNA, 201 bp, Bos taurus
ccataaaattgtgaagtatactgtgtttacacaaaagcactggaataaattaatcattgtttataactaacaatttcctagaaagtgaatacattttctaygagactgagtgatgatttttcctaattcttttttacatcttccactaaataccctacattagaggaaatttactgcaaactcttacaaccagaactcaat

SEQ ID NO: 76743 - DNA, 201 bp, Bos taurus
ttaaatatatgtacaaaaaaaaataaagttaagctctaagtgcaaatagcatagaattactatttcccaaagtgttcctgattaactccagaaatatttayaaagtgcttacacaaaatgccttgctttcatgaaactacaccctagtggagaacacagaaagtaactgtaaaattgtaaaaacacgaacataattaaaag

SEQ ID NO: 76744 - DNA, 201 bp, Bos taurus
attatacagtcaggttagtttatgttcagctctaagacattaatttagttgaatgtactaaattcaaaatgtactaatactaaagaatgcttaaacaagcmggtagaatctaggaacattttttaagaaatactgtatctaaatgataacttcagtgtgtaggcaataaccattgctttgatatacttaatataaattcaa

SEQ ID NO: 76745 - DNA, 201 bp, Bos taurus
cactacaactagagaaagcccctcgggagcaacagaaaccagtacagcgaaaaataaataaaatttaaaaagaaaaatgaaggccaacctaatcagataayatgttttcatagacatttggaaggtattgcttaaatgcaaaggcttgactacactggccagtaatttaggtgttatgaacaagacatctacagggaagca

SEQ ID NO: 76746 - DNA, 201 bp, Bos taurus
ccccatggactgcagcatgccaggcctccctgtccctcaccatctcctagagtttgcccaagttcatgtcctttgcatcagtgatgccatctagccatctyatattctgtggcctcttctccttctgcctattatatttctatatgtaatagtattgaaagtaacaccatgcttagaaatcgtctttaaaaaagaattgca

SEQ ID NO: 76747 - DNA, 201 bp, Bos taurus
gagatgtttagatagcatcaccaactcagtggatatgaatttgtgcaaactctgggaaataatggaagacagagaagtgtggcatgctacaatccatgggktctcaaacagtataatatgattcttgacagaacaacaacaattattcagccataaaaaaaaaaaaattgccacttgtaacaatatgaatagatctggagg

SEQ ID NO: 76748 - DNA, 201 bp, Bos taurus
ggtattaaactatcagaatttttaaaaagtcatcaataatgttaggctgcagagcaaatgtaaagctatagccatagtcatgttacatactagaaatttgstggctgtatttgcagttttctcactggcaggaaaaggacctattctggtaatcaatacccttgctccactcaacagagtaaagtggacctgtagattata

SEQ ID NO: 76749 - DNA, 201 bp, Bos taurus; identical to SEQ ID NO: 36988

SEQ ID NO: 76750 - DNA, 201 bp, Bos taurus
tcattcccaacatatacatcataaaagttaaagagacactccacttcatttttcagatttataataattagataaaggctaaaattgggaatataaaaatkatcaacattcctacacaagagaaatatataacccattgcttttattgagaatatggaactaagggaccttgtaaactgagttcaaggtactgtacttaag

SEQ ID NO: 76751 - DNA, 201 bp, Bos taurus; identical to SEQ ID NO: 36992

SEQ ID NO: 76752 - DNA, 201 bp, Bos taurus; identical to SEQ ID NO: 36993

SEQ ID NO: 76753 - DNA, 201 bp, Bos taurus; identical to SEQ ID NO: 36994

SEQ ID NO: 76754 - DNA, 201 bp, Bos taurus; identical to SEQ ID NO: 37064

SEQ ID NO: 76755 - DNA, 201 bp, Bos taurus; identical to SEQ ID NO: 37065

SEQ ID NO: 76756 - DNA, 201 bp, Bos taurus
aggcatacaccaggtaggaaagcgcttcttggtacctgagaaagttatcgatgaaaaacagctcagtgctcctttcccaaacccagggcttagtccccatygctctctaatacaagaatggaaccggctacagggatggaaaagtcttaagcatggaggcagcatggtgcaggtggaaaagagggccaaagaccacagcca

SEQ ID NO: 76757 - DNA, 201 bp, Bos taurus
attccctgcctggagtcccatgcccttaaggggctgtaactctttcacttttgtaagctaacctttattggcaagggctagatggcctcaaggccagcccygaagagatggagacattgtggagttggggagagggtggataaataaatggtctctgcctcaggggtaaaagctaagggcagaaattaaatggggctttca

SEQ ID NO: 76758 - DNA, 201 bp, Bos taurus
tcctcacaacaagactggctacataaatttgtggggcctcatgcaaagtggaaatgcagggtcccttgtttaaaaattattgagaacatcaaaatgacacyaagccaagcatggggcccttctaagtgcaggactccctatgactgcatgaagccagcctgcctcccagcctctcagttcttgccatgcctctgccctgac

SEQ ID NO: 76759 - DNA, 201 bp, Bos taurus; identical to SEQ ID NO: 37068

SEQ ID NO: 76760 - DNA, 201 bp, Bos taurus
acaagaggatatgtggccttggagcctgtgagaaagacctccctccaggaacgagccagagtgtggagaacaacagaggccgagagctcgctgcctctgartgtctcctctgttccccttgacgtgaacttcttcctcaataaccttttacataatcagggcccctgaaggttagctgggcttcccatactgtcaccctga

SEQ ID NO: 76761 - DNA, 201 bp, Bos taurus; identical to SEQ ID NO: 37069

SEQ ID NO: 76762 - DNA, 201 bp, Bos taurus
catttcgtacctgacttgagagatctgggttccccatgagtggggtagtcatccatgtatgttggtttgtgtgtttcagagtcaaggggccagagaaggaraagttgagccgggcagtcgagcaggtcctgaagtgtaacatgactcagagctggctgctgagggccatctgcctgcccctggccgactgcctgctaagca

SEQ ID NO: 76763 - DNA, 201 bp, Bos taurus
gcaagttattgccttgattttcatctgtcttccactgatttacttattagattcctccagtagagagtatctcttctagctttggataaaccactgtcctyaagtgtcctcatcagcgaggaaacgtacactgaccttcattttctgttgtttaaacttataaaaacaatagttttttttttttttttttttcacatatat

SEQ ID NO: 76764 - DNA, 201 bp, Bos taurus; identical to SEQ ID NO: 37076

SEQ ID NO: 76765 - DNA, 201 bp, Bos taurus
tgaacctatttgcaaggcaggaacaaagatgcagacatagagaacagacttacggacagagcaggggcagaagagggtgggacaaattgagaaagtagcaytgaaatacataattaccgtatgtagaacagataactaatgggcaattggtgcataacatagagagctcaacctggcactctgtgataaccgagggggtgg

SEQ ID NO: 76766 - DNA, 201 bp, Bos taurus
gaagggagagagtttcactttgtagtctggcatcatctttctccagcagaagagacaagcacgcccccctgagagccacctcagggatacgcggccctttrcatgctgttgtgcaggcttccaagtcaagagggtgcgccaattggatttattacaattggaaggaaagaaattgtaatctttaaaagccaacgacatggc

SEQ ID NO: 76767 - DNA, 201 bp, Bos taurus
agcactggccagatggttaaggagcaatcatgagactgacactcccctagatgaccaagctctgaaaggggacaggtgtccttgaggccccaactccaaakgaggcatcctttgctagtcagtggattgggctgatcaaccagtgctgtctttcttctggctccctggaaggtcctggcctggagggtcagtgacctggtt

SEQ ID NO: 76768 - DNA, 201 bp, Bos taurus
taggagagtagaagcaatatattcctcccctggagctatttttgagctacttgaggactcacagcccctgctgaggccccggggaagccgaggtacgtgtygctgatcttctgtactcctgatggtggtgggtgtcaggttgagttgcttatcacggccccctgcctgctgcacatcttcgagagctcaaaagtgacccgc

SEQ ID NO: 76769 - DNA, 201 bp, Bos taurus; identical to SEQ ID NO: 37078

SEQ ID NO: 76770 - DNA, 201 bp, Bos taurus
ccataacaggcacttactatacattcattgtggggctgctgatgagggtgacagaagttactgccatatttcctgagtaggaataagaaatgaatctcttkggctttattttaaagtaagggccaggaaaatgaaagtggttttgttggtcctacagggaataggtttggtaaaccaatgaaaaaaataaactcttgagag

SEQ ID NO: 76771 - DNA, 201 bp, Bos taurus; identical to SEQ ID NO: 37082

SEQ ID NO: 76772 - DNA, 201 bp, Bos taurus
ggaggctgcagttattgggaaactcaggtgaatgagccccttgataagaaccagtcatcccaagtctggccaaacgttgctgaggccttttctggcctgcrtgtctaaagcctctcccgtgcctgctgggtagcggtcaggagggctgatgatactactacaccccagccccccatgctaacagcaccccgggaaggtctc

SEQ ID NO: 76773 - DNA, 201 bp, Bos taurus; identical to SEQ ID NO: 37084

SEQ ID NO: 76774 - DNA, 201 bp, Bos taurus; identical to SEQ ID NO: 37087

SEQ ID NO: 76775 - DNA, 201 bp, Bos taurus
ctttgaattcgtttcacgtttattctcaggatacaatattcactctctgcgggagaacgggatgccacaaaggcgggaaaagactaaaacaagttacaacycggcctgaacacactggagatactgcccaggggcgcgagcagcggcctgagagggctctgagcgcaggcagggtcagggtcaggggcgcggggccgccgg

SEQ ID NO: 76776 - DNA, 201 bp, Bos taurus
agtgccttagctcctcagtgttatagcaactctgattggtccaaggaagtaaacagacattgggaggctataataggaggaaagacaatgagaaatcaccragggagaaggcctcgaagtgggcctcgagggggaactggagaccaggaagtgggtctgggtggagggaacggcccccactggtagccatagggtggaggt

SEQ ID NO: 76777 - DNA, 201 bp, Bos taurus
agaagcttctacctttggttgctcctcattggcccccattttggggggtggggcagggcatagcttcctctttcattccttgatgtcccttggtgttgttsccttgaaaggcctaaactccattctgggaaggaaagagcagatgtcaggtcatttgggactaaaggcttgaactggctgttctctggggttccctcctgg

SEQ ID NO: 76778 - DNA, 201 bp, Bos taurus
gacttctttgatagcttaatataatctgtcaataaggaaatctgatttctctacttctaaacaaacactgactgtaagctccctcttcctggcccagttgygactggttacccagtcccagactcttcctctcttgcatcgctcgtgtttgctgcccttttcttccttcccaggtccagcaccaccacctgcatgcggaat

SEQ ID NO: 76779 - DNA, 201 bp, Bos taurus; identical to SEQ ID NO: 37089

SEQ ID NO: 76780 - DNA, 201 bp, Bos taurus; identical to SEQ ID NO: 37090

SEQ ID NO: 76781 - DNA, 201 bp, Bos taurus
gagggctgtgctaccctgcctcagagtgtcccctggaaaatgggatgacaaccctcgcagcagggcagctgcaggccctccattcagtgcccgctgactcygagcctgaggcggggagggctgacgcctcttgtatctcatccaaaggaagctggttacccctggagtggggttaggctgaggcagctgcttcagggcttg

SEQ ID NO: 76782 - DNA, 201 bp, Bos taurus
aatttttttttttttttggcttatttctataaaaacgctaaaggaaattaaaatcaaatggcttctaattatgcacataatgaattgcccctattgaaaaygataaaatgttatgaaacgacatcaaaaccagtgcaaataaaacatacaaatgttttgaagggaaaaggttccaagaaatcctagggtgactcatggttc

SEQ ID NO: 76783 - DNA, 201 bp, Bos taurus
agccctggcttctgagaagtccttctcagcacaccagggggctggaaaagagatgagagaccagagggaggggcctgcttccttgggggccagggatctcrgagagctgctagtttgggcagaggctaaaagtgaggaagagttacaaagaaaatacagtcttgcctggccttaagcaaatcatttctccagaccctgagc

SEQ ID NO: 76784 - DNA, 201 bp, Bos taurus
tctgtatgagatgtgcctatgtttgttgctaactgtcaggtccgattacagctgagtgatgtgtattcctgagcatccattcaggaaagaatatatatgcrggtgtgggttggaatttttgtgtatatcatgaattaattgaaggccaaaacaacaccttatttacttggccagatacacatgggcttcccaggtggctca

SEQ ID NO: 76785 - DNA, 201 bp, Bos taurus; identical to SEQ ID NO: 37097

SEQ ID NO: 76786 - DNA, 201 bp, Bos taurus; identical to SEQ ID NO: 37098

SEQ ID NO: 76787 - DNA, 201 bp, Bos taurus; identical to SEQ ID NO: 37099

SEQ ID NO: 76788 - DNA, 201 bp, Bos taurus; identical to SEQ ID NO: 37100

SEQ ID NO: 76789 - DNA, 201 bp, Bos taurus
atttttgtggtgactttcaaggccagcccggtgtctgtcccctaactacccctcagctctcactatatcccttctaatgtcctgcgttccctcttgcctcraggcctttgcacagactcttctttaagcctgtgtgcgtgctaagtcgcttcagtcatgtctgactctttgcaaccccatggactgtagcccacaaggctc

SEQ ID NO: 76790 - DNA, 201 bp, Bos taurus
aggaaataggagctaatagagtccaagaacaaaggttgtcctttaaatagagatgagatgagctgggacctcattaactactgataacttcctagtgccaygtagataagggaaaaggagcagaaaggggaagtcaaaggtgttagtcaagacggccccctccctcctttcccttcctacccccacggaggggaaaggcca

SEQ ID NO: 76791 - DNA, 201 bp, Bos taurus; identical to SEQ ID NO: 37104

SEQ ID NO: 76792 - DNA, 201 bp, Bos taurus; identical to SEQ ID NO: 37105

SEQ ID NO: 76793 - DNA, 201 bp, Bos taurus; identical to SEQ ID NO: 37106

SEQ ID NO: 76794 - DNA, 201 bp, Bos taurus; identical to SEQ ID NO: 37107

SEQ ID NO: 76795 - DNA, 201 bp, Bos taurus; identical to SEQ ID NO: 37108

SEQ ID NO: 76796 - DNA, 201 bp, Bos taurus; identical to SEQ ID NO: 37109

SEQ ID NO: 76797 - DNA, 201 bp, Bos taurus
gggccttggatcccccaggaaaccctcctcactgctgcagacgagactgggtgtgcctgttctccacagcatcccgcctccccctctgactcagtggcctkagtgatttgcttaacatctcctccccccagcccactggttcacgagacgtccgctgtgcctccccagcagtgagcacagtggccgccgtggaaagaaggg

SEQ ID NO: 76798 - DNA, 201 bp, Bos taurus
tagagccagacaagtttctacctgaactttcactctacctgtgactggatggaggagccagaatagagacttggtaaaggaaaatgccttctcttttctgyttccagaccataaaaggccaagagaaaaggaagtgctgatggtggtggggaagcaccaataagaagagatggtccttgggcagatgggagctccaaaacg

SEQ ID NO: 76799 - DNA, 201 bp, Bos taurus
ctcactcaccctttccaggggcagttttccccccaatatctccaagaagagtggtcccagacaccccccaaccccattccaggcctttagccacctggctsctctttgtccatggtcatggtggtccacccagagagccccaaagcccagaccagcacatctcccaaagctcaaagaccagcagttgcccatggccagcag

SEQ ID NO: 76800 - DNA, 201 bp, Bos taurus
tccatggacagaggagcctggtgggctacatcatccacggggtcacagagagtcggataggactaatgttttcactttcctgagtctggcctcaatcctcrctgctactatttagcgtctttctgcctgttttgtcttcgggggagatgggctgtgactattggcaagcacaaggcctgtcgcgacccatgcctcactccg

SEQ ID NO: 76801 - DNA, 201 bp, Bos taurus
gagttcttcatctactctttgctgccatccaatttgggaaaattattgtgaaaaattatcagatctttgatattattcagaatactttcagtggtttttcmgaggaaaccttaagtggtcttttcagagaggaacaagaatgcaactcacttatgtatctcatagttctagttttcacttaatcttgttcactttatttta

SEQ ID NO: 76802 - DNA, 201 bp, Bos taurus
caggccaggtccaaggaagcacgtggatgggaaactcttacttgccccttgttccccactgatgctccgtcagcccttttagagccagaatccaagggtgkggggagtcttgaacgaacctttaggccacatgttataatttccaattggaagtgagaagaagagactttgttttgggctcacagctcaaggtagaaccag

SEQ ID NO: 76803 - DNA, 201 bp, Bos taurus; identical to SEQ ID NO: 37112

SEQ ID NO: 76804 - DNA, 201 bp, Bos taurus; identical to SEQ ID NO: 37113

SEQ ID NO: 76805 - DNA, 201 bp, Bos taurus; identical to SEQ ID NO: 37114

SEQ ID NO: 76806 - DNA, 201 bp, Bos taurus; identical to SEQ ID NO: 37115

SEQ ID NO: 76807 - DNA, 201 bp, Bos taurus
attccaggcccagtggggagttcacccccaccacccctcccctgctcatacctccagctgctcccctagagcgtgtcctgaggacaaatctttccttgagscaaggagctggccaagactccagcagctccagttctgtggcctccctgatctccttgtccttttgatcaggtgcttagacctttgtccgagtgagatttt

SEQ ID NO: 76808 - DNA, 201 bp, Bos taurus
gtgacttctttccactttcccagcccagcagaagataggctgctttcctaatcttgattagagttaatatatgagaatttgaacatagctgcaaaggaaaraaagaatgagaatcagccctcccaaatcatggtcttgggggaacttttctttgttgtctaaactttttgttttggccagggcatggggccagttttatct

SEQ ID NO: 76809 - DNA, 201 bp, Bos taurus
tgcactctctgcctacactctcagcatccccagggggatcttgctttgaattggagaagcacatctggtccagcaggtggactgagggactagtctcgccyaccttgctatcttgatccaggtgtggcatgaactagtgggcctttgtcacctggaatggtggccccgggggctctgggaaaagttaaaagtttgtctctt

SEQ ID NO: 76810 - DNA, 201 bp, Bos taurus; identical to SEQ ID NO: 37120

SEQ ID NO: 76811 - DNA, 201 bp, Bos taurus; identical to SEQ ID NO: 37122

SEQ ID NO: 76812 - DNA, 201 bp, Bos taurus; identical to SEQ ID NO: 37123

SEQ ID NO: 76813 - DNA, 201 bp, Bos taurus; identical to SEQ ID NO: 37124

SEQ ID NO: 76814 - DNA, 201 bp, Bos taurus; identical to SEQ ID NO: 37125

SEQ ID NO: 76815 - DNA, 201 bp, Bos taurus
tcttctagagctcccttttcttataggcacagagctattacatagtttataccagaagagaaaaaaagaaattttccagttgaaactcaaatggttacatmtgaatgtggaacttaaacttctgtataaacccactgatggaagcctggtaggggctgaacaactcggacttggtcttttatttttttttcttttggtaat

SEQ ID NO: 76816 - DNA, 201 bp, Bos taurus
ctgagaatggtcccctctgaatttttaattatttcctacaatccagtctttggatgccttcaaatttaattcatccatctgcttaaggtaatgataacccrtaaaagcaaagtatcccaaaataaccagcttccacagcacttgtggacacactcaattttccaaatatcaactctatacacatctgttaattgaagtgta

SEQ ID NO: 76817 - DNA, 201 bp, Bos taurus
cctgccttcacacagctcacagtcagaaaaggatgctcaagagcttgaactttcaccattaactctactggggcacagttaacgcctctactttcaagaaygcctttcttcagaggaaattgacacacctcagaagtcttgactccttcaacccccactgacctttgcttcctttgccttattactgttaaacaataaaaa

SEQ ID NO: 76818 - DNA, 201 bp, Bos taurus
cgatgcttattctcaggtggtttttaaacaatatctgatgaatatcctattagtatacttgttggcctgcttattcctttggttttagaggagccagccakaagatagtttttctctattatcttcattctttaaccattttaaaattggagtatagttaacttgcagtgttgtgttagtttcaaatatgcagcaaagtga

SEQ ID NO: 76819 - DNA, 201 bp, Bos taurus; identical to SEQ ID NO: 37127

SEQ ID NO: 76820 - DNA, 201 bp, Bos taurus
tcacagttgaaacagagtctccatgatgcctagttcttgggaaaattttttttttctaagatagtgtattcacactttcaggccactaaggtgccacttaktgcatcacgagacaatgctgtgtcctggaaataacttgggccttagggagaaaataagcccttgagatccaatcagcaggaagcacaggacacaccagtg

SEQ ID NO: 76821 - DNA, 201 bp, Bos taurus
cttctgcacagtgtatcggccttccacattaacacacgatacagcctcattccccactcctttcctgacccggaaccctggccactccccctgcttcaacmctcttttacacatgtctcatttcagggcttcccaacatagtgtgcctgtcttcaggcctctctggcagaagaacagaatgacaggagcacttttattttt

SEQ ID NO: 76822 - DNA, 201 bp, Bos taurus
tttcaagaagctgacaaagagcttgccaactttgtgtggcaaatacaaagttgtatttgagctcaaataccttgagcttgcctgtatcaattgtttgagaygggtagcttgaggttgcttggctttcctatgacagcgatatcaaaaaggggcaggaaaggctgctactcactcaaaggtctatttgagggcaaacatggt

SEQ ID NO: 76823 - DNA, 201 bp, Bos taurus
tggaaatcgcctttctgttaggacgtctccgaatcctcggtttagagattcttatatctggtaggtgtcgaaggggacagcaggaaccacaagcagaaccrcgtggaaccactaacttttggggccaaggacagaattcttctttaggtctggtttggtttgcgaattcctggctgtcatagcaacccccaaagtaaagga

SEQ ID NO: 76824 - DNA, 201 bp, Bos taurus; identical to SEQ ID NO: 37130

SEQ ID NO: 76825 - DNA, 201 bp, Bos taurus
gttttctaaaactggaaaatcaggagctgtgaaaggagcgtcttctaccccactctggagagagagatgatggggttgagctggggcccgactcccctccycatgatagtgcaacttcattcagttctagaatgcagatgcacctgctgctctgacctctcccaagacctcgggagacacgctatgaatctgggcctctct

SEQ ID NO: 76826 - DNA, 201 bp, Bos taurus; identical to SEQ ID NO: 37133

SEQ ID NO: 76827 - DNA, 201 bp, Bos taurus
cgctcttgtaaactgagaagtgagtgtccctcccgactgtgatccacagtcctgatcctgcacagtcgtgggcatggaccctccaggatgccctggccttytcagggtcacagggatgccagaaatgtcagcttcctgcttgagatcagactctaaccttgtgggtccctcaatcagggcctgtgtggtgctgagggctca

SEQ ID NO: 76828 - DNA, 201 bp, Bos taurus
acctcgttacctcactcctgctccggccatggctgtgacgggcccagccagctcctggttccgatgttctgtgtgaagctcaggggtcttgggcattgttktctgttgtaactcgaggccctcagcaggcctgggagcccggattggagccttggctgctggcgagaagcaccttgcctgctaggagtttgatgccggacg

SEQ ID NO: 76829 - DNA, 201 bp, Bos taurus
tagaaagtaaaactttccagaaagaggtaataaatgacattatttgtagatatgaacaccctgaaatgacttggtctatcagatctagccagtcacttagyaaagccttgagagaatgggatgcaaaatgggttgctggggggaaagaggaaaacattccccagcacaacagacatctgggagagtagacctggagaggaa

SEQ ID NO: 76830 - DNA, 201 bp, Bos taurus; identical to SEQ ID NO: 37134

SEQ ID NO: 76831 - DNA, 201 bp, Bos taurus
aggagcttactgtgatcatcaccttctccgggcctccctctgtgtgccttccatctcctctcaatattcacatctgttttccaaggtggtacttttcttcyaagacttccccaataagtaatctctcagtgaccagtgatgatagtaaacgcaccaaaacagttctgtacttctcactgtcttctgtgctttagtgccatt

SEQ ID NO: 76832 - DNA, 201 bp, Bos taurus
caggtagacacagctggactccggtctgactgacccctcccatgaacaaaggaaggcaaataaatcctgtgtaacttggtggttattacggcccaggaagygtgctaaatgctttacatttattctttcatttttacaataaacttgggcacagatgttataatcactgtggtaaaaataaggagactgatgggttagtca

SEQ ID NO: 76833 - DNA, 201 bp, Bos taurus
cagaactggaggactcctgattaagcaaaggccaacgtgcgtgtgtgtgtatgctgggggagatgctgggaaatggaagtatttagttgaccaaggctttkctaggggccctttttctaaaatttctctacatattattgagcatctaaaaaggtacctgagctagcctccctgcttcaggaagaggcattttggggagaa

SEQ ID NO: 76834 - DNA, 201 bp, Bos taurus
cctcagaagtggctgtgttcacttaggaaagtgcttttgatggagacatcttgaaattcccagtcaggtccgaacaccagcaccgaggccagtgtttgtayagaagcttctgcggaaacagtattggggtggaagtgggctgtggggagagtcagctgacttggactccaacacagctattgtggcctcaggctgcactga

SEQ ID NO: 76835 - DNA, 201 bp, Bos taurus
tgtccaggggcacaaagaccgttaccggctgagaacatgaatgaggagaatgggcacaagggcaccaaagttccttttcagaggccagacagagtctcccytcccagcaggctgccagctgaaggcgcttgctatggaattcaacagcctgagtcctgcctagggggcagaactgtcatgggaacatgaaattcaaaaccc

SEQ ID NO: 76836 - DNA, 201 bp, Bos taurus
gctgcccgcacttctctagcccagggtcctggccttaccatgccgtcggaacagttggagcgcggactggaagcgtccgagtcgccgctgtagtgttcgcygctgcggccggggggcaacgggccaggcgcgtaaaaggcagcggcagcgccgggaggcgcggcgtcctggtcgcgaagtagcgcctgcaggccttcgata

SEQ ID NO: 76837 - DNA, 201 bp, Bos taurus
aggacagttatcctgttataacagggcagcatacatggaataaatcaggggaatattgggagtaagctgcttctagtttttgcccttttctgttgaatcartcataaatatagctgtgctgaaggcacctcagagtctgcaacatgtttgacttttagccattaagtcccttgtagcaggacatccagatggatgaagacc

SEQ ID NO: 76838 - DNA, 201 bp, Bos taurus
gctgctggcaggcctgtgggctggtcgggcccgggttggaccttctctggggaaggcacagtctccacgctctcagtcaccagggtatgggcaggaatctkttctgcagctgttctggcctcagctggggggctgctgggactggaagggccctgggcctgtatggactgtgggacccctgtctcagtcatgaccttcgtc

SEQ ID NO: 76839 - DNA, 201 bp, Bos taurus
ctggggtccccggtgtctgactcaacccctgggttagcccctgtttctcttccccaggccccatgcgccccaaagggccccaggcctctgtgtttccaccrccctgctcttcctcatcacaagagtcattacctattaatgccctgagtgtgcaggcggggcgtgctgggcaaggccggggctggactttgtgccccattg

SEQ ID NO: 76840 - DNA, 201 bp, Bos taurus
gctagtaactgtctcattagccaggcggtgaatccatgtgggtataggtggctgtttccacaaccagtgaaattcctgttcctcacttgatcaaatggccyagagcgccatctcaaagtaagaataataacagcactgattattatcagcctccatgtgtcaggctctgtaaggccccatttaatcttcacaataatccag

SEQ ID NO: 76841 - DNA, 201 bp, Bos taurus
ttccgcatttagaaaaaaggaaagttaagcacagaatggtgacttgtcctatgcgacataagcggtagaggcaggactggggacttgtcttttaaacacasctatattactactggtaatagcactactggaatatacatatatattctctggtgaaggacagggaaaactggtgagccgcagtccatggggtcgaaaaga

SEQ ID NO: 76842 - DNA, 201 bp, Bos taurus
catgtgaccctgggccagccactgaaccatgatgaaactccatttcctcatgtataaaactggtctaataatggtgtgcttctcactgggtgttgtgagcrttgtacctggtgaacactgggccctgccccttgcttccctgtaagatcaggtctcaaactcagcagcccaattttaaggtccattttgctgctcccagca

SEQ ID NO: 76843 - DNA, 201 bp, Bos taurus
atgggtgtggtttgtccaggaaagctgcttcctgcattccaacctggcctcccgggcactaacacacttgtcaaggtgcagctgtggggagcaggagcaamttctgttgccatggaaaccactggcctttccctctcaaggagctctttagatcctggcctgtgatgtgccaacacctgtggtggttactggggagtttgg

SEQ ID NO: 76844 - DNA, 201 bp, Bos taurus
agagccatgaccatagaagccaggtcacctattagaccatctgtcctggcttagggacctaatctgttctgctgactctggggctgatctaaatcagaccratttttctccccttccctatataaccaaagtttatatgatactcccctcaaaatgaagaataagggaaatgtccaggaagatgcttacctggatgtagaa

SEQ ID NO: 76845 - DNA, 201 bp, Bos taurus; identical to SEQ ID NO: 37137

SEQ ID NO: 76846 - DNA, 201 bp, Bos taurus; identical to SEQ ID NO: 37138

SEQ ID NO: 76847 - DNA, 201 bp, Bos taurus
tgggccaggagtgtggatgggctcataggcattgcagttacgatctggatggtatccaaagtaaatattttgccattagctttctcatcaatttgataatygttgttggcttcaaggggccaatctgtagattttttttgaaagcgtatttgaatttttcagttctacatcttattgtgtagttccttctcatcaaaagca

SEQ ID NO: 76848 - DNA, 201 bp, Bos taurus; identical to SEQ ID NO: 37141

SEQ ID NO: 76849 - DNA, 201 bp, Bos taurus; identical to SEQ ID NO: 37144

SEQ ID NO: 76850 - DNA, 201 bp, Bos taurus
acttagcaatcataatttttgttacgttcccctaaagaaaatctcccgcttaaaaattttgacaggaggaatgtgtagggacaatgaaagtgaggggaccygtttggggacctatcgatggactctgtgtaaacataggctgtctcttctaattcttgcctcactgctcagggaacaagtcggggttatttttcttccttt

SEQ ID NO: 76851 - DNA, 201 bp, Bos taurus
aggactggcctgggagtggcaggtgaggccacctggagaagtccacatcctcttgtatgatcccatcggttcttgtggggaatttgccttggaggcattcraaattctaaggaagcagcatggatgggtgtgggtggcagcgtctcagcggcaccaatgtttactttgaagagaaaatgtctgctttgtaggcaaatgttt

SEQ ID NO: 76852 - DNA, 201 bp, Bos taurus
atgatctttccccacccccatttcattatttcttctttgggtctggagtgatataaggaagatagacagagatctatctttctaaaccttagcagattgcrttgactgaagcttctactgactccaagggagcaaattgtaatgggtaaatagttacaaagcaatcccagggaggaaacattcatagaaactttataaatg

SEQ ID NO: 76853 - DNA, 201 bp, Bos taurus
tagcttcaagataaatccatcttttcctgggccccacctatgatcagaatctcagaagggtggaaatgtgtgtggattttgttttgtttcagaatttctcyagatgagtcttaatggccaatccctgggctcaaccccacctttgggaactgctgtccggaatctcttgttttcgtcctgcctgtctgcttaacgcctcaa

SEQ ID NO: 76854 - DNA, 201 bp, Bos taurus; identical to SEQ ID NO: 37146

SEQ ID NO: 76855 - DNA, 201 bp, Bos taurus
agcttaacagaaccaatggctgcacacatatcccatcctccatctctcatcaccaccctccactcccatcccacactgcaatactctggctaacttgttcragacatgaaggatggtacataaactgaatgcttgcaggacaacatattcctatctcttacgctggccaagataatggttaggcaccaatgtacagaaaga

SEQ ID NO: 76856 - DNA, 201 bp, Bos taurus
gacatgtagttaccggagacaccgtcctactttatagaaacagtcgaaggctcgctgtgcagggtgatgcaggcactggagagtcagagatacaaggttcygctactctgaggggcccattggcagaacctggagatcagtgaaacaaagtttaaaacaaggactttcaagcttttcctgaggagtctacaatccacggca

SEQ ID NO: 76857 - DNA, 201 bp, Bos taurus; identical to SEQ ID NO: 37149

SEQ ID NO: 76858 - DNA, 201 bp, Bos taurus; identical to SEQ ID NO: 37150

SEQ ID NO: 76859 - DNA, 201 bp, Bos taurus; identical to SEQ ID NO: 37151

SEQ ID NO: 76860 - DNA, 201 bp, Bos taurus
cattttccttggcacctttgcaagatcgttctctctttactgttgtcctgagatggttcaggcagggctggacacaatcacaaacaattcatgatcaatcrtggaggtataaaattcccaaagttcacttcataaatcaggaatgcattcagaggagaatggttttgtatcccacactaggagatcctagattttagagga

SEQ ID NO: 76861 - DNA, 201 bp, Bos taurus; identical to SEQ ID NO: 37154

SEQ ID NO: 76862 - DNA, 201 bp, Bos taurus; identical to SEQ ID NO: 37155

SEQ ID NO: 76863 - DNA, 201 bp, Bos taurus; identical to SEQ ID NO: 37157

SEQ ID NO: 76864 - DNA, 201 bp, Bos taurus
aatatcatccacaaattcccttctcttacatatcagttggttttatttgctcatgttcccgtcccatatgcaaagaggagttttacatgattgtgtttatrcctatgttaggctattacgattcccaggaatcattctcacataggaagaacccccagagaatctggctttgaatgtagaaattccacaggattgggggaa

SEQ ID NO: 76865 - DNA, 201 bp, Bos taurus; identical to SEQ ID NO: 37158

SEQ ID NO: 76866 - DNA, 201 bp, Bos taurus
actggccagaagaagaagagttgaagccaagagcactagatttaagcctgaaggagatttttaaaaattaggtgtctgtggctataggagttattggcagygaccaacacaggcctcaggcaaaatagagaagaaagcagattcctagcaacccctccagagaactgagcaagccctgtgatgctctgtggctgggttaag

SEQ ID NO: 76867 - DNA, 201 bp, Bos taurus
gatacagttagttaaaatgaggcataatggtattagggtgggccctggatccaatataacacatgtgttgttataagagggaaagttgaacacagacacasagagagagagaagatggccacataaatgtggagacaggaatggaagtcctgctgctgaaagtcaagcaatgcctggggctaccagaccctggaaaaagca

SEQ ID NO: 76868 - DNA, 201 bp, Bos taurus; identical to SEQ ID NO: 37161

SEQ ID NO: 76869 - DNA, 201 bp, Bos taurus; identical to SEQ ID NO: 37164

SEQ ID NO: 76870 - DNA, 201 bp, Bos taurus; identical to SEQ ID NO: 37165

SEQ ID NO: 76871 - DNA, 201 bp, Bos taurus; identical to SEQ ID NO: 37166

SEQ ID NO: 76872 - DNA, 201 bp, Bos taurus; identical to SEQ ID NO: 37168

SEQ ID NO: 76873 - DNA, 201 bp, Bos taurus
cgtgtgctgggccattgtgaaacaagtctcattcttcagagtttggtcccattgcaaggagctggcaacgtgggcactcatgaaatattaacatgttacaytgatttttttttttataagtgtggccaacagtggatcaattatattagtatgaaaagcttttcataattcatttggggagcatcaagatctcatttccag

SEQ ID NO: 76874 - DNA, 201 bp, Bos taurus
gagtcatgtcaatgtatggcaaaaccactacagtattgtaaaagtaattagcttccaattaaaaagaaaaaaaaaaaaaaaaaaaaaccctttccctcttyctggaggaaatcttgcctttcaataaacagggcccttgtcccaactaagagagccgaaactgttgggggccgggggcggtgtgggggctgcggagcaggg

SEQ ID NO: 76875 - DNA, 201 bp, Bos taurus; identical to SEQ ID NO: 37169

SEQ ID NO: 76876 - DNA, 201 bp, Bos taurus; identical to SEQ ID NO: 37170

SEQ ID NO: 76877 - DNA, 201 bp, Bos taurus; identical to SEQ ID NO: 37171

SEQ ID NO: 76878 - DNA, 201 bp, Bos taurus
tgtgaagaaatatagcaataaatcagccctctgtgagctcaggagagaggcctgtaacagatcctccccttgcagctctcagaaagaaccaagatacccaycccttggtctcagacttgtggcctccaaaactgggagcaaataaatttctgttgcctaaaaacaaatgaaaaaaaacaattccatctttcctattttccg

SEQ ID NO: 76879 - DNA, 201 bp, Bos taurus
tttttttttttctgtttttctcatggttagactggagatttgggagaggaagaccacagaggtgaagtgccctttcattgcctcctatcaagggttcacgytatggatgggagttatcactggagacgcaaccttgatttggccaaagtagtgtctgcgtgaggttcctccataccctgatcactggaagccagtcactaa

SEQ ID NO: 76880 - DNA, 201 bp, Bos taurus
aaacaaacatggttaagaaatttttacttcagtaaaaagtactaaaaatgcaactctgaaactgcaacttccctgaaaagagagactgaaaaacaaacacrgctaagaaatttttactttcagtaaaaagtactaaaaatacaactttgaaattgcaacttccctgaaaggaggaattcatattcttaaaattagagaaaa

SEQ ID NO: 76881 - DNA, 201 bp, Bos taurus
ggtatctgtatatgctcttagaatgtttttgtcttttgcctactgtctaaacggactgtttgggttttttattacagtgtttcgagatgtctttatgtatyctaaatactagtcctctgtcagatatgtgctttccaaataatttctcccagtctgtagcttctctttttatcttcctcactttggctttcaaagggcaaa

SEQ ID NO: 76882 - DNA, 201 bp, Bos taurus; identical to SEQ ID NO: 37178

SEQ ID NO: 76883 - DNA, 201 bp, Bos taurus
acaggtactaactaactaggtctttcatgaaaataaagtggcatgatgtgaactttccaaaagctgggggctacctgtatatggtttaattctgggccttygataagtcagacactgaaatgagaaagatcacccccttcctggagaatctcaggaagtaacagacagctgtactgagtggaactgtgtgcgatctgtgcc

SEQ ID NO: 76884 - DNA, 201 bp, Bos taurus; identical to SEQ ID NO: 37180

SEQ ID NO: 76885 - DNA, 201 bp, Bos taurus; identical to SEQ ID NO: 37181

SEQ ID NO: 76886 - DNA, 201 bp, Bos taurus
ctcaacaactcctccttgcatgcacgtatgcatgctgaaaaaaaaaaataatcgtacgacagtatttcaaggacatttgaacatggtagtcaaagggctcrgtttagttgggaaatccctgcaagaacatttttagagggtagtgcgtccagccgcgatacacagccatgattgaagcaggctgctccagcttactcttcc

SEQ ID NO: 76887 - DNA, 201 bp, Bos taurus; identical to SEQ ID NO: 37182

SEQ ID NO: 76888 - DNA, 201 bp, Bos taurus; identical to SEQ ID NO: 37183

SEQ ID NO: 76889 - DNA, 201 bp, Bos taurus; identical to SEQ ID NO: 37184

SEQ ID NO: 76890 - DNA, 201 bp, Bos taurus
ctaataaaaaaagtatataaagtaccaaagtttgcaaattatttccttatttaaaaaattagagtggatgcaatattatcactataataacattcttagtracttgcattcatatatgcttttttactttggaaagaaaggaatactaggaatcgcacatgaagactgtatcatctaagttgccattaagaatttctttgg

SEQ ID NO: 76891 - DNA, 201 bp, Bos taurus; identical to SEQ ID NO: 37187

SEQ ID NO: 76892 - DNA, 201 bp, Bos taurus; identical to SEQ ID NO: 37188

SEQ ID NO: 76893 - DNA, 201 bp, Bos taurus; identical to SEQ ID NO: 37189

SEQ ID NO: 76894 - DNA, 201 bp, Bos taurus; identical to SEQ ID NO: 37190

SEQ ID NO: 76895 - DNA, 201 bp, Bos taurus
gtggctctgacctcaaccttggaaccagagggtccccaaaaaaagcggggtaatcctgtaaaaggctgatattctagacccctgtacaggcccctttgcaktgttccttgctcactgttatgcagggtgaccaactgagctgcaagccacccctccctcggaggctctagaatggcaaggaagggcccagctgcaggtgcg

SEQ ID NO: 76896 - DNA, 201 bp, Bos taurus; identical to SEQ ID NO: 37191

SEQ ID NO: 76897 - DNA, 201 bp, Bos taurus
gtgagaatgaaaacaaactgtcatggaattatctcctcatctctgagtcagccagctgaccctaaaactggcacactgccctcttgtaatatggagaatayagagtcttcttgagtggtgtctgtgcattatgacaagagaacccccaaaatgtcatgccaaaccagagacctacctggttctgcaaaccaggcaggaaag

SEQ ID NO: 76898 - DNA, 201 bp, Bos taurus; identical to SEQ ID NO: 37192

SEQ ID NO: 76899 - DNA, 201 bp, Bos taurus; identical to SEQ ID NO: 37194

SEQ ID NO: 76900 - DNA, 201 bp, Bos taurus; identical to SEQ ID NO: 37195

SEQ ID NO: 76901 - DNA, 201 bp, Bos taurus
tattcacatgatctttttcatttaggacggcttgtatggctgtacatgggtcggcagtggtgtgcctcaaggacaggggctctgggtgcagcagacatggrtatcacataagcactcttgaaggaggtcgccattaaccctaccatagagctgccagaacttaactggactgggaaatagactattgcagggcacaacaga

SEQ ID NO: 76902 - DNA, 201 bp, Bos taurus; identical to SEQ ID NO: 37196

SEQ ID NO: 76903 - DNA, 201 bp, Bos taurus; identical to SEQ ID NO: 37199

SEQ ID NO: 76904 - DNA, 201 bp, Bos taurus; identical to SEQ ID NO: 37200

SEQ ID NO: 76905 - DNA, 201 bp, Bos taurus; identical to SEQ ID NO: 37203

SEQ ID NO: 76906 - DNA, 201 bp, Bos taurus
gctgtttgacattttggcctcaaggtctaccacaccttgacaatagtatatctctttttcttagttcatattctcaagagaaaatgtggtcagccaataaygaattgtttctcttgggttggccaaaaagtttgtttggatttctccataccatcttaagaaaaacccaaatgacattttggccatcccgatacttgggtc

SEQ ID NO: 76907 - DNA, 201 bp, Bos taurus
ggaggagacatcaccagctctactagagaaaaagccagccatggacgtcagggagcggggctggggagaaggctatctgcggtttaggccggtgggcttcytagagttaggatgagctgggcttcctagctcaatcttaaaacctattcccatgacagctcgtcgggcctttagtgggaggcgggggtgggggcggagcat

SEQ ID NO: 76908 - DNA, 201 bp, Bos taurus
tagccattcatataccatatgtggcagttcaaataatgttagttaattcgtaaaagaggtaatcgtgtttgaataatgctccagatcaccttaaatcagtktagcagttttacttgctaaatgaacaagtctaaatatgactttatctgctaagtagctttcagtcccatttgggatttttaagtgcatttttttaactgt

SEQ ID NO: 76909 - DNA, 201 bp, Bos taurus
gtcacattcctgatacaaggtagaatcggaaacgtgcagagaaatgcagtgagttctaccctctggtgagcattggagcccatgaggggcggggccttatygatgacgtggtatgagtgaacgctgctgctctgtgatgaacctggaggtgcctggactccaggtcaacggagtcaggcctccttttgaccccgagttgcc

SEQ ID NO: 76910 - DNA, 201 bp, Bos taurus
gctcaaggccattccccagttttgcttccctgatgccaaggactggctccctgtgtcagagtacagcaggtgaggcccagtctggcagaatctcctccacyctgtcatagcgggcggctggctgggcccactctagtcccagcctcttctcctgtagcagcctggtccttcaccccctccctgggatggcagccccttctt

SEQ ID NO: 76911 - DNA, 201 bp, Bos taurus
aaccactcactatttgtcgaagttgatcctgtgatgatgcatgccaccagcattacctcggcctcccgggtgtttccggtgtttgcctgcaggaacacatractacatggctaaaatagccttctccagcccgtcaatactattgtagcaaaagcatttccccatacttctgggccttggctttatatctcttccagcaat

SEQ ID NO: 76912 - DNA, 201 bp, Bos taurus; identical to SEQ ID NO: 37208

SEQ ID NO: 76913 - DNA, 201 bp, Bos taurus; identical to SEQ ID NO: 37211

SEQ ID NO: 76914 - DNA, 201 bp, Bos taurus
aagaggaatgagagtagatggcggtctgcaggggaacccaaggatggcatttttccccacacctccttcctgagctggccgggttgggctggggcaccggytgcttgaagccatctggaggagtgagccacatccaaggttgtctatagaaaagcctcaagtcaccagagacatagattgcaaatgccaaggccaaaggag

SEQ ID NO: 76915 - DNA, 201 bp, Bos taurus; identical to SEQ ID NO: 37213

SEQ ID NO: 76916 - DNA, 201 bp, Bos taurus
ggacgaggccactcccaacaaagagaagaggcccggtaagtgtgtccaaatggaacaaagctctttgaactgcagttctagttatgagcatggcacacttrgtgtaggagggcctcacagacagcctggcaaatgaatagctatagaccttatgggggcctcaaatccccactcacctcatcttctgactcattgtgtggc

SEQ ID NO: 76917 - DNA, 201 bp, Bos taurus
taaaattatggcaaagaaaagtggatttacatacattctgactatgctgagaggtctatgtgatgttactgctggactgaactttatttaaatttaataartggtaaagactgtttgcatttcttggtatgaatatgcttaatttttgagttctgcaaatttgataatatagtagaacatctttatatattaatggtttta

SEQ ID NO: 76918 - DNA, 201 bp, Bos taurus
taatttgtccaagtattcaaaattatttggtggctggatgggattagaacacacgtttcttggacttcagagttcatgcttttggcccctgtgcttgcttwactgtatcttgcatgatagaaacacaggacccagaaatatgctcaaatcagtttatgggcccaagcatttctcttgtggccatgcactgagctgttgttg

SEQ ID NO: 76919 - DNA, 201 bp, Bos taurus; identical to SEQ ID NO: 37214

SEQ ID NO: 76920 - DNA, 201 bp, Bos taurus
agtagaagagaatgaacacacaatctgagcactttctaatgaggtggctctgctgggaaagaccttgttgaaaaagaaaatactcagttattgattgcctrtgtgacatccacaaattgctcctgtttgcctttatcatcagctttggcttttagagtcttccccaccaccatgtgttatcttctgcctaatgtactatca

SEQ ID NO: 76921 - DNA, 201 bp, Bos taurus; identical to SEQ ID NO: 37215

SEQ ID NO: 76922 - DNA, 201 bp, Bos taurus; identical to SEQ ID NO: 37217

SEQ ID NO: 76923 - DNA, 201 bp, Bos taurus; identical to SEQ ID NO: 37218

SEQ ID NO: 76924 - DNA, 201 bp, Bos taurus; identical to SEQ ID NO: 37219

SEQ ID NO: 76925 - DNA, 201 bp, Bos taurus; identical to SEQ ID NO: 37220

SEQ ID NO: 76926 - DNA, 201 bp, Bos taurus; identical to SEQ ID NO: 37221

SEQ ID NO: 76927 - DNA, 201 bp, Bos taurus; identical to SEQ ID NO: 37224

SEQ ID NO: 76928 - DNA, 201 bp, Bos taurus; identical to SEQ ID NO: 37225

SEQ ID NO: 76929 - DNA, 201 bp, Bos taurus; identical to SEQ ID NO: 37226

SEQ ID NO: 76930 - DNA, 201 bp, Bos taurus; identical to SEQ ID NO: 37229

SEQ ID NO: 76931 - DNA, 201 bp, Bos taurus; identical to SEQ ID NO: 37230

SEQ ID NO: 76932 - DNA, 201 bp, Bos taurus
atgacacttatcacattgtaggttatatatttacaagtctgattcccaccctagtctgagaacttgtaaaggacagggagtgtgtctgtttcagcattgtktctccagtaactgttttaagggccttgtccagagtgcccaggaaatttgattgcttgataggttgatcagctgattgaatggttcattcacctactcagt

SEQ ID NO: 76933 - DNA, 201 bp, Bos taurus; identical to SEQ ID NO: 37232

SEQ ID NO: 76934 - DNA, 201 bp, Bos taurus; identical to SEQ ID NO: 37233

SEQ ID NO: 76935 - DNA, 201 bp, Bos taurus; identical to SEQ ID NO: 37234

SEQ ID NO: 76936 - DNA, 201 bp, Bos taurus
tcaggatgaagtgggagccacatgtgcttagggccttggccacagctccctgtgccttgagtctcagcacagccctcagtatgaaggtgtaggagaggaakatgaggaggaggtcagatcccaacagagtccagcctccagcaaattggtagagacgattgatggtaatatcattacaggagagcctggagacagacatat

SEQ ID NO: 76937 - DNA, 201 bp, Bos taurus
ctatatcaggccctattgaaagttttcatctccttttcattccaggctcctggactcacctttcttcattgtctccttcttacaattttcctggcctcaayttgggacttaccagcttccgaagtttgcactgcctctatttctggttgttggaaaaaggacccgaactggcctcttcaaaggctctagaggctgatttta

SEQ ID NO: 76938 - DNA, 201 bp, Bos taurus; identical to SEQ ID NO: 37236

SEQ ID NO: 76939 - DNA, 201 bp, Bos taurus; identical to SEQ ID NO: 37237

SEQ ID NO: 76940 - DNA, 201 bp, Bos taurus
caaagccagcaaatgagcttcccatcctcctcacagaaaagctggagtttctctccatggtgcacacaaagaatcaccttcagctgcttccctgagcccamcaccacctccctgagcctctcggctatgttggccaggtgccgattgggccgcaggttcccaagccagtagctggtctggcacacaggacacctgctctgc

SEQ ID NO: 76941 - DNA, 201 bp, Bos taurus
aaaggaattaatttcattgacagttggtcctaggaatcaaatgtgatattttgttctcagggaatgacaatccacatgatggccactttgaatttgatcarttttaatccagactccttcattttgatggggatcccagaactggagcagttccacatcttgtttgggattcctttcttctccatctaccttgtggccctt

SEQ ID NO: 76942 - DNA, 201 bp, Bos taurus
taacttgtaatattaatatatctgttatttcagcaatatttattgagccctaaggtagatattagcagtagcaaggtagatattgaagttagctctgtgaycaaacaggataacaaatatttgtccataaggagcttgcatcctaaaacctttattttccatttacaattacttgattaaaatagaatttcaagtgtggta

SEQ ID NO: 76943 - DNA, 201 bp, Bos taurus
accaaaactcattaagtgtctaaactgcctcagatcctacagtaggtactggattaacaaaggcgaataaaatacaatccctaatttaaagggcagtttarcctaactagggagatatacaagaaatacagattcgaaatatgttgaaatgagaatataagaaatccagcttatttatcaaaagcttctgggatcatagaa

SEQ ID NO: 76944 - DNA, 201 bp, Bos taurus; identical to SEQ ID NO: 37244

SEQ ID NO: 76945 - DNA, 201 bp, Bos taurus
attcaggtaatttttgtactaaccaagataatatgaaatggatgacaataaaataagtttatacaaccagaaatatgagcacagagttaacactttattaytgagggaagagatatgaaatcatagggcagtcaacagaaaggggtcatgtagacctgatatctgataacccactagctcagaaagaagaaaacaaaattt

SEQ ID NO: 76946 - DNA, 201 bp, Bos taurus; identical to SEQ ID NO: 37246

SEQ ID NO: 76947 - DNA, 201 bp, Bos taurus; identical to SEQ ID NO: 37247

SEQ ID NO: 76948 - DNA, 201 bp, Bos taurus
acatttattaagaactaaatctttaatctatttcagtcatttattttctgataatcatagagaagttatactatctcctaaatggtatatttgttttcatkacatataggttgttgtatgtacattcttggaacagttaataatacaaagtaaaagctgagaaatggaaaataattaatgaaagagcctacatggtataaa

SEQ ID NO: 76949 - DNA, 201 bp, Bos taurus
gcaggctgcccaaggtggcctcatgaggtttttatctctttcagtggaaactccatgaggctctggaacatctgaagaaagagcaggaagaggcctggaarctggaagttggtgagaggaaacgaactgccaactggaaggcaagttgccccctgaggaaaagagtctgtatggtccctgtgttgtcctgaagctggcttc

SEQ ID NO: 76950 - DNA, 201 bp, Bos taurus
agaaggaaggccccaggtttctctgtgcaacccttggaagaaactggctatttccagtacctgaataaagaggggacacagaagaaaaaaagtcaaagagrtagggccatggcctccctttgactgtgaactaaactcatccaatcatccagacaagaggtgactactgtaatgaacagagctgagagctctgtggacatc

SEQ ID NO: 76951 - DNA, 201 bp, Bos taurus; identical to SEQ ID NO: 37248

SEQ ID NO: 76952 - DNA, 201 bp, Bos taurus
aagctggcgtgctgcaattactgaagcctgcccacctagagctggtgcttcaaaccaagagaaacctgcacactgcaaggaagaaaatccacacagagcakggaagacccagcacattcaaaaataaagaaaaagaataagcttaatcacagaagtgagaaaaggcagaaacaaaggaaaactgtctaacaaaactaaata

SEQ ID NO: 76953 - DNA, 201 bp, Bos taurus
ggccagggtggggcagggatggaaaggcaaacagggaagatttcttgcagaaggaggaggaagggaagtcagagtgtgtttgggagaagggaaaggtggaytgtgatgaggagtggccttgccagggcctgatgggaagggaagtttgcggtgtgagggtctgtctacctggaggcctcactgtggtgtcttttgcagaga

SEQ ID NO: 76954 - DNA, 201 bp, Bos taurus; identical to SEQ ID NO: 37259

SEQ ID NO: 76955 - DNA, 201 bp, Bos taurus; identical to SEQ ID NO: 37260

SEQ ID NO: 76956 - DNA, 201 bp, Bos taurus; identical to SEQ ID NO: 37262

SEQ ID NO: 76957 - DNA, 201 bp, Bos taurus
agtgcttggcagtcctgtgctgagcgccgatacaggtcagcctggaggctgaggctgtcaccagggtaccctgggtccacaggcttttgccagcctctgtytcaggatgaacgtatgtgctgggggctaagggcggtcagttttgctcccctccttgccatcctctccctgcagtcactgggcctgggaggcgtcatgctg

SEQ ID NO: 76958 - DNA, 201 bp, Bos taurus
actcgccctcctcagctgctccccctcccaaggccagggctacccacagggctcacctcctgtcctgccatgaggattaccggccacacggtgggcactcrgcagatgcagcctccatcattcatggctcccctgcactcctgtatcacacaccttagccccggcccctgacccggagatgcagcgtatctgtaggtatcg

SEQ ID NO: 76959 - DNA, 201 bp, Bos taurus; identical to SEQ ID NO: 37268

SEQ ID NO: 76960 - DNA, 201 bp, Bos taurus; identical to SEQ ID NO: 37270

SEQ ID NO: 76961 - DNA, 201 bp, Bos taurus
atgatgatgagagcatatgtccctttgcattccagttctatagcaatggtcaccctctcaactcccttcccactcccaaatgtcagagacaaaataatagratgggtaatgcacttctatggaggaaaaatggaaagcaatggcaactgttgtgagctggagtactcatccacctaaaagaagaatcattcattcagttcc

SEQ ID NO: 76962 - DNA, 201 bp, Bos taurus; identical to SEQ ID NO: 37272

SEQ ID NO: 76963 - DNA, 201 bp, Bos taurus
ggccatgtatggagccatttttggttgtcacaaatgggggaggagtgctactagcatttggtggacagagaccagggatgccgctgaatatcctacgatgygcagataggcccccacagacaaaacccatgctcaggcgtcaaaggtgccgaggctgagagaaactgctccagggcaaagcagagctccttcttctctttc

SEQ ID NO: 76964 - DNA, 201 bp, Bos taurus
taagcaggggagtaaaatattcaggttagtgttttagaaagatcattactgctggtccacagaagaaggaatggacagagagagacaaacaggtaggacartcgtcgagctatctggaacaggaacgagggcctgaatgaaagcagtggcaatggagtagagataagataatttattccagagataattaagtttgtagca

SEQ ID NO: 76965 - DNA, 201 bp, Bos taurus
aaatctatttctccaaaattgggtaattggaatttttttaacctgacaagactttcttgtcatgttacttgatgtcagatttgaggaaacacttttgattrgttaggaaaaacttcttcctttatactatgaaatagttacttttagagaagaaacatttaagtaataaatagctcttttaaaagcatggtccacttatat

SEQ ID NO: 76966 - DNA, 201 bp, Bos taurus; identical to SEQ ID NO: 37274

SEQ ID NO: 76967 - DNA, 201 bp, Bos taurus; identical to SEQ ID NO: 37275

SEQ ID NO: 76968 - DNA, 201 bp, Bos taurus
gagcactcagtctggtttggggttttacctacctcagagaaaaaagacactggccacttccactactctgccttccaaaacaacatcactgtgtgtgtacrtggctcagatatccttagtctacagcttagaaaaaccgccaaagacagccttgcatcctagtctctgaaaaaacacgtcattccttttaaacaaagctcc

SEQ ID NO: 76969 - DNA, 201 bp, Bos taurus; identical to SEQ ID NO: 37277

SEQ ID NO: 76970 - DNA, 201 bp, Bos taurus
tgctgcttgacaggcagggagcaggttctgaccaggaaaataattcctgctgaaacccatcatcctgtgacacttcccactggcccgagccttggtccccytctgctgagaggcagcctcttgtagcttctgcagtcactggttttggattccaggcctggctcttcatttagaactctgtgaccttgggcaaggcactca

SEQ ID NO: 76971 - DNA, 201 bp, Bos taurus
cccagccctcctcggggatccaaggaggatgagttttgtgagcaccttggtgtctcaacagctctggtggctggagtctgcccttctcattccaggagtgkctgtgtcaggagtgggtcaagggccagtgggcaggtgggaggctggcacgagggcagacgcaaggccactcacccacacagcggggacagcactgctgcg

SEQ ID NO: 76972 - DNA, 201 bp, Bos taurus
agttacacaaagctgtggtccatgtgatcagattggtttgttttccctgggggtagagagcttaaataggaagtgaaaatcacaaatcagaaaggaaaggmtcatttataccaccatttacacaaaataaacttatgcatgacaaaagcagcaaagacaaaacttaaagacacaatctgggaaaagatattcactaagtat

SEQ ID NO: 76973 - DNA, 201 bp, Bos taurus
ccgagggacgcatggaagttggcccacagctgcacagccccccgcccaaggcagtaggatccattccttccatgttggccaactgaggctgttcagtcttmtctaagaagctgtgagttttccccactgtatcatccagcagctatcatgtcatccttcctgcgctgccggagcgcacggcatgggcctctctttggtcct

SEQ ID NO: 76974 - DNA, 201 bp, Bos taurus; identical to SEQ ID NO: 37278

SEQ ID NO: 76975 - DNA, 201 bp, Bos taurus; identical to SEQ ID NO: 37280

SEQ ID NO: 76976 - DNA, 201 bp, Bos taurus; identical to SEQ ID NO: 37281

SEQ ID NO: 76977 - DNA, 201 bp, Bos taurus; identical to SEQ ID NO: 37282

SEQ ID NO: 76978 - DNA, 201 bp, Bos taurus; identical to SEQ ID NO: 37283

SEQ ID NO: 76979 - DNA, 201 bp, Bos taurus; identical to SEQ ID NO: 37285

SEQ ID NO: 76980 - DNA, 201 bp, Bos taurus; identical to SEQ ID NO: 37286

SEQ ID NO: 76981 - DNA, 201 bp, Bos taurus; identical to SEQ ID NO: 37287

SEQ ID NO: 76982 - DNA, 201 bp, Bos taurus; identical to SEQ ID NO: 37289

SEQ ID NO: 76983 - DNA, 201 bp, Bos taurus; identical to SEQ ID NO: 37290

SEQ ID NO: 76984 - DNA, 201 bp, Bos taurus; identical to SEQ ID NO: 37291

SEQ ID NO: 76985 - DNA, 201 bp, Bos taurus; identical to SEQ ID NO: 37292

SEQ ID NO: 76986 - DNA, 201 bp, Bos taurus; identical to SEQ ID NO: 37293

SEQ ID NO: 76987 - DNA, 201 bp, Bos taurus; identical to SEQ ID NO: 37294

SEQ ID NO: 76988 - DNA, 201 bp, Bos taurus
gtgaatttctttactttaagaagcaatattaaaagaaaaaaacacttttcttttgtacttatttatttcctggctacacaaaatgccccattttcggaacrttctccctattccctagatttctatttaatagcatcacacagttgtaatagtaatggtaataataagaagcacatttataatattttatatagtttttac

SEQ ID NO: 76989 - DNA, 201 bp, Bos taurus
tatcatgtttattaaaattcacattccgtgggacacactgtgcaagtatgcagagagactgaatattaggatgcccttcaggtactttcaggttttgtttygttctatctcagaatatgttaaggtgagcctgtttttttgcaaagccagagagtaataaatgtaattctttctgcagaagaaatgcttttttcccccaag

SEQ ID NO: 76990 - DNA, 201 bp, Bos taurus
gatatctttggatataaaaaaaaaagctaaattcccctactgggtggaattttatgagctctgtgggagaatttctttgtggtccttttctctactgtacmtaatatatgctgatgattgttgtgaaaaactattcttattgcatttttcaaaagcccaagtcttaacatcaacagtcttagaagtttagaaccatctaga

SEQ ID NO: 76991 - DNA, 201 bp, Bos taurus
tgcttggtaggatttaaagtgcaggcactcccttatcagagtctttcccaaccagagagcagaaatactgacgaaggcaaaagtttgacagagaagactastgtttttgatattgataggcttctctggtggctcagacaatctgcctgcaatgcagaagacccgggtttgacccctgggtcagcaagatcctctaaagaa

SEQ ID NO: 76992 - DNA, 201 bp, Bos taurus; identical to SEQ ID NO: 37295

SEQ ID NO: 76993 - DNA, 201 bp, Bos taurus
ttggcacctattaaataaactaattcaacaatctttattgaatacctgtgggagctccagggaagttccctactttcataggtcttacattctaaagtggyatgtgacccatcactgttgatatttagctgagatcccattctaggtattttttctagaactgttcggaaagaggtgtgctgtcttccactgagtccctgt

SEQ ID NO: 76994 - DNA, 201 bp, Bos taurus; identical to SEQ ID NO: 37296

SEQ ID NO: 76995 - DNA, 201 bp, Bos taurus
ttattttaaaaaagacacaagcagctctacaaagatactctatctcactagtagttgggaaactggaaattagaacaacaatgagatattgtgtcggccakactggcagaattcttttgtgaatagtgacatcaaatgatgagtcagaagtgaggaaatggatactcttacccagatgagtcagaaaaacaaggctgttga

SEQ ID NO: 76996 - DNA, 201 bp, Bos taurus
atctgtgaaagccctatccctgaaaataaactgatcaggctaggggagggggtcccccttatttatttagtcccagccctaaggctaaactggtggcctgrcagctcagagtgtttttctctgagctgaaaagccaactccaagtgctggggtgagcaggttaggaaacttgagaaccacacagacatcagggaaaattcc

SEQ ID NO: 76997 - DNA, 201 bp, Bos taurus; identical to SEQ ID NO: 37300

SEQ ID NO: 76998 - DNA, 201 bp, Bos taurus; identical to SEQ ID NO: 37301

SEQ ID NO: 76999 - DNA, 201 bp, Bos taurus
aaaattgggaagggaagggatggacctggaatatagtagctactcagaaaattgttgaatggatgaaagcagaatggtgtgttatgagaggggcctaaagycaagctttttcttgaagcacaggctccagccatcaccaagatgtactctttgggcatcagcacagacttacgtgatgagcccaacatagtccaatcctgg

SEQ ID NO: 77000 - DNA, 201 bp, Bos taurus
ctttatcattgagctacctgtgaagcccttatgaaaaaagtaaataacactatgatgttctatgataatttattcattcactcaacaaaaatttatggaayacctattatatgccatacgaactgctgggggtatatgaagatgaataaggtgccagtccctgctttcaaggagttcatagtctagtggaggacatggaaa

SEQ ID NO: 77001 - DNA, 201 bp, Bos taurus; identical to SEQ ID NO: 37302

SEQ ID NO: 77002 - DNA, 201 bp, Bos taurus
tccctgatatcactgcttttaccctcatctttccactattcaggattcaacaaaactgaagtaaaagtaatattaatatggccaattttcttgtaaacttsaaagtgctctaaaaataaactgtgttagaaaaaaaatagtaatataaaactctggttagttttcttctttctattttcttttttactggtttggcccagt

SEQ ID NO: 77003 - DNA, 201 bp, Bos taurus; identical to SEQ ID NO: 37303

SEQ ID NO: 77004 - DNA, 201 bp, Bos taurus
caaatgtcctctcctcccctcccccaatttcttccttctcttccactttgccttctttaaaatattaatcaggactaagtaaaagagaataaatagcttgyagaaatatagagttctgtacatttttgttgttcttagtagctcacaaattatgaattttgtcaagatttatctatgaatcctttcccctccatttgatta

SEQ ID NO: 77005 - DNA, 201 bp, Bos taurus; identical to SEQ ID NO: 37309

SEQ ID NO: 77006 - DNA, 201 bp, Bos taurus
acctttgaaaatgatgaacaattcagaaattaaacattttaaaaagcagtattaaactgtgattgaggatactgtggagttgttttgatattactgacttytgaaataactggtagttatcaagttcgtccagactttctctcaataaaaataaataaagaaattccaaagtagctttaaggcagacgtatgagcactgtt

SEQ ID NO: 77007 - DNA, 201 bp, Bos taurus
gtttatatatgacatctgaattgaagcctaaaaattatttcaaaaaagtgatgctgttcagactaaagaattggaaattgtgctaaaaatccactcctatrtattaggaaaggattatatagcaaaaagtaggctacatgagctaatgtaaacaattcagaccttcagcactttctctgaagggaaaaattttttaacctt

SEQ ID NO: 77008 - DNA, 201 bp, Bos taurus
ataataaacatattctaaaattgaaaaaaactctgaaataatttgagcattgcatatatctgtctggcacattgaaaactgacacaaagctacagagaacygatgatgccagacttcagcatacaccattcatcttcactaaacaatactagaggccaagctaagggctatgatattaacatctactttcaacaacacatg

SEQ ID NO: 77009 - DNA, 201 bp, Bos taurus; identical to SEQ ID NO: 37313

SEQ ID NO: 77010 - DNA, 201 bp, Bos taurus
gaggtgaaaagatggcacctgacagcctggtgaagatccaccttaaggtgggaaccacacctgaggtggctgagagtaagtttcagagaaaacagactgtrtggcctcagctagaaaaagagaaaccaggaaatatctgacttggttcctaaccaagtccctaagccatcctcagaaaacttacttgtaataacaatagct

SEQ ID NO: 77011 - DNA, 201 bp, Bos taurus
gaagcagcctaagatcccccgccccattccccttggggccgctgtgaacgttctgtcccaccaagcagctctgccaaaggggactcagagctttgacactraccctctctaaaggccaattaatcaggagagactatgaagaagtattactgaaaataaaggacatgatctctgtctcttttcttctttgtgctataagaa

SEQ ID NO: 77012 - DNA, 201 bp, Bos taurus
tccctggtcaggaaactagatacagaatgccacaactaaagatctcacattcttcaactaaaaatcatgcatgccacagggaagattccatgtgccataaytaagacccagagcagccaaagaaagaaagaataagagaaattcctctgggtacgaatgagttaaatttccaaagactatataagtctatttgtttctacg

SEQ ID NO: 77013 - DNA, 201 bp, Bos taurus
acaattagctgtctatgcaacttgaaatttccattttgccagctgagtaatcagttgactggagtttctcattttggatgcatttctaagccttttgtgtkcaggttttttaaaaatgtggattctaaagtaaataaacagtgcgcttaatcagatgtatcctttttagaaacaccctcttcccaaacatacagacaaacc

SEQ ID NO: 77014 - DNA, 201 bp, Bos taurus; identical to SEQ ID NO: 37315

SEQ ID NO: 77015 - DNA, 201 bp, Bos taurus; identical to SEQ ID NO: 37316

SEQ ID NO: 77016 - DNA, 201 bp, Bos taurus; identical to SEQ ID NO: 37317

SEQ ID NO: 77017 - DNA, 201 bp, Bos taurus; identical to SEQ ID NO: 37318

SEQ ID NO: 77018 - DNA, 201 bp, Bos taurus
ttcctgcttcctctttttttcttgccttccctttcccttcccttctcaagccatttggtcctaaatctgtaaggcggccataacaagatagatgtttcacyggactggaagcggcagagctctagggaataaagacagtatctccaagggtgtgcaggggtgggcccatgtgctgtgaaggcccaggttggaaagagagtg

SEQ ID NO: 77019 - DNA, 201 bp, Bos taurus
gtctcagctctgggtgacagacacatgaatagtaaaaccccatcataaaattattctgcccaggaggactggagatggggttgtttggagaaagtagaaaygatgggccaatggactccagagtccagaggttcaaagccagagcaggaagagccttgtgtgaggttcagaacttgggagcagatttcaactagcagagaa

SEQ ID NO: 77020 - DNA, 201 bp, Bos taurus; identical to SEQ ID NO: 37325

SEQ ID NO: 77021 - DNA, 201 bp, Bos taurus; identical to SEQ ID NO: 37327

SEQ ID NO: 77022 - DNA, 201 bp, Bos taurus
aagaggtggtttacatgaaaagcaaaacagagaggggctgtagaattcagcaaaaccaggaattcagatcagaggtaactggaaaacccgagtcacccccragaaccatcctctgctctgtgtttcccctccagaagttgaacaaggcttcgagacaaaaaaatctcagaggccagcatgtccctggcagtctagatgatt

SEQ ID NO: 77023 - DNA, 201 bp, Bos taurus; identical to SEQ ID NO: 37328

SEQ ID NO: 77024 - DNA, 201 bp, Bos taurus; identical to SEQ ID NO: 37329

SEQ ID NO: 77025 - DNA, 201 bp, Bos taurus
tagctaaaattaaaaaatacatattttatctgacatataggtatgagtgggacagacacgctagacagagttctccatacacagggaactcagtgaactcrgggttatcactctactgttttgaagatagattttatactaaggagtactgtgtggggctctcctggtggtccagtagttaagaatccaccttgcaatgca

SEQ ID NO: 77026 - DNA, 201 bp, Bos taurus
tggtataataggaaaattgctggtattttatgaaaaagtgaaatgtagcagccataattttccccattttgccctcatgcagagagtccaaggatgaggayttcatgttcctgacttttgggcttgagactctccaagacagagtaactagggaacaaagtcctggtaaaagtaaatgaatatttctgtgagatgtactca

SEQ ID NO: 77027 - DNA, 201 bp, Bos taurus
acaggcaggctacagtccacggggccacagagaggcagacacaactgagtgactgaccatacacacacacacatacacacacatacacacatcactacttyacaaatgaggaaacaggcccatagaaattaagctacttgacctagatcacacagccaaaggggcacatttgaacagttccagctcttggtctcaccccac

SEQ ID NO: 77028 - DNA, 201 bp, Bos taurus
tcttttctatttcataggtattcctgcgacacatggtaaacccactagttattcaataagggtagataatacagttccccttgtaactcaggccccagccrtgcagccactacagatccgaccaggagttctttctcaggttggtgataataattcattatttttgcttatgtgctgtccttctcatactcaagtagaggc

SEQ ID NO: 77029 - DNA, 201 bp, Bos taurus; identical to SEQ ID NO: 37332

SEQ ID NO: 77030 - DNA, 201 bp, Bos taurus; identical to SEQ ID NO: 37333

SEQ ID NO: 77031 - DNA, 201 bp, Bos taurus; identical to SEQ ID NO: 37334

SEQ ID NO: 77032 - DNA, 201 bp, Bos taurus
tagctaaggttcctgactcagtcctagaactcatgggtctacatgaatagaacccccgattttctagatttcagagcatttgtcctattccaactcatagmaaagaccctagagaactggcacttagtagtaaaacaggggctgttaaggaattctctgacaacctcacctccaaccactaagtacacaactgtgagcagg

SEQ ID NO: 77033 - DNA, 201 bp, Bos taurus; identical to SEQ ID NO: 37335

SEQ ID NO: 77034 - DNA, 201 bp, Bos taurus
tctttaagagaatgatggtgtggatgacgctgagtggctgtggcatcgggaattcagggtgatcttggcctagagcaccttggggataaagaccagcagcyctagccctgcctctgccctgccagggtttcagcaggcctagccccacggcaacagtgttgagcaaaaacttctccacacagagggccagttttgatgctg

SEQ ID NO: 77035 - DNA, 201 bp, Bos taurus
ctgtcagtgggggtaccagagtctattacatcaactgttgtaaggattaaatgagtaaacgcatgcagtgtggcccacagacctgtaatgaactgggggtrataatggatatgagattacatgcatgcaaagcatttggtgtatactaagcactcataaatggtaacttctgtgttgtaggaaaaaattgccgggagaatt

SEQ ID NO: 77036 - DNA, 201 bp, Bos taurus
ctcagaggccgttcctcccacaaaatgaaaataataaaagctatgagacaggactgtcaaggggactgaatgttacaatgcacgaaacatatacaatagckcatggccattggtaagtgctcagtgtacgtgagttgctgctgcagcaaagcatagtctgagataaaggactattcttggggaggcttatttttcttaaat

SEQ ID NO: 77037 - DNA, 201 bp, Bos taurus
aactaacaaggccactatttgccaagaagagtctgagttatccattaaccaggggtgatctatcagtgcctggaagccacacaaaggacaagggttcggtsagcctgggagggcccacgatggggcccacgttaaagaaatgtcaacacagtgatgtaatatcctggcccccaacttccttcccttagaagcttccggttg

SEQ ID NO: 77038 - DNA, 201 bp, Bos taurus; identical to SEQ ID NO: 37338

SEQ ID NO: 77039 - DNA, 201 bp, Bos taurus
gtaaattcaggcagtgttggggcccgtttcttaatacaaatcactgtagcttgcattcctccgaggtcagctctttaccagctgtaagtggagctcacctyctaatgcatttttctcacaatactctgcaaggttgatttaatcgactcatttgtttttatgggagtgaatattgaactctatgagggagatttgattgtc

SEQ ID NO: 77040 - DNA, 201 bp, Bos taurus
agaggccactgctgccggtagtgtgagcccaatgcaatacatatgaaagtcaaccttagaaaaatggcaccagtaacttgctgaaggaaggcaatctccayatcaattaggccctttacataatctctgatttgtggttacacacattttaaaaacacaattagttatgggccagagctaaagaagtctttgatgcataat

SEQ ID NO: 77041 - DNA, 201 bp, Bos taurus; identical to SEQ ID NO: 37340

SEQ ID NO: 77042 - DNA, 201 bp, Bos taurus
cacaggtgcttttgacttgcatgtgatttactccaggagtttgatggagtgaatggagtgtcatgccccagctggaatggcctggtctgttgaaatttgtmggctggtcatcagatatctcaaaatgtcacagggacagcctgtggtctggcatcccagtcctcggccaacctgtcttcattctgccctgcctgacctgcg

SEQ ID NO: 77043 - DNA, 201 bp, Bos taurus; identical to SEQ ID NO: 37343

SEQ ID NO: 77044 - DNA, 201 bp, Bos taurus; identical to SEQ ID NO: 37344

SEQ ID NO: 77045 - DNA, 201 bp, Bos taurus; identical to SEQ ID NO: 37345

SEQ ID NO: 77046 - DNA, 201 bp, Bos taurus
cacatacacacacacacacacacacacaccttccgagtctacccagcagcttcatccctacagcaatttagcccacgagggcggggccccagttaatgcawgtgactctctaaagaagtctctactgaaaggtctttgctgctccaggcttaggggactggaaacaggccttcacatctattattggaacgccctcaggaa

SEQ ID NO: 77047 - DNA, 201 bp, Bos taurus; identical to SEQ ID NO: 37346

SEQ ID NO: 77048 - DNA, 201 bp, Bos taurus; identical to SEQ ID NO: 37347

SEQ ID NO: 77049 - DNA, 201 bp, Bos taurus; identical to SEQ ID NO: 37348

SEQ ID NO: 77050 - DNA, 201 bp, Bos taurus
cgctctatgccagtttagcttcccatggcagttgggttttttttcttgaagattttataaagctgagtataaaatgggaatgttttcataaatgcttaagyatctttagcgaggctaatttatagaatttaaatgttcctcttaggcagtttaaacccaaattccccagcagcagagactggaggctgagaaacaggaaac

SEQ ID NO: 77051 - DNA, 201 bp, Bos taurus
atttggcctttgtgctgagagcacggagggcgttgcagtattttaggtgagggatggcattaggtttccatttagaaaacatttgcagtggtgaggtggcrgggtgggaggccaggagaggaggacggtgagatgggatatgaggaaagcactcaggaggcccctcgacacccccaccccacccatcacatccccctgctg

SEQ ID NO: 77052 - DNA, 201 bp, Bos taurus; identical to SEQ ID NO: 37351

SEQ ID NO: 77053 - DNA, 201 bp, Bos taurus; identical to SEQ ID NO: 37352

SEQ ID NO: 77054 - DNA, 201 bp, Bos taurus; identical to SEQ ID NO: 37355

SEQ ID NO: 77055 - DNA, 201 bp, Bos taurus
accagtggaaaaaccagagctcattagcctctctcttcccataagcctctccacatagcaaacttgggcttcctcacagcttggccatctcaggacagtcmgaccagttagatggcagctggctttccctagagcaggcattctgagagagaatactgctactccttaaaggccaggtgaagcatcacttctgtctttttt

SEQ ID NO: 77056 - DNA, 201 bp, Bos taurus
cagggaataggaaccttgcacataaatacagtttgtggctttgggattccacagctgggagctctcaacagccactgtgtataaatatgcctatggagttkagttctaaataatgacagtcctacattcaggattcacatggcttccaggacctcagtcagttcagtctgactctttgggacccgatggactgcagcacac

SEQ ID NO: 77057 - DNA, 201 bp, Bos taurus
ccttaagggagctactggtagcaaatgcagggtctgtaggcacatgagtggtatcatacaaaaaggagagtcagagtgcctccagatggtcatctgtaatrtgttgcaggattttcaaggaggaaaggatcactcacaactgtgaagatcctagagggtttcttggaggaaggagcatttgaatgaaaccttaaaggatga

SEQ ID NO: 77058 - DNA, 201 bp, Bos taurus
ggtggcgttgtaaaatggctagcaatttgggggctttgaagggcccttaagtgatgctgtcttcagcacttcagatctatttggcatcttcaaaggatatkcctgtccatccatctggcctgatgtgactaactccctgagcctcttcaaaagaaagggcatctagttcagtattgcttcccgctgtggagcgtcttctta

SEQ ID NO: 77059 - DNA, 201 bp, Bos taurus
gctcttggtttctgttactgacagagatggtttaatgttggccaccagctgtggccgtctgtcttgttcctaatccaatttagcaggccagcactatgackggggatgctcaccatcccagattagaagcttacacatgaacttattcagcttctgtacattttaattctccagagacaggccaaacctggcaatttttct

SEQ ID NO: 77060 - DNA, 201 bp, Bos taurus; identical to SEQ ID NO: 37357

SEQ ID NO: 77061 - DNA, 201 bp, Bos taurus
gcaagttggggaatgacgaagcgtctccagcagacgttcccccgacaagagctcacggtaggacacaggtgagctctggtcctttcttgggccttgaggcrgagctggtttgtgagcacagttacccaggctcctcggggagttgcccggtgctgctgtgactgggcctgcgataacctacacctcacccaggagggtgtc

SEQ ID NO: 77062 - DNA, 201 bp, Bos taurus
aaatgttgactttcagattaggagatcaggagtccagcattctgggtttcactgtgtaattcagatgtagtcactacaacacattaataaattggccttcmcatgaaagccattattctaagagtttatggttcatttcctgttgacatctatagcacagatgaaaagtgataatatcaggtgggatggaaacattcatga

SEQ ID NO: 77063 - DNA, 201 bp, Bos taurus
ataagagataacaactgcaaagaatttagtgtcttgaaaaaggcagaggaaaagaaggggggggaaacctagtctatgtacaagtgagttgatttaataayggaagataacctctttcactataatctcaaagacttcctgtttcttcaatcatttgttatgctatcttgcctattttttttccacttctgtttcccatat

SEQ ID NO: 77064 - DNA, 201 bp, Bos taurus
tcctgtagcatctctctgtttttctggtcatcatccatgttcagtgtttgtttttatgttgctataagtataacatggacacaactcaggagaatgcaaaytgtttacaacaaacagcctttcttcttccgaggttcattatgtcagtgtgtagtcttctttattctttccttttagtttttgtacctaacgcatttgctg

SEQ ID NO: 77065 - DNA, 201 bp, Bos taurus
ctaaataataatagtttagtcataggcatagctaaggatatttagttccttttcatgagctatagataatattctgagccatatcctgtggactgtattayaggtactgacacaccccgaagcagaaaaagttaactacataatgacaagactgtagccgtgacttacgttcctcatcattctaagaattgacctcaagga

SEQ ID NO: 77066 - DNA, 201 bp, Bos taurus
cccttggctaagaggagactctgccttgggcccactggtgtaatagtaataaactgcactccactatctgcattgtcctgagtgagtttgtttcccagaaygtgtggccacaacagtttaacaggtcttaattgttggaccattcatttgctttcttcctttgtttaaaaacaagagtcaaggatgtgcactgaactccct

SEQ ID NO: 77067 - DNA, 201 bp, Bos taurus
ggactgacagtttcatttataatttcagaaaaacgttatgctttaggacatttatatctctggccttagtcacagctgtgttatctcatgtaaaaacacaygagaacactttatgatgagttaatcattcaggaagataaaaaaaagatacttcctgtattcccaagttattgaggttcattagaaagaacaaagatttgg

SEQ ID NO: 77068 - DNA, 201 bp, Bos taurus
ttggaagaaactggcagcattccacaatttttacactgtttaaaagtatcaactgtggccttgccagaattccatcactgacatttgaagaggccacctcrggtctaggagaaccatgctttaccagctaaacatgagaagaaagaagtaagggtaagaacacattaacagaataaagacaacaaaggcctttctctgaga

SEQ ID NO: 77069 - DNA, 201 bp, Bos taurus
ttagttcacaatggagcccattttaattaatctctgattagagctgaggtggaacaattcaggaatagatactatttcaaatctatttagaacagtgtgtrtgcagaaatattagaaggatcagggattttttttttttttttttgtcttatagtacattcttatggactctgtgggagagggagagggtgggaagatttg

SEQ ID NO: 77070 - DNA, 201 bp, Bos taurus; identical to SEQ ID NO: 37360

SEQ ID NO: 77071 - DNA, 201 bp, Bos taurus; identical to SEQ ID NO: 37362

SEQ ID NO: 77072 - DNA, 201 bp, Bos taurus; identical to SEQ ID NO: 37363

SEQ ID NO: 77073 - DNA, 201 bp, Bos taurus; identical to SEQ ID NO: 37364

SEQ ID NO: 77074 - DNA, 201 bp, Bos taurus; identical to SEQ ID NO: 37365

SEQ ID NO: 77075 - DNA, 201 bp, Bos taurus; identical to SEQ ID NO: 37366

SEQ ID NO: 77076 - DNA, 201 bp, Bos taurus
aaaacttaccactcattatcaaatgaaggatgggggaatgttaataatgatttcccttgtttttgatatctaaaatctccctctggtcttttttcttatcrcatacaacctaataacaggacagattgtgtccatagccatacatctctgaatggataaatgaaaaaattgtgcatgaagaaaaacaagtatagtttttgt

SEQ ID NO: 77077 - DNA, 201 bp, Bos taurus; identical to SEQ ID NO: 37367

SEQ ID NO: 77078 - DNA, 201 bp, Bos taurus; identical to SEQ ID NO: 37368

SEQ ID NO: 77079 - DNA, 201 bp, Bos taurus; identical to SEQ ID NO: 37369

SEQ ID NO: 77080 - DNA, 201 bp, Bos taurus
tctatacattaaggttcagatcacctgccatctataccacctacactgtgcatgaaacatttcaaaccagagctaaatatcagctacagaagtcatttcamgttctcaattctcctttgctgaacacaatattattttgaaatgaaagtctgattcactcacatatgtatctacttattttatcagcgacacaatgcctat

SEQ ID NO: 77081 - DNA, 201 bp, Bos taurus
taacagaaagtgctactggtttactttattctcataggacattcattatcctcagaaaataagcattacttaatttctgaattggactaggatatcctcawtgagctttttagttgccggtaagatggatagggtacagaaggctgaataatggcactatccaggatcttctctgtgcctaaccccatagccagataatgt

SEQ ID NO: 77082 - DNA, 201 bp, Bos taurus; identical to SEQ ID NO: 37372

SEQ ID NO: 77083 - DNA, 201 bp, Bos taurus; identical to SEQ ID NO: 37373

SEQ ID NO: 77084 - DNA, 201 bp, Bos taurus; identical to SEQ ID NO: 37374

SEQ ID NO: 77085 - DNA, 201 bp, Bos taurus
cataatgctcccaaagtgtacttccaccctatttatttcagtgataaagttgagattccctgagaggaagggaaggtaaaaatggagagagactgggttcytatttcccaagtacttaatattccatgcgtgaattgttcatctgtccctattctcttttccctgaatcctaaattcattttacactcccaagacagagag

SEQ ID NO: 77086 - DNA, 201 bp, Bos taurus; identical to SEQ ID NO: 37375

SEQ ID NO: 77087 - DNA, 201 bp, Bos taurus; identical to SEQ ID NO: 37376

SEQ ID NO: 77088 - DNA, 201 bp, Bos taurus
gcgtcttgaaaatgttcttctctctagtaaattgaatgtatggtttttatgcactagccacatttccctcctcatacttagaaatccttttatgttttgcrgactctcaagcattttcaaaaaccatccattcaaactgggactgttctggcttgtcttgtgtttccaagaatatacagttattctagaaggctttgattt

SEQ ID NO: 77089 - DNA, 201 bp, Bos taurus
aagtagaatcaaaagaaaaggcaaatcaagaaattagatcaaagagtcagcagaggaccagatggtgtagagcctcacaggtttaagaattttgtcttcaytctgagagcaagtctttacaccactgaagaagtttccctatgaaggtaaattcatcttacttttttaataggatcatttcagctgcctgcttagaagatt

SEQ ID NO: 77090 - DNA, 201 bp, Bos taurus
ctgtgcggggccccttctttggggctggaaggggatcaaacgttctgggctgagcgattctgaggaaaccacccagcatgggagaacctcaaggctctgcrggggccctgccttcctcccctgcagaaccctagcagggtctgcccaccgtgcccctaccattctttggcaccgagcctcactttgccctggcccacccag

SEQ ID NO: 77091 - DNA, 201 bp, Bos taurus; identical to SEQ ID NO: 37393

SEQ ID NO: 77092 - DNA, 201 bp, Bos taurus
aatccattaactgcagtgaaccaagctactagtctgtctccccatcccgacctgaaggcagaggctgtgtccagggcctcacagaatcccccaggaggccrggaacagggacaggcaaagtctggtgaggagctggaattaggcatttcagtccccttctctgtgaaaactgggcatttgggccaggaggcgtctggcgtc

SEQ ID NO: 77093 - DNA, 201 bp, Bos taurus; identical to SEQ ID NO: 37396

SEQ ID NO: 77094 - DNA, 201 bp, Bos taurus; identical to SEQ ID NO: 37397

SEQ ID NO: 77095 - DNA, 201 bp, Bos taurus; identical to SEQ ID NO: 37398

SEQ ID NO: 77096 - DNA, 201 bp, Bos taurus; identical to SEQ ID NO: 37399

SEQ ID NO: 77097 - DNA, 201 bp, Bos taurus; identical to SEQ ID NO: 37400

SEQ ID NO: 77098 - DNA, 201 bp, Bos taurus; identical to SEQ ID NO: 37401

SEQ ID NO: 77099 - DNA, 201 bp, Bos taurus; identical to SEQ ID NO: 37402

SEQ ID NO: 77100 - DNA, 201 bp, Bos taurus; identical to SEQ ID NO: 37403

SEQ ID NO: 77101 - DNA, 201 bp, Bos taurus; identical to SEQ ID NO: 37404

SEQ ID NO: 77102 - DNA, 201 bp, Bos taurus; identical to SEQ ID NO: 37405

SEQ ID NO: 77103 - DNA, 201 bp, Bos taurus; identical to SEQ ID NO: 37406

SEQ ID NO: 77104 - DNA, 201 bp, Bos taurus; identical to SEQ ID NO: 37407

SEQ ID NO: 77105 - DNA, 201 bp, Bos taurus; identical to SEQ ID NO: 37408

SEQ ID NO: 77106 - DNA, 201 bp, Bos taurus; identical to SEQ ID NO: 37409

SEQ ID NO: 77107 - DNA, 201 bp, Bos taurus; identical to SEQ ID NO: 37410

SEQ ID NO: 77108 - DNA, 201 bp, Bos taurus; identical to SEQ ID NO: 37411

SEQ ID NO: 77109 - DNA, 201 bp, Bos taurus; identical to SEQ ID NO: 37412

SEQ ID NO: 77110 - DNA, 201 bp, Bos taurus; identical to SEQ ID NO: 37413

SEQ ID NO: 77111 - DNA, 201 bp, Bos taurus; identical to SEQ ID NO: 37414

SEQ ID NO: 77112 - DNA, 201 bp, Bos taurus; identical to SEQ ID NO: 37415

SEQ ID NO: 77113 - DNA, 201 bp, Bos taurus
ttttcatctattcattttgcagatctggggttatttacaagattcctaactcatatgcgtctatttctttgatctagtatttttccctcctcatctccacrtaagttttgatattaaatgtatagttagatacattaataaatgtacattaattgatgtatctaactaatgggcttctctggtggctcagatggtaaagaa

SEQ ID NO: 77114 - DNA, 201 bp, Bos taurus; identical to SEQ ID NO: 37416

SEQ ID NO: 77115 - DNA, 201 bp, Bos taurus
cagcacacagggcacagcatacatggtagatacatctgttcacacctgtggaatgtagctccaagagtgaagcgtggctccaaacctggacttggggtgaygatgcgtccgtgggttcaatggctggagcagatgtgccggcggggtggggggctttgattacgggggagtctgtgcacgtgtgggggcagaaggcatttg

SEQ ID NO: 77116 - DNA, 201 bp, Bos taurus
caaggatgctgatgaaactggtgagcctccggacactgagcagcgtccactcagagcaagtgtttgccctgcgcctgcaggataagaagcttcccccgctkctctctgagatctgggacgtgcacgaatgacagttcctcctccgtgtcttctgttttcctgggctggatgactgaggctgggtggctgcctcctagaggt

SEQ ID NO: 77117 - DNA, 201 bp, Bos taurus; identical to SEQ ID NO: 37419

SEQ ID NO: 77118 - DNA, 201 bp, Bos taurus; identical to SEQ ID NO: 37420

SEQ ID NO: 77119 - DNA, 201 bp, Bos taurus
agtggtttcttctaggagtgatttggtaaaattctcaaaagatctgagggtttagtgatggtctctgcagtcataaactctattggtgatttccttatagyggtgacttgtgatagtccataatcatctgttgccagtgttcaaggaaggatgctttgtggtgtgagtggatgtcacatgactcctggtctcaggtgccct

SEQ ID NO: 77120 - DNA, 201 bp, Bos taurus; identical to SEQ ID NO: 37422

SEQ ID NO: 77121 - DNA, 201 bp, Bos taurus
ggtctctgaatctctaaaaagaagttgaggcagagaagatctaagctgcactgtttaggttatttgtacctaataaaatatactagtaacagaataaagtrtagtaaaataaaaggctgattattttgagtgaagaagttgtaaggatgctaactgattctttctctctctccaaagaactggaggtagacatgtagggct

SEQ ID NO: 77122 - DNA, 201 bp, Bos taurus
taaacaggaagaaaagcaaattatagttccctctgagatcaagccagacttttccttgaagttgaatcaacttaaagtagaaatgaattccctagcctctrgtactactttttggacttcattttagtgaatttaattattttcctttatatattcacccacacattcaatatttatcatgcatatgatattgtgttatct

SEQ ID NO: 77123 - DNA, 201 bp, Bos taurus
catagtaaaagtgcagtaaccaatgtttgagtatattgaatttaagcaagtaaacaaagatttccctgcttaagtagtttgtttgctgaagttcttacctytcagttgcagtctgcttgccattttatggaaggtcaagattattttgctgtctgtaatttttgtccatttcttatttttccaaaattatgaatattagag

SEQ ID NO: 77124 - DNA, 201 bp, Bos taurus
tgcgccgagggctttaatgtccgttgctccaaatctttgttgtgacgagacaaagaaccaaggaacacacactcgagtgacatttatggtgccatgactcrggcttaacctggctgaaacaacctccgaggggaagaggccaagcacagcaggagcccaacccagtgaagctcccgagctagaagcggaaggcaaagaaac

SEQ ID NO: 77125 - DNA, 201 bp, Bos taurus; identical to SEQ ID NO: 37424

SEQ ID NO: 77126 - DNA, 201 bp, Bos taurus; identical to SEQ ID NO: 37425

SEQ ID NO: 77127 - DNA, 201 bp, Bos taurus
tgaagtcagtttacggtcaggcaatgatgtcactgtaactctctatgacatgaatgctattctcgcttctgacaaggaagggcccaactttcaccctccarttccctggtcctggtgaacgggaggcagatctcagctgacagttccttcagggccaggtttccagatcccacccagctgtcatcgctgagggagccgggg

SEQ ID NO: 77128 - DNA, 201 bp, Bos taurus
tttacaaagaaaattattctttacccatatatacttgataaacacttccataaaagtttatggacctctacaggtccatgagtccatcatggcagagaacrgttactaagggtgaggtaagggataaaatgaaaatatggagataaaggggagcaaggtcggatagaactctgtggatatgtcaagaattcaaatatagtc

SEQ ID NO: 77129 - DNA, 201 bp, Bos taurus; identical to SEQ ID NO: 37428

SEQ ID NO: 77130 - DNA, 201 bp, Bos taurus
gaggatgtggggatttgccgacggggtattgaatctaaaattctgaaggtatcgtatcgctggtggtagataaggccacaggttattctcaaaggttacaktatagatagtctacacacacacacacacacacacacacgtttaaatgtggaaaggagcctgcattagcccacctggccctcttgagcatttaaaaatagg

SEQ ID NO: 77131 - DNA, 201 bp, Bos taurus; identical to SEQ ID NO: 37429

SEQ ID NO: 77132 - DNA, 201 bp, Bos taurus; identical to SEQ ID NO: 37431

SEQ ID NO: 77133 - DNA, 201 bp, Bos taurus; identical to SEQ ID NO: 37434

SEQ ID NO: 77134 - DNA, 201 bp, Bos taurus; identical to SEQ ID NO: 37435

SEQ ID NO: 77135 - DNA, 201 bp, Bos taurus; identical to SEQ ID NO: 37437

SEQ ID NO: 77136 - DNA, 201 bp, Bos taurus; identical to SEQ ID NO: 37438

SEQ ID NO: 77137 - DNA, 201 bp, Bos taurus
cccctcgacatctgcgcttgcccacgagcagcgtctgttctgtctgacgttgttgctgttggtctactccatctatgtgcccacccctggcctggtcatamgtgtcctgaaagcaggaacgtccgctctccgtcagctttagtgcctcccctaacagatactctttgtttgtgaccgcggaaaggcagtaaggaggcttgc

SEQ ID NO: 77138 - DNA, 201 bp, Bos taurus
cgcagatccccgcccaaagcaagatgtcctgtgcgtgtgcacgcttgcgtcgtctcagacgcgccgttgcagtggcagcccgcggttctgggttaggcggmctggtaaacggggtagcaggtgcagtaagcaggcttgcgggattactcctaaaatgctggcaagtccaggtacattcttgaggtttaaaactggtgacag

SEQ ID NO: 77139 - DNA, 201 bp, Bos taurus
agagcaaaccagagctaacaggtgcgggatggagccccagggctgggaggattgcaacagcgtagctgggaccctcagaggccaggcctgcgaggtttccragtggtcacctccctctctgtaacatccatttccacatcgtcttttttttttttaattgggggatgattcctttacaattttgtgatggttttggccaca

SEQ ID NO: 77140 - DNA, 201 bp, Bos taurus
ttccctctgcaggaggccgcgccaagaccttctccacgtgcacctcccacctcactgtgctgtcgctcttcttcgggaccctcatcttcatgtatctgggrgatcactctggccggatcacagcggtgatccccatgttgaaccctcttacctacagcctgaggaacaaggaagtgctggaggctctaaggaaaattctca

SEQ ID NO: 77141 - DNA, 201 bp, Bos taurus; identical to SEQ ID NO: 37442

SEQ ID NO: 77142 - DNA, 201 bp, Bos taurus
gatcctatggtatcaaggattataatctttatcttaagatagaagcaatgttatatttctggaaagggacatccggaatttcttctacccagttacagtcrtgaagagtgaatacaatcagttttgtctgggaaggaactgctcaaagaaataaaagacaagaaagaattaaccttcaaacagcattcttggccacagaag

SEQ ID NO: 77143 - DNA, 201 bp, Bos taurus
acattgggcccacagaaagagagactgaaggtgattccaacatggatggaggcattcaggaagccacagacaccggggcctgtggacagaccagcacacaygcttgtcgtcatagttgcggtgtaacggaggggcgtgcacactgctgcatagcggtcataggccattgctgccaagagaaaattttccatagtggcaaag

SEQ ID NO: 77144 - DNA, 201 bp, Bos taurus
acagtatagtgagaacattttaggctatatacaacactgttcttgacacaatggaaagccaaaaaaagtaagctgaagtaaaattaatccaatttcatatktattttactaagtttagtttagtttaaagaataatttttgtttttgttttggaaactttgaattgggagccagagctgttctagttagcaaccaatctga

SEQ ID NO: 77145 - DNA, 201 bp, Bos taurus; identical to SEQ ID NO: 37444

SEQ ID NO: 77146 - DNA, 201 bp, Bos taurus; identical to SEQ ID NO: 37445

SEQ ID NO: 77147 - DNA, 201 bp, Bos taurus; identical to SEQ ID NO: 37446

SEQ ID NO: 77148 - DNA, 201 bp, Bos taurus
caaaccgtttggcacccggttctggtgttgtggaagacaatttttccatggtccagggagcacggggggatagtttcgagatgattcaagattgtgacatktgtgtgcattttgtttctattgttgttgcatcagcttcacctcagatcatcaggtattagatcctagaggctgcagatccttgccctaaggagtctccat

SEQ ID NO: 77149 - DNA, 201 bp, Bos taurus
tagcagttataaagcactttcacttgcatcgtgttaacttttcctcacagaagtccttgctatagtgttattgcttaccctagacaggaaatgctgcaatyaaaacaaatgagaaagttacatgacagctgagggttacatgacaattgtcatgacaaatgacaactgagcaatgactctcagggtctggaaacccgaagt

SEQ ID NO: 77150 - DNA, 201 bp, Bos taurus; identical to SEQ ID NO: 37448

SEQ ID NO: 77151 - DNA, 201 bp, Bos taurus; identical to SEQ ID NO: 37456

SEQ ID NO: 77152 - DNA, 201 bp, Bos taurus
caacccactgcagtcacaagaatgcagctcagcaaacaccacctgggcttcctgaaaagcacagctggctgctagcctgagacccacccaatgcaccctcrgggcccctctcccttacactgcagtccactgtctcaccggtacactaattcctgtgcgtctatcacgccagatgctgacgctgagaagctctgttccaca

SEQ ID NO: 77153 - DNA, 201 bp, Bos taurus; identical to SEQ ID NO: 37457

SEQ ID NO: 77154 - DNA, 201 bp, Bos taurus; identical to SEQ ID NO: 37459

SEQ ID NO: 77155 - DNA, 201 bp, Bos taurus; identical to SEQ ID NO: 37460

SEQ ID NO: 77156 - DNA, 201 bp, Bos taurus; identical to SEQ ID NO: 37461

SEQ ID NO: 77157 - DNA, 201 bp, Bos taurus
cctgagactattcccccagaagacatagtgacctgatcacggggtgggtggtgaatggaggaggaatgactctgtgtctataacaaagagtggaatgtggyagctgtcctttggggcgaggccaccctgctctccactcttctttcttattatttacttcagaacccctgctgttctactccactgagatctattcctgaa

SEQ ID NO: 77158 - DNA, 201 bp, Bos taurus; identical to SEQ ID NO: 37464

SEQ ID NO: 77159 - DNA, 201 bp, Bos taurus; identical to SEQ ID NO: 37465

SEQ ID NO: 77160 - DNA, 201 bp, Bos taurus
cccaagtgaaaaggaaagatagggattattataccccttttgacagataggaagactgaggcacagagaagtgatgtgacttgctcaaagtcactcatctytggagaaattgggaccaaaagcccagtattctgattgtacgcagactgctaaggcagagtagatcaggagactcaccgggatatctgggcgatgtcatag

SEQ ID NO: 77161 - DNA, 201 bp, Bos taurus
cttcatccagtcagtggggtcaaaagagttggacaactgagcaaccagcacacacaagaagaatgaaaagccaacctcaaactgggagaaaatatagtcgracttgtaaagatttcaggattggtgttcggaatatgtaaagaactcatacaattgataagaaagagacaaacaacccaacagaaaaatgggcaagagaca

SEQ ID NO: 77162 - DNA, 201 bp, Bos taurus
cagagtgtgttaaacatggccctttgtcaactgaaggcagaggcgggacttttaaaacacagcttggaatactttagaatgttaactaaaacacaaatacwtaaggtagcagagaggaggccacaggcacaggctgagtttatgtttctttagtcttgcttcaaagaggtttgcgtttactattatccccatggggttgca

SEQ ID NO: 77163 - DNA, 201 bp, Bos taurus
caaagctgctagggttcctctttgactgccttctgctgccacctgctgcctgcagaggggaaaagaccaaggcctgccaggagggaacttccagggttttrgggcatggggggcgtgggtaaggaggttgagctatgcaggcggggacctcactctatccctggctctgctccccaacgggtgcaagtttgactccgatcc

SEQ ID NO: 77164 - DNA, 201 bp, Bos taurus; identical to SEQ ID NO: 37471

SEQ ID NO: 77165 - DNA, 201 bp, Bos taurus; identical to SEQ ID NO: 37474

SEQ ID NO: 77166 - DNA, 201 bp, Bos taurus; identical to SEQ ID NO: 37475

SEQ ID NO: 77167 - DNA, 201 bp, Bos taurus; identical to SEQ ID NO: 37476

SEQ ID NO: 77168 - DNA, 201 bp, Bos taurus; identical to SEQ ID NO: 37478

SEQ ID NO: 77169 - DNA, 201 bp, Bos taurus; identical to SEQ ID NO: 37479

SEQ ID NO: 77170 - DNA, 201 bp, Bos taurus; identical to SEQ ID NO: 37480

SEQ ID NO: 77171 - DNA, 201 bp, Bos taurus
attttataccatgagtgtgtatctaacacgagtgcattaaaagtcattagctctgtcacctcctgttgtgtagaataggcctcccaggcgggtcagtgttmaagagtctgcctgcaaatgcaggacacgtgcgtttgatccctgggctggcaagatgccccagagaaggcaatggcaaccccttctagtattctggcctgc

SEQ ID NO: 77172 - DNA, 201 bp, Bos taurus; identical to SEQ ID NO: 37485

SEQ ID NO: 77173 - DNA, 201 bp, Bos taurus; identical to SEQ ID NO: 37486

SEQ ID NO: 77174 - DNA, 201 bp, Bos taurus
gaatcccagcactgaagcccggccacgttcccaaccactgctctgccagagaatgggttggtggcaccattaaaagctcctgccacactcaagcctgggtyttcttgaagccacgtcaggcctacgtgccttaccttccttggtgcctggcccttggttaagcccaagatgccaagccatgcccagaagtagactgcggtg

SEQ ID NO: 77175 - DNA, 201 bp, Bos taurus; identical to SEQ ID NO: 37487

SEQ ID NO: 77176 - DNA, 201 bp, Bos taurus; identical to SEQ ID NO: 37488

SEQ ID NO: 77177 - DNA, 201 bp, Bos taurus; identical to SEQ ID NO: 37490

SEQ ID NO: 77178 - DNA, 201 bp, Bos taurus
ctccaaaaaatgaccagaaacaggcctcccagaacacagtcgtcttggaaggtcccactttgttttttacataggaggaaggcccttctcttcatcacttycagagctagaatttggaaagtgggggcatggagttgaggaaagaaacgaggagattccaggcctaggttctatcctcactttgccacttcctagctgtgt

SEQ ID NO: 77179 - DNA, 201 bp, Bos taurus
tttatttccaagaaatcaacattaaaccttcgttaggaaaatatattgaaagtaagtagagacacttccatatttccttaaacattcattcaaacttgtakaagaaacatttcattcattttggccaaaagattattgatatcataaacttacatttagtttttactggggtgtaatctcctgctgttcctcattaaccac

SEQ ID NO: 77180 - DNA, 201 bp, Bos taurus
tagtgagccctctgggttcttctgtgggaaaggagacatgacaaaaaatggtagaaggatgaatgaatttttatggcagagaaggccaaaatggaggtttkggggaataatccatgtacagtatgagagcaagcaagattagagaagaaggaataagtatttgggaaacctaagaggacagggtgactgactggataaaga

SEQ ID NO: 77181 - DNA, 201 bp, Bos taurus
tcgtaactctggcccccggctctcgttgtggctgttagcaacatcctgaggtttttactctgctcgcgaccgatctggccatctagagggattccacgccygtgtgctgctgcctcccctagagacattcaggttattggagaactaatctcatctcaaggggccagacaccaagtcccaaagcctgcagacctctttccg

SEQ ID NO: 77182 - DNA, 201 bp, Bos taurus
catttcctagacagggcttcccacagctgtcagatggtaaaggacacgtccagtgattaattggtctctctgcacacacaccttatctgctgaggccaggkctgagcctgatgccttcctcgggagcccgttgcatccccagagccgacattccctgagccagaggtctttcctccctctcccttcaggggagctctgctt

SEQ ID NO: 77183 - DNA, 201 bp, Bos taurus
ttggccttgtgcatcacacccagctgcttcacgaagatgtgattactgagtaacagtggatgccgcctacgcaagtgtaactctcccgtgctgaagggtgytcttcatcactgctgccgacggccctctgctgggaaagaggtggtcagcccgggctccagggctccagggattgggagtggtgatcctcagggttccagg

SEQ ID NO: 77184 - DNA, 201 bp, Bos taurus
ccagtagcattttacttggctgagcactccttgccccttggcgtggtttttcccttgtcctcagggatgccactcttctcgtatttctttttactgctcargtcgctctttcaagctgcttttcagcctctcctgctctgaattataaatgtctggcttctctggggtttggttctggactctctcgtcactctgcactct

SEQ ID NO: 77185 - DNA, 201 bp, Bos taurus; identical to SEQ ID NO: 37501

SEQ ID NO: 77186 - DNA, 201 bp, Bos taurus
acaaagaaatgattaacaaacagcaaattgagtagtgacaagagcagagttcaaccatagtacaggaacagagaccagaaatctgagatgcatatcagagratgttcaaactgaacccaaaatgatgtgaaagagatagtttagtgttatcaaattgccaacctccattggatcacagaaaaagcaagggaattccagaaa

SEQ ID NO: 77187 - DNA, 201 bp, Bos taurus
ttggcagaatctcagggcaggcaggtgggggatggtgtgtggggtgagaagggggaggaggtgagctgagaagaaggaaacatggccaaaagcgaaggacygtcacagactgagggaataaaaatgggtcaactcagactgaggctcaagccctagccataaaggcccccagataaagaatgcctccttatctgtgcttcc

SEQ ID NO: 77188 - DNA, 201 bp, Bos taurus
tggctataagaccttccagatgcgtttagagatgtgtgctaggaataaggtgcaaacttctcacataatcctatatatgatagtatctgcttctctctgaygcaggctactgactggtactcctaatgagttttgcctggaatgtttttctaaatagcataggttcttcaggagacagtagattcacatataaaaaccatt

SEQ ID NO: 77189 - DNA, 201 bp, Bos taurus
aaggtaaaagccatcacacaagagattcctcaggttctcaggcctggacctggtgagcacactaccacagccatggcacaagaagatacgtccttccaggrttgaaaaatctcccttccctggaatccatctgctctcacttaatggtgactctgagcctcaactatcagtcctctttttgaagattgtagaaaaacttga

SEQ ID NO: 77190 - DNA, 201 bp, Bos taurus
gtcctaagaccctacaccactttgtagtcagctttcagaaagatgaagagaacatgggaaaagatacagttgttaaagttattggccgacgaaggagtatyacttttacttgtgtttcatacctagatctcactggggaatcagtgacacagtcataccatgacacagaggctgagaaagtcacctttggccaaagagtag

SEQ ID NO: 77191 - DNA, 201 bp, Bos taurus
aaaaatattctcttttgttcagcttatagttttttgttattaaaaatatagaattgttttcctaatgtccaataccatgcataaaatttaaacatatcacratatcctagaaaataataatttctcatattttttgaggacagcttaactgtacatgtgtatttagcacactgacaagatcgatttttatttcttttttta

SEQ ID NO: 77192 - DNA, 201 bp, Bos taurus
cccaaatcagtgccttaaccaatttacaggtatttctgacaccatagcctattcttatctccctagaacatttgggctccaaaccatactttcctccatarcaacctcatctcactttccacaaacaatgtactttattgtttcctcatctctgctgagaatgttcttcatagttcatagtgctgaattaatacttctgag

SEQ ID NO: 77193 - DNA, 201 bp, Bos taurus
aatatccttttgatctattgggtttcggatttagccagaaaaatgcaaaaccaattagacttcactatttggattcttcaaatgataggttgcctattttytcctaacactgaagattttaaatgttgtcaagcaatagtgagtaacatttgtattttaataacatattgtgttttaaaagccacaaagtgattttattta

SEQ ID NO: 77194 - DNA, 201 bp, Bos taurus
tttaatccacacagtcaaagactttggcatagtcaataacattcctacacataggttattgatttggggggatgagagcaatggtattcctttgctgtctraacagtaggcatcttttttgttaatataactgatacttcccagggttctaattaattacatacaatgagaaaaattacataggttttaagaagtagaatg

SEQ ID NO: 77195 - DNA, 201 bp, Bos taurus
agaagaaataactgaagaactgaagaggttcacgaggcaggaaatggaaagaggattttctttatctgaggggcacacttggttgttaaggtacaagaccmgagcatagaacggtacatgaaggttgtaagaactgttcagaaagcaatctgcactattatttcatctatgaagagggaaattaaaaacaaaaaaaagtac

SEQ ID NO: 77196 - DNA, 201 bp, Bos taurus; identical to SEQ ID NO: 37507

SEQ ID NO: 77197 - DNA, 201 bp, Bos taurus; identical to SEQ ID NO: 37508

SEQ ID NO: 77198 - DNA, 201 bp, Bos taurus; identical to SEQ ID NO: 37509

SEQ ID NO: 77199 - DNA, 201 bp, Bos taurus; identical to SEQ ID NO: 37512

SEQ ID NO: 77200 - DNA, 201 bp, Bos taurus; identical to SEQ ID NO: 37513

SEQ ID NO: 77201 - DNA, 201 bp, Bos taurus; identical to SEQ ID NO: 37515

SEQ ID NO: 77202 - DNA, 201 bp, Bos taurus
tgattcgatctataccattacaagaactctcaaaactgaccagctaactatgtgctttaggatcagatagcacactgaaaaggaacttctggatgtggcaygaaaataagcaatgtagagaccaaaacgggaaaaaagaggggaaaggtccagataaaagtgaaggagggaagctggcccagaaaagcaaagtcaagccac

SEQ ID NO: 77203 - DNA, 201 bp, Bos taurus
tctgtgcaagttctgagaaagttttccaatcagtttgaccctgatactggcttgggaagtagacatgaacctggggattattcttcctgattttggaggayttaattattggtttaaaattgggagtgctattctgagtgtagtgatacatatctaggtacccattcccttttttgaggggtttaatacatgtccttggga

SEQ ID NO: 77204 - DNA, 201 bp, Bos taurus
ccaggatccacggttatagctattgtaattatcaagtcttctgtgagactctgttctttataaaaagcaaactctgttagaggactgaattcaattctacstttccaaatagctgttatcaatcatgtggtattttttcccagtctttatttgccaaacaacgtttgcatgtccactgagtcagtggctgtccacactcac

SEQ ID NO: 77205 - DNA, 201 bp, Bos taurus
gtcaggagccattggcctttgtgaagctaatccactgcccaggatccgcggcagcccaggagctgctgtccaacacagagtcgatccactgcccaggagcyggaggtacccaggccttgccactgctgctggtctctccagggccaatcttctgtcaccaccagccccgcactgggaactggggtcactggtcactaccct

SEQ ID NO: 77206 - DNA, 201 bp, Bos taurus; identical to SEQ ID NO: 37523

SEQ ID NO: 77207 - DNA, 201 bp, Bos taurus; identical to SEQ ID NO: 37524

SEQ ID NO: 77208 - DNA, 201 bp, Bos taurus; identical to SEQ ID NO: 37525

SEQ ID NO: 77209 - DNA, 201 bp, Bos taurus; identical to SEQ ID NO: 37526

SEQ ID NO: 77210 - DNA, 201 bp, Bos taurus; identical to SEQ ID NO: 37527

SEQ ID NO: 77211 - DNA, 201 bp, Bos taurus; identical to SEQ ID NO: 37528

SEQ ID NO: 77212 - DNA, 201 bp, Bos taurus
aactttgtagccatacgtcccaatggcgatacacctaatcagggtgaagatttcaagttctctgctacagacctcatcctaaccctgtcaaacatcacagmactggtaatcactccaaggtaacgtgcaatgatagcttcccaggtcggacatcatcctcgctggttcaaattcaggtttgcctcaggtatctccctgaac

SEQ ID NO: 77213 - DNA, 201 bp, Bos taurus
ggcttatttcaaacctcttagaggactttgaggggatcaaaatttcaggggaggaaataactgcaaaagtagtgaaaatagcaacagaagcagaagtggtrcctgaagatgtgactaaattgctgcaatctcatgataacactttaatgaatgaggagttactttttatgaatgagcaaagtgatgtctatagattggctt

SEQ ID NO: 77214 - DNA, 201 bp, Bos taurus; identical to SEQ ID NO: 37531

SEQ ID NO: 77215 - DNA, 201 bp, Bos taurus
aaagggggccaggcctttgcacacctatgatggccaatcatcagatgtgggctgatggggtggagaggctgaaagaaacttggttaaagcagcttcctcarctacgggcaattcctggaatggccgctgtggagcatgcgcagactacactgcccggaggtggcgggagccagtggtttggtttcgcgggacccggcacca

SEQ ID NO: 77216 - DNA, 201 bp, Bos taurus
tgaggactaatcaggcctcaccctgcatttgggcagacgagaagacagtgactctttcatagcagctgtgcagagaaaatcccagggcctcactggtcagracagtacaccctttccccgcttccctttctctcgctgtgaggctttgctgtgcttcctgctttggcctctgaaagcaaacagcgtgccaagggtcccctc

SEQ ID NO: 77217 - DNA, 201 bp, Bos taurus
ttaataatacccttatagaaagaaaataagacatattatcatttgaatgtcttcgtttccatttgtactgtggcaggtatgtgcatttctcatttttctcmcaacttttggctaagcagagataagcattactccttccaactagcagataaactagaacaagatggagttaaataacttactcaaatataagagtcagac

SEQ ID NO: 77218 - DNA, 201 bp, Bos taurus
tttagatatttgtttttaattcaaacaacaaatcctttatacttgagcaaggggatcaatttatctgccttttaaaagaccttcttgtcttttaattcttyatctctctgggttgtgcaggttttctttctgagaactgagcctattattttttccagtggttcctactgcgctgatgaagagttacagacagagtattca

SEQ ID NO: 77219 - DNA, 201 bp, Bos taurus; identical to SEQ ID NO: 37533

SEQ ID NO: 77220 - DNA, 201 bp, Bos taurus; identical to SEQ ID NO: 37534

SEQ ID NO: 77221 - DNA, 201 bp, Bos taurus; identical to SEQ ID NO: 37542

SEQ ID NO: 77222 - DNA, 201 bp, Bos taurus
aatcagcatctttcttgaaacagaggcattgcagcaagagcagcagcagcagcagcagcagcagagatatttacagatcttagtgagccatctgctcttargagtgtggatctcagcacattccataactactcctctattttcctcttttctctttcccccctcctccctcttttttaacttctctttcgtaagtgaaga

SEQ ID NO: 77223 - DNA, 201 bp, Bos taurus
ggtgtcattcagtctgaggccactgaataagaccaggttgggttcagaagcaaaggaaggtttattctttgatcagagaatgaactggtgtgagctccatyctagagaacaagctctctggacaggctgtgagtggggctaccttctagggatctctcagaagatgaggggtggtttctcttggggctggcacagttgccc

SEQ ID NO: 77224 - DNA, 201 bp, Bos taurus; identical to SEQ ID NO: 37543

SEQ ID NO: 77225 - DNA, 201 bp, Bos taurus
cgactcctatttctctaactttcgtccctgtcaatctcggggctgttttaacacagtagcctcttgtctcctactttcggtcttgttcacctaaaattatytccacacacagcaatcacaaatcgtagtttggatcatagccttaccccacttgtatgcttttgaagtgtaacatccaccggcaagtttcaattcggtcta

SEQ ID NO: 77226 - DNA, 201 bp, Bos taurus
agaaatctttttcaaacaaacagaaaatgagataaaacaatttataaccagcagatctgacatataagaaatgttaaaggaaattatttatgtggaataargtaatattaatcaaaaatttgaatcactattatgaaaggaagagcatcaaaaaataaatgaaagttgaaatacattttgtttttaaaaactgatgtctaa

SEQ ID NO: 77227 - DNA, 201 bp, Bos taurus
tgaaaagagcttcacttcttagcagactgagcttaaaatagtttcttttgaaattgtttcattaaataacaggtccttttacccaatctaatactttcacyttagaatattgtttactcagatttcaaacaccttaaattatttcttcagcaactaacttattttggctaataaatagtagttttgcataatgcctatgga

SEQ ID NO: 77228 - DNA, 201 bp, Bos taurus; identical to SEQ ID NO: 37547

SEQ ID NO: 77229 - DNA, 201 bp, Bos taurus; identical to SEQ ID NO: 37548

SEQ ID NO: 77230 - DNA, 201 bp, Bos taurus
tatcctttaactttctcaatattaatgatacatctttgggttttattcccattaagcaagttagaaaaacttgtaagacaaaatttccagtgtctatactrttcccttcttccctgaataatcttttctaatttttcatttactgaaattttaataatcctttaatatcttcaaatgtaacccactttcttaagatttaat

SEQ ID NO: 77231 - DNA, 201 bp, Bos taurus
tacctgaataaacaactgactgcaaagtgcttttgtagtatatttaaaatcaaaagctgaaaaattctaccaactctctaaaggttcaatgtgttgctttyatattttaaagattcacactagggataccaagatctacaatttctttgattagataaaaaaccttggattttaagtgtcatgtaattggcatgtaatttc

SEQ ID NO: 77232 - DNA, 201 bp, Bos taurus
tgaagtgatgggaccagatgccatgatcataattgtgtccaaactaaatagtggaaaatttgataaacaagctttatcggtaacaagctttttgatcaaaytcttaaaacttaagctatctcatttgtcgttcagtttctttatttaattaaaggtactaggtctaaaattattattctaaattaactaccatatataata

SEQ ID NO: 77233 - DNA, 201 bp, Bos taurus; identical to SEQ ID NO: 37549

SEQ ID NO: 77234 - DNA, 201 bp, Bos taurus
gattttcctttcctcctcttttttaaaaattttttgatgactcatcaggatatagaaatacattggaaggaaccaggtccatgtattgccctctaatcatrtatgtcccctttttgtaaatatgcctccttctttctttatggaggttatttaagatctccagtttgaacagatctagaaaataaataattttaaacaatg

SEQ ID NO: 77235 - DNA, 201 bp, Bos taurus
caattttgccttcaaaataaagattctggagctcctactctggttaagatgttgtactgtgctctgacggtgattcagtcataaataagaaatgactctgrctctcaaatatgggtccattgggagaggtaaaacatgaacacaaataactcaaagacagttgaaactgattagagtctttagggagtcataaattaagtg

SEQ ID NO: 77236 - DNA, 201 bp, Bos taurus; identical to SEQ ID NO: 37551

SEQ ID NO: 77237 - DNA, 201 bp, Bos taurus; identical to SEQ ID NO: 37557

SEQ ID NO: 77238 - DNA, 201 bp, Bos taurus; identical to SEQ ID NO: 37558

SEQ ID NO: 77239 - DNA, 201 bp, Bos taurus; identical to SEQ ID NO: 37559

SEQ ID NO: 77240 - DNA, 201 bp, Bos taurus; identical to SEQ ID NO: 37560

SEQ ID NO: 77241 - DNA, 201 bp, Bos taurus
agaagcaatgggccaggccagtggtttaggagtggctagctaggtttgaaagtgggaccctgtaaagttcatgttcatcattactgttaaagcctatgttkgggggccatctaaaggctccagatattttgacgtgagccaagatctacatggctatggttgaggcaggagacagatggacccccagggcaaacagtagga

SEQ ID NO: 77242 - DNA, 201 bp, Bos taurus; identical to SEQ ID NO: 37563

SEQ ID NO: 77243 - DNA, 201 bp, Bos taurus
tttatctaattcttgcattctcagaaaccagcaggaacaaggaagagtatatactagggatttctctttttatttggctgagaggtaggattcttagttcrgaattactgtatgaagtgagaaatgttgatgacgggagaacagtggtggtgttcagtcactaagccatgtactactctttgcaaccccatggactgcaac

SEQ ID NO: 77244 - DNA, 201 bp, Bos taurus; identical to SEQ ID NO: 37567

SEQ ID NO: 77245 - DNA, 201 bp, Bos taurus; identical to SEQ ID NO: 37569

SEQ ID NO: 77246 - DNA, 201 bp, Bos taurus; identical to SEQ ID NO: 37573

SEQ ID NO: 77247 - DNA, 201 bp, Bos taurus; identical to SEQ ID NO: 37574

SEQ ID NO: 77248 - DNA, 201 bp, Bos taurus
cagctagctgtgcaggcactgtctccattttcttgagagcaggaataaactcagtcaccagtgatcttgcaatgcaacatgaagctgggtttccggggccygcacccactcagctgcgactcttctccgtgtcctccactccacgtggcatttggttaccctaccactgttcctcgcaggccttgagtcagaaaccatgct

SEQ ID NO: 77249 - DNA, 201 bp, Bos taurus
ttgtatgttgaatcctaatgcccaacgtgatcggcatgtggcctttggggtgattagattatgagagtgacacacatcccctgtggtgggattaatacctycacaaaagaggcctgagcgctcccttgtcccttcttccatgtgaagttgctgcaaacgacaccatttgggatgaggacctcactggacaccagatctact

SEQ ID NO: 77250 - DNA, 201 bp, Bos taurus
accaagctttgcatctggtcttcatgaggcaggagagactgctgcaatgtggggtcagaatgtggctttgtgaagacctcagggatgtggccaaggtttcyggactcattccccatccctcaggagtgactcactgacacaccattgaaagttactaaaacatagttatagctcaataagtacagttattatcttggtatt

SEQ ID NO: 77251 - DNA, 201 bp, Bos taurus
cggctcagaatgacccagagaacaggtgtgagactgaggtcaggagccttggataagtcaaaattctacaggagctttgtgacccaggttatgttaaattytgtgaatcccagtgttttcatttgctcatagcaggttttgagggtaaaattgatatgaacctattttgactattgtcacgttttatatggctttttttcc

SEQ ID NO: 77252 - DNA, 201 bp, Bos taurus
aggatgtgaaacaacaggagctctcagctgctgatgggaatgcaaaatggtgcagccactttggagggtagtttgttggattcttataaaactaaacctaytccactataccacccagcaatcatcttctttgatatttacccaagtgaattgaaaatttatgtccacacaaaagcttaatggtttatatacctttattca

SEQ ID NO: 77253 - DNA, 201 bp, Bos taurus
ctccccatatgagcttttctggaattctttatcttgaagaatgtcacctcccacccacactcagacagctacaccagagagctgggagtcaccatggaccyctctccctcaatctcagtgatccatctgtctccacctcttgctaattgctgcctgtctatctctcctatccacagcctcgttgccaactttttttgtttt

SEQ ID NO: 77254 - DNA, 201 bp, Bos taurus
tcctccgtataaatacaccatacctttttacatgtttctgtacataaacagtttctgctgcctggaatactttctctgttccattccttcatgaaacctcycatgatgcctccttcccctcaggcagatgctggtattccttcttggcatctgtagcccttagcatctatctccaggagagcagtgtgcagcctgcactgt

SEQ ID NO: 77255 - DNA, 201 bp, Bos taurus
aagagagacaccacagcctataaagtgggctgagagggaggaggaggagggccaggtggaccgtacaggtgacctgccgtcttggctctgcctggcctcaygctggctgcttttctccttcctgccctggacaggagaggctggggacagagcccagggggagcccgctctgatagggcagctgcgtctcttactggagtg

SEQ ID NO: 77256 - DNA, 201 bp, Bos taurus
tataatattgtaattaaactgtacttcaattttaaaaaagaaactatctaaaatgaagtacatggagaaaaaagactcaaataaaataatcagaaccatastaatatataacaatatctatagatccaatgtatgtgtaattgacatctcaaagaaagaggggaaagattcaagaaaattacttgaaggaatagaggctat

SEQ ID NO: 77257 - DNA, 201 bp, Bos taurus
gaggaatcttaaacttttatgcattttaaaacttttatcttagttaaagcctggggtttgagaaaatgaggtatgtaaccacaaaaaagttcactccttaytggctggaaacctactaaaaaatccatttttttttccagagatttcctaatctgttgcaaccatatatgtttttgtttcttcatgagtcatttcatttaa

SEQ ID NO: 77258 - DNA, 201 bp, Bos taurus
ctcagaacgtacatagactctccccttgtggatggtggcaagaagacatttaatgcagccatagcccatactcagttggaggaccatgcatcatggttcgktgctttgcgccattgactcagaagaacatgatgcccagagagatgctgactgctcagaataggttcaagggcttgactggttgaccagctgcttgagaat

SEQ ID NO: 77259 - DNA, 201 bp, Bos taurus
tgatcaattttttttaaataagaagatgtagtaccaaatgtctcatctttcccttttttttttttttattataagtgctgtaagatttaatttctttatgyacatctgaagcagtgtgccagaaggtttacatttgctgaatctcagtactggatctgtgtgagttgctcagttgtgtctgactctgtgaccccatgaact

SEQ ID NO: 77260 - DNA, 201 bp, Bos taurus
cactccagtattcttgcctggagaatcccatggacagaggagcctggcaggctacagtctacagggttgcaaagagtcagacacgactgaagcgacttagyacacacgcaggtagactactttattttgctacaaattactaaactactgcaggtgcaaggggaagaggatgtggttttggatgtgactcttaatgacatt

SEQ ID NO: 77261 - DNA, 201 bp, Bos taurus
aaattatttttattagaagttatattcctcagacttgatctttaaccacagaaatgacggaataacagtgtttagatttacctgtactcatttataatttytttttccttttgatcgtatgcctgttcttcatgcatattagctggaagatgaattggtttttagccaccccaaattcagggttcccccagctccctggtt

SEQ ID NO: 77262 - DNA, 201 bp, Bos taurus
accagaatttcaattctgtggagagctctgggctgggctcagtgttcagagatatttcagattcaggcatggggccaggtctttgtacctcagggaacccygctctctaataatatttcctctggtcaaactggcctatgaggacagctaccgctgagctggatgatgctcaccagcgcgttccttactgctttggggata

SEQ ID NO: 77263 - DNA, 201 bp, Bos taurus
tgatttaacatttctcaatgatctaattttaaaggaatgaaagtcctatatgcatatgactttaaatacaatggtattaaaaaaacaaactgatttttttwaagtaccatatttgcccatcaggaaaaactgtagaataaactggaatattatgtgaaaaaattttcatataagaattttatctcaagaatttgaaccttt

SEQ ID NO: 77264 - DNA, 201 bp, Bos taurus
agtgggaaacgccaataatagcccctgtgaaaggaaggaaaaccatagtaggccaaattagcggacactgttgtggccctagagatgggctctgctccagraatctctcccttccattctgcatccacagggtgcaggggtggctggcctgaccccgggcacacagcacaaccagagggtggatggggacaagtgtcctgg

SEQ ID NO: 77265 - DNA, 201 bp, Bos taurus
aatggccaaccatgtctacatgaccgagctccaattaagatgctggacaccaagcctcggtgagcttctccggttgtcaatactcaacgtgtattgacacrcactgttgctggggaacaggccctgtgtgtacagctcactgggagagaaatactaaaagctcatgcctggttcctcctggacctgtgtgcctctcttcct

SEQ ID NO: 77266 - DNA, 201 bp, Bos taurus
gatcagctctattcagggcttcaaaaccaggccaagacagtacaatttaaaaaaaaaaaatttttttttttttgtttgttttgtttatatcagctcatagrggaaggaggggaaggcatagggttcaggcctcaaagtgatccacatctttcctgccaacattccattggccagaatgaggtcacatggccaactagtcac

SEQ ID NO: 77267 - DNA, 201 bp, Bos taurus
tcatgtaagatcttggactcccacaaaattgtctctggacgtacccagagtcagtgtccctcccccatcaccatacttgtgggccatgctcttcctctgcytgctcccatcctccaaaaagcccacatgagagtccagcacgtccacatgcccaagtgagaccccagggtccctgtctccctacattaccactgctgccgg

SEQ ID NO: 77268 - DNA, 201 bp, Bos taurus
ctagccccgtgagttgaagggcctgacctgcactagctgatggtccagagatggctcctctgaggacaaagcagggtgggctagagggcagatgccacccrtaaagagaactgtggccagaaggggttttgcctggtaatccagtcctcagtccattttaattctcctgcctttcagagacctggaaccctggatctgctt

SEQ ID NO: 77269 - DNA, 201 bp, Bos taurus
cccctctgtgaatactcagaggcacattgctggtctacagtacccacccattgcctcccagagcctggtgtcctcagggccagaacaagtactgcccagayccactggctgaaaggaacgccttggtgcatgggctctggggaactggctgaaccttggggtcagagaacaagacaacttgaacaaaaacacaggtaaggc

SEQ ID NO: 77270 - DNA, 201 bp, Bos taurus
caagacgacacagcaagaaaagtggccgaggtcagtcccacagtcctctcaccagcagtgtaggaaagacctcaggcttcagacaggaagaggcaacagamaggcctgggaggcctgagacctgtggcccttgctacgcaaggagatgcaaaggacaaaagactcaggtgacctgagatttctcgaacactctcctgcctg

SEQ ID NO: 77271 - DNA, 201 bp, Bos taurus
aggcccctctacctggatttggaagagtgactgtttgacctcttgcagacctcctgagctatatcattctaccattcttcttttctgcaaatcatacagaygccaaccttcactgttgcaggccaaggcaaagctagacattcctgaacttgcacgacatcagtgcctctgggtcccctcaccccctctctgcagcctcgg

SEQ ID NO: 77272 - DNA, 201 bp, Bos taurus
ttttcaagccccatccatgtggcagcattccaggagaggccttggtcactggcaggcatcctctcaaaccagttagaaccacaggtgagctggagcctcaraggtcagtggatcatctggcctggcctgtaccagccagcctggttttacccagaccccaacgtggccgacccaaacaggctgtgccagaaggagactcca

SEQ ID NO: 77273 - DNA, 201 bp, Bos taurus
ggttggctaggctagtaccaattagtacatcttggccagaagcagaattaaagcctacactgctaaccataagtaaagaaaccttggaggaagacctgagygacaaccatggcagcagtaacagcagcagctacaatgctgtgggagggcctgaattttgtcacttttttttggctgtactgggtcttcattgctgtgcac

SEQ ID NO: 77274 - DNA, 201 bp, Bos taurus
aggacatggtcgtgatctttggtccgggaagattccacattccatcatggggcaactactgaagccctcgagttttagagtctgtgttctgcaataaaagmcaactcaatgagaagccctcacacctcaactaaagagtagtccccgtccgtcacaactagagaaatcccgtgagcagcaacaaagacccagcacagccaa

SEQ ID NO: 77275 - DNA, 201 bp, Bos taurus
aatgttctacccacaaggaaacagcttatggaagctctgggcttggtaaccaatggggatcttagaataagcctttcctttctggccccgccccctcaccygaagcaggagtcttgaggctaaaagaaaatgctcttgcctgatctttctctgcacggccacccccacaaagcctctaatcaggtgcctcagacaaacttt

SEQ ID NO: 77276 - DNA, 201 bp, Bos taurus
gagctgtccttctgggcacctattggtgcaatccaaacttctcgtgtctgtcagtcctgtggacagaatgacagagcaataccctattctgacaagttctytctgttgctgctcgttacagtatctgaggcagaaatttcaaatgtagtttgtattgctgcctgacttgggtgctagaaaacattttcagatatttctctg

SEQ ID NO: 77277 - DNA, 201 bp, Bos taurus
ctttgaatattgctttctgagaaagtttaaatgtattagtatttgattgagaccgttgtacatttttaaattttagttaactaaaaatcttgctagtggargtgctcaatattttaattagcatgattattgaaaggaaaaaaggtaaaggacctcttctgaaacaagtaaaacatatatgtagcaactcgattgtaaagg

SEQ ID NO: 77278 - DNA, 201 bp, Bos taurus
attcctgaggagaaaactgaatagagagaaaaaaaaagaagaaaaaagctgttttattgtctctgaactgatgaaagatttgagtttacagattgaaaatscttcctaattcaggcagagttgtcataaagacatatttggacataagctagaaaattcctgaactccaagcttcaaagacaagttataaaagaacagtga

SEQ ID NO: 77279 - DNA, 201 bp, Bos taurus
cagggaacaggtgtgtgagtacctgtgtatgagcacgaaggagaaggctcaggctgaccgcgcagggacatgccatcccccaaagtttggccctagtctcrcctccatttcttctagtttaagagatagttccttgtgtcacttcccttaagacaaaacaaaagcattacttagatttaattgatattttggcttggccaa

SEQ ID NO: 77280 - DNA, 201 bp, Bos taurus
gccccagcttctttccaagctttctgaggtcccactgcccccaaagttgcagactgtaagaaggagaggttatggaatttctccccaccaggaaaagaaarttggtaaaacatgagagtttggctgctgagactttcactggcctggctggggggcggcagggtcctctggagctgttacatttagttcaaatttctgctg

SEQ ID NO: 77281 - DNA, 201 bp, Bos taurus
atggacggtgggagctgagggaggcctggaatgagttctctcgattctcatggctgatgtttccatccagctggaaataatcacccacgggccacacctgmcaccacggggactgattcccaaattaaactctgtgggaggggtgattgggtcaggtgcttctcccatcatctgcgatcaggtgagtgggacctatgtggg

SEQ ID NO: 77282 - DNA, 201 bp, Bos taurus
gattatcccatgggaggtaaagtagaaaaacatactccccacagaaatgaacatactcaatcattgtctagaattttctgaatgaattggggaacgtcaaytagggggcacaggagactagaccacccaataaggagtgccacgtcatcaatgctgcccaaaccagaaagatggcttcatgaagtggatttatggattcta

SEQ ID NO: 77283 - DNA, 201 bp, Bos taurus
tctggaactctgctgggcacctcccttccctttgatgacttccactagctcttcatgcagagtccaagttggtccccagctccacatgtgcataatgacayctcagctctagtccctcatcactgaggggccagaggttattattattatttaattgattgatatttcaaaatcaacttcagtgaggtataacttaataat

SEQ ID NO: 77284 - DNA, 201 bp, Bos taurus
tctgccctgcctcagggaggcagagtcgctcagcgcccctcgctctcacttgcctcagcagtgtttctgggggtttctgagtcccagttttcacataagcrcatgagcctgaaaggcctagtgacagctcattccttggtcatttaagccttgtctgctgcctccctggcccttcctctgccatcatctttaccaccttgc

SEQ ID NO: 77285 - DNA, 201 bp, Bos taurus
ccagtgactccccaacaaacagcaccctcttctctaccctggactttagaggcactgagaaataaatcagaacaggaaagaaaaacatccccctttttacygataggggccagcttggaggataagactctgggtcagggatcttgctaatactgaactcccgaaagaggcagattttgggagcctgcctggacctggtgg

SEQ ID NO: 77286 - DNA, 201 bp, Bos taurus
gctaggtttctcagacatgacactctccagcaaataacaccagctccaataatatttttatttctcgcatgccatctctggccctgttccagggaaatttyattgcatggggaaggtggaattagaagcagcaagttgttaattgacatgaagcacacctgcatattggccccctcttcccacctcccaccttctacctaa

SEQ ID NO: 77287 - DNA, 201 bp, Bos taurus
ggggcggggatgaagcctgcaggcccaactggcaggggtcccctagaaaccagcggacacaacagaagcagggacggtacagactctgggcagcctggcaytgaattcctggccccaggccgcctccctgacccccagggccaatggggtgagtcaccccactgttgcacatcagacgcccaccctcctccctgctcctat

SEQ ID NO: 77288 - DNA, 201 bp, Bos taurus
ataacgttttacgttactaagtgccggagacagggttaagaaagaatctgtcttaagaaatccccctcttcaccagcgtaagctgctgtcacttggcccarcaaggcagaaatcggagaattaaagtgatgccaaacgtgggacaaggggaaatgcgaaaagtccccgcaaatctgttttcctattgttatggacaaccct

SEQ ID NO: 77289 - DNA, 201 bp, Bos taurus
tctccgtccagcagatcatgtcttacggcaccatcccccaggccgaggacaaggtgtgtggaatttgcttggtgtgacactgtctacacctgctcacaaaygatcccttaatatagctggcccatgagagcagagcctcatttcctggaacctggctttatggttcctgtctggtatccctccagtgtcctgcccaggcca

SEQ ID NO: 77290 - DNA, 201 bp, Bos taurus
gagcctcaccgttgtcttgggaaggctgcaggcccagatgcttaccccctgtttcagatggggaagctgagtctcagcagtctgatgcgatcattgattgmcaggcccggaatcctgtgtcctctccacacgctgtctctgcccgcgctccctctgctgaggcggggctgtgccctggctgcctcgctcggtgtcctggct

SEQ ID NO: 77291 - DNA, 201 bp, Bos taurus
atttctaaaagttactcttatattggttcttttggatttttcatttcccagcattatctattaacttcttacattggaagatgaggatttagtgctctctmaccttcacagttctccccctgtattgtatctcatatccactctctcttcaactctcattctacaatatagttgaaacaaattttatttttatatttagtg

SEQ ID NO: 77292 - DNA, 201 bp, Bos taurus
ccaggggctcttcctaacccgggcatcgaaccaggagttatgtctcctgcattggcaatagggccgttttcagctttcagatcctccttagcttaaatgcygtcttttctatatactttaatttctgtgtatcccacttctttcctgggatctcacagagtatatacctttactgcagcatttattttcttggtttattat

SEQ ID NO: 77293 - DNA, 201 bp, Bos taurus
gcaggatattttccttctttacacaaataattttttctctctgttcttttgcaaagaaatctgccttttcatgcattccaacattttctttcttttctctrtaattctgcattccagcctttatcctctcagtcaatccattaacacagaaacaaatttggtttgcaatcaacattttttttattaaagttggttttagag

SEQ ID NO: 77294 - DNA, 201 bp, Bos taurus
atagtgcaataaattttgatctaaatatcaatcaaattaaaacttggtacgctttggagcaactggtcatagccagaaagggtattgtattgtggcattcrgagcattctttttctagtagcaaaagggtcatgaccttataagcatagagaacaaaatgtgtagggaaagagcaaatcagccaacgtggcatggtcagct

SEQ ID NO: 77295 - DNA, 201 bp, Bos taurus; identical to SEQ ID NO: 37582

SEQ ID NO: 77296 - DNA, 201 bp, Bos taurus; identical to SEQ ID NO: 37583

SEQ ID NO: 77297 - DNA, 201 bp, Bos taurus; identical to SEQ ID NO: 37584

SEQ ID NO: 77298 - DNA, 201 bp, Bos taurus; identical to SEQ ID NO: 37585

SEQ ID NO: 77299 - DNA, 201 bp, Bos taurus; identical to SEQ ID NO: 37586

SEQ ID NO: 77300 - DNA, 201 bp, Bos taurus; identical to SEQ ID NO: 37587

SEQ ID NO: 77301 - DNA, 201 bp, Bos taurus; identical to SEQ ID NO: 37588

SEQ ID NO: 77302 - DNA, 201 bp, Bos taurus; identical to SEQ ID NO: 37589

SEQ ID NO: 77303 - DNA, 201 bp, Bos taurus; identical to SEQ ID NO: 37590

SEQ ID NO: 77304 - DNA, 201 bp, Bos taurus; identical to SEQ ID NO: 37591

SEQ ID NO: 77305 - DNA, 201 bp, Bos taurus; identical to SEQ ID NO: 37593

SEQ ID NO: 77306 - DNA, 201 bp, Bos taurus
actcagtcctcattcacaaggcataaagtcttaactaaatttaactctttattagtcatatcaatagaaaagtaaagtcataattcataaatgtgacaaaygtgctcaggaaataataaatctcttgctacagaatatgtttaaactgtaactttaacatatatgaataaatgcttgggaattccttgacagttcaatggc

SEQ ID NO: 77307 - DNA, 201 bp, Bos taurus
accatggcattgttccgaattgttacgactggtgtatctcccccacgacactctaaatgcctcacagaagaaagcgtaattcactcatttttgtgactttyacagggttctaactaaataactgtaggttgctgagttagtgacataagacacttacttacagaccaaaagccctcaggagaacatataaactcaagttta

SEQ ID NO: 77308 - DNA, 201 bp, Bos taurus; identical to SEQ ID NO: 37595

SEQ ID NO: 77309 - DNA, 201 bp, Bos taurus
gctctcagcaaactgcttctgtaattgaggctggctgcctccaggtggcaccagagtgccgtcatcctgaagcggatccgccctgggatagaagcaagaayagtttctctcccccaccagttcatttccgcaactactgccaagatgaatcttcttaatgatgaggtttcttctctgctcaaagcccatcagaggcttcct

SEQ ID NO: 77310 - DNA, 201 bp, Bos taurus; identical to SEQ ID NO: 37598

SEQ ID NO: 77311 - DNA, 201 bp, Bos taurus
aaagtttctaaggtaaaaccaaatactttgattggacaagcttattctaggtttcactttgacttttaatcaagaggcagggagctttgagtacccaagakgactccggcttgcagagttgagttatggtggcttggggttctcaggctatattacaattcccgcttaaatagggtgtgaccttgagtgcacaaaggatga

SEQ ID NO: 77312 - DNA, 201 bp, Bos taurus; identical to SEQ ID NO: 37600

SEQ ID NO: 77313 - DNA, 201 bp, Bos taurus
gacagggaagcctgggcactgcagtccatggggtcacaaagagttggacacagcttagtgatggaacaacaacaaacaagcttgagcaaaaagtgctacartgggtacctcgacttttatcaaggctttccctggttatgctgactaggattatactgtgtgaccacagagtccaggccagaccccaggcagggccactgt

SEQ ID NO: 77314 - DNA, 201 bp, Bos taurus; identical to SEQ ID NO: 37601

SEQ ID NO: 77315 - DNA, 201 bp, Bos taurus; identical to SEQ ID NO: 37602

SEQ ID NO: 77316 - DNA, 201 bp, Bos taurus; identical to SEQ ID NO: 37604

SEQ ID NO: 77317 - DNA, 201 bp, Bos taurus
tatatggtatttcagaaaaataacaaattggtaatattttattaaatggagatattttaaattatttacataaccctatttgtcccattcaagcatcccayagcacaagaacaaaagaagctgatttattagacatacgccagggtgaaaatttttctcagaattcttggttgggctgtgataagaacacaaatttatcta

SEQ ID NO: 77318 - DNA, 201 bp, Bos taurus
caaagagttggacatgactgagcgactgaactgaactgatgttaacaataaacgccaaaatgtcttgtcatataaacagcaatttactgagtgtctgctayagaccaagtactcttctagaagccagggatatagaaataaaacacagttgctgcctgcaagtatacacaatatattataaagttagagaaggaaggcggc

SEQ ID NO: 77319 - DNA, 201 bp, Bos taurus
tcggcgtacgcctgcgcagtcagcagctggagaggcctgcggttgagacccccagcacaactccttttcattgtctgtgctcggcgcctgcgcagtaggasttcgccgggactgggccggagcaggggtagggccgggctcctcgccctctccccaggcgcctgcgcactgagcggccgctccttgccgttaccgctatgt

SEQ ID NO: 77320 - DNA, 201 bp, Bos taurus
acccagtgggctgccaggctgtgcttcactcatgcagaggctgcctgcccatggagtaaggtccctgagcagctggctgggtggtccaggatggctggtayttatggactggtgggtgggtaagtccctaacactaataggctggaaggagaactccaaagggatgtttcccagtgccagggtccttatggcagaacaagc

SEQ ID NO: 77321 - DNA, 201 bp, Bos taurus
tccagccttcacctgactgttgagttctttcaggagaaacaaaagagatggtacaaaaagtgcagacccagcggaggacaagctcctgtgtggacctggtrtgcggaaaagcctggaagcatgagtgagcataaagatttgagagaagagaatggagtgtggctcagctggtaaagaatctgcctgcaatgcaggagaccc

SEQ ID NO: 77322 - DNA, 201 bp, Bos taurus
tcagttattcaataaatgtttattgatcatgtctgccatgccatgcatgtagatttaggcaagattgtagaactcaaagagctcaatttagtgaaaaagaycaaaaggtagaaaattcatgcatgatcagataatgaatttgcatgtccttgaaagggaaaaaatgtaagccttatgttactgtggaaataattttcatta

SEQ ID NO: 77323 - DNA, 201 bp, Bos taurus; identical to SEQ ID NO: 37609

SEQ ID NO: 77324 - DNA, 201 bp, Bos taurus
agttttacctgatttcagaggccatgtgcctggaattgagatagggcaggaaaaaaatcttcacttaggacaatatcttagacatagtcatggataagatraagtccagctgagcagcaggccagatgggcaaacctctgacttgctatgagttatctatccacttggcacttggtttcagcacattgcttcttgctctaa

SEQ ID NO: 77325 - DNA, 201 bp, Bos taurus
tcccggtgctccaggtatgccctgaatcttctgtaaaacccattaggaattttaagaaagtttaagaaacagagactcagagactcctctgcctggtaccwcagtgcatttcagtgcatacaggtaaggtgaaagccaaccattccctatccctcataaagctacggtgggattccacaatgggattccaccatgagaagc

SEQ ID NO: 77326 - DNA, 201 bp, Bos taurus; identical to SEQ ID NO: 37610

SEQ ID NO: 77327 - DNA, 201 bp, Bos taurus
cttgcccatggtggagggagcaggatgctaaagtgtgggagagtggaccagggagaggactgctgttggtttcacagagatggcctgaagggacagaagtraggagctccctagccgggaatgatcctggaggaagcagatctgccttggaaataaggcaccactgttgaaaggcatgcaagaggtggggccgccatcatg

SEQ ID NO: 77328 - DNA, 201 bp, Bos taurus
aaactgtgatcactattcccactacaggcttcatcatggagacggtggaatacaagaacatcagcttcactccgtgggacatgggtggccaggacaagatycggcatctatggtgccactacctttagaacacacaaagtcttatctttgtggttgacagtgtgagaggcctgcgaggctcacatgaggatgctggcagaa

SEQ ID NO: 77329 - DNA, 201 bp, Bos taurus
gttgtgtacctgtaaatgcaggggtgtgtgtgtgtgtgtgtgacagcacagtaaaactttttcttcacagggaacaaaattgcctattttagtcttaaagyatcccgactgaataaatcaaggaaataatccccttgagcttaattattactattctattcctatactgattgaaattattggatatttgcccattctata

SEQ ID NO: 77330 - DNA, 201 bp, Bos taurus; identical to SEQ ID NO: 37612

SEQ ID NO: 77331 - DNA, 201 bp, Bos taurus
gttttcattgagaatgccatatgcgttcttgtcagaagacccttagatctactacttccctctgtgtttgatgccctcctctggcccttacctttttactrctctggtgtctgctcattcattgcttcttcagacaggtctcctttggctagctctatgaagtagcctttcactcaccttgtgatgtgatcagattttatt

SEQ ID NO: 77332 - DNA, 201 bp, Bos taurus
tgaagctgtagattaatttgggtagtatggtattttagcagtatttgttcttccaatccaagaccgtggtatatctttccatctgtttatgttttcatttycttcatcagcatcttacagttttccatgttcaggtcttttacctacttagatttatccctatatgttttatattttgctgcaattgtaaatgggatagtt

SEQ ID NO: 77333 - DNA, 201 bp, Bos taurus
ctttattgtctttttaagactcttgaatctcttctaattctttcaaccatttttctagatttcctagatcactgaatggccaccagggcctatccttgtgycccacacaccttgaaaacctcctgcttcctctgtgagcttgtacctgtacagctgagagctgttggtggaagcctctcaccatgcttcccaacctcacct

SEQ ID NO: 77334 - DNA, 201 bp, Bos taurus
ttttgataattctattatttaaaggttcgaggtgaagtaatgaaattagtacatctggcttaacacagccacattacactgttcacatagtaacagttgtytagagatgcagttttactcctgagtttgttcatgcttgaatatccagatgaaaaataaactggagtcttacagtaaatttgttgttgaactttatttagc

SEQ ID NO: 77335 - DNA, 201 bp, Bos taurus; identical to SEQ ID NO: 37618

SEQ ID NO: 77336 - DNA, 201 bp, Bos taurus; identical to SEQ ID NO: 37619

SEQ ID NO: 77337 - DNA, 201 bp, Bos taurus; identical to SEQ ID NO: 37620

SEQ ID NO: 77338 - DNA, 201 bp, Bos taurus; identical to SEQ ID NO: 37626

SEQ ID NO: 77339 - DNA, 201 bp, Bos taurus; identical to SEQ ID NO: 37627

SEQ ID NO: 77340 - DNA, 201 bp, Bos taurus; identical to SEQ ID NO: 37628

SEQ ID NO: 77341 - DNA, 201 bp, Bos taurus; identical to SEQ ID NO: 37629

SEQ ID NO: 77342 - DNA, 201 bp, Bos taurus; identical to SEQ ID NO: 37630

SEQ ID NO: 77343 - DNA, 201 bp, Bos taurus; identical to SEQ ID NO: 37631

SEQ ID NO: 77344 - DNA, 201 bp, Bos taurus; identical to SEQ ID NO: 37632

SEQ ID NO: 77345 - DNA, 201 bp, Bos taurus; identical to SEQ ID NO: 37634

SEQ ID NO: 77346 - DNA, 201 bp, Bos taurus; identical to SEQ ID NO: 37635

SEQ ID NO: 77347 - DNA, 201 bp, Bos taurus; identical to SEQ ID NO: 37636

SEQ ID NO: 77348 - DNA, 201 bp, Bos taurus
gctcaactccggaggggaatttgtagacctctgtcagagaaaatcataagacagagcgcaggcagcaataccgtggcccacgaggagttacgatgcacagyccctgacaccagctcttaggacgtaacgtatgactctggagaacacgaacaagtgctcaacgaacatgtctaatgggcctaatatgtgccaggcctattc

SEQ ID NO: 77349 - DNA, 201 bp, Bos taurus
tccttttctcttaaaattttcaagccattcttttttcttacccttctcctcttattggggtaactaacaggcactttacccaaagtgtgtcctctgttttrtcagaagatctgactctacttccccaatttagaatcttattctgtgcttcaacatatttttcaactgttgtttttatgacagttatataaatcaatgaac

SEQ ID NO: 77350 - DNA, 201 bp, Bos taurus; identical to SEQ ID NO: 37640

SEQ ID NO: 77351 - DNA, 201 bp, Bos taurus; identical to SEQ ID NO: 37641

SEQ ID NO: 77352 - DNA, 201 bp, Bos taurus; identical to SEQ ID NO: 37642

SEQ ID NO: 77353 - DNA, 201 bp, Bos taurus; identical to SEQ ID NO: 37644

SEQ ID NO: 77354 - DNA, 201 bp, Bos taurus
ataccccaggcagaggatcaagtgcttgagttttcttcgagtctgatttctgacatttgactgatttatgcaatttactttgtagccctaaaatatttaayagacggtctgatttcaagaccttttcaaatgaaaagaacctaatgaaataatgtaaaatcaaaatatttctttacccattataaaacagcactactatct

SEQ ID NO: 77355 - DNA, 201 bp, Bos taurus
caggaaaaggaaggggtttgaaggaacggtataattattcatcatagtctgtataaatgtattctgtttaagtctgaattatttacttgctgctgtctgayaaagctgcttagagatttactctatttaaatgcacagatcttttaaggacaaaaggacgttattttgttaatgctaaaaaatcaacattagccaaattgt

SEQ ID NO: 77356 - DNA, 201 bp, Bos taurus
agctatttggcttcattccagggacatctcaactttggaatttctctggtgggcatcatctttcagctgcttttctctacctcctcttctccagtgcatcrttgcagggtcttgagcttctttgcaggaagcactgagaggaacagcttgttttttttaaccacagtttagcaactgtgccatttattggcctcttgggaa

SEQ ID NO: 77357 - DNA, 201 bp, Bos taurus; identical to SEQ ID NO: 37646

SEQ ID NO: 77358 - DNA, 201 bp, Bos taurus; identical to SEQ ID NO: 37647

SEQ ID NO: 77359 - DNA, 201 bp, Bos taurus; identical to SEQ ID NO: 37648

SEQ ID NO: 77360 - DNA, 201 bp, Bos taurus; identical to SEQ ID NO: 37649

SEQ ID NO: 77361 - DNA, 201 bp, Bos taurus; identical to SEQ ID NO: 37650

SEQ ID NO: 77362 - DNA, 201 bp, Bos taurus
tatttcaaggcaaaatgaaggcacatatctttaggaacatgagattatgacaagcttgcctcaaaatttgattgcagcatcattaattctgccattctgtragcatccagtcagggatttatacacctgtttccctttcctaaatacagtcttccaaaccaactgggggttttcttgggacctcccttctcatttctcttg

SEQ ID NO: 77363 - DNA, 201 bp, Bos taurus
aagggcttattcttaaaaaaccatttatactgagaagagcagaggaagctgactttacctgatgactcagaactagaaagcactgccatgcacactcatcrggacatctctgctatgaggatgcatagatgcatcattccctcagtctccggcttgggtagggtgtgctgggacaagctctccacctttgctgcactcatg

SEQ ID NO: 77364 - DNA, 201 bp, Bos taurus
gaggattagcaaaactgttcatttaagccaggagttgtacctcatgaaaatgaatttgttctgtcttgatccagtggtggtgttggaagggccaagactcmggagtccagacttgattattttcacacagaatagatccaaatgccacatagtcaagtaaagtacaaatatgagattaaaatgagcctgtgctctgctggc

SEQ ID NO: 77365 - DNA, 201 bp, Bos taurus
ctctcaagaaccctttacaattttaaaagttgttgaagaacctaaagtgcttttgtttatgtgagttgtatctgttgttataggaattaaaactgaggggraaaagtatgggatttatacacgtattcatttatatatagcaataaaaaatccatttggtgttaacataaacaatatttttgtgaaaagtaagcatatttt

SEQ ID NO: 77366 - DNA, 201 bp, Bos taurus; identical to SEQ ID NO: 37653

SEQ ID NO: 77367 - DNA, 201 bp, Bos taurus
aaatgaggtgtctggctacatactagacaccagttacagagaaaaattaatgtaatctgataggacaaatttgcctttaccatcattttaacccagaatcygatttcagaaccaaaattaagaaagatggaaagtgatggcaattttgcaacatatcagagttaatactggattcattagaaactcaagcctttacagtga

SEQ ID NO: 77368 - DNA, 201 bp, Bos taurus; identical to SEQ ID NO: 37654

SEQ ID NO: 77369 - DNA, 201 bp, Bos taurus
cttagaactgtaaaaaccatttttagctcgggggctacacaataacaagcagttgccaagggctagatgtggtccatggaccatagtttactgacctctgwttgagtatattctagccatttagtgttcctggggacatggaagatgcagccgttctagacaaaagcccaaaggggctcggagggactccagtagctcccc

SEQ ID NO: 77370 - DNA, 201 bp, Bos taurus
aacactcgcctagtctgcttctcactgcctcctccaggccagaaaggagacagtgtccaaaccaccatgtcagggagtgtgcttccgtggggaggctattygggccagatttcaaaaagtgaatcacattcggggagatgcacgtatacccatggaccaaaccaatgcatgtaatcacagttttttttatgagcagctaga

SEQ ID NO: 77371 - DNA, 201 bp, Bos taurus; identical to SEQ ID NO: 37658

SEQ ID NO: 77372 - DNA, 201 bp, Bos taurus; identical to SEQ ID NO: 37659

SEQ ID NO: 77373 - DNA, 201 bp, Bos taurus; identical to SEQ ID NO: 37660

SEQ ID NO: 77374 - DNA, 201 bp, Bos taurus
tgagttttcagtgacaggtgggagcgcggcccgcaatgaccatggtccgattcagtgggacccggttcttggcaggagaggcaggttttaccaggaacacrgacaggcctctcactgagaagccatttccagataaaacaacacttgcttcacaaatgccaacttctttttctttagagagcctcagatttcagcaacacc

SEQ ID NO: 77375 - DNA, 201 bp, Bos taurus; identical to SEQ ID NO: 37661

SEQ ID NO: 77376 - DNA, 201 bp, Bos taurus; identical to SEQ ID NO: 37662

SEQ ID NO: 77377 - DNA, 201 bp, Bos taurus; identical to SEQ ID NO: 37663

SEQ ID NO: 77378 - DNA, 201 bp, Bos taurus; identical to SEQ ID NO: 37664

SEQ ID NO: 77379 - DNA, 201 bp, Bos taurus; identical to SEQ ID NO: 37665

SEQ ID NO: 77380 - DNA, 201 bp, Bos taurus; identical to SEQ ID NO: 37666

SEQ ID NO: 77381 - DNA, 201 bp, Bos taurus
aaataaatattttttaaaaagagtatggcctaacctagtaatgaagaattcaatgctgaggataaggtctgagggtgtgacaagtgtctgaagcctaagcrgaagggcccacaggcaggatctgtatgcagcttcactctggctggcaggatgcccacggctttacagtggtacagttacccaggtaacaggagcaacatg

SEQ ID NO: 77382 - DNA, 201 bp, Bos taurus; identical to SEQ ID NO: 37667

SEQ ID NO: 77383 - DNA, 201 bp, Bos taurus; identical to SEQ ID NO: 37668

SEQ ID NO: 77384 - DNA, 201 bp, Bos taurus
aatcagctgcacacagcttcaaaactgttttctcccacctggtggcctgacactctccagcccatgcaggcgtacatgtgcacgcgcgcacacacacacayacacacacacttcacctcttggcccaggaagccaaggcaatgagtttaaattctgccttccaacctggatcccagacaaatgacttggcttctttgagcg

SEQ ID NO: 77385 - DNA, 201 bp, Bos taurus; identical to SEQ ID NO: 37669

SEQ ID NO: 77386 - DNA, 201 bp, Bos taurus; identical to SEQ ID NO: 37670

SEQ ID NO: 77387 - DNA, 201 bp, Bos taurus; identical to SEQ ID NO: 37671

SEQ ID NO: 77388 - DNA, 201 bp, Bos taurus; identical to SEQ ID NO: 37672

SEQ ID NO: 77389 - DNA, 201 bp, Bos taurus; identical to SEQ ID NO: 37673

SEQ ID NO: 77390 - DNA, 201 bp, Bos taurus; identical to SEQ ID NO: 37682

SEQ ID NO: 77391 - DNA, 201 bp, Bos taurus
gggagaaacaaggggctgagaggagaaaaaacactccaaaggatctgtaaggagagaggggaagactggggcatcacaggctgaccatccacgtgctgtgygggcactcacatctgtcccgtggtctaaagcctgtgattctgaggcgtgtcacctggctgccatggcaaccagggcccccgtttcccgggagaggacaac

SEQ ID NO: 77392 - DNA, 201 bp, Bos taurus; identical to SEQ ID NO: 37683

SEQ ID NO: 77393 - DNA, 201 bp, Bos taurus
cgtcagcgaaactagtcagttaactgatgtacatcacaatgtgtttgcctattaaaaattcagattatcaggcttctacctgggaatctgtgtttttacaygtccccaccccagaaattcagatgggtgactgaatatgagaagaatatagaagaatgcagtagtctacagatgaaagaataaaaagatatattttttaca

SEQ ID NO: 77394 - DNA, 201 bp, Bos taurus
catggaatggcaaagagtcggacatgactgagcacgcacacacatttttccatgcacttatcagccatttgtacatttagagaattgtctattcaggtctrttgcctgtgttttcagttggcttgtgtttttattattgagttgtaggcgtctcttctgtattttttttttttttggctgtgctgcgttgtctggtaggat

SEQ ID NO: 77395 - DNA, 201 bp, Bos taurus; identical to SEQ ID NO: 37686

SEQ ID NO: 77396 - DNA, 201 bp, Bos taurus; identical to SEQ ID NO: 37687

SEQ ID NO: 77397 - DNA, 201 bp, Bos taurus; identical to SEQ ID NO: 37689

SEQ ID NO: 77398 - DNA, 201 bp, Bos taurus
taaagtccccaggagcgctgtgagtgcttggctgctgcacctccagctgtgcccgagagggtcgcactagctttgtctggcccagcatccaggtgagggtkaaatgccctggtgggctggctggcatgtcagtgggtcccagtgtgtttctctcgggagtttgtcctgggcctggcagaaatctgaggctactggagggga

SEQ ID NO: 77399 - DNA, 201 bp, Bos taurus; identical to SEQ ID NO: 37692

SEQ ID NO: 77400 - DNA, 201 bp, Bos taurus; identical to SEQ ID NO: 37693

SEQ ID NO: 77401 - DNA, 201 bp, Bos taurus; identical to SEQ ID NO: 37694

SEQ ID NO: 77402 - DNA, 201 bp, Bos taurus
tgggcagattcctggggaccgggatggtgcacaatggaaggttacggggcgcccggcggctacattgtgtgtgtctgtctcagactgattatctcattttkctgggccccacgctgccagaacacagagcgctgtttactgcctctgtactcgatcaatcacttactcatacggttgaagattatggctgctcatttgcta

SEQ ID NO: 77403 - DNA, 201 bp, Bos taurus; identical to SEQ ID NO: 37698

SEQ ID NO: 77404 - DNA, 201 bp, Bos taurus; identical to SEQ ID NO: 37700

SEQ ID NO: 77405 - DNA, 201 bp, Bos taurus
cccaggaccctctgctcttctccgcctgtactcacttgcactcttcccaggacaccacgtccagcctcctctggaagcctcgccggccagcccgggcagarctccgtttacactggcagccaccgtcgggctctgtgtcatcgtccccactgctcagcactccccctgcatctgtcacttcacgtcctgggactggcacaa

SEQ ID NO: 77406 - DNA, 201 bp, Bos taurus
gttaaacactttgacttttcgttctcgatacaattcttctttaacttatggagtaagtcaaaagatgagtgctacacttccggggaacagtgcattccccycaaagctaataatacattaaggtgaaacaaaagtaacaatgacagcaaaaccaacaaacaaaaggctcccaaatgtacagcgttcaataaacaggttaca

SEQ ID NO: 77407 - DNA, 201 bp, Bos taurus
ctgggactcagtgccccgccagacctggagccagctcagtgttaagcatgttcatgctgttcgctgagctgctactcagggcctcgtgtgctgcagatatygtctttgctccgcccacatgtgcacgtcccattcaaccaagaagaaaacagtcccagagaggctgtcactttgcaaaggtcaggaagagccctggagtgc

SEQ ID NO: 77408 - DNA, 201 bp, Bos taurus
gctgctccagcctgagagcctaggccccaggtcagaagtggccaatggatgctgcccagtccaagcccctccttttacaaactaaatgttgcacagagagrgggcacatctgcccaggggccctctctgtgtgtgctcatggagggcaggtggtccctgctgggccctctgcactatttggatggatggatggatccatcc

SEQ ID NO: 77409 - DNA, 201 bp, Bos taurus
gcgtggtcaacatctgggtgcccatggccgcctgcaggactggacatgggagcagaaaagccaattctctccctgggctgtgacctagaataggtgtgacycccagaggccacagtcctcagacttggggctcagtgggaggaggcagacacatcctaagagtgaaccccacagtgcccaggaccctgtggctggggcggc

SEQ ID NO: 77410 - DNA, 201 bp, Bos taurus
cacccgccccgtctctgcagagtgcctcccgggggtctttgaagttggctgcccgcacagctgcgggtgcctcaacggtggcctctgtgatccgcacaccrtccactgcctctgcccagccggctggaccggggacaagtgccagagctgtgagtgggtggctcggggacccatgggggaggccaggaggcccctcgggcc

SEQ ID NO: 77411 - DNA, 201 bp, Bos taurus
actaacatttatttatttttaaataaaaaatctggatccttcactattttattctgtatctcacagaagtgcagtcctggctggacctggcctcctggtgkttttttttttttttttttccccactgcccctcggctcccagacacatgaccatggaaccatgctctctgcaaggaaaggccaaaggaaggaccatctttc

SEQ ID NO: 77412 - DNA, 201 bp, Bos taurus
aggggagggtaaccgtccctgggaagagcccagtgactgcctggggctcagggtctcctgacattcaaggtcacctctcaggaggggcttcctgacttccrgagtgggggccactctggggaggagagctttcggagctggctcatgaacctcaccactccactccgcctctctgcacacactagggctgcctctccgcta

SEQ ID NO: 77413 - DNA, 201 bp, Bos taurus; identical to SEQ ID NO: 37705

SEQ ID NO: 77414 - DNA, 201 bp, Bos taurus
gaggaaacaagttctgggaggttcctcagctccccaaagcccctccgctgaccagtggacatccaaggcctcagactttgcctgtacagtcaggcctggartctacagctccggaaagcaatgtctgtacctctctcagctgactgggtcttttaggagctgcccatccacaccaggggatcccagcactgaacatccaga

SEQ ID NO: 77415 - DNA, 201 bp, Bos taurus; identical to SEQ ID NO: 37706

SEQ ID NO: 77416 - DNA, 201 bp, Bos taurus; identical to SEQ ID NO: 37707

SEQ ID NO: 77417 - DNA, 201 bp, Bos taurus
tgtttttcaaaagttatagataagcctttttcataaaagcaactttttaaaataaaatatacagtagcaaatacagtcccaggcctatactcctgcccatmctggaattatgctcctcagaagctgtcatattcattgtctagtgcagaggttggatacctctggcccattgcttgttttcctaaataaggttttattgga

SEQ ID NO: 77418 - DNA, 201 bp, Bos taurus
tagaaaatgtaagtgaccccagcctagaagtcacaaactggaccaagaggtggctgaatcctgtgatgcagggaggcagggcctgagcaaaggtgcttctygcctcagtcctcaagcgagaaccaagtgcctgtaaacatgatgctggcatgggaggtgtgagccccatcccgagaccccagcaggcccctggctctttgg

SEQ ID NO: 77419 - DNA, 201 bp, Bos taurus; identical to SEQ ID NO: 37709

SEQ ID NO: 77420 - DNA, 201 bp, Bos taurus; identical to SEQ ID NO: 37710

SEQ ID NO: 77421 - DNA, 201 bp, Bos taurus
cggctccaggcagcgctaccaccaccgatgtgccatgcaggcctgctggtttccaaaacacccagagcctgcaggcctggccgccccaggagggccagccygggggcagcatgcgctccatgcttagcctgcactcctactgcctggggtcccagcccaccacttcctctttcttctccctgggtcccatgcctgccggcc

SEQ ID NO: 77422 - DNA, 201 bp, Bos taurus
gcctgaacaggtcagggaactggggaggagggcctggctcctagagctcagtctgctggtgtatgactggggtacctcagggcacagctcttgttaggagytggggagacagaagcttgttggcccccatggtcagggaagactgtctggaggaggaggcagcgatgaccttgggccttaaagggcaggtgcttttggagc

SEQ ID NO: 77423 - DNA, 201 bp, Bos taurus; identical to SEQ ID NO: 37711

SEQ ID NO: 77424 - DNA, 201 bp, Bos taurus; identical to SEQ ID NO: 37712

SEQ ID NO: 77425 - DNA, 201 bp, Bos taurus; identical to SEQ ID NO: 37713

SEQ ID NO: 77426 - DNA, 201 bp, Bos taurus; identical to SEQ ID NO: 37714

SEQ ID NO: 77427 - DNA, 201 bp, Bos taurus
cattccctctaaacagggtatttatctaggaagttccccaaggttgatccttgaacaccatcagtctatgcaaaagtttccaatgggccatagtgaaataygaaaaagaaggacaatgttacgagtttttcatgaaatcctgtttatttagtatcaaggcctgctcttgactttgagatcatgtctgcccatcttcccccc

SEQ ID NO: 77428 - DNA, 201 bp, Bos taurus
tcccctggaggaggaaatggcaacccactccagtcttcttgcctgggaactcccacggacagaggagcctggcaggaggccatggagttgcaaagagtcgwcataacttacaactaaacagcacttccactgccggggctcaggttcagcctctggtcagggaactaagctcagtggctcggcccctccaaaaaagtcatc

SEQ ID NO: 77429 - DNA, 201 bp, Bos taurus
ctgagatgcaaaacgatttcttgggggcctcagagtgtgcagctcagctgtctttcctctctgccctctgatctgtaagtgccaatcaggacccagctcarggtgggaaaaggggccgggcttttcagggatgcgccagactcagatggctgaggtgagatgtcacccgtagggcatagctcacctctaagcataggtcac

SEQ ID NO: 77430 - DNA, 201 bp, Bos taurus
gcatcctcggcctatgtcattctttcaaaggttgtaccctgactgcttccctcctgtttcagtccttccccacagacttcacctccagacttcctaattayagtgtgaaaggccaccattctcccagtgacttgggctggaaatttcagtgtccttgagccttctctcccctcctcaccccatttccaacccacacacata

SEQ ID NO: 77431 - DNA, 201 bp, Bos taurus
ggagtcttagccactggaccaccagggacgtccttctgcatcctcttttaggcagcccacctagcagtctctgtctttcaccatttcagctctcactgcaycctcgtttcctgcagaaaagcgtcctagtactgagatagtggaggtgatggttcttgtagctacttcgtaaggcatccccccatcaccctccaacctgct

SEQ ID NO: 77432 - DNA, 201 bp, Bos taurus; identical to SEQ ID NO: 37717

SEQ ID NO: 77433 - DNA, 201 bp, Bos taurus; identical to SEQ ID NO: 37718

SEQ ID NO: 77434 - DNA, 201 bp, Bos taurus; identical to SEQ ID NO: 37719

SEQ ID NO: 77435 - DNA, 201 bp, Bos taurus; identical to SEQ ID NO: 37720

SEQ ID NO: 77436 - DNA, 201 bp, Bos taurus; identical to SEQ ID NO: 37721

SEQ ID NO: 77437 - DNA, 201 bp, Bos taurus; identical to SEQ ID NO: 37722

SEQ ID NO: 77438 - DNA, 201 bp, Bos taurus; identical to SEQ ID NO: 37723

SEQ ID NO: 77439 - DNA, 201 bp, Bos taurus
actttgctccaataacctgacaaaaacccatcttttgtgcaatagtactctcaaagtcttatgtttcagaagcacttaattctgcctattctttcttcatmttcttccagagtaaataagtagggctccatccaccagggaaatggtttcagcactggtgtgtttgaaggacaactcataacacagccaccaagattctat

SEQ ID NO: 77440 - DNA, 201 bp, Bos taurus; identical to SEQ ID NO: 37725

SEQ ID NO: 77441 - DNA, 201 bp, Bos taurus; identical to SEQ ID NO: 37726

SEQ ID NO: 77442 - DNA, 201 bp, Bos taurus
ttggttcctccgcccatcataatacctgtttatacattcttttattcaacaagcctttgttaatcatcacaacctaggtattatgctaagtattaaggatrctaaaatgagttaaaagtcatagctcctatattcaaggagcttgcaatccaagagagataaaaatgttatcaattcagttgataagtattatggtaagtg

SEQ ID NO: 77443 - DNA, 201 bp, Bos taurus; identical to SEQ ID NO: 37731

SEQ ID NO: 77444 - DNA, 201 bp, Bos taurus
ttcactgttgctgccactgcaggtatctgctttgtgcacaaagatctcagtgtcatctctaggagacataaggccatgtctcctgatcttgtaaggccatyaaaaactaagcacatgggttactgagacctacaaaccctttctagtttacattttacccttgagttttggccctgggaattgcccctcttttcttgcaaa

SEQ ID NO: 77445 - DNA, 201 bp, Bos taurus
aacttatgcccttctggcccatctcttggctcaactctgttcaaagaatgcttacaaggattaatgagattacaaaaattgagtgttctgtaagaacagcyatagttatcactgagagacaaactgaaggaggagaaactgaagtaatggagactggctaagaggtaatttaggaggactattacataatccaagaaaaaa

SEQ ID NO: 77446 - DNA, 201 bp, Bos taurus
attcatgcaaatttgtcatcctactccatagtatgtttatttcaatatacattttaaataacctaatagtaaaatgagttaatgtctccctttgaaagatygtcaaataaaattgaaaccctaggaaaatgcccatgatcaacctgggctctatacacccacaccagagacctacagatccatgggaatacacactccaga

SEQ ID NO: 77447 - DNA, 201 bp, Bos taurus
acgatgttattcaacgtccagagcctaggagatagaggccttgcagctcctcttctcaccctgttggaacctagagatcaccatgtagtgaagaagcccgkttcactctattggaagataggaggccatgtggaggagaaccaaagtgccctgaaatacaacatagtcaactgccaaatccgtgagtaaggtacatgttgg

SEQ ID NO: 77448 - DNA, 201 bp, Bos taurus
ttgagtatatagaagtccacatccaaagcagccataaatataattaaaggtgaaaaataacaataaagtgaaaaacttgatgttcttagaagagggtagaygacttggtgcatctaaataaacaaaggccaaaaaaaattactttgttaccattttgaagtattagaaattaggttgatgatctgccaattaatatgaact

SEQ ID NO: 77449 - DNA, 201 bp, Bos taurus
ctctgagtagtctaggtaagtgtataagttagtctgagttattcatctggattgttctttaaatagtgacacaaaatttacattattttaaatagctaatrtttaattttgatcttagcctccacagcatagcaaatataaaacatacatgtgtcgagacatgaagcagagaggaggatgccctcggggggccagctgtac

SEQ ID NO: 77450 - DNA, 201 bp, Bos taurus; identical to SEQ ID NO: 37741

SEQ ID NO: 77451 - DNA, 201 bp, Bos taurus; identical to SEQ ID NO: 37742

SEQ ID NO: 77452 - DNA, 201 bp, Bos taurus; identical to SEQ ID NO: 37743

SEQ ID NO: 77453 - DNA, 201 bp, Bos taurus; identical to SEQ ID NO: 37744

SEQ ID NO: 77454 - DNA, 201 bp, Bos taurus
ggccatctagaattgctttaggaaatgtgcagcctctttgaaggattccactgtgctaatggcttgcacattcaagatgagggatcagtgcaattgtggtrgacaggccagggataagaacaagtggcagcttgatgtgaactagcacttaggttaaaatctgtgaatgtttataatatttctttcctctcatctttttct

SEQ ID NO: 77455 - DNA, 201 bp, Bos taurus; identical to SEQ ID NO: 37745

SEQ ID NO: 77456 - DNA, 201 bp, Bos taurus; identical to SEQ ID NO: 37746

SEQ ID NO: 77457 - DNA, 201 bp, Bos taurus
ccatctctattcattagggatactgacctgtagttttctttctttgtagtgcccttatctggctttgctatcagggcaatgctgggctcataaaatgactytgggagtgtttgtttccctcttactcaattttttggaagagtttgagaagaactggcactgctgctgctgctgctaagtcgcttcagtcgtgtccgactg

SEQ ID NO: 77458 - DNA, 201 bp, Bos taurus; identical to SEQ ID NO: 37747

SEQ ID NO: 77459 - DNA, 201 bp, Bos taurus; identical to SEQ ID NO: 37748

SEQ ID NO: 77460 - DNA, 201 bp, Bos taurus
tttaggatgttgaccagggctgtagtcatctgaagactcgctggggctagaggactggattctaagatggttcacatatgtgatctggttgttgcagaagscctccctactgaagcatctgctgggctgcttgagtatcctcacaacatggtggctagcttcccccagaccaagctacccgagagaaagccaagtgggagg

SEQ ID NO: 77461 - DNA, 201 bp, Bos taurus
gtgagcatgttaggtacagagctggagcagtaacagaggagagcagagcagtagtggagtaatgaagatccttgctgttattttctggagggagaaagccyggctcccctaagcaaagtaagatggaaagaagttactaaagagtagcttgtctcacccacccagcctgacagccagacaggtgagttagcaaatgctaca

SEQ ID NO: 77462 - DNA, 201 bp, Bos taurus
atctgtgaagtgggtttaatttttgcctagttgatttgtaaaaaggattaaatgatttagcttatggaaagccatgagcatagtatcccggccttggttaytgctcagaaaatgacagtcttattctttgacatcacaggctccatgttgcctggaccttcttgtcaaggagataagagaatccaggagtcagaggggcct

SEQ ID NO: 77463 - DNA, 201 bp, Bos taurus
gtccaggaagatttcacatacctcggagcaactaagcccatgagccacaactcctgagcccacatgctgccactcctgcactctgtgcacctagggcctgygttccacaacaagaggagccacggcaatgagaagccacggcacgaccaccagagcgtagtccccactgccgtaactagagaaggcccgagcagcggtgaa

SEQ ID NO: 77464 - DNA, 201 bp, Bos taurus; identical to SEQ ID NO: 37753

SEQ ID NO: 77465 - DNA, 201 bp, Bos taurus; identical to SEQ ID NO: 37754

SEQ ID NO: 77466 - DNA, 201 bp, Bos taurus; identical to SEQ ID NO: 37755

SEQ ID NO: 77467 - DNA, 201 bp, Bos taurus; identical to SEQ ID NO: 37757

SEQ ID NO: 77468 - DNA, 201 bp, Bos taurus
atagggccaccagccatcctcataatcctgcagcggtggagggagttctggaaggacaccaggtaaaagcttgagatctgtgctcctaaaaaaggccaaaraccttgaagaggtgatacccaccctgcttgctcagcagggaaatagaaggatgagcccaggtgaactttaagtcaggagaaggacatttgtggagaaaca

SEQ ID NO: 77469 - DNA, 201 bp, Bos taurus
gaacagttcagagaaggcttatggtttaggtctgcaggactcagcaatttgacattctatttctgttgtttctcaccttaaactgaacagagtcagcaggrttttgtttgtttgtttgtttgtttgttttttccttccctgaactcatctccctattaggtttccttgcccattacttcccactctcatcgtttacttcat

SEQ ID NO: 77470 - DNA, 201 bp, Bos taurus; identical to SEQ ID NO: 37758

SEQ ID NO: 77471 - DNA, 201 bp, Bos taurus
gaggaagaggcgggtacgacagcataccaagaaggaattaagagaggttgggaggatggagagtgatggaagagacagggaaatgctggctgggccaatgrttcaaggcaatgagatgacaataaaggtttggtttcatgatgatttgaaggtcccaggagatgagggccgagaagagaggagaacgtgaagtcgctcagt

SEQ ID NO: 77472 - DNA, 201 bp, Bos taurus; identical to SEQ ID NO: 37760

SEQ ID NO: 77473 - DNA, 201 bp, Bos taurus; identical to SEQ ID NO: 37761

SEQ ID NO: 77474 - DNA, 201 bp, Bos taurus
aaatctctgtgagaaaagagaaaacaaaactgattttctctgaattcccgtccatcctccactccccatctccaaccccatctgtctcctgcagctgcatygcaggcccaatcaataaagggctttcctttcacatggaagctttctgtgaagtttgatggaaaacactagtcagtaatccaaaggccaagcttcgccact

SEQ ID NO: 77475 - DNA, 201 bp, Bos taurus
tcccgtcacctatccttgccagtccttctgggcatggtctctcagcaaggatccaggccctcaggtgaagaggtggcctcctcggccatttaacatctatrgcaatgttatcaaccaccctgtcctagcctttgccaagaagctggagccccagccaatacccagcctgtggccagagagagcgggtgaagagaccagtcc

SEQ ID NO: 77476 - DNA, 201 bp, Bos taurus
agtctttcttgatgtgcctctattaacatcctgttaaaatattttagagactaagttattgcatttccttggatactagtatgtctgttccttgccaggtkatcataggatgatctaagtaaaggagaatcaaaggataagagtttaaaggaaattcttagaatcagtgcctcccagtagttaatgtgtatacatttgata

SEQ ID NO: 77477 - DNA, 201 bp, Bos taurus; identical to SEQ ID NO: 37767

SEQ ID NO: 77478 - DNA, 201 bp, Bos taurus
ctatagcatgggggaaaaaaaagaaaccatttgtctttaaataagacctttgcataaaaaagaaatgcgtaaggttaccttgaatggtgtctatttctccrtctccaacacaggaatgagaataaaaaacaatgtctgtggtgcagcttccagctcccttgcgattagtaatgttatagtacattattgtgttttgttgaa

SEQ ID NO: 77479 - DNA, 201 bp, Bos taurus; identical to SEQ ID NO: 37768

SEQ ID NO: 77480 - DNA, 201 bp, Bos taurus
tttccctcagccacaaggctcaatatctcgattctcaagctctacttggaagcactttcttgtcaaagctttatttccacctcaaatgctcccactcttcrtagaaggcctctggttcttactactactactaagtcacttcagtcgtgtccgactctgtgcgaccccatagacagcagcccaccaggatcccccgtccct

SEQ ID NO: 77481 - DNA, 201 bp, Bos taurus
ggctgggcctcgctggtcactcctggttctgtttcctgaggaatgaaaatccgacaaagcccagaaagcatcaccagccagtgtgatgccagcctcctgcrgagaggccaccaggtgaaatgtgttttgctgcgtattcaaatcccccgagggagcttcgaaaactgcggtgcctggcttcatctcatggcagaatggctg

SEQ ID NO: 77482 - DNA, 201 bp, Bos taurus
ccacctcctgggcaccatgccttctttccacctcatcaggcacactcatccattcaacaagtatttcctgaacacctacttgctggaaatcagaacagtgygtaggacggttgaggagctgccctgggggagctcccactggcctgggtgagactatgagagagacacccgcgtgcactgtaatttcagagtctccaaggt

SEQ ID NO: 77483 - DNA, 201 bp, Bos taurus; identical to SEQ ID NO: 37772

SEQ ID NO: 77484 - DNA, 201 bp, Bos taurus
gtgtgtagtagacatcaataaaatgtttgaaataatagatctatcaccaaggtctgtacttgttcgtgttttcatagtgcttttcatctggctccgttttratgcctggcaaacttctgtttcttctttgaactctggctctaatgtcacctttatgaggacttacccaacttctccaagtgtttggttatgccttctctt

SEQ ID NO: 77485 - DNA, 201 bp, Bos taurus
tagttcttttgaattctgttctttcaagttggaaagcctcctggagtttcctgacctgcttcttgaagaatgggagggacttaatgaaaaaattaatgagrtgaagtctcagttggattcatcgttatacattattggcactgttccgcagtacatagatatggattctggcctgtaagttttcatagctatctgctgggg

SEQ ID NO: 77486 - DNA, 201 bp, Bos taurus; identical to SEQ ID NO: 37773

SEQ ID NO: 77487 - DNA, 201 bp, Bos taurus
gtgacagatgttacaaccaacagctttcacatctggcctccaagatacttcagtgggtcaaagaggcacttggactcttgcctcagagcactggcagcaartttctgggaaggaaaaggccccctgatttctctttctttgcatttgatataaagcaggaaccgatgccttagaaagaattcataggatcactgtttctca

SEQ ID NO: 77488 - DNA, 201 bp, Bos taurus; identical to SEQ ID NO: 37774

SEQ ID NO: 77489 - DNA, 201 bp, Bos taurus
tttggagtgggatgtcctcccctgagggctctctgcacagagaaaggagtagcagcccctgcacccaccctctcaaggggcctgtgtcccagatcctcccrgttccaccacctggacagtggagtttgaaaagggaatagcccagctcttcctgctgttggtgagaagaaactgagagacttcaggcttcagttgctttgc

SEQ ID NO: 77490 - DNA, 201 bp, Bos taurus; identical to SEQ ID NO: 37775

SEQ ID NO: 77491 - DNA, 201 bp, Bos taurus; identical to SEQ ID NO: 37776

SEQ ID NO: 77492 - DNA, 201 bp, Bos taurus; identical to SEQ ID NO: 37777

SEQ ID NO: 77493 - DNA, 201 bp, Bos taurus; identical to SEQ ID NO: 37779

SEQ ID NO: 77494 - DNA, 201 bp, Bos taurus; identical to SEQ ID NO: 37780

SEQ ID NO: 77495 - DNA, 201 bp, Bos taurus
tttgaaatatgcatcaggcaggaggccgttgtggagattgccttgaggtcagggctttcagttccttggttgctgagtctgaggtttctgccaaaggccaygaaatatcccttcattaactggttcttggcggcaaatataattaagagcttgccatagacccgaatgttgtaaaacgaaaggtgtctcctgtggtgtgaa

SEQ ID NO: 77496 - DNA, 201 bp, Bos taurus
tcctttggagatgaccttgatccactgagcaggagcagccccctgttctgctcttaggcatccttacccgacagggattttttttctgtcattttaactaygtggcctctagtcagtagcttttatgtgctgggagtgtgttggagccaggaacgaggttgaggaggaggaagcactgtgaggtgtcagaggctgaccact

SEQ ID NO: 77497 - DNA, 201 bp, Bos taurus
tcggttcacatactattgaagcctagtttggagaattttgagcattactttgccagcatataagatgacatagcaggaaagaagtaacaggtctctaaaayccaagcccctgtctccagtcagaacctgaccatgacgatggtcaaagactagttccgtattcatggctccttctaaagagaaaaactccctgcagcttgc

SEQ ID NO: 77498 - DNA, 201 bp, Bos taurus
cagcagtattagctttatatatctctattgtactttctactctgcacagaagattagtgtgcttcaagttcagggggtgagactaggccattaagtactayggtctgttttcttttagattatagataacagccacaaggtcttaaaaacctttctccccaccattgggccaatatctaccattaaatgttataatctaac

SEQ ID NO: 77499 - DNA, 201 bp, Bos taurus; identical to SEQ ID NO: 37781

SEQ ID NO: 77500 - DNA, 201 bp, Bos taurus; identical to SEQ ID NO: 37782

SEQ ID NO: 77501 - DNA, 201 bp, Bos taurus; identical to SEQ ID NO: 37783

SEQ ID NO: 77502 - DNA, 201 bp, Bos taurus; identical to SEQ ID NO: 37784

SEQ ID NO: 77503 - DNA, 201 bp, Bos taurus; identical to SEQ ID NO: 37785

SEQ ID NO: 77504 - DNA, 201 bp, Bos taurus
gacttgagatatctaaaaccaaattcacatgtgatccagggctctcaacactacaaggacatgtagtgacagcccctgggtgtgttgctgaacatgttacrtgcaaaacacacacctgttaggtgccctttgaaggcgagctctgacacatttacttactcctttgaatccttaaattcagaccataggaaaggtcacccc

SEQ ID NO: 77505 - DNA, 201 bp, Bos taurus
gattaggagaagctctgctgcaagaagaatgatctctggggactctggggaatcagccctcatgtgcttggttaggtcagccctcttagacaacaaatacycttccatatgctaacttcagattgaaggttccttgcaaacaatggctctgccctccgttggagcttccttggaaccctaaatatttggctctctggattt

SEQ ID NO: 77506 - DNA, 201 bp, Bos taurus
caatatataaatactagagaataagtggcataaaaaattcaaagtgtggctggggacacatcagaatgcatatggcgggcagatcagacagtgtggcctcragcacatgataaaaagacattgtctgtaatggatattgaagtccctagcctgacctccagagctttacaatctggcctccacctgcctgtcagccttacc

SEQ ID NO: 77507 - DNA, 201 bp, Bos taurus
caggcttaacaggcagggactccggcattgtggctctctgtccagcgtccctagctctgaggggacgtgaagcagcggccctcccacgtcccttgagctgrggctgctcactcggtcaactggagaacttggctgctggagtttgctaagaaggatacactgcatgaccgctccacaggcccctggatatttgtccaagaa

SEQ ID NO: 77508 - DNA, 201 bp, Bos taurus
aggagacttggtagaaacagcacgtaccccccacacccaagcagagtggcaatgccaggctccttcccagggagccacactcctcatctcagcatcaagcygctctatcccttttgtctgttttatttttgtttaaactttttattttatattggagcatgctgtgatagtttcaggtccacagcaccatgacccagccat

SEQ ID NO: 77509 - DNA, 201 bp, Bos taurus
gggctcaggtgatggctactgctatcatgggcttccacctgttaaccaaccaacgtcagcctcccagaagggcaagcagggcagagagaagccctcaagtkgtcgtgagggaatatcagccccaaacagccaactcttccagcacagcctctcccatccccacgcccactcaaaaggagatccttatttctaaccagacta

SEQ ID NO: 77510 - DNA, 201 bp, Bos taurus
aggaaaaagaacaaacctggaggcataaccctcccagacttcagacaagactacaaagctacaataaccaaaacactgtggtcttggcagaaaaacagacrtatgggttaatggacaagaaagacggcccaaaacacccatgatcaattaaccttccacaaaggaagcaataatatacaatggagaaaagacagtctctta

SEQ ID NO: 77511 - DNA, 201 bp, Bos taurus
attatattgtccatgtgggggtgggatgcttctgctcatttgatgctggctctcactgtcccccaattctgaggatgcctcacttggcctttcctcttaaygagatggctgaggggttgggcggggtggggtagaccaagatccaacttgtggaccagccagagtacttggctctcctgtggcctcggggccatcagttga

SEQ ID NO: 77512 - DNA, 201 bp, Bos taurus
gtaaaagggtatcagttttggccatcacctcacttaaaggggaggacagcaacgaaccagcagagagtacagtgctagttacctcaatgccactgtgatarctggccactcttctctcttccttcagaccaaaattacccagcaccaaaaaggagaggaagtaatcaagtcagaccccaacagaggcacatcatctctcag

SEQ ID NO: 77513 - DNA, 201 bp, Bos taurus
gagggggcagggaggccgcatgcatcctgccgctaggcctgcggcctttcaggtcacaacacccagttccatcccgatcatgttgttccaaatcccatatyttcttaagggaaatgagcggtaaataaacattttaagcactgactgggtccccggcactttgttcattgcttcacaagagatatgcacccagtcaacccc

SEQ ID NO: 77514 - DNA, 201 bp, Bos taurus
gttgttgttcggtctgcttggaaagtcaaataatgtaaggttctgagcttgttcgactatcactgatttcataaaaattctttctcggcaccactaataayggtggattaatgttgttactgagaaggcagaatgacttgacctaacacatgttaactctagagatgacctttaacatgttctcgggaagcctcaacttct

SEQ ID NO: 77515 - DNA, 201 bp, Bos taurus
ctttcactattttatttttctccacagcacttactaaattctaggctggtgcttctcaactgggagtgatcttgtcccccaggcatgtttggcaatatgtrgagacatttttgttacaactggaaggggatggtggcattattgacatctaatgggtagaggccagggttgctgctagacatcatacaatatataggagaa

SEQ ID NO: 77516 - DNA, 201 bp, Bos taurus
gtcctgtggtggagacagactgtaaacatctttttacaatatatttgtgcaaactgtgattcgtgttttaaaggaaccagggcgctgagaagaagatagcrgagtggaactaattaaatagagaagtcagcaaagtcttctctaacttgggattttttttttcttctgttttttaaattaaagtataactaaggtacaaca

SEQ ID NO: 77517 - DNA, 201 bp, Bos taurus
ataatggctttggaataattatgtttgtcaaagtagccctgattattcgaacttgtttaattatttttgctattttatgcagggcaaaaaatacagttgcrtggtccttattgacaggtgctttccctgctttctaagccttaaactctatgatcagtgcctgcttttgtggcaaaagaacaaaaacatggcttcgtggct

SEQ ID NO: 77518 - DNA, 201 bp, Bos taurus
gacacattgaggctgtgagaaatttttaggttagtgaggaatgtctctagatttttctgtgattatttgtagctctttccataattgcagtgatctcacarttttaccttttaaccaaagtctaatccaatcttcaagcttcctgctaaagaaccacccaggaatgtttggggatttctgtgtaaccaggccctaggaaag

SEQ ID NO: 77519 - DNA, 201 bp, Bos taurus
tcgtcagggagtcccaccagtcaacagatgacttagtgatcaggacattctggggacccagtagaggaaccctggttcagccagatgatggtgagggaagraatgaggtgtcagcagagtgggtaggctggggtagggttactgtatttcagagagagtttgagcctaggccagagggtggaggggaccctgttgtgactg

SEQ ID NO: 77520 - DNA, 201 bp, Bos taurus
tcctttttgttctattcagcggagtcagctaggccatctttcaaggtcaggagacatttcaaactttctaattgggccagttagtctaatgttagtatgtmcttaaccttcgttactgagaaactgtacttaaaagcatttttagtgaatccttccagggttacccgtttttggcctatagaaacagaaactagggtttag

SEQ ID NO: 77521 - DNA, 201 bp, Bos taurus
ccctgcccctggtataacttccaaactggtctctcctctctcattctcacatttctttgctcaaaatgcaaaacaatgggagagggggcctcacttccaarcttggtcacatgtgtttctgttggttattctgttaaaaggaaaataatctttcacgagcggtcattatatcaaggcctcagagcacttgcgttgggtgtc

SEQ ID NO: 77522 - DNA, 201 bp, Bos taurus
ctctggactgccagcatctttaatgaacagatggagccatcctcccttccttggctatatctgtttaatcagctttggaaggagctatcataccaccagcyaataaaagtcttaataaatatctaaactgcaataccaccagacaggtgttcatgctattagaaaaatctgacaaaagaatgcctggatttttatttaaga

SEQ ID NO: 77523 - DNA, 201 bp, Bos taurus
aagccctctcatctcccattcatctctctttctaaggctctggattggctcaggcacgatgataaaaattggggtggcttttctccactccaacagttgcrcggtcaaaggaacaaatatatgcacatagtcacgcattaatcctgggagatgacaggcaccgttcgagatagcagtgttcggtttccggtaggacgttga

SEQ ID NO: 77524 - DNA, 201 bp, Bos taurus
ctaacttgcagcagcatcctaagtgattatgcttgcatcctcattggagtaagccttgaccaggtgatctgctgtgcatatggccagctcttctcatcccygcagatagaatcatgacttcactcccttaggtcctggactaggacatttacaggtggcctgcctggatatcatcaggtgacagtaaggatgtcaatctta

SEQ ID NO: 77525 - DNA, 201 bp, Bos taurus
ttgggggaatctctctctctctctctctctcacacacacacacacacacgcacacacaaaaccagcacaatgggagctaatccataggggcccaaggtgcmggtgagggcgaggaggggcacaagtcccaggggaggagctgtgaggaggtcctgaggtggttagaggccaagccagagctcagcaacttgttcaccacgg

SEQ ID NO: 77526 - DNA, 201 bp, Bos taurus
ccttaattttctcaacagtaaaatgggaataatgatggcagttgtctcatgtttatgtacgttctaaatatccaataaatgatccttattattgcaagcarttaggaagttttactctgtactctaccagtgtagagtaagcaggttgtttatcattcttttctgcagttctctatcttactcagaatttcaaacttagaa

SEQ ID NO: 77527 - DNA, 201 bp, Bos taurus
ccatttctcctaagtggtttgagaacttaatgtaagcaagtttagttccttgagacaaaaatgttacatctttaaattattacctgtagattaactcactktgctaatttaaggggggaaaattctattagcttcttttgcccatagctcactgttaacccaagttgtttatttttcactgaaattgtattgtgtccagag

SEQ ID NO: 77528 - DNA, 201 bp, Bos taurus
tagcagaaagaaattttattaaataaagaaataattgtcaagaaatttacattttttaacgaggtcaatgatgatatttagaagtcccatgagagtatatyttaatgactgttataactttcagattgtcagtgtagggatgttttaattccaacattgctttttaatacccagggctttcttctggagtggtgccctgtg

SEQ ID NO: 77529 - DNA, 201 bp, Bos taurus
ttgaaagaaaagtttgcagaagatagccttctcttcctcctcctcttcttcctttttgcatagattattatacagtaccctctgccttttgagtatgtgamcaggaagtaaataaatatgtattggtactcattagaagtatatacacaaatgccgtatatgtttgcttcacattctgccacttggtttttcttgcaggct

SEQ ID NO: 77530 - DNA, 201 bp, Bos taurus
ttgtcagtgactttgggctgatccactgtacactgatttattaaaaaaaaaaaaaagaatagtactgttaataaggagtacaatcgctttttttttttttwaaaggaaaagcatctttttaattatcttttgttcattgaataattccccttaggaactaataaaatgcattttatgggttatactcggctgtgtttgggg

SEQ ID NO: 77531 - DNA, 201 bp, Bos taurus
tcctcctcacaacagcacactgtatcttccccagtagcagcttccctctctgcgccccatccccgccctctcaagggttacttgccttctgagaattcccygcattttccttcttgtgtagttctctgttcaacattttaaaggcaactctatcaattgagaagagtctattccaaatgtaccatctaatctttgcaactg

SEQ ID NO: 77532 - DNA, 201 bp, Bos taurus
cactgtacaaagaacaaaagaggaaagtgaaggacagccagaaatccatgtctcccccagagaagcccaaaatgtgtttcaacgttcagaatgtattacckcagtgtaatctcctcatgaagcaaatactgaactataggaagaaaggaagagatgggctgcaaagggaatgggcagctcttctagaaagggccatggtta

SEQ ID NO: 77533 - DNA, 201 bp, Bos taurus
cccactgaggagaagcgatgctaccagggaagctgtgggcacagcgagcttgcaagggaagaccagcatccgctgtggagtcgggcccagaaacaagggcrggaagagcgccgcacttaccgctctccaccttaaatttctcatgccgccccttcaggccgtcgatctcggactgctggtcagcaaggaacttctcaagtt

SEQ ID NO: 77534 - DNA, 201 bp, Bos taurus
tcctttctcacaggagggaagaagagaaagatggtgcagaggcaggagggtttataccatcagaagggagtacaggtctgatcacctcagtatggcttttkcttcattcacctcacttggtgcattggacctttcaaactgaatggttgtaggtttgtttgtttgtttcagagcagtttaggtttacaatagaattgagga

SEQ ID NO: 77535 - DNA, 201 bp, Bos taurus
ggtgggccagaaacacttatcagagtgcccatgagcagagacgataatgtgagcccatcaactggctctcatgccaaaaacatccctctggaagcaggaarggaagacctttcctcctgctctggcctcatggtgcccctctaggacctggtgctgacaaagtctaaaactgatccaggagaaatcaaaggagacgtgttt

SEQ ID NO: 77536 - DNA, 201 bp, Bos taurus
aaataatttagtttctcagctttaccacataatatttatcaaatgctcactaatctaacttcttagagttttcaacttctaagaaaatacttttatcttcmttaaatttcttagatgttaataagaaagctaattttaaaaataatatttttcattgtatgtgaactttggagtgagttttattgtggcatttgttagcca

SEQ ID NO: 77537 - DNA, 201 bp, Bos taurus
ttgcttccatggccttgcatgatctgctcctccccgtacgtccaaactcaccatgagccacttttactcttgctcaccattcaccagccagtgttttctcrcagttcctcaaacggcctgcctggaactctaaattctaaattcatgcctcctcaccctctatagttgctcctttactgagatcaagttcccagttattct

SEQ ID NO: 77538 - DNA, 201 bp, Bos taurus
acagcaccacagatacatgtgactcttggttaacacaaaacctccctaaggatgccccttcaaacatggaggagaagcgaggtacctctgctctcagagcyacaccaaacatctgaacggacacgggccagtgtctcctcacccacgaatcccagactctgcttccctggcaccattagtgtcctcttaggccgaatgcac

SEQ ID NO: 77539 - DNA, 201 bp, Bos taurus
ctagttcatgcaaactcagaggattcgacacgtataggcagtacttccatgaaatgcctgcctgatatggtccctccagggccacttaccttccctgctarcggctgttatgtttcttgtgggactcaccccgattgaaggtgctgtgtgtgtcctgggcctcagtaacataatcccgattccttggtctttcagttggtt

SEQ ID NO: 77540 - DNA, 201 bp, Bos taurus
tcattttctaccaatgtaatgctctatagcttatacaaaaaataatatagatcttattagtccatgtatttaggtgtctataatacaccatggccttaccrttttgttatatttctttgttttaaaaaaaaaaaaaagcttgagtgtgaatgagcatgcacaacaaaataaaatcttgaaataaaaacatcaaaatttgaa

SEQ ID NO: 77541 - DNA, 201 bp, Bos taurus; identical to SEQ ID NO: 37792

SEQ ID NO: 77542 - DNA, 201 bp, Bos taurus; identical to SEQ ID NO: 37793

SEQ ID NO: 77543 - DNA, 201 bp, Bos taurus
gaaaacctgttaggtcagtcaacagcaaagggcacaaatctcccccagatcaaatcagatccaggcagcagcttagaggaaagccataggccctgatgagytgggctgtggaaaatgtccctggtgaagccgaagacccatgactgctaggagggcagagggagaggaagaggatttgcatgagcaagaaaatccaagggg

SEQ ID NO: 77544 - DNA, 201 bp, Bos taurus
cagcgttaaaggtcttatggccaaaggaaaggatcctgaagggttggtggtgggatgggggagagttgaattttaactcagccaaactggggactaatttycttggcagttcaaaagctcttaatgaaggctttctgccagacagaagcagcgtgggccactgggcaggcatgctgaggccatccttcagagaacaggctg

SEQ ID NO: 77545 - DNA, 201 bp, Bos taurus
tacaaagatgctaaaacaggatgtaactgcagcctgcggaggaaacacactggctgatctggaagtagagtgtcctgagagggcctgggaaggctaggtcyagaggtgagggggccaggtgtgcgctgagactggagagttaaggtgttgctcacctagaggaccaattaggaaagtactttccaggggggaggaaagaac

SEQ ID NO: 77546 - DNA, 201 bp, Bos taurus; identical to SEQ ID NO: 37794

SEQ ID NO: 77547 - DNA, 201 bp, Bos taurus; identical to SEQ ID NO: 37796

SEQ ID NO: 77548 - DNA, 201 bp, Bos taurus; identical to SEQ ID NO: 37797

SEQ ID NO: 77549 - DNA, 201 bp, Bos taurus; identical to SEQ ID NO: 37798

SEQ ID NO: 77550 - DNA, 201 bp, Bos taurus; identical to SEQ ID NO: 37799

SEQ ID NO: 77551 - DNA, 201 bp, Bos taurus; identical to SEQ ID NO: 37800

SEQ ID NO: 77552 - DNA, 201 bp, Bos taurus
agcaaaataatgacataatcaccatcagtgtcacagaccagactgtacacaaggtgacaggggaggggggggctgtaatacacacatgaggaggacccgcyggggcccactgcggctgcgccctgaggcccgggatgcgggcacgaccacgtgcccacctctctctagcggagtctcacttcctaaggtgaggcttgtccc

SEQ ID NO: 77553 - DNA, 201 bp, Bos taurus; identical to SEQ ID NO: 37807

SEQ ID NO: 77554 - DNA, 201 bp, Bos taurus
caagccgagtaacatgatatccagggcccagatatgagagagaacgggggtgggagggagactttaaattgtctagtatgtcctggattcttgctcccccmacccaccccagtaagccaccccttccatcagacactgcccactcaccctcactcactcacacctttgcacacccctccccttcccttcccaagtgccggc

SEQ ID NO: 77555 - DNA, 201 bp, Bos taurus
accacggagatgtaagataattcctcttactgacggggagcctctatcatttcagaatatgcttatttttcagcaaggaaaccaggccaattcactcaacygcttacaatgtcatcgtgcatttgtgaaatggaagctttctctgggctcaatgtgacaaaatgctgatggctgactttcagtggccgcgtcaccaggaaa

SEQ ID NO: 77556 - DNA, 201 bp, Bos taurus
atggtcctctattctctgcattactctaaagtcttctttctctctcctctcttcctctaagttctcatcccatcatcgccgtattctgctgaaggccttcycatcgttcttcccattcctgttgctttcatccacccttgaactgaactaaaccatcatggcaacttctgggctccaactttccagttctgggcctttccg

SEQ ID NO: 77557 - DNA, 201 bp, Bos taurus
aattacaccaaagtttgggagtggtaaaaaggggacccacagcagaaatccctccagctcaaaggcatcatttgcctgccccacaggcccctacggtgcayaggttaataagttcacccaagacacgtggacctgggctcccccgagggacccatccaggaacatggccagtcagacatgtcccctctgaattgcttcctc

SEQ ID NO: 77558 - DNA, 201 bp, Bos taurus; identical to SEQ ID NO: 37809

SEQ ID NO: 77559 - DNA, 201 bp, Bos taurus
aataatgtccatgtgtggtgactggtatatttctaaacagaatccacagactagaaacactgccctaatgttacatttaaacatgtataacatttaaacayataacatgttaaatgtataaccatgtgcctgaaacagaaattattatacattttggttaaaagttagaattgtgactatggtcaccacggtttgtatgaa

SEQ ID NO: 77560 - DNA, 201 bp, Bos taurus
ttaggggcggggagggggtgtgtatggaaaaaggaagaggggagcagaaggacaggagccacaggtccttgtggcctggaagcctgcaagcatgctactgmatgtgcataaaggggtgaggtgggtcgagggggcagagaaggttggagaggtggagagagccctgtgaggccaaataggattgctgggcttcatcctagt

SEQ ID NO: 77561 - DNA, 201 bp, Bos taurus
aagtgtggtgtcaccatctgtcagcacctcaccaggctgccccgtcccggtgagcagcccttctgcgaaggacggactcagagccagggtcccaggggccratgtagctgagagcaggacacacggagtgtgcatcttgtacccgcaggcgttttgccacagctgtctttcaactccagcgcattcctgaagggagcattt

SEQ ID NO: 77562 - DNA, 201 bp, Bos taurus
agccacaccctgcagcaggctctggccccagacacccccagcaatctcggcctgagcagtaccagaaccggggagcctttggagtgagtggcctgagaggragagaataccttagccacagcttggcatgcaggtatcagtcagagggaagaaagttgggctgtgagagaacttcctcagaattgagtcaattttcagaaa

SEQ ID NO: 77563 - DNA, 201 bp, Bos taurus
tgtccagggactggggtggccctaagggaggtcccggtgcccgcttgacacccgtttctagtaggagggtgcaagttcctgttcatcttgggacacccctsttgcaccatctctggggcccagagtggttgtgggtggcaggagcgtgtcctgcaggggggtctgagggggcggtgattcaggtcctccgggtccagcggc

SEQ ID NO: 77564 - DNA, 201 bp, Bos taurus
acccaaggatagaacccacatctcctgcattgcaggctgattctttaccactgagctaccagggaaggccaaaacagcaaacgtaaattctaccttaccarcaattacattcaatataaatggattaaacattagtcaaaagcagagactgtcaaaactgattaaaaaaaaaaaaacaggtttcaactacatgctgtttac

SEQ ID NO: 77565 - DNA, 201 bp, Bos taurus
ggaaaacagctggcacctttccagctcagatccatgtggacaaagtgtaacataagcaggttggtataaacactgaaaagatcttggatgcccacagatayctgaatcactccactgtaagatggcatttcagagcaggaagaaaaattctctttcatacacatattacagggctttccactggtttttgttaaggccaca

SEQ ID NO: 77566 - DNA, 201 bp, Bos taurus
aaaaattagtagacaaacagagctgctgctatttccctcccctcccacatcagatcagatgctatagatatgccaagtcctctgccaatagccagcgccaytgattcctggcacctacttcctacttctttgctctctgagtctcttcttcgtgcagttttgcttccgagagtccacaagaaacagtgggtgggtgcaaag

SEQ ID NO: 77567 - DNA, 201 bp, Bos taurus
cccatttattatttattgttttaccatttgcatgagtcagaagtccaggcgtgacttcactgggtgccctgctcgtgttgtcacagagttgcggtcaaggygtcagccagggccagtcttgtttgggatttgggtgcagggtccccttctaaactcatgtaattgttggcaggattcatgtcctcacagctgtgagacttg

SEQ ID NO: 77568 - DNA, 201 bp, Bos taurus
agaagactcctagagcaaactctgatctaatgaggggtgtagggtgcatccagagagaagcgaaattcagacaaaattcaggagtcccttctcagccccckaccccgaccccacccatttgcctaccacaccttctttgctgtcttgatctgtgggtctcaccttcttgcccccatagcagacccatgaccctgagcaagt

SEQ ID NO: 77569 - DNA, 201 bp, Bos taurus; identical to SEQ ID NO: 37816

SEQ ID NO: 77570 - DNA, 201 bp, Bos taurus
actagtgttcttttgctgtgtaacggtagtaccacaaacttagctgggtcctcagcttagaatctccaggctaccatccaggtgtcagctgggatgtgttytcatctgaaaatgtgactggggaagactctgcttccaggctcaatcaagttgctgacagaagcatttctttgaggttctgaaactgagggccctggtttc

SEQ ID NO: 77571 - DNA, 201 bp, Bos taurus; identical to SEQ ID NO: 37818

SEQ ID NO: 77572 - DNA, 201 bp, Bos taurus
acgcaaacacacacacatccatacagtatgcggacaaagtatggaaatgacatggcctacattttctggtataatcctcaaaaagattgcccatatcacaytatgaaatattttgcactataaattttaaaatcacaataaagacattattctttagaaatctgtttatggttacttaacagtcatgatttacaaagtaat

SEQ ID NO: 77573 - DNA, 201 bp, Bos taurus; identical to SEQ ID NO: 37819

SEQ ID NO: 77574 - DNA, 201 bp, Bos taurus; identical to SEQ ID NO: 37820

SEQ ID NO: 77575 - DNA, 201 bp, Bos taurus; identical to SEQ ID NO: 37821

SEQ ID NO: 77576 - DNA, 201 bp, Bos taurus
gtttaagatgctcaccaagggatagcaccattttccaggcacaggcctttgtgttaaaaggcaccattaaatcagtgggcacgaagggctgctggcgctcrggttggagaggccatgaagggcaccccacctgttgaacctgggttcggttcagttcagttcagtcgctgagtcatgtccgactctttgcgaccccatgaa

SEQ ID NO: 77577 - DNA, 201 bp, Bos taurus
ccatttctcagcctcccctcccagcgcgctgtccctgagccagtcttgccaaaacccaacgagagagcccgacccagagaaaaggcgtttaaccttggccrgggagctcagtggaaagtttttattacttgtcatggcaaaaaaaaaaaaaggagaagaaaaagaaaatcatgcttttgaaaataacctcttctttgaggc

SEQ ID NO: 77578 - DNA, 201 bp, Bos taurus
cccctcttcctcggtttccgcagggccagttcctctacaacatgttggggctccctccactttcttctcccaaagcgaagcagacagagacacacttggtmgttgtttccaccagccctgatcggcctgaactggatctgcctccagtcaaaacactgagagatgaagacagaaaattggctccagtttccagccgtgagt

SEQ ID NO: 77579 - DNA, 201 bp, Bos taurus
gtgggcgtggggtgggcggggaggagaggaggtgagtctgaagcagcaggaagcagacaggtggggtcaccaaggccccagctgaggccttgaaaggttgytttctcctgtgcgctctgccaccgatttcctgtatggctaaggacagtcatcctgggtctcagtttatttgctgcaagatgagaggctttgctaagatga

SEQ ID NO: 77580 - DNA, 201 bp, Bos taurus; identical to SEQ ID NO: 37829

SEQ ID NO: 77581 - DNA, 201 bp, Bos taurus
gcaaattctaagtctcagtcagatttctcctgcttcttttccctgggcataatttaaggaggtcttttctttaagaaaagttcagccatcttcacactccrgatccagctccttgtccatgtggctggcagctcagtggactgcagtttgttctgctgcccagcagtttagattaagagaccagaaaaggaaacttaccct

SEQ ID NO: 77582 - DNA, 201 bp, Bos taurus
ggaagaccaggacccccacgaatgccagagtatgagcctgggaccccccacctcccctgcaaccactggctggggtgctggcctctctgggccgtgatgayctcctctgggacacggggagaatctcatctttattattaatatttaaatctaaaccaattgccccgtaactaaagctctccttgctctttggggaaggag

SEQ ID NO: 77583 - DNA, 201 bp, Bos taurus; identical to SEQ ID NO: 37830

SEQ ID NO: 77584 - DNA, 201 bp, Bos taurus
ttactagaatttctaccttgtaacttctcaggaaggcttacaggggatcaagagggagagggagccgtgccaaagaggccagttgactaactgagggaacrtcgatccacccccaccgtgctccatgactgccccgcggcattttggaagaagtaggccagagatcactggggaacaatggctgcggggttcactgccaca

SEQ ID NO: 77585 - DNA, 201 bp, Bos taurus
attaggtggctcccagccagtgactgagattggcagggacactaaagcagactgccatgggagatcctggactcttttgaaagtttggcttgatgactctmtggtgggcctgctgaacattcctgagtctgtctggtgttctagaacagtttcttcctctctgcttcctctggaagatgagacttgccatgtgggccaatg

SEQ ID NO: 77586 - DNA, 201 bp, Bos taurus
ctttctgagctcgtcaacaaggccccgtcaatgggagcaacaggacaccggaccagcacggagattcagcccatcagtcaatgtttctgcaggagacaacrgggccctccctggagagtctcggccttggggacagcagttacttctgcagggaagctcggtttattcaaaccagaaggcagagaggaatgcggattgcca

SEQ ID NO: 77587 - DNA, 201 bp, Bos taurus
tccgtaagggctggtactcagtagcagctctgggccaacatcttccaaagaataccacttgggagtgcccaggatgccggttatcccttgtttgccttccrtggaccagttcggcccattcatgtctctctctttccagtcctactgtggagaagtaactcaaagcacagaccgtctttgtgatgggtcagttaaatcaac

SEQ ID NO: 77588 - DNA, 201 bp, Bos taurus; identical to SEQ ID NO: 37834

SEQ ID NO: 77589 - DNA, 201 bp, Bos taurus
atccctcgacagaggccagaatagcatcaaccagaatgatttctactctcttctctctatgtgaccattagacatgtgttcctctggaggcagcccagagyggccttgattaatgcccacaggttactgcagactgcttctcttcctactggcgcttggttcttgagacactgatcatgggcagacagcataatgcggatg

SEQ ID NO: 77590 - DNA, 201 bp, Bos taurus
attccagcctcattggaccatctttgcctcatacttgctgaaggggaagagaaaaagattctcgtaaggtcagaagcaaaggaatggaaattgaaattcarattagtggatctcttctagaagcttggtctcagaagatgcaaagatccagataacataatcagactgtataattcaggttatcatcctctgcagtcctcc

SEQ ID NO: 77591 - DNA, 201 bp, Bos taurus
tcgaataaaaggacacaaacagcatggttctggccaaatggaatgctgggggcttgtgtcaggaagggtggtgagctgacggaccagtctagaagccagaytgctgagttcctgggagtgtggcctcaatgtctaggcctaaggatttcccaagggatactgttaaaatgcagattctgtattactaggtgaggatgcggc

SEQ ID NO: 77592 - DNA, 201 bp, Bos taurus; identical to SEQ ID NO: 37835

SEQ ID NO: 77593 - DNA, 201 bp, Bos taurus; identical to SEQ ID NO: 37838

SEQ ID NO: 77594 - DNA, 201 bp, Bos taurus
tggaagaggggggccccagccacacgcttgcctctgggtccccgcaagagagagacaaatcctccaagaccagcctaaggctggactgaccttaaacctcrtggaggcacctgggcctgtgggccttttaagtccagtgacattaaacgagggtttgtcctgagctgatggggagagcctggtgggtgggtatgtccctgc

SEQ ID NO: 77595 - DNA, 201 bp, Bos taurus; identical to SEQ ID NO: 37839

SEQ ID NO: 77596 - DNA, 201 bp, Bos taurus
ccacctctcctttcaaggccccttcccctagaccttgcagggaggaaaggacggggcctctacatacctcagacggccctacgtccctgcccctcgccctygcgctggtcttagcgctttctgagtctcctccctctctgcgtcagtggcatcgctggctttttaccgttctgtaacagtaaatggacaaaacctgctcct

SEQ ID NO: 77597 - DNA, 201 bp, Bos taurus
gaaatttcagaagctatgtagaacaatttaaagaaggacatgaataaataagtgtagatggaaaaaaagctcagccactgaacctggatgacttagtcctraagtcatggttggagaagtgggcttggaatctggaatggaaaattagattcaattctccagccttatccatacaaaattatggatttaaatctggtattt

SEQ ID NO: 77598 - DNA, 201 bp, Bos taurus
taaaatgtccattaagacaagaataaaattctctgaggcaagaaataaaatgagaaaaagatcacagaagagagaagtgttgcaggcctggaatgaaggaygctattgcttgaaagggaaactaaccttgcttcctgctgggcagcagcccgggagcctttgcagtcaggcttcaggcagaaacgtttgcttaacggagcc

SEQ ID NO: 77599 - DNA, 201 bp, Bos taurus
tcacagtcggaaatgactgactgattgaaaaacaacaacagctcccacacagctccgcgggtgggtgaggctggtgttggggccagtactggcccactggkgagtgaggctgcttctcagagtctctggttgcagggtgtctggtgcgttagggcttgttctggtgcacagacgtgtggggagtggacactctgatggaca

SEQ ID NO: 77600 - DNA, 201 bp, Bos taurus; identical to SEQ ID NO: 37842

SEQ ID NO: 77601 - DNA, 201 bp, Bos taurus
gtctgagatccggttacaggcagggccacattccccgcaagatgtactggaagggaatccgtttccacgccttcttcagcttccagagcggcatgctgtgkcttgcggcccctcctgcgtcctccaagccagcaccctggcacacggcctcagcggtctcaccacctttctgctgttctcaggtctccctctgcatgcttc

SEQ ID NO: 77602 - DNA, 201 bp, Bos taurus
tctggaaaatgaaacacagtcttggatctggaaaatattctctaaatgtgatgctggaagtcacacaagctgcctttaaagagctttctaaatccaggcaytgtgctacagggtttaaatgggcctattttaactttgcttcacccagtgaggaaagcacaaacctttacatggaagtaagcatatgtaaagcttacatac

SEQ ID NO: 77603 - DNA, 201 bp, Bos taurus
caccgcctcttcgtgaacacactgtcactgccctacttaggaaggatgggaaggaatcaagggcaggcgcagtcgtcgttggcccttttccagaacgctgkactaaataaaaagaatcaagcgcctccatctgaaaacagtctggatccctgtggggcagacacagctcaggactccactttggacctggggccctccaga

SEQ ID NO: 77604 - DNA, 201 bp, Bos taurus
tcccagcttaaagaatataaagaacataactgaggaacactcagatggaagagatgcacagggtgaggtgtgtagaaggcgaggaacttccaggcccctcrtagtagccactcttccagcacatccacatgttcaccaaccaggaatctctcagaatcccatcctttttttcttatggaggttttatggcaggggcaattg

SEQ ID NO: 77605 - DNA, 201 bp, Bos taurus; identical to SEQ ID NO: 37843

SEQ ID NO: 77606 - DNA, 201 bp, Bos taurus
tgaacattaatcatctctttatttatatgtatatatatggcattctcacaggatattcaaaactgggaacttctgtaagtttgcatttagtaggacctaartaaaagcaataaattcaggaaccagaatgactcactatcataaaccttaatcagtaatatttaaatatccatgcaaaataatttcttgaacaatatactc

SEQ ID NO: 77607 - DNA, 201 bp, Bos taurus; identical to SEQ ID NO: 37845

SEQ ID NO: 77608 - DNA, 201 bp, Bos taurus
ggccttctctgatgttgagctgtcttgatgaccacaggtgtgccatgagcagtacctcatttaatcctaatatcagtaggaaggttactgacacttgacaratgcaaaaactaaggcccaaacggttaaatgatttactcagactcatcactggttttccttcaaaacactgtcttgggtttcagtgtcctaatttataaa

SEQ ID NO: 77609 - DNA, 201 bp, Bos taurus; identical to SEQ ID NO: 37846

SEQ ID NO: 77610 - DNA, 201 bp, Bos taurus
cacgagagaagacgatgttcctgcctctcgagatttttttaaaaggatgaacatgctgaatactgaatgcaataaagcacctacaaatatcaacacactcytccacggatataactgctctcagcgttttgatcacagatgaaaacttattaagtgccattaatactgatcattactcacgtccaattgtaacattcctaa

SEQ ID NO: 77611 - DNA, 201 bp, Bos taurus
cagtctctgtgggtgccaccaagcctttacaggaccgccagactcagtgctgaatctgtattctccaccaaacaccatcttcagagtgaaactaactcggyggcccaaaacactctagcaccttccatcctccaggcacctgaccctcgcgcagtgggggcccgggaggcttcctctcacattcctttcttccacgctgat

SEQ ID NO: 77612 - DNA, 201 bp, Bos taurus
aagagcactgtgttttctagggaaaaaaagaatacgagcaaacagaactcagtcaaatatagctgaaaaggtacagcagaaggtccttgaagtggtacacrgagattctaaactcctgaatgtttgactattttccacttccttattggtgcaaatgagaagatacaaatcaacaaggactgagaggtctcctggtcgtca

SEQ ID NO: 77613 - DNA, 201 bp, Bos taurus; identical to SEQ ID NO: 37848

SEQ ID NO: 77614 - DNA, 201 bp, Bos taurus; identical to SEQ ID NO: 37849

SEQ ID NO: 77615 - DNA, 201 bp, Bos taurus
ccactcagttcggagatgccctgaccgcgggctggaacctgcccgccagactccccagacgccggacagtgaactggccgcagcacgttcactgattctgmtggatgtttcttggcttggggaccgcagcgatgggcaggcgatccggctcgctctaggccggggcgagaacagtggttaaaaaagaattagctcgcctct

SEQ ID NO: 77616 - DNA, 201 bp, Bos taurus; identical to SEQ ID NO: 37853

SEQ ID NO: 77617 - DNA, 201 bp, Bos taurus
gatggtggtgtggaggagacagaaaaagaaaggggaagcagagagggaggctatgagcaatttatttctgctcttgaaacagctgcaccgattcattcagraaaaaaaggtgccattccagggtctgggtacgtaggcaagtcctcctcttgatggttctcaccttgtggtggaaggaaatagatgaataacacgaagaac

SEQ ID NO: 77618 - DNA, 201 bp, Bos taurus; identical to SEQ ID NO: 37854

SEQ ID NO: 77619 - DNA, 201 bp, Bos taurus
taacatttcacctctgtgctaatatttattcatctaagaatgtgcatcagccagatcatgaaactcctgttgtgattttctcgagcagacatccttctttmtttctcccacaggtcagggtatggatctttcttcttctgctgtctgcaaaattccctccccgtaggcacttcacaccagcactgtaggaagattggcaca

SEQ ID NO: 77620 - DNA, 201 bp, Bos taurus
ctacgtcccctcttctcctcccctcttctctgcccccggctgggtcagaaacatctttgagcaggaatgatcccggaagaaagagggccctgccttacccrcagtcatggcaagcccacagcaggacccagctggagagggaaatttccctttaaatcaggtgtgaagttttgattatgacctgagcctggacactttggc

SEQ ID NO: 77621 - DNA, 201 bp, Bos taurus
ggctactcgctccagtgttctggcctgaaaaatcccatggacagaggagcctggcgggctgcagcccatggggtcacacggacacgactgagtgagcgcasagacaaggaaggccacttggcgagctgatggagattctgggagcactccccgagtcctttctggaggaaaatggcatcacggatctgcagttttgggtgt

SEQ ID NO: 77622 - DNA, 201 bp, Bos taurus
tcctccggtgaacagagcatggtgagcactgtgtgaacagggcctccattagctctctcagaaagcactctgcacgtcgcacggctacatttggcactggytcaccgtgtgcagtgatggccatgaggaggaagacagtacctgctacctctaagtggttcaggttgcgacaagttactcctttgtgtacggttccaaagt

SEQ ID NO: 77623 - DNA, 201 bp, Bos taurus; identical to SEQ ID NO: 37856

SEQ ID NO: 77624 - DNA, 201 bp, Bos taurus; identical to SEQ ID NO: 37860

SEQ ID NO: 77625 - DNA, 201 bp, Bos taurus
gttaaatgttattgcaaattttaaaatttgattacagttttgttttttaaggattcagctacaagcagatctgacgggagcttttctcagctgcagtggtrttcttcctggcaccacccctcagcggtgctaaccagcgcccgcatcccttctcacttccagataagggtcaggggtgagaaacagcagcgcggcacggga

SEQ ID NO: 77626 - DNA, 201 bp, Bos taurus
ggagttgggtcatggcccactctgacttcagcccgtcccccgttcccagaaagatctgttaggacccaacagatcatgtccatatatttagctctttacakaaggaaatatatagagatttaaaggtatatcattttacccccaaaactatgtaataaaaaccacagagagcaaaaacccactggactgtagttgtgacat

SEQ ID NO: 77627 - DNA, 201 bp, Bos taurus
tctgtgatttattcagctattccccagtcggtggttggtctctctgcttgtatacttccatgctcccaggacagatgctaaacacaggccaggctctgctygggtggaatggggttaggaccccgagacctccacagcccctcagaaaccccctgttacttggcccactctggggtgccctcaaggatgctccagccccac

SEQ ID NO: 77628 - DNA, 201 bp, Bos taurus; identical to SEQ ID NO: 37861

SEQ ID NO: 77629 - DNA, 201 bp, Bos taurus; identical to SEQ ID NO: 37862

SEQ ID NO: 77630 - DNA, 201 bp, Bos taurus; identical to SEQ ID NO: 37863

SEQ ID NO: 77631 - DNA, 201 bp, Bos taurus
ttagcatacacaccctcaattttcaggagagctgcatgttccctctggttccttggatccagcttataacaggcaaacttggcccacaccttccagacacrtttgtcgtggtaggggtcccgttcccggtggggggccctccagctggtccagcttcgagccacattgcccctttgccgaggcacacagctgagcctgcgt

SEQ ID NO: 77632 - DNA, 201 bp, Bos taurus; identical to SEQ ID NO: 37864

SEQ ID NO: 77633 - DNA, 201 bp, Bos taurus
gattcctggtggtcggggaactcctgtgagtagagagtctcgccgcgttccttcccctcccacctccaaaccaaaggtatctcagtccacctatttgcagrgattggcgctgtctgcaaggggggcactttgcatctcacactccagctggaggttttgctacaacaatggaacataactctggggggaaaaatgtccccg

SEQ ID NO: 77634 - DNA, 201 bp, Bos taurus; identical to SEQ ID NO: 37866

SEQ ID NO: 77635 - DNA, 201 bp, Bos taurus; identical to SEQ ID NO: 37867

SEQ ID NO: 77636 - DNA, 201 bp, Bos taurus; identical to SEQ ID NO: 37868

SEQ ID NO: 77637 - DNA, 201 bp, Bos taurus; identical to SEQ ID NO: 37869

SEQ ID NO: 77638 - DNA, 201 bp, Bos taurus; identical to SEQ ID NO: 37870

SEQ ID NO: 77639 - DNA, 201 bp, Bos taurus; identical to SEQ ID NO: 37871

SEQ ID NO: 77640 - DNA, 201 bp, Bos taurus; identical to SEQ ID NO: 37872

SEQ ID NO: 77641 - DNA, 201 bp, Bos taurus; identical to SEQ ID NO: 37873

SEQ ID NO: 77642 - DNA, 201 bp, Bos taurus; identical to SEQ ID NO: 37874

SEQ ID NO: 77643 - DNA, 201 bp, Bos taurus
cagtgaaatacagcaagacacctggtgtagtcagcaggatcagtgagacatacggtctattgctcttcagtttctgtttcagtgaccattcaatgttgtartaaagtacatactctaagaatacaatggtttcttaaatattcagcgttaaatgaagttaatctgtgtgtagatttatgcctcagagaaggcaatggcacc

SEQ ID NO: 77644 - DNA, 201 bp, Bos taurus
ggtggagcttatataacaaagtagcctgtggccaagcgagtacctcacgaggcacatgcacagtgctgtaagtgatctcggttgttacctaattatttacraaacttgcagcaaaagtgagaggccctggggcaagagcttgacctcgtcatcttggctaatttgctttttccctacagagagtttgatagggattgcaat

SEQ ID NO: 77645 - DNA, 201 bp, Bos taurus; identical to SEQ ID NO: 37877

SEQ ID NO: 77646 - DNA, 201 bp, Bos taurus
cttcctcccgttgcctccccactgttcatcttttcactgtgtgtgcttagttgctcagtagtgtctgactctctggctctttgcaaagctatggattgtasactgccaagcttctctgtccatggggattctccaggccagaatactagagtgggtagcctttcccttctccaggggatcttcccaagccaggggtcgaac

SEQ ID NO: 77647 - DNA, 201 bp, Bos taurus
gtaacaaactgtccagtgaaatgtgagaggaacctcacttaggggctgaggaagctaaaaaccagagtgtgtcttccactgtctcctcccctgtcagagtrgctttgggggcctcctcagaacacgtcctctgaaccaaagaagggctgctcctttctttcattgtctctgtcctctactgtcttattttggaatgtcttt

SEQ ID NO: 77648 - DNA, 201 bp, Bos taurus
ggttctctgttacttccataaacaaaataaataaaagagtcaggtcctggctctgttcatgaaaatagctgtgttctttaagcacagggcctgtctccccyttttttttccccctcaggtcaccatttcagaactggtgcctctggggcaccccgtgctgaccattgtggccacagacgtggaaagcagtgagaacattac

SEQ ID NO: 77649 - DNA, 201 bp, Bos taurus; identical to SEQ ID NO: 37879

SEQ ID NO: 77650 - DNA, 201 bp, Bos taurus; identical to SEQ ID NO: 37880

SEQ ID NO: 77651 - DNA, 201 bp, Bos taurus
aacatctataggactttccatcaagcaatagcagaatacatatttttctcaaattattctgtaagtggcccaaagatggctagtgtatattggcccttacrttatttactttttcacaagaggttggcaccatcaactcaatgccaaactcaaattcttacatatccaattactttaaatatatctaaagtaagtgtgtat

SEQ ID NO: 77652 - DNA, 201 bp, Bos taurus; identical to SEQ ID NO: 37883

SEQ ID NO: 77653 - DNA, 201 bp, Bos taurus
tgcgcaaccaacacaccgacaaccactctgtacccagacaacacctccggtttcactttcagtattcaataaactatataagatattcaacactttattayacaagtctttgtgacagatgattttgtccaactgtaggctaatgtttaaatgttctgagcccttataagataggcttggctacactatgatgcttggtgg

SEQ ID NO: 77654 - DNA, 201 bp, Bos taurus; identical to SEQ ID NO: 37888

SEQ ID NO: 77655 - DNA, 201 bp, Bos taurus; identical to SEQ ID NO: 37890

SEQ ID NO: 77656 - DNA, 201 bp, Bos taurus
tgaactcacgttctgcccaagcagaggggccctgagtgggtggtgtgtttcatactctgaaggggcggggttagggaaagtcagcctctacctcccactcygtaccctggcctgctacccacttggaacgacaagctttccgctcgagcctcttggactccccctaacgaagcctatcaacaggcccgcctactctcagtg

SEQ ID NO: 77657 - DNA, 201 bp, Bos taurus
tcacctaagaacatcagatgatgctgagtcagacaatggtcttgtctgagtcgttcaccgctctctgtgtttggaggacggggctcaccaggtccacctcyggggccgatcggtccagcggggatgtgggtccagtaggctacaccttcaggggcactggcaggcggccccagcgaggggttctatgtggaagacattcag

SEQ ID NO: 77658 - DNA, 201 bp, Bos taurus; identical to SEQ ID NO: 37895

SEQ ID NO: 77659 - DNA, 201 bp, Bos taurus
agcctatagacagaggagctaattacctcatgggaaactagggatcaagcctggacatgacagacattacttcagtccatgttctgctggccagactaatyacgtggctccagcctaactgcaagggaggctgggaaacagttctttgtgaccaggaagaggaagaaggcacgtgggcctcttgcatctacttgaaaggtt

SEQ ID NO: 77660 - DNA, 201 bp, Bos taurus; identical to SEQ ID NO: 37897

SEQ ID NO: 77661 - DNA, 201 bp, Bos taurus; identical to SEQ ID NO: 37898

SEQ ID NO: 77662 - DNA, 201 bp, Bos taurus
ttctcaaacctaagcctaatacattctcctttgctcaagtaaacgaagtgtttcctctgggatgaggctcccaagactctccctcagcccaggcctcaggrttgtcctgtcttgagccccttccccaaacgtttgccctcagggctttcacaagtgggctgccggctgcagagctgaactgggtggcctctgtgagactgg

SEQ ID NO: 77663 - DNA, 201 bp, Bos taurus
aaatataagagcatttaacttgtgtgcaaacttattgagattatacaattcgtatttcctggcttatctgtggagggtgctttcaattggccagaggtggyaaacactaaccagattcagaaagctaggaaggaggaaaacagggtccctcatggctggggtgtgcttgagggacaagcacagaccctcaaggagggcctg

SEQ ID NO: 77664 - DNA, 201 bp, Bos taurus; identical to SEQ ID NO: 37902

SEQ ID NO: 77665 - DNA, 201 bp, Bos taurus; identical to SEQ ID NO: 37903

SEQ ID NO: 77666 - DNA, 201 bp, Bos taurus; identical to SEQ ID NO: 37904

SEQ ID NO: 77667 - DNA, 201 bp, Bos taurus; identical to SEQ ID NO: 37905

SEQ ID NO: 77668 - DNA, 201 bp, Bos taurus; identical to SEQ ID NO: 37906

SEQ ID NO: 77669 - DNA, 201 bp, Bos taurus; identical to SEQ ID NO: 37907

SEQ ID NO: 77670 - DNA, 201 bp, Bos taurus; identical to SEQ ID NO: 37908

SEQ ID NO: 77671 - DNA, 201 bp, Bos taurus; identical to SEQ ID NO: 37910

SEQ ID NO: 77672 - DNA, 201 bp, Bos taurus
cctgggtcctgctgccttttaatcagtctccctttgcaggagttgcttctgttcttttgatcactaaggtaaaattttttttgtttattcacttgaatttrtaataaatgaatttttcctttcccttttgacagctagctttcttagtctattgctttcattttgttatttagaaaataagatttgatactttctctttca

SEQ ID NO: 77673 - DNA, 201 bp, Bos taurus; identical to SEQ ID NO: 37911

SEQ ID NO: 77674 - DNA, 201 bp, Bos taurus
taatgggcggaaaactacattaccatcatgtttttctcgacccggtagtgaagcccacgcgggtatgggtgtaaaggggcctgcttgtttggcagcgggtrtagagtaactggcattggtgcgaggggctggaaggagggctgagtaaacactgcaagtaacagtagagaaagatgccgtgggctttccttagacttgctt

SEQ ID NO: 77675 - DNA, 201 bp, Bos taurus
attaaatatgtattatatttgaattgcttatagagttagcataaacattgagaaaatattcctaattttttatatttataatattaccaagtaaattgacrtcaggggccaagaaaattcacacagtgcaaaagcatgttgcattatgcttatttgaaaggaaattgctctctgttttctacatagcaccagtattatttt

SEQ ID NO: 77676 - DNA, 201 bp, Bos taurus; identical to SEQ ID NO: 37913

SEQ ID NO: 77677 - DNA, 201 bp, Bos taurus
tcagttctgtctcgtcacaacaaagatttgaagcgatgaacattaaagccctcggcgcattatagctcttggacagactgtgttttagctcttggattgcraacagaccatgttagagctcttagatccttgttacagctcagttttatttagaaaatagcaggaaagtacatccttgaggcgtgagggaatgccaaccca

SEQ ID NO: 77678 - DNA, 201 bp, Bos taurus; identical to SEQ ID NO: 37915

SEQ ID NO: 77679 - DNA, 201 bp, Bos taurus; identical to SEQ ID NO: 37916

SEQ ID NO: 77680 - DNA, 201 bp, Bos taurus; identical to SEQ ID NO: 37921

SEQ ID NO: 77681 - DNA, 201 bp, Bos taurus; identical to SEQ ID NO: 37922

SEQ ID NO: 77682 - DNA, 201 bp, Bos taurus; identical to SEQ ID NO: 37926

SEQ ID NO: 77683 - DNA, 201 bp, Bos taurus
cagtgttcttgcctggagaatcccatgggcggaggggcctggtgggctgcagtctatggggttgcagagagttggacacgactgagcaactaacagacatrcaaagccgcaaatttagtatcatttgtacttactgtatttttgtttaacccatgcttccaaaagataggggatgaagcagaatacacagaccaactacac

SEQ ID NO: 77684 - DNA, 201 bp, Bos taurus
caagctctaaacagacagtcaacgaaatgtgctggcaatcaaaaagaaaaattaagatattggaaaatgactcattcttggtgagtaaaaaagaaatcctrgataaactaaagaggacaaagaaaacagccgctgcccatcctaagagaggaacaagtccattacatattttacatggaaataagaaactactcatgatat

SEQ ID NO: 77685 - DNA, 201 bp, Bos taurus; identical to SEQ ID NO: 37928

SEQ ID NO: 77686 - DNA, 201 bp, Bos taurus; identical to SEQ ID NO: 37929

SEQ ID NO: 77687 - DNA, 201 bp, Bos taurus; identical to SEQ ID NO: 37931

SEQ ID NO: 77688 - DNA, 201 bp, Bos taurus
tgtactctcaaggtgagaagtgcttatgaaactatcacaatgagctttggcggggagggagaggaattgttccttttaagaggtctttctctacctggccrctgtgctctgcctctacccgagtcccacctgcgggtgctgacaccttggctctggggctgtgtgcagaagttctgcaaccaagacagaagtagcaggcca

SEQ ID NO: 77689 - DNA, 201 bp, Bos taurus; identical to SEQ ID NO: 37933

SEQ ID NO: 77690 - DNA, 201 bp, Bos taurus
cacacactcctcctgaatgaactagtcttcctactgttagctgttcctaaaagtcctcctgttaggctcaccagccttccagtcagccaagggggcttgtytttcccattcaggaccccaggactgggatgcccataatgtctttcaaactgctcacacccccagcaagatctctccccatttaatctccctttttctctg

SEQ ID NO: 77691 - DNA, 201 bp, Bos taurus
tcagattttaactgccagcttgaacccataggtggaggccgtccatagtatctggtgtcaccattttacagacctggaaactgagactcagcctgtaaacrtgatccgtctaaggccacagagctgaggaggatgaagaaacaaacccttgagctagagaagacgaaaactgaatgtcctggagaagtaggcagatgggtc

SEQ ID NO: 77692 - DNA, 201 bp, Bos taurus; identical to SEQ ID NO: 37936

SEQ ID NO: 77693 - DNA, 201 bp, Bos taurus; identical to SEQ ID NO: 37937

SEQ ID NO: 77694 - DNA, 201 bp, Bos taurus; identical to SEQ ID NO: 37938

SEQ ID NO: 77695 - DNA, 201 bp, Bos taurus; identical to SEQ ID NO: 37939

SEQ ID NO: 77696 - DNA, 201 bp, Bos taurus
acctgagccaatcctcagacccagaactcactggccaaagagaactgaggtcccctgaggacgttccctgcaataaatgccatggcaactgtgtacactaytaatttcccacatcattgcaacgtgggtaccaatggatgctgccatcttgagtgtgggcaagtcctggaaggacgtgctccttttcattggaaatctgtg

SEQ ID NO: 77697 - DNA, 201 bp, Bos taurus; identical to SEQ ID NO: 37941

SEQ ID NO: 77698 - DNA, 201 bp, Bos taurus; identical to SEQ ID NO: 37944

SEQ ID NO: 77699 - DNA, 201 bp, Bos taurus; identical to SEQ ID NO: 37945

SEQ ID NO: 77700 - DNA, 201 bp, Bos taurus; identical to SEQ ID NO: 37946

SEQ ID NO: 77701 - DNA, 201 bp, Bos taurus; identical to SEQ ID NO: 37947

SEQ ID NO: 77702 - DNA, 201 bp, Bos taurus; identical to SEQ ID NO: 37948

SEQ ID NO: 77703 - DNA, 201 bp, Bos taurus; identical to SEQ ID NO: 37949

SEQ ID NO: 77704 - DNA, 201 bp, Bos taurus; identical to SEQ ID NO: 37950

SEQ ID NO: 77705 - DNA, 201 bp, Bos taurus; identical to SEQ ID NO: 37951

SEQ ID NO: 77706 - DNA, 201 bp, Bos taurus; identical to SEQ ID NO: 37952

SEQ ID NO: 77707 - DNA, 201 bp, Bos taurus; identical to SEQ ID NO: 37953

SEQ ID NO: 77708 - DNA, 201 bp, Bos taurus; identical to SEQ ID NO: 37954

SEQ ID NO: 77709 - DNA, 201 bp, Bos taurus; identical to SEQ ID NO: 37955

SEQ ID NO: 77710 - DNA, 201 bp, Bos taurus; identical to SEQ ID NO: 37956

SEQ ID NO: 77711 - DNA, 201 bp, Bos taurus; identical to SEQ ID NO: 37957

SEQ ID NO: 77712 - DNA, 201 bp, Bos taurus; identical to SEQ ID NO: 37958

SEQ ID NO: 77713 - DNA, 201 bp, Bos taurus; identical to SEQ ID NO: 37959

SEQ ID NO: 77714 - DNA, 201 bp, Bos taurus; identical to SEQ ID NO: 37960

SEQ ID NO: 77715 - DNA, 201 bp, Bos taurus; identical to SEQ ID NO: 37961

SEQ ID NO: 77716 - DNA, 201 bp, Bos taurus; identical to SEQ ID NO: 37962

SEQ ID NO: 77717 - DNA, 201 bp, Bos taurus; identical to SEQ ID NO: 37963

SEQ ID NO: 77718 - DNA, 201 bp, Bos taurus; identical to SEQ ID NO: 37964

SEQ ID NO: 77719 - DNA, 201 bp, Bos taurus; identical to SEQ ID NO: 37965

SEQ ID NO: 77720 - DNA, 201 bp, Bos taurus; identical to SEQ ID NO: 37966

SEQ ID NO: 77721 - DNA, 201 bp, Bos taurus; identical to SEQ ID NO: 37967

SEQ ID NO: 77722 - DNA, 201 bp, Bos taurus; identical to SEQ ID NO: 37968

SEQ ID NO: 77723 - DNA, 201 bp, Bos taurus; identical to SEQ ID NO: 37969

SEQ ID NO: 77724 - DNA, 201 bp, Bos taurus; identical to SEQ ID NO: 37970

SEQ ID NO: 77725 - DNA, 201 bp, Bos taurus; identical to SEQ ID NO: 37971

SEQ ID NO: 77726 - DNA, 201 bp, Bos taurus; identical to SEQ ID NO: 37972

SEQ ID NO: 77727 - DNA, 201 bp, Bos taurus; identical to SEQ ID NO: 37973

SEQ ID NO: 77728 - DNA, 201 bp, Bos taurus; identical to SEQ ID NO: 37974

SEQ ID NO: 77729 - DNA, 201 bp, Bos taurus; identical to SEQ ID NO: 37975

SEQ ID NO: 77730 - DNA, 201 bp, Bos taurus; identical to SEQ ID NO: 37976

SEQ ID NO: 77731 - DNA, 201 bp, Bos taurus; identical to SEQ ID NO: 37977

SEQ ID NO: 77732 - DNA, 201 bp, Bos taurus; identical to SEQ ID NO: 37978

SEQ ID NO: 77733 - DNA, 201 bp, Bos taurus; identical to SEQ ID NO: 37979

SEQ ID NO: 77734 - DNA, 201 bp, Bos taurus; identical to SEQ ID NO: 37980

SEQ ID NO: 77735 - DNA, 201 bp, Bos taurus; identical to SEQ ID NO: 37981

SEQ ID NO: 77736 - DNA, 201 bp, Bos taurus; identical to SEQ ID NO: 37982

SEQ ID NO: 77737 - DNA, 201 bp, Bos taurus; identical to SEQ ID NO: 37983

SEQ ID NO: 77738 - DNA, 201 bp, Bos taurus; identical to SEQ ID NO: 37984

SEQ ID NO: 77739 - DNA, 201 bp, Bos taurus; identical to SEQ ID NO: 37985

SEQ ID NO: 77740 - DNA, 201 bp, Bos taurus; identical to SEQ ID NO: 37986

SEQ ID NO: 77741 - DNA, 201 bp, Bos taurus; identical to SEQ ID NO: 37987

SEQ ID NO: 77742 - DNA, 201 bp, Bos taurus
tttaaatagtgccaacttatacaaaaatattctacttattccaatccagtttcaacttgaacaataaaatatgcttccttttattttacctatttcatttmttttatgtaatatcttgctttttattctgttgataacctcagaaataagtacaagccaagcatatcaaacattgggaaaacaatatttatgttatatgaa

SEQ ID NO: 77743 - DNA, 201 bp, Bos taurus
tagtaattgactccaaaattcattagagggaccattagtggacatggactgccagaagaaagaatatgtgagttgggatataatacagagaaagaaatggratgaagaaatagaaacagagctcagagaaacgtgggaaattttaagtgcaccaatatacgcataaggagagtactggaaggagaggagaaaaataaatca

SEQ ID NO: 77744 - DNA, 201 bp, Bos taurus
gtctcacagaggcacagaagaaggccatggctgaagactgcctgggaatgcaaaggtgtgtaacagcaggactacacagatgggcctgagtccttgactgmagctcccttctgagcctgcaaagcactgattgcaccccaagcctggtatggggaggggacagatttgccctaatgaggcccgccagttatttaaagtcaa

SEQ ID NO: 77745 - DNA, 201 bp, Bos taurus
tgaatatatatgattctctcacatgacatttagcaacatccaatcctatgacacaacacaatcttaaatattatcttgtatgtgcttattagctcagtcaygtcccactcatccgttttctggtatatatagtttaaatgaattttaattacaataaaaagtacagcagttatttctttcctagaagtaagagaaacacta

SEQ ID NO: 77746 - DNA, 201 bp, Bos taurus
gcatggccaaaaaagaaaaacactttctaacactaaattaataagatttatttagcctttgacaccctggacgtagttccaattttagatcccccagctgmtccataaatgtatttcttaacttctaacctcaaacttcagcaacaaaaagtataaatacaaacattctttcctgtagtatgtataaatgtttcccacaga

SEQ ID NO: 77747 - DNA, 201 bp, Bos taurus
gttgttcatgctgcaaaaatatactgcctatttacactgtgtgggcctttgtaatgactgctatcattacagtgtgctagacgatactctattcttcacaygtttattctttagtcttaaaacaattcaaaagcataggtacagtacaaattaatcatttgaaacctctactataacagacttgagaggccagaaagagaa

SEQ ID NO: 77748 - DNA, 201 bp, Bos taurus
aacatgaaagcatattttccttatggatcagagtgtttatgtgaaaggactgatttcaaaatttggatagcattttctcaaaaatttacctctgagttacktttgtctccagtcaaaacctgtttttcttttttttttcccctgacacatagtaagcaacatttaaaatgtggatagatagatagagcagataggtaaata

SEQ ID NO: 77749 - DNA, 201 bp, Bos taurus
gtataagatgttataaatatcttatagacttgctggaatggctaaatgagaatatatatgtgtcatgcttataagggcgcagaaatcattttaagtacaaygactcaagtcacatgtatcctcttgctgtgcaacaatgcaagagcactgaccattcagcagtcacttttttatactgcagatgctagggaagttgccagc

SEQ ID NO: 77750 - DNA, 201 bp, Bos taurus
gagaggtgtcagtgtggtggaagcagagagcagaggaagcacagacctaatgcctcccctactcgctcacatcctgaaagcccaccatgcttggggtggaraatcactactggaaaatcatggtgtatgatttgcatttgtgtatgaacagaaatggggttgttaaaataattttgttaaatgctgaaaatgaggataatt

SEQ ID NO: 77751 - DNA, 201 bp, Bos taurus
acagacattacaagaaattcaacaataaatagtgtcttgtccttgttcctgaattatctctattttgctggaatggctaaattcatgcctcacttagattrtagtattatgaatatcacttcagttcagttcattcgctcagtcgtgtccgactctttgcgacccctgaatctcagcacgccaggcttccctgcccatcac

SEQ ID NO: 77752 - DNA, 201 bp, Bos taurus
cactttcaaagcaagacaacaagtttctgtgcaatgaaaagaaagaagaaaatttaaattgtactctctttctgaaaccccacagaacctgattgcagcakagaaagttttctgcattactttttttaaatgagtttccactggcctgagatgactagggaacagtctccaatatgcctattcaaggttagaatttcaaaa

SEQ ID NO: 77753 - DNA, 201 bp, Bos taurus
ttatctattttatatatagtactgtgcatattttaatcttaaactcttaatttattcctactcccctcccctttggtaactgtaagcttgtttcctatgtyggaggctatttttgttctgcaagtaagttcattttcatatggtatttattatatgtagtatctaaagccacaataatttaaagaaaacctacaatgtggt

SEQ ID NO: 77754 - DNA, 201 bp, Bos taurus
tgtgggagacgtgatgaagaggcaggcccgtgagacctttcacgttcagggaacagcagtggagtcacagcaggaatcatcagacgactggagtcaggaaracgagaaatggccacagctacatgtacaagtacaaagtctaagggcaaaactaaaatccatgggactttaaacaaccatctagagtaatctgaagggtgc

SEQ ID NO: 77755 - DNA, 201 bp, Bos taurus
aagctgccttgctctgagatgcttgctttgtttagtgtttacactggaagtggtgttctaaaaggcagagttcccaataagggagtggcctgctacaaaayacatgattacttttcagatgctgagaaatccaactttagcctcctagcatgcacagggaagatttgtttgggccgtttttgtttaagctaggtgtaccag

SEQ ID NO: 77756 - DNA, 201 bp, Bos taurus
agcacaccttctgaatattttagtagtgttctcctccacagaatccccccctcccctgtgttgtaatgcatattcaagttaaatcagatcatcaataccaragtccttgagcataattgataggatagcatggaagtaatgctcatacaatacaaatttactggttaaatagagggcactgaaagataacatacccacatc

SEQ ID NO: 77757 - DNA, 201 bp, Bos taurus
acttggatagccagcttgacagttttgatgggccattattgtagcttaaatttcatttttggaagatttcatttgacatttcagacttattatgctacctkgaaagctggagttccatagggctctgcctttgatctcaggtcatcatcaattaatgccaatgatccacagcatccccctcatataaacgtgaactcaaaa

SEQ ID NO: 77758 - DNA, 201 bp, Bos taurus
ccttttaaaatttattttcttttctttgaggtggtgaatgaaggggtcaagtagtggacttggattcaaatttcaattttttctacacatcaaaattaatkaggcctgtgtccttgtactagttttcttttgaaatcattattgctacccaatcattccatggtcactggcaataataatagatttacctttttaaaagaa

SEQ ID NO: 77759 - DNA, 201 bp, Bos taurus
ccagagcactaagttccccatacttctagcctgacttccacactgactgagttccaatgacttcagaaagaagagagaaaggcatagcttgcatttacagragtatcatgtccatgtgaattttagcgtgcaaagaattttatgctatggttgaaatcagatgtagatcaatgagatgtgactcagcacactgaagcactg

SEQ ID NO: 77760 - DNA, 201 bp, Bos taurus
aaacacaatctaaatatgataaagatcagagggtcttagatattgaaaagtgagagtaagaaaaacttttgaaagaaatgaaagtgaatgttacagctccraaggagcagacctaaggaaatccatggcctgcgccatcaggacagaatggaagagtaattcaaacaagagatggatacactacagccatcgtctgttcta

SEQ ID NO: 77761 - DNA, 201 bp, Bos taurus
caatagaagaagattttttcatattctaataatcatattgttcaacgaaatctccaaatgagattttactttcctcactaatcatggtgagttgtcaaggyttacaaagatagtatgaataattttatatgtctaattgcccaagaccgtaacaaacaaagaagaaagatatcccaaataatcagccaccaatgagatcca

SEQ ID NO: 77762 - DNA, 201 bp, Bos taurus
ctttgtagggcaggtcatgagcaatggagtggcaatttttataagcttctccatatcaaggataaggttagagtgcataaaggggaaagaaggatgaaagkaaggagacatatttcagtcagcagagaacttttctctcggtttccttggtttctaaaccaaatgacctggaaactgaaattgaagtttgtttcagttttc

SEQ ID NO: 77763 - DNA, 201 bp, Bos taurus
tgctggatgctacagaaagatatacttttaacatacaaaacatttctgaatccaacaagtgcccaataatttaataatgtaatgactagtggacttactckagtccactaaaccaatatttctcagagtattttaggctaggttagcatttattctgacagatgacctgcaatgccatccctacaagaaaattgccatatt

SEQ ID NO: 77764 - DNA, 201 bp, Bos taurus
cagtattcttgcctggaaaattccctggacagaggggcctggtggactctggtccatggagttgcaaggagttggttacagttgagtgactgagtgcacamacacatctaaagatctttgccttactcaaggctgcaaagcttctcttctatgtagtcttctagaacttttatactcaaatctatgaagcattttgagtta

SEQ ID NO: 77765 - DNA, 201 bp, Bos taurus
tgtcagagctctcgcctcctgcaccatcgtgcccgtttcatcaagaggccagaatgcttctcctgatgatgtctgtcctcctgctgatagagctgctggcrtggatgcacttcttctcggaggcctcgctctccgagtcactcatctctacgtcagggacatacccgtcattctcgttgtcagctttcagtttgctttttg

SEQ ID NO: 77766 - DNA, 201 bp, Bos taurus
tcttaagaagctagatcatttggacctgcgtcttagccaactgtccaaggtcagcaaaatgctatggcatgttctgtttgatggccccaggcaggaagccmtggcattctcactattaatatctcttgacctttcgacttacaaatagaagcatccctgtggccatttttttttcctgtatatccctgaaaaaccaaggat

SEQ ID NO: 77767 - DNA, 201 bp, Bos taurus
atcaagtataagctgcagctctttcccacatgaagctcactcagtgttttcattttccaggattgactcactctcagaagatgaaaggtggccgggggtgrgggggtggcggtgggggagtggtctgaaatgatctaaaataactgcagtgtacaaagcagctgattaaattattttgaagggctgatgaatgctttcaaa

SEQ ID NO: 77768 - DNA, 201 bp, Bos taurus
aaatagttattgctaaagagtttcagacagaatatttagagatctagaagtaaaattgacagagagctatatttatagcagtgccctacctctttagccamcgtctgctggaaaactgcacgaatggagagacaacactgatggaaattctttatcagttgagggtggatcgagccactcagctgtgccacctcttcatgg

SEQ ID NO: 77769 - DNA, 201 bp, Bos taurus
actgtaaatatgcaaaatccaaaccatgatactgtcaaaagtctgagcagaggacaagctgatctcagccacctctgtactggtcgcatcttagaggaaayggtattgacagcctttctgattaatctaggtgggctgtcctggtgcctttctgcaatcttcacaccaaatgaacacaggtagctattaaaccagtgcagc

SEQ ID NO: 77770 - DNA, 201 bp, Bos taurus
ggtcattcccactttaaatgaagaatgacactattgtacatgcagtaaagtaggaggaggatcactccttaccagctctgtatagatataaagctgtaaaygtaacgtgtgaactactcaaagcacaaattttcctcaaactcatagtcactattcataaatatgagggagttgctgtcacttacagactggttctgcgta

SEQ ID NO: 77771 - DNA, 201 bp, Bos taurus
tttatcacagcttcttctctagtatcttcacaccacagatatagctttcttattatgttaattgtgttatattttggccataatgatagctcttctgattrtacttggttttctagcactaaagttgttgatctttccaacctctgtaagctttaccttgggtctccatataagtctccttaataatgttacacatgttaa

SEQ ID NO: 77772 - DNA, 201 bp, Bos taurus
ccctctccttaggcattttttgagctttatattattattattagactgtattcctcattgtgaactgcttagtggtttattagggacaagtgtggccactrcctctggaagatgccagagtggtgtatgtaaaccatgatgaggttttagcagacaggggatggtatgttagctttggccttgagttcttgagggatcatg

SEQ ID NO: 77773 - DNA, 201 bp, Bos taurus
ataaatggatctctgttctgtggaaacaaacagttagagctcttgctccaaaatgactactgtgtgatacatgatgatacattgcgcatggtgtggcatarcagatgattgttacaagtcttagtgtgctgagaagagcttcagagtatacatgcaacatttcctctgaaaacacacaaatctttaatttttgtgagctag

SEQ ID NO: 77774 - DNA, 201 bp, Bos taurus
agcctggtaggctacagtccatggggttgcaaagagtcggacatgattgagactaacactttcttacttaatcttctcaagaacaaatgatgtaggtactrtatttttaggctcaattttcaaatgtaaaactgaggatcagagaggttaagaaaattttccaaggtcacataggtggtgaagtgggaaatttgggaatca

SEQ ID NO: 77775 - DNA, 201 bp, Bos taurus
aatgtttctttttctcattcttcattcttttgagttccttctttgtcattttttttttcttcctacccgttatatggaatttaatctcatccttttgtttyctggtgtgtctgaagcttaggcaaaaacaggttgttgttaatttcagcaacgcatctcaggggagtttgcctttgaaatgttccctttgctaggtggtcc

SEQ ID NO: 77776 - DNA, 201 bp, Bos taurus
attaggagggaaaacgcatgctctgggccacctttgttttttccatagtttcctttgtgctttcgctatttcttcctgtagagttctctttcagtctcttmgatggccatgggatttttgtgtggttctttatggctaactcactgtgtttgaaaaacttatgtccattcctgaccttggtcttatttactccatttctct

SEQ ID NO: 77777 - DNA, 201 bp, Bos taurus
catgacatagtcataagtgtaatatgcaatcagataacttatcccaggtctatacatggtagagctgctaaatagaacagttaaatgctttgactgaatgygcaggtgctttcactgatatgccacaaaaatcaaattaattaacatatatgacacatatgtatctaaagtagtatacactaagttatgactgatgataga

SEQ ID NO: 77778 - DNA, 201 bp, Bos taurus
aaagtggcaggaagttagttttgaagaatcactcagcaaaacaacagtaacagtgactataatgatgatgatgacaaactaactccatcagaataatgtgycaggttcaatggatttaagctgtaaagagagacttaacatgctgaatgggaagaatggcaaggactagacactaggctggggtctagatttatatcccta

SEQ ID NO: 77779 - DNA, 201 bp, Bos taurus
ttagcaagaaaggaaactcaggtttagaagtacaaaggaaatggtagaagaatggagagttatttggagacaaaccttatgaaattcagtgaatgagagcrtaagtttcaatttatgatatggaaggaattgaggcatacctaaatgttgtttataagggcaaagactaagggattgagagaaggatactaggaattaaga

SEQ ID NO: 77780 - DNA, 201 bp, Bos taurus
ggtacatttgttatgactgatgaaactacattggtaccataaacaaatggtttaggttttgaaacagtaagttctgatgatctactgtgtacctcatatayaagtggactctttaaaatttgtgaaaaatacatgtagcaatctttgtacagagagtcctcttctgttgaattatttctgttatttaatttgggaaggttg

SEQ ID NO: 77781 - DNA, 201 bp, Bos taurus
tattatggttaccaaagaggaaatattggagggagggataaatcaggagtttgggattaacatacatgaactactatgtaaaagataaaaaaaaaacacartaagagcctaccatatagcacagggatctctactcaacattctatgatgacctatatgagaaaagaatctcaaaaagaatgggtgtatgtctacgtataa

SEQ ID NO: 77782 - DNA, 201 bp, Bos taurus
accaacaacctgcttgtcccaagctggcagaaagttctcacatgaggatcccatttttttagctaagccaattaatacctaagagttaggtgccactgggytggggattttgtgatgttgtacaatgtacctcagcaactaaacaacaacactgtgctatttttattcctttcataaaatttctgtatagtgcagacaccc

SEQ ID NO: 77783 - DNA, 201 bp, Bos taurus
atatccatctttttgtattcctttcccacataagtcatcacagagtattgagaaaattccctgtggtatacagtaggtccttattagttatctgttttgtrgacagtactgtgtatatatcaatttcaatctcccaatttattcctcagccctttcccatcctggtaaccataagtttgttttctttatctgtgactttat

SEQ ID NO: 77784 - DNA, 201 bp, Bos taurus
ttgggaaatattcatttttttcttcaaagctcccacccacaccccccccatccccaaccagccttgtaatcttaccatacattaggcagggttcttgaaawtttaaatcagattaaagcacatcttgttcaaaatccttcagttagtataaaatccagaattcttcccatgccctgaaagcccattcccgtttttcccatt

SEQ ID NO: 77785 - DNA, 201 bp, Bos taurus
tatggcacaataaatttttgctaatttgttttagaatgcatagcatgtcctttgtatcaacattatttatttagcaccgtttccattcctttactggacarcaaaatcggaagcatgaattttgaagatgcagaactatatccactgtgacaacagtgagaaaagggatcagtctgcacctaagtgtgccttatttctatc

SEQ ID NO: 77786 - DNA, 201 bp, Bos taurus
gcagggaatcctagagggaaaagaaaaccaagtcttaatgttcataaatcacaaaaataatagcaagcttaacaatgggttgtagacagaactactaaagmgaatgtagaaaacaccccaaggtaatatttgtgaatacatagacaggtgattgagtaatttttagttttgttataagaaaaatatttttatttacgaact

SEQ ID NO: 77787 - DNA, 201 bp, Bos taurus
gctatttaccaaggtgttgaaatgctaaattacgagagtgaagaggaaaaaaatatactagagagcggatatttttctatacatttctttatttctgtcaygtaattcctgagagttcaacattaacagtgccacactctactactagccaaacatttatcacattagtaatttattgaggccaacaccaattttcagaga

SEQ ID NO: 77788 - DNA, 201 bp, Bos taurus
agctgtaacactggtctgttgtttcaaatccttgctgtgatgagacaaaatagactggaatagagttagaaaatagaaatagaaatctatgcatttgcaakaagtaatatcaaagttcttagaatcccagatatcatcaagttcatctcccagtcaaaagcaaggcattgaactgtcaggtcatttatctaaggaaaagca

SEQ ID NO: 77789 - DNA, 201 bp, Bos taurus
gttaggactacaaagataagaccaccctgagtggctcgtgtgaacactgtcacagctgcttcttttcgctttgaaatcattcaaagtgatgcatgaggaaygagtctgcttttatcagcctcccactcggggtctgcttagcccactgaggaaaatacttgtgatacactgctgacagaaaacaaaacatgatccaaacag

SEQ ID NO: 77790 - DNA, 201 bp, Bos taurus
agatacaaccaataataatatgaaattctagctcccaactactgctttcaatattcttggagaaacacatttgcttttcattttaggagtggttggaactkgggaactgaaacttggtttacaatttcagcactttagttcacaggagataccctgacaaacaattttttctcataaaaaaagtcatcatggtgaattctc

SEQ ID NO: 77791 - DNA, 201 bp, Bos taurus
agacacaaattaggacagtagaggaatataaagccactggcctcaacagctactgcaggcattaattaataagcaactcctattcagattagcgtaaaccrtcatgctaatggcctatttactttaaaacctattctccaatacagcatcactggcatttaacaaaaaactacaaggtataccaaaagtcaataaaaagat

SEQ ID NO: 77792 - DNA, 201 bp, Bos taurus
tcccatggacagaggagcctggccgtctggtccatggggtcatgaagagttggacacaattgagcgcgtgcacacatacgcacacacatctttattgaagytgtaaactttctccatagagatcatgtgctcatctgtttcaaatggcctgatatttcctactgttcaatgaaggcagatttttaatattagaagagaaaa

SEQ ID NO: 77793 - DNA, 201 bp, Bos taurus
tcacatggcctgagttcagaaggagtgaaatccgataacggacaagaaatgaacttcctttggtccctcagcaaactgatcagccctcacaggataggagmtgtttcagtggccaaggagtctatcatcagggactcagagataaatgaatacccaacaagaacataaatgggagcctttaactaagcactactcagaaaa

SEQ ID NO: 77794 - DNA, 201 bp, Bos taurus
ggtattcaggccctcagtagactggatgatgcccagcgcttggtggggatgatctcctttactccgttgacaacagtgcaagggagtgttaatcgctcaaycatggccaactctttgcgaccttgcggactgcagcccaccaagctcctctgtccatggagctctccaggcaagaatactggagtgggttgccatgccctc

SEQ ID NO: 77795 - DNA, 201 bp, Bos taurus
aaatcgttatcatgtattttgggaaaagagacaatactgatgtagtctagtaatagtttcataatatagagacagtaaaagccattggtaatatgctgatragaacataatggagtcagtctggtttagatttctttcagattttagcacatagtagcaaattctctaagcctgtttccttcacaataaaggagacacaag

SEQ ID NO: 77796 - DNA, 201 bp, Bos taurus
atagcactaataatctgctgtataaatgtaatccctttgatagcatttaactgtaatggacacgtttttctgcatctaattttcagatacagagttaacgytggaaatctggagaagcattttatacaaattgaaagattgggctttctcttcagttttccagatgtattgtctcatctgcatacttgaaatatccacaat

SEQ ID NO: 77797 - DNA, 201 bp, Bos taurus
ggttattgagaaatcaaaacatttagattctcatggaaatttgcctaaagcaggcatgaacatactgaggtgtaaaataatgattagttcatgactagaartgttgccctgggatttttttggtctgttttggattatccttaatgggagcaaagaatacaaaggattttctcaacatgtacagagttgtatttctcacag

SEQ ID NO: 77798 - DNA, 201 bp, Bos taurus
tgccaatcattagctgttcatgtaattatattttctaggttcaagttcaattctcttcaaaaataaataaagggacataaagaattttgactgcattttgkggggcttctattcattatattttcccatagaaacttcacatataagacaatttatattttgtcaaaaggcagagaagatagttttgttaatgtagaagac

SEQ ID NO: 77799 - DNA, 201 bp, Bos taurus
atttttaattagatagattctctttatgctgtacatttgatgatttataaatttattggtcatgtgatatgttatctaaaccatagtgaattacagcagaygattttaaaccaatctaaattagagcacaagtgtgttagtatcaaaaatgattgacttttggattctgtctcttccataatgatacatttaattcttcag

SEQ ID NO: 77800 - DNA, 201 bp, Bos taurus
gggaaaagagcttacttttatagatactctaagaccaaccaaaagaagtcttacattaacatacactaataacagcaaaacattaatgacttagaagctayaggtctaagtcactaggggctgattaaaagaaacaggtgttaagacatttaggatgatgacagtcagctactaattaaatcattaactgaggattctgca

SEQ ID NO: 77801 - DNA, 201 bp, Bos taurus
caaagagtcaaacacgactgagtgactgatctgatctgatctgataaactggaactacgttattcattttaatatttgagtcataaacatgccaatctcastacacttttgccatcactgggtattaactttttctaattggatgggtaaaagatgattttttttattttattgcatttatttgatttttagtcaaattag

SEQ ID NO: 77802 - DNA, 201 bp, Bos taurus
gacctttcaggtcagaggccagtggtggcttttcatgcaaaccataggacaggatggagatgctcatggtcttcacgcttcctcccatgggcagtgactcyggtgggccacgctgactctaggaggactgggacagtggcaaatatcactcagttccttagaatcaataaagtgttagtcactcagtcatatcagactctt

SEQ ID NO: 77803 - DNA, 201 bp, Bos taurus
aggagcctagcgggctacagtccatggagttgcgacaagtcagacatgatggagcaactaacactaacactttccagatggtgggttgacacattggaggrgaaggcggttgagccctaaactgaaccactttatgaagcttatcctatatgcccttaaactttgggtcatgtgaattacatgtaagtaggattcagactg

SEQ ID NO: 77804 - DNA, 201 bp, Bos taurus
acatatactgccctaaacacaagcattacttatgataattttcttggtgcatgcaaaatgcaagcaaattttcattttaaaaccaaaatagctacaagagwcttaacacgtcctagaacaacaagaaataagtcccaattcctagtaaaatgctgcattaggccatctctctagggaaagtcttacctttaatccattcta

SEQ ID NO: 77805 - DNA, 201 bp, Bos taurus
tttctttcttcttggtttctgtctagggagactgtacctttctgagaatttgtctatttcttccaggttgtccgttttactggcctgcagttgttcattgkagtctcttatgacccttggcatttctggggtcagttgtaacttctttttcattcttaattttactgatttgagccctctcccttttttcttgatgagtct

SEQ ID NO: 77806 - DNA, 201 bp, Bos taurus
ggacagacgggtacagggccatgtgaaagccacagggtctgacgcaaagcctaggactggggtcaggaaggaggactaagtgcacttcagctcagggaaayggcctgagtcaaggctaagaggagaaggatgtcagaaggccatcagagagggagtcagaagacttggctcatttgttgggtacacactgaacttaaaaca

SEQ ID NO: 77807 - DNA, 201 bp, Bos taurus
cccacaacaaagtcttgataaatatctctttttattttctatgacaaaataattagttcttcactccttccagaatctgtttcagtagatagtacaaggtyagcctcttaaagtttttctcctaactagctagtgaattttcctagcaccatttatatcttaaacttaacttctccacagaatttaagttttaaaaattta

SEQ ID NO: 77808 - DNA, 201 bp, Bos taurus
ggagttaacacgggtaagcattttaccacataagcaagtaagttcacaaacctgagtgctctggtggccaggactggccctgctgcagcagggaaagagcragagcctggacacagcagacaaagcccaggatacagttcagccatcagcactgggagaggccttctacctccagggctctccagcttcatgaccccattc

SEQ ID NO: 77809 - DNA, 201 bp, Bos taurus
taagtaacactactcaaagaaaaaaaagagtcgcagatatttttggattttgctgtttgaaataaaattttggttggagaggaatgagtattagctttttmattcacttaattgttgcattattttttaatgaaggtagaatgaggtcttgattggggatggaataatatgtataaatcagagggttaagtagagtgttag

SEQ ID NO: 77810 - DNA, 201 bp, Bos taurus
ttctgtatctcctgacacagtgtggccagagatacaagatttcacctcactgtgttaatgctggaaaattttcatgaagaatcagaaaaatccagaatgckgaacaatcttctggaacagtaggcctgaactctttgaagaattaaatattgtgggaaaagacaggagaagtggagaactgcttctgaattgggggagcat

SEQ ID NO: 77811 - DNA, 201 bp, Bos taurus
ccatggttgcagcagaaaaacccaggtaaggaataaatgcatgagcttctagctacataggccatggacagctttacagaaatttccatgcttcacatggygacacagcagtagaaatacgtctgcattctcaaattgtgaactagtttctggtagtcctgaaaatcctgctggacccttcttttctgagaaacagaaatg

SEQ ID NO: 77812 - DNA, 201 bp, Bos taurus
ttccacttgtcaaatccagtgaaaccctttcagaatttaatcatactggatttctctggaccttctgatattgttaacaatccttcctttctaaaacattyttctcctttggcactttcccccttaggcctctaagacacaccttttttgcttatctctctctctctctctctttttttttttttaccccagccattcttt

SEQ ID NO: 77813 - DNA, 201 bp, Bos taurus
ttatgtaagtgtaatgagaatagcaactgatcacctaggctcctttaatttacctttgctaaaagtttcataaggaatcttaaaacttttaaagtctctcmaggccagcaaagtcatgttaaagatcacattttgtctcaaatgcctgcagttttgggtgaatttctttcttttcaagtactcaacatatcttcgggttct

SEQ ID NO: 77814 - DNA, 201 bp, Bos taurus
atggacagaggagcctggcaggctacagtccatggggtcgcaagagtcggacacgactgagcgacttacttcactatggtcacaataagggttaagaagtrttctcaaagtggtaaagaggaatacagttgagttcaacatatagatttgtttgtttggaagaggttttagggaatttatatggttataaatttatgcatt

SEQ ID NO: 77815 - DNA, 201 bp, Bos taurus
attttccacctcagtcagatgactgcaagaatacatgctcagagacagtcttcaaatgacaagaaagaccaccttccatacagtgtctttattcacagctmtcatattccagggtcacattagaactcaataggggcccacatcactgcaaatgtagagttagtatttattattcataaagtttaggtaaaaaaatagaga

SEQ ID NO: 77816 - DNA, 201 bp, Bos taurus
ttaaaattgtatacatatttaagcaccttcttttctctcttttcctctttgtgtctttaaccttccatctaaaatcattttcctttgcctaaagaaatgcmttcagaattaaccttaagacaagttattagacatgtattttcttactatttttgaaagcatatttattttaatttgtatgtgtgtgtataaaattctaag

SEQ ID NO: 77817 - DNA, 201 bp, Bos taurus
ggtgatggacagggaggcctggcgtgctgcaattcatggggtcccaaagagttggacacgactgagcaactgaactgaactgaataatgtgactattagtrcccttgatgttgtaccagaggcctcttaaaatgttctcagtttttaaaattatttttctgtttttttgttcagtttcagtgatttctactactctatttt

SEQ ID NO: 77818 - DNA, 201 bp, Bos taurus
gaatattaaacaatcagtcaggggcctgtgctatgtttttatagcaaactactcaaatcccataaagatgaaatgtctgatggtcatttacactcatttaytgttggactgtgaagaaggctgaatgccgaagaattgatgcttttgaactgtggtgttggagtagactcttgagagtcccttggactgcaaggagatcca

SEQ ID NO: 77819 - DNA, 201 bp, Bos taurus
ctaagttactaaaatgatcctgggataagaactatactctaggaaccttgattagaataaggctatcaaaatccattttagtcagtaatttatagtcattwagttttagttactttagagagatttactaatctcatttactcagtgcccatttgtgcacatttcattattagaaggctacctttattttagattatgaat

SEQ ID NO: 77820 - DNA, 201 bp, Bos taurus
gctctgaagttatcctgactttaatcttattttgattaaaaagtgacattgggacatcgtgtttgtttgtgtagcagttcagtctcaactgaagattaatkacaaggtgaatccaggcacaatagttcttggcttccctgatgactcagtggtaaagcatcggcctgcaatgtaagatacccaagttccatccctgggtcg

SEQ ID NO: 77821 - DNA, 201 bp, Bos taurus
tggatccatatgagaaaggataaagaggcatttaaagtcagtaaaatatttagaagcagtgggaagcatccaataaccattttaagtgcttgccatgttcyggatcctgccatacagcttaaggtgcttatttatctggtattttttatgcacatacatttggccaggaatagttctagacatgagggatataacagtaag

SEQ ID NO: 77822 - DNA, 201 bp, Bos taurus
taaaattttctgctgaggtcaggattagtttaggaactgagcgcatagcatacagccttcctggtgatctcagctaaagctggtctagaccacagagctgyccaacagaaagtcctgtgttgatggaaatgctctaattcactacccaatgtgagactcattagccatatatgactgttgagcagctgaaatatggtatga

SEQ ID NO: 77823 - DNA, 201 bp, Bos taurus
attaaaatcatgttttaaaaaggagattagggattttttaaaagctttctatatattacatgaaaaaagagcaaaggcaaattagaaaaatatagtcagcrtggttgcacaaatacacaaacatgcaaataaaactctgaaagttgttttctttgagtgatagaattatgggtaattcttattttctcatttgcagttttt

SEQ ID NO: 77824 - DNA, 201 bp, Bos taurus
agcaaatattatttaaaaatatcatgtaagggagtgataagcactaagaagaagaaaaaaacagcgggaggagacagaatcatgcagggccctattgtggrtggggtggttaggggctacctctacagaaggggctgttcaataaataccacaagaaaagaaaacacagagatgagcatgtccagagacctgaagtgaaga

SEQ ID NO: 77825 - DNA, 201 bp, Bos taurus
agtaggtacaactgaaaaatttgagtcactcaccatcttgtatctgacagagtcctcaacagagaaatagtccctttgaagaatgcccacaaacaatgcayttaattttccaagataaaagtttatcatcatttagaaagaagccaggaaaaaaaaatggtcttaagggctttagaatgttttccaaatgcattgtggtac

SEQ ID NO: 77826 - DNA, 201 bp, Bos taurus
tcccccggccactgtcagcagcgtccagggaggctcggtccccctggtcctgggaaagctcctccgtgctgggggaagagatcacggtggctgcagcatayaggcccctgctctcagacagtggtgcacaggaactaggcggccgacgggaaagagaaaggagaaaagaagatgagaaggaggggaagaaaagagcaagat

SEQ ID NO: 77827 - DNA, 201 bp, Bos taurus
tcaggaacccacccacaggcaattgcatttgtggctggggagctctgaccctctctggctatagctgattggaaccaggtaacagctgtccccagcccacmccccagattgtggcctgaagatcagaagaaaagacacagacacaaccatcaaatggtacggatgtcaatgacataggtcacaaatcaacagtcagtacct

SEQ ID NO: 77828 - DNA, 201 bp, Bos taurus
ctgggttgctcagagtataagccctgtgtctgccaggactgttgcaacagctttcttaccggcatccctctcattcttggccggttacatatccattcagygcaaaataaaggtcatgagagttattcaaggaaacctactagaggttagactaagagttacctgagtgactatgggcccccaaagcaggggactcacatt

SEQ ID NO: 77829 - DNA, 201 bp, Bos taurus
caaaaagttaacatggatccattggcacctaccaatggtattgaccaagcacatagttaaactttattcagttgaaaaagtgtgtctatgttgtcattcartgccacataaatagtactggagtccaactagaaaattgaatgcaggtgatttgacgactttgtacttttattcaatattttagtaagttgacataagcca

SEQ ID NO: 77830 - DNA, 201 bp, Bos taurus
agcaaaaagacagatttgaagtcaagggcaattaaacatcttcctaatgacctttctacccagcagctcctttccactcccgttgtctcagctgtgattcyaatctagattatctcacatctgcctggtacactttaaaaaaaaacattttattttgtattggggtataaccaattaacaatgttgtgatagtttcaggtg

SEQ ID NO: 77831 - DNA, 201 bp, Bos taurus
tttgtatataggaaacagaactaattttctatccaacccctggcccaactggctcctctttaaaatgcaaatattctgaatggcttaaaccttcattgtcmaggtgctccagaggccttgttcacatcttattttcagtctcaggcaaatctcttcctatcctagctcagtcaccatccttttgctgctaagtcctgagtc

SEQ ID NO: 77832 - DNA, 201 bp, Bos taurus
ttaaaagctagctcttcaaaactatccagtgaagtcttttattcttttttacttccttctgattcttctaaagcatggggaattttataagtcccctgctytcaattctccatatgacagtttacagtgaaacctgaggcttccgtttcaaaaacagagtcacttttaaagaacaggtgtcttgccattttcagaaatggc

SEQ ID NO: 77833 - DNA, 201 bp, Bos taurus
tttgctttgaaatttttattttaaagtcaaatatttaagtggtgtttgggaatatgttggattgtagtggatagattttgaaagcaatcttagaaaagttrtgcttgaaacaaattgaaatcacttgctctgggatgttgcagcaaggacaagggaatacagaacacagttgttaattttctgtacacaacattctttctg

SEQ ID NO: 77834 - DNA, 201 bp, Bos taurus
aagaagaagtcatcaataattgaactcactatccaaacagaacacttgacttatttgtattcctttcctgtgtgtataatttatatagataattatgatamtgtaatagtgattatgaatcaaatttgtatcctacttattgcatctgttgctataatgtgaacatatctcatggcataaaaagttattcctaagccttat

SEQ ID NO: 77835 - DNA, 201 bp, Bos taurus
tatggcattttaatcgtacgtccattaggcacttttcagcttttttcatatttgactacacttgtgacagacctcttgaaattctgtttctttcacatgcyaaatactatgctttccatttttttgttcttcctctcttaacactcctgattttttctctcattttcctttggatttttattaattcagaaagtggagtct

SEQ ID NO: 77836 - DNA, 201 bp, Bos taurus
aatgtaagtatagttgtatgtatacattcatatggctaccagagtctttctctccatatatatacacacaaaaatgtgcacactcacacactcacatacgrtgtcaaatgcatgccaggtactaagttagtcagagggaacataaagtgtgtacaaatatgaacctgtattttttatataagttcaaaactaagaaaaaat

SEQ ID NO: 77837 - DNA, 201 bp, Bos taurus
ttaataatatgatcataagcaattgagattctaaaagtgatgtgctaccttaatttcttccaggtaaaaatgcttgtaagactatcctgtaaaaggagcakgccactatgtgtgagaagaatttacttgcaaatcaagcttagccactggtgttattaacataaaagatatcagagctctggatgtctgtttgttaaatca

SEQ ID NO: 77838 - DNA, 201 bp, Bos taurus
cacatgtcctttactcctacattttcataggtgtaaggactgtctccttgaatttatatctcttttaattttcagttgctcagctcattaactttcccttrtccttgttgacatagattgtgattgcttcactaagcaatatataaatatgcataattcaccatgataattaatatccaatttattatggcccaagtttgt

SEQ ID NO: 77839 - DNA, 201 bp, Bos taurus
aacacttcactgcttcaattcaaccccaagtatagcaattgtgaatttttccacaaaaatatgttctctcttctgtctccctttctcttcacaataagtcytaataactcagatactcaggaaacagatcacaagagtccaaattctcatgtattaattctctggctctaaagccaaaattacatgacatgatatcagggt

SEQ ID NO: 77840 - DNA, 201 bp, Bos taurus
taaaacaccttgatttaacttctttgttcaatctcaacaacaaaaatagaacattttaagtgtggattttttaaagcaattgaaagatgtatgcaattatragtaattttttgctgttggctaactaatctaatcgaaaagggtttgcaattcttttttgttttaaacgaacacatttttaggggtgcacagttgttttga

SEQ ID NO: 77841 - DNA, 201 bp, Bos taurus; identical to SEQ ID NO: 37988

SEQ ID NO: 77842 - DNA, 201 bp, Bos taurus; identical to SEQ ID NO: 37989

SEQ ID NO: 77843 - DNA, 201 bp, Bos taurus
ttacatttattgtctcttataacaagacatccggagttcaggcaggttcaggatgacttagtttcagggctccgtgccatggtcaccaggctctttaaacrtttacctccatcatccttggcccatagacttcagaccttgggctcatcccagtatcacctcctgacggagctgtgtccagacataggaaaaagaagcttc

SEQ ID NO: 77844 - DNA, 201 bp, Bos taurus
agactggccagtcctgcctttgttttaactttaatgagaatgaatttggttttatttaatgtactatttgcagttaatttatgttatccagttttaccatsatttaaatatttcctgcacttcacagttgactcagtttttatctatttgatttattatgtttttcaatatttattaatatgagcatatagtttttctcct

SEQ ID NO: 77845 - DNA, 201 bp, Bos taurus; identical to SEQ ID NO: 37991

SEQ ID NO: 77846 - DNA, 201 bp, Bos taurus; identical to SEQ ID NO: 37993

SEQ ID NO: 77847 - DNA, 201 bp, Bos taurus; identical to SEQ ID NO: 37994

SEQ ID NO: 77848 - DNA, 201 bp, Bos taurus; identical to SEQ ID NO: 37995

SEQ ID NO: 77849 - DNA, 201 bp, Bos taurus; identical to SEQ ID NO: 37996

SEQ ID NO: 77850 - DNA, 201 bp, Bos taurus
tcttggaagatatgggactgagtacagatggaactgttagaaataaagaattaaagtggtccattttcaagggtgtctggttttgagtggaaagattactrccagccaaactttcctaacagcttgttggttgtagtaactgtaaggaaagtctgggcaaacaaagggagggtgggatgcctaggatttttgtgtgggctc

SEQ ID NO: 77851 - DNA, 201 bp, Bos taurus
acactgaaactaccaagttcttagaatcagacagtctagatagtagagccaaatgatgctccctcaggcccaggaacctgatgcgaataaaacacagtaarcaaagcttagatgtgtgatgttcacagtttgactccctgctttggaagtgttcatgagataacttcatgaaggaattgggttaagtatgctggaggttgg

SEQ ID NO: 77852 - DNA, 201 bp, Bos taurus; identical to SEQ ID NO: 37997

SEQ ID NO: 77853 - DNA, 201 bp, Bos taurus; identical to SEQ ID NO: 37998

SEQ ID NO: 77854 - DNA, 201 bp, Bos taurus
ggttcctcacatcaacagcagtagccagagtggccagtttcccaactctcagttctcacagggggataccaagagggccacagattagtagtaggctgacrtacgggcaagagtcctggacttaaggagctgaatcctttctgctagatggtcggcatgccttgctttgcttcagagggaggtgctatctctatttctaag

SEQ ID NO: 77855 - DNA, 201 bp, Bos taurus; identical to SEQ ID NO: 37999

SEQ ID NO: 77856 - DNA, 201 bp, Bos taurus
tgtgaagtgatatttcactgtagttttgatttgcgttttccggatgattaatgatgtagagcatcttttcatgtacctgctagccatctctctgttggccyttggaaaaaggtctattcagatctcctgcccattttaagatcaaattgtttgttgctattgagttgtatgggttctttatgtcttttggctattaggccc

SEQ ID NO: 77857 - DNA, 201 bp, Bos taurus
ccttgtccaaggcagcttctcatctgcaagagcagagttaagtgcttgggacagaagcttctggcaagaaaagccaaaattattgcctggcctttactttrctgacactgatttagatcaaagttgcagccataatttccagcaattatctaaatagatattttcacttacgtgtcaggagtgtagaaggaatctaaggcc

SEQ ID NO: 77858 - DNA, 201 bp, Bos taurus; identical to SEQ ID NO: 38000

SEQ ID NO: 77859 - DNA, 201 bp, Bos taurus; identical to SEQ ID NO: 38004

SEQ ID NO: 77860 - DNA, 201 bp, Bos taurus
gtgattgtccaagatcataggcctcagaaccacagggacccacaagtcccactggacagcaaggaaagtatggggtcatacactggccaggattacagtcrgatatccttatgaagcagagctcaaaaggagccatcaggaccgggcagggagaagtgactgcgacatagctgatcggctgacaaaccttcagggaattcc

SEQ ID NO: 77861 - DNA, 201 bp, Bos taurus
tgtacttagcagatgctaccaaaccactttccacacatgtaagaatctgaacagacttgccacgctccctggcaaagggtctggcctgtttccagctctckccgccctgtaccacctatagatacgcgcgcgctaaagggaagcaagatgcgccctcgtcgctgttcccagacctcagcgccttgtcaccggctcctgtct

SEQ ID NO: 77862 - DNA, 201 bp, Bos taurus; identical to SEQ ID NO: 38005

SEQ ID NO: 77863 - DNA, 201 bp, Bos taurus; identical to SEQ ID NO: 38006

SEQ ID NO: 77864 - DNA, 201 bp, Bos taurus
tgtagcgaatgacattggcgtggcagatgaagatctcatagctgtcctcctgctgcttggcgtccgcccggtggatatagttccggaaggcggcctcgatycgtgctccatcttcataatactgctgggggcagaagaaggaatcgtgcgtatggaggcagtgtgggccccgctgccaccaggagcccaagggcagagagg

SEQ ID NO: 77865 - DNA, 201 bp, Bos taurus; identical to SEQ ID NO: 38008

SEQ ID NO: 77866 - DNA, 201 bp, Bos taurus
atggcacttcatccacacgacctcgcggctctcttgatgcccccatggctggccgcgctgctcccatctcacgctgaagatgggggccagagaggcaaagygactggcttgagatagctcggcaggaggttttggtgctgaagtccaaacagaggcttgtgtcctccttccaggctgtatcgcaaaggggaggggacagga

SEQ ID NO: 77867 - DNA, 201 bp, Bos taurus
gagatggccctacaagccatcctgagagctgcggaagcctgtggggatatgtgcagtctccttccctgggagagccctcagagaatgagctctggtggagrgtggtttactctggcctctggaggcttgccttaaattgcttccccagagaacagagactgatgatgtcttgaatcagtttcctgtggaatctagtcttcc

SEQ ID NO: 77868 - DNA, 201 bp, Bos taurus
agattcacaccgaggtcccgcctcccaggtgcccttggtcctgtgtcttggctcttgctgggcaggtgctgtgccctggcctgggaaggacagcaattggkattcaacggcaaacctaaacccctctggtgacttcatccccacaggttaggcactccacagggtccctgacccgtgagaacagggtgctgtggggccaga

SEQ ID NO: 77869 - DNA, 201 bp, Bos taurus
gcataaacagaaaccaaaccccaggaagatggtccttggcaccgccattcacgaaatgcaaattactctagcagataacgcgtgctcctctcttgatagcyggaaggtatacctgtcaggggttggcaaactcaagacacacacgctcacgtcgggggcggtggtaggggggatcacgcagcttagaggattcagttaaga

SEQ ID NO: 77870 - DNA, 201 bp, Bos taurus
gggtatacaggcatttactataaaattctctcaatcctggtatatctttgaaatttttcatagtagaatgttagcatctattaagatggcaatgtcacatrtcacttaataaataaaaggctgtaacaaaagtcctatttgctaacaaaacttcattcttccaccttagagcaggttatgaaggttccatactagacctta

SEQ ID NO: 77871 - DNA, 201 bp, Bos taurus
catctctgacctatgtcagagtacacattgaagcctgtgaggttgggataggtgcccaggggacagtttgaagtgggacaggcccctgagttgggcctcckggctgagggtccctgtgagcatgccaggaacgtgcaatgcaaggtctacagaaagcaagccagtccctcctgtgtgcttgctgcacccccaggcctagcc

SEQ ID NO: 77872 - DNA, 201 bp, Bos taurus
gggcctgggagtgtccaggcgctcacctgtccatccatccccagagatcctcctctactctctgctgacagagcatggttctctcttcctgtggaacctcrtccaggcccatgccctggcctcactcacactcacaaaggggaacttaggacatttaccgcagtagtctttttttgaaaaaatttttatttggctgcacaa

SEQ ID NO: 77873 - DNA, 201 bp, Bos taurus; identical to SEQ ID NO: 38009

SEQ ID NO: 77874 - DNA, 201 bp, Bos taurus
tcagtggaagtcctttggacaggagtctgctctcacccctagcatccaaaataaagcaaactttcctttccaccaacctggcctcttgattggctttcackcagtgaacagctggaccccaattttggttacagtgggaactcctctttctgggttgatctcagcgccggcttctcctgcctgctcattggccccttggac

SEQ ID NO: 77875 - DNA, 201 bp, Bos taurus; identical to SEQ ID NO: 38015

SEQ ID NO: 77876 - DNA, 201 bp, Bos taurus; identical to SEQ ID NO: 38016

SEQ ID NO: 77877 - DNA, 201 bp, Bos taurus; identical to SEQ ID NO: 38017

SEQ ID NO: 77878 - DNA, 201 bp, Bos taurus; identical to SEQ ID NO: 38019

SEQ ID NO: 77879 - DNA, 201 bp, Bos taurus; identical to SEQ ID NO: 38020

SEQ ID NO: 77880 - DNA, 201 bp, Bos taurus; identical to SEQ ID NO: 38021

SEQ ID NO: 77881 - DNA, 201 bp, Bos taurus; identical to SEQ ID NO: 38022

SEQ ID NO: 77882 - DNA, 201 bp, Bos taurus; identical to SEQ ID NO: 38023

SEQ ID NO: 77883 - DNA, 201 bp, Bos taurus
tgagtgatgagcgatcccagcaaagccggcttccattctcaggctggaaggatgttctgtgaattcagatgaccgcggggaggagaactgtcaggatgatyctgccctcgggccagccgcgtgcttgcactgccgagagcccggaattccgtgggtcatcagtattcacgccttgcacctgagtgggccccttgctatcct

SEQ ID NO: 77884 - DNA, 201 bp, Bos taurus
acagcaccgtccccacagaagggccaaggctcctttcaggtgacctcacctggttaacagcactcccattgaccttcaggctctattgttaactttgggckgtctggcctcacatcctgtctgaccacttccttcatgggcacttgccatggtgtaaaatcaggaatctcccaaaactcatactcttggtcacttttgtag

SEQ ID NO: 77885 - DNA, 201 bp, Bos taurus; identical to SEQ ID NO: 38024

SEQ ID NO: 77886 - DNA, 201 bp, Bos taurus; identical to SEQ ID NO: 38025

SEQ ID NO: 77887 - DNA, 201 bp, Bos taurus; identical to SEQ ID NO: 38026

SEQ ID NO: 77888 - DNA, 201 bp, Bos taurus; identical to SEQ ID NO: 38027

SEQ ID NO: 77889 - DNA, 201 bp, Bos taurus; identical to SEQ ID NO: 38028

SEQ ID NO: 77890 - DNA, 201 bp, Bos taurus; identical to SEQ ID NO: 38032

SEQ ID NO: 77891 - DNA, 201 bp, Bos taurus
cacccacccaacgtggttctccatattggatggccacaagctaattcaaccagaccactgtctggattattatgaataggagatgcaagcaaaagaagcargagaggcctgttcagaggtgagaagaaagcagcatgaatataactttccctggagctgtatttacaacttagacacaagacctccaggaggtctcagagc

SEQ ID NO: 77892 - DNA, 201 bp, Bos taurus; identical to SEQ ID NO: 38033

SEQ ID NO: 77893 - DNA, 201 bp, Bos taurus; identical to SEQ ID NO: 38034

SEQ ID NO: 77894 - DNA, 201 bp, Bos taurus; identical to SEQ ID NO: 38035

SEQ ID NO: 77895 - DNA, 201 bp, Bos taurus; identical to SEQ ID NO: 38037

SEQ ID NO: 77896 - DNA, 201 bp, Bos taurus; identical to SEQ ID NO: 38039

SEQ ID NO: 77897 - DNA, 201 bp, Bos taurus
ttctgttggaccaagcatctctgcgaatgtaaataagatgaggatctcaagatgagaccaccatggataaaggtgagggggaaatccaagaatgagtgtcyttttagaagagagaaaagaagacatagtgtatcagttcaagtgccacggtaaaatacaagatggggtggcttacaggatggacctttattttcaaggttc

SEQ ID NO: 77898 - DNA, 201 bp, Bos taurus
atttttaaatcccagctagaacttcaaaactactttagaactcccgaagagacgccgctgtgcttgttagctttaagaagcacacagctttattgacaaaygcatcacctccataactaagaaaaggggtgatcgacaatttcatatttccactttcagggctcgttagatcattacctccagaattgcggctgacatgcc

SEQ ID NO: 77899 - DNA, 201 bp, Bos taurus; identical to SEQ ID NO: 38041

SEQ ID NO: 77900 - DNA, 201 bp, Bos taurus; identical to SEQ ID NO: 38046

SEQ ID NO: 77901 - DNA, 201 bp, Bos taurus; identical to SEQ ID NO: 38048

SEQ ID NO: 77902 - DNA, 201 bp, Bos taurus; identical to SEQ ID NO: 38049

SEQ ID NO: 77903 - DNA, 201 bp, Bos taurus
aaacctgattcctcttccccctcatcacccagctgtgaaacaagcttctcaggccccagtatatccaataattcctctgaaactggactccagagaggtgrgaagctctcagaatcatagacggccaccccagatctctataaaactctagatcctagcctgagaattctttattaataaaccattggttgttatttgcat

SEQ ID NO: 77904 - DNA, 201 bp, Bos taurus
cccccagggctctctgaggccctgaagcaacaccaaacgctgtgtattctaatgtaagaagagctgaggacgggaatgtgcagactgaaaacagcagttcrtgccatgttaatctgtgagcatgggccagacggcttgtcaatgtcatcacaggaaggctgcctctagaggttcattgctctactgtcaaattacacttct

SEQ ID NO: 77905 - DNA, 201 bp, Bos taurus
agcaaccacaccattttacatttccatgaacaggagtccagtttctctacattcttgtcgacacttggtatcatcagccttttgtattttggccatcctgytgttctcattatagatttaaagattttttgatgtggacaatttttaaagtctctactgaatttattgcagtattgcttctgttttatgttttggtttttt

SEQ ID NO: 77906 - DNA, 201 bp, Bos taurus; identical to SEQ ID NO: 38060

SEQ ID NO: 77907 - DNA, 201 bp, Bos taurus
gtgtggccaaaaagtttaaaaaaaaaaaaaaaaaaaggcaagtgctggttggaaaggaaagattgctttatttaggaggccagcaatgtggggagaaggcrgattcacgtccaaaaaccaactctaaagattctgctcaaccatgaaagtttttaaagggagaatcttttggagaaaaggtcagggcctttatcttcttcc

SEQ ID NO: 77908 - DNA, 201 bp, Bos taurus
ccattagctctcaaaccagattttcacaggcttgtgaaggacttctggccctctggggacaggctgatgttgcaccagctttatacctaaatggccaagcygaacctgccgcaagtaaagaaggttatggagagtcaggatgccaagagctgtgggtctgagccctgtgtagtctcctgctcctgcagaatcttggccaag

SEQ ID NO: 77909 - DNA, 201 bp, Bos taurus
ccccaggcttttgagctgctgaccttccccctgcagcatcctcttctgtaggtgccacaggcagtggcccatgcccaggccacagggtgcagtgaaacctrtacagaattgaaattctagagttttggctccctgccccaaatcggtgtgtctgtggccaaaccaagtggccttgtacctgtaaaaacgaggacagctcca

SEQ ID NO: 77910 - DNA, 201 bp, Bos taurus
gttactatccagctctgggaagaacatggaggtgatgtgaaaatgatacagaataagctccaattatagaacattcagtgaatattcaagaaacaaaatgrtgtgtatagaagtctatgtttgtgttaaaaaagaaaaaaaggagggtatgattgctcatcaaggaaatgtacatcaaaaccacaatgagacaccacttca

SEQ ID NO: 77911 - DNA, 201 bp, Bos taurus; identical to SEQ ID NO: 38063

SEQ ID NO: 77912 - DNA, 201 bp, Bos taurus
accaggcaagtgtgggattggtgggtgggggtgggtgtgggagggggaagacttcctcaggtagcaccgtcgtgaggccggggctggggggcattgaagtygaggacaggttctcatacctgtctccattcacatttacctgggagtgggcggtggggtggggttgcgccagaccccagatcgcagctctggagccccagg

SEQ ID NO: 77913 - DNA, 201 bp, Bos taurus
ttcctttctgaatccagggcactgggaacagccaggtgccccagagcaaatatgctgagctgctggccatcatcgaagagctggggaaggagatcagaccyacctacgcgggcagcaagagtgcgatggagagactaaaacgaggtaagtcatgtaccctggactcccctggtgggtgatgcccttctgctggctgacccc

SEQ ID NO: 77914 - DNA, 201 bp, Bos taurus; identical to SEQ ID NO: 38066

SEQ ID NO: 77915 - DNA, 201 bp, Bos taurus
cagatgagaaaactgaggcccaaagcagaaagctggctaccccaagggcaccattcaagtccaggcagtctggctctgaaaaaaatccatctgtgtgtgtrtgctcagtcgcatccaactcttcttgaccccatagactgtagcctgccaggctcttctgtccacgggacttcccaggcaagaatactagagtgggttgcc

SEQ ID NO: 77916 - DNA, 201 bp, Bos taurus
tgtttaggtttgtaatccattttgagttcatttctgtgtccagttcaaggaaaggacccaacttcattcatttgcctgtttagtcatctagtagaaatggmaacccactccagtgttcttgcctggagaatcccagggacgggggagcctggtgggctgccgtctatggggttgcacagagttggacacgactgagtgacg

SEQ ID NO: 77917 - DNA, 201 bp, Bos taurus
tgtaaaacagttcaaaatgctttgttctatttattctatagtataaaggggatgggagctatttttaaaagttctgtcctcagaatgctcatgtgcctttktcagacacccacacacaacctgacttttctattttccgcaactaatcaccaagtcaagctgcactcaagccatcttcctctggtttgtttttgttgccac

SEQ ID NO: 77918 - DNA, 201 bp, Bos taurus
atgtttggtattggtggtagtggaaatttggggggtttttttggttttgtttttcgctttggttatggacttttgaattttctgttgatgttttttaacaytggattgaatttaattaatgacaggcagtaacatccaatgaacaaaagaaagggttcgcacagttgtttgttgcaaacctctgtgatctcattcaacccc

SEQ ID NO: 77919 - DNA, 201 bp, Bos taurus
aatatattaaaaaaaaattctgaaccctgtttgctgtctcaggcagatttctggagcagttctgctacttgagggtagcaacatgcagaaaaagtatacaygtggcaccacatgtacatacgcacatgtgcatgtactgacataagtgtgcatatccatacacatatacagacatatgtgcatgcccaggcaggcacacag

SEQ ID NO: 77920 - DNA, 201 bp, Bos taurus
tcgttgtgcctgtgagctttctctagttgcagagtttggggctactctctagttttggtgtccgggcttcttcttgccgtggcttctctccttgtggagcrcgggctctctgtgcacaggctctttagttgcagcatgcaggctcggtagttgtggcttgctggctctaaggcacgtgagcttcagtagcagcatgggggc

SEQ ID NO: 77921 - DNA, 201 bp, Bos taurus
tcttattttaagtgggattgctcaatttttaaattttgccatcaagttccaattaaaaataaaaacaacactgggctttggggccacacccgcacaccacrtgctggatctagtttgtctgcaacctctgtggactgtaattctcagcttcaatgcctgtcttgcccatgagctcttgggagtctggagtgggactgggcc

SEQ ID NO: 77922 - DNA, 201 bp, Bos taurus
gtgtgattctactgctatcttttcccaccaactgggtgaagatgacgatctgcatttctctatgcaagccacatcagggcctcactgttattaaagaaagrggaagacctttaatatagaccctaaattaaagaaaggagaaggagagcaacaggcctttggagagcagagggcacagtgacttccactacgtgggcaggg

SEQ ID NO: 77923 - DNA, 201 bp, Bos taurus
gcgggaactaattccctgaccggggatcgaacccaggcccccagctttgggagcacaagagtcttagccaccagaccaccaggggaagtccctaatctttrgttatatatttatgtgttcacttggttaatgtctgcctctccatggtggggggaactagtctgttttgttcatgacctcatttgaaacgtagtggttatg

SEQ ID NO: 77924 - DNA, 201 bp, Bos taurus
tgtggcctgggttcagccgggatgggacctcaggctgtttgccacccacagtatggggacacgacacacaccctggtggagaagatgaactatactggccrgttcctgcctggattcgaggcaccaccattcatggacccccaactttccaagctgtgagtgccccttggaacaggggagggtggaaagcaaggccctttc

SEQ ID NO: 77925 - DNA, 201 bp, Bos taurus
gagtcttagctactggaccaccagggaaggccttcgggggctttttttttttttttaaccttgcaagcccatcttcagaggccagagtggaaccctgttcrtctcttctggacagatgacttgcccctctaagcctgtgaatcactgtgggtaaatgggaaaggtcattgtatcacctgtggctgggaggccccctagagt

SEQ ID NO: 77926 - DNA, 201 bp, Bos taurus
cttcatcttgaagagcaaccaacacatctctgcaagccctggaggcctggcaagcccccgttctctgtcctacctaccaaaggtccccagagaaatacccrctccctgtccaggaagggccggagccagacacaggctctcagcagcaagcctggctgagcagcagcttctaatttcacagttcactgtgcccacagccca

SEQ ID NO: 77927 - DNA, 201 bp, Bos taurus
gtaaataagaacctgtgctcccaatgcagggggcacaggttcagtccctggttggggagctaagatcccgcatgctacctggtgtggccaacgaacaagcraacacacaccctcttttccctatagacgtcctgcccagatcctcccactgtggccttatgggattggactcagtggtctgctcacccgagtgcccttgag

SEQ ID NO: 77928 - DNA, 201 bp, Bos taurus
ctatcactgcctcccattggtcgatctataaaggaagtcagctcttttggcagcctgcagaggttggcatccgagtgatacagagctaagcagaggaaggscaaggaatggatttgaaggcaaacaagcccaggcccaacactggggagctggagttatatttaatctctctaagtctcagattcaccatctagaaaatag

SEQ ID NO: 77929 - DNA, 201 bp, Bos taurus
tccactcttgaaacaatcacttgaatagagcagttgatgcccagttgaccagacttgagtcatagtggaacccctaaagctgacagcatggccagctccayggagtcccctttgacacacaaggattgattcctgacgtgaatcaggctgctgttatcatactaaaggaacttggatggattcaaggccggctaaagaaaa

SEQ ID NO: 77930 - DNA, 201 bp, Bos taurus
caggcactaagccaagcactctacttactatagtgaatgtattaatacctttgtcacttggcatccattttgctggcttctgggaaatctacctgaaattycctttgggaaacacctttcctaactctccgtggtttgaatggggctgtgacctctcccaggagagggcacctgactcagtcctggccaatcaggacagtg

SEQ ID NO: 77931 - DNA, 201 bp, Bos taurus
ctttctgaggttgcacgcactttcgtttgcatatcaacaggcacgctgcagacttcattaggtgttaagaggaagaatacagaaaaaagaatatagaaaakttcccatcacaagaaaaatatttttctgtaactatgtggggttgttagatgttagctagacttactatggtgatcatttcacagtatatacaaataacaa

SEQ ID NO: 77932 - DNA, 201 bp, Bos taurus
ttagctcacaccagcagattatggtgcaaatacccaactcttgcccccagcctgggcccccaggcacattgctatcagttacccctgatagctatggcccytcacactttacatctttaatgaaaatggatcaaatttgacactgtaggtgtacttctgctatctaggcccaagaatgattaaaaatttaacctgagttgc

SEQ ID NO: 77933 - DNA, 201 bp, Bos taurus
catgtgacgttactttttgggaattgcagccatgctgaaatgcgtgatgagcggcagtcaggtgaaaggtgcagaggcctttcttgccttcctgtgtaaaraagggaaagcttagggtttgtgggcgtggggacgtttccaccgtcgtctcatttcttgacctttgcctttatggctaagggacagaaggcctggtcatag

SEQ ID NO: 77934 - DNA, 201 bp, Bos taurus
aggtcattagtctgctgtgatccaaactgaactaattttttttcttccctcccaaatctgcttctgcttccacactggcctaggtcacagagtcacatcckccctgccgctcaagtccagaatgaaagatcactcttggcttctctccatcaggcctgtcaatctaacctcctgaacaccattcctcctgcaccttctctt

SEQ ID NO: 77935 - DNA, 201 bp, Bos taurus
cctgtagctggacattcttaccaggcttggaccctctcactgtagggggagaaaaaccccaatttagtcaagtgaagtcaaagtaagatttcatataaaarttaaacatatatgaaaaggcacaagctttaaataaagaggagacaagaacatggtttaactactttctgactaggctttattttcaggacacataaaaat

SEQ ID NO: 77936 - DNA, 201 bp, Bos taurus
tgagctgagtgagtgagggagccaggcgcacaatgtgaggcaacggcaaggtgtgcaaggcagatcgcatggtttggccttggaatttcataccagaaacraggggagtaataaggagttcctggcaggagacactgtgtcgaaccagcccctagggtgcccatgacaggggcaatctgactgggagcaaggccagcaaac

SEQ ID NO: 77937 - DNA, 201 bp, Bos taurus
tttggggacaatggaggcctttgttatctttcccttcttcgagtgggccactgtctgtatgagaatccagattacccttgttggtggcgctgatgattacytctgagaatctgttcctaccggcctctccaggcaggctgggggtgaatcgggggctgcacaaagccaagaatgttatcacggtgaaccaggacaggcccg

SEQ ID NO: 77938 - DNA, 201 bp, Bos taurus
tacagaaacacagcataaacagggccgccatccatcctttgttcacagcagacatcactagtcagtcacaggctatttccctctgaattagcactggtgcyagaatcctcctccctctgggccctgatcagtgaggagagacaggggtggctctcccctttggggtccctcccaggtgtcaggccttcagcccacagttga

SEQ ID NO: 77939 - DNA, 201 bp, Bos taurus
atggggcctatgtaaagttctggggtatcacatctagaaatgtgagccaaagagtgtcaggatcacattttgtattctggaaaagatcattccaggagackggagatctactcatgtttgcaggccacagaagagaatgaaagagccacagaaagaagggacaatttgagagaatgtatgtcactagaatgtatgttccag

SEQ ID NO: 77940 - DNA, 201 bp, Bos taurus
gctttccagttcagcttaacaccaaggggtgttttagctggctatgggatgtgttcctatctcctctgtggagcagttagaattggggaccatgggtctgrgatgtgttaacttcacttttccagtgtcagctcagagctggttcaggtgttcattcagtaaaggtttgttggatggataaagaaggaaataataatgcct

SEQ ID NO: 77941 - DNA, 201 bp, Bos taurus
ccggccggggctttgagattgcccagggccgactgggtcccggcaggatccatcactgcatgcggctgattggctgctcggagagggcgctggcgctcatraaggcccgagtaagtacttctctttgcgcctgtctctggaccagaacgacccatctgtcttcctttcagacttctaatcctaactgtttcctgagagcag

SEQ ID NO: 77942 - DNA, 201 bp, Bos taurus
ggaagcactagaagtgcaaccttaattaaacagttcgggattttctaattagcagcaatgaggtaatctgctatgaggatcctctccatttcccccacgcyccccaccacagaggatgagaaggtaacccacatgatgtcctgaccaaaaagatatcctagcttgaaaatacagtgatccttaatttttttcctgctaatc

SEQ ID NO: 77943 - DNA, 201 bp, Bos taurus
cctccacagtttggtatttgtgcttgtgggcagctccgttggtactttggattttttaaaatcaggagaaaagaaatggagtttttaggtaaaagaaagtrttttcatagataatgtttttatctttatatatttatatatatatataaatttttttaatggagaaaggagtccaggactgcttaatactagagctatgaa

SEQ ID NO: 77944 - DNA, 201 bp, Bos taurus
gaattctggctttccccaccacctcaccacgcttcccctgccgtgcagtttcctcattcttagtgatcagtaaatattcaatggtgaggataatgctgacyaaagtttgcactgttagcttcaagaaaattctcagaaatcattcatttcctggccaccatttggagtaaaacataactaggatttctgcagcccttcctt

SEQ ID NO: 77945 - DNA, 201 bp, Bos taurus
agtcctttgaaggatttactactgttatcacttgtattttataaagaaactgaagcttagagaggtcaagtggcttgcttaaggtcacacagcaaggaaaygatggaaccagtggtttaatcagacatgggcaaccagaccaatataaaaatttaggcctcacagataggccagtgggtaacagatcaccttaggtgaacc

SEQ ID NO: 77946 - DNA, 201 bp, Bos taurus
ccattaaagaggaaagttgggtgtgttcttatctatctttcaactgccttctccttcacaggccaacatcatcaatttgccatcttgtaggcaagacactytgaggtgcttttgacatcttagtgtctttttctcctctcttttggtcaaaagagatcatattttttcctttatgacacttcctattttgatatctcctcc

SEQ ID NO: 77947 - DNA, 201 bp, Bos taurus
atacataagagcagcagacatgacaacccacaaaagaaatacaattgcttaacgtgaaaagatgttctagtttgccagaaattgttttcttttaatggtgyctacttccagttaagacaagcaggagtggctataaatgaatgacagtgacatagcactgcctttaaaaatatatcttaaaaatagaaaaatacgttaaag

SEQ ID NO: 77948 - DNA, 201 bp, Bos taurus
tgtctaggatttcagtccattactttactctataagtacatgacacctggtagtccaaatacatcatgagctcctcagaggtaaaaccttgggatataccytctgtgtagtgtgtggtggtgagagatggtggtgagagatcaggctctgaagttagacacacttggcttaacaccccagtgcagtgacatgctgaactct

SEQ ID NO: 77949 - DNA, 201 bp, Bos taurus
cttaattgtgagtggcttggaggaagccacacatggggtgattttacaaaaggctattatgttggcatatgggtttcacgatctgtggccatcacagcaayggctatttttagcttcccagaaaaggttgggcaggagctatttttctttttttctttcccccttcaatgctggaattggccactgtgtggtataacctgg

SEQ ID NO: 77950 - DNA, 201 bp, Bos taurus
tagctctgacaacctctacagtctgtgtaactaaggatttgtacccaaaatggaaagtgtcgtcagtagataactgatccggccactttcccactaaattytataagagaaccagaactgtctgaacataagtgtgatgaaatgagaagatgtcaatggcaaatgacggagataatgatgatgtagttctattttgctggg

SEQ ID NO: 77951 - DNA, 201 bp, Bos taurus
atgtggagtggccgcaggacttgatcctgacgagactttgcaggagctttactgacaactgttaatcctggcgaaaagccagaactcatctgccttgagcrcctctcggcctccactccgattctccccagctgaagtctgtagagacagccaggcctgggcctcagaggctgaagccaaggtgaactctgtcccctgatc

SEQ ID NO: 77952 - DNA, 201 bp, Bos taurus
cattagctgcaagataagatacaaagtgaaatgttatgtccccttttatttgttttgcaactgtaaaatgtgcaacattttcatcatgatagaaaaggtaragaagggaaaactcccagcattttggcctaatgcaatggagcatgacctgtcaattgcgccatcttgcagaaaaacctactactaacactatccagggaa

SEQ ID NO: 77953 - DNA, 201 bp, Bos taurus
gaagcttgcaggcatttatgagtggtgtttttaatacggtgctggaatatttgccctataaattcttaagaacagacttatagattgcctattaccagcaytatggactattaataaatcagttacaggcacgtatttttttttttgaaattgcattttccctttatgttcacattctaagcacctaaaaatcagagagag

SEQ ID NO: 77954 - DNA, 201 bp, Bos taurus
tggtggcatgcatcgtctacttacattctatttctcacttcccacaatttcatgaaaagtttcagaattgattttggtaggccttaattggcaccacctgrgtcactgactcatcctgaaccaatcagagaggacaagagatatggacctctgattgactgggcctcagtcatgtggccatttctgaagccagaattcaca

SEQ ID NO: 77955 - DNA, 201 bp, Bos taurus
cagggagagatcctggaggcttactaccaagtgaaaaaatgatataattgatgtggggaaaaaaaacacacaacaaacaatcctaacatcaaaccacactrcagagtttctacatatatgtacacatggaaagtagggcttcccaggtggctcaacagtaaagaatctgcctgcatgcagaagacacgggttccatccctg

SEQ ID NO: 77956 - DNA, 201 bp, Bos taurus
ccagggctctgctttgaacagcatgccttcctccagctaacatgacctctcctctgagattcagcttagaatcctcctcccagaaaccccatctgagctgycctgtgtcagcgtgtgaacaagggatgcatgcttcctgacagttgtctgtctccatgactttgctctaaccccagcggggatgggtgcctggtctgccct

SEQ ID NO: 77957 - DNA, 201 bp, Bos taurus
tctaggctggaaccacaaagttcctatcaggctttaactggggcactgctttcctttcctcccatgttgtgggacatataatgtgactgatacagtcttaygagtctaccagcccaccgtctgtaccctagtttacaggtggggtaggtcctggtactcaaagtgcatggatgcatgggaaaagcatcactgtaaattcaa

SEQ ID NO: 77958 - DNA, 201 bp, Bos taurus
cagctacagtccatggggtcacaaagagtcagacacaactgagcagctaagcacagcacagggttgcctgtagttttccagtagagcatgggtttctgaarccatcgttagaagaggccccaagttgctatctgagcactgggttcagccatcacttctgctccagatctgttttttcttggccacgtcatggttcctagg

SEQ ID NO: 77959 - DNA, 201 bp, Bos taurus
ggatgttgcggagtgtttttaaagcaggagtattttgatggctgccaaggcaacaacagttcaaagaaatgtcagtttatctgccctaacttcccaacacratcaaagagctggtggcttcagtgggtgccagcatccactcccaccacccatcccactgcccctggccagaccgggaagcactgtattaacagtgaatga

SEQ ID NO: 77960 - DNA, 201 bp, Bos taurus
gcctgggacattggaacagacacagtccccgccctcccaaggctgacattctagtaggggacacagcaataacaagtaaacaaacagccaaatatataatygctagctgggccaagactctggggaagataaccaggctgctgcctgtctgtccatctggctggccgtccatctgccagtactccagcctgtccttacgct

SEQ ID NO: 77961 - DNA, 201 bp, Bos taurus
aacgccagacactcccctgccaccccgaaaaacagcaacatcttcactccctctttctccacaaggcggcagtggggaggcaggaagagcctcactctgargtcagtatggcccagtgctaatagctgcttttaccaccagataactggagtgagtcactttgcctctcagagcctctgctttcccctctgtacaatggga

SEQ ID NO: 77962 - DNA, 201 bp, Bos taurus
gctttcagaggcggcaggagtttatcggctgcctcagccctggggtgaccccggaaatccgctaaaagggaaacaagggagtgttgctttgtcagtagtgrtggataagagctccctccttgggtgaaggagttttgaggatgctgatggcaaggggtgccagggcagagaggaaactgaggctggagctgagggtaggaa

SEQ ID NO: 77963 - DNA, 201 bp, Bos taurus
tacccaagcaggaaggtaccttgtcctaacacagctctggactcccaccgttctccacctgccccttctccagtgggccagccttgcagttaacctgtagkagctaacttctgaagttagaacctagttactctactctcttaagctgaaaagatttccagttgctatagtgaatgaagctctgggggccgtgatccagcc

SEQ ID NO: 77964 - DNA, 201 bp, Bos taurus
ttccggtccccagcctcgcggagaccaggccacccgctgggcctcctctggccatgcgtctccatggccctgtgctctggcccacactccagcacctggcrcgctgggacgtaagggtcaaataacctgagacacctcagacacgcgtagtggagaacagccccgctcgcaggctggcctaggcccagccacgccagctct

SEQ ID NO: 77965 - DNA, 201 bp, Bos taurus
caaaagtaaccgagccgcagagaaccatgagacatcatctgagtgggccaatgtaggcattataggagtcccagatgggaggagagagaaaagggagtagraaggacacccgaagaaatgaaggccaaaaactctcccaaattggagggaaaacattcatctgcatagcaaagaagctcaacaaacaccatgaagaataaa

SEQ ID NO: 77966 - DNA, 201 bp, Bos taurus
aggtgggtgcaggcgtccagcatccgtgcgcctcctgccacttggagcccccagccggaaacctggacccctcgctgctcagcctgcagatcagaaagcaygggcagtgggcccacccttcagtgttctgagtcagaaatgttgatttgttatagtaacatgagcacaggggaaagacgagaggcaagtgagcaagcgaga

SEQ ID NO: 77967 - DNA, 201 bp, Bos taurus
attattctaaacaaataacaggcacttttaaattttacagatgtatttaacacctgaacagtttaacatttagaatttataccagagcataaatctacatkgtagctactgaagaccataaatgtttaccttctaagttactaaaaactaagtatataagtctaagttactaaaaacatttttcaaagagtattggtttac

SEQ ID NO: 77968 - DNA, 201 bp, Bos taurus
atgtatgtgttatttcagaaattttgcacatgccctgctttaaaccactgattatttttgtaaaatgctgttgtgtggatttggctcattccattgacgcygaactcatcagatggctatattgtcttctaggaatgtgacttgaattgattaaatggcataggcaacaacatctgttttgtgaagctagtttagtgtcat

SEQ ID NO: 77969 - DNA, 201 bp, Bos taurus
agggatgtatcatagtttggttaaccagtcctttacaaatgggcattttgtctgtctgtagttgttaactattacaggcaatgctgtaagtgttatctgtrtagtcttagaagtggcaaaagcctccttaggtcatcagtattgtcctccttgccctcttgtttcttgtaatcttaggggaaaaaaaagaattttatagct

SEQ ID NO: 77970 - DNA, 201 bp, Bos taurus
aaacattagatcagagagggatggagtcaggttacacagctgaatctcctctgagataccaaaatcactgtggtcgattcagctcagggaatgtgttagtwatagaagttcacccccaggttcccagaggagagaacttgtgctcagaattctgcgagagggtccttattacatacagggcagtcaggctgatgggctagt

SEQ ID NO: 77971 - DNA, 201 bp, Bos taurus
ccttcctttttggacttttatgaaggcttcactaaatagtcatgattgattaacttactggccattggtgattgattcaacctcaattgattggccagtgrgaatcactggagaaaggctggaggtcaggagggagggaatgactgggctgttctgtttctccagctcctcttgggtggcctctcttccatgtccttcgcc

SEQ ID NO: 77972 - DNA, 201 bp, Bos taurus
gatcatgcagaggagtgaggggcagagatttgccattcagaatttcaaagagagtccaagagccttgaagtacatgatgtggcttccactcaccgaccacrtgctgtctgtctctcattggcttaacacactatccatatcccctggaaggatgaaagggccacattgatgctgccagaaccccagacagtggttccaggg

SEQ ID NO: 77973 - DNA, 201 bp, Bos taurus
cacttaaggctacttttgaaagtaagcttatttttaaactggtttctcagtataacactaggctggaggcatgaatgcatgtactgtgtgtttgtataccrtatccctagttgttttgcacataataaaaggaagaagtcaggagggaagggaggaagggaccatctagtacagtggagagagttttaaaaggtgcagtca

SEQ ID NO: 77974 - DNA, 201 bp, Bos taurus
cccaaccttttttttgcaagtccactctgaaccccaagagacaggtgatcttgaaactgataataagaggcattcttccctgctgacgcaaaaggctaagraagttcaacacagattgaagtagagagacatgataaagttcagtttaaagaaaaagagggagatttagagggagggagagaaacagggagagagataaag

SEQ ID NO: 77975 - DNA, 201 bp, Bos taurus
ccaaggccccagagaaatgaatgaaactgttttggacaccccctgctctgcccctccagatcagagatcagaaccctttctctacaaaatgccagatatcmaacactgaaggctttgcaggccatccagcatctgttgttcctactctactcttacagcatgaaggcatcatagacagtatataaaagaatgggcatgata

SEQ ID NO: 77976 - DNA, 201 bp, Bos taurus; identical to SEQ ID NO: 38084

SEQ ID NO: 77977 - DNA, 201 bp, Bos taurus; identical to SEQ ID NO: 38085

SEQ ID NO: 77978 - DNA, 201 bp, Bos taurus; identical to SEQ ID NO: 38086

SEQ ID NO: 77979 - DNA, 201 bp, Bos taurus; identical to SEQ ID NO: 38087

SEQ ID NO: 77980 - DNA, 201 bp, Bos taurus; identical to SEQ ID NO: 38088

SEQ ID NO: 77981 - DNA, 201 bp, Bos taurus; identical to SEQ ID NO: 38089

SEQ ID NO: 77982 - DNA, 201 bp, Bos taurus; identical to SEQ ID NO: 38090

SEQ ID NO: 77983 - DNA, 201 bp, Bos taurus; identical to SEQ ID NO: 38091

SEQ ID NO: 77984 - DNA, 201 bp, Bos taurus
tcagtaagtgctaaccctggccttaacagaattaattttgcatttgatttcaatacttaaatgaatccagcttggaaaaagaaatacaggcaaaagaaaamgaaggctgatttctaaaaagaagggggtttgttttgttataacagtcacagattatctgccagctccaaaacgccacaaattcaccagaccctgatgctg

SEQ ID NO: 77985 - DNA, 201 bp, Bos taurus
aaaaatgataaagatgttatgagtaaccattaaattccttaaatgagcccacagtcatttgaacacaaatatcctcaatctttcttattttcttttaaatycctcatcttttaaaaaggcagtctgccatttctccactgcccaaccctaaaatgaccaactatttaatcacagtcatttaaagcaattataatagagagt

SEQ ID NO: 77986 - DNA, 201 bp, Bos taurus
cccttgtgcctctgctttgttgagcttttatgagctctgagtgaagctagtttgggaatttgtattttgaacagagacactgccgctttgtttagttcctyacagtgtggctgttgaccgggccgtgttctttatgctgaacactcatccaagttgttccggaaatcactgagccagttataacacccctgcagtttttgg

SEQ ID NO: 77987 - DNA, 201 bp, Bos taurus
agccagtaatatcttacagttggcttactggttttagatattccagtgtgcccttgcccgttaattttaacctcgttgtaacccagggaggtatccttgtyggacagatgatgaagtaaaaacctatagaagtttggcaacaggactgagatgatgccgctggtgagtgccagagcctggtttcggagcctaggggtcttt

SEQ ID NO: 77988 - DNA, 201 bp, Bos taurus; identical to SEQ ID NO: 38093

SEQ ID NO: 77989 - DNA, 201 bp, Bos taurus; identical to SEQ ID NO: 38094

SEQ ID NO: 77990 - DNA, 201 bp, Bos taurus
agtgggcagttgagaagaaaagtccagtgctctttgcttccagatgggaattgggggagatggggaagagggtctctccacctgtggccatagtggtgcartagatgagaggcgcttccattcccacaggcatggagccatgatcagctgtttcctgtctcctggccttgactaacgcttttccaaccacaaggaacaagc

SEQ ID NO: 77991 - DNA, 201 bp, Bos taurus
gcaagccagagcagggaaagtagcactgaggggacgagtctgtaagaagcaggttgtggggaggtgaggagcggagaagggtcacatcaccagcccaaagrgggcctctgtgctggagaggcttccacctcctttgctcctgagacccctcagccaagtgtctgaacaacagccctttgactgagttacattttgagggac

SEQ ID NO: 77992 - DNA, 201 bp, Bos taurus
cccatcaacactcatgcctatggggtggcagagtacaagccttaaacactgtcatgcagaaggcccacaagacaagcgcccagaagctgtggggaggcccrccagtcccaggctcccacctgaaacacctcctctccctgcctcatcttgaggaggttgacaatcgcctggtcgctgtaggccctgacgacggtgttttta

SEQ ID NO: 77993 - DNA, 201 bp, Bos taurus; identical to SEQ ID NO: 38095

SEQ ID NO: 77994 - DNA, 201 bp, Bos taurus
ggttgtagatgctgccattgtcaaacacctgctggatgaccagcccgaaggagaagggggagatgttcagcatgttcagcagcgtggcttcgctggcgccyactttgtctcctgtcttaatcagctgcacatcactctgaagaacaaggagttggcagttaacccctggatgtccggcaagtccaaggccaccgagtcccc

SEQ ID NO: 77995 - DNA, 201 bp, Bos taurus
aaccaggtccttcctgtcacacaagcacatgggctcaccgctggggccagcgggcccgggacactgaaatctcaggtcccacgctcctgtggaaaagcccytcaaaaagggccctgggctccaccccggctgagcccgggaaataatttgccccaacggaggctctacacctgactgggtgtcccagagatcggcctcatt

SEQ ID NO: 77996 - DNA, 201 bp, Bos taurus; identical to SEQ ID NO: 38097

SEQ ID NO: 77997 - DNA, 201 bp, Bos taurus; identical to SEQ ID NO: 38098

SEQ ID NO: 77998 - DNA, 201 bp, Bos taurus
agaagatgggagaggattacgaggtacaaactactatgtgtgaagtaaataagctccaaggctacacagtgcaacccggggaatacagtcaatgtacagtrattacaagtgggatgtaaccttcagaactgtgaatcactatgttgtacacctacaacttacataaatttgtatatcaactatacgaaaataaaatacata

SEQ ID NO: 77999 - DNA, 201 bp, Bos taurus
ccagccctaggccccctcagctcaaagtgagttcctcagtcagcagtgccagcatcgcctgggtgtcacttacacttgccaaatccaggcctggcccagcyggtcctctgcaatcagaatctgatctgagtatcaccaggatccccgagggacttgtacacatgccccagtttgggaggcaccaggcctggtcgtcggaag

SEQ ID NO: 78000 - DNA, 201 bp, Bos taurus
gagcgctgaatatgaaatagaaaaagtgaaacaaactagataaaagtaaaagatccttatatagtccagtttttaaacatggctgctcattggaaacataytgagctctggcagaaagaaaaaaaatagcaatgtctggccttttgtatttttcaaaaaattccaagataattctgatatgcatctggattttaaaaagtg

SEQ ID NO: 78001 - DNA, 201 bp, Bos taurus
aggcctgcggaactctcaaaagcagcaggagaccttcaagaaccttgctacccaaggtccaggaaccagcagcctcagcaccatctgggagcacttagaaytgtaccatcttaggccccattccagacttactgaatcagcatctgtcttttgataagattcccaggttaaaatatgagtatagcagaatgcacggcagac

SEQ ID NO: 78002 - DNA, 201 bp, Bos taurus
tttgagtaacttctatcttatttctattgaagagcattgaaggaggaggatccaattttcagtccacagcaaggcttcatctctctggctagggccccctrtatgttaataacctttgtcccagtctcgtgggatttgtaatctctgccttacttccctcttgtaggcctgttatgaggttttagtgaagtcctagagtta

SEQ ID NO: 78003 - DNA, 201 bp, Bos taurus; identical to SEQ ID NO: 38105

SEQ ID NO: 78004 - DNA, 201 bp, Bos taurus
gttgtagtcaaaagttcacggggccacaaatccaaggatctgtgctctaaacacagctgcctgtcccaaagatggacatatgtgacctttgtagtgcaccrctgggacttggccctgggctcagcaggtcctaggcgtgaggcgggtcgccccagcctctggagctgtgatatagggtgacgatgcccagaggcgaggctg

SEQ ID NO: 78005 - DNA, 201 bp, Bos taurus; identical to SEQ ID NO: 38106

SEQ ID NO: 78006 - DNA, 201 bp, Bos taurus; identical to SEQ ID NO: 38108

SEQ ID NO: 78007 - DNA, 201 bp, Bos taurus; identical to SEQ ID NO: 38109

SEQ ID NO: 78008 - DNA, 201 bp, Bos taurus; identical to SEQ ID NO: 38110

SEQ ID NO: 78009 - DNA, 201 bp, Bos taurus; identical to SEQ ID NO: 38112

SEQ ID NO: 78010 - DNA, 201 bp, Bos taurus
tatggatcacagcacctgccctgagaatttcctccctgcccccatggctgatgtggggatcacaggagatgacagatactcttcacaagctgcaaagcatygcacccagaacctgcccccatcctctgccctgtggcatccaggaggcagcacttctacatttcttgcttattcttccagacgtttaatttctgaacactt

SEQ ID NO: 78011 - DNA, 201 bp, Bos taurus
tgacctggagaagtgacaaagtagaggatactaggaaggcctgaccagagccttttcagcagagggatggggagacccctggctggagcaaagagacaagrcggaaataagggctggtgtttggagtagacaccagacttctctgatgagaagagaaagaaagttaactatggggaaagcggaacccacgagaggattgtt

SEQ ID NO: 78012 - DNA, 201 bp, Bos taurus
tcctagccttgtgaagtcctagctccctcatatatatcagtcaggatcaacaaggtgctgtcgctgtaacaaacagtcctaaaatctcagtgatttattayaacaaaaattacttaccatgcatgctgtgtgtccaccatgcatcagcaggggtctttactttttctacattcacgggcctggcagatggagtcaccacca

SEQ ID NO: 78013 - DNA, 201 bp, Bos taurus
gatgtatcgggtcacttacattgagccactggtgaacgtttaacgttagctgggtcttggggggaaaagccccaatttgtatgtagcgtttccctattccygtggtgtaaatactcccaccagggcacactgcagggtaccaaatagctgtccttatacacagagctgggaagagatgtgcagtacatcatcattacacac

SEQ ID NO: 78014 - DNA, 201 bp, Bos taurus
tctgcaccagagattcccactcagagcctccttctttccctggggagccccgtacaagccccatcactcttagttaactcagaccttgccaggatccatgygtggctgatgttagaacttggcgatgtttcagggcaagaaaggaaaaggaatgggaggtgtgtcccccacgggaggcctgtggcccttttgctctcataa

SEQ ID NO: 78015 - DNA, 201 bp, Bos taurus; identical to SEQ ID NO: 38121

SEQ ID NO: 78016 - DNA, 201 bp, Bos taurus
aaagctaatacaattctttctcctgatttttgcaaaatattttggtgggacattgggatagtttgcctttcctggatgtcacatacactcgggaggtaatkagtatccagacagtttgcagtggttcaaatgtagaaacaagggtaaacacattccacagttatctagtaagcaggtgttgggtcacagttttttattctt

SEQ ID NO: 78017 - DNA, 201 bp, Bos taurus; identical to SEQ ID NO: 38122

SEQ ID NO: 78018 - DNA, 201 bp, Bos taurus; identical to SEQ ID NO: 38123

SEQ ID NO: 78019 - DNA, 201 bp, Bos taurus
ttttgcacctgcacctatatgacagaattttaagaagcaactcgcttgtattcattccttccaaagcactcagcctagttttcctggaaactcttggcccrgtcgcatcgtacgggtgtgtgtaatagctaatagaatagtaattgcataaaagcgtgtgaggcataaacaggctgtgagcacacactgtgtggcagtacg

SEQ ID NO: 78020 - DNA, 201 bp, Bos taurus; identical to SEQ ID NO: 38125

SEQ ID NO: 78021 - DNA, 201 bp, Bos taurus; identical to SEQ ID NO: 38126

SEQ ID NO: 78022 - DNA, 201 bp, Bos taurus; identical to SEQ ID NO: 38127

SEQ ID NO: 78023 - DNA, 201 bp, Bos taurus; identical to SEQ ID NO: 38128

SEQ ID NO: 78024 - DNA, 201 bp, Bos taurus
agaagggcaagaatgtcttcagtcagtctgcaaagtcgagcacatagtcaagcacctactatgtgccaggcactattttaggccctggggaccctgagcarcagaaaaattttccctcctccctggagctgaccttcagatgaaatgccttctcctgtctccctggaggtgggacctcaggcccaagctgatcaaaaccct

SEQ ID NO: 78025 - DNA, 201 bp, Bos taurus
agtccagtcccagctgccactctgtggccttgtctgtgaaagacggttagaccaggtgctctggtggctttgctttgcgaggtgagcgcactcttaactcrggactggctgacggggcccccagacccaccaggcagcgggacctcccgagagctgagtattacccaggggtaggtggtaactgaacagtcagctgctgcc

SEQ ID NO: 78026 - DNA, 201 bp, Bos taurus
atgtcaggttcctccgggtgcttagcagcctgagtggcctctcaggctcactgcctcctccactggaaggcacaggactgggcattccccacgtcccctcracattagtggtcagcaaggcccccaactcccagcaccagctgcatggattatttgttgactcaaggggagaacagacaaagaagtgaaggtatccgagtg

SEQ ID NO: 78027 - DNA, 201 bp, Bos taurus
gcctatctctgccctctgtagcacacagagccctggggtgccgggtgtacaggctgatcacaccccttgcgggctttttggctggagagatgaggcaaacrggccctgtgggtcttgtccagaggtcggccctgtgccctgagcgtagtccacaggggttgaagttggcacaaccactatgttcaagggacaattattcct

SEQ ID NO: 78028 - DNA, 201 bp, Bos taurus; identical to SEQ ID NO: 38129

SEQ ID NO: 78029 - DNA, 201 bp, Bos taurus
tgtagggcctcacgcacgagtcctaagcaagccttgttacctctctgcttgggtaatgatttccccaggtctcacagtgcttattatcgaagtcacaacaracaatcatgggcctcctaattaaaaaccagtcttcgtttggtccctgcgcttgggactgcagcttggcattaccttatccaagatggaaagctagttggc

SEQ ID NO: 78030 - DNA, 201 bp, Bos taurus
gggtgtgtgagaaccaggatcatccactgcagatggcctgggccaaccacacttacccctcaggtgtgtggacttgggaagctgctggaggcacagggcgyattggctggagcacccaggaaaatcacagggtcccagctgggtgaccatcatggccttttgcatgtggaagctgtgtgggtgtgaagttggggcatcatt

SEQ ID NO: 78031 - DNA, 201 bp, Bos taurus
ctggccatccccacaacagggcatctggatgctgcttgctcccactttacagatgcagaaactgaggcccagagaggagaatgggctttctctgtggcccyggagggacctgcaagccggatctctggactccaactccaggtccctcctctttgccaaacgtgatctatttgacagcaaaagagcaccgagggtgggcct

SEQ ID NO: 78032 - DNA, 201 bp, Bos taurus
tttgcttctctatccagcagcaaatactgcaacaataccttagggcatgggtgtgggagttttcagtctcccagatgagcacccagccctctgggccccasctggagcagcaggcacaggtctgcacaagttgttaagcctcctcctccccctcaacccacccccactcccaccgggcaggatgctcagcctggggcccag

SEQ ID NO: 78033 - DNA, 201 bp, Bos taurus
gtgggttgccatttccttctgcaggggatcttcctgacccagcgatcacactcacacctcttatgtctcctgcattggccagcagattctttttaccactkcgtcacctggggaacctcagttttcagttcagttgagttcagttgctcagtcgtgcctgactctttgggaccccatcaactgcagcacgcctggcctccc

SEQ ID NO: 78034 - DNA, 201 bp, Bos taurus
gaaccaggattagacttcccagttttacagatgggaaaactgaggctcagaatagcaagccttctttgacctaattccaaagttggccagactctacagcycgtgatcctcctgagtggtctcccggtgtcatttcttccacaagagaacttccaacggccatactcccagatgcctcctgaaccgaaagacccacactgc

SEQ ID NO: 78035 - DNA, 201 bp, Bos taurus
tcccttctagcatcctctgctgtatttttatgattatctgacatggtatgtattgtaacctttttgtttctccttagtgtcccttactagaatgtaagctmcatgaggccagggatcttggcctgattaggtctgtgctgcgtccccagagcctagaatggtgcctggaatataggctctgtaaatgtgtattgagtggga

SEQ ID NO: 78036 - DNA, 201 bp, Bos taurus
cagagaatcctctggtcctggagaggactggagagagagagacttgtccattcagtccaaagcgctgaacgtccaatcctgaccacagctcctaactacayggtgcgagggtgccagtgaaggacaagatagctcgtctctctctctctttccaattcctgctccaccaacaaaaacgtgtttcctcaatgtttctccaga

SEQ ID NO: 78037 - DNA, 201 bp, Bos taurus; identical to SEQ ID NO: 38140

SEQ ID NO: 78038 - DNA, 201 bp, Bos taurus
gcgtcaacagctcaggtggcctcgtggttagagggccggcccccacccctctgaatggagacttactgctgcagaaggggatgtgaccacacgtgtcatcrtcgctcagtgactcagggtcgcctgtatgactctccagtggactgctcttgtcttcagggcagggctgggggctcgaccttttgacatttacccactctg

SEQ ID NO: 78039 - DNA, 201 bp, Bos taurus
tggctgcgccgtggagagaacgaggcctgacagcaaggatttcgaaagaaccctggattaaaacaaacacaaatgaaactcaccttaaagtcctcaaaacyccctggccttatttattgatttatttttaacgtacctgaatggcaaaggccaatataatggtagaacccgttttagtaaaaggtataagaaaatagctgt

SEQ ID NO: 78040 - DNA, 201 bp, Bos taurus; identical to SEQ ID NO: 38144

SEQ ID NO: 78041 - DNA, 201 bp, Bos taurus; identical to SEQ ID NO: 38146

SEQ ID NO: 78042 - DNA, 201 bp, Bos taurus
tctcggggtgaggagggctgacggagtgtccagggtggccagctgggccagttgccacaagttcctcttccaaggcaaaccttggggccactgttccctcyggagcttcccaacaaagcttctgcgtgaaccttccagcacccccgcctcccgacaggccccaactgctgatgtccgttccctccacaaccccaggggatt

SEQ ID NO: 78043 - DNA, 201 bp, Bos taurus
cttagcgaccccatggatcgcagcacgccaggctgcacacggcgatactcttgcctaaaaaccggtccacatgctatgccaaaagtcggccctctactttygtactcttggcgactgtgagattggctgagtgaatgctaacactctattggctgagtatttgccacaggctacctcatggggagctagccagcctgtggg

SEQ ID NO: 78044 - DNA, 201 bp, Bos taurus
ttggacatgactgagcaactgaattgaattttttctctttatgcctaagtttcagtgttttattgtatgttgtcatattggtagagttggaaaaatcttaytgttttagggataaaactctattcaggtgatcattcacatcatggtgaagtgtctattctggtattttagaatctagaaagatactaactctttgatttg

SEQ ID NO: 78045 - DNA, 201 bp, Bos taurus
atgagttgtggccttaatcatttgtttaaaatagttttacacatcttttaaattgcaacttgattcttactttgagttttcttaaattgttaaatctgttkgaaaatcaaggccttgttcctagacttcagttcagttcagtcgctcagttgtgtccgactctttgctaccccatgaaccacagcatgccaggcttccctg

SEQ ID NO: 78046 - DNA, 201 bp, Bos taurus
agcagcgcaagctgaaaggatttaggagtcttatcagtgatcagcccagctcaaatagggaaagccgccagctgctgctgtgcggccagcagctgtgttaratcagcagccctgtcatttgcggagtttgctgactttgagcgtaaggggaaaggactctcatctcaaagcaagggtcgttcagtgcaattcttcctgttg

SEQ ID NO: 78047 - DNA, 201 bp, Bos taurus
ttgctaggcatccggcctgctccagggcaaggaacgtctctcgcctgacctgcccaactggaggaagaagggggacgtgtcgggctctcagtgctcacagrattcctggccacctctagccagggtggtccccagtgtgaactagcgaagatccagccactgtggggggtgggggggggagtgtgaccggggacagcttct

SEQ ID NO: 78048 - DNA, 201 bp, Bos taurus
cacaaaacacctgctcaaagggaaaacagttgcaacagaatagttagaagttgaaaggaaactggctatttaaaacaattatttagatcttttttgccttyctgaagccagcttattctagataccaccatgcttagaaaccagcaagaaagcccagcaactaggcaggtgctggtagtgcattattttggatgcgatgaa

SEQ ID NO: 78049 - DNA, 201 bp, Bos taurus
ttcagctcctattttcttcttacttctcacatccttttggttaccatttctgttttgtatctgaaatacttcagaccataatttggtcatggatcagaaaygatgaaaagagacatacttgaaatttaaaaattcttaaatgataagaactcttaaaaccaaactctacttgagaaataggacacagaacccaagtaaaga

SEQ ID NO: 78050 - DNA, 201 bp, Bos taurus; identical to SEQ ID NO: 38150

SEQ ID NO: 78051 - DNA, 201 bp, Bos taurus; identical to SEQ ID NO: 38151

SEQ ID NO: 78052 - DNA, 201 bp, Bos taurus; identical to SEQ ID NO: 38152

SEQ ID NO: 78053 - DNA, 201 bp, Bos taurus
gaaaggcctggtgaggggctgtgtccagggctgtgggcgcagagggcaaggaatggggtggtcccatggcaggaggagcactgggggtggggggtggagcrtctggggaactggcctgacccagctgcctcacttcccatccttcccttggcttaggcacttaactccagccacccacctgtctccactgcaggccccctg

SEQ ID NO: 78054 - DNA, 201 bp, Bos taurus; identical to SEQ ID NO: 38153

SEQ ID NO: 78055 - DNA, 201 bp, Bos taurus
gaaagactttggatatgtagccccacgtgaccctgctgttgagccccagtttttagggagagagagaaaggagggatggcaaagattggacaggctgaaayggcgtcacccgttctgtacaagttttagctgcttgcctggtttgcacacatacgtgaccgtgatgggtttgagggggaggccgaaagaacaaagccagag

SEQ ID NO: 78056 - DNA, 201 bp, Bos taurus; identical to SEQ ID NO: 38155

SEQ ID NO: 78057 - DNA, 201 bp, Bos taurus
gagcaaggcttcggtgtttccagtgctagtgctgttcactggggcctcacgtgtcttgaacccacgctgtgtgctgagcggggcctctgggaggcacctgygccatctcccgcctgtcttgttcatctgagtacctttccctgccccgttcagacctgcaggaggtaccttgtcacctctgctccctcccaggcccacctc

SEQ ID NO: 78058 - DNA, 201 bp, Bos taurus
atacaagtgggagatcgtggtttatctactgtaacccaatgcacagcacccaggtagctggtttgcattcacatcttcccaagaacaatgtcaaggtctcrccatccactgctgcagccctagctcctggaacaagtgcctggcaaatagctcgttgcatcagattgtctttcatccctgggtcattcttattctcatatc

SEQ ID NO: 78059 - DNA, 201 bp, Bos taurus; identical to SEQ ID NO: 38160

SEQ ID NO: 78060 - DNA, 201 bp, Bos taurus
tccgcagcccgcgcacagcatcatccgccttctacccgcaggtcagtccaaccccagagccctgcagcccatgcatgcctgtctgtcagctgaagccttgmcctggccttcagcttggttctgaaaacacctggaattgggctgaagccgagtttgaggggcagttgaaattgaatttgatcttggagatgcagtaccttc

SEQ ID NO: 78061 - DNA, 201 bp, Bos taurus; identical to SEQ ID NO: 38162

SEQ ID NO: 78062 - DNA, 201 bp, Bos taurus; identical to SEQ ID NO: 38164

SEQ ID NO: 78063 - DNA, 201 bp, Bos taurus
gcggtggagagctcacggtgctggagaaggtggaagacgtggaggacagaggtggtccagtgtggggtgagggagcccccgtggccgcagggaaccctgcrtcacgttcaagaagaggtccctgagtggtagctttagcaccgagcctgcaggtcagaagcgtgcggtgtgtcccctaaaggctgatacacagcagtctat

SEQ ID NO: 78064 - DNA, 201 bp, Bos taurus
tagaacggccttgatgagcacaggtgcctcgaatcctcacaaccaggctgcctcttaaccaagggggaaactgaggctcagagctcttgccagcattgccygtggccactcgctcaggaagtggccgtgcgcaggggcctgggccgccctgactgggggtcgccgcctgtggccagggtggtggtggcggcggggcccttg

SEQ ID NO: 78065 - DNA, 201 bp, Bos taurus
cagccagccagtgccaaagccccggccgcagagtcaggaggagccgtggacagaggaccatagtctggaagcctgggggaaggggagtcctgcggtgaccyggaggctcaggccgctcaagggaaagaaaaaaaaaaacaaaaatgccttccattcaccgccgaagcctgtctgccgaggtctccaggctgggaggaggca

SEQ ID NO: 78066 - DNA, 201 bp, Bos taurus; identical to SEQ ID NO: 38169

SEQ ID NO: 78067 - DNA, 201 bp, Bos taurus; identical to SEQ ID NO: 38170

SEQ ID NO: 78068 - DNA, 201 bp, Bos taurus; identical to SEQ ID NO: 38171

SEQ ID NO: 78069 - DNA, 201 bp, Bos taurus
aaacctttctctctgtagctctggatctactggacaaaatgttgacgttcaaccctcacaagaggatcgaggtggagcaggctctggcccatccttacctrgagcagtactacgacccgagcgatgaggtaagagtccggcaggggctgcctgcctgggcggagggggagcgcgcacggatccgtcagctcccccaggagc

SEQ ID NO: 78070 - DNA, 201 bp, Bos taurus; identical to SEQ ID NO: 38175

SEQ ID NO: 78071 - DNA, 201 bp, Bos taurus; identical to SEQ ID NO: 38176

SEQ ID NO: 78072 - DNA, 201 bp, Bos taurus; identical to SEQ ID NO: 38177

SEQ ID NO: 78073 - DNA, 201 bp, Bos taurus
gtggggttacagatgaaggggccttccatgacggcccaggggttaagactccgccttccaaggcagggggtgtgggttcgaaccctggtcagggagctacratcccacttgcctcggccaaaggacggaagcacaaaacagaagcagtgttatgataaatccagcgaagactttaaaagctagatgaggagcccgcagcct

SEQ ID NO: 78074 - DNA, 201 bp, Bos taurus
gcactaggatccactcgcgggcactactggctgggaggaggggctgcctttcaagagctgaacctgcaaatccaaacatcagtgagcatgggcctctgagycacctgttctctctctgccagtgaagaacccaggcaggggtctgaggtgagaccaccatgacaccccgcacaggggcaggagcgcagtcagagtggccag

SEQ ID NO: 78075 - DNA, 201 bp, Bos taurus; identical to SEQ ID NO: 38178

SEQ ID NO: 78076 - DNA, 201 bp, Bos taurus
ggggaggcggggacacgcagtgtttaaggcaggagcacactctgtccccctctgcctggcaaagtaataaagtatccgtttctacttcacccagacagacraatagggtcatttcaagcacacaggaagacactgcagagatgagtgaaggaggctcacatccaagagcgtcctgcagtggggtcctccgggccctcacgg

SEQ ID NO: 78077 - DNA, 201 bp, Bos taurus; identical to SEQ ID NO: 38179

SEQ ID NO: 78078 - DNA, 201 bp, Bos taurus
cgagggcctcaacatctcttttgggggagacacagaagcccagggtgactatcggggtttgcacactgagagcactgcctgctgggaagctcaccaaaagrggggggcgtgggtggccaacctggcagcagggcagagcccagggacgggcaggggggctgggcaagaaggcacgtgggtcagaggccagtgtcccaggaa

SEQ ID NO: 78079 - DNA, 201 bp, Bos taurus; identical to SEQ ID NO: 38180

SEQ ID NO: 78080 - DNA, 201 bp, Bos taurus; identical to SEQ ID NO: 38181

SEQ ID NO: 78081 - DNA, 201 bp, Bos taurus
gggggtgcatcgccccggagcccacccaccgtcccactgcgcagacacttggtgttctgacagcgacaacccagacctgggctttaaagtgacatctcttygaagggattgtggcttaaaaagaaagtacatgtgctcatcacgtgggcacatccattgtcagcaagggtgcccgcgccccaggctgggaggccatggggc

SEQ ID NO: 78082 - DNA, 201 bp, Bos taurus
gcgctagaagatcacagctttctctaatgatcattaaagtggcaaaaaaaaaaaaaatcccccaaaaggaaagccaagtcaagcaggaggccccaggcgtrtcttaagttgctagtgagaccacagagatggacggggatcccctggtgacttaggaacacgggggccactggagtgggtgcagccctcaaatcatcctgg

SEQ ID NO: 78083 - DNA, 201 bp, Bos taurus
aattccaagtccatggggttgcaaagagttggacacgactgagcaactctcactagaccccactagaccaggtgtgtggcccagcgatgctgtgtgcaggrtgagtgtggaaatggtcacacgcgcgcacattagcacatacacacgggaagaagggcacgttggccgtggtggggctctgggtggaggggtgcatgaacc

SEQ ID NO: 78084 - DNA, 201 bp, Bos taurus
cagctcgggcagcgggcagggccaccccccagccaccgcactgcgggacagcagccagcagacgcatggagcacctcttgccacaggggatgcagactgayggccagtgggcaggaagacggggtggcggggtcctgtgtgagtgatgaccccggcgtgcacccgtactttgccaagaaaggtctggaagcacacagccaa

SEQ ID NO: 78085 - DNA, 201 bp, Bos taurus
aataaagtggccgcattcaaaattaaactggaattatgggggcaccaagtcaacactgagattttgacatgtttcaaacatcagcagagattgaaagagayagagccggggccttctttctccaagctggtgcatgatcacctatttcagctttcaaaagtgtttgagcattacttcccaaccacgaaagacctccaaact

SEQ ID NO: 78086 - DNA, 201 bp, Bos taurus
aagggcccccctgttgtaacccttcggcatgtttggaatatgtgcacttctatttagtgcatcagatcagagagccagcagtataactgcagatttatggyagccaggccttggatatcgcctactatttaaaatgacttgttaccaaaacgttcagagaaaaccatagattaagcgtattgactatgtttcttctttaag

SEQ ID NO: 78087 - DNA, 201 bp, Bos taurus
gcagagcccaaagctcacagggccctccagagcagccctctgaggctgcctctgtcccatctcctgctccccgtccttgaccagaggccccctgccagcarcacagagacactcacagccttgactgctccagcctgcagagacagagcaaactgatggccgtgtgcatcgctctaatgacacttgtaagagagtcatgat

SEQ ID NO: 78088 - DNA, 201 bp, Bos taurus; identical to SEQ ID NO: 38183

SEQ ID NO: 78089 - DNA, 201 bp, Bos taurus; identical to SEQ ID NO: 38185

SEQ ID NO: 78090 - DNA, 201 bp, Bos taurus
acctgcggggctctggctatgggccagacgtggatgggcacaacttcatcatgaggtgagtcccagggaccccaaggctggatacgggacaagcctccagraggaggcactggcctccttggccttgcccagctgtaggaggaattgccagctgctggggggtcctggaggaccctgattcccagaatcttccatgacaag

SEQ ID NO: 78091 - DNA, 201 bp, Bos taurus; identical to SEQ ID NO: 38187

SEQ ID NO: 78092 - DNA, 201 bp, Bos taurus
ccgagacgctggccgtgcagagcgaacaccaggcacccttcttgtaggggacgatggtcttcccgttgacctcccagttccctctgcgaaagcaagcagcrgagggctgcaaggacctggccttggccgtggcagggacaggccctgctgcctgcccgcagcccctgtcagttccttcctgccccgccagggagtcaggga

SEQ ID NO: 78093 - DNA, 201 bp, Bos taurus; identical to SEQ ID NO: 38189

SEQ ID NO: 78094 - DNA, 201 bp, Bos taurus
aaccagcaaaacaccagacgtcattataaagttctcaaaaacagccgggatctacgattcgagttatggaacctcggccctgcctttccctggccttgccktctggccctgcctttcacagagagagagagagagaggggaagagcgcgctagccaggacgcacacgtgctccttgtctcctctgctctgtttcggcagaa

SEQ ID NO: 78095 - DNA, 201 bp, Bos taurus; identical to SEQ ID NO: 38190

SEQ ID NO: 78096 - DNA, 201 bp, Bos taurus; identical to SEQ ID NO: 38191

SEQ ID NO: 78097 - DNA, 201 bp, Bos taurus; identical to SEQ ID NO: 38192

SEQ ID NO: 78098 - DNA, 201 bp, Bos taurus
cgccagcccgccgcaaggggaggcccgcacatcacaacaagcgagacccgcatgcactgcaatgaaggctgcgtgaagtcaaaataaatttctttaaaaaygtatgtcaattgttcatttttaatcctactaaaccctggtccatctactgcattattttggtaaaggttttacagtatgctttgagtagactggcaacaa

SEQ ID NO: 78099 - DNA, 201 bp, Bos taurus; identical to SEQ ID NO: 38194

SEQ ID NO: 78100 - DNA, 201 bp, Bos taurus; identical to SEQ ID NO: 38195

SEQ ID NO: 78101 - DNA, 201 bp, Bos taurus
catcctgcagtgacacagatgccttaatagggttaagctgttgtgtttgtgtctctgtcttgttttgggatgtgtacaagtgagtcagatcttttcctccktaggcccagggagagcatttcgggcctgtatgggctgaattgttcccctgctcccattcatatatggatgccctcaccaccaatgagactgtgttcggag

SEQ ID NO: 78102 - DNA, 201 bp, Bos taurus; identical to SEQ ID NO: 38197

SEQ ID NO: 78103 - DNA, 201 bp, Bos taurus
gagacacagcatggccggccagaggagttgtaagagatgagaacgacttgactgaacactgaattgaggaggagaggattgtgggtgtagggcttgagagraagggcactgtgcagactgtgatatttttgtttctttttaaaattgtatctatttacttatttttaactgtgctggctctttgttgctgtgcacggattt

SEQ ID NO: 78104 - DNA, 201 bp, Bos taurus
gtgtccttatccatgactccacacaaacccacatccactctgcagcaccaaaatgtttccttcacaggtagctctgctggccttcaatgttgcaagatttytttaaataactttattaagccccaaaggggctttccaaagggaaaacaggagcacaggttaaacaatgcgcggcgcgggctgcatcgcttagagtaagaa

SEQ ID NO: 78105 - DNA, 201 bp, Bos taurus; identical to SEQ ID NO: 38200

SEQ ID NO: 78106 - DNA, 201 bp, Bos taurus
ctcacactgttttgagtcacctttcagctgaaatttcaccccaacaggtctaccttggtggccccctctaaacaccgaatactacctcatctcgcacaccrctcccttgcccagtttgatttatttcttcacagcctttattcctgcttgtcatggtgtacttttgcatttctcatcctctccacattctactgtgcacgt

SEQ ID NO: 78107 - DNA, 201 bp, Bos taurus; identical to SEQ ID NO: 38201

SEQ ID NO: 78108 - DNA, 201 bp, Bos taurus
caattaagtccacaggctgcagctgctgaagcccacgtgtctagagctcgtgttccacaacaagagaagccagcacaataagaaggcctcgaaccccaacyagagaaagcttgccacaactagagaaagcccatactcagcaacgaagaccccgtgcagccaagaataaataaatacaccttcctctgttagaagggccaa

SEQ ID NO: 78109 - DNA, 201 bp, Bos taurus
tcctggccagtctgggtcaattgttgcagacactgtggtttggcttctcggagtggctgctgcagaggtcgtgggtcagagttcactgttatagacggtcyggccattgtctgtttgtgtattcaacatctcactacctatttcatgattgttcttcccagaattaaatgagctaaagtcattgcttataaagggcgagac

SEQ ID NO: 78110 - DNA, 201 bp, Bos taurus
ccggtccccggagtgagtgcttccgaggctgagaaatcacttttgcactctccagcctttagctagacctcactaggctgatgtggccagagggaggggtrtgctggggtccctgccaaacggagggcagggcaggcgaagtgcaggatgtggaagccctctggctgatgggggaggcaggccttgaaggatgctgcggga

SEQ ID NO: 78111 - DNA, 201 bp, Bos taurus; identical to SEQ ID NO: 38207

SEQ ID NO: 78112 - DNA, 201 bp, Bos taurus
aagaggagcgagccacctgcagttggcgtggccagcccacaaaggcctcagtgaccccgcccctgctcgctgcttggcaacactgcctccatctccaggtrtcccccagttgagagtggccaggcagcaggaaggagagaaatggtagattaggccaacctcctgccttcccgggagccctctagaaagccccgcacaagg

SEQ ID NO: 78113 - DNA, 201 bp, Bos taurus
gtgtttcccgtgaacagctgaacagcgtcgccctgctttctctcaccccccgggcatccccacatgtggctctcattcatcccctccttccctcaggccayacagacgtatggagtagcacctacacactacagacgccgtgggtgccctcctgactgtaaaaccacaccacccaggggccatgggacatcactcggcggc

SEQ ID NO: 78114 - DNA, 201 bp, Bos taurus; identical to SEQ ID NO: 38210

SEQ ID NO: 78115 - DNA, 201 bp, Bos taurus
taggagaatctggggtgcactcaccctggtcaactctcagcagacctgcgtgctctgccctgatggggtcccgggagatgtgcatgctcccaccctaatgyaggtcttagcatttcatctcacagctctcaagaccacatctcagagatgattatgggtggggctggggtggggcgaggcaggggcgggcttccaacagca

SEQ ID NO: 78116 - DNA, 201 bp, Bos taurus
cccatagtaaatttttgctattgggcccccggctcttgtttctgacaggctggagtgtgactggtccagaacattccacagggccacatgaatgcagggtyggaatgtcagcgtgctgttatctgatttgcgtcttttcagttcgtttcctgttggcccgaagaatgttctcaaaattacgtggactctcagatggtgttc

SEQ ID NO: 78117 - DNA, 201 bp, Bos taurus
agttagaattttattctcatcatcgttggaaaagacgcaaaggtcttaaaacgtacagcaaagtgcttggcactgatgctatgaggatccctggcccctgygctggggctgaagcttgcgaggacggtagcccaggcaaaacgtgctgactaatgaatgacttgctttggagagggactgtcgagaagatgctggaattct

SEQ ID NO: 78118 - DNA, 201 bp, Bos taurus
catcctgtgtcctttcctgcccctccccaatctagtctccctacttcatgcagctggtgtaatccttttaaaatataactgggttcatattacttccttaytttaagcccttcatttgttctaatacatgggaaacagtccagacatcttccaaagcctcccagatcctgtgtgacgtggcccccgtcctcccctcgttct

SEQ ID NO: 78119 - DNA, 201 bp, Bos taurus
ggtgccccccacattctccaacccaggacagggcacccatctatggcgaatgagcacccagtggattcttcacttcaaacaaacacaaatggatgaggctytccaggccaaaaccggtgcacggtgctttatttatttaattggatttaatcttcattctgcttagtgaatactagaaggaaacaattaagcaaaagggag

SEQ ID NO: 78120 - DNA, 201 bp, Bos taurus
aggcccaggagctggggtctgcagctgggggtgccgccagctcacaacagccttcagggagggggccaggagagcgaggaccccgatcatggcctcctccrtcttcctcctctcttgctggtgctccccatgggctaaaccctactgagacaaacagtaaaggattttgtcgtaaatcccactctccagggcagggggcca

SEQ ID NO: 78121 - DNA, 201 bp, Bos taurus
atcatcccaccagccgaacttcctgcaaggatgggaaggttctacgtcaatgctgccgacaatggtagcctctgaccacgcatgcctatgggctagaagcrtggccagtctaactgagggatctgtactctcaagtttcaattttatttaatagcaaataattttaatttaaaaagcccacatgaggcaagcagctggtgt

SEQ ID NO: 78122 - DNA, 201 bp, Bos taurus; identical to SEQ ID NO: 38214

SEQ ID NO: 78123 - DNA, 201 bp, Bos taurus; identical to SEQ ID NO: 38215

SEQ ID NO: 78124 - DNA, 201 bp, Bos taurus; identical to SEQ ID NO: 38216

SEQ ID NO: 78125 - DNA, 201 bp, Bos taurus; identical to SEQ ID NO: 38217

SEQ ID NO: 78126 - DNA, 201 bp, Bos taurus; identical to SEQ ID NO: 38218

SEQ ID NO: 78127 - DNA, 201 bp, Bos taurus
ctgattagtgaaaagtacagcgtgaaaactgagtcagagaagtgcctagaaaaacagaattgccctatgatccagaaatcctacttctgggcatctacccrtaaagaaaaacagggattcagagagatgtgtgtccatctgtgttcatagcagcattgttcccaatagtcaaaaggtggaaagaacccaaacgtccattat

SEQ ID NO: 78128 - DNA, 201 bp, Bos taurus
aaggcctcggcgtgaggcgccgggagcagggaggaggcgccggccagcctctgccacgggctgaacgtgcattccctccaggaagcccctctcggggaccygttcctgcctgtgactgctgggcctccttcacccagtccccttgctgtcacttgccccctggccagtccgcctagccccatgcctggtggtgcttcctgt

SEQ ID NO: 78129 - DNA, 201 bp, Bos taurus
gattcctcagcttaggaaagctcattcattttgtacccatgaattcccagaagagttaacccattttatggcatatctggccatcttttggcctacccccrtcatttcaactagtccaagaaggcaaaaccagagaagggtggggattgagagaggagagatgggagaagcatttaccactggccaccccgtaattgggat

SEQ ID NO: 78130 - DNA, 201 bp, Bos taurus
agcggtgtctccgtttccctttcctctcgggtcttgcttgtgtcaatcagaagaaaagtggcatcagtttctagtgaacctggccagcacctttcagcccygtccacgtgaagggctgcaggtagcaacgcgacttgggcggtggcaggatgtctgtggagctggagtcatccctcgggaggggcggagctcactgccccg

SEQ ID NO: 78131 - DNA, 201 bp, Bos taurus
ggcagtgctaactctgttgtgtgtttcttttttaaacactggaagtgttggtctggccggtacaaatgtaaaagcaggcctgcctacagagaacttatacygatccttctccaactcctcctaaagactgaagaggaaggaacactcccaaagacattctatgaagccactatggccctgataccaaaaccaaagactcca

SEQ ID NO: 78132 - DNA, 201 bp, Bos taurus; identical to SEQ ID NO: 38225

SEQ ID NO: 78133 - DNA, 201 bp, Bos taurus
tcatttctaatgcattcctatcatctttcaaatgtattttaaagagactgacctcatcagagaggtttctggtcagccacagtttgtcttgtggttagggrcccttcaatccgatttttgtttctagtgtttctgtgtatccagtaccaaacagttagaattgatgtaaataatgattcaaagaccatgaatcatcaaaga

SEQ ID NO: 78134 - DNA, 201 bp, Bos taurus; identical to SEQ ID NO: 38226

SEQ ID NO: 78135 - DNA, 201 bp, Bos taurus
ggcccaccttaaatcatggtctcatctatcagtcctcagctaatctgcagagatcctatttctaaacaagatcacattcacaagtgttgaggggttaggayttggccatatcttctgcaggaacactatttatgccactacagtgagtaatggagaaggaaatggcaacccagttcagtattcttgcctggagaatccccg

SEQ ID NO: 78136 - DNA, 201 bp, Bos taurus; identical to SEQ ID NO: 38229

SEQ ID NO: 78137 - DNA, 201 bp, Bos taurus
cccatgcaggaatacctaaactcaccccgataaagcttttgcgagaatcaaagtcagtagtacatgcaggcagttttgcacagtgcctgacacaattaatrttagttgctagttcagtgatagtgtcatgctgcaaaagctggcccaccctttcgaaaaaggaaccaagtgatgggcccgaggaagtggtggtgctgagtt

SEQ ID NO: 78138 - DNA, 201 bp, Bos taurus
tttctataaaaggaaaaaagccctgccagggactcctatcaaactgcagttgaaaaacaaagttaggtctgcccggccaggaggttgcaaacttgtatttrcagcaatatttgggaagactatttggttccaggtgtttccaaagttgttcacggcccagacggtgctggtccttgctgctcttttcacgcacatgctgcc

SEQ ID NO: 78139 - DNA, 201 bp, Bos taurus; identical to SEQ ID NO: 38231

SEQ ID NO: 78140 - DNA, 201 bp, Bos taurus
tcactgacaagaactgtccgcttgatgtgatgtcaaagaattgttttcaccttcttcacttcacaaggaaaatatacactagctttcatttcaataataartactgtcgctacgagaaagtgaaaatcagaaacaaagagtgatgggcaccagtgttttcatttggttgatttctgctctctcctagggaactcctttgtg

SEQ ID NO: 78141 - DNA, 201 bp, Bos taurus; identical to SEQ ID NO: 38232

SEQ ID NO: 78142 - DNA, 201 bp, Bos taurus; identical to SEQ ID NO: 38233

SEQ ID NO: 78143 - DNA, 201 bp, Bos taurus; identical to SEQ ID NO: 38234

SEQ ID NO: 78144 - DNA, 201 bp, Bos taurus; identical to SEQ ID NO: 38235

SEQ ID NO: 78145 - DNA, 201 bp, Bos taurus; identical to SEQ ID NO: 38237

SEQ ID NO: 78146 - DNA, 201 bp, Bos taurus; identical to SEQ ID NO: 38238

SEQ ID NO: 78147 - DNA, 201 bp, Bos taurus; identical to SEQ ID NO: 38239

SEQ ID NO: 78148 - DNA, 201 bp, Bos taurus; identical to SEQ ID NO: 38241

SEQ ID NO: 78149 - DNA, 201 bp, Bos taurus; identical to SEQ ID NO: 38242

SEQ ID NO: 78150 - DNA, 201 bp, Bos taurus
ttcccagatgtggctgcagctgcccccaccacaggcagctgattgagaagcaggaaggaaacccatctggcaaatggggtgtggtgcttggagcatagcargaggccatggccagcagccccagcagaccaagtcagcaggcgtgattcccagctggagaggagcaggtgactggcgaggggctccaaggccagcaggatt

SEQ ID NO: 78151 - DNA, 201 bp, Bos taurus
accataaagggtttgcacgttgcctccaggctctgtagctgtcgtttccaaaggctgaagaatggtcctctctgagcactggccacgctggctggaagtcrcctagtttttgctctgaacatgagcgcttggtgggtgcctccttgtctgtcatggccagggtttgtctgttgcttcaggtttccgcttaggattgggatt

SEQ ID NO: 78152 - DNA, 201 bp, Bos taurus; identical to SEQ ID NO: 38244

SEQ ID NO: 78153 - DNA, 201 bp, Bos taurus
cggccctggattaacacgggtcccaaccgctggacacggagtagccacatgaccccacagctccaccccgggggtgtacgaggccccaaagaaccgacacrgtgaagcagggtcctgtgcccacgtgttcacacttgagccagaaggcggaacacacaagtgtgcgtagtgggtgagtggactcctgagtgcggcccgtct

SEQ ID NO: 78154 - DNA, 201 bp, Bos taurus
ggaaggaatcactgccttggtgatctggtggggaagcttatgggggttggaagggcaggatttcctcctagaccctgtaaccatgggccatatcctttgckccttagagagcatgcacttgcgccctctgtatttttaagggagctattttcctgtctttctggaggaggaaagtggttggcggtggctgtcagacccttg

SEQ ID NO: 78155 - DNA, 201 bp, Bos taurus
aacgtgctcccagcatcttagctgacctcacgtggctccccaggagaatcatctgggtgctcaggaaagttcagcttcccggcccgctcagtgactcaggrtagggaggggtctggtttatcgcccatctccaccccatctccccggctccagctgcatctcacgattgggcaagtttgggaaacagcccaagctttgagg

SEQ ID NO: 78156 - DNA, 201 bp, Bos taurus
ggtgaggggccagtggggctagttaattcaagatgggatcaaggacctggtccttttatttctttactctgccatcctcagcttgctggcttcgttcttaktctggattccctcatggccccaggatggctgccacagctctagacatcacaaccagacatgataaagatgaaaaagtccaacagaagaggccatgtgtgt

SEQ ID NO: 78157 - DNA, 201 bp, Bos taurus; identical to SEQ ID NO: 38245

SEQ ID NO: 78158 - DNA, 201 bp, Bos taurus; identical to SEQ ID NO: 38246

SEQ ID NO: 78159 - DNA, 201 bp, Bos taurus
atcaaggcattggggaagttcggttcctctgctaaaacagcttaggtcgagtgccttttagcaggctgatgagaacctcatcagctgacgatcaggcctcycggactggtctctcgaccttgaacgtgtggttcctgtgccctcactgtggactggactctgcaggccccttcctattttggagtctgttgtgtcagtctc

SEQ ID NO: 78160 - DNA, 201 bp, Bos taurus
cacacagtcaccgaggctgcccagccacgcctcagcaggacgacgcagggcgagggccaggctccgagcccgaggggacaaggcctgggcagccccactgmccgtgtgggtcagcggcagagaggctggcgaacaggtgactcctgctgctggcgtccacgctggcccccgacgcggctcagggctctcgcccgatggttc

SEQ ID NO: 78161 - DNA, 201 bp, Bos taurus
tagaaaaataggaatctgtaatggtagagcatggggccttcagggaggagtgtgggagcagagcttgtatttgtgggttcggatccggtgccttgaacttyagggttagccctggcgaggaggcctatgtgcctcccgtcacagcctgtgagcagcgctggctctcaggttcatgcaggtctggtccaagtactaggctgt

SEQ ID NO: 78162 - DNA, 201 bp, Bos taurus; identical to SEQ ID NO: 38247

SEQ ID NO: 78163 - DNA, 201 bp, Bos taurus; identical to SEQ ID NO: 38248

SEQ ID NO: 78164 - DNA, 201 bp, Bos taurus; identical to SEQ ID NO: 38249

SEQ ID NO: 78165 - DNA, 201 bp, Bos taurus; identical to SEQ ID NO: 38250

SEQ ID NO: 78166 - DNA, 201 bp, Bos taurus
catcatccccgccctcccacttacctttggaccaattggggcgccttctggctcagcgcttgcctctgaccccgccacaccacgaatcttcagtgaatggrtcctccccaaggccggctcctgtcccattgagtgtctgctccagaatcttcattcgctcctgtatgacctatgacatctaaacttggcgtggcccatgag

SEQ ID NO: 78167 - DNA, 201 bp, Bos taurus
ttgaccctttgacttccccttttgccaccagctggagaaaattctctgccttttaagggcgcgtgtgatttgattaggctcacccagatcatctccctttygattcactcaaggccaacagatgagtaaccttaattacacctgccgaactccttctgccccataaaataacaaagtcagggtgtggtgtctcatcccttc

SEQ ID NO: 78168 - DNA, 201 bp, Bos taurus
cctcaaggagctaggtccttcctgtcaccttgtcttgcccaccatgacgttggctttgtcctcatgctggttacaagatggcggccgtggttccaggcatyacggaagaagagagaccatctctcccatggtgctctcctggaagtcaggagattctcccagaaggcccctggctgtcactgtcttccagttcattggcca

SEQ ID NO: 78169 - DNA, 201 bp, Bos taurus
gagcacatggacagcatgcttttcagaccagatgccacaggtagagccgggaaatggctcatacacagaggcagcaaggtcaccatcatctaattccctgmgcacagcgataggcgtttacaccggctgtagatacctggagcacccggtaagaccggccagtgtgaccctgggcagctcgcgatttctccaagaaggagc

SEQ ID NO: 78170 - DNA, 201 bp, Bos taurus; identical to SEQ ID NO: 38252

SEQ ID NO: 78171 - DNA, 201 bp, Bos taurus; identical to SEQ ID NO: 38253

SEQ ID NO: 78172 - DNA, 201 bp, Bos taurus; identical to SEQ ID NO: 38254

SEQ ID NO: 78173 - DNA, 201 bp, Bos taurus; identical to SEQ ID NO: 38255

SEQ ID NO: 78174 - DNA, 201 bp, Bos taurus
tgctgccccacatgcagccatagagtgggtctcccctcttccagggccacgtggggtttcccaccagtgtctgccttctgttttccagcgcagagtcctcractcaatcgtgcacccagtggcccagggccttattgaagggctgggggcgggggcagtctgcatttctagcctgttcctgggggactctactgctgctgg

SEQ ID NO: 78175 - DNA, 201 bp, Bos taurus; identical to SEQ ID NO: 38257

SEQ ID NO: 78176 - DNA, 201 bp, Bos taurus; identical to SEQ ID NO: 38258

SEQ ID NO: 78177 - DNA, 201 bp, Bos taurus
ttgcttgctctaggccaggctttgggctacgcaccaagcctgtcaccaacaaagcctcgcttggcaagtgaagaaatgggagctcagaaagatgaaatcaytggcctcatccagctggttggacacaaacactgaccccagaactggtggaatagagcaggcctcagcctgtgacaggtgagtagatggggagatgggtgc

SEQ ID NO: 78178 - DNA, 201 bp, Bos taurus; identical to SEQ ID NO: 38259

SEQ ID NO: 78179 - DNA, 201 bp, Bos taurus; identical to SEQ ID NO: 38262

SEQ ID NO: 78180 - DNA, 201 bp, Bos taurus; identical to SEQ ID NO: 38263

SEQ ID NO: 78181 - DNA, 201 bp, Bos taurus; identical to SEQ ID NO: 38264

SEQ ID NO: 78182 - DNA, 201 bp, Bos taurus
gtgctttatgtctggcaagactgccaccagctcctgcagctcctcatggcgggcccccagctgcacagcatggcacggggagtggtcacgtgacagggccrgggacagggtgacaagcacatgtcatcctaaggagaccatgcctagaaagcaggtctcactaggatagctgtgtcccggcccacttacctttaaaaatac

SEQ ID NO: 78183 - DNA, 201 bp, Bos taurus
ctccccaggcctatgtggtgagaactctctggaggactcggcctttggacactgaagttacctagcttgtctgtgggaggtttgaagcttctgcccagacrgcagtgccctcggcctgtgtggaggcacagttgtggacactcaagcacagcctcctgtcctgggactcagccccaccctagagcatctgctgtggatagc

SEQ ID NO: 78184 - DNA, 201 bp, Bos taurus
ctgttgcttccagacattttatcatgggccttttaaatagattgcagaagcacatgtggctgagacccccgtcagcccttgaggagctgtgtggtgccccyacacaacccgggccccagcacctactccgtactcagcctgctcagcttcaggcagggcgggccaggtctctccccagcaggcggcttcagcagccccctg

SEQ ID NO: 78185 - DNA, 201 bp, Bos taurus
ggggtgttggggaaagccgtgtactacagcagcattgcagtccccgtagttagggctggacagtgacacgtaaccatcgtgacacaggacacatggcctcrtgggctccaggtgaaagaccaacaccacccatccacttcggggacgttgacagattcccctatcaccccaggactgctgtgtgctggagagcaagaggtc

SEQ ID NO: 78186 - DNA, 201 bp, Bos taurus
tgccccagggtttgggcaggttgccccaggacttgagttgtgacaggccttagttgcctgccctctgctcctccagcaaacaccggaagctgtataaggaygtgtccggtcacacctggcgtggccctgtgacctcctggcactgcaagacaggctcagcccagggctggtgctgtgatgcaggttgtcatgcacctccag

SEQ ID NO: 78187 - DNA, 201 bp, Bos taurus
tggcctcattaaaggatgagctccaaagattagaaactataaggtctgcagccattgaagttgggatcctaagtgaaactgtgaaacttagcagaaccctrgggccctcctggacactagaccttttttcccgtcccccctttttgttttcaggaaaaaagctttcagtctcctagattttacctaaatccccaagggcag

SEQ ID NO: 78188 - DNA, 201 bp, Bos taurus; identical to SEQ ID NO: 38266

SEQ ID NO: 78189 - DNA, 201 bp, Bos taurus; identical to SEQ ID NO: 38267

SEQ ID NO: 78190 - DNA, 201 bp, Bos taurus
agttacctacactgataaaccaaggccttcatttacaagcatcaacagaaaattaaggattaccagctatttgaggaaaataaagagagcaagagagaagraacaagataaaacatgaggaacagggagtttcctggtggcctagtggttaggattctgggctttcactgctgaggcccaggttaaatccctggtcaaggc

SEQ ID NO: 78191 - DNA, 201 bp, Bos taurus
tgttgctgtcactggcaggaccagacaaccaactattggccatggctcaagagtcagaaaaaatgtgagagagaattgactgttgagtagagcatatagtrctaagataactgtgtggagtttggccaggagtgccaaccctcagatcctgcccttgatcaggaaacatcctgcttaaggaattaatagcaacagctttcc

SEQ ID NO: 78192 - DNA, 201 bp, Bos taurus
ggtactgtaggaaaatgacagagctgagttctcaatcctggctgcacattagaatcaaaaagggagcttttaaaaatgccagcggccaggccacaccccaraatctctggagaaggggctcaggcatcgatattctgtgtaactgaggatgagaagcactgcccttggatgatgcttctaaaacttcagcttgttaaaaac

SEQ ID NO: 78193 - DNA, 201 bp, Bos taurus
ccaggagttggtgatggacagggaggcctggtgtgctgcagtccgtggggttgcaaagagttggacatgcctgagcaactgaactgaacacagaagccacrtttttggcctcatgttcttcaccgtgagtgtgctttccagttcactgcatccctctcagcccttccttttccacttgacctgcttcacgcattcattcat

SEQ ID NO: 78194 - DNA, 201 bp, Bos taurus
aagaaacaaaaagagaatggtttgttatttcaaaaagtaaaaacataaaagaagccagagtatgttgaaaaagaagagaatgttttggctttttgacttgygtaattacttcaaaatatttcaaatgattacttggattcatcttttctatatgagcttgagaaaaacatgcaaaagtactactactctctcttgctcccc

SEQ ID NO: 78195 - DNA, 201 bp, Bos taurus; identical to SEQ ID NO: 38276

SEQ ID NO: 78196 - DNA, 201 bp, Bos taurus; identical to SEQ ID NO: 38277

SEQ ID NO: 78197 - DNA, 201 bp, Bos taurus
ctactggctattgccagcagggctgcgaacgtggaccccggcttcctctgcaggacctcaggcttgtcaaactccaccacctgggaggcagagagagaagrggagggaagcagggtgcagctgagctcagtcctgagggatccgaaggcctgggcgccatcctcccagcggcctgggggtgtcccctcaccttcccgttgc

SEQ ID NO: 78198 - DNA, 201 bp, Bos taurus
ccccctgctgaggcatccttttgggtgcagaggggctccttcctgctccttgttgaaccctgtggcagacacacatgagtgctgtgctcacatggccaggyctgggtgcagactcttctgagggtgcacaggccatgccggtggctgtgtggtgcgcatgcccacagacagccgccccaggccttaagtgggcagctgggg

SEQ ID NO: 78199 - DNA, 201 bp, Bos taurus
ctgaagaagctgagagaactagacttcatttctcctgttcctctcccttcccttccctggggagttgggtaaagctttctgggggcgagttctcagagctyctggagccccttgctggccctggccatctgctcgactgctgaatccctccagcccagcgcctgatcatctctgttccagaaactgggaagctccttccca

SEQ ID NO: 78200 - DNA, 201 bp, Bos taurus
tgaaaatcctttgaattgcccataagttacagtgcatattgttttgtggcaatcaaaattccaaacatcatgctttgccaaaatcaaattttggcccctcrtatccctgtcccttctccctgttagaccattaatcaacggcattttgcccatccaaaaatgacactaatacctttggccccgtgctggagtaccttataa

SEQ ID NO: 78201 - DNA, 201 bp, Bos taurus; identical to SEQ ID NO: 38285

SEQ ID NO: 78202 - DNA, 201 bp, Bos taurus; identical to SEQ ID NO: 38286

SEQ ID NO: 78203 - DNA, 201 bp, Bos taurus
cgcttcagcttcgcagcgggttggggtctgcgggttgtaggtgccagttgcgttccctgcggggtgctgctgagtggccgggctcacagacagggcttgcrtttgtctaacgcgtaaacgggggaaccaaattcatttcacagctgagggtgctcaccttggaaaaggccaaggagtttgggaaaagtgaagccccttcag

SEQ ID NO: 78204 - DNA, 201 bp, Bos taurus; identical to SEQ ID NO: 38287

SEQ ID NO: 78205 - DNA, 201 bp, Bos taurus
caggttttgttttgtttttttccctttagttgccccataatattgttcctaggtggggctacctttttaaactagaggataaatagaggcctaaatcagtktggttattcccactcattctaattaagaatctttgtttccactcaacaagatatgggaaaaaatagggcctcttcatgatatttctattgtccattaaat

SEQ ID NO: 78206 - DNA, 201 bp, Bos taurus
ctgtctccccaaaaagccactggtggggtctgctgccctctggcccagtctctccctctgctgaacccccaagtcctgtccatgtcgccacactgtggttyattcttagactgtcttgcttcctggccctgttgcccgttgacttattcctatctttccattcccatggaaaatcctgccttctccctttttgcctctgtc

SEQ ID NO: 78207 - DNA, 201 bp, Bos taurus
tggccattagatttctgctcacagagcagcacccacaggagtctgggtcaccagtcagggcagtccccacaccctgggcctggagcagatgagtgcagatmacccagccccccagccccagccaggctccagcactggttggaggaggaggggccattccagacgatgtgactcagagaagacaagggctggagggggtgc

SEQ ID NO: 78208 - DNA, 201 bp, Bos taurus; identical to SEQ ID NO: 38288

SEQ ID NO: 78209 - DNA, 201 bp, Bos taurus
ctggccgcccaggtgtcagtggccactgcccttctccctacaactctgtcactccttccacaggggcacaaccccacaagagatgacctttctaaaacctscctccaggcctcctacttgtcactccactggggctcctcaaatcccatccccaggagcccaaggactttcccaccctctgcacacctactcttccccctg

SEQ ID NO: 78210 - DNA, 201 bp, Bos taurus
ggggcctacagagcgtttcagtaaaacacaggagcctcaagcttgcaggacactgagaggacagacccactgcaatcaggatccctaatccccgagggccrgcaggcacgtaaatggatgacgtgagcagaggggctgtgatgaatataccccacctgttggagcagcctccacccccacaccaccgggactgtcaccaag

SEQ ID NO: 78211 - DNA, 201 bp, Bos taurus
tcctgtggattttaaaatctcctgtggatttcatgagatgaaatcatatcaagaagttgtttattaagatatattataaagtataccctttggcctgatcktactccatgagtcacactgaagagtcgagtcgcattttgccatttaactttattccggagatgtttctcaaaagtaaatttgtcttcagtggaaggccaa

SEQ ID NO: 78212 - DNA, 201 bp, Bos taurus; identical to SEQ ID NO: 38293

SEQ ID NO: 78213 - DNA, 201 bp, Bos taurus
cagcctttgtgttccccaggacatctcattcaggcccttcacggagagagaggggctcaaggaatggtgagggggagggagagagggcaggagaagaaagraagccctaatccgtggcccagaagaaatgaacatctctgacttccccgtatccctgatctaagtaggtcacacggaagaactcggagttcctgtcaaagt

SEQ ID NO: 78214 - DNA, 201 bp, Bos taurus
ctcagccagtcttggtaaagccattatcccctttgccagtgattggttcaggataagtcacatgaccctattctggccaataagacttgaagggaaatctkttgaggggctgtaagatgtctgggtggtagccatcttgccaccagcttgaggatcacagagcagacatgggggagaacccgggccctagaggaggaagtc

SEQ ID NO: 78215 - DNA, 201 bp, Bos taurus; identical to SEQ ID NO: 38297

SEQ ID NO: 78216 - DNA, 201 bp, Bos taurus
agtctcttgcattgtaggcagattctttaccatctgaaccaccagggggaatacgttgctttaacaggtaactcagaggagaggtctgtgcaagctctggwaaaggatatacctggattggctagagggactgaaagaggctcatgggaagtagaatctcatccttttccaaatctttcatttgatgatggtgacctatgg

SEQ ID NO: 78217 - DNA, 201 bp, Bos taurus; identical to SEQ ID NO: 38304

SEQ ID NO: 78218 - DNA, 201 bp, Bos taurus; identical to SEQ ID NO: 38306

SEQ ID NO: 78219 - DNA, 201 bp, Bos taurus; identical to SEQ ID NO: 38307

SEQ ID NO: 78220 - DNA, 201 bp, Bos taurus
gggaggcacacctgcaaaacagctcaggaagtttgcctccaatgcaatctagacatttcagagaggagctgaagcagaggataggagagaaggccaatccrgggaaggtcccacagggtcctgcttgattacagtccttgggttgcagtccaaaggaaccagcccctgtctgggggttcctgagaagccagagggccagct

SEQ ID NO: 78221 - DNA, 201 bp, Bos taurus
tgaggatgccatgtcttctatgtgtttgagagaacatctctgggcagaaaatgagcacaaaatggggggggaaaatgggaaatggtaaatagacttcatcyattctacaattctgcttgcctttagattaaaattgaaatgagagtaagaactaaggactgtcatgttttgaatagtaagagtgtcaaacttcagaattaa

SEQ ID NO: 78222 - DNA, 201 bp, Bos taurus
tggggccaaaaagagtaggacatgactgaagcgacttagcacacaaaatgccgtttcattccctcactttcctaattagtaactgcttggatctgctcttyggaattcgagggagacctaggagactaaagtctttttctgaacacaagaaatggggaacgcagaaagagctctgtattccagagagccccacagggtcca

SEQ ID NO: 78223 - DNA, 201 bp, Bos taurus
gcccagtcccttgcatcttctgatgctcgcaatatatttaaaagattcggctctgccaaatcggggtgtactgaaagcttctggatgaaaggcaagatccytgagtccggccaggaaaatcccagaatggatctcaggccagcagccaaggcctggctgcctctccgtgcccccaagagaaagttcagcaagttcaggttc

SEQ ID NO: 78224 - DNA, 201 bp, Bos taurus
ggttgtgcctgattaggacggcaaggtcagaaaccgcatcgccagtgttggaaacccattttccgatggcggcaaagaaaagatgtccactctgccctcarcttgcaggccaacataaggatacgtctgaagcacgcaaattatctttggcacttcccctttcttgacagcctcgagctggaggcacccaacttactgccc

SEQ ID NO: 78225 - DNA, 201 bp, Bos taurus
aacctgactcacatgtttaggaattactgatcaaaactaaccaaatgtttgttctttgtaatatcccttatataccattttagaatgtttaataaactgayatgacttcattatttctaagaaccaatgttctatgtaagtacccatagaatatgtgtgtgtatgcacatatatataaactatatattttatataaaatat

SEQ ID NO: 78226 - DNA, 201 bp, Bos taurus
taacagctccttcaactaagggcaccccctggggatcaagaggaaaagcaagaattctggaacctcttttttcctcctctgtgcatttactcccaagatgrtctcaccctgtctttttttttaaattagatttttgctatttaaaaaaaaatttattgaaatatagttgattcacaatgttgtgttagtttcaggtataca

SEQ ID NO: 78227 - DNA, 201 bp, Bos taurus
actccttgaatgttctctgttcaacctgtgctctctgcctagagaattctttcttcagatccttcttcaggcctcaaatgtcaactccctagaggccttcyctaacctcctcctcttccatcactgttacagcatccaattgtattgtctttgcaggattcacgactccctgaaatcctcctttgttttcttaattgttgt

SEQ ID NO: 78228 - DNA, 201 bp, Bos taurus
gtgagagataaactttggaggggtaaaatcttgaattggagggacttttcagaagagagattagcaaagggagttatcaggcagagttggaagctactctrtggccctctatggaactatgattactcaggcaatcggtgcacaagtactctagcgaacaactgccttgatgaaatgctaagcctttcctagccaatgtga

SEQ ID NO: 78229 - DNA, 201 bp, Bos taurus; identical to SEQ ID NO: 38309

SEQ ID NO: 78230 - DNA, 201 bp, Bos taurus
aaatctaaatacagaaataacaaagtcaagaacggcagaccaaatttggctggcagtttttttttcttcccttttcctaatacagtttgaatgcgtgctcygttatttcctgtgtcttttattcacctgctttgctcattaaactgcctggcttctgatggcatttcagttcagattgtaggttctgttgatgagtgattt

SEQ ID NO: 78231 - DNA, 201 bp, Bos taurus
acaggctgttcctgtaatgtcaacaaatttcatgtgaaatctaaaaagaactcttttttttttccccttgtaataaataatgttgttaaacctgtattttyagagaagttgaactacacttgtattcattttcctttcaaagcagttaagtttacccccgttaaccactgtcttttaataccacagataaggtttagcagc

SEQ ID NO: 78232 - DNA, 201 bp, Bos taurus; identical to SEQ ID NO: 38313

SEQ ID NO: 78233 - DNA, 201 bp, Bos taurus
tgaaaggcaatgctgtaactcgataggcctgtaatctgcacgctgagattaattggaaagaattagggaagggactacagggagccgccatcatccttccmggggaaattcgtagatggggcctcgtacgtctttgccacctccaccccgagagtcccattgataaatgcgcagtgcaggtgtctgattaatttagacctg

SEQ ID NO: 78234 - DNA, 201 bp, Bos taurus
agttcctttaccagggattgaacctgggccttctgcattggaagtgtggagtcttaaccactggaccaccagggaagtccctatgtgtcgcattttaaatraaggaggccttttaaataaagacggccagatggaggggctcatgttaggcaggcttgtcggccgcacaccctggctcctgtgcgtgtgtgtgtttgagtg

SEQ ID NO: 78235 - DNA, 201 bp, Bos taurus; identical to SEQ ID NO: 38315

SEQ ID NO: 78236 - DNA, 201 bp, Bos taurus; identical to SEQ ID NO: 38316

SEQ ID NO: 78237 - DNA, 201 bp, Bos taurus; identical to SEQ ID NO: 38317

SEQ ID NO: 78238 - DNA, 201 bp, Bos taurus; identical to SEQ ID NO: 38318

SEQ ID NO: 78239 - DNA, 201 bp, Bos taurus; identical to SEQ ID NO: 38319

SEQ ID NO: 78240 - DNA, 201 bp, Bos taurus; identical to SEQ ID NO: 38320

SEQ ID NO: 78241 - DNA, 201 bp, Bos taurus; identical to SEQ ID NO: 38321

SEQ ID NO: 78242 - DNA, 201 bp, Bos taurus
tcatgcacaattcaccacgttctctttttccttcccataatgatgttccagatggtggagcctctatcatcctgggtcccaggctgaggacaacatggagyggagacccctgctgaccctcgatggatacgcaccgtgagcaagaaataaacctttgttgttttaagccactgagatttggggtcatttgttataacagca

SEQ ID NO: 78243 - DNA, 201 bp, Bos taurus; identical to SEQ ID NO: 38322

SEQ ID NO: 78244 - DNA, 201 bp, Bos taurus
gaagtggccagaccccagatgatgctcaagaatcccaaacagctgagaatcctgagaagggcgggtttgtacccggccagctcagtaagaagcaaggtccrgatctcgtgacctgatgcagcttgggcactgcgaagctgccaggaagaggtggtgtgaaacctggtgggagggacccgaaacagctcccagtcctgtcta

SEQ ID NO: 78245 - DNA, 201 bp, Bos taurus; identical to SEQ ID NO: 38324

SEQ ID NO: 78246 - DNA, 201 bp, Bos taurus; identical to SEQ ID NO: 38325

SEQ ID NO: 78247 - DNA, 201 bp, Bos taurus; identical to SEQ ID NO: 38326

SEQ ID NO: 78248 - DNA, 201 bp, Bos taurus
ccacacacacacacatgttcatccactcatacacactcatatacacacgcataaatgcatgcagtctcatacccacacatatatcatgctctggccagtcygggtttcccatctcaaacctatgccacctacatttgaaccatgtctctaacatgctccccaaagacctccctggaaggcaccccaggacacccccactcc

SEQ ID NO: 78249 - DNA, 201 bp, Bos taurus; identical to SEQ ID NO: 38328

SEQ ID NO: 78250 - DNA, 201 bp, Bos taurus; identical to SEQ ID NO: 38329

SEQ ID NO: 78251 - DNA, 201 bp, Bos taurus; identical to SEQ ID NO: 38330

SEQ ID NO: 78252 - DNA, 201 bp, Bos taurus
ggaagaactgctagtgcggatcttgaccagaaggtagcaaatacatctggcctggctgagccgagagaccttaagttctcatgcaggtgagcatacggccrtggtgcccaccactggggagggctccccaggaaccctcccatacagtctgaccctgtgtggcacccatgccattttacagaaagggccaagcagagcact

SEQ ID NO: 78253 - DNA, 201 bp, Bos taurus
agatcctgccaagtgtccccaactttgctgaagacctgaggactttgcggttggcaggcacatggttcctaacaagctgtctttgggttgtggccatcccrgaagcagcagccagtgcattctaatatgtcacggctggtataagtgttggaagtagagtgatgcctttaagaagttactgggtggaagccactaccattt

SEQ ID NO: 78254 - DNA, 201 bp, Bos taurus; identical to SEQ ID NO: 38331

SEQ ID NO: 78255 - DNA, 201 bp, Bos taurus; identical to SEQ ID NO: 38332

SEQ ID NO: 78256 - DNA, 201 bp, Bos taurus
gagtttaggacaggaggaggtttctctccatttcagaagctgttttggtgtcctgtcccctttaataagatacacatgtcctagtcctggccatggcaggragggctggtaaattttaaatccacaaatctccaggagatttgcagtgaaatgaaggatggagaaggccctgcccctcagaaatgagggcagagcttagaa

SEQ ID NO: 78257 - DNA, 201 bp, Bos taurus
ccctgactgaggatcgaacctggggccccctgcactcgagtgcagaggcttagccactgcaccaccagggaagttccctttgtacttttcatacagtagtrtgattgcctgggccatggtcttgcctctgagaggtgagcaccttgagggaagggactctcagcttggaatcaccaccatccatcccagagcctgactctt

SEQ ID NO: 78258 - DNA, 201 bp, Bos taurus; identical to SEQ ID NO: 38336

SEQ ID NO: 78259 - DNA, 201 bp, Bos taurus
agcagctgtgactggagccccacagcagtgctgagagacaccaaggcccttccatctccggagatgtctttcttcaaggctcctaggacacagggcagggrttggaccccgtccaggaagtcaggccactgcctcgtcaccccaggatcttccctcctagcccagtgcccactgcaaacaccacctggctcctaccagtga

SEQ ID NO: 78260 - DNA, 201 bp, Bos taurus; identical to SEQ ID NO: 38337

SEQ ID NO: 78261 - DNA, 201 bp, Bos taurus
aaggagggctgggcgggccccttactacctctaccgaacagtgaggcgctgtcattaccggtgtgcaagtaccccttcctgtgtcgtctctccccaggccytcagcatcctcatgctccctcacaacatcccacccagcctgaacctgctgaccagcatggtggatgacatgtggcattacgctggggaccagtccactga

SEQ ID NO: 78262 - DNA, 201 bp, Bos taurus
cggccgagctgacccggaatgcctgcaggacccgctctagggatcttcgtctcatctgtatctacttctctagcacccgctttttccaggtcagcccctgytggtgggccatgaagggtgggtgctggccccttcctgggggctttgcaggcatccatgtctcctcctggccttctgcaacctcagccagttagcgcccct

SEQ ID NO: 78263 - DNA, 201 bp, Bos taurus
cttacagatggaaaaatgtcagatgagttcacagcttgaggccccccggtctgcccctgtctgctgtacccggggtgatgaagtgcatgcacaccagtctrcagctctcgtgctcagagtgggcctctgagtgggcttctgctcttctcaatcccaaattgctttctggggccaagcggaggggcatgattcagttctggt

SEQ ID NO: 78264 - DNA, 201 bp, Bos taurus; identical to SEQ ID NO: 38339

SEQ ID NO: 78265 - DNA, 201 bp, Bos taurus
gcagctgagccctctgcatggggtaggcaccggcctctgaaatcacccacatgtccttttgacaaggttctgggctaggaagcagaaagttgaggctctckgctacaacacttagctccccctctttccatgcccatgggtgcttttgaggcaggatccagtgggaccaggctgcagccccaggggaacagtgaggtcaca

SEQ ID NO: 78266 - DNA, 201 bp, Bos taurus
tccatgctctaaggatggagttatggagcacaggaaaccggggttcctggtaggtaggtgggagtggttatctgtgcgtggtcaggtacagtgaaaggccrctgcttaagccagtttatgctgtttctgacacaaaccaagagaccagaatgaggcaggtggagaccagactggaggtccggagaggcagggaggggaaag

SEQ ID NO: 78267 - DNA, 201 bp, Bos taurus
gacgggactacaggtcttaaaagtgtgagtgttggacttccctagtggcctggtggttaagactccaggctcccaatgcagggggcacaggctcgatctckgatggggaagatctcactggccatgaggtgtaagggcccccccttaatagagtgtgagtgttccccactgtcccaggcctgctggtgagggccttgacac

SEQ ID NO: 78268 - DNA, 201 bp, Bos taurus; identical to SEQ ID NO: 38342

SEQ ID NO: 78269 - DNA, 201 bp, Bos taurus; identical to SEQ ID NO: 38343

SEQ ID NO: 78270 - DNA, 201 bp, Bos taurus
cagggcagagggattagggccgcggggccctggggcctccgtcccagcccacaccttctgctctccagccgcatcctcctgggccctttctgctcgtggayccagaaggggaccaccccagtcctttccgatgtgttttcctaactgactctcaggatggggaagttgtggtcaaggtgtctttccttccagaagcttctg

SEQ ID NO: 78271 - DNA, 201 bp, Bos taurus; identical to SEQ ID NO: 38345

SEQ ID NO: 78272 - DNA, 201 bp, Bos taurus
atcatgatcatgatgatgatgactcatgatcatccatccctcagcctcccgctgtctaagccacagggttcatctatttaaaaacagccctaccatcagtrtgaaggattaatggccagggctcataagtgatcatcaaccaaaccgctctgagctcaactctttggctgctgctgtttgttgctctttccttccaggggg

SEQ ID NO: 78273 - DNA, 201 bp, Bos taurus
ttagaggttgagtcaggctggaggggttggtgccacatcactgagatggccacacccgttcccaagtgtgtacagggccaggggctccagcccaggttgtmtctgccctggagctaacttcaggttgtgtgcagggacatgagagctggccatgctcgcctctgtcctggtcagaggcaagactggggtttgggtggcttt

SEQ ID NO: 78274 - DNA, 201 bp, Bos taurus
ctaactacatagacagactattcaataggcagaagtttcttttgcaggaagatcaacaaaaagttaaaaataacacaggtctcttggtctccagtgaatckgttgtggcctgtcacctgggtttggggaagtgacccttcctgccttgctgcactgccccatgaccttcagggggcgccctcccatacacaaatctagtct

SEQ ID NO: 78275 - DNA, 201 bp, Bos taurus; identical to SEQ ID NO: 38347

SEQ ID NO: 78276 - DNA, 201 bp, Bos taurus
ctaagcacagtgtactgggctctttcaaatttggtctccaactattgccagtgtcagctgacattcctttgtattgcgttcttcatggggatggtgtgagygaccagaggcagggctttcatgaaccagtgcctttgccctatacctgaacccctcttgggctttctctctagtgttcagtcatatttcacaactaactca

SEQ ID NO: 78277 - DNA, 201 bp, Bos taurus
accttggtagtcccttcagcttacatgcagaggcagccctgaaatgcagaggggataaccttgaaccattggtagttggaagacagtggataaatgcctcmgtctcctgttgttcagaagacaaattctagaagtaattttcatgcttcctagatgtcttggcagggtcaagaccttgttgccaaaatcagtgacctacat

SEQ ID NO: 78278 - DNA, 201 bp, Bos taurus
accattagcaccacctgggcaagcccctgacgtcttaattctcccagatttctatgagtcacttaaaatctcctggaggaagttttacatccttctaaatycattagttccacgggatgaagaacgggtatgggaatttgttatttacagttcagaagtgggacaggaattgagaagtagaatctagaattgcatatttgg

SEQ ID NO: 78279 - DNA, 201 bp, Bos taurus
taaaaggactccccagtaaatctaagatggggatatttggccatctgtgttttgaggcacagaagtgaagctgttgaggcacaatgactttattttttgtktatgttacctgttgtatggtcaggccattccctgtggcttccgtcttgctctcggtacatcccctgctcaaccagtgcctgcttcactgacagtcctcta

SEQ ID NO: 78280 - DNA, 201 bp, Bos taurus
tatgagtatggcttatgtatttattgagtcgccatggggaaaggaggctctcttgtttgtgtgtgtgtatgtttgtgtagttatttaagatgtactcaaayactgtataggagtcctctgataaatccagttaggtattcaccatctctctagaattagaggttgtgcaaaacacatatcattaaatattcattcatttga

SEQ ID NO: 78281 - DNA, 201 bp, Bos taurus; identical to SEQ ID NO: 38350

SEQ ID NO: 78282 - DNA, 201 bp, Bos taurus; identical to SEQ ID NO: 38351

SEQ ID NO: 78283 - DNA, 201 bp, Bos taurus
taatatatctctggtcactaatatgttaataatacataagaaggcaagaaaagagaaatgagaaacaagaaacagtggaaataaacagaaaaaaaataaartggccaatcgaagcagtaacatatcaataacttcaatgtaaatggtataaatatatcaaataaaaagcagaaattcacagtggttgaaaaagtgactcat

SEQ ID NO: 78284 - DNA, 201 bp, Bos taurus
ttgggattgtaaagagttggacatggatgtgcgactgagcacacacacattaaatcacattctttgtaattgtttgatatagagactggccctcgtttatkccacctattcacacatgttgaaaatctggtgcatgaaatgtactatataaagatctgggtagcaggagaggaggacggtaggcatgagttaagaggccct

SEQ ID NO: 78285 - DNA, 201 bp, Bos taurus
tgcagaactggtttgagatttataatttagatatacatgtagtaaaatgcattattccatttaattcatttcaatccaaatgtcaaaatatgacagtgttwaaaaaaaaacttgaccatctagcaaatttaaatttatttcttcttaattcttttcagttcagtcatcagcagtatcaaaatttatcatttaaatgaatga

SEQ ID NO: 78286 - DNA, 201 bp, Bos taurus; identical to SEQ ID NO: 38352

SEQ ID NO: 78287 - DNA, 201 bp, Bos taurus
tgtttttgctgactgtatagagcttctccaccttaaactgcaaagaatataatcaatctaattttggtattgaccatctagtgatgtccatgtatagcatygtcacttgtgttgatggaagttgatgtttgctatgattagtgcattcttttgataaaactctgttaacccttgtcctactttatcttgtactccaagacc

SEQ ID NO: 78288 - DNA, 201 bp, Bos taurus
cacagagtgtctcaccagctgacagttccagagtgaagattccagcatacaggcccacgagatgcacaccaggcagtggcctccacaggctagcctgtgayggctgcggcaggcagggacaccccagcagccagttcccaaatagcgtagtggctttgcctctggccataagcacattcataacagaggccctctttttgt

SEQ ID NO: 78289 - DNA, 201 bp, Bos taurus; identical to SEQ ID NO: 38354

SEQ ID NO: 78290 - DNA, 201 bp, Bos taurus; identical to SEQ ID NO: 38355

SEQ ID NO: 78291 - DNA, 201 bp, Bos taurus; identical to SEQ ID NO: 38356

SEQ ID NO: 78292 - DNA, 201 bp, Bos taurus; identical to SEQ ID NO: 38357

SEQ ID NO: 78293 - DNA, 201 bp, Bos taurus
gagatcccacatgctgcaactaagacctggcacagacaaatacataaataaatacatttttaaaaggttacttatattcttagttttgccaaggtgttatyccagaacacttgttataattttactggaaattgctagaagctgtaacaaaggcggccatcttaaaattaagttcttagaagtttttgcaatagttttgac

SEQ ID NO: 78294 - DNA, 201 bp, Bos taurus
agttggggaactaagattcctcatgccagactgtatggtcaaaaaaaaaaagaaggaaagaaacgaagaaggaccaaagtgctaacttcacaatgtagacragccaagtttcttggcaaaactacactgaataaaataaacacactaccttatatgactgttatttatttttatggtttttatcccaagtagactatcagc

SEQ ID NO: 78295 - DNA, 201 bp, Bos taurus
ttagttgaacagtttcaagaaatctgaataaatccagagaatacagaggataatgaagataataaggagagtgactagaacagaggataataaaaaaaacygacaaaaggctgaaatcataggcagtggtatcttcctgtgggcatcttacaaatacattaaggatattagacttttacccaaaggagtttggagaaatta

SEQ ID NO: 78296 - DNA, 201 bp, Bos taurus
agaatacctaatggtacactgaaaccaatgggctcttacaaggcataatataaaaaagccagaactgttaacaaagaacacaaagtcatggaatttgggcracatttttttttaaggtgaactttcactgctgtggagttaagtcacttaaattcttttcatagattttactatcttctccactcacacagcagtcaaccc

SEQ ID NO: 78297 - DNA, 201 bp, Bos taurus
tcccacctacctttttgcctaatgtcacttgtccaggcttaagccactataacaaaataccataagctgggtggcttaaaatataatcattgatttctcayagttctgcaaggtgggaggcctgaaatcaaggtgctggaagcttcagttttcgatgagagttctctttttggcttgcatatggcccctatttcactgtgt

SEQ ID NO: 78298 - DNA, 201 bp, Bos taurus
cgcagaggatgttggactccagctactgtggtgggccacagatccatgcttgggctccctgccttagaagtttggagttgaattccaggaagtgggagctrcaggctcactccatgtggcctatgccctgttttgggtacaagatggtggagtagaaggatgtgtactcaccttctcctgtgagaactccaaaactgcaac

SEQ ID NO: 78299 - DNA, 201 bp, Bos taurus
aatgatgtcagctctgagaaagtaaggccttccgttcagtgttaaggcacgactattaatgtggacagtatgggtcattgagcaagtatatatctgcaggytccagtaacttggtttctattgttaatacctcttcccgtaatttgtctcttgctccagtaattaataataagagcaaatgtcattcaattaatatttgga

SEQ ID NO: 78300 - DNA, 201 bp, Bos taurus; identical to SEQ ID NO: 38360

SEQ ID NO: 78301 - DNA, 201 bp, Bos taurus
agacctgacagtttcttttgactactttctcatgtgtccttaaaatttagctgggtctgttaactggaacagagacagtttctgatgcagcctgggattcyttacaacatgatcaactgataccaagggctgagcaagggaagagagagagagaagtaaggtgtggtgcctcttatgacctagctgtgaataccatacagt

SEQ ID NO: 78302 - DNA, 201 bp, Bos taurus; identical to SEQ ID NO: 38361

SEQ ID NO: 78303 - DNA, 201 bp, Bos taurus; identical to SEQ ID NO: 38362

SEQ ID NO: 78304 - DNA, 201 bp, Bos taurus
gactttagaagaatcaattgcagtagtgagctagttctactgaatgttgaagaaaggaggggacagctggaaagcagggataatttcaaagagatccaagraacatctgagatcatggatgctgaaaaccaaaagtaaaaacagtgcacctcagactgggacttgaacccacagtctttttacctggtctcagaacttaat

SEQ ID NO: 78305 - DNA, 201 bp, Bos taurus; identical to SEQ ID NO: 38363

SEQ ID NO: 78306 - DNA, 201 bp, Bos taurus
tgaataaaagccagattcagattttttttttaatttttattttatttttaaactttacaatattgtattagttttgccaaatatcgaaatgaatccttctyattcatggcacagggagagcagatccttggctcacccccttcactttccatctctagccccaccccacttctctgctaatcttcttcacgtctatacaca

SEQ ID NO: 78307 - DNA, 201 bp, Bos taurus; identical to SEQ ID NO: 38370

SEQ ID NO: 78308 - DNA, 201 bp, Bos taurus
caaagggtcagtatatgtttaagctcaagaaacactttgccaaatgccctccagtattaactgatactcccatcagcaaattattagagtgctcatcttaytctaccctggtcagcatgagcagtagtagtattatttaaggtcctgtcacttttaatgaaaaagtcaggatgtcatcatatagttcaaaaatggaaaatg

SEQ ID NO: 78309 - DNA, 201 bp, Bos taurus; identical to SEQ ID NO: 38371

SEQ ID NO: 78310 - DNA, 201 bp, Bos taurus; identical to SEQ ID NO: 38372

SEQ ID NO: 78311 - DNA, 201 bp, Bos taurus; identical to SEQ ID NO: 38373

SEQ ID NO: 78312 - DNA, 201 bp, Bos taurus
ggccttgttcaaccatgaagccttggaacctgaaaaattacttggcattgcagcatctgagcagggaacctggtcagtgactctgcagagacaagccagtkaccccacctggccaaagagtttgatggagaggtctgcctgttctgtgactacccctacctttctgtgtagtgaaactaagctgtagccctgctcatgctg

SEQ ID NO: 78313 - DNA, 201 bp, Bos taurus; identical to SEQ ID NO: 38375

SEQ ID NO: 78314 - DNA, 201 bp, Bos taurus; identical to SEQ ID NO: 38377

SEQ ID NO: 78315 - DNA, 201 bp, Bos taurus
tcaaggactctgcctgtagatcccacattctgtcccctcacagtctcttcccctacctgctcagaactgcagggctgctgcagatggcctgtgacctcctrgactaagctaaagattccaccaggatgcccgcggcccccagcctcagctgcagacctgggcttctaccgagccccagggccctgcccaccttctctcggt

SEQ ID NO: 78316 - DNA, 201 bp, Bos taurus
taaaaaaattaagctgaggtgttttgggttttttttacattacaattaactaccagaaaaaaacctacactccttaaaggaaaatcacagaatacaatgtrccatccataatttccaatataccaaaaattactagtcatgtgaagaataagtaacatgtgacccataatcaagagaaaaatacgtctaaggaaacagacc

SEQ ID NO: 78317 - DNA, 201 bp, Bos taurus
acacaactagatccgcttagctcacacagcagccaggccccacccaccctggctccgacggaggtcattcaagtccctccaaggtcaacagaccaggaagyaaccagggttctgggtgttctcaggccagctcctttttctggtctgttgggatgctgagtctcagcccctacgctgcccccagctctgatcgctggaccc

SEQ ID NO: 78318 - DNA, 201 bp, Bos taurus
gaagcgcagagccagcagcctaggggggaacacggggaggggctgcccatgagcctcagcgtctcctgcctggatgctcagagttaaatccggaagcaagrggggctggggccctgctgcagaggcttcagggctccaggagagaagagggggagcctgctggggggcgcccaagaaggggacttctgcctccagtccact

SEQ ID NO: 78319 - DNA, 201 bp, Bos taurus; identical to SEQ ID NO: 38379

SEQ ID NO: 78320 - DNA, 201 bp, Bos taurus
cttcggagcaggtggggtgagtgcaggccaccgccaggctgcatctgggctcaggcctttgctgcctgatgctgactcactgcagccccgtggccccgtcrccttggagaccctgctgcggggctcccgcctccctgccctcgcctctgttctcagctctggctttggcatctcgttggggcctcagcaggaggcctggag

SEQ ID NO: 78321 - DNA, 201 bp, Bos taurus; identical to SEQ ID NO: 38381

SEQ ID NO: 78322 - DNA, 201 bp, Bos taurus
aagaaagggagagacgaagacaaaagtggggaggctgctgagggctcaaggcagtcagaagaaaagcagggactgggaggccagctctaccaggggcgctrcaggctgtgcttgcttcgaacctccgagggctttgttttcagaggacagaagggttcaggctgctgctgctccagaaagctgtctgttggttggcctgag

SEQ ID NO: 78323 - DNA, 201 bp, Bos taurus; identical to SEQ ID NO: 38383

SEQ ID NO: 78324 - DNA, 201 bp, Bos taurus; identical to SEQ ID NO: 38384

SEQ ID NO: 78325 - DNA, 201 bp, Bos taurus
ggatgtagcagaccccagaaccacagggaatcccttccaggctggtgaggtggccatgggctagtaactcggttggcctatttttaagacagtgttacagmgcaattgggaaaccctgcttgcaaggatggtttagagctcagcaaattggggaaagaatccaagaacaaggccaagtttcaaggtatcagcagggagaca

SEQ ID NO: 78326 - DNA, 201 bp, Bos taurus
agcgctggcgacaggatagaggtggagagccgggccggcgagggccggcgagggtggtgagtcacctgctgctttgtttcttaagctccggtcccgtctgmgctgtcgcagggaggccgccccggcccggcgagccgaaccaatgctggatctggaggtggtgcccgagcgctctctgggaaacgagcaatgggaattcgc

SEQ ID NO: 78327 - DNA, 201 bp, Bos taurus
gccacctcgaggccaagtagcgtggggtcgcggaggttcagcagctccttcaatgcaagcagcactggcacacactgaacgctctcctccaggccctgagyacgcaggggttggtctttctccagtcctcgacccctatcaaatcactaagactcccgcccatcctctcgcccagcgaattctcaccaaaccgaggaaaag

SEQ ID NO: 78328 - DNA, 201 bp, Bos taurus
aaggtcctttccagcccatctcctatttcctcttggccttcagtctctctggctccagtctactcttggtaagtgatcctgacaaaaggcagctgaccacrcttttcaggccctttgatggttcaccactgcacaggatggaagctgagcttcttggctggcattcaagcccttttatgtcagccccctgcctacttcttc

SEQ ID NO: 78329 - DNA, 201 bp, Bos taurus
cgctatttcccttccagcccccggccggcggctgctgcggagatggtgggggcggtgacttaaagggcttttccaccagtgcagcctcccgcgctcaggaygtcccgggccaggccgcttccagggaactcccctcaccctgtggtctcacctccgccggcactccctagcggggcctcacccagcactgacaatactcta

SEQ ID NO: 78330 - DNA, 201 bp, Bos taurus
tggctttgtaccacaggtctgagcctgggcttgaaggtgggcagtggatccaggagtctttagatccaaggagcatcatctccctggagatctgctatgaycaggccatgggcagcacctgggtcacctccagcccatatgcacagtgctgtcaaccacccattctgatgtctgtgtccattggacagatcggcagtgacc

SEQ ID NO: 78331 - DNA, 201 bp, Bos taurus
tctggattatttatttacccactcacctactgaagaacatcttggttgctcccaggttttggcaattatgcaaaaagttgttataaacatctatatgcagrtgtttgtatggacataagctttcaactcctttgggtaaataccaagtttttagttttgtaagaaattgccaaactgtcacctaatataatctgctttgta

SEQ ID NO: 78332 - DNA, 201 bp, Bos taurus
ggggtccaagcctcccagagatgggcctaggaagggagggctgctgatgttgtgaagtcgggagtcggaagcctggatcccatcccagccatggtgacccygggttgtctcaggctgaactgggccatagtggagttcactggctgtccatccttccctgaccaggctgtgactctggttttggcaacgcgacggccaaga

SEQ ID NO: 78333 - DNA, 201 bp, Bos taurus
cagcttgtggtgtttgaaaagttcttcataccttagaccagaaatgaccccatggaggtggtggcagtgggtgccaggagaaaaagggtacctagtgtggkggtcagtgctgaaaactgtttccccagcttgttgtccttatgtgtgtttgtctcatctcttgtgacatttgttttcttccctgtccctggggaaatcttc

SEQ ID NO: 78334 - DNA, 201 bp, Bos taurus
agcagaatttgaacttaccggttttcagtgaaaagtaagtacagaagactagatgtgtgaggtctttggctggttggtagtgttcatgcagtgggatctcycaggaaaattggtatcatctgggactatgaaccaggcagtcagcaacttggattgactgaggctgtcagggcatttgctctctatcccatgcatgggcta

SEQ ID NO: 78335 - DNA, 201 bp, Bos taurus; identical to SEQ ID NO: 38385

SEQ ID NO: 78336 - DNA, 201 bp, Bos taurus; identical to SEQ ID NO: 38386

SEQ ID NO: 78337 - DNA, 201 bp, Bos taurus; identical to SEQ ID NO: 38388

SEQ ID NO: 78338 - DNA, 201 bp, Bos taurus; identical to SEQ ID NO: 38389

SEQ ID NO: 78339 - DNA, 201 bp, Bos taurus; identical to SEQ ID NO: 38391

SEQ ID NO: 78340 - DNA, 201 bp, Bos taurus
ggactgtgtgagcttaaaatctgcctcagttcccaaatgttctttacagtgtggacttcagcaagcaagtcagtagctcagcagcctgccatagcaggcartttgaaccgctagtgtctggccgagctcaggtggttctctcctggtgggacattgaaatggaccctgaggggaagatcaagtgcaccatggccccctcct

SEQ ID NO: 78341 - DNA, 201 bp, Bos taurus
tgctggagtcaggttactgtcaacaaggttcaagtctagagaggtttggtaacttacacaaagtcacacagccctttagctgagtgtcagagtcagacttygtgcagacctgaaactaagttgggctggcagaaaccccttgaggtgaaggtagggagcaactgctggccttggggaaatgtcttgactgaactctggtga

SEQ ID NO: 78342 - DNA, 201 bp, Bos taurus
ggtgctggcccccgcacaggagggcaggccatggccctcatgggtccaagcccagagcctgtgctggtatgaatagtggaggctctgggcccactgccacrttcagccttcttgctgggtggctgctccactgcttgggagcatgtctgtgtctgcccagcttagatgggagcggccctagcttctcttgtgagaatccaa

SEQ ID NO: 78343 - DNA, 201 bp, Bos taurus; identical to SEQ ID NO: 38392

SEQ ID NO: 78344 - DNA, 201 bp, Bos taurus
atccaggcctaaatgacaagagtcagacacgactgagcaactgatctgatctgatctgaaatgacaaggtgttgttggatcaagatctaggggaaaactayacaaggctggtgaaaaggccctgtggcaggaagaataatgtgagaaagaaatatgcttctatcttgcttaagccactgttcttttaaatatctttttatc

SEQ ID NO: 78345 - DNA, 201 bp, Bos taurus; identical to SEQ ID NO: 38395

SEQ ID NO: 78346 - DNA, 201 bp, Bos taurus; identical to SEQ ID NO: 38397

SEQ ID NO: 78347 - DNA, 201 bp, Bos taurus; identical to SEQ ID NO: 38398

SEQ ID NO: 78348 - DNA, 201 bp, Bos taurus
tggtgtttatccttctttgtttctggagatttcaagacagaactgtagccaaaactgagttgcttttttctgtcccttttcttcttggaaggaggggaagrggctattttcttcccctgggaagttctatgtggagtcctagctctcctaagaagatccacagaagcaacaagtgtaaaagatacctgggtaccaatattc

SEQ ID NO: 78349 - DNA, 201 bp, Bos taurus
ctgggctcatctgtgcagctctgtgagtctcacatgtgcacacacatgtcactgtagtcagacggtgggtcaacttcaggtgatcttgatggcctcatacrtgcgtctggtgttagaggcacaagactgagggtttctaaagcagcacgagtggggaaaccccaatacacaagcacttttctagcctctgatggcgtactt

SEQ ID NO: 78350 - DNA, 201 bp, Bos taurus
gccttcactagtcatgtctcctttgtttcttccagcctgtgccagtccctcagtcctcccttgtctttcatgactttgaccctttggtaaagtactggccmgttacttcacagaatgtccctctattactgggagtctgatgctttctcatgatcagaatggggctctatgttttgcctaaggtaccccatggctgacacc

SEQ ID NO: 78351 - DNA, 201 bp, Bos taurus
aatgggggaggggttcctgatgaaaatgttagaacttttctccacaagaggacttctcaaatggcagaggaaggtgctcagcagagagagtgcgagtgctrggtccctccctttaactctcttactgaagaggatgtgctctgttgaaatctaactaaattcttaaaaccaccaccaccaagaaaaaaaaagaaccaccca

SEQ ID NO: 78352 - DNA, 201 bp, Bos taurus
gctgctgcagagcagtcaggaaaccatggctgggggcccttttgcatgtattcaaatctccagcctctgggcacgtgggaaatacagggagtacgagagtkggggcggcagcaaggacctttccctccgggacccctagtgagctgttttgaggaaggacacagctcggctgcccacgcccactcccattctccccccccc

SEQ ID NO: 78353 - DNA, 201 bp, Bos taurus; identical to SEQ ID NO: 38408

SEQ ID NO: 78354 - DNA, 201 bp, Bos taurus; identical to SEQ ID NO: 38409

SEQ ID NO: 78355 - DNA, 201 bp, Bos taurus; identical to SEQ ID NO: 38410

SEQ ID NO: 78356 - DNA, 201 bp, Bos taurus
ttgagatagcaggtgtcagaatcaagtgactaagaaagaattatgtatgccagtgttctactagagttttaagagttttagtgctactttggagtgaagcrtggatgcacaagatttcagttagggttttagtgatgaaataaggaaggaagagaataaatcttaatggattgaaagtatctgctgaaatgaatctcctcc

SEQ ID NO: 78357 - DNA, 201 bp, Bos taurus
ttgtggaatttactcagcgttcaaatgttcttttgatgaatctgtgggggagaaagtggtctccctggcctatgcctccgccatcttgggactgccccccsctcccccgcccacttctgttttctaacaaaggaaatagacaagttctatcatggaagatagaagataatattattgtatgtatcttacagatgagggaaa

SEQ ID NO: 78358 - DNA, 201 bp, Bos taurus; identical to SEQ ID NO: 38413

SEQ ID NO: 78359 - DNA, 201 bp, Bos taurus; identical to SEQ ID NO: 38414

SEQ ID NO: 78360 - DNA, 201 bp, Bos taurus; identical to SEQ ID NO: 38415

SEQ ID NO: 78361 - DNA, 201 bp, Bos taurus; identical to SEQ ID NO: 38416

SEQ ID NO: 78362 - DNA, 201 bp, Bos taurus; identical to SEQ ID NO: 38417

SEQ ID NO: 78363 - DNA, 201 bp, Bos taurus
acttgtaccatttattcagaagttgacttggctaatcaaggcaggggcctatgacaggaaaaatctgcactaggacaaaacacctgaagttagggatcctrtaaagcctctgtgacattgtggccttgagccagtcacttagcttctttgcaccttgacttcatctgtaaagtgaacattaaatacatatataggataagg

SEQ ID NO: 78364 - DNA, 201 bp, Bos taurus
gcacctggcctcctgctgtgaatttattgggcagatcccagtcttatcccaggactcttatcccagccttatcggtaaaggcagcccagctctgtggtggrcggtggccgaggtcacgcccggtaactgatgagccatccagggccctacacctgacccaggttctgacccagggcttaatcatcaattagtctaaactag

SEQ ID NO: 78365 - DNA, 201 bp, Bos taurus
ttccacttattccacaggaagcttttcagaacggaaaactgaattctctacacctttgtgaagctcctggagcttttatagctagtctcaatcactatttraaatcccatcgattcccctgtgattggaattgggtagctaatactctgaatccttaccatgaggcaaatgacaatcttacgatgattatggatgaccgac

SEQ ID NO: 78366 - DNA, 201 bp, Bos taurus; identical to SEQ ID NO: 38418

SEQ ID NO: 78367 - DNA, 201 bp, Bos taurus; identical to SEQ ID NO: 38419

SEQ ID NO: 78368 - DNA, 201 bp, Bos taurus; identical to SEQ ID NO: 38420

SEQ ID NO: 78369 - DNA, 201 bp, Bos taurus; identical to SEQ ID NO: 38421

SEQ ID NO: 78370 - DNA, 201 bp, Bos taurus; identical to SEQ ID NO: 38424

SEQ ID NO: 78371 - DNA, 201 bp, Bos taurus; identical to SEQ ID NO: 38425

SEQ ID NO: 78372 - DNA, 201 bp, Bos taurus; identical to SEQ ID NO: 38426

SEQ ID NO: 78373 - DNA, 201 bp, Bos taurus; identical to SEQ ID NO: 38427

SEQ ID NO: 78374 - DNA, 201 bp, Bos taurus
tctgtagctgtggccactatacttcccttgcggggcacagtgggagatttattccccctccttttatggggtgtttcttatcaggccttgcacttgtaagyggtgaaaactgcaatgtgtattacctagaaaactcttaccttctgatagcaatcaccacaaaggccaggcagacagttacaacagaaaaatctcctggtg

SEQ ID NO: 78375 - DNA, 201 bp, Bos taurus
cggaagcagagccccatctgagcggccccgtcctcaacggccagtatgccatgagtcagaagttgcaccagatcacctcccagctcagccatgctttcccygagctacatccgcggcccaaccccgaggagaagacccccgcgcctcttgacgagaaggcccacgtgcccatgagtggccagcccatgggcagtcagatgg

SEQ ID NO: 78376 - DNA, 201 bp, Bos taurus; identical to SEQ ID NO: 38430

SEQ ID NO: 78377 - DNA, 201 bp, Bos taurus; identical to SEQ ID NO: 38431

SEQ ID NO: 78378 - DNA, 201 bp, Bos taurus; identical to SEQ ID NO: 38432

SEQ ID NO: 78379 - DNA, 201 bp, Bos taurus; identical to SEQ ID NO: 38433

SEQ ID NO: 78380 - DNA, 201 bp, Bos taurus; identical to SEQ ID NO: 38434

SEQ ID NO: 78381 - DNA, 201 bp, Bos taurus; identical to SEQ ID NO: 38435

SEQ ID NO: 78382 - DNA, 201 bp, Bos taurus; identical to SEQ ID NO: 38436

SEQ ID NO: 78383 - DNA, 201 bp, Bos taurus; identical to SEQ ID NO: 38437

SEQ ID NO: 78384 - DNA, 201 bp, Bos taurus; identical to SEQ ID NO: 38438

SEQ ID NO: 78385 - DNA, 201 bp, Bos taurus; identical to SEQ ID NO: 38439

SEQ ID NO: 78386 - DNA, 201 bp, Bos taurus; identical to SEQ ID NO: 38440

SEQ ID NO: 78387 - DNA, 201 bp, Bos taurus; identical to SEQ ID NO: 38441

SEQ ID NO: 78388 - DNA, 201 bp, Bos taurus; identical to SEQ ID NO: 38442

SEQ ID NO: 78389 - DNA, 201 bp, Bos taurus; identical to SEQ ID NO: 38443

SEQ ID NO: 78390 - DNA, 201 bp, Bos taurus; identical to SEQ ID NO: 38444

SEQ ID NO: 78391 - DNA, 201 bp, Bos taurus; identical to SEQ ID NO: 38445

SEQ ID NO: 78392 - DNA, 201 bp, Bos taurus; identical to SEQ ID NO: 38446

SEQ ID NO: 78393 - DNA, 201 bp, Bos taurus; identical to SEQ ID NO: 38447

SEQ ID NO: 78394 - DNA, 201 bp, Bos taurus; identical to SEQ ID NO: 38448

SEQ ID NO: 78395 - DNA, 201 bp, Bos taurus; identical to SEQ ID NO: 38449

SEQ ID NO: 78396 - DNA, 201 bp, Bos taurus; identical to SEQ ID NO: 38450

SEQ ID NO: 78397 - DNA, 201 bp, Bos taurus
tggaggagtacgctcgtctggagggcctggtggacacaccgcttcccctagcagagggaatgtgcacttaagaggagcccagcatcactgagatggtggaygatggctcgcctctgtgggcctggagctggtggggtcagctctcctggaacaagggtcactaacagcaatgagggcaagggagccccaaacaatcttggt

SEQ ID NO: 78398 - DNA, 201 bp, Bos taurus
tcatttagcagcagttccccaaaaatccactgtgctgctagactcggcaccactggggcaccgggcagtgggcaagactcttctctcctgagacatgtcaygaacttaagaagctagagcaccaacgtgtggcactcagcccagaggccggaggacagtggagtggatggccaggagaatgaggtccatggtgggaagtct

SEQ ID NO: 78399 - DNA, 201 bp, Bos taurus
ttaaattcctccaaccttacaaaattcttaaatgcaattagtaatcagtggctggaaagaatatttcttaacttacagtatcttctgcattttggtgaagrtaaaaattcttaatttggtaatatggggatggattagtgtgttttcatgctatatagttgggtcaaaattaattaaggatacattataccattcagttat

SEQ ID NO: 78400 - DNA, 201 bp, Bos taurus
gcatttcaggatccagtccacaacctactctcattgcattcattgtcctgtgtccccagtgtcctctgctctgtggattactcattctctcctggtctgtyatggctttggcagtcttgaggaagactggccagggattgtcgaaggcccccaggctgagtttgtctgctgctattctcataatgtcgagtgaccttcagg

SEQ ID NO: 78401 - DNA, 201 bp, Bos taurus
ggatcctttcccacactgtgggtgtcggccacatcctctctaccacctcattcatgaggatctttttgctcccagcttcctggagaagggccagggtggaraggaaataatgccccccacttcccaatgccctgagcagacccctgacagccttgcccacatacaggccccacaggcacatccacacacagcctgacccac

SEQ ID NO: 78402 - DNA, 201 bp, Bos taurus
caatatgtgaccttgaagacaggatcgtgtggactttagcagtgtacagttagatcagtgattagtgaattgtctcacaggcgttagtgccaggcaggccygagcacaagccctgagcccctggtcagactctggtggctcctgtcctgctgttgtcactgtgtccttcatcttttcagtggcctttgttgggccacttcc

SEQ ID NO: 78403 - DNA, 201 bp, Bos taurus
aggccattggggatggaatatggtctgtgctcccggctaagcactgctccgtgattgctcctgaatctcacctggagattcttctgtgctctctcttctayatcagtgcttctcaaagggggcccaaaccagcagcagcagcatctggaaacttgtttgaatattcttgggtggatatccttgggtgacaccccagactac

SEQ ID NO: 78404 - DNA, 201 bp, Bos taurus
caagtagcctggaggaggacctcagatctcccacaatggccaccaatccctcctccaaggacaacgcccagtctaagtaagaaagattacattattacaaycaaagcatggccttctcccatcaccccgccaggcagcagctctgcttaaagactggaatatctcccccttccctgtcctttcctgaggggcaggagatcg

SEQ ID NO: 78405 - DNA, 201 bp, Bos taurus
cctcctgggagctgcaaaaggggcaggctgggagtcagcaggggtgccacccaggccctcaggaggggacccatagaggcctctgctcaccccaccccccrcttcggccccttcttccagatcctccagaaccttcctgggttcagctctccccctcgtcaattaaagaaggagttacagtagagctgacttgtatgtcag

SEQ ID NO: 78406 - DNA, 201 bp, Bos taurus
ggcagcagtaacggtggaggcagcaatgcaggcagcagcggcagctctgggtccagctcggtatgttctactcttttgttgaaggcagagatggggccccyggtggtccctgctgaggacactcactccagggtcttcctgaaagctgcccgccccagggtagctggcgtcaatggagttgtcatcccaggccccccagct

SEQ ID NO: 78407 - DNA, 201 bp, Bos taurus
gcccagctgggcagaaaccaggccagcatgtcctatgaattggtccgtggtccctgagatagcctgatttggaaatgcgttgtggggcagttataggcacytggagctctgtgtggggtcactggccatgaggtatggcctctgaaccatcacaggttgtctgggttctggactgagcctggatctggtgactagagaggt

SEQ ID NO: 78408 - DNA, 201 bp, Bos taurus
cccgaagagagggggcgggactagagcgcctgatggaagagggtctgggggcctgggttcttgggtccagaggatgaagtggcaggggacgccgattcttyggtcccaagagaggaagggcctgagtcttgctgaaggaggagactgggacctcaatttctgggtcccaaaagagaaatgttgcaggggctggactcctgg

SEQ ID NO: 78409 - DNA, 201 bp, Bos taurus
cagagcgtgacggtccgaacgtctctggagagaatgaactggtgttcggggtgcaggtgacctgtcaggtgcggcagccgccccgcctctcctctggcccrgtgaactgactgccgtggtcctcagctcagtataatgaagctgctgtatccccctgtccttcccactcccacagggccgttcctggccagttctccgcag

SEQ ID NO: 78410 - DNA, 201 bp, Bos taurus
ggattacacgagaagcgtttctttcctgagggcaaaactgagtttctgtctaatgacttcaaagttaagggggtacagaaatggaggcctaaaacctgacyaggattaagagttataaaagagagtttccccagattaagtgtgaaccccaaaatctagaccctcaaagtaagagttaacaagaagtcaactctcccataa

SEQ ID NO: 78411 - DNA, 201 bp, Bos taurus
gagacgtgagctgagaatgacatctgaaggagataatcgggcaaagagcagaaggaaaggtattctgggcagagggccaacacaagcaagggcttagaacrtgcagggcactgggggcactgcagtagaagtgaggcaggaggcgtgggcagggttcaggacccccaggctgaggagctcagactctggcccgatagtatt

SEQ ID NO: 78412 - DNA, 201 bp, Bos taurus
cttggactgccatctccaccctcggccaccccgcaaactgaccgtccaccagtgacccctccaacatccaaattcaacatcccaattcctttcccagccayttccgctcccatgccgacgcaagcatgctcagaccaatgggaattctcaaaggctctaaagctccgccttccgcccaataggccctctcacagagtgtcg

SEQ ID NO: 78413 - DNA, 201 bp, Bos taurus
ccgtgttctcatctgtaaagtagggctgataacagcgccttcttccctgggttgctgtgggctctcgagtctttcacataagacacttactcttttcactraggccttctccccttcctctgtcctctcagtttccttccatgcttagtttttctctaatgctcccatcatcacctgatatctattttacatattcattct

SEQ ID NO: 78414 - DNA, 201 bp, Bos taurus
agaggccaagccatcaaatgggtccccgggaacccaggacctccttctcacccacagggctgactttgcttgcctcggccagtcgggaccgactgatccaygtgctgaacgtggagaagaactacaatctggagcagaccttggatgaccactcctcatccatcacggccatcaagttcactggtaagtccctgtcttcta

SEQ ID NO: 78415 - DNA, 201 bp, Bos taurus
tggagtgcgagccctctgacactgcctccccgatcatgtcctgcagcgtgaatgggaaacgctactttgaatgccaggccaagtacggcgccttcgtcaarccatcggtcgtgacagtgggggacttcccggaagaggactacggtttggatgagatgtgatggccgaggaagggcagtcccctgctgcagccagctcgcc

SEQ ID NO: 78416 - DNA, 201 bp, Bos taurus
aaaagcaaggagtataacactgtctcataaggcttgcaatgtatgtagatataataaatataataatcataatataaagaggggaggctaaaaagacatayattgtggtaagatttctaaatataacatgaagcactaaaatgtaactcaaagtatactgtgaattacatatactgtgtatatcgcaatactctccaaagt

SEQ ID NO: 78417 - DNA, 201 bp, Bos taurus
gaaattctaccaagatacatctagttaaaactctttcctcctatatcctgctcagcgtagaaaggaaccatctgattactaagttttcttcaactctggcmatctgtcttaactgttgtttttgcatcatcaccatattctccttctagaactcatatcttacatttattttattttctatataattttcttaccccatga

SEQ ID NO: 78418 - DNA, 201 bp, Bos taurus
cataagggggtttatatcattaacagaatgtgttaatttaatgtattccaccatcactcagatctgagaatcttcccattcattctacaaactcattaatrtaacaaatgtggggaagacatttatcgtcatctctagcccatcactttcctacttgtgttatactgaacaagatgcttaactgctccatactagaatttc

SEQ ID NO: 78419 - DNA, 201 bp, Bos taurus
ttacaagatatggccctgttacctgacctcctctatcaatcatccctttacacagacctctactataactttccccatattcctcaaatacaccagcagarttccactgtgaggcctttgctctaactttctctgtctagtatgctcttcccttagataaccagacttactccctcacaccttcaaatcttgactcagatc

SEQ ID NO: 78420 - DNA, 201 bp, Bos taurus
agtatcaaaataaatggtaatgcatcatataacacactgaataaatgaaaatctacaaatacatactgatataacaaatgaacaaataagtgagtgataarggaatgctctccttcacagtcgaataccaactaattaatacagacaaaatcatggagattttaaaattctaccatcttgaaaacatcatagtaataaagg

SEQ ID NO: 78421 - DNA, 201 bp, Bos taurus
ccaataaataaataaataactaaatcttgggggaaaaagaattttcagaattaagtatattttatgtggttgtaatacatttcagttatgtatacagatgyttaaatgattccatcttttacaggttaaagagcctctgccaactggttcctcttccttaattaccctatctaaattacccaattaacccatcataattcc

SEQ ID NO: 78422 - DNA, 201 bp, Bos taurus
ccagatcttccactcatggccctcagggtcatattactgatttaattgtgcagatctctcacaagcaggcttgaaagcctgggaaaagaagagcccctaastccactcctcccagttctctgatcaggtcccattcggatacgcctcctcctggcccagggacccgttggacacgccccctgcctcacgtcccgccttccg

SEQ ID NO: 78423 - DNA, 201 bp, Bos taurus
gggtgcagcgtttcctttccacgttgtttaacatgccgagctctgcggactatatttagtacctcattcacgtggccccgggagtggtctggggatgtggygtcgtctccacagtaagacacgacaaggtcagtttctgtggggatgtttagttggttggttggtggttacttcaaaactaaaggcccttcagcaaagcat

SEQ ID NO: 78424 - DNA, 201 bp, Bos taurus
agaccagcagggatacccaggagcttacaggccctgcataactgtctcattcaatggatcttcctatgaaagttctggttagtctgcaggtccattgcttrctccagcctggttgtaaccacagttcagctgtgatggtggcctctcccatttgtttgctactgagactgcaactgttttaataatgcccaggggtgtggg

SEQ ID NO: 78425 - DNA, 201 bp, Bos taurus
tcttggcccccgggccgccggggaaggccctgtgtgttgtgtttgagtggggctatcgcactcatgctctgccacgtcacacggcccagcgctctgtcttygggagactttgcagtgtcctccgttgtggtcaaaacaaactccacttgttggacaaccctagaggccccctggggaggatatcgaacccacacgaggaga

SEQ ID NO: 78426 - DNA, 201 bp, Bos taurus
gaggaaatggcaacccacttccgtattcttgcctgggaaatcccacagagatgcctagtgagctacaagccatggggacccaaagagtggaacatgactgrgtgactgagcatgcacaaacgcaccctaagaaccagtgaagagtcatgagacaaaaggcctgtgttggaatcccagcctcctacccgtgtgagtgtggcc

SEQ ID NO: 78427 - DNA, 201 bp, Bos taurus
tctgaggctctccatgtcatcgccttgagaggacaaaaggcttatttactcactctagatgtttaaactcatgttaaaaatgtaaggatactttccagaaraattaaaatattggattggccaaaaagttcatatgggtttttctgtaccttcttaacaaaacaccagatgaactttttggccaactcaacagaatgaaag

SEQ ID NO: 78428 - DNA, 201 bp, Bos taurus
gctgtatcttctccagcatttacaagagtacctggctcatagtgggtgctcaaagaaagtatggatgaatgaacaggcctgtgtctcctctccagcctcayctcccaccacagtcctcctccagcataaacctgggtttagtgggatgtggtggggagactgggttcaagtgtttaagagatcttgggcctcacattcaga

SEQ ID NO: 78429 - DNA, 201 bp, Bos taurus
acttcatccactcccagcctttctggtccatggtagatgttgctcctggattctggtattctccctgccaaaccctccaggcagcctggcactccaggccytcactgcagttgactcaagagtttgtgagcaggggaaacctacttgccacatcccagacaaattaggacccctcagtgcctccagaagagcctgtggtcc

SEQ ID NO: 78430 - DNA, 201 bp, Bos taurus
agaccagggattgaacccatgccccctgcagtggaagcatggagccttaaccactagaccaccaggaagtccctgattcacctgttcattacatctcccakaaggatgtcagttccacagccagggattttgcctgctttatttgctgttttatatccacacgtagtcagtgtctagcacagagcagatgctcagtgttta

SEQ ID NO: 78431 - DNA, 201 bp, Bos taurus
gggttgtggggacaaggtgagactctatccacaaagggctcatgaacagtagcttgtcacttgtgtgtgtgaaggcctgcgaccgttttctcctcacagargtccagagcagcaggaatgacagcctcccagccatacaccagcaaaggcctgctcaggtcacacagccagcaaggggctgagctgggagctggggttcca

SEQ ID NO: 78432 - DNA, 201 bp, Bos taurus
ccatagttcccaagaaggtgtaaatccttgtttctgaggaggtggttgttgcagagggacaggcagcatccatctcaccccctaccaactaaagacatgcytcctgccgggaagccagggcccagggcacggcattgggagccagcctcaggccgaatccctgcccagcctttggtactcatgggactcgggctgcctccc

SEQ ID NO: 78433 - DNA, 201 bp, Bos taurus
cctcagggccctgcagatggaatgcggaatccccatggcttgcagtttgtatatcaccaggggtttaaattcctgaccaccacgtggtagtcccactcctygcctcttgattgacaggcccacagtggcataggggtggcagttttcctaaagggaaatggagccattgtgaccaggaggagggagggatggctcctgggc

SEQ ID NO: 78434 - DNA, 201 bp, Bos taurus
gctgggccgcatcccagcacatctcccttccccccgcaggtgccgcctggagcctgctggcgcgcgtggccggccggcgtcttctggcagctgggggcccktggacccgggacgtgcaacgcgcaggcgcctgggagctgcgcttctcctatcgtgcgcgctgcgagccgccggccgtcggggctgcgtgcgcgcgcctct

SEQ ID NO: 78435 - DNA, 201 bp, Bos taurus
cttcctcctcccgtttttcctgcattccctcacttctctaattagtaactgtctgagtctgctcttcggaacttagggaaggcctaggaaagaaactaaarcccttttcaacaaataagaaacagggcttacagaggctgtgtatgtaccttggaggggtctgttgtggcctgcttggtttcaacactcccctcttttgtt

SEQ ID NO: 78436 - DNA, 201 bp, Bos taurus
gaaaattgcagaacaggaattctgggctataaggagaagttttgaaggagactacagaggaggtaagctacaattttggatcttccctgtacaacatgtcygtcccgtcttccccttcagaaaccagctgttaattgagttagactcaccctacctaaagtttgagaggcatgctgaatttgaccagaacaagagtgagca

SEQ ID NO: 78437 - DNA, 201 bp, Bos taurus
caaggcctggaaccatcccctgcttctccactgtctgctcacagaagctgcagcaagagctggagttcctggaggtgcaggaggagtatatcaaggatgarcaaaagaacctgaagaaggaattcctccatgcccaggaggaggtgaaacgaatccagagcatcccattggttatcgggcagtttctggaggctgtggatc

SEQ ID NO: 78438 - DNA, 201 bp, Bos taurus
ctgtgtaggctgccaggctgcggcagaggtaggtgacgttgcccttctgggcacagaggtcatacacgcactggcggaagtactcagaggggctcagcgcygcgtggcaggctgagaaggggccgttggcatcccggagctgcccacaggcctcgaggctctcgtatggtgccgtctgctctgctgagcacacagggcagc

SEQ ID NO: 78439 - DNA, 201 bp, Bos taurus
ttcagcatctttgctcctgcctttcccttggcccaaaaggttcttttcctagaaatacacatggctcactcccttgcctcttacaaagactttgctcaaaygtcaccatctcagggaggccatccccgagcaccctattttatatggcaactcctccttagtccctgttccctttctctgctctattttttccctctagtg

SEQ ID NO: 78440 - DNA, 201 bp, Bos taurus
gtgccttgaaaggatgaactcattcaatcctcaccaccacccaatgaagttgaaactatctttatccccattttacagatgtggtaactgaggcccagcamtggcaagtgacttgcctaagccacactgtgaaggaaggggcaggcttattccacaatctgagctccaaaggactgtgctaacctgcctcttcctctggcc

SEQ ID NO: 78441 - DNA, 201 bp, Bos taurus
accaaagaaattaagcattgattagccatttggatatcctcttttgaaaactgcccattttactatttcattttgctcattttttgactgggctctcttaytgttataaagatttgtattttggatacacgtcctttgctggagatacaaacacatacacacacacacacacacacacaaaccattctctctctctccagg

SEQ ID NO: 78442 - DNA, 201 bp, Bos taurus
ggccaggactgacaaggctataatattgataaaatatctaaatacttcctggacttcatggtaaatagccactgccctgagggtctcctctactgctcccmcgtggccttggccaccccagaatcccccgatctccccagaaaacagcacctaaagagttaatgctggactcagcaatgagcctccctaccttgctcctgc

SEQ ID NO: 78443 - DNA, 201 bp, Bos taurus
agggggtgctttatttagcttcccatcgaggcctcggtagtcagggttagcaagtgctcatgtctgcacccttggtgttgttccaagtagtattgttaccsagcagggttcttggcctccttaatcaaaggaaattgagcagaggccagacaagaaactcaggcgaggttttatcgggacccctgctatagcagcagggag

SEQ ID NO: 78444 - DNA, 201 bp, Bos taurus
actccaccatggaggaaggaatcttcaactgggcatagcttcctacatcaggatccccactgctccccatcaccctgcactcaggagcttcatttactctyttatgtgacctgtctggcccctgaattcattcgacagcccctaggacggtagccagtgtggtttgtaagagcatcaaggcctgtttgtaagagcacgcct

SEQ ID NO: 78445 - DNA, 201 bp, Bos taurus
acaaactcacctccccttaagaggctgcgcatcattttcctcatctgaaagcggggttgtgggggcgagcaggagcacaccagtacccagggcctcagccrtctcttctgcacccccaggtgttcaaatcgcgaacgccgcccgaggccatcgcgctctgctccagcctgctggagtacaccccctcctcgaggctctcgc

SEQ ID NO: 78446 - DNA, 201 bp, Bos taurus
ggacatggccctcactcagacccacatgcacacactcctcaggggaatccggaacttctggaactggggctgtttcagaagcagagagagcacacacacayattttcccagcgtcatgtgccatgtcctgcatacatctttgcatgtgcctcatggctgcctcaacccacccggagttatgactcaggacagggggagccc

SEQ ID NO: 78447 - DNA, 201 bp, Bos taurus
gctacccccacctctcctcctgagcccctactctcatcagctgaaattcccaccgtcaccaatgtccagaaccacaggtttggccaggaagccacaggatrcacagaggatgaaaacgcacatcactcagactgaccacgtggagcacggaggcaggaagaggaagggcagcaccctggagatgggccggggacaaggatg

SEQ ID NO: 78448 - DNA, 201 bp, Bos taurus
gcaggcacgggctccaacccgccttcccggcggatggacgggatgggcactcacctcgcacgcggaggtacgtcccgcaggagcgctgaatcttcttgccrtcactgacttggcacctatacatgcccctgtgagtcttgttcactggtttgatgatcagctcgcccccggcacccacgtccccgcgatacatcacagggg

SEQ ID NO: 78449 - DNA, 201 bp, Bos taurus
ggttgggacatcccagcacagcagtaacagtgctgggcattcttgggttgttcttgattttcagtgtaatactgccatttttctagaaaacaatgttgctrtgtcttgtttgcttgcttttttgagggagatagattaaaaaaaattttttttccagcctttttgagatacaagggacatcatgctcagttgttcagtcat

SEQ ID NO: 78450 - DNA, 201 bp, Bos taurus
tccaaacacagccaggtgtaaagggggcatttcctcggccccttgggcttatgagaccagaacttggatccccacactcacctggtagatgggaacttgtrgcttggcatcaggtagggaggcctggggcacgggagagagtgggcatcagcagagagggaaggagagtcatttcttccaagcatccatctccaagcctga

SEQ ID NO: 78451 - DNA, 201 bp, Bos taurus
ggtcccacactggcaatggtggccaagatctgagaccttgctccagacctatagttacacaataacccaggaaaaccacatactgttacagatcagaggargtgagttctggaggcctgagtcccccaaataagggagtgtggctcagattcctgggtcctgaggggcagggtgtttggaccagaatgctctcttactatg

SEQ ID NO: 78452 - DNA, 201 bp, Bos taurus
aacacagatgagtttgacagcaaagctaaaggcctttttgagagctgcctcattcctgaatctccattgcactgtcccagacacaggcaacctactcccarggttggttattttgttcaaatgaagagcttttgatgtttgtagagttgactgtttgaaatcttgggttggccaagaagaaagtccacttggttttgccat

SEQ ID NO: 78453 - DNA, 201 bp, Bos taurus
ggcgggctaaagagtgggtaccactacctgcctcaagacaggtgagagagaaagggatgaggctggtgtccaaagatcaggggtccctggctctgtgttcmaggagttagtttgatgtagcaggcataggtcagaggtctcacgcaagtgagaaggcgctaagagaagtcacacagctgaggagttgagtcttctggaagg

SEQ ID NO: 78454 - DNA, 201 bp, Bos taurus
atatatgtaaagaatgtaaaaaggccttccgttctatatcaggtctttctcaacataagagaattcatactggtgaaaaaaccttatgaatgtaaggaatrtggtaaggcctttaatcgtagcgagcgacttattcagcatcagagaattcatactggcgtgaagccacataaatgtacggaatgcggaaagcctttactc

SEQ ID NO: 78455 - DNA, 201 bp, Bos taurus
tgggccgccatctgtggggtcgcacagagtcagacacaactgaagcaacttagcagcagcagcagcggttcctcggggataatcatatggtctctattgcrttaaaaaggcctgagtctgcaccattcactatggtagccattggccacgtgagactgttgttcttcaaatgttgctggtgccaactgagatgtgctgtta

SEQ ID NO: 78456 - DNA, 201 bp, Bos taurus
ggcacacctgttttgctgggatgttgaatcagtctcattgagaattaagttgaaattggattctgtttttacaatagttatcttccatacactgcttcaawtttttctaacattcccttgttttagggtgggtgctggaggattttcctcaatgttcctgtccaccttcagcttctggctatgcctgtgccctgtgacaca

SEQ ID NO: 78457 - DNA, 201 bp, Bos taurus
taacttccacaatcccactgagtaagtactatataattatacgccagccattaggcttctctatccatgggattttccaggcaagagtactggagtggggygccactgccttctccggattcagagattaacttgcccaaagttataacactagcaagtggccgtgctgattgcgaatcaaggagaggctgggggaataca

SEQ ID NO: 78458 - DNA, 201 bp, Bos taurus
tcctgtgggaaccgggcctggggaaggacacagcttcctgcccgtgacaccggcgtgtgctatctggtgtcctcggcacgacagggctggccgcgggggcrggggcaggctgactcgatgactaaggtggtcgaggtctgagctcgggtgtgaggggcagagaggggaacacatgcctggtggctgggtccagggtccgga

SEQ ID NO: 78459 - DNA, 201 bp, Bos taurus
aaggggtactgccaggcctggaataaagactgtacctaattcccccactgcactcacttactttcattcccatacttgtccatttagtcattcaacaaacrttctctgaacctttcctgcatggcccagccctgtgttgatcactgggaacacatcagagaactcttggggacacagcgcaaaatgagataaacaaaactc

SEQ ID NO: 78460 - DNA, 201 bp, Bos taurus
actcttagggtagagaagcccttctcaaataaacacagaaacaaacaatcacaacaagtgcctgaaaggaaaaagtctcatagatttggttactttaaaaygaaaaaacttcagcaggacaaaacatgccagaaatgaacattaattcacagacaatgaaaagaggcatctttcaaaagcggtataaatgtccaataagcg

SEQ ID NO: 78461 - DNA, 201 bp, Bos taurus
agtgcctggagtagtgcctggcacacagtaggtggtcagttgaatatttgagagatgagatagttacttacaaagacatagcaacgtctaccttatttcaytgagctaagatgcgcattttccccccatttgaacctttctgaaaatggaatgggttttacagtcagtggtgtctggagattataactgacaatgtttttt

SEQ ID NO: 78462 - DNA, 201 bp, Bos taurus
atcttcctaagcacccccccaacaaatgacttccttccctgagctcacagaggtggccccttgcctgccctgcccctcaacctgacacagagatggggccrgttctccatctttggcaggtttagaaagcacggggagggtttctcacaagaactccatcctctttccttctttgatttcattccccatcttttctccagc

SEQ ID NO: 78463 - DNA, 201 bp, Bos taurus
aactcaccaggagcttaaaaccaggaggagagaaaacagggaggccctgaggcctcttctgccttcttcctgcaaggaactgaagaaacacaggcgcccayttttgaaagcacttctcctgggcctaagcctgatatggaaagcccatttcacagttgagtaaactgaggccagaagcgggctgatcactttgctgacaca

SEQ ID NO: 78464 - DNA, 201 bp, Bos taurus
catcctgatagcaccttggatatcttctcctgagcacttttcacagttttttgtggctttgttgtcaagaaagacacttgagaatcaggcctagttgtgcrtttgattctcagtgagaagggaatgagtttcgtctggaaccaaacagatcaagggtttcagattgaggcaaaccacaccagccttcactctgcacgcgca

SEQ ID NO: 78465 - DNA, 201 bp, Bos taurus
ccttaacttctctgtgcctcacttttctcgtctctaaaatggggcctcccttgagggttaagtgcactcttatttgtagagctgggctgggatctggtgtygatagctgtgtgaagcccaggcccctcccgtttccttttttctagtctcttcccttcagtgagttgttcagtcagttcttttatgagcatctgctgatcg

SEQ ID NO: 78466 - DNA, 201 bp, Bos taurus
ggaagggatgctggaggaccaccgcccagcctggcctgcagagaccctgggctggagggcggtctgcccagacctgtgggggtttctcccaccagcattgmggaaggccttcaagggaaacactcagatccttgcaaacttctgtttcctcgtctataaagtgaagaccttgtcaggcaactcataaggaattgctccatg

SEQ ID NO: 78467 - DNA, 201 bp, Bos taurus
ggaagaatgttttagagagattcgtgctcgagagcaaggccacaatcccctttgccattcatagcggcaggagactaaccctcttgctgggtgggtattgwggagaggaggcccagaccccttcagctttgggctcttctggaaatctgcccattgcaaagtctacagccatttttttgttttgttttgtcttttataagg

SEQ ID NO: 78468 - DNA, 201 bp, Bos taurus
gacgaccaaaaatgcctccagacttggccaactgtccctgaagggacaaaaccaccccagcggaggaccatggaacgtggccccattctacagatgggaakgctgagggctggggatgagtaggacagcacccttccaaattttcctcttgcagagccagagcctccagtggaaggaaagcaggccgcccccccggaggag

SEQ ID NO: 78469 - DNA, 201 bp, Bos taurus
cccctggaatctcctggccagatagcctcaggctcactttctaggctgcttccctgtctgcctctggagtgtggaccttaccacagcgtctgaatgcctcrgcctgaggattggatgttttggtggggaaggatgggcaaaaccttgtgcaaagtcaggttcaaagctccttacattgtgggtgagccagaatgagacggg

SEQ ID NO: 78470 - DNA, 201 bp, Bos taurus
aaataaaaaatttatttaataaaaatataaaatgggagtgagaatgctcacctctttgactggctgggtggggcaaagggatcaagaccatgtggggcctraacccgtggctttgcttcaggcagcgacccaggcactggaagctttgtggacctttgagttcttcttactgggcctctgtgctctcctctgtaaagtgga

SEQ ID NO: 78471 - DNA, 201 bp, Bos taurus
gggagggtgtaaactaaatcctatattgaatcctgggccacagaagatgctgtcattttattattgagacagctggccacatttgaaggcacaatgtcgaytagatagtaacattgcatcaatactaaattcctcgatttctatcatttttctaagattataaaggaaatatctgtggccttagaaaatattctctgaagt

SEQ ID NO: 78472 - DNA, 201 bp, Bos taurus
tttcctctacatccggtttctcttgagtctgaaaattcaagttctctgtgacggaggaatgtatctgaaacgacatccatccacagtggccaccaggctcyatttaaatgcttgagccatagtcacgccatttttatttttttttaatcattttgcttatttatttttggatgggctgggtctttgttgctgcacgcaggc

SEQ ID NO: 78473 - DNA, 201 bp, Bos taurus
tgaagcatcaccccggaagcacagacatgggccccagaatcccctccccgctgctctccagccactcagctgggattctttcggaggatctcctcagggtmcccccgttactcaccaggcctcgggccgcagggtagatgggggacagggagaggtccgcgcacttcacctcccacacgtcgctggggtccagccagtggt

SEQ ID NO: 78474 - DNA, 201 bp, Bos taurus
gcagaatagtttgtggagagatctatgcttaacttatattccaaccctgattcttcagctgtgggtcagctctgcagggcctggctgaaacagcctagctkcctgcctggtagaggggacctaagctcattgccactaatctccctaccccattaagtgactttcgtgcaaaaataatgaggccagagtggctgaggccaa

SEQ ID NO: 78475 - DNA, 201 bp, Bos taurus
cactagcattattcttcactgagggtagaatgggggtcttggagatacccagtccaccacccccaccagatgctggaatgcctggccttctgggggcaacrgggatagcagatactctcagaagctaggtctgaacttggatgcctgcatgacagggcaggcaagggagaatatgggttgtggctaagggccagaatcacc

SEQ ID NO: 78476 - DNA, 201 bp, Bos taurus
tacgtgtgatgaagaaaatacacaagttgatatgatggagcatcccagggccctccttaggtggcagtgtgtgtgtgtataaaggaaggcctttctgatckgagacccagggaggagaagggatcccaccatcagaaactgggggtgggtgagccaggagcaatattccagacagagggaagagcaaggacatcggcactg

SEQ ID NO: 78477 - DNA, 201 bp, Bos taurus
ggtacctggaccagtgcccctgaggactctgccctcgaagacaggaatgcctgtatcaggagtcacgcagcccgcaggaaggcagtcctgagttccaatcyggcccgggtcacccaccagatggaacacactgggcacacaggatcctcctagggggctccgcatccgcgaaatgggtgatgccccgggactggctagact

SEQ ID NO: 78478 - DNA, 201 bp, Bos taurus
atcgaaccgtggtctcctgaattgcaggtggattctgtcccagctgagctaccagggaagccccatatataggtgtagatgccacataagcaaggatgatygggaagggcctttctgaagatgtggtatttgaactgagacagtaaataggaggcggttatagcaagcttcagaggaaaggcataggggtagaggggggat

SEQ ID NO: 78479 - DNA, 201 bp, Bos taurus
ctcagatgaggtctgctgtgcttcagggcagttggggctcagagaggggcctacccgtggtggccaggtgaccggaagttctgggcctgtgtccgtcactytctttcttgctctgtgatactgttgacaacatctactcacagaattttttttttatcctgcacaggggaccctcacaatgatcccaatgctcagggtgat

SEQ ID NO: 78480 - DNA, 201 bp, Bos taurus
gtagtttgtaattaacccatggatcaaagaaggaaaaaaaagaagctaggtaatattttgaactgagtgatggttatgtcatgacataccaacatgtttgkggggggcagctaatgctcgggcttccctggtagctcagctggtaaatgcaggagacccagattcgattcctgggtcgggaagatcccctggagaagggat

SEQ ID NO: 78481 - DNA, 201 bp, Bos taurus
gaaggtggccctggtgcgcctgtcccctgggcacccctctggtccccctcgctctccctgagagaccacctagcccggcagttaagaacgcaggattggarcggagttcatccctgctcggccactccctggctgtgtggccctaggcaagtggcgtcacctctctgggcctcactggccttatctgttcaacgggatgat

SEQ ID NO: 78482 - DNA, 201 bp, Bos taurus
tttacctactgacagtttttaagctcggccctgcttcttccccttctgctgataaagcctggagctccctcttttgctaatggtggaaattcaaaccgcaygaagctctggcccatgtagactcctcacccccacctcacctcttaaccacaacaaaaacctgtgctgggtgcttgtccttgttcttgtagagctgttccc

SEQ ID NO: 78483 - DNA, 201 bp, Bos taurus
gcggagccacgggggagagacagatgtgactgggtgagaggaggtgatggaggaaaggggcggggccgaagggagggagaagctgaattgattggccttgraagggatgggggcggggcttaaactgagaaaaggacccagactccaacactgtcttgccggacggggcggggccgcacatgcgacacaccgattgggtct

SEQ ID NO: 78484 - DNA, 201 bp, Bos taurus
atggcggtgagagggacctgggggcgggcctgtgtggagagacggacaaatggacgggaggtagagacgggtcgggatggggagaggggaggagaggcagraggaagagaggttgaagagaaaggcctcatcaagagggtgtgagcaaaggaaaccagcgtgggggagattcacgcaggaaggtgtgtgtgtcagagaaac

SEQ ID NO: 78485 - DNA, 201 bp, Bos taurus; identical to SEQ ID NO: 38451

SEQ ID NO: 78486 - DNA, 201 bp, Bos taurus; identical to SEQ ID NO: 38452

SEQ ID NO: 78487 - DNA, 201 bp, Bos taurus
ggctagacacagcggtggcagcgctgggtcacgggccacatctgaggtcaattcttgcagtttctggagggcctgagatctgaatctctaattccttcccyctgcctgttcccacccttccccttaccccagggccttctacaaatcaatttcatccctttattctcaatttctacgtgtcgtcttgctctctttacttct

SEQ ID NO: 78488 - DNA, 201 bp, Bos taurus
cttgaaacaccctttcctctccatccctgcctctctgagtcctcagcaaccttcaggctcagtcttcaacatcactgtgtgtgtgtgtgtgtatgtgtgcrcttcattgtctggttttggttggaagagcgacatacatttaattatagattattcataaagtattactgcatatctactctaagccatctagttgtaggt

SEQ ID NO: 78489 - DNA, 201 bp, Bos taurus; identical to SEQ ID NO: 38454

SEQ ID NO: 78490 - DNA, 201 bp, Bos taurus; identical to SEQ ID NO: 38455

SEQ ID NO: 78491 - DNA, 201 bp, Bos taurus
caggagagaagctgtggcagtttctgagggtgtgagtatgcttcactcgctggtggtgtctatgcaggagaaggaccatataaacactggccccagtcacragtcccatgaacacagcatctgggaaagtcatgataatggtgtattttgcagcactagacatttcaggatttttcaaagaacacagcccataatcccgta

SEQ ID NO: 78492 - DNA, 201 bp, Bos taurus; identical to SEQ ID NO: 38456

SEQ ID NO: 78493 - DNA, 201 bp, Bos taurus
tgctaaataaacactggaccaccagggaattcccattggtcttgaattgagtgagtagcactggcttatctgacagttacaagaatagtagaatctccctsttgaactatttgctcctggttcttttgtttttgagggactttttagaaccttctcttttctatgaatgttggtctgcttctgcttcctatcatcctgtgc

SEQ ID NO: 78494 - DNA, 201 bp, Bos taurus
ggacggaggagcctagtgggctgtcctctctggggtcccacagagtcagacacaactgaggcgacttagcagcagcagcagcagcagcagcatgatgaggrcagtgatggagacttttttctccagtaagcttctccttaaaagttggttttatactatctttcaatttactctcacttgtcattgcttcctccaggttgc

SEQ ID NO: 78495 - DNA, 201 bp, Bos taurus; identical to SEQ ID NO: 38457

SEQ ID NO: 78496 - DNA, 201 bp, Bos taurus
tgattcctaaaatgtcttgccgtatcctgtttgaccacttgcaatttaccttgatttatggacctaacattccaagttcctatgcaaaaccgcttaaagayggcagagtagaaggatgtgcactcatcttctttgagacctccaaaattataactcactgctgaacaaccatcgataggagaatgttggatcccaccaaaa

SEQ ID NO: 78497 - DNA, 201 bp, Bos taurus
gcctgatcgcctggcccacgaatttacaaggatggcgagcgagtaagatgcccgcctacagcaagagaccatttgccatagggtaaaatttggcaccgaakaacattgggtgttacagggctggccgaggtcacctccctctacgcggggtgagaggaagggctgacgggaaggttggtctgcagggcagaaggaccggtc

SEQ ID NO: 78498 - DNA, 201 bp, Bos taurus
cacatcctgttgaagcctggcttggagaattttgagcattactttgctagcgtgtgagaggagtggaattccacttcagtattctggcctggagaacttcrtggacctcttatcaaagacagagcagaaaggaaataaatctataagttgaaaagccctgaggtactaattttagcttctcatttgcatcattggacaaag

SEQ ID NO: 78499 - DNA, 201 bp, Bos taurus; identical to SEQ ID NO: 38459

SEQ ID NO: 78500 - DNA, 201 bp, Bos taurus; identical to SEQ ID NO: 38460

SEQ ID NO: 78501 - DNA, 201 bp, Bos taurus
gcaatctgaaaatgatgccctctagctacacttggcatttatccttccaagaaaacattacttccctctcggagcattcttcattccaaaaagaatgtcakgggacgatgacctcagagaccaccagaacctgttcttgaatcgcctcatgccagctgtgatgatctcaattcacccaggaaggggagaagaatgcaagac

SEQ ID NO: 78502 - DNA, 201 bp, Bos taurus
caagctaagagaaaagttatgtctttatctctgggcctatgccctctgcccttaagtttttcataattgttggaggactgcagcacttttcaaattctcaytgtaactggccactcatcccagaaaaccaccagatgcaaaaacaagaccaactttgtaaattatttctctcagaggatctcatttgctcagactcagaaa

SEQ ID NO: 78503 - DNA, 201 bp, Bos taurus
ccccagggaatcaggctgacattctttgtttctagaagttcccgccctaaatcctccctttctgaggtctcaggtgtgctcagtgtgaggctgcagctccrggctcctaaatgcaggtcttcctcctgcgttatttccgaaaccctcagagcctgggcctggtagcccagttggcgggtccatgattgtctctcgtgaatt

SEQ ID NO: 78504 - DNA, 201 bp, Bos taurus
aatcaggattgcaggtttgaacgttttcaagcttcaggctcatcattttgacaggttatcttttacacagtcggcctttgtgatgacaaaagcagtttgtktttttttttttttttttactccatcatattgagagggtaacaggcaggaaggccaggggtctccaaaggaggaaacaggctgcaactgtttaatctcgcc

SEQ ID NO: 78505 - DNA, 201 bp, Bos taurus
cctgccactcaaaagcaaataatcaggccaggttggtgggaaggaacgtttgctttatttcagatgctggcaactaggttgggggaggatggtggacatcratccaaaggccaactccaccccaccccaaaaggggatgagagcttttatagacagggggaggggggctacaggcggaaacagcacagtcctctccaacag

SEQ ID NO: 78506 - DNA, 201 bp, Bos taurus
tcaaaagttcatcagcagcgtttgaacaagaaggaaacacaggtccagggaagtatatgacttgttcaagggcagagaggtggggccaagatcctaatcayggcttcctgactctttgaatgcttgccctcaaccataatgctcaactcggaccttagagtaacatggacagaagccccctgctcttaactcgtgttctct

SEQ ID NO: 78507 - DNA, 201 bp, Bos taurus
aaaccaaagcacagagatgagaacttgcccattctgtccttataccacctacccctcatcactccattgctccgtggaactggactcctagggccaaggawggatggacattcttgacggctttgtatgttgtttttctcagcagatcttaacctcttcaactctgtctaggatgctgcgtcagtatgttcgccagtttcg

SEQ ID NO: 78508 - DNA, 201 bp, Bos taurus; identical to SEQ ID NO: 38464

SEQ ID NO: 78509 - DNA, 201 bp, Bos taurus
gaggagtcctgctagcctcccgtgggtggagggaggccagagttacagcgaaacctccctcaatgcacaggacagctcacttccccaccccagcaagaaaycacccagtcccagggcttccctggtagctcagtggtgaagaatacgcctgccaatgcaggagacacgggttcaatccctggtccaggaagatcccacatg

SEQ ID NO: 78510 - DNA, 201 bp, Bos taurus; identical to SEQ ID NO: 38466

SEQ ID NO: 78511 - DNA, 201 bp, Bos taurus; identical to SEQ ID NO: 38467

SEQ ID NO: 78512 - DNA, 201 bp, Bos taurus; identical to SEQ ID NO: 38468

SEQ ID NO: 78513 - DNA, 201 bp, Bos taurus; identical to SEQ ID NO: 38469

SEQ ID NO: 78514 - DNA, 201 bp, Bos taurus
caccccgtttactgagcatttattttctaatctgtcaaaaaggccaccgtagcttagtgagaatctggaattactgcctggcctaaaattctaattccctyattgaccagtttttcaatgtattttttgtaaattagtcaccctcttagcacctcagtatccttccctgtttggatttttatttattttgggccacactgt

SEQ ID NO: 78515 - DNA, 201 bp, Bos taurus
agtttgggattgtctgttgcctgggttctcagccggggtgggggtggggggggggggcaggtgggcgatggtatccccagggggcctccactgagggcagyggagatggtttcagttgttacagctcggatgctactggcaggtggcgggtgagagccggggtgctgtggggccgcctccagggcagaggacggcccagtt

SEQ ID NO: 78516 - DNA, 201 bp, Bos taurus; identical to SEQ ID NO: 38471

SEQ ID NO: 78517 - DNA, 201 bp, Bos taurus
ttggagcagaagccggcctcggttcccccaggcccaattagaggctcctggagttttcaagaggccgcagaggagacctgaagagggcaggagtggccagycttggtcactcaggagctcgagcgccaggaagacggtctgccagaggggctccctgggttcccagaggccctgagatccggaccccaggagagcccttgc

SEQ ID NO: 78518 - DNA, 201 bp, Bos taurus; identical to SEQ ID NO: 38473

SEQ ID NO: 78519 - DNA, 201 bp, Bos taurus; identical to SEQ ID NO: 38474

SEQ ID NO: 78520 - DNA, 201 bp, Bos taurus
aggggccatgtgtgtagaaggagaggtgcaagaggatgaaaggacaggcacgaacaggagtctctgggagctgtgatgtagggagacatgagggggcttcyggaggatcctatgaggagttactgtgcgttgagattcatgtcagggcttctactgatacagttccatcggactcacggagcagtcgcataggagggccag

SEQ ID NO: 78521 - DNA, 201 bp, Bos taurus; identical to SEQ ID NO: 38475

SEQ ID NO: 78522 - DNA, 201 bp, Bos taurus; identical to SEQ ID NO: 38476

SEQ ID NO: 78523 - DNA, 201 bp, Bos taurus
agtcagtagcttccatgtgattttggtccactcaggctaaaggacttagtgatttttctaagaggtcgggtggggtggggggaattccctggccatcctgyggttaggaatcggtgcagagagaacgggttcaatccctgatcggggaactaagatcctacaaggggcgcactgcggccgaaataaaaaggacgacttcca

SEQ ID NO: 78524 - DNA, 201 bp, Bos taurus; identical to SEQ ID NO: 38480

SEQ ID NO: 78525 - DNA, 201 bp, Bos taurus
gttccttagtaagatcacactcaatctcccctggtgtttgtattttaggaagatggtttcagatgcccgcacagccccacacatcagacgatgacgaagcrccactaactgggggccacaaactcattaatgacaacctagtctccatgtatcatttctcccaagtctctgggatgtgaaggaagaaacgcctctcgtgtg

SEQ ID NO: 78526 - DNA, 201 bp, Bos taurus
tcccccagccctgtcgccggctctgtccccttcagactgggccctcacagcaggcacttcccataaggtctgctgcccctgcgcgtgggccgattgctccygtgtgcaactggtctgcaaacgtgtgagtctgccggtgaggcaaggtgagcaccgactcctgttctgagcgccgtcagtgtagaaccctaggcagaggtc

SEQ ID NO: 78527 - DNA, 201 bp, Bos taurus; identical to SEQ ID NO: 38481

SEQ ID NO: 78528 - DNA, 201 bp, Bos taurus; identical to SEQ ID NO: 38482

SEQ ID NO: 78529 - DNA, 201 bp, Bos taurus
actgggtatctggaagggagacactgggcacgcctagtgcaggtgagcaagagggaaagcactgcttttgtacatccagaaaaggctctcttgcctgcagrgtctgtgcccaactcactgagaaacaccgatgtgtaatccggccacagtgaatggctgtgctcttgctcgctgaacatcgcctgcccaaccagtccgatt

SEQ ID NO: 78530 - DNA, 201 bp, Bos taurus; identical to SEQ ID NO: 38488

SEQ ID NO: 78531 - DNA, 201 bp, Bos taurus; identical to SEQ ID NO: 38489

SEQ ID NO: 78532 - DNA, 201 bp, Bos taurus; identical to SEQ ID NO: 38490

SEQ ID NO: 78533 - DNA, 201 bp, Bos taurus
ttggtggaaaactgcacctgtgcaggaggagactttacaaggcaggcaggcaacagctcagggcaccatgacctgactgaggctcagaggcctcaaagacrtaacttactgaccagagggtaggcgtgtccctgaacacactggagcatccctggacaccctcactggcctgacctttttagcgtcagggtatctgagtgg

SEQ ID NO: 78534 - DNA, 201 bp, Bos taurus
tggccaccactggctgggcgggatgtgggggccgctgaaacagaggcacaccgcctgcccttacctggctcctcggtaacctcggactcttctttcacccrcaggcccagtgttgactgctccgtagccccagggagcatctccagcccaggttctggagtctcaggtatgggctgagggagggcctggaagtcggggggc

SEQ ID NO: 78535 - DNA, 201 bp, Bos taurus
caggagaagacacagttaactctcagttaagatttagctcttccacaaaagacactagacacatgcagatagcatagggatgataccacacaagaatattrcttcaagactgagaaaggtaactttaatctaatttcataaagacaaggagagaaagttaatgaagtgagaaaacaaagaaatatgtttaaaataaaaaga

SEQ ID NO: 78536 - DNA, 201 bp, Bos taurus
ttaagggaaagatagcaaaaactttctgagtcttctgtttcttaaaaataatcagtctaaattaatcttcatgccaagcagagtattttggggtggcaaakttttctccccaacagagtcaattataaaattttcactaacaaaacaaaacagaacagctctagactaaaagctttaagaaattgttaactctaatcttat

SEQ ID NO: 78537 - DNA, 201 bp, Bos taurus
gattgggttgcttcaggccaaaacacgggggcgggggggagcagagttctgtcaatcagcagaaaattggattaaatatttgttgagcatggccctgaacyacagccagtccctctcatcaggaaacttgcacaagtctctaacattcatccatcaaagggcagacagaagaagcaaaaaacttcaatcccatggccccca

SEQ ID NO: 78538 - DNA, 201 bp, Bos taurus
tctcttcttaaacatcttcctgctggacaggggctgcatactttagcctttattagtggcatagaagtccctctctgaatgtcccaaggacctgtagggaygtgggccactctccactgaaatgtgttgaattccttgagctatcatgagacttcaaaatactgtagcctagaagacatgtgtgtgtgcacgtgtgctaag

SEQ ID NO: 78539 - DNA, 201 bp, Bos taurus
acagcttgagaatccatccaattgctcttcccttacctctgacagagctctcattgctgtagactctggcagtttggaaagaaggtggaccctaacccttmaccaagtaggcctgggtcccacttcaaatagaaaggcaatagccaagctgaggccagtaaggggctagtcatgtctcacacactcccacagcctgctcct

SEQ ID NO: 78540 - DNA, 201 bp, Bos taurus
cttcctgggacacccacccaccagctggccaagaccagaactgagatggtccaagccattgagtcatctgttccaggggttggccccattcaccaaaggcragaagctccacataaggcaggggctggcagccagccagcacagggctcagcccagtttaaagagcacacacagcatttcacatcaacacaagagaagggc

SEQ ID NO: 78541 - DNA, 201 bp, Bos taurus
tgcaattaaaagacatgtgtctcttggaagaaaagctatgacacaccaagacagagtactaaaaagcagagacatcacattatcaacaaaggtccattagmcaaagctatggattttgcaataataacatatggatgtgagacctggaccataaagaaagtcgagtgctgaagaattgatgctttgaactatgctgttcgt

SEQ ID NO: 78542 - DNA, 201 bp, Bos taurus
gtaccaaagccattcaagccttgaacaaagaacaaattcagatgaggaaggcagtaattcaaaataagatgatattagacatactcacaacagcccagggkgggacttgggccataattaaagttgaatgttgagtacacatgcctgacgtgtctgaaaatgtatcttctgccttggaagatatgcaaaatcaattgaaag

SEQ ID NO: 78543 - DNA, 201 bp, Bos taurus
ggcaagagtactggagtgggggtgctattgccttctctgtctagctgtacagttagaatcaaatgtcttaacatctccatacttaggatatctcaactatyagctaagtgtagatcatatgaatagtatctcctagtagagttgtttcatactattcatggggttttcaagacaagaatactaaagtggtttgccatgccc

SEQ ID NO: 78544 - DNA, 201 bp, Bos taurus
tccttgttagtttattggttggagtcaatccagtcctgggctctataggcctatggtagggttagtcatgacctccaagagggcctatgccaagagggccrtctagaacttctactctcattgccctctttcctgtagtgagccctgctaacccatgcctccacaggagacctcgaacattagcaggtagttttgatttag

SEQ ID NO: 78545 - DNA, 201 bp, Bos taurus
ttgtttggcctcactgtacttcagacacacaaacttgtgttcagtaacagtgacaggctagggtctgctctaaagaaaacatcccctcactaatgactgarctaagttgtggtacaagggccttgacattttctctcagtgtgagactcttctaccaggtgtgaatgaaaatattgcctgtgtcaacttgaaaaaaaaaaa

SEQ ID NO: 78546 - DNA, 201 bp, Bos taurus
caactcagcaaattctaatatattttcatcaagtatttgacactttgtctgccaattaatagttggacattggtaacaagaaatgtacttaacaaaaatargctgtaagagccaagtcaaggaaaagaatgcttttgtctcaagtaaattgccctgagaatagattaactatacataaaaagaaattgacattagttgtaa

SEQ ID NO: 78547 - DNA, 201 bp, Bos taurus
ggttctttgggacactaatccatcatctatttctgctggccttctgaatagtctctattctttgctccatcacttcatctctctgtatattggcctgcatrcagtgagcaatgcaagcttgggcttggtaacacatatattaacctttagactgcatgccaacaagcagattatggtttaagtcaaggggccaaataactt

SEQ ID NO: 78548 - DNA, 201 bp, Bos taurus
tttgattgtctgacattggttcattaatgttcatgatcttgctttctttgtcctccaagctttgcagaagcaggcatatgttttacagaaccaaacttgaytcaattcactcatgcatagtcaagcccatttactgacaccaggttgtgatgaaggaaattgcagcatttattgtagggcatagtataaggagaatgggtg

SEQ ID NO: 78549 - DNA, 201 bp, Bos taurus
agatcctacataagttacaacttagaatcaagctgtgtcctaaaataagaatgcaatataacctagagagtttcatcctgatttaactaaggagatcataygattcattgtccaaacatagcatttttgaaagtaaaagagggttatattaataatgactttctcatatgcaacattcaatttttatagactgcaaggaga

SEQ ID NO: 78550 - DNA, 201 bp, Bos taurus
tctcccagcctcttgccagttttacaacccatgaatgtctttctccaggagccatccttctaaactgtaatcatcaagaaagatagcacccctatctctcygtctctgtgggagggtagcaacctaactttgacaagcaccaattagcaaatacagattgcaacagtatggagtaaagccttccttgcctgtttaactcag

SEQ ID NO: 78551 - DNA, 201 bp, Bos taurus
actgttattcctttgattcaggtgagaaactgggcgcagaggagttcagccactcacccaaagacacatagtaagcaaacagggattcaaaccgccagtcyagccccaggagttgctctctttattgctagcaaatgatgtcttcttcctactacactgtcaactcagtacagagcccacccctgcagagtgaaatagata

SEQ ID NO: 78552 - DNA, 201 bp, Bos taurus
aactgtaagctgagcactattgataatgacagttggaatctcaggacataacttgaagaacccacacccacagctcagcagggatagagaatggcccaggygatactgaaacatccttcgccctcaaagtgggaatgctacttgtaagcctgagatacacaggtggaactaaacagaaggaagtgccatctgcccaaggcc

SEQ ID NO: 78553 - DNA, 201 bp, Bos taurus
gctttctctaggcataaataggcaagagggaactttttccagaaccagtgggaagagttgcacacggcaggcagccgtgagggcagtggtgtctgtggccraaggagcaacgatgacaaggagcctgaccacatccccctgcactctcccgcctcctccccgtgggtcccatccactgagccagtcagaagcgagatggca

SEQ ID NO: 78554 - DNA, 201 bp, Bos taurus
tttaacagaagtattcaagaatacattattatttcaacatctttataaatgtcaacgtgaaagaattcagacagaagctgggtgtgtgaaagtgcttggcrccttgcctgtcgtgttgtgtagttgctcagtaagtgctgaagcagaatctagacagtgtggaagaggccttggcaaatccctgaagtcacaatcttctca

SEQ ID NO: 78555 - DNA, 201 bp, Bos taurus
tgacaaaattcaacattcattcatgataaaaaacccttaccaaactgggtgtagaagaaacatatctcaatgtaataaaagctgtgacaaacccacagccratagaatattcagtggtaaaaagctgaagaccttatcactaaaatctaggacaaggatggcaattctcaccacttcttttctacatagtattagaagtcc

SEQ ID NO: 78556 - DNA, 201 bp, Bos taurus
tctgccaaccaattaacctccctgagggccaattgccatgaacattaaatgacaaatgggtatactttcatgtgagtcctccccacacaaaaagttctccrttcattcctctggccccacttcaaagctgcatcttcattttcacaagtgacaaagagcaagacaagattctccatatccaaaatagaaacggttcattcc

SEQ ID NO: 78557 - DNA, 201 bp, Bos taurus
catccactgcagatctcagcagccactagaagctggaaccaagcagagcctggctaatgagaatctccatcctctgccagtgcctgggggcccatcccttyctctctggcaagcaggatacaaagagagctcaaagcagagtgaggaccaaaaggtcacccagaacattcattctgcaagctccccaccaggcctttctga

SEQ ID NO: 78558 - DNA, 201 bp, Bos taurus
gaagtgacttagcagcagcagcagcctcatagagttgcagagccagataccaggaccagctcagcctcactcaggccccagacacactgaaactctgagayaagaaatgttgatacatttggtacagagtgtaggtggctaatcctccacctcacttcactcaggtctcttctcaaatgtctcctaacacatccaaaacca

SEQ ID NO: 78559 - DNA, 201 bp, Bos taurus
tttttcaactcctgcactggtgccctccgcccacagtggattcacaataaccacagggactcctctaagtaacctcaggcagttaggggcccattaagacsttttagaactaacacacaaaaaagatgtccttttcattataggggagtggaatgcaacagtaggaagtcaagaaacacctggactaacaggaaaatttgg

SEQ ID NO: 78560 - DNA, 201 bp, Bos taurus
agtgcctagcaaagagccttacatgaggacatgctcagtgaatactggtccttctctccctcctctctccatcaccaagcaccaggcctgtgtctctttcmtattgagatctggtcttacattattctggtaaacattaataatgttattcttctttacaagccctgtatctggccaatgctgagactatagacaactctt

SEQ ID NO: 78561 - DNA, 201 bp, Bos taurus
tctcctttgttaacagttgaactatgcaccctcctcctcttcacctgcaggtcaaatcctgcaggtgaagtgagctcaagtcccacctaagggctgaaaaycatgatgaaactaagccagaaatagtgatgcagccctcttgtctgcagatggcttggatgtgggcatagagcacaatcctcgccaatcatgactaacagg

SEQ ID NO: 78562 - DNA, 201 bp, Bos taurus
attgttattgtttctagagattggtctgcttggcacttactccatcacactgaaagtagaacttcagaagatattcaacagctcctatcaataacttctaygtttatcattatttcatgatcagtcttctctttctgagtcacagaatcacagatatcctgtacaggcattgtgaaacagacagacaaaaggaacctagat

SEQ ID NO: 78563 - DNA, 201 bp, Bos taurus
acgtctatggtgaattaatgaaggccaagaataaaatttggatccactgacactcggtttgaactctttccttcaagccatgctgcaggcaacaaaatacyggccccagtagattcctgggggaaggaaaggggaaagaagtgccagcctaaagtgccattcctcacctgctacaaggacgcttctagcaggggtatgtcc

SEQ ID NO: 78564 - DNA, 201 bp, Bos taurus
taggacagaataactctaagggaataacttcttgtgcaaaattttccccaaatggaggagaaaccatgtttaatcatttttcctggattgttgtctttctyaagattctcacctccttcctcgtgtgcttggtaccccaagtcacatgcccagagtaaacactctcaatgactcaaagttactgcatcatgattcctaggc

SEQ ID NO: 78565 - DNA, 201 bp, Bos taurus
gtagtgaacctgtgcttttggcgctctcctgggggaggaacagaggtttatcttgaagaatctagaagtaaacaaggagtaaagagacctgaattctggayctgatgttaatcggtcaactcatttctgctttctggatctgagtttcatcatttgcacaataagagtttgcctagctctcttgatgagttctggatgttt

SEQ ID NO: 78566 - DNA, 201 bp, Bos taurus
acgggggaaagttggctcctagcaaaggcagcacaaggcagggggtggaatgcctggtccatggctaggtattttctctcccactccttttctgtgggtayagtggtcacagacagcagcaatttttttttttccccgatactgctatttctcctagtgatgcatgggtgaggcaacaaaggggaggggaggcgttgtttc

SEQ ID NO: 78567 - DNA, 201 bp, Bos taurus
tggtccgcccctgatgaggtcaccttgttatgttaaatatttctacctcctggtggaggaaccgaagctgattgctctcaaggccacctctgcccagaacrgagaacacagcacccaaggcaggatatacactttccaaaggcttaggtaggctcctctgtgaactagaaagattcctttcaggccccaggaccagagcat

SEQ ID NO: 78568 - DNA, 201 bp, Bos taurus
gatggcgtctgagacagggaaatcactgactcccagctcaggaatgaacaggggccggattcttgacaggctttttacgacgggatcttctgctgagggaytgcggggaagacagcattcaagaaatactgcatttagttggaacatgacagggggctggtggtgaaatcagcatcatcaccccagaagaagcagagaaag

SEQ ID NO: 78569 - DNA, 201 bp, Bos taurus
tgggccactctccactccccacgctcaccctgcacgtttcgactcccatgactccactcacgtgaccttctcaatcccacatactctccccacttcccgaycctttgatgtctccctcggcctccagggctccgctcagaagtgaacccccgtgagaagtctgccctaaccccctgctcagatttcagcacctcttcactc

SEQ ID NO: 78570 - DNA, 201 bp, Bos taurus
gtcagcggcctgctttgatcgccacaaaagacttcacctgcccacttgaaggaaacaagttaatatatagccctagaatggtagaacgaggcagatttgcrgtaatttatcgagtgcttctggcccacactccttagccaacctgcccttttggggtaaaacttggctcttaactttcatccagaggtctctaagtgctgc

SEQ ID NO: 78571 - DNA, 201 bp, Bos taurus
gaagcaccccgacccgcgtggccttggtggagggcagggttttctccacattgttgtgccaggcggagatcttggtgttgaaccactccacacaccaggaygcgttgttgcggccaagccggctttcggggccctgccgctccatgctgccgtagcagatacccaccccgcagaagttgttcttctgcagctccacctccc

SEQ ID NO: 78572 - DNA, 201 bp, Bos taurus
taggcagtctgcaaggacttcctgtgtgcaagtcttgtctgttttttgttctttaataggtggtgcacataacacaatacatgattccaaagaaaaacgargagaagagggcaccgccacctccttttctgtcccccagacacacgtctcctctttgggagactgttatgaggttcccctgttcctgctcagcacatgtga

SEQ ID NO: 78573 - DNA, 201 bp, Bos taurus
ggacctctgcggttggaaggacacagaggcaggaaccttaactcaggcttgaaagcaaagtaacgagtctggctgaagctgcctgggtagcagagtgatcmctatggcagaggaatcaccgcactacgacaaaagctgaaagcatgcagtgccggatgcctctaggaagggtggggctgttttaaaaggacactgtgcacc

SEQ ID NO: 78574 - DNA, 201 bp, Bos taurus
ctctgctgtttagtttaatgagagggtggagtgaatcttcggtgctgtgatttttcatcctgttaactcttttcaaaagggccccttatcttgtgagcagrgaggagtgatgtcctatacgtgggatcactgtgtatcttctctgtgaaacttcaatcagtcaggagtggaccttcagtccctgcctgttcgctgtaagaa

SEQ ID NO: 78575 - DNA, 201 bp, Bos taurus
aagccgtgaacccttgttctgaagtgagggtagaaaagatgcaagatggggtttctgtccacgaggtgctcctggttggggagagaggtttctattcagaytccctttcccctcgaccatgactctgacctctgcattcccccagggtttgtttcgaggccaggttgttgcctgctgggtcctgctgcttcctgggcgttt

SEQ ID NO: 78576 - DNA, 201 bp, Bos taurus
aaggctcctgcatcttctgccgtgccacctctccctcccttggggaccttctgaaggcatggcaccttggtcccttcttctaggatctgggttccagaagygtggccaggaaggggattagcctgaacgtcgccagcctccctgtgcgtgctgcagcagctcctgcctggatgagaatgttgttgttcagtcgctcagttg

SEQ ID NO: 78577 - DNA, 201 bp, Bos taurus
ggacacacacacacatacacctctttcctggatctgtgctcgcacatcccctgcaaactccaccaccacggagagcccactggccttggaaatggcatcargggcttagctgtttccagcatgtttggggtgaccagtgaagctgggctgcctaacaggacaggagcggtagcagggagcaggagaagcaggcccagaagc

SEQ ID NO: 78578 - DNA, 201 bp, Bos taurus
gaagctgcggatgacctctgtcgtggtcgctctgcaccctagggagtgtgcccgctcggggcctccttttacttggcccctagtggctccgtgctgcccayctgcccatctgccctccctccgtctcctgactccttgtggtttcccagtacgccgtgcagggcctgctctgcgtcctgcagctcaggttgcccgctctgc

SEQ ID NO: 78579 - DNA, 201 bp, Bos taurus
ttcttttaaaggttccataccacacctctgtggggcaggccgtactgaaccaccctaaaaccccgcaggtttggtgacagatggacttcgagtgttgcttrtatgatgggaaagtgcaagcatgggcctcaggtgggcctcaggccgaatcagctcagacttaacttccaccaaatggtaccctctcctttgcatgctgga

SEQ ID NO: 78580 - DNA, 201 bp, Bos taurus
aaaggaaaagctctttccagtggtatagcctccaccccaaatatattccaccgcttaaaacggggatataatgacactacacacattgagttagcagtcayttatctccattaccgaaaaaatgatccatttgcaaaaaaataaaaaattaaaaaatggtgcttgttaatgcctgtccagatgctcttgtgaacactgggg

SEQ ID NO: 78581 - DNA, 201 bp, Bos taurus; identical to SEQ ID NO: 38495

SEQ ID NO: 78582 - DNA, 201 bp, Bos taurus; identical to SEQ ID NO: 38496

SEQ ID NO: 78583 - DNA, 201 bp, Bos taurus
acttctccgactatgtatggctggcctgggtgggcaggagggaaaaggaagctgtttcctggagtcattgagacagaggcctcaggggaccaccagccagygctccttttggtggatttgtggctcttccttgagttacactctgaaggggagtgctttttatccacagccttggtttccagtttggcctaaattctgcct

SEQ ID NO: 78584 - DNA, 201 bp, Bos taurus
tagcttatacctgcttataggtcctctccatcacatgacttttccccagatgaaaccacttatttgaattttgtgtttatcattccattacttataaaagyaatctcatcacatttttacataatcagcatattgttttattttgctattttgagcttcatacaaatattacattgtatataatattcctggatttgcttt

SEQ ID NO: 78585 - DNA, 201 bp, Bos taurus; identical to SEQ ID NO: 38498

SEQ ID NO: 78586 - DNA, 201 bp, Bos taurus
accagccatggggggcagttcagaagtccgggggctgccatgggagtgactccaggacgtaagggctgcctctcagggcctaaattctagcacaagagaaraaccttttctctgagctccacccccaccgaccctagcccagaaaactcccctccctttgggacagcagtggaactcagaccgggccacggctcctgtacg

SEQ ID NO: 78587 - DNA, 201 bp, Bos taurus; identical to SEQ ID NO: 38500

SEQ ID NO: 78588 - DNA, 201 bp, Bos taurus
agcgacttagcactagccaagcaaacaaacaaaaacaattagaatatgggcaaaatacaaaacagaaacttctccaaagaatatacacaaatggccaaatrgatatgtaaagatgctcaacatcttcataaggtacatgcaaatcaaaaccacaatattacttcacactgattagcatggccatcataaaaaaaaaaggac

SEQ ID NO: 78589 - DNA, 201 bp, Bos taurus; identical to SEQ ID NO: 38504

SEQ ID NO: 78590 - DNA, 201 bp, Bos taurus
atgggaggaatgcagtcattttgttttaaccaggattagcctctctgagcatggccaagcacaaaagaaggactgacactgaaggtgccaggccctggggrctgcaagtgggtcgatctggtttctttgaaacgtggagcagaggcaaggtcaacggaccctttccttcttggcctgaaccaagtctgacactgcgttttc

SEQ ID NO: 78591 - DNA, 201 bp, Bos taurus; identical to SEQ ID NO: 38506

SEQ ID NO: 78592 - DNA, 201 bp, Bos taurus
agatcatgagaaaggtgacaggatatccacatgctattaagaacaggtatgatggaagtgagctggaaaggcagttggctgaggctagagagagatgtctrgggtttcgagttaggaaatagaacattaagtgatacaaagtccagagtgtagctataggaataggtatgtacagtgcagtcaaaaagctgtcattaagca

SEQ ID NO: 78593 - DNA, 201 bp, Bos taurus; identical to SEQ ID NO: 38509

SEQ ID NO: 78594 - DNA, 201 bp, Bos taurus
tgttccaggaagctgcaggctctgactccaaccagctcttcagttccttgtctgaagtagccatacagatgccaccaagaactccccacctgtgagcataytttgcccacattgcaaggttgtgggtccactactcaaaggtgacagattcttgtatactgtctccctgcccttctggggttttcatgggctctggaatcc

SEQ ID NO: 78595 - DNA, 201 bp, Bos taurus; identical to SEQ ID NO: 38511

SEQ ID NO: 78596 - DNA, 201 bp, Bos taurus; identical to SEQ ID NO: 38514

SEQ ID NO: 78597 - DNA, 201 bp, Bos taurus
atagggtgataactacacctaatttggataattttgatgaggagatgtgaactttgagtctgatgatattttaaagagattttactgttaagaactgatgytgtaatgtgctgagatttccagggatgtttgtatggggtaaacgtattttgcacgtgaaattatcctgaatttgagggttcagagagggtggactgtaat

SEQ ID NO: 78598 - DNA, 201 bp, Bos taurus
aatcacacgtaccaatgagcactactgtcctcacaatctgaagaatattacaagaatactcacagaactaatctggactgtaaagtgctgaacctaagacyataatgtatgtgtcagataatctactgtgaccaaaacttcaaatgaacatggtactgattctgttctactgcacagagatttgccaaaggtcactagtca

SEQ ID NO: 78599 - DNA, 201 bp, Bos taurus
atgtttcaaaatattcatcaaattttccatccacaccctggcttctccatacctcatcctccttgttaccattacaggccttgttactgttaaaagcatcmcctcaatttgtattctagtccctgtttgctgtcctctcaagagctctgctccaccaattatcctttcttgctcttactaaggtaggagataggtgggccc

SEQ ID NO: 78600 - DNA, 201 bp, Bos taurus
ttttctttctctgacttaattcatttagcgtgataccctttagatttatgtgttgttgcaagatttctccttttcaaaaaaattgtgattgggtagtactytatgtgtgtataaatgtatctcataccatttttatccattcatctattgatggatatttaggttgcttccatatcttggctgttataaataatgctgcag

SEQ ID NO: 78601 - DNA, 201 bp, Bos taurus
aatctgaatctctatccaaaaatttattgaacatcgtagtatttaagattctttgattggtgttggggtacagattaataaggtcgtttctttgttctcaygagcagaggggcgatacacaattaaatcaatgaatacagtgtaagttgtattatttaaagggtgaagcattgaaaaattgatgctaagtaaatggcgatg

SEQ ID NO: 78602 - DNA, 201 bp, Bos taurus
ttgaatgcatatttttggctactgagggaaataggaatataagaatatcttggcacaaagacatctcagttcttaaaactggcattttagagcccacataktcttaaatgtagctacaagggagcagttgcatatgacagcgccttgcagttctcttagtttggctattgacttccctccaggtttatttttaccagtaac

SEQ ID NO: 78603 - DNA, 201 bp, Bos taurus
aggtgtcactcactggaaagtaaagttctttcttgttttttgtcttttattgtgggtccagagcataaatccttcttacaggttctccttttgcttttttytaattatagcagaatataacggttaatctttgtttttgcttgtctgtcctattgttaggttggtgcaaatgtaactgcggtttcagaccatgaattttaa

SEQ ID NO: 78604 - DNA, 201 bp, Bos taurus
ttcctggagtgtgaattacctttcagttgggtctggaaaatgggtaggaatttccggccagaaaaagaggacagcggggcgcgccaggcagggaggccccraagagcacgcagggctggaatagcacagaacttagtgcaggagtgacagtgagactgaaaaggcagctcctgcctggatcccagggtgggggtggggatg

SEQ ID NO: 78605 - DNA, 201 bp, Bos taurus
gtggagatgggactccacacttccaaagcagggggtttaatccctggttggggaactagggttccacatattttgggggaatggcccaaaatagtaataakaaaataaaaataaaataataaaaatagaatcaagcagaccagagttcaaatcctggttctgctatttttctggctgggcaccttttgggaagggacataa

SEQ ID NO: 78606 - DNA, 201 bp, Bos taurus; identical to SEQ ID NO: 38518

SEQ ID NO: 78607 - DNA, 201 bp, Bos taurus
ctggtgggatccataagttacagtgtatcaaacttgtttaagccttctcttctgaaactctctccactcctttagctctaaatcccaattcaatgacactracctccccatcatcaccccacaagctaatcaatttctcataccctctcatatcagtgtagcccaactctaggaaaaccttgaaatctttctaaaagcaac

SEQ ID NO: 78608 - DNA, 201 bp, Bos taurus
agcagtgggccgtgaatggaagtgggttggcagggcaccattcagattaggaactggcttcattttcctctcttgcttttctcttttcagaagctcaggcrgaagccaaaaggcccatgttcattcaaaaccagactgtggctatcttgcagtgtcttggttctgggagcaaagtgaaagttaaccttgtacattcagaaa

SEQ ID NO: 78609 - DNA, 201 bp, Bos taurus
actagagagtagcccctgctctccgcaactagagaaagcctattcaacaacgaaggctcagtgcagccaaaataaatgaataaaagggcttccctgatagytcaattggtaaagaatccgcctgtaatgcaagagaccctggttcgattcctgggttgggaagatctgctggagaagggataggctaaccacttcagtatt

SEQ ID NO: 78610 - DNA, 201 bp, Bos taurus; identical to SEQ ID NO: 38521

SEQ ID NO: 78611 - DNA, 201 bp, Bos taurus; identical to SEQ ID NO: 38522

SEQ ID NO: 78612 - DNA, 201 bp, Bos taurus
aagtaatattgaccataatcccttccctcatgtgcatttttgttgacttcctttgaatcgctagcctgtcttagagattcttcagcccacgtgtatgatakgattgtccctggttcatgctggaaatggttctagaaacagactcacagatttagagaatgagcttatggttgtcaggaggggaggaggctgggaagggac

SEQ ID NO: 78613 - DNA, 201 bp, Bos taurus
gattcccagggagcctagcagaccttctatctctgactctccacccacagccaacaataggtcctctgcaaacatttgcagaatgactcactctccactcrggccatacacactatgcgtttatcattcattcgttcactcactcatcacacaattattgagtacctactgtatgccaggcacagtgctcagatcgtgggg

SEQ ID NO: 78614 - DNA, 201 bp, Bos taurus; identical to SEQ ID NO: 38523

SEQ ID NO: 78615 - DNA, 201 bp, Bos taurus; identical to SEQ ID NO: 38524

SEQ ID NO: 78616 - DNA, 201 bp, Bos taurus
acttggtgactgtttgatgaatgggcaaatgacagaaacatgacctcaggcttcctggtcctctggcgggaattccttaattcagttccttccatccaaargaggcttgggccactgtcccgggcaacatcgcgcctgccctattcgtgtggttagagcaactgaagaagcacagcactctcagttctgtggaaaagtctg

SEQ ID NO: 78617 - DNA, 201 bp, Bos taurus; identical to SEQ ID NO: 38526

SEQ ID NO: 78618 - DNA, 201 bp, Bos taurus
actgtcccaccacccactgtacagtcactgatgcaggacaagggatattctatcctctccatgccaaccgcttcacatattcatagcccagactcttctgyttggccccaaaactaaaggcttactgctctttagttataatgtaaactgccctcattccagtctgcccagcactggccttcatgacctgaatacaagtta

SEQ ID NO: 78619 - DNA, 201 bp, Bos taurus; identical to SEQ ID NO: 38529

SEQ ID NO: 78620 - DNA, 201 bp, Bos taurus; identical to SEQ ID NO: 38530

SEQ ID NO: 78621 - DNA, 201 bp, Bos taurus; identical to SEQ ID NO: 38531

SEQ ID NO: 78622 - DNA, 201 bp, Bos taurus
cccatggatttgaggggcctggtggtctagagtccttggggttgcaaaagagttggacacgatttagtgactaagcaacagcagcaattttacatcatttmaacatcatagcattgaatttttatgtacatgtctccttggacacacgtgtgagagtgtttgtagagattatacctagaaatggagctggggtttagagct

SEQ ID NO: 78623 - DNA, 201 bp, Bos taurus; identical to SEQ ID NO: 38532

SEQ ID NO: 78624 - DNA, 201 bp, Bos taurus; identical to SEQ ID NO: 38533

SEQ ID NO: 78625 - DNA, 201 bp, Bos taurus
ctggccgcccgcacaggaggaggcaacagggatttggaaagagagatgaggaaggaggactgtgcttactgcctagaccacaggggataagactcttcacrtggccagtgggataggaattctaaagtttccatccattgtcttcccaacagccctctctctcccttgcttctttcttgctatcagaattcagatactagc

SEQ ID NO: 78626 - DNA, 201 bp, Bos taurus
agggatggagagtgaggctgagaagattcaaagggagggagcagggctggggtggagactgaggagcctagaaacctgagaggcctggggtggtaggaagkttgaggtttgaggtccctgcctctgatcctgaggtcactgcctgagctcctgatgagtctcatttatcagcaagcttaggatattgtttgcaatcctgac

SEQ ID NO: 78627 - DNA, 201 bp, Bos taurus; identical to SEQ ID NO: 38534

SEQ ID NO: 78628 - DNA, 201 bp, Bos taurus; identical to SEQ ID NO: 38535

SEQ ID NO: 78629 - DNA, 201 bp, Bos taurus
atgtcccttaccagactctgcctacttcctacctgtggtacagtatcatctgcactgaatggagagggaagcggaggcccagaaagagaagctgatgtgcmtaagtgcacaggcagtcaatgctgctcttgtgatcagcaccaccacctcctgcctcccaggcctggacatttgcagctccgcgtgctcccgagtagactg

SEQ ID NO: 78630 - DNA, 201 bp, Bos taurus; identical to SEQ ID NO: 38536

SEQ ID NO: 78631 - DNA, 201 bp, Bos taurus; identical to SEQ ID NO: 38538

SEQ ID NO: 78632 - DNA, 201 bp, Bos taurus; identical to SEQ ID NO: 38539

SEQ ID NO: 78633 - DNA, 201 bp, Bos taurus; identical to SEQ ID NO: 38541

SEQ ID NO: 78634 - DNA, 201 bp, Bos taurus
aagggagtggcagaggatgagatggttagatagcatcaccgactcaatggacacgcatttgagcagagaaacaagagacagactggagctgcattccactycagcctgaggagtccttacaccctgcttctcagggtaccccaggctctccatctgaggaactccaggttctttgctgtccctaataagttgtgattttat

SEQ ID NO: 78635 - DNA, 201 bp, Bos taurus
gaactgttttatttccttccacgtctagcatccaacactcaccatccggtgaaatgtggtcatggggacggtgcagagttaatacaaaaaaagtgctcagkactgactgtggtgctctgtacacactcaatgttagtcttcattactatacttaatatttttctgattttcccacagggtgataaatggtgtgctgcgtgt

SEQ ID NO: 78636 - DNA, 201 bp, Bos taurus; identical to SEQ ID NO: 38543

SEQ ID NO: 78637 - DNA, 201 bp, Bos taurus
tggggtggggaggcaggatgactcagatgcctaaactctcattactacatgaccaggaggcatttctaagaaggaaggaagtggtcagtggccacttcctrttgcccttatgaaaagccctggttttaaaaggcatgacctgcacccaacctcccacaacaaacacatcctttgctttcttacttccctgttgctatgctc

SEQ ID NO: 78638 - DNA, 201 bp, Bos taurus
agtcagaggtgtggacaagctgcagtggaggccccagctaggaggagacactaactctcaccagtttaggcatcatctctggcctcaaagagcccatagtytagcaaaacaaagagagaaaggacattgcgaacgaatgtcagagagtcaccacgggcagccagagacagagactcaatgggtagcaataggtggcctgac

SEQ ID NO: 78639 - DNA, 201 bp, Bos taurus; identical to SEQ ID NO: 38544

SEQ ID NO: 78640 - DNA, 201 bp, Bos taurus
cagtggtccttccagatgtacattatcttcggggctcagaggggcagcaagtggggtgtgcaggataaacaccttcctggatgcctgcccctgaagagacsgcagctcaccctctgcagagccaggcggtgtctgtatccatatgtaaataccgagcactcagccagggccgggaaacacacagaagaataacaaacagat

SEQ ID NO: 78641 - DNA, 201 bp, Bos taurus
gaggatcaccagggtcttccagaatgtccaatcaatacaggcctctttcctgcccgggttcaaagccgtttgaaaaataagaggaaaagagtaaataagayagaggccaaaaatgtcacctttgtgaccaataaggtctagatgagggacggtttatatcttcaggaagatgacttcctgaacaaacgctgagtgctagaa

SEQ ID NO: 78642 - DNA, 201 bp, Bos taurus
ctctcttcaggctgagaaatcattgtgtcatgagtatttcttggagactctggtcacctcaaaactgcttgtttcctggcctggtggagggtgagcctcayatgggtggaattgacgtccacacacctgctgaaggacaagagagggctctggtgagtgagggatgtttgtccttaaggccacctgaggaggtgtggccac

SEQ ID NO: 78643 - DNA, 201 bp, Bos taurus
ctcttcccacctattgtttcattttgccctcagggaagccctgctcctcacagaacattagctctgttttgcagagaaggcccagagtagctaggtgactkttccgagggcacagagcaggtccctgagggtgccatgctcttcccgctgggccccagctgtgtgggcttggggacgaggaagggaacaggtctcagggat

SEQ ID NO: 78644 - DNA, 201 bp, Bos taurus
ttcacagatggcaaaatgaatgaatgagcagaaagagaggatgaaagagaaccttggaaatgggatttcatcagattatcctgtacgtgtggagatcgcargggccaaggagacctgcacatgcagaaagcaactgcagcgtcgctttgcaaacatccccgtgacctgcttcttcaggaaggtgaccatcgcatccaccgc

SEQ ID NO: 78645 - DNA, 201 bp, Bos taurus
gccatgctctctctgaaacctgaagaggagaagtccttccccacctcctcctagcttccagtgatgaccctcagaccgtggccttccttggcttgtagctrcttctgcctctgtcatcacggggcatcctccctgtccatctgtcttcacaggcattttcctctacttggaaggacagcagtcacactggcttaaggccca

SEQ ID NO: 78646 - DNA, 201 bp, Bos taurus
cggctggtgcagggcagagcagggtccagtgtggctggagtgagccagggagaggacagtgggaggggctgcgtggagattgtaccagactatgtgggtcytgtgggccacaggagggactttggctttcactccaggcaagacagagatggagcacagtggcagagtcttaggcagagaagagacaggatctgactttgg

SEQ ID NO: 78647 - DNA, 201 bp, Bos taurus
agcagcagccaggttgagtggttgcagtacagtttggcccacagagctgaaatagtcactctctggccctttagagagaaacttgactgacccctaacaamacagtatctcaggacccatccagtttgaccactttcacaaagagagactgaggcttccaaattgaaaggctcgcattttttcactgagtaataactgcac

SEQ ID NO: 78648 - DNA, 201 bp, Bos taurus
ctgtctgcttatttttaaaatctctcccttttcttttcttatcccactctaactattcctgaaggctcctccagagtctccaatcaagaactaggtcttartgttttgagcctactttgatagtcttaaatcacagatccagttactgagccaagaagctacttagctgtttttggttttaaaaatccccaaagccatgtt

SEQ ID NO: 78649 - DNA, 201 bp, Bos taurus; identical to SEQ ID NO: 38551

SEQ ID NO: 78650 - DNA, 201 bp, Bos taurus; identical to SEQ ID NO: 38552

SEQ ID NO: 78651 - DNA, 201 bp, Bos taurus
taaatactgaaatgtactactaaggaggttgtaaagtttctgaaaacttttaagaataaaatgtttatctttgtgtaacgattaagaagaaaccttgtctrtgggaagaaaagttaagactgtgggtcacaaggttcatctcttccaactttatggagactgtacataggagaactgactattaacaaccatttgaaatag

SEQ ID NO: 78652 - DNA, 201 bp, Bos taurus; identical to SEQ ID NO: 38553

SEQ ID NO: 78653 - DNA, 201 bp, Bos taurus
catagtgattgtttgaaagggagtttatccactccctcaggctctgggctaagtgttcagagagggcaagtccctgccaaaaggacacacagctctgggarcaggtctagaactcatacccaggtctgctgcatcacgtgtggcactggtctggaggcagcctggtggagcagagagggtttgggtctgacaactggtgac

SEQ ID NO: 78654 - DNA, 201 bp, Bos taurus
agagatgagtgccagacagcctttggcctcccgaagctcagaatccagtgataaagaaaactacaacccaagcatcttatcctcatttcacaaatggagaygctggccccagagaggttaagtgatttgcccaagacgatacagcccatccatctcagaagcagaactcctctcccagggccctgcacagctggagggcac

SEQ ID NO: 78655 - DNA, 201 bp, Bos taurus; identical to SEQ ID NO: 38555

SEQ ID NO: 78656 - DNA, 201 bp, Bos taurus
gaggaataggtcagacaggccagggctggtgattccgaattaaaaggataataaaaagatgtgagaggccagctgggctgtgctaccagctaaatcagacrctgagatgggtccaacacgagcacttaaagggccaaggaatgttggtctgttaactttcatttatcctactcagcgatttgctattttccatcctggaga

SEQ ID NO: 78657 - DNA, 201 bp, Bos taurus; identical to SEQ ID NO: 38556

SEQ ID NO: 78658 - DNA, 201 bp, Bos taurus
tttttaatctttgttttaaaaaatatttatttggccacctggggtcttagttctggcacgtgggatgtctgtcgtggcacataggagtctagttgtgaagygagggctcagtagttgtggcccttgagtgaaagtcgttcagttgtgtccaactctttgtgaccccatggactatacagtccctggaattttggagtgtgt

SEQ ID NO: 78659 - DNA, 201 bp, Bos taurus
aactaagcctgcatgccacaactactgagcccacgctggagactgcatgacataacaaaggtctcacatacctcaattaagacccaaggaacccccccccmaaaaaaagaaaagtagttcctcagactgctcacccctttggccttctggtgaagcgtgtcttggaaagtcactccgctgccccagtttttgatcctcaca

SEQ ID NO: 78660 - DNA, 201 bp, Bos taurus
taagagtcaagaatgaggcacaggtcccaagtgggccctacgacattgggctattaatttttctgggctttaatttacttattgctaaaataaaaaggacytgaatagatgactgagaaggcccaatccaactctgaaattctaaatctatgtaagtctccacatcagacctctctagagaccgaagattttatttaattt

SEQ ID NO: 78661 - DNA, 201 bp, Bos taurus
cctctgagcagatcttattgttctcatctttcacagatgaggacacggacgcttagagtggggcagtgacttatccaaggcctcacagtggtgctgtcaakattgtaacccaggcacgtctggcggctgatctcctctccttaactatcacatcaaaggcctcccatcaccctctttcattctcacaagccaatgaatgag

SEQ ID NO: 78662 - DNA, 201 bp, Bos taurus
tgagttctgtgagcacagtgctctttatctgtagtaatcctaccaagtattgtacagttagagctcaacttgagagagtgtttagtccagcctcctcattytagggaactgagattcagacatgttgatctagttagcgaagtagaactcccatctccttttatctgctgttaactcgtgatcctaaagaaaacatctgta

SEQ ID NO: 78663 - DNA, 201 bp, Bos taurus
cagggccccaagatgggtccccagtgtcgtctcttctcttctttctctaggagatcgtgactgctttgagctgtggcaagaacatcgtgcctgtcattgayggcttcaagtggccagagccccaggccctgccggaggacatgcaggctgtgctcaccttcaacggcatcaagtgaggagggggcggggcgggttacacag

SEQ ID NO: 78664 - DNA, 201 bp, Bos taurus
gtccatgctggatcccagcacgggccccataccacggtgtactggaagatttccgctggggcagaggagcacaggacgcagcctgttatacactttcaccyctctctttggcctttactccagaagggcctcagctcatctcccaccccagccatcaccaccatctcagtcaaatcatctgccctcccctactcacagtgg

SEQ ID NO: 78665 - DNA, 201 bp, Bos taurus; identical to SEQ ID NO: 38560

SEQ ID NO: 78666 - DNA, 201 bp, Bos taurus; identical to SEQ ID NO: 38562

SEQ ID NO: 78667 - DNA, 201 bp, Bos taurus; identical to SEQ ID NO: 38563

SEQ ID NO: 78668 - DNA, 201 bp, Bos taurus; identical to SEQ ID NO: 38564

SEQ ID NO: 78669 - DNA, 201 bp, Bos taurus; identical to SEQ ID NO: 38565

SEQ ID NO: 78670 - DNA, 201 bp, Bos taurus
aaatttagtttggccaagtcaagaattaaggggaagtgacttttgtttgttgtttataccctgaagaataacatctgggggaagaaagtagaattaactayatttagctttaacagatatacctaatttcactgtggctgcagtaattaatttttcaaatcagatttaaaaggaatccttcttgttctcagaagcagaaca

SEQ ID NO: 78671 - DNA, 201 bp, Bos taurus
gtacaacttcagaaaactgtttggcactgtttctaaggtgaatatatatataccctatgatcagcatttatacttctaggtacataccaagataaatgaaygtatatgtctaccaaaagacatgtagaggattgatcatggcagcttttttgtaataatcaaatctggaaagtattcaaatattctatcagcagtagaatg

SEQ ID NO: 78672 - DNA, 201 bp, Bos taurus
aatgcagtttccagtctccctacctagacttggaatcaaggtctttccaagatgatttctatgtccagggaaaaaagaggcccacccccctaaggccttartgtattcaatcttgcttttatacatggcagcttctagagctattcttagtacttcttaagtatagtatttcattgagtaaaataaggccgacctctataa

SEQ ID NO: 78673 - DNA, 201 bp, Bos taurus
taaagattgagttatatgtaaagtgcttaggatagtataacattaatgttcacaggaagtgtaactattgttatgtgatgtcactatagttcaggtaattmagagaactcaattttgagaaattctaaaagttgtgtgtgtgagtttcatttctcatcccctgtctcaattcttactgacatacagtgtgcgtgttagtca

SEQ ID NO: 78674 - DNA, 201 bp, Bos taurus
ttcctgtgatgtcccagcagactccccagaatctcaccctgcagcctcatcacatcaccatggtgtcaactcaacagcccatggtcccccagcaaccaatrgtgccagtccctggccaacactccatgaatccaacccaacagcaccagccaaactttccagtgttcatgcagcagcccttctggccccagtccatccagc

SEQ ID NO: 78675 - DNA, 201 bp, Bos taurus; identical to SEQ ID NO: 38570

SEQ ID NO: 78676 - DNA, 201 bp, Bos taurus
ttccttcaccaccaccccccaaatgctgaggcccccagagcattgtggcatctggcttcctgcgagaattcatttgcatcgcaattaactgcgtagacctyggaaacccaggccgcctcgcctacccggctcctccttgagctgcaggccaccaaggggtttctgatttgatgtcaattagtcatgcgtgcaagcgggggc

SEQ ID NO: 78677 - DNA, 201 bp, Bos taurus; identical to SEQ ID NO: 38573

SEQ ID NO: 78678 - DNA, 201 bp, Bos taurus; identical to SEQ ID NO: 38574

SEQ ID NO: 78679 - DNA, 201 bp, Bos taurus; identical to SEQ ID NO: 38578

SEQ ID NO: 78680 - DNA, 201 bp, Bos taurus; identical to SEQ ID NO: 38579

SEQ ID NO: 78681 - DNA, 201 bp, Bos taurus; identical to SEQ ID NO: 38580

SEQ ID NO: 78682 - DNA, 201 bp, Bos taurus
gacccccaccctgcagggccaggccgtcatctcgttcctgctggggttggcttcctgatccttcccttccagcttggctgatcacaggcctctggggagakctgggtgcctggggcagctcggctggttcttccggctgccagctgtacccagagcatattggatgagagaactaaccctcccggccactctggggtgggc

SEQ ID NO: 78683 - DNA, 201 bp, Bos taurus
gcatccagctgactcaaaggctcagacctgggagcctgctccgtgtttggagccgagacaggcagtttccacttatcacaacttggcatctggaactctcsggcctttgccagtgcctaataaacaccatacttcacgccttgccattgtcacccacgcgtcccctgacgcctgctgacgccgcctgccaccgcacacagt

SEQ ID NO: 78684 - DNA, 201 bp, Bos taurus; identical to SEQ ID NO: 38583

SEQ ID NO: 78685 - DNA, 201 bp, Bos taurus
tactccttgactgcatggtctgatgctcaaggccaaaaacgatccttggctccatctgtgtgggattctgagataaaagaaggaacaccgaagtactgctycagtggtctgcttccaggttaggcccctagaaaagagagttgactctcagttctaaaaggctcaaacttgccttataccaaaatgcaagtcagtggcaaa

SEQ ID NO: 78686 - DNA, 201 bp, Bos taurus
caaaatcaatctgcagcccagtcaccctgcacttctctgagaacataaacttcatgttctcagcagtgcagctggagccctatggccaacagcaggtcacrgtaacctcattccaggatttctcaagtacctctcctgtgcctccctcaacctctctctaggtcagcgccttatttgacttcagttctcctaagctacgct

SEQ ID NO: 78687 - DNA, 201 bp, Bos taurus
tttatgggccaacagagtttaccagctctggagtgtgatgtggctgaaactagagaccactcttgtccagatccctagcttacaccctttcggcaataaayggcttctatcatttcagcgacaggcctctatccctgccttccattacctttcttccccatctgtcaattagtcctctgagtagtgtataccttgaccatc

SEQ ID NO: 78688 - DNA, 201 bp, Bos taurus
ctcagaagagggtctcatttgagtcaacttctctgattgatagcaatgaccaggccttcatgctggccaccaggatggcctcgccctcccctttcccctcrtgtaccaacatgaaggtgcacacacatccttggactcatcatgtgaacagagtggctggtctaggtcagaaaacagtcacttgaggcttgaagttgaatg

SEQ ID NO: 78689 - DNA, 201 bp, Bos taurus
ctgaccagggctcaaacccaggccctgtgcactgggagagtggagtcttaagagctgtctttaaactgcttaaatcttcactcttcctttaatttctagayctcagtggtgcaaccagtcagaagactttccaatcaggtgtaacctgatacaaatctgtatagcattcgcattctgctgaagctctgctgctaactacgg

SEQ ID NO: 78690 - DNA, 201 bp, Bos taurus; identical to SEQ ID NO: 38584

SEQ ID NO: 78691 - DNA, 201 bp, Bos taurus
tttgtgcagtttgattcctttcctccccctccatggaggaggaaacaggcagagtcttaaagggggcagagcttggattcctgctctgactctctctgccytgatgtgtggctgggttggatcttgggtccaaccaaagtgatcatcaggttcacctgatgaagcacagatcattattagtaccctaattaagttttggat

SEQ ID NO: 78692 - DNA, 201 bp, Bos taurus; identical to SEQ ID NO: 38588

SEQ ID NO: 78693 - DNA, 201 bp, Bos taurus; identical to SEQ ID NO: 38589

SEQ ID NO: 78694 - DNA, 201 bp, Bos taurus; identical to SEQ ID NO: 38591

SEQ ID NO: 78695 - DNA, 201 bp, Bos taurus
aaaaagcaccctgccctctggacccagggtttctgtgcaatgggggtaggacagaacagtgtctggagttcacaggctctgtgacaggaacttgctcatgyggcccagccaggagcaaaatcaggacaaagtgcaggagccccaggtctgcccttgactcccaggctgcaggcagaggaaaaattcaagtctcagtctgtg

SEQ ID NO: 78696 - DNA, 201 bp, Bos taurus
attcctgccagtcccacctcactccaggcagtcccgcctcctaggaaggatcagagggatgtcggtctggatggaaatcactttcggatactgctggcccrgctgtggaccaggggagtgggcctggctcagcagcgccacccagtggctggtagcagaggcgatgggaggcagggcgctggcaggagagcagcagttgtg

SEQ ID NO: 78697 - DNA, 201 bp, Bos taurus; identical to SEQ ID NO: 38594

SEQ ID NO: 78698 - DNA, 201 bp, Bos taurus; identical to SEQ ID NO: 38595

SEQ ID NO: 78699 - DNA, 201 bp, Bos taurus; identical to SEQ ID NO: 38596

SEQ ID NO: 78700 - DNA, 201 bp, Bos taurus; identical to SEQ ID NO: 38597

SEQ ID NO: 78701 - DNA, 201 bp, Bos taurus
tgggatctcagtcttaacctctgggccaccagggacatccctgagtgattgccctgttaacatccattgtagatgatatatggaattctggcaaagtaaaycccaagggagaagattcaaggcctaggcacacatggggttgtgtatgccctgcggatacacacgcacactcacacatgcacatacgttgcaaataatcct

SEQ ID NO: 78702 - DNA, 201 bp, Bos taurus
gctgattctgcagcaggcccgcatcacgcagttgggattacaaagtatcctcacaccatacacactctctgtcttcctccagaggataagagacagtcacrtggccccagcctgccctcctccctccgtctgtctcttctcttaggggcgcaggcctgtgagggaccagccagcccctgtgaacgtccaacttggcggtca

SEQ ID NO: 78703 - DNA, 201 bp, Bos taurus
tcaaaacatgattcctttggtggaggcaaacgtccagggatagaaatcagaccggtagttgctaagggccagaagtaagggctgaggcaaagggcacaacraaccttttcagtcgtcggaaatgttctttatcctcttcatggtgttgctgctgctgctgctgctgctgctgctaagtcgcttgagtcgtgtccgactctg

SEQ ID NO: 78704 - DNA, 201 bp, Bos taurus
tgtctgcattcctcactttgggaatcacatattcaaagattggtccaaacatctcattttcagtgggggcagtgaggcccagagggatgaattcactttcrgaggtctagtttctcagtcagtgggaaggtcagtctggtcaggagagagaaaagagaaaataaaggaatcaaagtcttatcagtctttacatttttggag

SEQ ID NO: 78705 - DNA, 201 bp, Bos taurus
cagcattgaatcctgagggaggggccaaggatccagctcccccgccttcaggtctgaacacatcccaggatacggcggctttttttcaagagaaaagtctrtgagacctgagaggtggccgtaacctccaggcccaggtccttcctggccagtgggcatctctggtcagcttggctagccttgaccagcctgtttctactt

SEQ ID NO: 78706 - DNA, 201 bp, Bos taurus
tcacggatgctttcttccctccctatccaccctgacagctatgaactcacaatttcctccactgatttcatcatgagatgggagacaagctgcatcccaargctttattgctctgcggcaacctctccttgaacaaaccatcatcttgcctcctcccagccttttccctcttcttactgtgtcctgagtgtccctgaaaaa

SEQ ID NO: 78707 - DNA, 201 bp, Bos taurus; identical to SEQ ID NO: 38600

SEQ ID NO: 78708 - DNA, 201 bp, Bos taurus
acggagggaagatgatgcataaaaaggacccagcataggagctcgcctactcctagctcttaagacctttcatcatagaggtaggccgcagaccaccctcyggacactcagagcatgtgagagtctggttcctaaaactcccactttggctccccctccaaggcctcaaaagctcaggatcaagcacaggttggaagcccc

SEQ ID NO: 78709 - DNA, 201 bp, Bos taurus; identical to SEQ ID NO: 38601

SEQ ID NO: 78710 - DNA, 201 bp, Bos taurus; identical to SEQ ID NO: 38602

SEQ ID NO: 78711 - DNA, 201 bp, Bos taurus; identical to SEQ ID NO: 38603

SEQ ID NO: 78712 - DNA, 201 bp, Bos taurus
gcctggcaggctatagtccatggggttgcaaagggtcagatatgactgagcaactaaacacacacattcttaaatacatatgtgctattagggttcaacaygcacattttcagtagcccctggtcactataccatcaacaactagaggaaaattacttctgatctggaggaaaggggaaggagaatttttaacaggttcac

SEQ ID NO: 78713 - DNA, 201 bp, Bos taurus
caacaagagggcatacttggaagagtggagctgtgccacatcatacccacaggaagcttctgtcactacagaaaatgagcacaaggccattctgggtcacrggagaagccatcctgaactgccatcagctaccacactgggctctgtgggggcagccatcttggatgacttggggaatatagcctcagctgccttggcgtg

SEQ ID NO: 78714 - DNA, 201 bp, Bos taurus
gagtggagcagagactccaagaggaggcctcaccaactgtggaggcagcaagggtgtgtgtatgcatgcgcacgtgtgtccacgtgggcacacccgctgcraggccaaactatgtatttatatccaaatcagatagacagcacaatgggcctcactataatttcctgcctgtatttaagagctgaggatagttcatttggt

SEQ ID NO: 78715 - DNA, 201 bp, Bos taurus
atccgtaaagtgggaacacttacagctacttcatagcgttgctgtgaatggatatgtgtaacccactcatcacagggcctgtcccagatgaagtatctaayaaatgaaagctaattttattgcatgtcaatcattatgtaagaggagggccattatatcatcccacaccctgtggatggaaaggactctgtcttcttaaaa

SEQ ID NO: 78716 - DNA, 201 bp, Bos taurus
agttaataaaaataaaatggttgaggcactgagagatgctgacacaatgctcccaactccaggggcagcaaggccatgctttttcagcacctgcagaacarcgtggcccaagcacgtccagggggctgagacagagctgagggaacagagaaaggattcccctggtagtcgggcggagctgagtagtctttcgggttaccc

SEQ ID NO: 78717 - DNA, 201 bp, Bos taurus
ccggtcctccatcttccccactgcagctaacatgactgtcctaaccagcaaaaatgatcacttcctgctgtggatgttgcattcaatcctgactttccagyacttcacacaccggcatatgataatcaataatgcttcctgggtgatacagggaaattactgaaaagtccaggaggtcaacacttggacaaacctactaaa

SEQ ID NO: 78718 - DNA, 201 bp, Bos taurus
cttactggggtaaaaagcatggtgttatgaacatatcgatgaaaatggtctttttttccccctagtctacaagttcattacaaaagagtgagaaatctttrtcctctctccataataatttttgctggcagtctaggctgcttttactcccaaaagaaaaaggtcacaggccattgttttacagagtccaagtcacaagtc

SEQ ID NO: 78719 - DNA, 201 bp, Bos taurus
gatttctatggggtgggaaggaggccatcgtttctaaggaactctgaaaactacactaggagaaagtctatttttcaaatcccatgtataagtaatgagcraatctggcctcttgtcaatatgttctttctaatcagccagctttctgtctgaaatgctccatcatcccaagttgtgcagaggaaaacaatatctcttagg

SEQ ID NO: 78720 - DNA, 201 bp, Bos taurus
agagggggccagcctcgcatgctttgaaaattcatttcgaccgcaatttattgcatccttggtttatgccagcaactgtgttcagggctggaagagatacraggatgaataaggcccgagcctggtccccaggagaattacagcttgtgaaggagactgtggcgacacttaatactcttactaatcctccatgatatattt

SEQ ID NO: 78721 - DNA, 201 bp, Bos taurus
cggcgacgcggcgcggcccccaggagcgcagggcttgaagaaccacggcaacacctgtttcatgaatgccgtggtgcagtgtctgagcaacaccgacctgytggccgagttcctggcgctgaggcgctaccgggcggagcccggccgcgccgaggtcaccgagcagctggcggcgctggtgcgcgcgctctggactcgcga

SEQ ID NO: 78722 - DNA, 201 bp, Bos taurus
ccactccttctccagaggagggtgtggagatggtcaaggtcattgggctgttgctgatggggcctgtgctagagcctgagtccacgaggtggagccatttmttgtcttgtcccctaagtactcccaggcaagacctcttcctgtacatctgtgctgagcacagagccctgcacagaatacctagtgctcacccaagattta

SEQ ID NO: 78723 - DNA, 201 bp, Bos taurus
agaggaaggccttcatcattctctctgagattccagagagtaactgtgtgtggaaagaggagggtgtgaaaccagacgtggggagggaattcaaatgcccrgatcttggtgactgggcctcaaggaaatttttgaaaattttcaagtcatcaaattgcatttgaagcgtttcagtgcatttataggcatgttattacattg

SEQ ID NO: 78724 - DNA, 201 bp, Bos taurus
actgtagcttccatggtggtttctgtaatttccatattccttccacagagtatatgacttttctttctcagtttctttttatcttacttggtgcctagatygtctgcaggtttacatgtagacaacacacacgtgcacagatatctcgggatatcctccaccccagctctgtgtttgggcagacattgtatccccctgctt

SEQ ID NO: 78725 - DNA, 201 bp, Bos taurus
aaaaaggagaaaaacatatattagagattgtgatttggccttttaggtttcaaagtagaatttccccaaataggatcaatttgtgtagcgatgtgtgtaartgaaaaattccagtccggccccggcccacgtctcagcctcaggggtcctgctggtgggtgcagtggcctctgctgcccactgagagcaaagctggggtcc

SEQ ID NO: 78726 - DNA, 201 bp, Bos taurus
actgtttgctgtcccagggagtttggggtacagattgtcttgtttggcaggggagaaagagataaatattcacactgtaatgagtcctccctggagaaagygagggagaaggaatgtgtactcctcaaaggtccacggaggaggtgggacgtgggctctgttccgtactccttgaaatagttcaggaaaggcatttccttt

SEQ ID NO: 78727 - DNA, 201 bp, Bos taurus
agcgggcagcgggcagccggggagccccgtcaaggaagggggccgttgtagacaatggcaaacagtactaccacgtttgtgggccagagactaagatgtckgaacgtgtccagcctcgggtctgaccacgccaggtctccttggcaggagctgcccgagaagtggaacaacattaaaaagacggcggttaccgtgaggcag

SEQ ID NO: 78728 - DNA, 201 bp, Bos taurus
aaaatatgaattccttgtggaacatcgtaattcctgccgaccaccctgaggcctcacagcctgcagtccagccacactggcctcctctgtattcctcgatmcctttaagttcatttcaaggtacaaccttgaatatgtgtggtcccttctgtctggactgctcttccccatgctttctgctccgctgtcatcctctcatcc

SEQ ID NO: 78729 - DNA, 201 bp, Bos taurus
catgcaacatcattccttaaacagtgagattgtagaccacgcgtagaaatcagtattatccgtacaatgagatggcccactagcacccagagacagtgccytggaggactgtggtccctctcttttcccttccactcctcgtcctgtgtcaggagtgggagatgctgcagatcctcagttattgcgggtccactcaacatg

SEQ ID NO: 78730 - DNA, 201 bp, Bos taurus
ttaaaagaattcgtatttagacagagggcatgttgcatatgcaggacttgaagaaagtatagagcaacgagagtaaaagcagcgctataggtctgatggaragatggctctcagggttaccaagggatgctgattgctaagtagggttcagaggattctactgggagccaagagcccactgtaagaaggtgatacagaaag

SEQ ID NO: 78731 - DNA, 201 bp, Bos taurus
catgaagggtcagatcatacagagaagatccatacctgttcagactgaaggaagtggggagggaatataagatgctaatgctcggccatcaagagttctgytgggcagaggaggctgacagcccctgggggctagcacagtcagttctgggctctctgagtcgctgtgcactcaggccctgtaccaagtaaaccccaacaa

SEQ ID NO: 78732 - DNA, 201 bp, Bos taurus
ctgggccctggggccggcctccccatataaaatctgccagtcacaccggagcgggcaccagggtattctgccattttcagtgtcgcagactggcccctccragagctgtacttccaaaccactttccgctggactggatcgcgggtttatttttaaaaccgtgcccaaaccatagaccagaaaaagaccttggccagtcat

SEQ ID NO: 78733 - DNA, 201 bp, Bos taurus
ggcccatccacagacatttccatgagacaaatatttgggccagaccgttcttaggttgttttttttttaagggaaggcaggagatgacaaaaggattttcrctcctagatggccgtgcgcttcacatacgctctatcagcaagtgatgaagctcatcactctaagcgaataatcactcacaccaggcattcccgctccgga

SEQ ID NO: 78734 - DNA, 201 bp, Bos taurus
cgacccattattggagcacatggacacacacagctttgtggagttttgaaaacagaaaggacgttgaggttcaattttagacatgggggaattgacccctraattcctgaggaagtctgattaatgctgaaccgttagcgagtgcaaaggttggttttatttccactctgtgaaaatacctctgtcaagcatgccacctct

SEQ ID NO: 78735 - DNA, 201 bp, Bos taurus
tacacttccggttcttcctctcattccaacagtgatctgtgttcactgtgcaaagtgtgcaaaatccaggaagacagaaataattcaagatatgctacccrtactcctgcctcgaagaggtaaccactgttaatatgtgggtgttttttggtccagatttatttgatacacacactctgaggttcacacatgtaaatatgt

SEQ ID NO: 78736 - DNA, 201 bp, Bos taurus
tgtaactcgtcctttggtgaatttaaacaccctcctgtttcagctttaggttcaatataagcaaaccccgagacaaggtagtttgtatgggaggtggcccrggaagcaagaataataggggaagaaaagtgactcggggaagaagaaaaaaagaaaaaacactatagggccagcaaaggcagactaattcctcaggggctt

SEQ ID NO: 78737 - DNA, 201 bp, Bos taurus
ctagaaaactgggtgggttcttttgttaatgtgcgtagatacggccatggagagacatcttccatgtctcctgacatgtggaaacaggagtttggccgttkgattcacagataaatcatcttcaaattgtgttattctttctaatgacagacgcgcacaagaaaacctgctcactaggtagttgtcattattcccactaca

SEQ ID NO: 78738 - DNA, 201 bp, Bos taurus
tggaggctggctcctggaggtgacccacttcggcctcctgagaaaagcctcctgctctcgctcaagccctgctgtcccatttccccttcagcctcaaggcrgtcctggccgggagccctccggacaacaccgtggacctgtcaggcatcccgctgacctcccgtgacctggagcgggtgaccagctacctgcagcgctgcg

SEQ ID NO: 78739 - DNA, 201 bp, Bos taurus
gagatgaattctctggcagataaaacaaaggggattttcaagggctctggaggtggctggcactggtttcttgctgaatggagtttcaggtcaaaacttamaactttactttccaggttgatcgtaacccctaatcttaacgctcatctgtaattaggtttaatttggaacaagcagctggagatgagggaggacaaagag

SEQ ID NO: 78740 - DNA, 201 bp, Bos taurus
ctgtaagcagtcttgagatcttcctggtctccacaagacccaggatgcaggctgggcaactccgccagggacctgcgggcccacgcactcatctacacttmggcacaaagatcccaagacagccccacggttgtaccaccctgcctggatccccacgaaggccacacgtgcaaagtgacggacaagcagaggggcggaggg

SEQ ID NO: 78741 - DNA, 201 bp, Bos taurus
cattcccccacccctccttgtcatgctgaacacctctgcatgaggggcctctgccaggaggtgacatctgagcagggcttagagccaagggtggggccatygtggcagagcccagagaagattgcaggcacagggagtaggtaatggacttggcagcacagccagcgggggctggacacagggcctgggtgagaccagccg

SEQ ID NO: 78742 - DNA, 201 bp, Bos taurus
ctggtgaccccggccagccccctgcaggcacaggagtgccctctagggtccctccacaggcacatcaaactggaccctgagctctcagacctctcctagcrtcccagtgacgcggcccatcaccagtcccaacaaagacttggacttgggccccacccgcagggcacccaggcaccaagtcccgggcccatccaggatgca

SEQ ID NO: 78743 - DNA, 201 bp, Bos taurus
gcccaggaagcagtcctctcgtgggcccagaccaccttcctggtccccgaggtcttaactcctcaggagctgagccccactgtggtgctacaaagcatgtrggtggaggccgtgtgcagcagagggcggggcacgaggccaggctgcccccacaaggcctctgcagccatggtaggccggggcgtagatggcccccaggac

SEQ ID NO: 78744 - DNA, 201 bp, Bos taurus
gctcctgtccagaacagagacactgccctgaggcgggacgcaggcagtccggggctggctggagtcctgcactgatttgccatgtgactctggaaaggccrtgtccagcccgtttactcctgtaacgagggcaagttgaacaagttcatttctacatctgaagcttaaggccggaatcaaaggagcttttagtttttcttt

SEQ ID NO: 78745 - DNA, 201 bp, Bos taurus
tttctgcccccaggctctgatgggaaggttcagggtgggaccaggcagggctgcctcacctgcagccaaggtccagagcacgatctccatcaggcccctgmccttgccctctccagctgcggggtgggtacaggggctgccccagtccctgaggacttcacattagccctgtctggtccttcctggcttgtctggtcctgt

SEQ ID NO: 78746 - DNA, 201 bp, Bos taurus
ccagacggtgtgaggttctggggagtgggagtgggcaggcagagggtccctggtcgggggtagccatctgccttgagccacccagcctgggcctcatgctyccctccagctcctgggctccaggacttcctcttgtctcctcctcaactctctggatgtgggggcccagcctcggcagcagtcaccagcagagagcccgtg

SEQ ID NO: 78747 - DNA, 201 bp, Bos taurus
gacaagttggtctccatgtgctctgccttctctgtgtccagggcctcaaacttctctattacctgggacctcctgcaagagagggcacgaggccactgagyggggagacagggttccctggagcctaaagggacgtggtccggagtctgaggggctcctgcagccagcaccccaagccagctcaccccagctcctgggcca

SEQ ID NO: 78748 - DNA, 201 bp, Bos taurus
ccagcagcagggcctgagatcctctggggtcagctcatcaccctgctccagcaggcagcaggtcttcccatcccagtaacatcatcactctgctagcccamgagccctgctctctgtggccccttagatgtctggtctccctgccgctgctcctctcgtgccaggaccacgggggcctggttaggaggaagcccacggccc

SEQ ID NO: 78749 - DNA, 201 bp, Bos taurus
aatatcaccatggtgtccatttcaccctaaatcatgtatagactgtgtcccagttggcggtgtggtgtggaaaggttgtatataccaaggaaggcaggtayagccggcctcatgtacatcaccctgtttagttcctaggcaagtatggtcatccttatggctcacatatccacaaggttccatggggaacaggaacaacac

SEQ ID NO: 78750 - DNA, 201 bp, Bos taurus
tattgtttgactatatcaaaatatacgtatctgttcgactactgatgtgaactttctaattctctgattcttttagctttttcctactggcacatcttctyatggacataagccataatccctgtcaggctgtgtcatacggggtgtgtgtgtatgctcagctgtatagatattgccaagcagttttctttccaaagttgt

SEQ ID NO: 78751 - DNA, 201 bp, Bos taurus
taggcgaagagaaaacaaaagttcacgtcgacctaggaaaatggccgattgagtacatctggctggaccccaactccttagtagcctcccctggcccaccracattaagccctgggcttcaagggactatacgatcaactcatttccctaaaagatgaactaaaagtgcctactattgaaaataatctctttatccattta

SEQ ID NO: 78752 - DNA, 201 bp, Bos taurus
agtcctgtacacattctagggctctgaaaaatttagttagaaaactaaaagctagaaagaatacggaatctagcatcacagttcaccggcctttagtagcygctgactttgggtaagctaatcctctgaggactatcacttggctcaaaattttttgtaaaattctttatctttgtaaactatacactattaaagctgatg

SEQ ID NO: 78753 - DNA, 201 bp, Bos taurus
tgtcttagccacaactccaagcgtacaactcagtagccccgttctcttacggttcaaatatactgctgaccttgggttcgttcttgttttgtttttttttyctgttaggattatttgggggtttttggtggtttaaactctttaactttttccttgctgtgtatgaggaaagctaaagctgttatcaacttcttcttctat

SEQ ID NO: 78754 - DNA, 201 bp, Bos taurus
cgctcagtcatgtccgactcctagcgaccccgtggactgcagcctaccaggctcctccatccatgggatttgccaggcaagagtactggagttgggtgccwttgccttctccgaagttaatagttgagaggacctaaatattttttgtcactatttcttaagttattaaaaaaaccaaaaatagcttcaggccaatacaga

SEQ ID NO: 78755 - DNA, 201 bp, Bos taurus
cttggtttagggcttctggcctccagaaaataaatttgggttttcttgagccaccaagtttgtggtcatttattatggcagccctaggaaacttacacacytgcctcaaactcttcaatggcccctcctggtcagggttaaatggcccagggagcctgctgagggctgattctgccacctctccagcctcgttgctcaccc

SEQ ID NO: 78756 - DNA, 201 bp, Bos taurus
ggggccattcctgactgacctgctgggggcgggggcaaggagcactgctctgaggagtcaccaaatgagggaccttctgctcgggtgacactgcctggagrcggtcagtttgccccgtggcccacatccacctgaaaggtagcaagttctacactgggcgagaggggattttccagaaacccagggctacctactgacaag

SEQ ID NO: 78757 - DNA, 201 bp, Bos taurus
tttgcgtgaactctgggagttggtgatggacagggaggcctggcgtgctgcgattcatggggtcgcaaagagtcggacacgactgagcgactgaactgaaytgaaaggtcttctggcccccagtctgttcgcctcctgacagtactagcgacgactgcctgggagcccaccctccgggcaccagggaacgtggctacttca

SEQ ID NO: 78758 - DNA, 201 bp, Bos taurus
aattccaagctgactatctgggaggctagagaggaagggaagaagagagggagagggaaggaccccttggaggaggcaggtagccactctagggcctcccytaaaatgcagggggaacagggtccacaccagagaccactaggagctgagcaaagggaagcctgagcctggaggcgcagagagaggatctgccccagcagc

SEQ ID NO: 78759 - DNA, 201 bp, Bos taurus
aaacaaataaacaaccacgatcattcctaacaagaaagataggccctgctcacaggcactgctgggcttattatgtgctaaatccatgtgggaaattgtcygtcctccaaaaggccctcttgactttacacttttttcagcaaaagaaccccaaaatccctagtgctgagctctccttactatatctgatgggacacagtg

SEQ ID NO: 78760 - DNA, 201 bp, Bos taurus
tcatctttgggtgctttttcctaggaatcctgttcaccggggagctctgggagttcttgagctttgccgaaaggtaccctaccatcgtctataacatcctyctctttggcctgactagtgccctgggccaggtgagtgccttgatgggtgatggcttggcttccccaagagagactggcctggctgggagaagagggtggc

SEQ ID NO: 78761 - DNA, 201 bp, Bos taurus
tgtctcatataaggacccaaattaaatggtttttgtaatgacattgaggttctgtggtattaagactctcttgatcataagaaaaataagcctatttaaamtagctcatataaaagatttatcaaaaggaaatagctgttatagaatccaaggaaaagctgaccagggcttcagaaagggctggcactgaaacagttcagg

SEQ ID NO: 78762 - DNA, 201 bp, Bos taurus
ttcatgtaccaccagactactttgctgatgagcatgtgtttgcacatggtgcctactctgagtgaaattaattagacttgtgctgtcctagtcagtttccyttccagcaggttgtgtggctagagctccttagagtctaaaactgattctctagttctactgactgctgggttggacatttttaaacaattggaagacggg

SEQ ID NO: 78763 - DNA, 201 bp, Bos taurus
tacgggacacgtccagcacacccaccacagtgtggcctcgccagccccgagcgggccacgagggaggcagcatctttatccaggcgggccctgggctgatrggcgaggctggctgtggaagggtcacttgctggataaggtcactcccagaggagccagcaggggcaggacgggggaggaacacgtggctcacgggtggct

SEQ ID NO: 78764 - DNA, 201 bp, Bos taurus
ggatctgcctcttactttactttccacctcacaaccaccactctactgttatctgaatctcctgtcatttcttgactgttgattgccagtgggtggggccyatttgaggcactgaccaatgactgagcaggaccagttgcctagtaacagggtgagtgatgatgctcaggaatggctgtgagctatggcctgcatgcaccg

SEQ ID NO: 78765 - DNA, 201 bp, Bos taurus
gagaggagcctgcggggaggcctatagcaggacggggtagcactgccttccctgggcatctctgaggctctgggaaagaggagtacaggagggcctgggarcacacgtcagcatgagaatttaagggtctgggatgaaaccagcctggagtgggaggatagctcagccaacgcccaggccaagcacctgtcaggatgggct

SEQ ID NO: 78766 - DNA, 201 bp, Bos taurus
tggacaattagaggtgggctctagaggcctggcgggaggagggggtgtgagaagagctgaggattcagtcagggacacagaggcaggtggagagaaggggrcggaggccaaaagagagaggcttctgactccccagtgaacttgggaagggggaggcaggagaactagagaatggagcagaggcctcatggggagcccagc

SEQ ID NO: 78767 - DNA, 201 bp, Bos taurus
atctccagaaacttgtggcgttaggccctcctggttgtggttatctctaatttgctggttttctcttatttctgatgtagatccatcctgtatccacttcytgtgttacactgaaattagagcaaaggggagagaaatgcaagagcactgggtcagctctcagaattcaaagtctttgttctgatgttttttctgtaacat

SEQ ID NO: 78768 - DNA, 201 bp, Bos taurus
cagtcaggtgcagcctggctttggagcccctgttctcctcccctgccctctaccgcagaagcaaaggtgctgcggctgaggccagagcagagagcatgccygcactcctcctgactcccacagaagccagggggtggtatcctctttcccaggttagcagcagtgtggcctacctaccattctggtcccctctggggccct

SEQ ID NO: 78769 - DNA, 201 bp, Bos taurus
gtcagtgccccctgagagtcctggcacctgccacgtttcaatgcaacaccatctccctgccccaagaaagaaatggggacctctttgtccacccaagtctyctccaactagcccagacctacatttgcccgctgctgatgcccaacaaacagggctgatggcatccctgtactaagctgacagatgttatctgctgatttg

SEQ ID NO: 78770 - DNA, 201 bp, Bos taurus
ccctgagctccggccccacgcccaggtccagggctggtgggacgggcagggcacctttgactttgcccaggtcttctccctgagccagcagcctgtgcgcrtggaggctgccaaggcccgcttccgggccgggcaggagctgctgcagcaacaacaaggtcagtgagtagacagcgtggggcccagctctcttccctccca

SEQ ID NO: 78771 - DNA, 201 bp, Bos taurus
accatctgagccaccagggaagccctatgtgtatatgttaatcccaacctcctcctattttatcccttcccttactttcttttcttgatcatgaccggcartttgaataacattatcatgaagggttgatgtaataaaatacagagcagtatgcccagtatattgtaattgttgaataattgttactagtctcttccaggc

SEQ ID NO: 78772 - DNA, 201 bp, Bos taurus
attccaaaatcaacctatgtaacgcatcatattaacaaaataaagtagaaaaactacctgaccattttcaatagactcagaaaagcacttgacaaaatttyatacccattcatgaactttaaaactcttagataactgaaataaaaggaaatttcctcaatttgataaccattgtcccagaaaaacccctatagttgatat

SEQ ID NO: 78773 - DNA, 201 bp, Bos taurus
agcttcctcagggccttcctggggacagtccgcccaccccacctctgttagtagaagggagagtcctggcatccttgtttcaacctgaggaaagcaagggmtccagttcagggaggctcgtggccccagctctagtggggctgtgccccacaccaacccagcacacgcttcctttacccgggaagtctgagcaagtttctc

SEQ ID NO: 78774 - DNA, 201 bp, Bos taurus
gaactccctgcttctcaggatagccttctggccctctcactctgggtctctgcaacccagactgcagattcaaacccaaacaatagactgcctgctaagcwtcaccaccctacgtatcacagacacccgatgtcagcaggcccagaacagttccttgtcagctccaccaccccaatgccactcctgaattctacagtgagt

SEQ ID NO: 78775 - DNA, 201 bp, Bos taurus
gttgcctcactccggggagccagaagacgcaggcaggataggagagaaacttggagaaacagttcaacaacgacctcccgagatctggtcccgggggcaamcggctaccactttcactgcccgatctagagcccacttccgggagggcgtcctattacagaaacagcgtcgcaggacagtgacgtttaatactagctgtcg

SEQ ID NO: 78776 - DNA, 201 bp, Bos taurus
aagttacacagtctatcctctagccatgtccccggccctcttctacctgtcctagggcaggctgctaagggagccttgccccaggggcctgtcgtgcccaygtctccttggtctgattttcctgagccccttctcagagggagccctgcttgccactgcagtaggggaggacggggttcctgcaccagggagagagagctg

SEQ ID NO: 78777 - DNA, 201 bp, Bos taurus
ggggaccgcagcctgagtgttttgggcaacagacccgggcagaatgcgagcagaggtgggggtagggagaggctgttcagtggccactgggtggagattgratttcagtctccatttgtttgaagatccctccctggtgagcaaggagaaggctggaagcagagtcaaggctacaaggggccctagaggcaatctggtcca

SEQ ID NO: 78778 - DNA, 201 bp, Bos taurus
tcgtgtttccatatatggcagggtcatccctctggggatgtccggttttctaatgtctggattttggtgtccaaggggagggtgccatgtgggtgtgtgtycattgagacctgggtttttcagggaagatcttctgagctctccactagaaaacctggcagacttgtcctgccaggggaaacagtacaataatggacaaaa

SEQ ID NO: 78779 - DNA, 201 bp, Bos taurus
cgctcaatcacgtgccagagtttcgtctctttccttgtggttgaggggcccgcccgttggtgtccccaccaatgctcacttctgggaacaggccctgcatytcagctaaatatggcagaattggtgggtcaccccacgcttgaggggaggggctgtagggacagagctgtaaacagggtggctatctgcctagtccccctg

SEQ ID NO: 78780 - DNA, 201 bp, Bos taurus
gggcctcccagaggttaggttgcaagttaagaataggttttctgaccagaaacttccaaattactctcctgtggccccagagaggccttgtgcctactttygggggactccttctgaccaaccaattcatacagacacttcccgagcaaaccttgccccagactagaggccttgtggggcaggccccagtttgtgacctgg

SEQ ID NO: 78781 - DNA, 201 bp, Bos taurus
tgtcaactgtgtttccattttttcccttaaaagacattctgacggctaccttgtgggtcatcactcataacttaaggtttggtgcaagcccacattcgtarcagcactagtcacaacagccaagaagtggaagaaacccacgtgtccatcagctgagcaacagatgagcaaaatacaacatatacatacaatggaatgtca

SEQ ID NO: 78782 - DNA, 201 bp, Bos taurus
gaaagactggtgttagctgaaagcaatatcagtgtttttgaaatctggttcctggaccgcctatagtacttgttaagtgcaggtccccaggcctcatcccrgccctactctaccagaacattttgtggtggctgccaggcatctgccttgcaacaggctccccagttgcttccgctgcccccgaaaggttgagaaccattg

SEQ ID NO: 78783 - DNA, 201 bp, Bos taurus
tttgtgcttccagtgaagagagcacagtgtcagtccctggtcagggagtgacgattctacatgctgtgcagtgtggccaaaaaatattttttcttgttaamatcttaaattcctatccatatgactgagtcttgtaaggtgaaactaaggcccttgagtctttcctgagggagatagcctacttaaaaaatattcagggtc

SEQ ID NO: 78784 - DNA, 201 bp, Bos taurus
atccactttggttttggccttcctggaaatgttttgttgccctcttaattctctgtgtggaggcaggatgctgtagatctgcactgtctaatacagtagtygctggccatgtatggctgttttaaattgaaattaattaaaattaaattcagtttctcagttgcacttggcatgtttcaagtgcccactggtcaccagtgt

SEQ ID NO: 78785 - DNA, 201 bp, Bos taurus
gcattaaatgtgtaaaaacaggcatggatacatacagctgattcatgttgttggacagcagaaactaacatatattgcaagcaattatactccaactaaaraaataaaaatagtcatggaaaggtagatactaaattcaagatgggggtggaaaagggtgtcaatggagagggatttttaggagctgaatctgtgttggta

SEQ ID NO: 78786 - DNA, 201 bp, Bos taurus
ggagttccctcttctgacagctgtaccgacaagatcctatcattgtgcaacacgtgtttcctcttggtcaatcccgaagcgcccccgggccttcacacacrggctgttgtttagagtcgcatcgatataccaggttgcttctcccttccagtggtaacctggaggtgtggcccaccgccttaggtgggtgttagtctcagg

SEQ ID NO: 78787 - DNA, 201 bp, Bos taurus
cttcccagttctttaaaaagagtccctgtggcccttggtgatcaaatgtgaaccaggttccgtaacaagaagtggtgaacacagagcatgaaagaggagaktatggccctccttctttcacctatgtgcacgaagttctctgcactgagtctaactttaggaatactgatatccacagccaggaagtctactgcagacaga

SEQ ID NO: 78788 - DNA, 201 bp, Bos taurus
gcaggggaaggaaagcagactgaccctcacccccgtcgggtttccagaccccactccccaccattctcccacactttgagaggttccaggccacatttctycttgggctccacccctgctcctgaggaactggtggggtggggctggcatggtgccatggcccagcctcctcccacagggtggccttgtgcctggtactgc

SEQ ID NO: 78789 - DNA, 201 bp, Bos taurus
atccccgcccttgggcccactcacctccaattgtgctctcctggtactcgtggaactgacccttgacgaagcggaggacgaggctggatttgcccactgcrgactcccccagcaggaccagcttaaactgacagatcttgttcccagcagctggtccgttgggtcgcgctgcgcctccccgacccgccatggcccgtcccg

SEQ ID NO: 78790 - DNA, 201 bp, Bos taurus
aggctgtttccagctcccttagtagttttgtttgtctttactactggattatttcttttatccagtgacaaggcactgctctcaacacctaacagaacttkgaaacgattcagggttgctggagtccccaggggaagactctcagctctgggaattttttaaattcaagattccacccaagtgtgcttttcctaaaagaag

SEQ ID NO: 78791 - DNA, 201 bp, Bos taurus
aaatcctcaatgctggtgaagttgtagtaaagttggggcatgtatagactgccaggaaacattgtaaattggtatctatccctgggagagtgatatggaaytgtgtgccaaaagccatgaagatatccacacccattgactcaatagtttctgggaattatttgaataattaaagcagaagcagaattatgtatataaaca

SEQ ID NO: 78792 - DNA, 201 bp, Bos taurus
agtcacttttatactacatttggttcagtgtctttcatgggaagagggaggaagattccacatgcatgtgtgtttgggctatcaatttatcagtagctatrcacttaatgttctcctctggcttcaaaaagcatcccttggtattatagggtatatgtgtattgcacaaaaaactttgacttctgaaaatttgtacttaat

SEQ ID NO: 78793 - DNA, 201 bp, Bos taurus
actcagagaccacccagttcaaactctgcattgcggagacggggaaatcgaggccaccgagaggtcaagacctgcccgaggccgcgaagcgaattcagtgmgagaagtcgacatgctcgccattgggagctgggctgtctgcagagggtagggagagggagctgcctgagcagagtgggggcgccttagtcctggggctgg

SEQ ID NO: 78794 - DNA, 201 bp, Bos taurus
ataaagatggtgtttgtactggccttgaaaagttggtaggacttctgacttcctttgttaggaggatagcatgctgtcaaggtcatggggccagttcccaycaggctgagaacaaggactatatgcaatccttgtcagggactctgcagatctgtggctgggaaagtctggctgagagaatggagacggcttggggccaca

SEQ ID NO: 78795 - DNA, 201 bp, Bos taurus
cactgggcttggctttaggctttgtgccccatccctcaaggaccctgcttgtctgatgcaaactctgacctgaggaatcaagtctaaatccctgtgactgmctctccctgactctgggagcctttgtaggatccttctccatcttttcttcatatcagagtccttcaaggaccagctcagataccactcctctaggaagct

SEQ ID NO: 78796 - DNA, 201 bp, Bos taurus
aggtggccctctgtgagcagggctggtcagccctcaggcaaagctggcatcacaattgttggagtcattatgaggattagttgctgcctctagaagtgcgkctggggccactctaggagccaataagtccccgggtgggagagggccccgaagacccctattaggaagcagcgatcccctctaaggctaagctgctgagcc

SEQ ID NO: 78797 - DNA, 201 bp, Bos taurus
cttgtgcatctcgttctgttgatgacatcaccatccctctcaggagtgtcctctcctccctcgcctgctcactcgagtcacgtggatcctgcctccataaygccctgcctgtggcctcccttcggcccccttttccgccagcacccccgtgatgtcccaccatttcctctcgcttcctgtcatttctattatgatccttcc

SEQ ID NO: 78798 - DNA, 201 bp, Bos taurus
gatctgctctcattgcccctgccaaggcccagctccctggaccctcacattccatggtctcagacctagccttcggcaaacttgattaagcaaagcccctygggagtcagagcagatggggtggcccctgccctggaggtccgggccttaccaagccactggcagctgagtttttcgaatctttgaagaaagtcaggattc

SEQ ID NO: 78799 - DNA, 201 bp, Bos taurus
ctgaaaggcccaggctgaaggaaatgggtgtctgcactgaggagaagacctagaaatgggatgtgagcaagggagtatcatgcagccttgaaagcacgggrgtggagaggccctgtgggtgcctggctaacagcacaggttctggggccactaagtcctcttccggctccaccattgctcgctgtgtgaacctgggacagg

SEQ ID NO: 78800 - DNA, 201 bp, Bos taurus
tgtccgtggtgaagagcagagcctgtggtcgggagagaactactttctccatggcgtgggtgtgctggtgataggagacacccgtgggaggtgatgggccragagcccagctcccatccactactcaaccccacagaacattagctccatcaccacgatgttgtgttaataccgaaccatgcaaggcgaggggggctcgga

SEQ ID NO: 78801 - DNA, 201 bp, Bos taurus
tttaggccaccatcaaagtactctttatagaactcaagcttggtcgtgtctctcttctctgcttaaaacattatagtctgtgctctgtttggtcaggtccmcgtgcctttgccaggcccttcaggactggttccctgctcacctgcacagcctcatctgctgccctttccccgctgagctccacgcttgggaacaccagac

SEQ ID NO: 78802 - DNA, 201 bp, Bos taurus
ccattgagtgagataggaatccatgagttcataacagtaatagatagacaaataggttcataatggggatcaaggggcgggggctctttctgacaagaaartgctgactgataaatgcggaggtaggcataaagttgaaaaatcaccatcctgaaaccatcatagattgatctgagcaagaaagaatcaacagtgggtgct

SEQ ID NO: 78803 - DNA, 201 bp, Bos taurus
aaacagagctcacctttcatccccccagaaccgatccatgagatgtttctcccagttcaagttatctgctgtttcctggaccctggtggccctcggtgtgrgtggaacatatacatcaatctggcaaccaggatgcagcccctttctggaatatgctggccttataaccacgggaaaagatcaaaggtggaagcagtgctg

SEQ ID NO: 78804 - DNA, 201 bp, Bos taurus
ctccgtggtagacccagaaagaccaagatattaaggcaggactttgagaatacacagcagaacaatcactcgtgagtcagcaatgcttccaaacagccagygagatcctggaattgcttggtatcactgccctccagacctcgccgggttccctgtgtgagctgggaaatgtttgcaggcaggacacctgtgatcgctttt

SEQ ID NO: 78805 - DNA, 201 bp, Bos taurus
ggctcttgtgaactgcagtcagatctcaaacatctttttctaccattctgcggtttccaccattaacgcagtactttttttttttcctttctgtagtgaaygttgtaaataggttatgtgtagggggcaagacttctccagcttagatggcttcctgaagaaagtggtgtctttaaagggaccattctgcccctcccagcc

SEQ ID NO: 78806 - DNA, 201 bp, Bos taurus
cgaagttaatatatgaggtgttgcaacagggcctggggtttaccacgtgcctataggtgtgatctgggaccactgtgtgtgcctggggtcctccgggcccyaacatctcatctcccatttgaaaatcaatctccctgtctctctttctctgttacttttcttggcatagttttcattaaatgaatatgttatgaagggcct

SEQ ID NO: 78807 - DNA, 201 bp, Bos taurus
ctccatttcagactgtttcccaggtaacctaacgtaagacaatacagttcaaaacaaaattaaggatcagtagatttgatgagcaccagggccatccatayattcattcagcaaaccagtgtctggcacccaggataactttagtcctagaagtcttcctgaatgaggaagggttccaagtgggcctgaagggcagacaga

SEQ ID NO: 78808 - DNA, 201 bp, Bos taurus
tccgattcctggaacccagatcccatgatctggcagccatcttgagggcgagtcctataagatcacaggaggtcagagcacctcagggcccacacatgctrcagcccctctttgccttaaccaccccctcagggactccctgctggtccagcagctaagtctctgtgctcccaattcagggggcccgggtttgatccttgg

SEQ ID NO: 78809 - DNA, 201 bp, Bos taurus; identical to SEQ ID NO: 38615

SEQ ID NO: 78810 - DNA, 201 bp, Bos taurus
ttccattaaaggggttggggtgagggtgctaagaaaagctgatggatcaaaagccaatagtcacagcagatatcatagcactgacttcccccaattatcayagaaaaccattgccctacaataaatttaggaataagcctggcttgcttcgattcatggggtcgcaaagagtcggacacgatcgagcgactgaactgaact

SEQ ID NO: 78811 - DNA, 201 bp, Bos taurus; identical to SEQ ID NO: 38616

SEQ ID NO: 78812 - DNA, 201 bp, Bos taurus; identical to SEQ ID NO: 38617

SEQ ID NO: 78813 - DNA, 201 bp, Bos taurus
ccgctacagccgcagctcctccggccccagcgaggccaccgagaagaacatcctggtgtccgacatggaaatgaacgagcagcaggagtagagccgagggygtgggcggggccgagggcgtgggcggggccgggggagctgggcgccccaccagctgcggtccagtcggcctatggggggaggtggcgccctggggagcgc

SEQ ID NO: 78814 - DNA, 201 bp, Bos taurus
caggaggtgggatttttttgatttggagagatgtagggcctaataagtagtcaggaaagaaaacataaacagtgaccgaggcctttcatttgtccctccgmggtgtggtcctgagccggctctcacatccagcgaggacatcccccacccggtcctgtccctgatgcctccctctcagggccagctctgagggcatggtca

SEQ ID NO: 78815 - DNA, 201 bp, Bos taurus
aaacacggcctatagcccaggatccatcacttatatatggtgtccatggcaaccaggcaatggtatgggatcccttctcactggggaattccttttatggygcatttccgaaaccagcatggccagtacacgagtctgcagtttcccagttgcttagcaaccagctcctatgctctagtcactaggaacagcagacagtta

SEQ ID NO: 78816 - DNA, 201 bp, Bos taurus
ctcatggatgcatcaaatagccaaagtgtttggacctcacttttatttctttggaaaacaggaagcctaaagccctctcaggttgtactggaccattatgraatgggttacatcatactacagtacttcctgcctctcttgctgctccaacagggaacgctcttccaatccccaggcccagctcacaccccatctgcacct

SEQ ID NO: 78817 - DNA, 201 bp, Bos taurus
tagggtatagttaattattgatgagattttagtgccttctgttgcagttcttgtagagaaatggagttatttgcctgaatgttgttcttagaagaacattygccacataatctgaaaattcatactgattggcttcctcctgaatccagattcagctattgagggattgtttgcttcaaagacaaacctgattttgctcca

SEQ ID NO: 78818 - DNA, 201 bp, Bos taurus; identical to SEQ ID NO: 38620

SEQ ID NO: 78819 - DNA, 201 bp, Bos taurus; identical to SEQ ID NO: 38621

SEQ ID NO: 78820 - DNA, 201 bp, Bos taurus; identical to SEQ ID NO: 38622

SEQ ID NO: 78821 - DNA, 201 bp, Bos taurus; identical to SEQ ID NO: 38623

SEQ ID NO: 78822 - DNA, 201 bp, Bos taurus; identical to SEQ ID NO: 38624

SEQ ID NO: 78823 - DNA, 201 bp, Bos taurus; identical to SEQ ID NO: 38626

SEQ ID NO: 78824 - DNA, 201 bp, Bos taurus
acggggtgaaaggcctgaactcggtggcctcgccagaccacaggcctggatttccatgtgttgtactgagtctttaaatcagcaaggcaagatgaaatcayccctgcctgctctgcctaagggggccaggaagtgccatgtggtttttagagatttttatcaggcgcagaagatgaaaaaagatcctggtgcctaaagggg

SEQ ID NO: 78825 - DNA, 201 bp, Bos taurus; identical to SEQ ID NO: 38627

SEQ ID NO: 78826 - DNA, 201 bp, Bos taurus; identical to SEQ ID NO: 38628

SEQ ID NO: 78827 - DNA, 201 bp, Bos taurus; identical to SEQ ID NO: 38634

SEQ ID NO: 78828 - DNA, 201 bp, Bos taurus; identical to SEQ ID NO: 38636

SEQ ID NO: 78829 - DNA, 201 bp, Bos taurus; identical to SEQ ID NO: 38637

SEQ ID NO: 78830 - DNA, 201 bp, Bos taurus; identical to SEQ ID NO: 38638

SEQ ID NO: 78831 - DNA, 201 bp, Bos taurus; identical to SEQ ID NO: 38639

SEQ ID NO: 78832 - DNA, 201 bp, Bos taurus
ttatgtacaagtgggaataggatgcacaaatcaaattttgaaaatatgtttcataatacatggtaatactgcttgaaagttagtcagtaccacacacaacytcctgtctatttagggggcaaaggagttaaagttgtgctctattattttaggagagaggtgtctttgatgataaaacttgaaaataatttacaagaagtc

SEQ ID NO: 78833 - DNA, 201 bp, Bos taurus; identical to SEQ ID NO: 38640

SEQ ID NO: 78834 - DNA, 201 bp, Bos taurus; identical to SEQ ID NO: 38641

SEQ ID NO: 78835 - DNA, 201 bp, Bos taurus
agtgggactgtcacagatttcaaagaaccacaggtataacaagcaagcaaaggaaaagcacagaaggggaggcaggggcctgcctcctgacccctggggayggattagtagctagagctgaatctccatcgtcactgcaaagcaaggcaggcccagagagagagcacatggaatcaaaacgaaaaaaaacgggaagagact

SEQ ID NO: 78836 - DNA, 201 bp, Bos taurus
tgtctgtttgtggccgtgcagaacctggaggactgggaggtgaggctgatgcaggaagggtgcccaggctttggggctcctgggtttccctgcagggctcrtcaaaggaagaaagattccaggggcctaattccctcaaccccatcctgaaatgtgagcccagtggtctctggccagcttgacttggcccctggacattgc

SEQ ID NO: 78837 - DNA, 201 bp, Bos taurus
ctcccccctcctccacccaacccatgcctgggctcctcctctgggcaggagtgccacgctgcagtcacctgggagatgccccagtatggggtcctcggccratcatgtctttggaccatgaataagaccctcttggaccctcttttctttggaccatgaataagaaccagtttgagggaccttccaggaagcacctgtgga

SEQ ID NO: 78838 - DNA, 201 bp, Bos taurus
tcccagttcccgggccccgttatcccatcatagcctctcctacgtgtggggtctacctctgccttcccctgtgagtgcccctggcttccccctacctggarctgatgtcttcagagggggccttggcagagaggtgacagatttcgcccctcttgtctgtaccaccagccagctgcacaggcgtgagaccaccctctaccc

SEQ ID NO: 78839 - DNA, 201 bp, Bos taurus; identical to SEQ ID NO: 38648

SEQ ID NO: 78840 - DNA, 201 bp, Bos taurus; identical to SEQ ID NO: 38649

SEQ ID NO: 78841 - DNA, 201 bp, Bos taurus; identical to SEQ ID NO: 38650

SEQ ID NO: 78842 - DNA, 201 bp, Bos taurus; identical to SEQ ID NO: 38651

SEQ ID NO: 78843 - DNA, 201 bp, Bos taurus
acgactgaagtggctgagcgtgcacgcatgccacacgtggaccagtctcatcagttccttctgtgttccctcccctaaaacttcctccccaaagggccagyccctgaacccccatcccatatctaaagatggcacttcaaaagaggcagaggctcccctctgggctctcattttcctaggcctccttgcacctgggcatgc

SEQ ID NO: 78844 - DNA, 201 bp, Bos taurus; identical to SEQ ID NO: 38652

SEQ ID NO: 78845 - DNA, 201 bp, Bos taurus; identical to SEQ ID NO: 38653

SEQ ID NO: 78846 - DNA, 201 bp, Bos taurus; identical to SEQ ID NO: 38654

SEQ ID NO: 78847 - DNA, 201 bp, Bos taurus; identical to SEQ ID NO: 38655

SEQ ID NO: 78848 - DNA, 201 bp, Bos taurus; identical to SEQ ID NO: 38656

SEQ ID NO: 78849 - DNA, 201 bp, Bos taurus; identical to SEQ ID NO: 38662

SEQ ID NO: 78850 - DNA, 201 bp, Bos taurus; identical to SEQ ID NO: 38663

SEQ ID NO: 78851 - DNA, 201 bp, Bos taurus; identical to SEQ ID NO: 38664

SEQ ID NO: 78852 - DNA, 201 bp, Bos taurus; identical to SEQ ID NO: 38665

SEQ ID NO: 78853 - DNA, 201 bp, Bos taurus; identical to SEQ ID NO: 38666

SEQ ID NO: 78854 - DNA, 201 bp, Bos taurus
agccaaagtcttctgagcaagggaaagacttgcctggagatgccagctggcctccttcccccaagcctgcaaccctcctgccaccacttttcactgggccrgcagagagccagcacttgggggtaagccgccaaatccagggcagtagccacccaccttgagcttggagtgtcggctgcaggaggacatcacggtgtgctt

SEQ ID NO: 78855 - DNA, 201 bp, Bos taurus; identical to SEQ ID NO: 38668

SEQ ID NO: 78856 - DNA, 201 bp, Bos taurus; identical to SEQ ID NO: 38669

SEQ ID NO: 78857 - DNA, 201 bp, Bos taurus; identical to SEQ ID NO: 38670

SEQ ID NO: 78858 - DNA, 201 bp, Bos taurus; identical to SEQ ID NO: 38671

SEQ ID NO: 78859 - DNA, 201 bp, Bos taurus
ggaaagatatttactgctaacagttctgggagccggagtccaagatcagggtgccagcaaggtcgggtcctggtcagggccctcttttggggtgcagatcrctgttttctattttctcattgtgtcctcacatggaaagcagaagcaggaagtaatcaggatactaatcccaccacaggggccccaccatcatgacctcat

SEQ ID NO: 78860 - DNA, 201 bp, Bos taurus
cgtggttggaatacagcaccccagggtgctgccctgactcaggcagggtgcgagcagatggcgccatcagcatcgatgcaccatggggggccaagcagagrgttcccggagcatggcgtcattcacagcgtccaaagaggacacagctccacctgaggttctgaagaaggcttcatgagtggatggctcgaggcctcatgg

SEQ ID NO: 78861 - DNA, 201 bp, Bos taurus; identical to SEQ ID NO: 38672

SEQ ID NO: 78862 - DNA, 201 bp, Bos taurus; identical to SEQ ID NO: 38673

SEQ ID NO: 78863 - DNA, 201 bp, Bos taurus
cagcctgaaaaagcctgactgaccataggctatgggaggaggcgggcagggtaggactttcaccatcctcaactgcgtgagcaggatggcaggccagtcartgtgctcatctgctttcccagccaccggtacgtacacattggagagaaagggaaaaaagccccagagtcccatcgtgtgagatccacagtgatccgtgtt

SEQ ID NO: 78864 - DNA, 201 bp, Bos taurus
aaccctgagttcgggcggtttcccaggtgattccattgcgcagccaccgggagaagcagtgttttcaagacacccgctccccacgtaaccggtgggcttgytgaagaggactcaggccctgggggtgggttctccccaaataagtaggaccaaaatgaaaggaaacacaggagggctccatagctaaggagaattggctgc

SEQ ID NO: 78865 - DNA, 201 bp, Bos taurus; identical to SEQ ID NO: 38677

SEQ ID NO: 78866 - DNA, 201 bp, Bos taurus; identical to SEQ ID NO: 38678

SEQ ID NO: 78867 - DNA, 201 bp, Bos taurus; identical to SEQ ID NO: 38680

SEQ ID NO: 78868 - DNA, 201 bp, Bos taurus
cagctatatggggtaaatattctcattcacttccaaggcctcttttttttgggggggggggctacaccatgcaaccagggatcttggttccccaacagggmtcaaatcctggctcccaggcctaaccatcagactgccagggaattcccctcaaatgcctcttcccatctgagctgcctcacaataattttaacagaagat

SEQ ID NO: 78869 - DNA, 201 bp, Bos taurus
agaccctggaagggaggatcaaggtgccggcaggggaggtgtctggcgagggtcctccccgggatggcagagggctttctggctgggggctcccgtggccyctttgggtttgggagcagctctccctctctctagggagacgaaccctctgtgtctcttcaaacaatcctactggatcaggactccatccttctgacctca

SEQ ID NO: 78870 - DNA, 201 bp, Bos taurus
gagggctcagtgtggcccctcagtgtgtgccgagacccctgggacctcctggctcagagcaaagctgtgtatgctaacacccagggctgacgctgaaacaygggcagcagagcctgggcctggacaatccccgagagtctaggtaccccagcccccctcagccatctgggagtccttctgaagaagctgcaggacaatatg

SEQ ID NO: 78871 - DNA, 201 bp, Bos taurus; identical to SEQ ID NO: 38686

SEQ ID NO: 78872 - DNA, 201 bp, Bos taurus
ctgccccaggcccactcttggcatctgtaatgaaaatggtttccgcattccgatcctcatctctggggtgtcactttgaggccatgcaccccaaggtgccrcagaggcaggacccttatggcatcaatgcctcttgtatccttgatgaccctgctcccatcttcctggggctcaaaggcctgcagaacttgaacttgtggg

SEQ ID NO: 78873 - DNA, 201 bp, Bos taurus; identical to SEQ ID NO: 38688

SEQ ID NO: 78874 - DNA, 201 bp, Bos taurus; identical to SEQ ID NO: 38689

SEQ ID NO: 78875 - DNA, 201 bp, Bos taurus
agacacagccttgggtctttctcctgcagcatcaggtagcctgcatcgccatatattcttgcattcgttctccaaattcctttctggttctaaagttctgrttccagatcactctcagctctagctgacaatcagaatcatttccagagcttcttagtagacagattactggtcctcgcttcctagagctcctgtcaggag

SEQ ID NO: 78876 - DNA, 201 bp, Bos taurus
agctccctggcttatggatggttcaatctcccatggccagtgcctcccctcaatccagatcagtccagccccaacctggtcgcctttccaggccagcctcrcaggaggaccctgtgctgggttagatgctctactgtcaccaacttgaaacgcttcatattttttgaatgaggagccctgcagttttattttgcaaagggg

SEQ ID NO: 78877 - DNA, 201 bp, Bos taurus
cccctgtggtcagagctgagcctcgccaagtcatttttaccagcactggcaatggagagaaccctccgtctaggaccttgacgtctccaggctgagcaccrtcctgtggttgcattcatgagggtctggcttagttggcctgggggtgaagtctcacctgcccatccttcaggcagagctcccatctagaaacctacaacg

SEQ ID NO: 78878 - DNA, 201 bp, Bos taurus
catgtggagccaccgcctatttatatcttcccatttatgtcttccagctaactggacaggaacatacaccttggtatatctgaccccagatacttcaattrcccctaacaatcagaccctccatatcccgctaactcataactgaccccagacgggcaattcatttccctgttgatcagtttaggaacagcagctggggtt

SEQ ID NO: 78879 - DNA, 201 bp, Bos taurus
cctggcagtcttttgacgcataaaactgttttcattttcctgaagcccgaactgtctgttttgtttgcttctgttgcctgtgcctttggtgccaggccccsactcgtctgtcttcagatctttgttggaaacgccccttgcttgccctgcatgtcctcgctcctgcactggttccggctctgactgccccagcccggactg

SEQ ID NO: 78880 - DNA, 201 bp, Bos taurus
tccagcctctgcccctgtgggggcgagcagctggggactcttgggggaagcttgctgcacagttactaggtccgacccacatggagccttcctgccgtctktggggccaagaggaacgagggttctggacaccagagtcctccgtcgtctctcaccgcctgtctgtctggtctgcagcccttcatgtacggggactacatc

SEQ ID NO: 78881 - DNA, 201 bp, Bos taurus; identical to SEQ ID NO: 38695

SEQ ID NO: 78882 - DNA, 201 bp, Bos taurus
ggggaatccaccacggtgaaaagccccctggctgcaacgagcaagcagctcctgctcaccaccactagaggaagcccgccccgtgccacaactaaggcccrgagcagtcaaataaagaagtaaatgctgaaaagaaagacgtagtgttgaagtcttctgagcgttcatgaggtgaatgaagagtgagaaaagacagttggc

SEQ ID NO: 78883 - DNA, 201 bp, Bos taurus; identical to SEQ ID NO: 38696

SEQ ID NO: 78884 - DNA, 201 bp, Bos taurus; identical to SEQ ID NO: 38697

SEQ ID NO: 78885 - DNA, 201 bp, Bos taurus
gagccagagtcttaaacataagagtaatgtcatgctggtaggggccttgggcatcaagtttttggaggaggagagaggtccaggttggggctggacttgcrggaggcgctcagggaatctggcctgcacatgcggattctgactcctggtgtggctctcccaacttgggctctgatgggagaaccagcggggcagggtgtg

SEQ ID NO: 78886 - DNA, 201 bp, Bos taurus; identical to SEQ ID NO: 38698

SEQ ID NO: 78887 - DNA, 201 bp, Bos taurus
cctacaggttgtggccgtcaggcgcctggggctgtggagcctgcctgcgagtgaacaagcagccgagactccaaaacgtgagcatcagcggaaactgcccmtttgaccagggaagtctgggccttgtcttccctgcagcagagcccccaggctttgaaaggggcggtaccggtgccaggaacaccgggctgagagcggcat

SEQ ID NO: 78888 - DNA, 201 bp, Bos taurus; identical to SEQ ID NO: 38699

SEQ ID NO: 78889 - DNA, 201 bp, Bos taurus
taactgagcgaccaacacttcacctagttcatttgaacagtgatgaagcgtcagtcgaacactacgttagacactgatgtataaagatgaggcataaacayggctcctcaccatcagaaacttacaccttggacacaggatgctggacagaaggggcaatgggggaggtactgtgggccttctaaagaggtcacgtagata

SEQ ID NO: 78890 - DNA, 201 bp, Bos taurus; identical to SEQ ID NO: 38704

SEQ ID NO: 78891 - DNA, 201 bp, Bos taurus; identical to SEQ ID NO: 38705

SEQ ID NO: 78892 - DNA, 201 bp, Bos taurus
cgatctgcatccctcttttctgctctgggtccattcttcctctgtcaggactctctgcccactccactccgaccctgccttctgtccaaattctgctcatktcttaaggcccaggccaaactttcatgaagccttccttggccacttgggtccacatttccttctttgagctcctacctccctttagggccaatgtattac

SEQ ID NO: 78893 - DNA, 201 bp, Bos taurus; identical to SEQ ID NO: 38707

SEQ ID NO: 78894 - DNA, 201 bp, Bos taurus
cggcatatacagctctgatcctagttagcacagagtatttaagaacaactcatattatccttagaactcctgagaggctgcgatgcttccttgaccacagktcattcccagactttttgggaaatgaagccaaaaaaaaaaaaaaaaaaaagagcaagggagagtagagacctgaaattgacagctggggcatttccttaa

SEQ ID NO: 78895 - DNA, 201 bp, Bos taurus
cctcaacctcgtgccctgtccagctcctcagcctcatgccctgcggtgcttccctgagttccagaaagaccggctgacctcacgtcttgcccgaggggcckgctcacaccgtgggggtgtgtctgccctgctcagtggcaggattttaagatgtagtctcttatttctcattctgtaggggggcagggagccccacaagcc

SEQ ID NO: 78896 - DNA, 201 bp, Bos taurus
ccgcggaagggggcacccttcgtagtcccaggtcccagccagagcttgtctctgcactcttgggctcaaggatgctagcgccccctctcacttgctctcayagctcaggaggccagaaatgaaaccaaggtgtgggcaggttggctccttcttgggactctaaagtagagtctgtcccaggccagtctcctcacttttggg

SEQ ID NO: 78897 - DNA, 201 bp, Bos taurus
tctcctctacaagcatgtctcctgctccctcgcctggctttccccaaccatcccaaaggacaccaagcggaactgggacttgtgagcctgatgagatgatrcctggtttcagggcctttctgggcttccgtcttcttatctgtaacctggggatgatggtacccatctgacagctttgttgtgagctttagaaataactgg

SEQ ID NO: 78898 - DNA, 201 bp, Bos taurus; identical to SEQ ID NO: 38709

SEQ ID NO: 78899 - DNA, 201 bp, Bos taurus; identical to SEQ ID NO: 38711

SEQ ID NO: 78900 - DNA, 201 bp, Bos taurus
ccatgtcaggtggcttgtgggatctcagtttactgacaaggtactgaacctgggccactgcagtgaaagcccagaatcgtaaccactgggccaccagggarctacccacccccactggacacacacactttcattttgcatttctacctggttccctcaaactttactacgccttaactttaataaatatttattgagagc

SEQ ID NO: 78901 - DNA, 201 bp, Bos taurus
gtgcatctttgaacccagtggggagagaagatgctgggggcagaagcctagtgttctccccctgcagggcctggagtccgtattgagagtcctgggcccaygccgcttagaccaccctctgtatgtctaagccgagaaaggagcaggcccatcggcactgcccagcccaggaccttctcggaggctcagtccagcctccct

SEQ ID NO: 78902 - DNA, 201 bp, Bos taurus
aagagcctgggctggtctgggctggcaaagaaaaccactgaagggggttaggagtgatgagcaaggcagggctcctgaataaaccatggccaagtgactcygtttctgtctttcagagcgccagcacccagataaagctgcagggagattgatgggcttccctggtggcactagaggtaaagaatccacctgccagtgcag

SEQ ID NO: 78903 - DNA, 201 bp, Bos taurus; identical to SEQ ID NO: 38712

SEQ ID NO: 78904 - DNA, 201 bp, Bos taurus
cttggcactcagcagcgtgacctcacaggccgggacctccgggataggcactgcctggtgccacagacacggtccccccctccccgggctgcagctgctgytcctggcctccctgacccggaagttaggaggatttgctgttcctgtagaagattagtcgcaactgtgaactccaagtgccgtaggggagaggggtggggg

SEQ ID NO: 78905 - DNA, 201 bp, Bos taurus; identical to SEQ ID NO: 38713

SEQ ID NO: 78906 - DNA, 201 bp, Bos taurus; identical to SEQ ID NO: 38714

SEQ ID NO: 78907 - DNA, 201 bp, Bos taurus
tgaaacacttcaagaggtatggaggaacagcaagtggccattcggttatctcaagagttggggtggtcagcagagccccaagaagaacaaatctctttgaygctcaaagaacattcccttcaaggccttgtcacttctggctcctcctgtctccagccttcaaaattgtccaagggctgcctgctccccagagcatgtgct

SEQ ID NO: 78908 - DNA, 201 bp, Bos taurus; identical to SEQ ID NO: 38717

SEQ ID NO: 78909 - DNA, 201 bp, Bos taurus
ccatggtcaaaaccagtgtccaccacccaccaccaccccgccctcagcatctttccttctgctcataaatggatgtgccgtcatcagaggaccccttcagyagagggctgggtttgagccaaggccccacagacactgagggttcagaggaatgccaaacgagccttaggctggagggcagggcagccggattctagtctc

SEQ ID NO: 78910 - DNA, 201 bp, Bos taurus
cttcctgacgtgctggacccgatgaagcctctcccggcccagcctgccccgggctttacattcctcccaaagctccacccgatgccagcacctgtctcctyggggacagtggccccagaggaatgaatgtctggcttcatccctccccaggcctgccctctgagctggggcttccgggccaggcttctgaatcagctccgc

SEQ ID NO: 78911 - DNA, 201 bp, Bos taurus; identical to SEQ ID NO: 38718

SEQ ID NO: 78912 - DNA, 201 bp, Bos taurus; identical to SEQ ID NO: 38719

SEQ ID NO: 78913 - DNA, 201 bp, Bos taurus; identical to SEQ ID NO: 38720

SEQ ID NO: 78914 - DNA, 201 bp, Bos taurus; identical to SEQ ID NO: 38721

SEQ ID NO: 78915 - DNA, 201 bp, Bos taurus; identical to SEQ ID NO: 38722

SEQ ID NO: 78916 - DNA, 201 bp, Bos taurus; identical to SEQ ID NO: 38723

SEQ ID NO: 78917 - DNA, 201 bp, Bos taurus; identical to SEQ ID NO: 38724

SEQ ID NO: 78918 - DNA, 201 bp, Bos taurus; identical to SEQ ID NO: 38725

SEQ ID NO: 78919 - DNA, 201 bp, Bos taurus
aaggagcccggtacagctgtgcccagcttcgccctagcaagagggcagcgatgctggctgcaaaagaatcttccagaagtgccaggggttctcccagagakagaagcctctcagcaagtaagcggactgctcatcgctttctaatccaccggtttagtctctctgaattttccatctagagtcctcttcccggccccaacc

SEQ ID NO: 78920 - DNA, 201 bp, Bos taurus
catgaccagttgctctcgccatttcgcaaatctgcaggaaagcctacctccacctgacaactctgacttcttccaggtcatctgtcctgggagtctgcccrgctgtttcgattgggtcagctgcaggcattccccgcgggggacaacatctcctcgaaggtgcttgtggcaggtgaggtctgcagaggttggaagtggagc

SEQ ID NO: 78921 - DNA, 201 bp, Bos taurus; identical to SEQ ID NO: 38726

SEQ ID NO: 78922 - DNA, 201 bp, Bos taurus
catcagttagatctcggaggaggggaaccctgctgtggaatctatcctggatttgctttgtatacatttttgcacaggctggtgtgtttatgccaatgcgytgtgcatgctgaaacattcttgtgtcacactgcaaccatgctgagtttcttttatgctttgctttctcccttccctcacctccaaatgtggggtgcactc

SEQ ID NO: 78923 - DNA, 201 bp, Bos taurus
tgaagaggaagctggaaatgtagatacttgattagctcaggcacgaggcagcggctgctttaattagagggaccacggtggagccggtgggaaggagagcycagccgtgttttgaaggtctagttcacctgacaagtgcatgtggggggtggcagaaatcgaagcatcaggaatgactcccaggtctctgtcttgagcaac

SEQ ID NO: 78924 - DNA, 201 bp, Bos taurus; identical to SEQ ID NO: 38728

SEQ ID NO: 78925 - DNA, 201 bp, Bos taurus
gctgtggagcatctgaaggcctcgcgcggtaggcagttggtaagagggtggcccgctgtggagcatctgaaggcctcgcgcggtaggcagttggtaagagraataatggagtcatttaagcatttcattgctttgcttgctttaatattccatcacaggttaagtcatgctgtatgagaaattaatactaaaaatgctttg

SEQ ID NO: 78926 - DNA, 201 bp, Bos taurus
cctgagtcaagccctaagtctgcttctcttcccaactagcttttgaaccctgaatttgtatcagggtgttagctgttgattctcctgctggcccttccgtraacggaaggctgaccatctcttgacaagccgtgtcctcctcaggctgcccttctgcctggtcaggccaagaccctgttcagtccatacccaaaccactga

SEQ ID NO: 78927 - DNA, 201 bp, Bos taurus
ctggaagccagctccccacaaaggaggaaggatggggccaagtcagcctgggcctcgagggaatatgagagagcgacctgtggctgattcacagggggccrgactgacaaagtgtgagagggagttggggatgtgtcaatcatttctccttgacaagaatttatttggggcatcagccttcaaaaaggcaacagataacct

SEQ ID NO: 78928 - DNA, 201 bp, Bos taurus
agtccaactgagagagacagagagtaatctacatcccaccaaagagctctcaatatcccactgtgaaatgcaaagaaatgaaaataaaactccatgatccrtgtaaaagtatggctcagaatttaacagaatcagtggtgcatatttctcagattcaagaatcagaagttcaaagatgtaactgaaaatctaaaattaggc

SEQ ID NO: 78929 - DNA, 201 bp, Bos taurus
gactgtcaaggagagagaaaagatgcaaatcatgaaataaaactctcaggagccaaaagagagacttctgaagtcattctagagattggccagaaaatcartgtattcaggaagtgatcagcatagacatgatcattttcttggggaaagctgtacatttggccagtcagagctctataaatcaataatgtaaccagagtc

SEQ ID NO: 78930 - DNA, 201 bp, Bos taurus
ataaagagaaaaagttgctgtacttccaaagacagtacttgttggggagaggcgggagattttattgtttccattagttatttagttaaggattctttccmccccttttttcccttcctacacaataatggagcaagagctgtgactctcacacattagaccagaaagaacttggcagacgaaagtagccgaggataaggg

SEQ ID NO: 78931 - DNA, 201 bp, Bos taurus
tggcttgagcttccttctgtgaagacttttgggtgattggaaaatgtgagagagctttaccaccaccacaagaacatctcttcggaatgaggaggtgctcrgatgagctgctgtatcattctcaacaccaggagttttaaaactgcttttgtttcttacaaataaagggctcatttccccactgtctctcctccacccatc

SEQ ID NO: 78932 - DNA, 201 bp, Bos taurus
tgcccctggagacaaactttttgctcagaacctggcctctgggcttcttttggtttgtgtgaggcatctggaggaaagccctgagggaaacgtggtgtcckgggtgagaaaggtggttagcccgaaccccaaacacctcccactgccgcacgctcctgagcagaccagcgctcacccttaaatgccaaacatcagaacgcg

SEQ ID NO: 78933 - DNA, 201 bp, Bos taurus; identical to SEQ ID NO: 38737

SEQ ID NO: 78934 - DNA, 201 bp, Bos taurus
ctttaccatctgagccaccaggggagcccagaggtataggtaggctgcacctgtggaagaagataaagtgaaaacagatggagctttagacttttattttkgtttcactgaatggagtagacagaaaatcaaaaccatttcctcagtgttcgctttctgatctcctctgtcaccttccaccaaaatattaggacagacagg

SEQ ID NO: 78935 - DNA, 201 bp, Bos taurus
gtgggaggattattccaactgttttgggaaatgggtagacattcccaggagttgggctactgtccactttttgatttttatggttggcctcagaactgcckcgatgcctgtgggtgtgttgtttaaccgacgtgttacaatgagcatacactgaggctcaaggcccagtggaattcacccaccgtcttggacctatttggt

SEQ ID NO: 78936 - DNA, 201 bp, Bos taurus; identical to SEQ ID NO: 38739

SEQ ID NO: 78937 - DNA, 201 bp, Bos taurus; identical to SEQ ID NO: 38740

SEQ ID NO: 78938 - DNA, 201 bp, Bos taurus; identical to SEQ ID NO: 38744

SEQ ID NO: 78939 - DNA, 201 bp, Bos taurus
tctgtatccagtagttgagtgattcgtaaaacaaattggccactcaaagtgtttgaaatcaaacatccacaggaaaaatcatctcatcatcaagtctgaaratttcatgaatggccaaaacgacaaacccgggttagaataccagaaacgagccctgtgaaacgagcctgtgaagcgtggtgcggatgccatcctcccccc

SEQ ID NO: 78940 - DNA, 201 bp, Bos taurus
gttaacgacttccaattaaagccaaagaggaatgtaatatggaccaggagtcatcacatgattgaggaaagtcacaaagggcaaggtcaccaagctttttytgaaaagggccagagagtcaatattctgggctctgcaggacatgcagtctccatcacagtgattcgactacacaattgcggggagaaagcagccctcaac

SEQ ID NO: 78941 - DNA, 201 bp, Bos taurus; identical to SEQ ID NO: 38746

SEQ ID NO: 78942 - DNA, 201 bp, Bos taurus; identical to SEQ ID NO: 38747

SEQ ID NO: 78943 - DNA, 201 bp, Bos taurus
gctggtttcttgaagaaaaaggcccttatagattaaggatgatttgtagatcaaggctaatagacccaggataactacactgttatgcttgtctcagaacyggccaaagaatgctagctcctgatgctgggtctgaggaacccctaagccctcccagacgggttgcactgtctgctggccgctctagcgctcaaggtggtg

SEQ ID NO: 78944 - DNA, 201 bp, Bos taurus
ctccacctcggtgtctccatttcttctctctaaataggaacctcgagcctgtcttacagagtgaagtcagaaaaataaatgtcctttgttaacgcctgtgytttttctcctaactctccaagagcgggtccctcaggattcccaccgccctccccgcctccgcacagtgatgtggcaacgagggtcccgtggggatgtcat

SEQ ID NO: 78945 - DNA, 201 bp, Bos taurus
ggtgggccagtggttaagactccacacttctcacactggtgcaggtgtgatctctgttcgaggaattaagatctcatatgccacatgttacagccaaaaamtacaaaacaaaaagctgccacgggcccttcgtgcaggggctgaaaggccacattcgtcatttcccaaaaggctccacggggtgctgcgtgagacggacat

SEQ ID NO: 78946 - DNA, 201 bp, Bos taurus
tgaagtcatttccccagttaatggtaaatacaaagtcaacaaatgcacacgagcctcacaaaggcagacctgtgggccttgggtcagagggcttagaagcraattgagaaagatgaaagggtcacgtagggtcagtcggggtcagaggccatcaagagtggaggttctagggcaggacgagagcgaagatcatccccgtct

SEQ ID NO: 78947 - DNA, 201 bp, Bos taurus; identical to SEQ ID NO: 38753

SEQ ID NO: 78948 - DNA, 201 bp, Bos taurus
ccagctcatggacctggcaagtgcctggttctgacccagttctctccgtgaccctgtgcaagctccctgcatctgggcggctctgttctcccacctgtaakctggggccagtaaggatctacctctaggcttgctgggaggattcacgggttcagagtcggtaaacacccctcaacgagcagaaacattcttcagaccgcc

SEQ ID NO: 78949 - DNA, 201 bp, Bos taurus; identical to SEQ ID NO: 38757

SEQ ID NO: 78950 - DNA, 201 bp, Bos taurus
tgggcagcagcaggccagagatctcaggctgacccgggccacatgaagtgtttaaggacagcagtagacgctgcttactcaccccaccttacaccttaggkttcacttgggcctgatccagcgtgagtgaagtggtgagaaagacctgaatcacacttgtattcctttaaccttcaaggtgcccagcttaaccatgtgaat

SEQ ID NO: 78951 - DNA, 201 bp, Bos taurus
cagggcccaacttttggggagaggatgtcagctgtgggaggaaggggagtgcattcatgtggtcgaggtgatgaatgccactcccagctacagtctgctcrtccatagtcacagggcccctgatgtttggctggacatgtggctgccgtgaataagacatgtcccagcctctcttaactgttggcttaaaactcaacattc

SEQ ID NO: 78952 - DNA, 201 bp, Bos taurus; identical to SEQ ID NO: 38760

SEQ ID NO: 78953 - DNA, 201 bp, Bos taurus; identical to SEQ ID NO: 38761

SEQ ID NO: 78954 - DNA, 201 bp, Bos taurus
tactaactgggctgtttgacactggagaaaccactaacctgtcaaaaccttagtttccttaaggtctctttctcttctctgggatcttaatcatcatgacrgtgaatgaaaactaatttcatagttaagatacatagattacaaaatgcctaacagcaggtatttaacagttcattacgcataagttgtcaaggataagta

SEQ ID NO: 78955 - DNA, 201 bp, Bos taurus
agcttcaaagaaatcctttggctgtcttatctcaagcccatagatggcactctgacactgtctaccggaggcatggatacagcagagaaagtcaccccggrggcctgctgcccagagccagtctgcctgtcaagcttgtcaccacacccacagacccccgtggggacagaagaccagggctgccagctccctcccactcag

SEQ ID NO: 78956 - DNA, 201 bp, Bos taurus; identical to SEQ ID NO: 38765

SEQ ID NO: 78957 - DNA, 201 bp, Bos taurus
tcttctcttttaaaatttttcctttagaattaaccctctgccatcctgaaactctttatctactaagtgcaataagggccactctcttgtcttagaataarcatgctctcatccctcccatatgaaatatgagggatttattttgacctttggtaacctcctgaggcttcccaggtggctcagtgggtaaagaacctgtct

SEQ ID NO: 78958 - DNA, 201 bp, Bos taurus
cagctatcatcactcgccttagggtgccttctccctccccttcctggctgcctgagaaggagaggccggggggtctcttcctttgtgtaccatactctgcrctggacatcccccattgggcatgagtcaaaaatgaggctgaggtggacagatttcagtcttaccaaaagcttgtacagttccttactcctcaccgctagg

SEQ ID NO: 78959 - DNA, 201 bp, Bos taurus
aaatgggactttcctttggagaacaggattcaggagaggcagcaggggatgggggagcagaaaaaactaagggggcagagaaggagagagtgggtacatayaattacatttcttttacagtgcattcattctccactttattttttcattagcaaaaatgagaaaattctgacttgcttaaagagtcccacccagatcaca

SEQ ID NO: 78960 - DNA, 201 bp, Bos taurus
cccgaccccagggttaacctggacacggctgggctggccccagggaggtgggctgagctgttcctttcggttccccagcctgttgctgagagaagcattcrgtctcacccatggcctgtgattgctctgtcaaatcaattcgagagactataaagatataagagctgaacagcaccagcaggagactccattttttttcct

SEQ ID NO: 78961 - DNA, 201 bp, Bos taurus; identical to SEQ ID NO: 38766

SEQ ID NO: 78962 - DNA, 201 bp, Bos taurus; identical to SEQ ID NO: 38767

SEQ ID NO: 78963 - DNA, 201 bp, Bos taurus; identical to SEQ ID NO: 38768

SEQ ID NO: 78964 - DNA, 201 bp, Bos taurus; identical to SEQ ID NO: 38769

SEQ ID NO: 78965 - DNA, 201 bp, Bos taurus
cattcaccatgttttacttcacagtccatcaaaactgcagccctgcctcatctacaaagatcctcaaagatcctgcctgatcttggccaagatccacttcytcctgaaggacctgttgcattgacacgactgccctccacggtcacacgtgtcagaaaacggccacctgagttgttcaggtcactgtccgtaagccctact

SEQ ID NO: 78966 - DNA, 201 bp, Bos taurus; identical to SEQ ID NO: 38770

SEQ ID NO: 78967 - DNA, 201 bp, Bos taurus
ctttggtaggtggggtagtccagacccaggccgaaagcacctccatcaaggatacagcaaagaccactccctagacagtgagactgggtgaccaagggatracggtcttggcccagtgtccttggaggaataagcatctgaacccgtgtctaaccaaagatgggaatgagccctgctgctgctgctgctaagtcgcttcag

SEQ ID NO: 78968 - DNA, 201 bp, Bos taurus; identical to SEQ ID NO: 38772

SEQ ID NO: 78969 - DNA, 201 bp, Bos taurus
gagatgacaaatcctagctttgggaccaaggggctaatcaaaagtgaaaacgacccagcctgccaggcggcctggcattgctatgccctgcccgcttctgytgtactcacaagtgccaatattttagaaaactgcccgttaagatatacgatttttttctgggtatctgcttagaaccctcctctgtctcactgctctgca

SEQ ID NO: 78970 - DNA, 201 bp, Bos taurus; identical to SEQ ID NO: 38773

SEQ ID NO: 78971 - DNA, 201 bp, Bos taurus; identical to SEQ ID NO: 38775

SEQ ID NO: 78972 - DNA, 201 bp, Bos taurus; identical to SEQ ID NO: 38776

SEQ ID NO: 78973 - DNA, 201 bp, Bos taurus
tgactctggaatcagacagacttgagttaaagcaccaaccttctctttctagtttggtccctcagatcagttcctaaatgtctctgagcttcactttcctyatttgcaaaatgactgtgaaaataacagcttcagcatcactagacaccgaaacgtcacatttttgttcacagagtgttagttagcttccctggtagtcca

SEQ ID NO: 78974 - DNA, 201 bp, Bos taurus
agggttggccctaactgaagccacgtagcactcacgcacacacagaacacaaggcttttttgtctctaggttttacggtttccgccgtacgagaacctccyggggccttaacctcctctcatccctggcatttcttgttactccttcagccttattcaagggtaacagagcttcccctgccttcattcctcttagtggcac

SEQ ID NO: 78975 - DNA, 201 bp, Bos taurus
gaagcccctctctctcctatataacacccagcaaggcccagcagccctatgccttctcccagcttctccatcaggacaaggagagaatgcactgcaaccgrgaagtctttctggcctcaggagtccaggtcaccagctcccagttcttagagattctgtgtgtgtgtgtgtgtgtgtgtgtgtgtgtgtgtctgtctgtcc

SEQ ID NO: 78976 - DNA, 201 bp, Bos taurus
atatgtctctgatttctggggccacagtgtcaggaggaggcggacacaacaccctagtcactgtacagactggtagaaggttccgtctgttcagacagacrgatgacaccctgcagggtggccagagtgctggcaagacttccaggcagaaggaggtgatgagaaagctgagtgcattccagaagttgggcgtggccagag

SEQ ID NO: 78977 - DNA, 201 bp, Bos taurus; identical to SEQ ID NO: 38780

SEQ ID NO: 78978 - DNA, 201 bp, Bos taurus; identical to SEQ ID NO: 38781

SEQ ID NO: 78979 - DNA, 201 bp, Bos taurus
cccccgcatcatggccagattcaaaccccaccctttcttccttttctgaactaaaactcctatgagtcccgaacttttcagatactagatcttctagaaargggtcttatcaggggtgccctggcctgaagcttgttggtgctcccaatcacaagctaaaacccagagtccagctttgcagataggcatctgggcagcacc

SEQ ID NO: 78980 - DNA, 201 bp, Bos taurus; identical to SEQ ID NO: 38783

SEQ ID NO: 78981 - DNA, 201 bp, Bos taurus
ggaatgtcttggggcactgtggtttaaaggacagtgggtgacagggccgtgggctctgcaactgcagctgcattggcttcgtgttggctcttctactcttrgaacagacacctgctgaggtggtatgttgtgcctccctgggctgggaccgggccactgagagggcagggcacacttcctgctgcccaaggctgccgggtc

SEQ ID NO: 78982 - DNA, 201 bp, Bos taurus
gaacctggccctaaagttacccatgttatagccaccaaagggaattcctcctgcggtgtctgccctctacccttaaagctaaacatcgtgcttactggcaraggcacaatatttaaagggcccacatccattttcacaaagtaggcaatgaagagtgattttagatttgagatgcagtaatttgataattggcataatttt

SEQ ID NO: 78983 - DNA, 201 bp, Bos taurus; identical to SEQ ID NO: 38785

SEQ ID NO: 78984 - DNA, 201 bp, Bos taurus
ctgaggccagggcgagcctgtgcagccacctgcaatctgaggcttccttgcccgctccttacggagtgcaggcaatgtccccagggagagggcagagaggrcagagcaagtggggagaggtccggcccctcctcctcgccccagtctgtcctatctcgcgccagggtgccagcactggggacctccttgggctgtccttta

SEQ ID NO: 78985 - DNA, 201 bp, Bos taurus
gagggaggcactgactgtgatgggggttttgtgtgggaggtgttggggttgctaatctaactaggatgctgcagggaggcctcaccgaaagtatggtattygcacagcgatctgaaggcgaggagacagcaagcctatctgtctgaaagagcatccttagcagagagaacagcgaacgccaaggccctgaggtgcaagtgt

SEQ ID NO: 78986 - DNA, 201 bp, Bos taurus
gcgggggggtggggggcaccggggccttccaggaagaggaaaaaacaggatgtcttagtcagcttcaaggtcagggcagttttctaaggagcatctggagrtggcagaggagccagagacatccaaagattaaacctggaagggccgggatatagagaactctgtaacaggactgggaagggagccactgttgattcactg

SEQ ID NO: 78987 - DNA, 201 bp, Bos taurus; identical to SEQ ID NO: 38787

SEQ ID NO: 78988 - DNA, 201 bp, Bos taurus
ttgcttctgtgactagatattggaaagccctgcccctctgttcttggcaggctggagcagcctttggttaatactgaggggtgggccaggacggtgccctmcctcctacccataggaagggactgaggcagagatctcctcttggttcccattgcagagaagtctcctccccctgccttgttcttggagtcccaggaccca

SEQ ID NO: 78989 - DNA, 201 bp, Bos taurus; identical to SEQ ID NO: 38788

SEQ ID NO: 78990 - DNA, 201 bp, Bos taurus; identical to SEQ ID NO: 38789

SEQ ID NO: 78991 - DNA, 201 bp, Bos taurus
aggttggtacaggctggattatatagggccttctgcaccttggggaagagtttgttgtctttaaatgcaatgggaagccattggagggattcacattggcrgtgggttaggggaaacctggggccaggcttcagtaccttaggggtcaggctccctctgccctcgacttcgtccactgtctccaggaggccaccagggccc

SEQ ID NO: 78992 - DNA, 201 bp, Bos taurus; identical to SEQ ID NO: 38794

SEQ ID NO: 78993 - DNA, 201 bp, Bos taurus
attgggtggcagcagctggtggggtgttgggataatcttgctgatgactgggtagatatgaacctcttgtgttagtagattccagaaagcaacatgctccytgatgaaaaggccatggtcattgtcttgcgggattggcctggcctggctctgacagttctcagctgctccataaatctcgcatcagttccatctggccaa

SEQ ID NO: 78994 - DNA, 201 bp, Bos taurus
gtgttgttgagggaaggggatttgggcagctgaggaagcaagtttccatcaagtgttagaaaagagcagggacttgatctaacatgatgccaaaacgaacrggaacagctaaagccagagtttctccttggtgcttgcttggaggaaatctaacagccccaggagtcaagagggcgtcagatggggacttgggggtgaaga

SEQ ID NO: 78995 - DNA, 201 bp, Bos taurus
tatctgttcctttctccccagtagttcctgtattctagaattgaagtgtaaagacttgattagattcattcatttttgtcaagaatacggcacagggggtratgtgcatttcagggcaatgtgaattttagcatatgaattttcatctcaagacatttattgacttcagacatacttttgtgcccttgggaaccaaagctg

SEQ ID NO: 78996 - DNA, 201 bp, Bos taurus
aaatccaaagcttcattactatgattgctattttatttggtctatattcatgttgttaaatacaccagcaaattgcttttaacttcctcaacacaagctgytatgtatgtagtcatacattttaactggaaacacatctctttaacaaaatagactattaattttcttagaatttctctgaaactctctctaaaactaccc

SEQ ID NO: 78997 - DNA, 201 bp, Bos taurus; identical to SEQ ID NO: 38797

SEQ ID NO: 78998 - DNA, 201 bp, Bos taurus
gcactgagggccccgaggaggggctgagtgctgccttttcctggtgcagcattcgaattctctgcagggcgaccattaatcctacaggctagatggtcagygagggcccccctgccctcatagacctcagagtctggtggcagaacatcatagggtggctgagcagagctgagcaggccccgagtccagcagcctggatct

SEQ ID NO: 78999 - DNA, 201 bp, Bos taurus
tggaaaattaagtcatggaaggacacagatcctggtggagctccctcttcatcctgaacttagatttttctctgccaactggggggtaagactactgaccygatagacttgtgagcagttagcctggtaatgaattataagggaggcagtgtgatgcttggcacagaaccgtgtcctgcataaacatatcacagatacaca

SEQ ID NO: 79000 - DNA, 201 bp, Bos taurus
ctggaccatatacttgcctggacttgtcttctcattacagctccccacccaggacgacaccaaggacaccgtgtccttcagttccattacagaactgggcyaccaaaactaaaaagatcaactgctttacatatttccgcatgtgatgagcacatgttcatgtaatatatggtagtatctgttggccttgtgtatgtgtca

SEQ ID NO: 79001 - DNA, 201 bp, Bos taurus
cttatcatcttctccatgtacagaggtttacctctttgagaggaaaaggtcctccctctgccttatctctaggtcctttcactgatcagctggcatgtctrtatgttatttttacccatgaaattatgtattgccttctccataactaacaccagtgacaatctgtaacagttcttccctggagaccgatttcattttcct

SEQ ID NO: 79002 - DNA, 201 bp, Bos taurus
aggtgacagagacggtgaccgtgagctctgtgactgcttcatgtggttagcttcacaaggcacggtgacttcagacttccctgtagttgtcccacccctgktctggccagggggaaatgatttgtgttagatttgttgtctcttccaccaagaaaaagatcaaaacactgaatgaaaaaaggaaacaaatctgttcaaaag

SEQ ID NO: 79003 - DNA, 201 bp, Bos taurus
gtgactgccagctgctctgccttcctcggcatgtgcggtggccagcgctggtgcttagcagcttctggctctccttcccttccagagcacagagcgctgcrtttctcagccccttgcccttggccacggccccgtgagcagtcctagaaatgaaatgtgaatggaagtgattgtgacttctggaccaggatactgaaaacc

SEQ ID NO: 79004 - DNA, 201 bp, Bos taurus
ggaagggtggcatttggggagtttgctagtgctaaattgctccatctgttgcattaataaccaatcagtccggggggctgggaaaatgggtaattggagcrtacggtacctattagggccgatctgcacatatgtaactgctcatttcatctgtacgagggactgcttacttatgcaaatagcaggtctgatgcccacgtt

SEQ ID NO: 79005 - DNA, 201 bp, Bos taurus
gacccggtgggcacagggggccgtgagggcgccgggatgagggggctggtgtgcccttcaaggtggtcacgacaataataaagggggaagtaaagaacgcrttgtcaagagctttgttttactcctttcctccctccagccaatgaaccagcgatgaaaagaatacagctggtgatacagagaagagaacaacaaagcacg

SEQ ID NO: 79006 - DNA, 201 bp, Bos taurus
tcttcttttgcattcatgtcatgtgtatcagtctgggctttctgatgaaaactaagggcaaaaagaatgtcatatgtcaggcccagggttggtgaatccarccctaaatccaccctctcatttcatcctcaccacagtcctgattttacagaagaataatctgaggcccagagagaggtgaagtaacctgctcgggaccac

SEQ ID NO: 79007 - DNA, 201 bp, Bos taurus; identical to SEQ ID NO: 38799

SEQ ID NO: 79008 - DNA, 201 bp, Bos taurus
actggacttccaggtaagtcccccaaccctttcattttatagggactggcaacggtggcccacagagaatgtcctggcctcagggcacccagggagtcagrggtgaaggcagagcatccctggtcaggggcagccctcaggggctaagagtgagacccagggagagatgtgacatgtctgggccatcacagccacagccca

SEQ ID NO: 79009 - DNA, 201 bp, Bos taurus
gagaatttaaaataaaaaattattcattgctggctctaaaagtttcaaattccactggggatcttagaaattaaatataagtcacccttcaaagacactcyaatcagcaatgatattagacataacagaaaaaaccatgttagaatttacattgatagtttaagtcaagtgcttctgtaggctcatggaatttgtgacgtg

SEQ ID NO: 79010 - DNA, 201 bp, Bos taurus; identical to SEQ ID NO: 38800

SEQ ID NO: 79011 - DNA, 201 bp, Bos taurus; identical to SEQ ID NO: 38801

SEQ ID NO: 79012 - DNA, 201 bp, Bos taurus
gttagaacttttgatggcaagtgtcagaaactcaacaattaaatagaaagaggacttactggcgcatgaatccaaggaagggccgaagaaccaagcctccrgaagggcagctgctctactagaccaggaacaattagaaccagggcatggaatgttccagaacattctttctgcctcatttcttggccttttctccacagg

SEQ ID NO: 79013 - DNA, 201 bp, Bos taurus; identical to SEQ ID NO: 38802

SEQ ID NO: 79014 - DNA, 201 bp, Bos taurus; identical to SEQ ID NO: 38803

SEQ ID NO: 79015 - DNA, 201 bp, Bos taurus; identical to SEQ ID NO: 38807

SEQ ID NO: 79016 - DNA, 201 bp, Bos taurus
gaaagcattccgaacacctagatccctcagcagtacaagtggaatctccaataggaaaaccaaagagaccacctgccttctagcctactatcttgaagaamtgtcatgcagttaccaaacttttaggcttatgttcagcattaggacaataagaattatatgagcagatggagggtgtaagtctcagacatgcattattgt

SEQ ID NO: 79017 - DNA, 201 bp, Bos taurus
tgatcatatttcatttctttcataagctacagacaaacacaaggattttttgcctctgcagtgacaagcagagaaccatggggccgtgttgagatgcagaygaaagcaggctcccttctaactgagcggctcatgtgtcttcccctgggtgcagggctcagatggatgacagaaaagcacaggccaaggaccttccaggct

SEQ ID NO: 79018 - DNA, 201 bp, Bos taurus
gtagtagcaactttgatttgtgaccatgaaattgggtcttcaataacagcatctcatacaacaacacagaaacagtactgaacttccccactggcctttaraagtccagattctacttacatttctacctatgtgggtgtaaatatttgtctcccatgagggggtagcagaagtcctaggtgagcttccaggcctccttgt

SEQ ID NO: 79019 - DNA, 201 bp, Bos taurus
ctccctcttccgttcaaaattccatcagggagaaactctttccaaccaatatttaaaggcccctctcatgggcagggcttcaaaatgtcaccagggcagaygctgctgatttttgtaaaataaccatgagcctggagttagagaaagagagcccctatatccctgagtgacagtcagtattttgtagaacatattagaaaa

SEQ ID NO: 79020 - DNA, 201 bp, Bos taurus; identical to SEQ ID NO: 38809

SEQ ID NO: 79021 - DNA, 201 bp, Bos taurus; identical to SEQ ID NO: 38810

SEQ ID NO: 79022 - DNA, 201 bp, Bos taurus; identical to SEQ ID NO: 38811

SEQ ID NO: 79023 - DNA, 201 bp, Bos taurus; identical to SEQ ID NO: 38812

SEQ ID NO: 79024 - DNA, 201 bp, Bos taurus; identical to SEQ ID NO: 38813

SEQ ID NO: 79025 - DNA, 201 bp, Bos taurus; identical to SEQ ID NO: 38814

SEQ ID NO: 79026 - DNA, 201 bp, Bos taurus; identical to SEQ ID NO: 38815

SEQ ID NO: 79027 - DNA, 201 bp, Bos taurus; identical to SEQ ID NO: 38816

SEQ ID NO: 79028 - DNA, 201 bp, Bos taurus; identical to SEQ ID NO: 38817

SEQ ID NO: 79029 - DNA, 201 bp, Bos taurus; identical to SEQ ID NO: 38818

SEQ ID NO: 79030 - DNA, 201 bp, Bos taurus; identical to SEQ ID NO: 38819

SEQ ID NO: 79031 - DNA, 201 bp, Bos taurus; identical to SEQ ID NO: 38820

SEQ ID NO: 79032 - DNA, 201 bp, Bos taurus; identical to SEQ ID NO: 38821

SEQ ID NO: 79033 - DNA, 201 bp, Bos taurus; identical to SEQ ID NO: 38822

SEQ ID NO: 79034 - DNA, 201 bp, Bos taurus; identical to SEQ ID NO: 38823

SEQ ID NO: 79035 - DNA, 201 bp, Bos taurus; identical to SEQ ID NO: 38824

SEQ ID NO: 79036 - DNA, 201 bp, Bos taurus; identical to SEQ ID NO: 38825

SEQ ID NO: 79037 - DNA, 201 bp, Bos taurus; identical to SEQ ID NO: 38826

SEQ ID NO: 79038 - DNA, 201 bp, Bos taurus; identical to SEQ ID NO: 38828

SEQ ID NO: 79039 - DNA, 201 bp, Bos taurus; identical to SEQ ID NO: 38829

SEQ ID NO: 79040 - DNA, 201 bp, Bos taurus; identical to SEQ ID NO: 38830

SEQ ID NO: 79041 - DNA, 201 bp, Bos taurus; identical to SEQ ID NO: 38831

SEQ ID NO: 79042 - DNA, 201 bp, Bos taurus; identical to SEQ ID NO: 38832

SEQ ID NO: 79043 - DNA, 201 bp, Bos taurus; identical to SEQ ID NO: 38833

SEQ ID NO: 79044 - DNA, 201 bp, Bos taurus; identical to SEQ ID NO: 38834

SEQ ID NO: 79045 - DNA, 201 bp, Bos taurus; identical to SEQ ID NO: 38835

SEQ ID NO: 79046 - DNA, 201 bp, Bos taurus; identical to SEQ ID NO: 38836

SEQ ID NO: 79047 - DNA, 201 bp, Bos taurus; identical to SEQ ID NO: 38837

SEQ ID NO: 79048 - DNA, 201 bp, Bos taurus; identical to SEQ ID NO: 38838

SEQ ID NO: 79049 - DNA, 201 bp, Bos taurus; identical to SEQ ID NO: 38839

SEQ ID NO: 79050 - DNA, 201 bp, Bos taurus; identical to SEQ ID NO: 38840

SEQ ID NO: 79051 - DNA, 201 bp, Bos taurus; identical to SEQ ID NO: 38841

SEQ ID NO: 79052 - DNA, 201 bp, Bos taurus; identical to SEQ ID NO: 38842

SEQ ID NO: 79053 - DNA, 201 bp, Bos taurus; identical to SEQ ID NO: 38843

SEQ ID NO: 79054 - DNA, 201 bp, Bos taurus; identical to SEQ ID NO: 38844

SEQ ID NO: 79055 - DNA, 201 bp, Bos taurus; identical to SEQ ID NO: 38845

SEQ ID NO: 79056 - DNA, 201 bp, Bos taurus; identical to SEQ ID NO: 38846

SEQ ID NO: 79057 - DNA, 201 bp, Bos taurus; identical to SEQ ID NO: 38847

SEQ ID NO: 79058 - DNA, 201 bp, Bos taurus; identical to SEQ ID NO: 38848

SEQ ID NO: 79059 - DNA, 201 bp, Bos taurus
tgcctggatttattctttgtgttgctcaaattgcctcttattggtctatctttatgttcacttacttctgttatctccatactaccattcagctgcttcartgaggttattattatttttattttttggtttgaaatttcccacttggctctgcttcctgtcttatattcttgtattctatcttatatcctttgctaatac

SEQ ID NO: 79060 - DNA, 201 bp, Bos taurus
tttcattcttttttatgcataacaaaatcattattgatactaccagtttgcccttgaacaataatttatagtttacaaagcacattcacgtcctcatcttratctccaaaaccactgcgtgaagtaggagggcagggcaggcattaatatccctgctcacagttgaggaagctgaatcatatatgtgtgcttcattcagga

SEQ ID NO: 79061 - DNA, 201 bp, Bos taurus
catttctgggccctggttatatttgactgtttatcctttcctctactcccagtagcataaaacaccctctctaagtagaaattaatgattgctttaaagtktcaagcagcaatatttaaacacaaagaatattttgacaatcacatgtatgactttaacatatctgtgaatttatgtgatggaaaatgtttcagataccta

SEQ ID NO: 79062 - DNA, 201 bp, Bos taurus; identical to SEQ ID NO: 38851

SEQ ID NO: 79063 - DNA, 201 bp, Bos taurus; identical to SEQ ID NO: 38852

SEQ ID NO: 79064 - DNA, 201 bp, Bos taurus; identical to SEQ ID NO: 38853

SEQ ID NO: 79065 - DNA, 201 bp, Bos taurus; identical to SEQ ID NO: 38854

SEQ ID NO: 79066 - DNA, 201 bp, Bos taurus; identical to SEQ ID NO: 38855

SEQ ID NO: 79067 - DNA, 201 bp, Bos taurus; identical to SEQ ID NO: 38857

SEQ ID NO: 79068 - DNA, 201 bp, Bos taurus; identical to SEQ ID NO: 38858

SEQ ID NO: 79069 - DNA, 201 bp, Bos taurus; identical to SEQ ID NO: 38859

SEQ ID NO: 79070 - DNA, 201 bp, Bos taurus
gaagcttggggagacgaactgacttgggccacatgtcaattattagaggcaaaatgaaaaacagaagtaaggtgttttgacttctagaccaagtcctttayactggacttgttacctcatcttgttggaaatcacatgattttcaatgatttttttaaatatttacttttagaaagaaagatattaacatttaccaacctt

SEQ ID NO: 79071 - DNA, 201 bp, Bos taurus
ttcattcctattattggcaatacgatttttttttcacatgaagctttgaaataaaagtgtacatgtctcccccatccacttcctggcctgtttctagcctwccctgtggcacaggcagcagcagcactcccccaggagagggagggagggaagggcaggcggaggaggcagggtgatgaggaaagccctgccagatccaag

SEQ ID NO: 79072 - DNA, 201 bp, Bos taurus; identical to SEQ ID NO: 38861

SEQ ID NO: 79073 - DNA, 201 bp, Bos taurus; identical to SEQ ID NO: 38862

SEQ ID NO: 79074 - DNA, 201 bp, Bos taurus
catagcttcagagctgttgtcagttatttctcttagcccttgattccaggaacaaaccattttgtctttatttccaacattatttcttggggtgggggatrctgtttaagaaaccagagttagagatgaggacttgggcacaagtaggagaaggcaatggcaccccactccggtactcttgcctggaaaatcccatggacg

SEQ ID NO: 79075 - DNA, 201 bp, Bos taurus
ggcctccttaggaagtagttctaccaaggtcaagtccaagatccaattagggcagaaagactgaagtaacagtgcctcagacgtcttcagctgcccagtgygcggcaccttgaatataggcgaggccccatatacatatccatacagatatagaatgttcaccaaatcagttgaacgcatttgtttatgcaaaaatagtta

SEQ ID NO: 79076 - DNA, 201 bp, Bos taurus
gaagtagagctggctggatttgctcataaattatgtaggtgtgagacaaagaggctaaatcccaacttttggttctgaacagcagggtaaatgtggaattrtttctggagatgagaaatatacaaagaacaggtttgtgggaatgaaattcagatgatttgattttgtaagtgttaaagctaagtaacctcacattcatta

SEQ ID NO: 79077 - DNA, 201 bp, Bos taurus
tctccatccccacttttggtaactaaaataaatacccaagaaggcaaacaggaacatctctgtgtgagagaagtaacctggtttgtgggagagaccaaatkgtatagagtctattggtgctaacatccaaccaagaagttgcctttataaacaaaccaaataaatacctgtgctttgccaaagatgacagttttttttttt

SEQ ID NO: 79078 - DNA, 201 bp, Bos taurus
gtttgccaggttagcaaatgctctcatgagaaagtggctttctcctataaggagaaacttctatgtttttttcctacaggaagaattgggcctgaaaaatycctataatcttctaaggtcttcaatgcaactaagaaggcttaaaaattactttcctgtctttttagttggtttcagttggatacttggccaaatatttta

SEQ ID NO: 79079 - DNA, 201 bp, Bos taurus; identical to SEQ ID NO: 38865

SEQ ID NO: 79080 - DNA, 201 bp, Bos taurus; identical to SEQ ID NO: 38866

SEQ ID NO: 79081 - DNA, 201 bp, Bos taurus; identical to SEQ ID NO: 38867

SEQ ID NO: 79082 - DNA, 201 bp, Bos taurus; identical to SEQ ID NO: 38869

SEQ ID NO: 79083 - DNA, 201 bp, Bos taurus
atctcaatattaagattgtcttaatgttaaccacatctcctgctaaaccttgtgctcctgctaaactttgtcttcacgtggggtcgccccctgctgaccakccacagtgggcacaaattccattgaaatcagctctaattccaagggaattacctgctggagatgatggctgttggcataattgaagtctcgagtcaggca

SEQ ID NO: 79084 - DNA, 201 bp, Bos taurus; identical to SEQ ID NO: 38874

SEQ ID NO: 79085 - DNA, 201 bp, Bos taurus
atactgcttgggggagtcagacagttgttggtaccctatgatacacttacaatttgacattttctaagagggagaaacattttaccattgggccaactttytctgagtggaaccactctaagagattttggaagcaattgagatttacctcataactgtggctcttcatcttgtttctactttgatacatacgttgatatt

SEQ ID NO: 79086 - DNA, 201 bp, Bos taurus
tatggcttagaaagctttcaacaattttaatgatttaaaattatgaatgttacagtttaataatatatccatagaagtggaatcaaaggacccatatgacrtattaattagtggctctagctctgtacactaaactaaggagacaaacaattccagcaatccagtgatcacattgaagggcaagtctcgcagaaggcaagg

SEQ ID NO: 79087 - DNA, 201 bp, Bos taurus; identical to SEQ ID NO: 38877

SEQ ID NO: 79088 - DNA, 201 bp, Bos taurus; identical to SEQ ID NO: 38879

SEQ ID NO: 79089 - DNA, 201 bp, Bos taurus; identical to SEQ ID NO: 38880

SEQ ID NO: 79090 - DNA, 201 bp, Bos taurus
aagaagggaagtcctcacttttcctgccagactgagcacagtataaccggccctctgagaggccaccccacaaattcaaagagacagatgtgtggggggartagtcctctgacactcaggctttacactcagttcattttactgagctccagccattaccaaaggacctggggaagttggatgggaattcatgtttccttg

SEQ ID NO: 79091 - DNA, 201 bp, Bos taurus
attcctcctagctccctgcaaaatcagactatctgacatatgtgtgctgtgatcatggggactttataatggaactaggtaaaagattctgttagaatacytagaaacaagccaggaagcctggatatcatacatttgaagtgtctatttagttaacctgaagaatcatctatagataacaggaaaccccacatcccctgg

SEQ ID NO: 79092 - DNA, 201 bp, Bos taurus; identical to SEQ ID NO: 38882

SEQ ID NO: 79093 - DNA, 201 bp, Bos taurus
gacggactggtttgatcttgcagtccaagagacttgcctgtgagtgtcctggagtctctggtggaagcatgggttgacagtggcctgctgcagggtcaggracacatactataacagtcctggagcctgctggcataagtccttttgaaggaggtcaccattacccctaccatagtttggcctcagaccaaacaataggga

SEQ ID NO: 79094 - DNA, 201 bp, Bos taurus
ccatgggaaaagaagagccatagtttcttttaaaaaaatccttggtgaaacattattacgattaaaaattgtagtgaaaagccttaagtaccaaattttaragcagcagtaatttaatttttatatcagtgttcttgttttgcacagactaaatgcagtgataggtgagtttatgagtacagtagttgcctttatcacatt

SEQ ID NO: 79095 - DNA, 201 bp, Bos taurus; identical to SEQ ID NO: 38883

SEQ ID NO: 79096 - DNA, 201 bp, Bos taurus; identical to SEQ ID NO: 38885

SEQ ID NO: 79097 - DNA, 201 bp, Bos taurus
taggaggctgtatgtgacacatgtgtgaaagtcacaacatttgccctccctgtctatctctagaagctggtaattgccccctcttggtttccttgcatctrctcaaacttttgcaaacagtcccttcactaagctcacttcaaattacccaattacatagcctctgttgggcttcccaggtggctcagtggtaaagaatct

SEQ ID NO: 79098 - DNA, 201 bp, Bos taurus; identical to SEQ ID NO: 38886

SEQ ID NO: 79099 - DNA, 201 bp, Bos taurus
acttggagcaatttttcaaaatgaaaaggtttttatacaagtaatgtaacttttacaaagatcttctttggatcatggcttgctgcctgggccagatttarctaacggatcaaaggcagaacactctaagctctgcacaggactgctgaaattcagctctcgagtgtgtgtgcttgaactgcagtggttcttaccctctgg

SEQ ID NO: 79100 - DNA, 201 bp, Bos taurus; identical to SEQ ID NO: 38887

SEQ ID NO: 79101 - DNA, 201 bp, Bos taurus; identical to SEQ ID NO: 38888

SEQ ID NO: 79102 - DNA, 201 bp, Bos taurus; identical to SEQ ID NO: 38890

SEQ ID NO: 79103 - DNA, 201 bp, Bos taurus; identical to SEQ ID NO: 38891

SEQ ID NO: 79104 - DNA, 201 bp, Bos taurus; identical to SEQ ID NO: 38892

SEQ ID NO: 79105 - DNA, 201 bp, Bos taurus; identical to SEQ ID NO: 38893

SEQ ID NO: 79106 - DNA, 201 bp, Bos taurus; identical to SEQ ID NO: 38896

SEQ ID NO: 79107 - DNA, 201 bp, Bos taurus; identical to SEQ ID NO: 38897

SEQ ID NO: 79108 - DNA, 201 bp, Bos taurus; identical to SEQ ID NO: 38899

SEQ ID NO: 79109 - DNA, 201 bp, Bos taurus; identical to SEQ ID NO: 38901

SEQ ID NO: 79110 - DNA, 201 bp, Bos taurus
gggtatgtccaggagtaggacagagaggtggcttaggtgttttgtccaccggttacgtggtgttgagtgcaggaggcatgctccgtactttgtttatgctkctgacaccctctttttattccaagctcttcaaaaacaatagttgggttttttggtctctttgtatcttatgggtccaaaatttgaccccactttgcctgg

SEQ ID NO: 79111 - DNA, 201 bp, Bos taurus
agcacgcaatatggaaagagcatctcaagtaaagtcatttccttggcaacagctctcactcatgttcatctcacatacacatgcattgcctttggcctgakcattcattttgattcagtaaccattagctatggtatctttttttttctttcaccgttccatgcggcttgcggaattttagttccccaatcagggatgaac

SEQ ID NO: 79112 - DNA, 201 bp, Bos taurus
tcttctactggccatttacctctgagagtcactatggaaggagaataataaagtcatgtgatatggcagtattagtaacacacagctgtattgggttactrtctttttactgatcattttaggccagttcttgctccctgggtaactctgggaattctctgcaggcgtgcagaagacgtgaatctagctctttgtgtctgt

SEQ ID NO: 79113 - DNA, 201 bp, Bos taurus
ccagcaaagtagaagaggagacagaataaggtgcaaaaggtgttggatgtaggaagtcttttgtttagagaaaaaaaggagtaggaatgggggaggggcckgaaggagcccagatggcgggggttgctgggctgatgtgcttggagttagactaggctcccagtgctaaaaggagctgactgtaatagaagtcctggctct

SEQ ID NO: 79114 - DNA, 201 bp, Bos taurus
ttcctgaaataaggagaacaatgaggagcccaactatggttcagtctacagagccaggggaggcatccaaatcgaactgggatgtcctgctgggctgagargatagacttggatttgagggaagggcagcttcactggtagctcagttggtaaagaatctgcctgcagtgtaggagacctgggttccattcctaggttggg

SEQ ID NO: 79115 - DNA, 201 bp, Bos taurus
tagataatttctgaattttaaaaagggggaggctaactatgtctcttgatctctcttcttagaaccttggggagacgacaccatattcttcagcggaggtragaggagggtgaagcccgtggtcccagggcctattgatattctcggcacacggtgaggtctgtgatttccctctaaaatatctgtccagtctttcttctt

SEQ ID NO: 79116 - DNA, 201 bp, Bos taurus
ttttccactgttcaatccctagcccctggaacagtgctgaggccctggtagatgttcaataaatattaacagagcagatgcatgggccatggggtagagcktggcaatttgttgttgttgttgttgtacaaataaacattgagactataatcagatttgaccactagtagcctatatttagggcttttcctggtggcccag

SEQ ID NO: 79117 - DNA, 201 bp, Bos taurus
attgtatgagtgtgaattattagtgataggaaccttggttaaattcatgtgtgtgttaaaaagcagttgttagaaggaaactaatgtaaatctatgactcraaatgtcaagttacagcagccaacagcctcagaaaagaaacaaagaacaaaaaagcaggtggcatttactatttgttttaaaaaataaagagtatacgtg

SEQ ID NO: 79118 - DNA, 201 bp, Bos taurus
tataaggtgcctctggttgtgaccaacagtacacctcttattatagtcaatattattatttattctaacaggagaggccaggttatgaaaaatcttgtgaytactcccatgttggaagagtctgactcaatagctttgtcctaggctcaggaatcttaatttcctaaaaatccctccagtagcttcatttatatgatgctt

SEQ ID NO: 79119 - DNA, 201 bp, Bos taurus; identical to SEQ ID NO: 38909

SEQ ID NO: 79120 - DNA, 201 bp, Bos taurus
ctaaatgaatcagtcactcccattgtgttttcaggcaacttcatggactaaggctagttcctgggtaatatgagaagacagcatctgtctcctgtgcttgkcctcattccagcttgtctctcctttttggccccctatatcctcatttccagctttccccatctctgccctgtctttcctctgcagctcctatggctgctg

SEQ ID NO: 79121 - DNA, 201 bp, Bos taurus; identical to SEQ ID NO: 38910

SEQ ID NO: 79122 - DNA, 201 bp, Bos taurus
tgtgcacggagtatttggcagtatgaaaaagaacatggagaacaactaggggcgcttttaaaaattactgatgcccccaccttgttctagaattttcattraagaatggggccatggtgccagtgctgttgttgttctttgttgtttgtgattccccagaacattctaatgtgaagtcagagttaaaagtcattgagtaaa

SEQ ID NO: 79123 - DNA, 201 bp, Bos taurus
gcctcacagagcctggccaattagtctccagagtttaaaacatcttagacaaaatctagagccagataaactggaagaaatgagatagaaatcacgattcyggatggccacagcccagctgatagaagcccacacccaatagcccagggaacgacatggttacaaccaaaaattattcacatttcgaaaagcaggcttttg

SEQ ID NO: 79124 - DNA, 201 bp, Bos taurus
gctctgctgggatgggctggactgagctggcttatctgggttccacctgttttctcattctgaaacccagatggaggaaggaggcaccatgtggaaaacckgagaacaagagcaggaaggcctcagtcaataaatacagtagcttgcagttgtatttaaggcttctgttcggatacaacaaaaacaatcacaacccttccc

SEQ ID NO: 79125 - DNA, 201 bp, Bos taurus
gtctttaagtcattcaagaaaccaaatagttgttgcttctggggaggtcaactaaggatcagaaggagagacttactttcagtttatctcatttatcctayaattatactgtgatatagaatcatcgagggatgaccgtttcttttcttaccgtgccgttggcatatgacagttctttccatttaagaagcctggtttgga

SEQ ID NO: 79126 - DNA, 201 bp, Bos taurus; identical to SEQ ID NO: 38915

SEQ ID NO: 79127 - DNA, 201 bp, Bos taurus
gaggtgagctaggtttgtggacattccttggtgctctcgtcccttcctgacaccacttttcatgacaaaatttctaatctggtcagatttcaaggacatcrattgggctgcatttattattagatggagttattgtttgttaactgaacaaacacaatctttggtctctttcttttactttttcttccatgcaggtgagtt

SEQ ID NO: 79128 - DNA, 201 bp, Bos taurus
ttcacagctagtgagaagataggaatctgaacactgcagggaaccctagagtctgagcattgttatttcttaaattaagctcttataaagatggaggtgamgaaagaaaaagaataaaataggctgtgctaatcttttgagttccggacctgggtcacactgcttttgtaaagctttagagaaaatgcattaagtgaacac

SEQ ID NO: 79129 - DNA, 201 bp, Bos taurus
taaaaagaaatgataagtgctagttctgagctaggccatgagaaaaatcgtttgtctctttttaccccctcgtgcttccaccaattgccatgagaagagcrttccccagttcactgaaggccctgaacagcttacaatctctgctacatcatcactggtttaaaacttttaatctagagctgttagtcctaaaaatccact

SEQ ID NO: 79130 - DNA, 201 bp, Bos taurus; identical to SEQ ID NO: 38922

SEQ ID NO: 79131 - DNA, 201 bp, Bos taurus
aggttggttgcttctcttctttggaagtggccgttaactttggagattgctaaggggcaatgtttgtgatgcagttgccaatcccatcaccttgtggctcyggcatcaagatgcactggccagtctctggttttctttatccattatctcattataatcattagtattgctttctcttttcccaattatagcctcctcttc

SEQ ID NO: 79132 - DNA, 201 bp, Bos taurus; identical to SEQ ID NO: 38924

SEQ ID NO: 79133 - DNA, 201 bp, Bos taurus; identical to SEQ ID NO: 38925

SEQ ID NO: 79134 - DNA, 201 bp, Bos taurus; identical to SEQ ID NO: 38926

SEQ ID NO: 79135 - DNA, 201 bp, Bos taurus
actacacagaatactacaggttatgacatacatttacttgctcagagttttcaaacaagccatgttgtttatcaaactatatctcctaatacttaatacartagaattagtgattgtagttctcatatattttacttacaagtaccttattgagataactaacattttgacagcttcagactttccaaattagcacaacat

SEQ ID NO: 79136 - DNA, 201 bp, Bos taurus; identical to SEQ ID NO: 38928

SEQ ID NO: 79137 - DNA, 201 bp, Bos taurus; identical to SEQ ID NO: 38929

SEQ ID NO: 79138 - DNA, 201 bp, Bos taurus; identical to SEQ ID NO: 38930

SEQ ID NO: 79139 - DNA, 201 bp, Bos taurus; identical to SEQ ID NO: 38931

SEQ ID NO: 79140 - DNA, 201 bp, Bos taurus; identical to SEQ ID NO: 38932

SEQ ID NO: 79141 - DNA, 201 bp, Bos taurus
agttgtcaaagaagttcaatttccaatttaacgactgcaccatcgcagtgtacatgtgtaattataaacagtggggcaccgggacacagtgaaggccagcrgaaagctaattctcggtggaagttgttgttcaaaataattgtgcattgttacttgatgttctgcagtcatcaagtcaagcacttttcaatttctttcatc

SEQ ID NO: 79142 - DNA, 201 bp, Bos taurus
tctttatttacattttagagcactattctccaaaaatttcattgcagagagtaagaactgaaacaaggatgcccaagtgtgaaatctgcaaaacaggtgckctgggtgtcctgagctgttttctaatcctcacccccttgctctgtgagctgtcttctgtgaactacctttcagatgcccattgtttatccaaagaattaa

SEQ ID NO: 79143 - DNA, 201 bp, Bos taurus; identical to SEQ ID NO: 38934

SEQ ID NO: 79144 - DNA, 201 bp, Bos taurus
tcgttgaaatgatctgcattggtctgttgttagcttgtgtaccactgcattacgcatcattctggctgctccttatttgaaaaagctgtacagtgttccaktggtgattgtccatttgtactcagtcttcaatctgccaacagtatttattcaagtatcatttttcctatattattaatacccaactttcatgacatcaga

SEQ ID NO: 79145 - DNA, 201 bp, Bos taurus
ttaaatgccttggtttctcttttaaactcaatgacattcatatcccatgctgatcatcaataaaatagtcagaacctttcatcaggagatagaacacaaaytgcagtgcaattttccattcctttttctacaattacctaaagatcactttgaatttagtgtgtttaacaagggctttttaaaaagaaatgtgcttttctt

SEQ ID NO: 79146 - DNA, 201 bp, Bos taurus; identical to SEQ ID NO: 38935

SEQ ID NO: 79147 - DNA, 201 bp, Bos taurus; identical to SEQ ID NO: 38936

SEQ ID NO: 79148 - DNA, 201 bp, Bos taurus; identical to SEQ ID NO: 38937

SEQ ID NO: 79149 - DNA, 201 bp, Bos taurus; identical to SEQ ID NO: 38938

SEQ ID NO: 79150 - DNA, 201 bp, Bos taurus; identical to SEQ ID NO: 38939

SEQ ID NO: 79151 - DNA, 201 bp, Bos taurus; identical to SEQ ID NO: 38940

SEQ ID NO: 79152 - DNA, 201 bp, Bos taurus; identical to SEQ ID NO: 38941

SEQ ID NO: 79153 - DNA, 201 bp, Bos taurus; identical to SEQ ID NO: 38942

SEQ ID NO: 79154 - DNA, 201 bp, Bos taurus; identical to SEQ ID NO: 38943

SEQ ID NO: 79155 - DNA, 201 bp, Bos taurus
aagtatgtaatttttatcatgttttttgatgattatttctgtttatattagctttataagcaaatttgcaagttgttctactaaatattctaaacaaatgmactcttgcaatgagaaaagatgataacggacatcaaagttctcaaaaaattgtatatgaaaagaaaatttttaaagtacgaaacagctatagttattaaa

SEQ ID NO: 79156 - DNA, 201 bp, Bos taurus; identical to SEQ ID NO: 38944

SEQ ID NO: 79157 - DNA, 201 bp, Bos taurus; identical to SEQ ID NO: 38945

SEQ ID NO: 79158 - DNA, 201 bp, Bos taurus; identical to SEQ ID NO: 38946

SEQ ID NO: 79159 - DNA, 201 bp, Bos taurus; identical to SEQ ID NO: 38947

SEQ ID NO: 79160 - DNA, 201 bp, Bos taurus; identical to SEQ ID NO: 38948

SEQ ID NO: 79161 - DNA, 201 bp, Bos taurus; identical to SEQ ID NO: 38949

SEQ ID NO: 79162 - DNA, 201 bp, Bos taurus; identical to SEQ ID NO: 38950

SEQ ID NO: 79163 - DNA, 201 bp, Bos taurus; identical to SEQ ID NO: 38952

SEQ ID NO: 79164 - DNA, 201 bp, Bos taurus; identical to SEQ ID NO: 38953

SEQ ID NO: 79165 - DNA, 201 bp, Bos taurus; identical to SEQ ID NO: 38954

SEQ ID NO: 79166 - DNA, 201 bp, Bos taurus; identical to SEQ ID NO: 38955

SEQ ID NO: 79167 - DNA, 201 bp, Bos taurus; identical to SEQ ID NO: 38956

SEQ ID NO: 79168 - DNA, 201 bp, Bos taurus; identical to SEQ ID NO: 38957

SEQ ID NO: 79169 - DNA, 201 bp, Bos taurus; identical to SEQ ID NO: 38958

SEQ ID NO: 79170 - DNA, 201 bp, Bos taurus; identical to SEQ ID NO: 38959

SEQ ID NO: 79171 - DNA, 201 bp, Bos taurus; identical to SEQ ID NO: 38960

SEQ ID NO: 79172 - DNA, 201 bp, Bos taurus; identical to SEQ ID NO: 38961

SEQ ID NO: 79173 - DNA, 201 bp, Bos taurus; identical to SEQ ID NO: 38962

SEQ ID NO: 79174 - DNA, 201 bp, Bos taurus; identical to SEQ ID NO: 38963

SEQ ID NO: 79175 - DNA, 201 bp, Bos taurus; identical to SEQ ID NO: 38964

SEQ ID NO: 79176 - DNA, 201 bp, Bos taurus; identical to SEQ ID NO: 38965

SEQ ID NO: 79177 - DNA, 201 bp, Bos taurus
taataaaaataaatgttaataatttgagttattatttgttttattttaattgattgttcatctaaaattttagttacccttgactcattaaacataaaatraaattagaatgtttccacaccataaaaatgtaagattcttagaattggtagattaatttgtatccaattatttccccatgccttttgttttattgtgtac

SEQ ID NO: 79178 - DNA, 201 bp, Bos taurus
ctacaaataagacttgaagctacctaaggaaactttctctaactttatactgcctttgtccattatagattccaagcaaacaaagtcatggtacacacatkatgttcctttacttgtttaattattgaattgtatttctttttcaaagtaaatgtttccacttgagcaatggatcgatactcctctcttctcaagaaacag

SEQ ID NO: 79179 - DNA, 201 bp, Bos taurus
ttctctgaagtatattaattttttaggctattttggggtaggacctacattctcccatgaggtagatgttctctttagcaaaccgtggcccacagcttccytatttgttactttatggcaaagactgccgccacctaattgaacaaggataatatcagatggcctttgtactgatttcagtgtttgttgctgtcttgaacc

SEQ ID NO: 79180 - DNA, 201 bp, Bos taurus
aaatccaatggccactacccataatccatccagcccttactgaaatcagtaaccttttgaagagggccaagaacacacattcaaagaatagcttgctgttkctgctgctgctgtttaaaagagagtttgatggaaaagaaagagagagcttttcttccagtctctgtttggaaacattcaaataacactagaaatatttat

SEQ ID NO: 79181 - DNA, 201 bp, Bos taurus; identical to SEQ ID NO: 38967

SEQ ID NO: 79182 - DNA, 201 bp, Bos taurus
tgcaatgcagtccatggggctgcaaaagattcagacatgacttaacaactaaacaacaaatacaatctctagaggattgaagtatgaaagaaacattctcytacaagactgaaaaaataactgatttttaaaagaataattagcagtcttagcatatccctagcatccatcacaagtgctgatatcataggatatttataa

SEQ ID NO: 79183 - DNA, 201 bp, Bos taurus; identical to SEQ ID NO: 38968

SEQ ID NO: 79184 - DNA, 201 bp, Bos taurus; identical to SEQ ID NO: 38969

SEQ ID NO: 79185 - DNA, 201 bp, Bos taurus; identical to SEQ ID NO: 38970

SEQ ID NO: 79186 - DNA, 201 bp, Bos taurus
aaatatatatgtctatcaaatcatcattttgtacacttatacaattacatttccgttaccccttaataaagttaatttttttttaaactaagacctgcctrctgagaaaaacattgctactgtcttccagaaattctcacatagatgctcagaaataatgtttagccagatatctgggcttaatctaaacaagttcacgta

SEQ ID NO: 79187 - DNA, 201 bp, Bos taurus; identical to SEQ ID NO: 38971

SEQ ID NO: 79188 - DNA, 201 bp, Bos taurus; identical to SEQ ID NO: 38973

SEQ ID NO: 79189 - DNA, 201 bp, Bos taurus
ccgagaggcctttctatattacctcaatttccctagttctgatttagttatgttaaattatacaatgtgtcatataacagaaataatgtgggatatgaatrcacatggcctgagacatcatcttaaaagctggaaatactcatcttactctttattctacatatgttatattgagttaacacttatcaaaatgtgggggaa

SEQ ID NO: 79190 - DNA, 201 bp, Bos taurus; identical to SEQ ID NO: 38979

SEQ ID NO: 79191 - DNA, 201 bp, Bos taurus
cttaatgtattatatttcaacaaaacagtctaagctaaaacatcaatctatttttatatttacccaatccatttgcttttattttccttcctgtgagacayaaatatattaaaaataacttagagctaagttcaagaagttataataaaaatactgaatacaattctattaaatactatttcaatgtccaatttctttgtt

SEQ ID NO: 79192 - DNA, 201 bp, Bos taurus
aaatggaagtgctgtctcctggtgttcgtaaattatgttagcgttgagctaaccatcaggtgttctcaattaactaataactagctccttaaagcttgaaygcaaagaactctccatgtttcatttaaagaaataaatatttaataatctgaatttacattaaactaaattatagcagaaaaaagaaaggaaagcaggtcc

SEQ ID NO: 79193 - DNA, 201 bp, Bos taurus
caactgtactcaatactctgtaatgacctgtatagaaatagaatctaaaaaagactggatgtatctatatgtgtaacagattcaactttatgtacagcagraactaacacatcattgtaaatcaactatactccagtaaaaattaacttgaaaaataaaaggacatatttacttgctgagtaaactaaaattaatgaacca

SEQ ID NO: 79194 - DNA, 201 bp, Bos taurus; identical to SEQ ID NO: 38980

SEQ ID NO: 79195 - DNA, 201 bp, Bos taurus; identical to SEQ ID NO: 38981

SEQ ID NO: 79196 - DNA, 201 bp, Bos taurus
atgcctggctgcaccaatggaagaatattttgctgtggatttgttaaaagagaaaaaggtaggcgagatttatttgaataacagatgcttctgggagaaayatgaggatttgacttcatgcttctatgataaaaaacaccaaaatatcaaatctgtaagtggatgttaggaaaaaaggtgcctcaatcagataaaaaaaga

SEQ ID NO: 79197 - DNA, 201 bp, Bos taurus; identical to SEQ ID NO: 38982

SEQ ID NO: 79198 - DNA, 201 bp, Bos taurus
attcattttgatatttggcaaaactaatacaattatgtaaagtttaaaaataaaataaaatttaaaaaaaaaagaaagaaaaaaaaattgcagctataacrtaaactacatgtgtgaaaaaattaggcacttttgagcaaaattatgccccgaccagtaatactgaagaagctagggttgaacagttctatgaagacctac

SEQ ID NO: 79199 - DNA, 201 bp, Bos taurus; identical to SEQ ID NO: 38984

SEQ ID NO: 79200 - DNA, 201 bp, Bos taurus; identical to SEQ ID NO: 38987

SEQ ID NO: 79201 - DNA, 201 bp, Bos taurus; identical to SEQ ID NO: 38988

SEQ ID NO: 79202 - DNA, 201 bp, Bos taurus
taacttcaggctccaaagtatccttttactttgctttattctatttttgcaaaactgagaaaattgtgattaccaaacatggctaattgtaattaccaaamctgtcatcaaagttttaagatcatacttagcaaactcaggattcttttcaattaaatgggaatggttgaaacagctttattctgaggccagcacaaaagt

SEQ ID NO: 79203 - DNA, 201 bp, Bos taurus; identical to SEQ ID NO: 38991

SEQ ID NO: 79204 - DNA, 201 bp, Bos taurus
caggtgatgtctttattattaggtttatttgaaagaaaaaaataagttaaaatacaattactggatccatggatacgtgatagaaaagccaaacaaaaaamcaaaatatcagttattatttggcctatacaaatatattttatcctagtcttgtataggagtttaggcttcatagtttcgaaaaatgtttattataattga

SEQ ID NO: 79205 - DNA, 201 bp, Bos taurus; identical to SEQ ID NO: 38994

SEQ ID NO: 79206 - DNA, 201 bp, Bos taurus
tcactcattgccctgaggatgaagctgtattgaatatactagagtggcttattccttggatggaaacttttaggttagaattttcctcttggtaccctccraatgaggtgatattttaatattaagtgatatttctgatactgaatgagtatccagaaagaacaatacaagtacataatactccataactttcccaggtag

SEQ ID NO: 79207 - DNA, 201 bp, Bos taurus
gctggttagacaatactgaattcacactatgataactctatctgacttgcttcttacaagttttgatctctatcatccccagaaatgtcacagtccaactyaaacacaatgcgctctgctgaacttccaaaccattagaatatactgtcacttttaccaaagtatttctgaagattttcacaaaagtactgtctactgaat

SEQ ID NO: 79208 - DNA, 201 bp, Bos taurus; identical to SEQ ID NO: 38996

SEQ ID NO: 79209 - DNA, 201 bp, Bos taurus
atggtgttgccaggagctgtggggaggggataatggggagatgttggctcaagttacacgtatttggttatggaaaattaatacattctagagatgtagcrgagaaggcaatggcaccccactccagtactgttgcttggaaaatcccatggagggaggagcctggtaggctgccatctatggggtcacacagagttggac

SEQ ID NO: 79210 - DNA, 201 bp, Bos taurus
ttaatattccatagaaaatatgggtcaggcgtaagaaaggatatgttatatttatagttcttgccagctatcatcaggaaaatggcaagaatattacatayatagagatatatttatagatagtctgagtctttattttccatgtcatttaatgtttacttctttctagcaaggtctaaatcatatttcagaggaagatac

SEQ ID NO: 79211 - DNA, 201 bp, Bos taurus
gtaagtaaataataaatctgaaaagtttttggaaaacagcaaaaaccaaaggtgatgtagaacctactgaacacatgtatgaagcgagggttaaatagcaytctattctaagagtacattcataagttcaatttgttcataggtccccaaaagttagcctaggtatccaactaactcaatcagctacatagtagtgtattg

SEQ ID NO: 79212 - DNA, 201 bp, Bos taurus; identical to SEQ ID NO: 38998

SEQ ID NO: 79213 - DNA, 201 bp, Bos taurus
ttgagttgcccatttcatttattggtctcaaagttctttatcagtttgaaggatattattcaacagcactgcttcccaatatagcatcactggggtctttkccacagtgttaaatcttgtactgcaagattactccaatgtctataaactatctctaatctaacttaatattctgcatccctttgaaaacacctcaggatt

SEQ ID NO: 79214 - DNA, 201 bp, Bos taurus; identical to SEQ ID NO: 39000

SEQ ID NO: 79215 - DNA, 201 bp, Bos taurus
attatctccttcactcagtcattccagaagcattcagatgagagtcttctctttgtcagccactagcttaagggctggtaagaagagggcagaaaaagatrcaaaaattatccactgctttgaggctatcacatgggaaggcaaaccattacaacatagtaagaaaagcgtttaccgagttaagtacaaaatgcaaaggga

SEQ ID NO: 79216 - DNA, 201 bp, Bos taurus; identical to SEQ ID NO: 39004

SEQ ID NO: 79217 - DNA, 201 bp, Bos taurus; identical to SEQ ID NO: 39007

SEQ ID NO: 79218 - DNA, 201 bp, Bos taurus; identical to SEQ ID NO: 39008

SEQ ID NO: 79219 - DNA, 201 bp, Bos taurus; identical to SEQ ID NO: 39009

SEQ ID NO: 79220 - DNA, 201 bp, Bos taurus; identical to SEQ ID NO: 39010

SEQ ID NO: 79221 - DNA, 201 bp, Bos taurus; identical to SEQ ID NO: 39011

SEQ ID NO: 79222 - DNA, 201 bp, Bos taurus; identical to SEQ ID NO: 39012

SEQ ID NO: 79223 - DNA, 201 bp, Bos taurus
agtcaccagagattcaactttcccaggttatccatccttggtggggcactaattctgtacattcctaaatctaaccatttacatacttttctgaatcttcrgcctactggcataaattaataatctgctgtcagcaaaatcttatatttttaacctcttctctgcacaacctttgagctttttgtaccaactgaaatccat

SEQ ID NO: 79224 - DNA, 201 bp, Bos taurus; identical to SEQ ID NO: 39014

SEQ ID NO: 79225 - DNA, 201 bp, Bos taurus
ggcttttttcgaagagtagactggttccaggacagaatgaggggagaggaattaacttaacagtagagaagtctggcaaatgctgcctaagccttgtggcyaagtttaacattatcagtgataagccatgttgctaatatgtgcccttgatatgatgtgatgagactaccttccttacctttgtagtcttccttctaaaat

SEQ ID NO: 79226 - DNA, 201 bp, Bos taurus
cctcgtcagtgaggcggacgcagcgccgcaggtacaggtgggtcagctgcgtgcagtgggccgcgatggtgtgcaggccttcgtcttccagcacgaagcartctgtcatgtccaggtagcggatggagatctgtttgccgtgcaagggggacagtttaatggaggcctcgcgggtcaagctgatgcaggtcaccttggagc

SEQ ID NO: 79227 - DNA, 201 bp, Bos taurus; identical to SEQ ID NO: 39019

SEQ ID NO: 79228 - DNA, 201 bp, Bos taurus; identical to SEQ ID NO: 39020

SEQ ID NO: 79229 - DNA, 201 bp, Bos taurus
gcccaaaagctagcctttgttaacttttctttgcttgacattcttcaacgatattttagtttcccaaactctctaagatccttctcacagcagggccttcyggcagtttcccactatttttctctggctgagtcttgcccttcaagtgtcactcacatggtcctctctatggccctaagactaagttagggtcttctgtaa

SEQ ID NO: 79230 - DNA, 201 bp, Bos taurus
gtctcccaacaattgccaggatctgtcttccacatcactcaagaacaaagaacggaagagcaatctttgtccttttccacatgctcaaacctcacacaatktctcgctaaagctggcttctctgaaggaataaaagttagcaagagtaatgaccaagcagacatttaactataaagttatcaataaagggagacaataaat

SEQ ID NO: 79231 - DNA, 201 bp, Bos taurus
ggaccgcagcatgccaggcctccctgggatccttaaaagtgaaggtgagaagccgaggaagagtcacagtcagagagatgccctgtgcctcaaccagctgytgctggctctgaaaatggaaggggccaccaactaaggaatgtagacacctctggaaggtggaaaggacaggaatggatgccgctccaaaacctccagaag

SEQ ID NO: 79232 - DNA, 201 bp, Bos taurus; identical to SEQ ID NO: 39024

SEQ ID NO: 79233 - DNA, 201 bp, Bos taurus; identical to SEQ ID NO: 39025

SEQ ID NO: 79234 - DNA, 201 bp, Bos taurus
aagcatcctgacagagaagatgggctgagttggctctcagctggaagttcaagaaagtttcatggacagcacttagactgggaggatggataggatgtccrtgtggacaaaagtctgagggtgaaatgaacagaggtaggaatgaacaggggtaggaatgtccaaggaaggggatggaggcagtcagggacaaaaagtatt

SEQ ID NO: 79235 - DNA, 201 bp, Bos taurus
tttagacctctccctgccatgcccgtacctctcccctgaaacctaagaacagtcagaagacaatgatgaagattaccatcgtggcgagaaagaatgtcaayggccaaccctcttctacttgtcacagagtttgattctgccagatacgcagacagggaggatggttggatggattgtcttcagctatggccctcaaatggc

SEQ ID NO: 79236 - DNA, 201 bp, Bos taurus; identical to SEQ ID NO: 39026

SEQ ID NO: 79237 - DNA, 201 bp, Bos taurus
ctaacaagctctcagtctttccagttgccaatcacatccctgacctcacccgacctctcatccctccatcccccaggcccagcctcttctctgtgagcccygagcagactctgctccatcactccaaagccccacccagagccctccccgcttctccttgccaccgtagaacccttcccgtcttctccagcacacatgggc

SEQ ID NO: 79238 - DNA, 201 bp, Bos taurus; identical to SEQ ID NO: 39028

SEQ ID NO: 79239 - DNA, 201 bp, Bos taurus; identical to SEQ ID NO: 39030

SEQ ID NO: 79240 - DNA, 201 bp, Bos taurus; identical to SEQ ID NO: 39031

SEQ ID NO: 79241 - DNA, 201 bp, Bos taurus
tgaggtcctgcacggcctccacggactcggcgtacacgtcgtccagcagctccttctgcagctcctccagccatgtccacagctgcggggacagcgccatraggggccctgtcctgcggcccgggggaggggaccgcgggcagctgctcccagggagccggaagggaggcgggtggcgggggaggcaccccacacggctgg

SEQ ID NO: 79242 - DNA, 201 bp, Bos taurus
gtaaactattaagctcagtattgttcagatggccagtagtatgacttacacttctaacaaggaaaattaacctctgggtcctaagagtaaacattccacamgttattcaacaatggaaaatcttttagttgtaccaatggtctgaaactcaaactatctaataccccactggtcgaatcaacttattttttacccctccac

SEQ ID NO: 79243 - DNA, 201 bp, Bos taurus; identical to SEQ ID NO: 39034

SEQ ID NO: 79244 - DNA, 201 bp, Bos taurus; identical to SEQ ID NO: 39036

SEQ ID NO: 79245 - DNA, 201 bp, Bos taurus
gaagtgtgaaacttccaatgtgtttttctgaaatccattcctttctttctggtccctttgcaaaaagaagaaagtccccagagagatgtttctgattcgaktttgcctctccaactcctttccaggcttcatgataggaaaagggctcattagctctggtggtatccacaatattggcaatttgagcaaaatgacctggtt

SEQ ID NO: 79246 - DNA, 201 bp, Bos taurus
tttgatccctgggttggggatggccttgacacctacaagctatgggatcctgggcatgttacttaaacttcttgggccttagtttcctcatctgtagaagrataataaccatccctatctcatagaatttttttgacattaaatgaggtcacacatgaaagaattttatcaaggcctggtacattacaagtgcaatataat

SEQ ID NO: 79247 - DNA, 201 bp, Bos taurus
cgtctcaataaaatcaatatgcttataaagtcatataagcatatatatggcatatttttttttcaaagaaggctgttttaattatgtatgtacactggccytttttcaaaaatattacttgatttattaatatagtatgcaggatttcctccttctgagtcagacaccactgcttcggaaactgcttgcaactaacgatgg

SEQ ID NO: 79248 - DNA, 201 bp, Bos taurus
aaatgacttcacttacgtcttgttccacttaccttggaagtcgactaagatggctttggcaaaagacagcaatttcatggggtcgatggtacctgaatgargcagagattgcctcaataaatatcttgagtattattatttgtttatgacctgctctgttcaaaaacagattgtagccaaatgggttggttatatcctttt

SEQ ID NO: 79249 - DNA, 201 bp, Bos taurus
gctcaaataaaattttccaatttttttcttagatccattggcgttgacattttcctgaatcaagcttcgaatcctgaaagctattcttgtctcatgtactyattgatctagatatgaaacttttaaaaataaagatgacatttattgtgatttccttggagctctcaacacgtctggtaagtaagatggtgctacttctca

SEQ ID NO: 79250 - DNA, 201 bp, Bos taurus; identical to SEQ ID NO: 39043

SEQ ID NO: 79251 - DNA, 201 bp, Bos taurus; identical to SEQ ID NO: 39044

SEQ ID NO: 79252 - DNA, 201 bp, Bos taurus; identical to SEQ ID NO: 39045

SEQ ID NO: 79253 - DNA, 201 bp, Bos taurus; identical to SEQ ID NO: 39046

SEQ ID NO: 79254 - DNA, 201 bp, Bos taurus
aactaaaaaaaatgtgtttgtagtattttaatttcacacgtgagaaattgttctgtagctagtaggttatatatgtagtatggccaacatatttgtcttgraagcaacagttataacgggacatggaacaaaagttcagttcacttcagttgctcagtcgtgtccaactctgtgactccatgaaccgcagcacaccaggcc

SEQ ID NO: 79255 - DNA, 201 bp, Bos taurus
cccacagattgaacccaggtctcctaagtctcctgtattggcaagtgaatacttaacccctagggccacctgagaggcccaggatgcacacacttggacckaagtcactaggctgtgaagaagcgcaagcagccaagaagatgctcacgtggagagatccacaaggaaagacactgcacccttcagtctccagccatgact

SEQ ID NO: 79256 - DNA, 201 bp, Bos taurus
gtcacttataattttatttaaatattttgcttcatatggcctaacttgtctaatatttcaaatgtgtgctgtgctaagtcgcttcatgtcctactcttggygacccagtggaccataggccacaagactgctctgtccacgagattctctacgaagaatactggagtgagttgtcacgcccttctccaggagatcttccca

SEQ ID NO: 79257 - DNA, 201 bp, Bos taurus; identical to SEQ ID NO: 39050

SEQ ID NO: 79258 - DNA, 201 bp, Bos taurus
gattccctacttagcaagtcttggaggaggcagatggcggcccatatcaacttctctctttgtagttagaatgaagctgctttgggcttctgctaaaatayccagtcagcaggaaggggtccagttctcaacccggttatgctaacacatggctggcacaagccctgttatccgagtgacacagttgacttgaccacatct

SEQ ID NO: 79259 - DNA, 201 bp, Bos taurus; identical to SEQ ID NO: 39053

SEQ ID NO: 79260 - DNA, 201 bp, Bos taurus
gggagaggggttggagattgagttcaatcatcaatggccaatgatgtatttaataaactgtatttaataaattgtacctatgtaactgggcttcccaggtrgtgctagtggtaaagaaccctcctgccagtgcaggagacataagagatgcagtttccatccctgggtcaggaagatccctgggaggagggcatggcaacc

SEQ ID NO: 79261 - DNA, 201 bp, Bos taurus
atcagggccccattaccagtaaagatttattttgtagctctgagttatataccagccatttaaaaagttcagaaattatcatgatgtaggtaagggtcacycatgtagtattatcactaaacttggtatccaacttaatggattcttacatcatcttaaactcccaagaaatatccccttctttattttatggaatactga

SEQ ID NO: 79262 - DNA, 201 bp, Bos taurus; identical to SEQ ID NO: 39054

SEQ ID NO: 79263 - DNA, 201 bp, Bos taurus
acttccctggtggcccagtggttaagacttggccttgcaatacagggaattcaggtttgttctctaattggggagctaagatcctaagatcccacatgctyatggccaaaaaactagaacataaacaacagaagctatactgtaacaaattcaataaagactttaaaaaaaaatgggtagcggaattacaaagtcacttac

SEQ ID NO: 79264 - DNA, 201 bp, Bos taurus
ctgaactacaacaaaataacctataaactatagtgaccattttagcaatatagtaaaataggaaacagttgcatacttactcaagacatgtcaggccctgrtcacttgatatagaaatcacctgatatgagctgatttctttaagcctcaagatgtctccatgtaggccctgagagtttaagtcacttgcccgaagtgtcc

SEQ ID NO: 79265 - DNA, 201 bp, Bos taurus; identical to SEQ ID NO: 39056

SEQ ID NO: 79266 - DNA, 201 bp, Bos taurus
gaagacagcctggcctggtggggtccccccttcccctcagctgcaggacttcctgacgtatccgcaggatccctgcagaaggtccagagtatcaggctccygaaggaggatgtcagcacaggaaggccacgaggggtgcggtccgtgggtccttgtcattggagcctatgctgcccttggacccagacacggtggacaccc

SEQ ID NO: 79267 - DNA, 201 bp, Bos taurus; identical to SEQ ID NO: 39058

SEQ ID NO: 79268 - DNA, 201 bp, Bos taurus
caggggaaggggtagaggggacagactggggtgggcaagtggctgagggggactagtcaggatgtggttggcggggaagaacccaagaggcccctgcaacragaagggtcttttgggagccgattgaaaactattgagaggaaaggtcatttcaaagaggtttcttgacttttgtaggccacggggacccccgagagggta

SEQ ID NO: 79269 - DNA, 201 bp, Bos taurus; identical to SEQ ID NO: 39059

SEQ ID NO: 79270 - DNA, 201 bp, Bos taurus; identical to SEQ ID NO: 39060

SEQ ID NO: 79271 - DNA, 201 bp, Bos taurus; identical to SEQ ID NO: 39063

SEQ ID NO: 79272 - DNA, 201 bp, Bos taurus; identical to SEQ ID NO: 39065

SEQ ID NO: 79273 - DNA, 201 bp, Bos taurus; identical to SEQ ID NO: 39066

SEQ ID NO: 79274 - DNA, 201 bp, Bos taurus; identical to SEQ ID NO: 39067

SEQ ID NO: 79275 - DNA, 201 bp, Bos taurus
gcccagggacattgtcagtcctgtctgtggaaggatcgcctggtgtcctgccggacttcctaatgtcccaagggacttttcctatggctgaaaataccctmtgttttcctcaggccatgggtgtgatctagccctggataatgctgacctgggatgccttttgtagctaccgttttcttaataaccttctgtacaggtctc

SEQ ID NO: 79276 - DNA, 201 bp, Bos taurus; identical to SEQ ID NO: 39069

SEQ ID NO: 79277 - DNA, 201 bp, Bos taurus; identical to SEQ ID NO: 39070

SEQ ID NO: 79278 - DNA, 201 bp, Bos taurus
aagccagttgagggaggagaggggaaggcagtggggctgcagcgatctgatggaggcgggaggcaagtccccttgccacaggagctgaaggcaaaccatgyaagcaccggctgtttgtcagctccagccacacccacccaagagccatgattctctcctcttgttcagaagtgtctctccttcccaggtgtcctcactcag

SEQ ID NO: 79279 - DNA, 201 bp, Bos taurus
gaaaatatacttaatctcactaatgatttttaaaatgtatattataatgagatgcagttttgcctttcaaaatggcatcatttaaaaacatttaaaaagamtaacagcatcaagtgttagaccaaaggtaggaaagagatttcttcatgcatctgtagtgggagtacaaattagcatagtctttgaaaatataattcatat

SEQ ID NO: 79280 - DNA, 201 bp, Bos taurus; identical to SEQ ID NO: 39075

SEQ ID NO: 79281 - DNA, 201 bp, Bos taurus
gcttagaagggatgtgttggcaagctccaagaagtcagtgagagatgcataagggagaaactagatctggcaagatttccctcttctgaaacagatagcayggatggggccaggcacagaccacagtctggagttacataagcaggactgcctgagttagcaaatattttagtgttagtatatcccaagcgttgcatggga

SEQ ID NO: 79282 - DNA, 201 bp, Bos taurus
tgtagagtgatgtgggaagtaaggcaaagcatctatttgctcctcagtctcccacccagcacccattctctggtttccttccttgttttcctcgacaaacytgagcaccaagccagcttcccgtctgtgatcctctctgccctctggtcctgcttcccagtcttagcagagctgctttcagcttccaggccttgactcgtt

SEQ ID NO: 79283 - DNA, 201 bp, Bos taurus
agatggtgcaatgatcacatttcaagcttaggggcggggacgctcttgaggttgcctcctgagtttttctgagacaactcgagtggcctttgatggcttcrttattctctgggataacaaggtgcctttcactcctcttatccatttccttccattgacctgagaagcagtcatttttatgtgattggagcataggagtgg

SEQ ID NO: 79284 - DNA, 201 bp, Bos taurus
ggcaaggatacaatgagcagcagtctctaaaccacagagttaatccttagggcaaagggactctcaccctcagccaaggggaagaggttcctggctggggwagcaggtgcaaatatgaccccaaccggtgttgcagggtcctgcacctctcattccaccccaactgactttggaaatagtgttcctgtgaacttggctgaa

SEQ ID NO: 79285 - DNA, 201 bp, Bos taurus
atgggtgtcattgttattttcctgttttaatcacgaacttcacaaattgagtgtgttctagtaacagctgtattttaagatcaagaccataaaggggctgrgaaacacagaatttatttgtcaatttctggctataggcatttgctaagggagaaggggtcttacatatttgcatatgtgtcaaatcaccttgcttttaat

SEQ ID NO: 79286 - DNA, 201 bp, Bos taurus; identical to SEQ ID NO: 39076

SEQ ID NO: 79287 - DNA, 201 bp, Bos taurus; identical to SEQ ID NO: 39077

SEQ ID NO: 79288 - DNA, 201 bp, Bos taurus; identical to SEQ ID NO: 39078

SEQ ID NO: 79289 - DNA, 201 bp, Bos taurus; identical to SEQ ID NO: 39079

SEQ ID NO: 79290 - DNA, 201 bp, Bos taurus
aatagtgattcttttagcatccattcagtatcaagaaaggacgtacatcctgggaagttagaagtcagttgacacgatggagagacccttggtgtgcctgstcaggtgtgtgtaggtgcaggacgaaagcaatatctccagtcctgtcactgactggctgtaatgaatgggaagtcatctcagtcttctaatccattcagt

SEQ ID NO: 79291 - DNA, 201 bp, Bos taurus
gctcacggaaggaaaatgataaaaagaggtggccagcactgcatcatctctgagattattttgcaatgatcattatgcatatctcatcaatctaacttctmttcctatggggcctttaatacaagtataaatgcaatagatatttaataatgggactcaatacatattcattagtacagaggccgaagagcaaaaattacc

SEQ ID NO: 79292 - DNA, 201 bp, Bos taurus; identical to SEQ ID NO: 39080

SEQ ID NO: 79293 - DNA, 201 bp, Bos taurus; identical to SEQ ID NO: 39081

SEQ ID NO: 79294 - DNA, 201 bp, Bos taurus; identical to SEQ ID NO: 39082

SEQ ID NO: 79295 - DNA, 201 bp, Bos taurus
ccacgaatccagaacctatttttcacataatttctctaacacagtagcttcgtctccctgggagctggacaatggacatgaaggccaaaagttgggcaaaygattggtgctgattcatgtgaaaaagcagcaatggagagacgccttgtgaccacgaagaggagcgtcaccctctgtgtggcccccacaagcattaaaaat

SEQ ID NO: 79296 - DNA, 201 bp, Bos taurus; identical to SEQ ID NO: 39083

SEQ ID NO: 79297 - DNA, 201 bp, Bos taurus; identical to SEQ ID NO: 39084

SEQ ID NO: 79298 - DNA, 201 bp, Bos taurus; identical to SEQ ID NO: 39085

SEQ ID NO: 79299 - DNA, 201 bp, Bos taurus; identical to SEQ ID NO: 39086

SEQ ID NO: 79300 - DNA, 201 bp, Bos taurus; identical to SEQ ID NO: 39087

SEQ ID NO: 79301 - DNA, 201 bp, Bos taurus; identical to SEQ ID NO: 39088

SEQ ID NO: 79302 - DNA, 201 bp, Bos taurus; identical to SEQ ID NO: 39089

SEQ ID NO: 79303 - DNA, 201 bp, Bos taurus; identical to SEQ ID NO: 39090

SEQ ID NO: 79304 - DNA, 201 bp, Bos taurus; identical to SEQ ID NO: 39091

SEQ ID NO: 79305 - DNA, 201 bp, Bos taurus; identical to SEQ ID NO: 39093

SEQ ID NO: 79306 - DNA, 201 bp, Bos taurus; identical to SEQ ID NO: 39094

SEQ ID NO: 79307 - DNA, 201 bp, Bos taurus; identical to SEQ ID NO: 39095

SEQ ID NO: 79308 - DNA, 201 bp, Bos taurus; identical to SEQ ID NO: 39096

SEQ ID NO: 79309 - DNA, 201 bp, Bos taurus; identical to SEQ ID NO: 39097

SEQ ID NO: 79310 - DNA, 201 bp, Bos taurus; identical to SEQ ID NO: 39098

SEQ ID NO: 79311 - DNA, 201 bp, Bos taurus; identical to SEQ ID NO: 39099

SEQ ID NO: 79312 - DNA, 201 bp, Bos taurus; identical to SEQ ID NO: 39100

SEQ ID NO: 79313 - DNA, 201 bp, Bos taurus; identical to SEQ ID NO: 39101

SEQ ID NO: 79314 - DNA, 201 bp, Bos taurus; identical to SEQ ID NO: 39102

SEQ ID NO: 79315 - DNA, 201 bp, Bos taurus; identical to SEQ ID NO: 39103

SEQ ID NO: 79316 - DNA, 201 bp, Bos taurus; identical to SEQ ID NO: 39104

SEQ ID NO: 79317 - DNA, 201 bp, Bos taurus; identical to SEQ ID NO: 39105

SEQ ID NO: 79318 - DNA, 201 bp, Bos taurus; identical to SEQ ID NO: 39106

SEQ ID NO: 79319 - DNA, 201 bp, Bos taurus; identical to SEQ ID NO: 39107

SEQ ID NO: 79320 - DNA, 201 bp, Bos taurus; identical to SEQ ID NO: 39108

SEQ ID NO: 79321 - DNA, 201 bp, Bos taurus; identical to SEQ ID NO: 39109

SEQ ID NO: 79322 - DNA, 201 bp, Bos taurus; identical to SEQ ID NO: 39110

SEQ ID NO: 79323 - DNA, 201 bp, Bos taurus; identical to SEQ ID NO: 39111

SEQ ID NO: 79324 - DNA, 201 bp, Bos taurus; identical to SEQ ID NO: 39112

SEQ ID NO: 79325 - DNA, 201 bp, Bos taurus; identical to SEQ ID NO: 39113

SEQ ID NO: 79326 - DNA, 201 bp, Bos taurus; identical to SEQ ID NO: 39114

SEQ ID NO: 79327 - DNA, 201 bp, Bos taurus; identical to SEQ ID NO: 39115

SEQ ID NO: 79328 - DNA, 201 bp, Bos taurus; identical to SEQ ID NO: 39116

SEQ ID NO: 79329 - DNA, 201 bp, Bos taurus; identical to SEQ ID NO: 39117

SEQ ID NO: 79330 - DNA, 201 bp, Bos taurus; identical to SEQ ID NO: 39118

SEQ ID NO: 79331 - DNA, 201 bp, Bos taurus; identical to SEQ ID NO: 39119

SEQ ID NO: 79332 - DNA, 201 bp, Bos taurus; identical to SEQ ID NO: 39120

SEQ ID NO: 79333 - DNA, 201 bp, Bos taurus; identical to SEQ ID NO: 39121

SEQ ID NO: 79334 - DNA, 201 bp, Bos taurus; identical to SEQ ID NO: 39122

SEQ ID NO: 79335 - DNA, 201 bp, Bos taurus; identical to SEQ ID NO: 39123

SEQ ID NO: 79336 - DNA, 201 bp, Bos taurus; identical to SEQ ID NO: 39124

SEQ ID NO: 79337 - DNA, 201 bp, Bos taurus; identical to SEQ ID NO: 39126

SEQ ID NO: 79338 - DNA, 201 bp, Bos taurus; identical to SEQ ID NO: 39127

SEQ ID NO: 79339 - DNA, 201 bp, Bos taurus; identical to SEQ ID NO: 39128

SEQ ID NO: 79340 - DNA, 201 bp, Bos taurus; identical to SEQ ID NO: 39129

SEQ ID NO: 79341 - DNA, 201 bp, Bos taurus; identical to SEQ ID NO: 39130

SEQ ID NO: 79342 - DNA, 201 bp, Bos taurus; identical to SEQ ID NO: 39131

SEQ ID NO: 79343 - DNA, 201 bp, Bos taurus; identical to SEQ ID NO: 39132

SEQ ID NO: 79344 - DNA, 201 bp, Bos taurus; identical to SEQ ID NO: 39133

SEQ ID NO: 79345 - DNA, 201 bp, Bos taurus; identical to SEQ ID NO: 39134

SEQ ID NO: 79346 - DNA, 201 bp, Bos taurus; identical to SEQ ID NO: 39135

SEQ ID NO: 79347 - DNA, 201 bp, Bos taurus; identical to SEQ ID NO: 39136

SEQ ID NO: 79348 - DNA, 201 bp, Bos taurus; identical to SEQ ID NO: 39137

SEQ ID NO: 79349 - DNA, 201 bp, Bos taurus; identical to SEQ ID NO: 39138

SEQ ID NO: 79350 - DNA, 201 bp, Bos taurus; identical to SEQ ID NO: 39139

SEQ ID NO: 79351 - DNA, 201 bp, Bos taurus; identical to SEQ ID NO: 39140

SEQ ID NO: 79352 - DNA, 201 bp, Bos taurus; identical to SEQ ID NO: 39141

SEQ ID NO: 79353 - DNA, 201 bp, Bos taurus; identical to SEQ ID NO: 39142

SEQ ID NO: 79354 - DNA, 201 bp, Bos taurus; identical to SEQ ID NO: 39143

SEQ ID NO: 79355 - DNA, 201 bp, Bos taurus
aatattgtgaagcaatcaataaaaataaatattaaaacaaaacttgcaactttcatattgtgcatcactgatctgatctgatctgatctgataaaaggccraaaagtggattagttcagttcagtcactcagtcgtgtccgactctttgcgaccccatgaatcacagcatgccaggcctccctgtccatcaccaactccag

SEQ ID NO: 79356 - DNA, 201 bp, Bos taurus
cactcttcagtgatatcatagcagtagcaatttcacttacactctcttatttgcagtattataataagtaaaatcaacatgataatagttatcttactaarttgatcttaatagttctagcttacatttctcaaatcctgcagcattctggattcatactgttacacctgggggttacctcccatttcttggtcagttctg

SEQ ID NO: 79357 - DNA, 201 bp, Bos taurus
aggccaccaaatccagaaggcaggtgtggttgcggggtctctgggtatgtccctccctcttgaaagtcctgtttgtcctccttcaggataacttgtcctcygagaggggccgaagttcaggctcccagagccacaagtcccgtcccccacctgagaacagtcccggcaggaccgtggcctctgcagattggacactgttgc

SEQ ID NO: 79358 - DNA, 201 bp, Bos taurus
acagcggattctgcctccaagtggctctgcagccaacaggcatactcttccttactcagaacctgggtgagacccgctgatgagtgcatgggccgtgcccygctgctggctctgcccctccgtggagctgcctactcaccctcttggcaatgcacaaggtgcgcaggccctccaccgcatacaagttgaggtaattctggg

SEQ ID NO: 79359 - DNA, 201 bp, Bos taurus
gcttggtagcaaaagggctgcctcggtctctggagggggaaagtccctgcagagggcggcagggtcccgcaggctcaggctgactctgggaagatgcacaygacaacatgagcccagcacactgccctcagcagctcttttttatgggctgacgtgtgttctcccccagaattcgtttgttcatgtcctaaccccagtatc

SEQ ID NO: 79360 - DNA, 201 bp, Bos taurus
attagcttctcagtctttcttcctcctcaggaccctttgtcggcttcccacagaagccacagaggcatctcaagggcctgtgtcctttcctggagaaagtrtccagaagttatgtccctgtgcagtccctgaggcaacagtacactctcagagagctgtgcggcccagagtgacagcggctgctgggagactgggtccctg

SEQ ID NO: 79361 - DNA, 201 bp, Bos taurus
ccatccatgtctgcatcagacagacgcccctaccctggctgggaggtgagctttcaggaggtaacagaaggcaggcaaaggaaaagcgctcaggagtttcraagaagggccacctcgtgtgtgagaccaggaaaacacccattacttgtctcttcacacggtggaatcgtcacatatttcaggaagaatcgccccaaatgc

SEQ ID NO: 79362 - DNA, 201 bp, Bos taurus
ccactccatgtccaccaaagcaatgacatgacacaggacagatcccagctgtgcaccgcatcggatcactgtccctgtgggtaccaaagaccctgaacaarctccggcctgacggtggggaggacggggaggctcagacatacaatgactcacagcccaggactgaaaacagccatcccagacttttgggcctgaaggagt

SEQ ID NO: 79363 - DNA, 201 bp, Bos taurus
cagtctgccatagcaaagtgccacagactgggtggctcaagcagcagacatttctgatttttatggaggtctgatttggcaggagggctcctctgaggccyctctccctcctcgtagattgctgtcttcctgtgtcctcacgtggtttctccgtgccttgtctgtgtcctgatctcttctgtggctgccagtcagatcaca

SEQ ID NO: 79364 - DNA, 201 bp, Bos taurus
attcatcatctccaaaaacactgcagtattcaagattagtgcaaaaggggcaataaactgttgctggatttaattaaaaacaacaaatcatttggtcagtrgtaatggatgctacaaacaacccatcaggtgcatggctatttaaggagccaatattttaatctcaaaacatccaattagatgagatcatgaagctgatga

SEQ ID NO: 79365 - DNA, 201 bp, Bos taurus
tacacaaaggtagactgattattttatgtaggttgggttttacagggaagttttgctaatacagctcaggcagattggcccatgggcacagaagatcgtcytgcagcagccttcagcaagctccatccagaacacatcctttcaggcaggtgcctcagaggggcctgggattgtacgtgagaactgtccgcaagtcccagg

SEQ ID NO: 79366 - DNA, 201 bp, Bos taurus
tctcctgcattgcaggcagattcttaaccatcttagccaccagagggttatcctagtgctggggtcccagggctgagggcaggtgctggccccagctagcrtgtgtctgcctgtctgcctgtgagactggagaggctctgtcccagctggagtcctgacattggctccagtgacgttggccactataagatcttctgtccc

SEQ ID NO: 79367 - DNA, 201 bp, Bos taurus; identical to SEQ ID NO: 39153

SEQ ID NO: 79368 - DNA, 201 bp, Bos taurus
gtcgttgtttacaagacgtaaggtatgaggccgtgagagagtggggcaggaagcctgactgaggcagtgttgttagttaatttctccacgtgtagaatacraattgcctccctgtccataatctgtcagtctgtgcaaaatgggaaaaatagaattgcctttggaaggtgaatgaacacgatgaagacatgcacaatgcat

SEQ ID NO: 79369 - DNA, 201 bp, Bos taurus
ttatgtgtggaagttttcagtatatgtgcaggtgtggcactgaaatccttcttacttgatttccttgttaccttattttcacaagatcctggagcatgcargtacagttttctgctcttcccttccattttctgagatgtcattctgcctcgacatgcctgcttttgtcagctgctactaaccaatagccactatgtaagg

SEQ ID NO: 79370 - DNA, 201 bp, Bos taurus
tttgtcacttactttttcctaatttgctgtttttatttccttatatgtggtaggttagtcatattttctgacctttgagtagtggccttttatgggagagrtcccctctggacacctgaagtatgtgatctaggggttattatatatgttggctgtgtgcatccttttgttttattgtgctgactactgtgggtagattgg

SEQ ID NO: 79371 - DNA, 201 bp, Bos taurus
gtgacaggccatctcaggccaaagaaggagcatctaggggcaacggtgggctgtgctgtaacattctcccactgcctcacaatcaccccacatggaaggcrtttgcctgagtccccctgaggggccttttccacccatcggtcacccaccaggctgtggccagccctgggtcactgagcagtatccacctggtactgcttg

SEQ ID NO: 79372 - DNA, 201 bp, Bos taurus
aaggctgctgcatagcccttggcatcagagttcccttcatcatcattccacaaatactctttaccttcctcttcattggatctcatttcctggagtacacrttgttctatttttgctttactctctctttttttatgaaacacatcctcccatagcttcctgaaataaaaaggaaatggaatttttctgttagatcgtctg

SEQ ID NO: 79373 - DNA, 201 bp, Bos taurus
ttttttggttctttttttttcatattctgctatactatatgttaataacatcagaaaaacagtatttgtggaaagagtcaggtgggaacattggaaaataycacaccttgaaaaaaagagtacaaaaatagaaggcaggacctccagcctctagctggcatctgcagtccttggttcctgggacttacactcaagaagaag

SEQ ID NO: 79374 - DNA, 201 bp, Bos taurus
aaagctgctaactctcacagtaacccaccattgagaaaccgaggcgctgggaacccagccagcatcagccagctggaaggtgttgggccagagtagggacrtggacctgccttaggattccctgggcaaaagtggacacttcttcagtgaggaaggggcagaagaaaagaagatgcacttctgaggccatttttttcctat

SEQ ID NO: 79375 - DNA, 201 bp, Bos taurus
gagggtcagctcgcaggcctgtctgccttctctccgtctctgcccccagctcattgctgggaacgcccccttggcaggcctcctcgctttctgccccttcyggaaggtagtgaggtccacgcagaaaggtcagccttgtgtgtccagcacttctccgcctggaggcagagggctcaggagcaatctcttttcacccctgca

SEQ ID NO: 79376 - DNA, 201 bp, Bos taurus
tggtgcgcttggaggcagaaggctgctcctcccgctcaggtcctacagcagtcaaggccatgcacagagtcctttcctgctgagttttccgtggcctttcytgtccctgtgttttaagttcagatgacactgaggagcctgttcacacccaaagcagtgcaggcaggagagtcagagctgtggggtgaggcctgggttcta

SEQ ID NO: 79377 - DNA, 201 bp, Bos taurus
tgtggaactgttggcccttctcaagttagtagacttggaatcgatgggacttgactgtgatgtccaggcgtgtgatgtcatctcctgtcccacatgggctkcatgcagccgaggcccttcagcggaagtggtttctttctgtcaccgagagcaaagtcttagggaggccacttttcatccgcattcctcaccgaggtgttt

SEQ ID NO: 79378 - DNA, 201 bp, Bos taurus
cgacctttggaagactgttatctagtaaggcctccctttactgcttccctgctcaaaggcatccctggctcaccagcccctctgttcctctcttgcacacygcccaggcctgcctgtgagcccccaactctccaagccaggagtcagcgtgcaggcactttctttaccatctgagctaccagggctcctaaagtgaaagtg

SEQ ID NO: 79379 - DNA, 201 bp, Bos taurus
atccttttgctgagaaaaccacttgttcctgctttacccagctcactcttactcatattttcccagggctctgctcaaatatgggctcttctctgaggctytcccaggcccccagcacccgtgattgcaggatcttgatgcaccctggaaacccgactaccatcggtctcctgcttggatggtgaagatccgggaaaacag

SEQ ID NO: 79380 - DNA, 201 bp, Bos taurus
tgactccagaccctggggaaccttccctgtagaaagtcctcccaaccagaggggacagaaacatgcggactatatgagaaccaggctgcagccagttgctrtcctgcaccatccagcgtggggcagacccagtgtcccccgagcagagaggcacagagaacgggagacagagccaggggttggcgggggcggggggcacat

SEQ ID NO: 79381 - DNA, 201 bp, Bos taurus
caatattcctttattactggtgcctatatttgtaatccattccatgacaagtacaattatgtccccgtcatacactaactgaccacggctgaaggtgggcrggaggggagctctttacaaggtatatctatccttttcagggaaaaccaccaggaagcattcagagcaaaggaagtcctgctaaccattctctctctacgg

SEQ ID NO: 79382 - DNA, 201 bp, Bos taurus
tatccctacaataaaatataaatcagctctatgaaaagaaatgaactaccaagcatgcaactacatgaattaacctcaaaaacattaaactaagtgaaagyacccagacacaaaattctatattgtatgattccattcatatgaaattgctataaaaagcaaaacaagagaggcagaaagaaggtcagaaactgtgtcaga

SEQ ID NO: 79383 - DNA, 201 bp, Bos taurus
tttccatgtcttcctctatattggttgctatagggcacatatcattttcataggtaatataggaagttattcttttatatataaaaaaagtttattctttytcactgtccttccattttaaaatgggcattccccaagttctgagcatttgacacacaatcatcctacaaatacaaaccacagtgcgatacagagcaactt

SEQ ID NO: 79384 - DNA, 201 bp, Bos taurus
tccttgcatctactttcctgcagggattcccagctccatgtcttttttttagccaaagccctccagcggcctccatacataccctgtggtgtgtgtggccrtggaagacctccctactgggcagagacgggagaggaaaggaagtggcacccttggactgcgacatgaccctgtcttgcacaaggatacggatgaagcagg

SEQ ID NO: 79385 - DNA, 201 bp, Bos taurus
tttttttttaatcacttaaggaatatgtgattagcacacacaattttctgttcacacttcctaataataatgaaagcttgtaaagcatttctacaccttaracatcagtcagcataagtaagtaaacacactgacactggcgaagtaagatgctattcaaaataagccaagactagaaagcaaggattttactatatttaa

SEQ ID NO: 79386 - DNA, 201 bp, Bos taurus
gtgctgctctagcatcacctgcaccatgagaggagaagcttgtgcatctcttagtttgtagaaagggctatttccagacatgtttgtcttctccttttggmttccttatcttgtcgtcttcaagtcacaaggtctgctgatcaaatacactcccatgttttacaagaacttactttctgattgttctgttttactttaaat

SEQ ID NO: 79387 - DNA, 201 bp, Bos taurus
gtgcgtgcacagaccgtgtcggcccttgtgtgtcgccggggcggcagggggcctggggggcggcgtgcagaagtgcacttgattcctgatcacggcctgcrtttgaatttcgcacttgccccagatggagacattccttggagctgctcagtggggtttgtttgaaatgggccatagctcagtgtcacatgaccctggagc

SEQ ID NO: 79388 - DNA, 201 bp, Bos taurus
tggctcagtttgacctttgaccttccacgaggccaggacgctgactctccaaggcatgtcctgggctagagtcagccttaggcagcactgggattcaggcrttggccaatggtccttcagggtgctgggaggcttatggacctcctgttgtaaacttggattagcctttcccaagagcaactgagattgcactccaccagc

SEQ ID NO: 79389 - DNA, 201 bp, Bos taurus
gtttgtcctccagcaaatggtcccctttctctctctctctccccatcacaccctgtttttattcccccaaagtatttgatatgtgtttgtgcacagtggcrtgatgtaccgtggaagatctatggtcgcaatttgtgatccctttaagaggaattgttctgtctaggaacaggattttacctaatttaagctttaccgaaa

SEQ ID NO: 79390 - DNA, 201 bp, Bos taurus
tccctgagttccccgtggtacctggagaggaatctcaagcccccagccgcaactcgagacaaaccacgagattcccccatcaatgtgagatgaggcccttytctcctgcgtcgcctagagagctgagttccctctcaaaacttgagaggatgcttgactcccttcatgcaactcaagggggcccagagatccctgtcacaa

SEQ ID NO: 79391 - DNA, 201 bp, Bos taurus; identical to SEQ ID NO: 39154

SEQ ID NO: 79392 - DNA, 201 bp, Bos taurus
atgttgtgtttcatcttttaaaactgatgctaaacaatgctatagtgaacatccttttgcatacattttgcacaggcctctcatcactgttagcaatacarttgcttaatcaaaggatatgtatttttctaagactgggacctaatgacaagctggtccttagaaaacttgaaccggctttgtgacaggccacaaaactga

SEQ ID NO: 79393 - DNA, 201 bp, Bos taurus; identical to SEQ ID NO: 39155

SEQ ID NO: 79394 - DNA, 201 bp, Bos taurus
cttgaaaacattatgctaagtgaaggaagccagacacaaaaggccacatcccgtgttacccatttccacgaaatgtccagaagaggcaaatccatagagayggaaagcaggttagtgatggccaagggagagggggaaaggaaagtgaggagtgactgtctgtctaatgggctcagggttgactttggaataatggaaata

SEQ ID NO: 79395 - DNA, 201 bp, Bos taurus
tggacagtgataggaatatggaaaaaaaaaatctgcctttggccatcagccccatttactcctaggatatcagaggggcctggggctgttcctataaggcragggcatccaagggcattcgggaacctccatctcagcttccgtgctcgtctggccaaggctgccttcccagatcaatgcctggctgagaaatagctcttg

SEQ ID NO: 79396 - DNA, 201 bp, Bos taurus
cgggacttatttagaatctgcttctataatctctctgaagagatcacacacacacacacacacaaaacccacaaaaacacctcttcttgctctaatctgcrcactgttcatactctctcccttcctgacacagtttatttagccaccccaactgcagtgatttaatttcacatatatgtgaaccaaaattgctttgtttct

SEQ ID NO: 79397 - DNA, 201 bp, Bos taurus
catgcataacttcagctgatccgcacagataccatcctgtcaacagggggtgggacaaatatactggttgtcctaggcctgttttccctgtgtaattactrgtaacactcctttcactctaaaagagagctccagtttgaatgacaaattatatgatctagttaactctaggtaactgcaacctaggtgggcctttcttta

SEQ ID NO: 79398 - DNA, 201 bp, Bos taurus
gacagggagaaatgaagaagtccactatctcgtgaggaaagaaagatgagggcacagtcctaatggaagaaagacagaggaatccatctgaaaactacagrttttcaagcagacttcttcttcttcaaaagctgcagtaatggaataaccaatatatgcaagtgacagaaatctgagatgctaatgcctgggtagctgaaa

SEQ ID NO: 79399 - DNA, 201 bp, Bos taurus; identical to SEQ ID NO: 39158

SEQ ID NO: 79400 - DNA, 201 bp, Bos taurus; identical to SEQ ID NO: 39160

SEQ ID NO: 79401 - DNA, 201 bp, Bos taurus; identical to SEQ ID NO: 39161

SEQ ID NO: 79402 - DNA, 201 bp, Bos taurus
ttatgagggtcagagtgcctatgccaaaagcgagcttggagagagggaaggctgatgaataagaaagagaattccagagaacaggatagatggggtagagrgggaatgtagcatcatagcaaagaaattggaagctcccagagaaatctatagctatataatctgcacccaaggggggtgggggggtctatggaacactcc

SEQ ID NO: 79403 - DNA, 201 bp, Bos taurus; identical to SEQ ID NO: 39163

SEQ ID NO: 79404 - DNA, 201 bp, Bos taurus
tgatggatggagaagcctggtgtgctgcagtccatggagtcgcaaagagtcggacacaactgagtgactgaactaaactgaactgatacatgttttgatamtgatacatgatactgaagacttgggaatagacatgtgcatctaaggagagagaatctggtcacagaggacgtatgaattactagaacttagagatccaca

SEQ ID NO: 79405 - DNA, 201 bp, Bos taurus; identical to SEQ ID NO: 39165

SEQ ID NO: 79406 - DNA, 201 bp, Bos taurus
taaaatataattgctgtagatttgccaaagaagttccacaagctttattcaacagcttttgcatcatgttatatgcaggatactgagttaattttaaatcrttattacctactctcactgtaacaaaatgggaaatgttgcaaattatgtaaatattttttttcttgaatttacaataactttttttttcacttcagactc

SEQ ID NO: 79407 - DNA, 201 bp, Bos taurus; identical to SEQ ID NO: 39167

SEQ ID NO: 79408 - DNA, 201 bp, Bos taurus; identical to SEQ ID NO: 39168

SEQ ID NO: 79409 - DNA, 201 bp, Bos taurus; identical to SEQ ID NO: 39169

SEQ ID NO: 79410 - DNA, 201 bp, Bos taurus; identical to SEQ ID NO: 39171

SEQ ID NO: 79411 - DNA, 201 bp, Bos taurus
gtaaacaatccgtgtcaacatggaatgtccgcattttaaggctgtgtgaggataaattttactttcttcacaagggccttctgggaagaactttggcacaygcggacggggagaatgtgacctagaggagaagggtttggagccctagctcattctgtaaccccactcctgtccacttagttgaggcccagttagggccca

SEQ ID NO: 79412 - DNA, 201 bp, Bos taurus
acctaatgtctttctagtgatgatttacataatcaatcagcactcatgatgaccttcagtggaagttatgataacacaggtgagtgtttcacatggagcaygtgtcacatggaagaaatactttttttcttccttctgtaaactggctgagaattatttttaagccattgacaaaatggaacaaatgtctaaaagttgttg

SEQ ID NO: 79413 - DNA, 201 bp, Bos taurus; identical to SEQ ID NO: 39182

SEQ ID NO: 79414 - DNA, 201 bp, Bos taurus
cctttgctgcttgttcattcattcattaggggaaccagtccattgatttcaaggttcaggggtccattgtagtgaaggtcccttagagaattctgaaataratgctggtttggattggataagcccaacctatgttttttatggataatttttaattattaaattaataattagtacctgcacacaggcttggagaaggaa

SEQ ID NO: 79415 - DNA, 201 bp, Bos taurus; identical to SEQ ID NO: 39184

SEQ ID NO: 79416 - DNA, 201 bp, Bos taurus; identical to SEQ ID NO: 39185

SEQ ID NO: 79417 - DNA, 201 bp, Bos taurus
tcaaaatgcacagatgtaagtgttaatctcatccaaaaacattcttacagaaacatccagaataatatttgaccacataggtgggcacgatggcccagtcrgattgacacacgaaattaaccatcataggtggtattctccaaacccacctcctttccagaacatcagaatgtggccaaggttgggaacagggcccactga

SEQ ID NO: 79418 - DNA, 201 bp, Bos taurus; identical to SEQ ID NO: 39186

SEQ ID NO: 79419 - DNA, 201 bp, Bos taurus; identical to SEQ ID NO: 39187

SEQ ID NO: 79420 - DNA, 201 bp, Bos taurus; identical to SEQ ID NO: 39189

SEQ ID NO: 79421 - DNA, 201 bp, Bos taurus; identical to SEQ ID NO: 39190

SEQ ID NO: 79422 - DNA, 201 bp, Bos taurus; identical to SEQ ID NO: 39191

SEQ ID NO: 79423 - DNA, 201 bp, Bos taurus
ctccatcttcagcagacctgaacccaacctgaaatctagggtcctagcagggctcagccaagctcaagttcatctaatgatccagcaatatactaagcaaygcagaaaagactagaattatgatatgcataatttctattatctttccttatatttactagtcgctcagttgtgtgtgactctttgcgaccccatggactt

SEQ ID NO: 79424 - DNA, 201 bp, Bos taurus
taaatgtcagctccaagagcctgaacaggggacatctaactgtcctctttagaatagggagaccaggaaccaggattcaagctcatctctctcatccaaayaccatgctattaggctcacagactaagcttctctgactcctctaagcaggttgcagctctcctgggtcactcaagatgccatccaacaccacaggataag

SEQ ID NO: 79425 - DNA, 201 bp, Bos taurus
gtaggaacctggggcatctcagtataggcacccaaaagttgttttaaaacaagaggctactgagtgttttcaaggtgtggtttcaggtatatggtcatatygctgggaatgattgctgaagaatttcatgctggcactaaaacatacaaatgtcacttttcaaataacatttcctacttgctcatcaacatttcgcttggg

SEQ ID NO: 79426 - DNA, 201 bp, Bos taurus
tttttttttttaagagttcataaagcacttcagtattctgtggttcatagtgtcattacagagaacagtagctatggccattcaagaaatttggaaacgcytgtaagtggagttttagctagtagaggacaggctttgattctgttagtgttcctgtttttcactgtttggaaggtctgtaattagctcagctttgggcca

SEQ ID NO: 79427 - DNA, 201 bp, Bos taurus
cagcaatacaaatgtgcccgagtggtccagacgcagcagagtctaagcctgaccagctggcagagggattaatgactaggaatgtagtctgggtctggccrtgtaagtcaacgctcctagcctgcgatgctggatggttttgtcagttgcttgttactgtcagtactcctgagaatgcacggggccatctgcccagaataa

SEQ ID NO: 79428 - DNA, 201 bp, Bos taurus
caaacctttatactcctgcagggaagatgcacaacctatctttactttcaccaagggaataacaccttagatttgcagtttgcaaagcaccttaacgttckttatatttaatccatgcaacacttccgggagggaggaggcagtttggcatgactatttaaaaatttttttttattaggaaaggtagagccataggagaaa

SEQ ID NO: 79429 - DNA, 201 bp, Bos taurus; identical to SEQ ID NO: 39193

SEQ ID NO: 79430 - DNA, 201 bp, Bos taurus; identical to SEQ ID NO: 39195

SEQ ID NO: 79431 - DNA, 201 bp, Bos taurus; identical to SEQ ID NO: 39196

SEQ ID NO: 79432 - DNA, 201 bp, Bos taurus; identical to SEQ ID NO: 39197

SEQ ID NO: 79433 - DNA, 201 bp, Bos taurus; identical to SEQ ID NO: 39198

SEQ ID NO: 79434 - DNA, 201 bp, Bos taurus; identical to SEQ ID NO: 39199

SEQ ID NO: 79435 - DNA, 201 bp, Bos taurus; identical to SEQ ID NO: 39200

SEQ ID NO: 79436 - DNA, 201 bp, Bos taurus; identical to SEQ ID NO: 39201

SEQ ID NO: 79437 - DNA, 201 bp, Bos taurus; identical to SEQ ID NO: 39202

SEQ ID NO: 79438 - DNA, 201 bp, Bos taurus
gggccccatctctcctttgatcagtcacggctggatgggagatttttgaatcattttattgtctgactgcagctttatagattctctttcaggaagcagckcacttttcctctttcttcctctggcctctaattctttctttgcttcaggggtcctggtagttcagggtctatgtgtcaaggcctttggttagatcattta

SEQ ID NO: 79439 - DNA, 201 bp, Bos taurus; identical to SEQ ID NO: 39212

SEQ ID NO: 79440 - DNA, 201 bp, Bos taurus
aggaaaatattaaattggtttctactcacccttggagttcagagacaagtttcattctgtgacatcacctggtttggtttgtatctgagtttctatccaayagaactactaaagagtaggacctgtgagtcattagtagatatgagtgggtgatacaaattcatggtctggaaacacaccatggtgatgggaaacagatat

SEQ ID NO: 79441 - DNA, 201 bp, Bos taurus
gggctcattattttgtttttctatccagagaggaaagaactttgaaatggcagcttctgacaagaataaaagaatagcaataatcatggtagctctgtccragtcaattttctccatgtggcaaaatatgataggaactcacaaaatgaaaggataccaggctacccagagcatagctaccaccagggaactcatcatgaa

SEQ ID NO: 79442 - DNA, 201 bp, Bos taurus
gcagctggaggaagacagagctctggctccatctcagtccccaagctgtatccctctggccatggtagcacttccccaaacaccacagaaaggagagagcyggatccttccagccctcagaaggactcagcctcttctgggctgccttcccaacaccccaaacaccagccacttcctttcaaacatatttccaagtgaatg

SEQ ID NO: 79443 - DNA, 201 bp, Bos taurus
atagttaccatgattatatatgatatcagtcaatgtcatgggaaaatattaattgaaatgaactaatccactcagtactgagtgcagaacaaacttgggcrtcaagctggagaaggaagttccactccctgtttgcctctcagatccaggtaaccaagtcttctagaagcctggtgaagggctacttcttcccaactaacg

SEQ ID NO: 79444 - DNA, 201 bp, Bos taurus; identical to SEQ ID NO: 39215

SEQ ID NO: 79445 - DNA, 201 bp, Bos taurus
aaagtaaatggcatcatttaattattactagaactttcctggtggcacagatagtaaagaatctgcctgcaatgtgggagacctggatttgatccctggaytgagaacagtccctgcagaaaggaatgacaattctctcccagtgttcttgcctggagagaattcccatggacagaggagtctggcaggtcacagtccatg

SEQ ID NO: 79446 - DNA, 201 bp, Bos taurus
acggcataatgtccaacacacatgctaaaggaatttgtagatgtgatagccatctgtgggacagagtgggggccacgacacgtggagaaggcaggcatcarttgaatcctaatttttccaaagcagcaaaacatagattctggaaacttctagctcataaacttggaaatctcagcagccaggaattagagtgagttgaga

SEQ ID NO: 79447 - DNA, 201 bp, Bos taurus
tctcctacattgtgaacagattctttatcatctgagccaccagcgaagtccaatgtatctgaacttagatgcagcatttaacctctggcttcaggtggcckctccccctgcaaacccagtacttagagtggaaaggagctttgtcctgaccagcccttgctcatgcccctgaactctgcagaggccctcctcagggagaag

SEQ ID NO: 79448 - DNA, 201 bp, Bos taurus
gtctgatggctttgcaaagggcctttgaagggtgctaatggatgttcaaggcaaaagggcaacatcccaaactattgtctttgtaaattgggtctagcacrgggcccaatacacagtaggtactcactcaatatggaataaataaacgaatgaaccaaaaagcacctccaagccactgctagagactttagcaagaaaaac

SEQ ID NO: 79449 - DNA, 201 bp, Bos taurus; identical to SEQ ID NO: 39222

SEQ ID NO: 79450 - DNA, 201 bp, Bos taurus
caagggacccagcaagcccacggaagatgtgtggccctttatcccacccatatcctagatcgcaggcttgttacagctctcctggaaaaagataaaatatkccagcagtgatgggtcaggggggcaggagaggggcccacaccactgcaagaatttgatgagcctctgataccagcagcataaataaggcctttaataaat

SEQ ID NO: 79451 - DNA, 201 bp, Bos taurus
agcctggcacttaaatacctgttgaatgaataaaaggaggaagaaaaatggaaggaaggtaagtagaaagaaaggaagaagcttttatccttggagagaakgtggttagctatttccaacattttctcaaagcccatcttgggaccagctttcttttttcatagagtcaacaaaatccttaataagcacctcttccatgtc

SEQ ID NO: 79452 - DNA, 201 bp, Bos taurus
tggcgtgactctctgcatggaacatttcatattcccatgcaatgaagaagccttcgaagtgctagtgggaagctgctgtataacacagggagctcagctcrgtgtcttgtaatggcctagaggggtgaagaatcagcctgcaatgtgggagacccagattcgatccctgggtggggaagatcccctgaaggaagaaatggc

SEQ ID NO: 79453 - DNA, 201 bp, Bos taurus
cctcgggggcccttttcaaactctgcactggctcggctccctttacccctttgtttctcctatgaaggcacaacctcccccacagggctccttggctcacmagggccaaacaagcaggtatgtttaaagcatcagcagccagaggcaccaaaaaatgaggacaattcagcttttctgcactcaagaagtctaagactctat

SEQ ID NO: 79454 - DNA, 201 bp, Bos taurus
tacgtctcttttattataaaaattctagggccttacctatttgaggccaaggtttaggaagagagtcaagatcaattggcagtattttcaaatacatggakgtgagaggagtggaggcccctatgccaaatgtttgctttccttgcatctaaacagaaaacaaattttcatacattcctcatgctattgtattagtaggac

SEQ ID NO: 79455 - DNA, 201 bp, Bos taurus; identical to SEQ ID NO: 39230

SEQ ID NO: 79456 - DNA, 201 bp, Bos taurus; identical to SEQ ID NO: 39232

SEQ ID NO: 79457 - DNA, 201 bp, Bos taurus; identical to SEQ ID NO: 39236

SEQ ID NO: 79458 - DNA, 201 bp, Bos taurus; identical to SEQ ID NO: 39238

SEQ ID NO: 79459 - DNA, 201 bp, Bos taurus; identical to SEQ ID NO: 39240

SEQ ID NO: 79460 - DNA, 201 bp, Bos taurus
tagctgctgccacatggcaggcgggatccttaattcccagacccgtgacccttgctgtggaagcagagagtcttaactgctggatggccaaggaagtcccraaaaggtgtgtttttacactgtgtaacatacactggaaaatggcagaacctaaaccatagaatatgagggccactgggggcaataagaggattctggagt

SEQ ID NO: 79461 - DNA, 201 bp, Bos taurus; identical to SEQ ID NO: 39241

SEQ ID NO: 79462 - DNA, 201 bp, Bos taurus; identical to SEQ ID NO: 39242

SEQ ID NO: 79463 - DNA, 201 bp, Bos taurus; identical to SEQ ID NO: 39243

SEQ ID NO: 79464 - DNA, 201 bp, Bos taurus; identical to SEQ ID NO: 39244

SEQ ID NO: 79465 - DNA, 201 bp, Bos taurus
gataaatagcatgtatgatctgtaggcagaggccaggagatgaaaaactatgtaaggtagctttaagaaactatcagaaaaggggaaaatagaaattacayattagaggaaacagatgacacacctcagtttggacttcactctgaagacaaataacaattgttggttttgggggcaagagagatagggagacgtttgtgt

SEQ ID NO: 79466 - DNA, 201 bp, Bos taurus
gcacttcctataatatgagagagacaggagggaccaaccagtctttctgaaagagggaattcacatgagaactagaaagttaagagatggttgtgctaatycatcgatataattatgcttgttttatttgaaccatcatcccctagtatattcttctatctctgtcgccagacttctgctctacttttttcccccaaatcc

SEQ ID NO: 79467 - DNA, 201 bp, Bos taurus; identical to SEQ ID NO: 39248

SEQ ID NO: 79468 - DNA, 201 bp, Bos taurus; identical to SEQ ID NO: 39249

SEQ ID NO: 79469 - DNA, 201 bp, Bos taurus; identical to SEQ ID NO: 39250

SEQ ID NO: 79470 - DNA, 201 bp, Bos taurus; identical to SEQ ID NO: 39251

SEQ ID NO: 79471 - DNA, 201 bp, Bos taurus; identical to SEQ ID NO: 39252

SEQ ID NO: 79472 - DNA, 201 bp, Bos taurus
ccacatctgtgctgctctgtcatctactggcactcaggcctgttagtgagagcttggctcctggaggaaggcagctggacagagtgcaaacagggaaaggyggtcacaggcctgatgcgtgatgttaaggtgctggggtagcctggccaggtgggatgtgtttcctccatcactgtttgcccgactctgtccttcaaggct

SEQ ID NO: 79473 - DNA, 201 bp, Bos taurus
atttatttatgtaggccgtgcccggtcttagttatgacatgtgggccctagttccttgatcaggaactgaacctggggcccttgcattgggagaaaggagytttagtcactggaccacgagggcaagcccttgggttaccgaaaggtgtggggtctggctgctcgctgccccaaagccggtaaacaggccaggttggtgga

SEQ ID NO: 79474 - DNA, 201 bp, Bos taurus
cctgtgatggtgggggtagaggcttcacctgagtaaggcgggccaggtgggctgggccatttgggctcctcacgtggccaaagcatcccagtgttctgttkactgagcaccaactgcatgctaggcaaagtgcgaggtgtttagtatcccgattttacagatgaggaaattgagactcggagaataagtgaggtgtccaag

SEQ ID NO: 79475 - DNA, 201 bp, Bos taurus
cctgccccggcggcgagcagcgaggccagcagagaggcttggaggcggtagacgaatcctgcccttagaggcacacagtggcaccggaaggggagcccgayggcctccaggacactaggagtgtggcttcttcatctggtgctggttgtgcacggtgttcagtttgtgaaaattcacctactagtgcatttatggtatatg

SEQ ID NO: 79476 - DNA, 201 bp, Bos taurus; identical to SEQ ID NO: 39255

SEQ ID NO: 79477 - DNA, 201 bp, Bos taurus; identical to SEQ ID NO: 39258

SEQ ID NO: 79478 - DNA, 201 bp, Bos taurus
aaattcagaaaatcatccatgttattatattcactgtgctgtagctataagtaggtaaaagctactagtctgcatgacaaggcttggaagtatagaaaacraaaagtctgatttgttgtgatagcagaaggaacacaaggtagaagcacaaacactggagtcagacagacttggcctgtgtctcagccctgccactgactg

SEQ ID NO: 79479 - DNA, 201 bp, Bos taurus
aggaaaaaacaccttcatatcacaatcacacactttagaactggaaaagactttaagtccaacctactaagaccaatttatagttctgtcatccccaagaytgcttctctctccttcttgtgtgatttatttaacaatatcaactggcttctagggtaattagaaatactcagatagctagcaaacttgcaacaaacactg

SEQ ID NO: 79480 - DNA, 201 bp, Bos taurus
tgtttttgttagtctgttgaacaagtggattttgggggcagatggtaccttgctgaaagctgagtgctcttctggcaaggccattcaggtcaaaagaatcrtatgcacttctttagaagtgactcacatgcttctcagttgaattcaggatctttccttctgtgggatagtgttcacataaattccctttcctggacagtg

SEQ ID NO: 79481 - DNA, 201 bp, Bos taurus; identical to SEQ ID NO: 39259

SEQ ID NO: 79482 - DNA, 201 bp, Bos taurus; identical to SEQ ID NO: 39260

SEQ ID NO: 79483 - DNA, 201 bp, Bos taurus; identical to SEQ ID NO: 39261

SEQ ID NO: 79484 - DNA, 201 bp, Bos taurus; identical to SEQ ID NO: 39263

SEQ ID NO: 79485 - DNA, 201 bp, Bos taurus; identical to SEQ ID NO: 39264

SEQ ID NO: 79486 - DNA, 201 bp, Bos taurus; identical to SEQ ID NO: 39267

SEQ ID NO: 79487 - DNA, 201 bp, Bos taurus
ggctgcctgactagtcctgcctgcaccaaaatgcatggctaccagttggctttaggatggcatacttcactagaagctgccccaggccccttataacccayagtgcgctttttatgtgactcattaaacacaccctacatcacagctgggctttactggcctcggggctcttagttttccagacatctaatccagggaaca

SEQ ID NO: 79488 - DNA, 201 bp, Bos taurus
gattttgtatattgaaaaccctgaagatttcacttaaaaactatagagacaataaatacagtaaagctgcagggtataatatcaatataaaaaagtctgtkgcagacgtagagaatgaactgaccattgttggcaggaaggatgggggaaagggatagttttattcaattcacataaaatttaaaaacagaaaaaactaac

SEQ ID NO: 79489 - DNA, 201 bp, Bos taurus
aggaatcacctaataagcaccccaaccttgaggaaaaagagggaaagaactggggactgaaaatgtgggcaaagtgcctggcgaactcatttgcctgcacygctagaatatcagcttcctgagggtggggatttttttgtctgcttggctcacccactgtgtttccagcaactaaaatagtgcctaacacacagaagacac

SEQ ID NO: 79490 - DNA, 201 bp, Bos taurus; identical to SEQ ID NO: 39268

SEQ ID NO: 79491 - DNA, 201 bp, Bos taurus; identical to SEQ ID NO: 39269

SEQ ID NO: 79492 - DNA, 201 bp, Bos taurus; identical to SEQ ID NO: 39270

SEQ ID NO: 79493 - DNA, 201 bp, Bos taurus; identical to SEQ ID NO: 39271

SEQ ID NO: 79494 - DNA, 201 bp, Bos taurus; identical to SEQ ID NO: 39272

SEQ ID NO: 79495 - DNA, 201 bp, Bos taurus; identical to SEQ ID NO: 39273

SEQ ID NO: 79496 - DNA, 201 bp, Bos taurus; identical to SEQ ID NO: 39274

SEQ ID NO: 79497 - DNA, 201 bp, Bos taurus; identical to SEQ ID NO: 39275

SEQ ID NO: 79498 - DNA, 201 bp, Bos taurus; identical to SEQ ID NO: 39276

SEQ ID NO: 79499 - DNA, 201 bp, Bos taurus
aattcaccagcaatggcgccttgaggatacgtcaaagataccatttccatttccagtgttcagcaggtgcaattgtcaatcaaagatgctccctgagtccygggaaaccttggcatcacctctctgctactgggtgtcatgagagcttacagttattgaaaaaactaattacaaatagtttatttcactgactgaatcgca

SEQ ID NO: 79500 - DNA, 201 bp, Bos taurus
tttttaaaaaataactagatatttcaaggagaagtggcatagttcaagagagctttgtcttctgtcaatataggaaaatgtgactttaaccaactgtattmatatggggagagggatagatggggctgattggaattattccttcttcattcctttagaatcttttatatggaccatttttaaagttttagttgaatttgt

SEQ ID NO: 79501 - DNA, 201 bp, Bos taurus; identical to SEQ ID NO: 39280

SEQ ID NO: 79502 - DNA, 201 bp, Bos taurus
acatattataaaatttaccaaagtgaccatggtgaggtggacagttcagtggctttagggctgtgtttcacagctggactcagtctggcctctcaaacacrgactgaaatcctcagctcagcgtctgccctaagttaatatcagagaccccacaccgattataaaagtcagaccttggaaaaattgtctggtgattctccc

SEQ ID NO: 79503 - DNA, 201 bp, Bos taurus
ggtatgagggctcagtgccaggcaccactggcatctccccagatcctctgactccaggttccaaacctcagcattttctgccagatggggcgcagttctamttcaagtaagctgtgcccccatgaaggtatgagccagcggaagacaggaagaactgagagataagactttaaaagctttgagcttgaggtaggaaaggag

SEQ ID NO: 79504 - DNA, 201 bp, Bos taurus
aaataattaatatatataacacaagaggtgttatattaacatatgatcttcttagggtgtcaaaatctgcctggtatctacttctcctccagcaaacatgrggaggagcccaataatgtcaaaagtgaatactgtcattatgttgtaggatgtctgccaagctgaacattggataaaaacacctcggtgttttttttttta

SEQ ID NO: 79505 - DNA, 201 bp, Bos taurus; identical to SEQ ID NO: 39283

SEQ ID NO: 79506 - DNA, 201 bp, Bos taurus; identical to SEQ ID NO: 39284

SEQ ID NO: 79507 - DNA, 201 bp, Bos taurus
cccttgaatatttagatatagaattggaattctgtgccggtgttactcagacgaaaggtgccactgagaagagaggcgtctgtctccatccccacgtcccrcactggcctcatcttgtgatgtccctgagtgagtcctttcatgtccccaagaaaagggatggcagaactggtgggctgtgctaaagagtggttttccttt

SEQ ID NO: 79508 - DNA, 201 bp, Bos taurus
catccctgccttgggtggggctgggggagaggaaatggccaggtccagcatatggaatatgtatgccttgagtcccagtctagacatctacacagacaggrgcagggtgaggagggaagggccagctggggaagcagatggacttggttttctttttctagttttggctgcagtgggtcttcattgctgtgcatgggcttt

SEQ ID NO: 79509 - DNA, 201 bp, Bos taurus
agtcagacgcgacagcaaccttcactcacctcaagacaatcctgtaggatgcacactgaactgagctgtggatgaagcccagagaaggtgaataattgackcaaggtcacaggcttgacagggtgacactgaagtacaaactttcttgtccggctctgctcctatctccccacctaccccttccccggcacctgctggcac

SEQ ID NO: 79510 - DNA, 201 bp, Bos taurus
ctgccccgcctccaggtcatcacagagcaccagctgagctccctgtgctgtacagcaacttcccactagctattttacacgtgatagtgtatatacgtcamcgccactttctcgattcgtcccaccattcccttccacacccccactgtgttcacaagtccactttctatgtctgcatctctattcctgtcctgcaaattg

SEQ ID NO: 79511 - DNA, 201 bp, Bos taurus; identical to SEQ ID NO: 39285

SEQ ID NO: 79512 - DNA, 201 bp, Bos taurus
tattgtctagaatgactactaatcaaacatgtatgcaatttcttaaaaaaaaaaaaaacaaaatctaccctggtcctctcaacaggctatgggataggaamcaccagtcacaccaacccaacctgaccctcaagtctaccgagaagcatcaactccttctctctccctcttgtctgtttcccatccagttaccaatgacgg

SEQ ID NO: 79513 - DNA, 201 bp, Bos taurus
cagcatgtgcactccggactgggacagacccatcttacccaaccaaatactgggaggacacggcctggccagcctggcctgcagcagatctctggtgcagsggttgaccagagagctgtctttgagtgggtggaggcgggggtgtgtctggtggagggagtgttgactgggaggacagaggctggccaagcatttcccatc

SEQ ID NO: 79514 - DNA, 201 bp, Bos taurus; identical to SEQ ID NO: 39286

SEQ ID NO: 79515 - DNA, 201 bp, Bos taurus; identical to SEQ ID NO: 39287

SEQ ID NO: 79516 - DNA, 201 bp, Bos taurus; identical to SEQ ID NO: 39288

SEQ ID NO: 79517 - DNA, 201 bp, Bos taurus; identical to SEQ ID NO: 39289

SEQ ID NO: 79518 - DNA, 201 bp, Bos taurus; identical to SEQ ID NO: 39290

SEQ ID NO: 79519 - DNA, 201 bp, Bos taurus; identical to SEQ ID NO: 39291

SEQ ID NO: 79520 - DNA, 201 bp, Bos taurus; identical to SEQ ID NO: 39293

SEQ ID NO: 79521 - DNA, 201 bp, Bos taurus; identical to SEQ ID NO: 39294

SEQ ID NO: 79522 - DNA, 201 bp, Bos taurus; identical to SEQ ID NO: 39295

SEQ ID NO: 79523 - DNA, 201 bp, Bos taurus
gctcttcacaggcaggcagatgttgttcccctattaaaaatatgcacgtcaacacagaaaagataagtacctcacccagggccaatacacccatacaccawatgtgtatgttcataactcacacaatgacactcaaggatacagagtcattgtttaaaggcccaaatatataattaatgtgtgtatatatatatatatata

SEQ ID NO: 79524 - DNA, 201 bp, Bos taurus
gtgggtggggggatgggggcacattctcagccatccactactccctgcagggagcctcagctcagattgctcaggaaaagccatagctgtggcagggcacrggctcatgacatatagcccacctcacaggctctagggccgttggtccccaatctttttggcaccagggaagggtttcgtggaagacagtttttccacaga

SEQ ID NO: 79525 - DNA, 201 bp, Bos taurus
cctgcctgccccagctcctgttccaggagagcaaccccggggtgcgctacgagtacatcatccacagggaggcggacggccacgaccacatccagccgccygagttctcctggcgctatggaccctggtccaaatgcactgtcacctgtggcacaggtgaggagagggctgggcacggccgctgcccagcggggcctttgt

SEQ ID NO: 79526 - DNA, 201 bp, Bos taurus
tgccccagaagcagctgaccccacagcaggtgctcgccgagtacccgctgactgtcatcctttccacagggcagggcgctgggtgctatggcctgaagccmctcatacactccaaatgccccatgaaaacagctgctgcagagtcggtggagcagtcagccttgctaatctgtatggaagtacagagggtgcggctataca

SEQ ID NO: 79527 - DNA, 201 bp, Bos taurus; identical to SEQ ID NO: 39299

SEQ ID NO: 79528 - DNA, 201 bp, Bos taurus; identical to SEQ ID NO: 39300

SEQ ID NO: 79529 - DNA, 201 bp, Bos taurus; identical to SEQ ID NO: 39301

SEQ ID NO: 79530 - DNA, 201 bp, Bos taurus; identical to SEQ ID NO: 39302

SEQ ID NO: 79531 - DNA, 201 bp, Bos taurus; identical to SEQ ID NO: 39303

SEQ ID NO: 79532 - DNA, 201 bp, Bos taurus; identical to SEQ ID NO: 39304

SEQ ID NO: 79533 - DNA, 201 bp, Bos taurus; identical to SEQ ID NO: 39305

SEQ ID NO: 79534 - DNA, 201 bp, Bos taurus; identical to SEQ ID NO: 39306

SEQ ID NO: 79535 - DNA, 201 bp, Bos taurus; identical to SEQ ID NO: 39307

SEQ ID NO: 79536 - DNA, 201 bp, Bos taurus; identical to SEQ ID NO: 39308

SEQ ID NO: 79537 - DNA, 201 bp, Bos taurus; identical to SEQ ID NO: 39309

SEQ ID NO: 79538 - DNA, 201 bp, Bos taurus; identical to SEQ ID NO: 39310

SEQ ID NO: 79539 - DNA, 201 bp, Bos taurus; identical to SEQ ID NO: 39311

SEQ ID NO: 79540 - DNA, 201 bp, Bos taurus; identical to SEQ ID NO: 39312

SEQ ID NO: 79541 - DNA, 201 bp, Bos taurus; identical to SEQ ID NO: 39313

SEQ ID NO: 79542 - DNA, 201 bp, Bos taurus; identical to SEQ ID NO: 39314

SEQ ID NO: 79543 - DNA, 201 bp, Bos taurus; identical to SEQ ID NO: 39315

SEQ ID NO: 79544 - DNA, 201 bp, Bos taurus; identical to SEQ ID NO: 39316

SEQ ID NO: 79545 - DNA, 201 bp, Bos taurus; identical to SEQ ID NO: 39317

SEQ ID NO: 79546 - DNA, 201 bp, Bos taurus; identical to SEQ ID NO: 39318

SEQ ID NO: 79547 - DNA, 201 bp, Bos taurus; identical to SEQ ID NO: 39319

SEQ ID NO: 79548 - DNA, 201 bp, Bos taurus; identical to SEQ ID NO: 39320

SEQ ID NO: 79549 - DNA, 201 bp, Bos taurus; identical to SEQ ID NO: 39321

SEQ ID NO: 79550 - DNA, 201 bp, Bos taurus; identical to SEQ ID NO: 39322

SEQ ID NO: 79551 - DNA, 201 bp, Bos taurus; identical to SEQ ID NO: 39323

SEQ ID NO: 79552 - DNA, 201 bp, Bos taurus; identical to SEQ ID NO: 39324

SEQ ID NO: 79553 - DNA, 201 bp, Bos taurus; identical to SEQ ID NO: 39325

SEQ ID NO: 79554 - DNA, 201 bp, Bos taurus; identical to SEQ ID NO: 39326

SEQ ID NO: 79555 - DNA, 201 bp, Bos taurus; identical to SEQ ID NO: 39327

SEQ ID NO: 79556 - DNA, 201 bp, Bos taurus; identical to SEQ ID NO: 39328

SEQ ID NO: 79557 - DNA, 201 bp, Bos taurus; identical to SEQ ID NO: 39329

SEQ ID NO: 79558 - DNA, 201 bp, Bos taurus; identical to SEQ ID NO: 39330

SEQ ID NO: 79559 - DNA, 201 bp, Bos taurus; identical to SEQ ID NO: 39331

SEQ ID NO: 79560 - DNA, 201 bp, Bos taurus; identical to SEQ ID NO: 39332

SEQ ID NO: 79561 - DNA, 201 bp, Bos taurus; identical to SEQ ID NO: 39333

SEQ ID NO: 79562 - DNA, 201 bp, Bos taurus; identical to SEQ ID NO: 39334

SEQ ID NO: 79563 - DNA, 201 bp, Bos taurus; identical to SEQ ID NO: 39335

SEQ ID NO: 79564 - DNA, 201 bp, Bos taurus; identical to SEQ ID NO: 39336

SEQ ID NO: 79565 - DNA, 201 bp, Bos taurus; identical to SEQ ID NO: 39337

SEQ ID NO: 79566 - DNA, 201 bp, Bos taurus; identical to SEQ ID NO: 39338

SEQ ID NO: 79567 - DNA, 201 bp, Bos taurus; identical to SEQ ID NO: 39339

SEQ ID NO: 79568 - DNA, 201 bp, Bos taurus; identical to SEQ ID NO: 39340

SEQ ID NO: 79569 - DNA, 201 bp, Bos taurus; identical to SEQ ID NO: 39341

SEQ ID NO: 79570 - DNA, 201 bp, Bos taurus; identical to SEQ ID NO: 39342

SEQ ID NO: 79571 - DNA, 201 bp, Bos taurus; identical to SEQ ID NO: 39343

SEQ ID NO: 79572 - DNA, 201 bp, Bos taurus; identical to SEQ ID NO: 39344

SEQ ID NO: 79573 - DNA, 201 bp, Bos taurus; identical to SEQ ID NO: 39345

SEQ ID NO: 79574 - DNA, 201 bp, Bos taurus; identical to SEQ ID NO: 39346

SEQ ID NO: 79575 - DNA, 201 bp, Bos taurus; identical to SEQ ID NO: 39347

SEQ ID NO: 79576 - DNA, 201 bp, Bos taurus; identical to SEQ ID NO: 39348

SEQ ID NO: 79577 - DNA, 201 bp, Bos taurus; identical to SEQ ID NO: 39349

SEQ ID NO: 79578 - DNA, 201 bp, Bos taurus; identical to SEQ ID NO: 39350

SEQ ID NO: 79579 - DNA, 201 bp, Bos taurus; identical to SEQ ID NO: 39351

SEQ ID NO: 79580 - DNA, 201 bp, Bos taurus; identical to SEQ ID NO: 39352

SEQ ID NO: 79581 - DNA, 201 bp, Bos taurus; identical to SEQ ID NO: 39353

SEQ ID NO: 79582 - DNA, 201 bp, Bos taurus; identical to SEQ ID NO: 39354

SEQ ID NO: 79583 - DNA, 201 bp, Bos taurus; identical to SEQ ID NO: 39355

SEQ ID NO: 79584 - DNA, 201 bp, Bos taurus; identical to SEQ ID NO: 39356

SEQ ID NO: 79585 - DNA, 201 bp, Bos taurus; identical to SEQ ID NO: 39357

SEQ ID NO: 79586 - DNA, 201 bp, Bos taurus; identical to SEQ ID NO: 39358

SEQ ID NO: 79587 - DNA, 201 bp, Bos taurus; identical to SEQ ID NO: 39359

SEQ ID NO: 79588 - DNA, 201 bp, Bos taurus; identical to SEQ ID NO: 39360

SEQ ID NO: 79589 - DNA, 201 bp, Bos taurus; identical to SEQ ID NO: 39361

SEQ ID NO: 79590 - DNA, 201 bp, Bos taurus; identical to SEQ ID NO: 39362

SEQ ID NO: 79591 - DNA, 201 bp, Bos taurus; identical to SEQ ID NO: 39363

SEQ ID NO: 79592 - DNA, 201 bp, Bos taurus; identical to SEQ ID NO: 39364

SEQ ID NO: 79593 - DNA, 201 bp, Bos taurus; identical to SEQ ID NO: 39365

SEQ ID NO: 79594 - DNA, 201 bp, Bos taurus; identical to SEQ ID NO: 39366

SEQ ID NO: 79595 - DNA, 201 bp, Bos taurus; identical to SEQ ID NO: 39367

SEQ ID NO: 79596 - DNA, 201 bp, Bos taurus; identical to SEQ ID NO: 39368

SEQ ID NO: 79597 - DNA, 201 bp, Bos taurus; identical to SEQ ID NO: 39369

SEQ ID NO: 79598 - DNA, 201 bp, Bos taurus; identical to SEQ ID NO: 39370

SEQ ID NO: 79599 - DNA, 201 bp, Bos taurus; identical to SEQ ID NO: 39371

SEQ ID NO: 79600 - DNA, 201 bp, Bos taurus; identical to SEQ ID NO: 39372

SEQ ID NO: 79601 - DNA, 201 bp, Bos taurus; identical to SEQ ID NO: 39373

SEQ ID NO: 79602 - DNA, 201 bp, Bos taurus; identical to SEQ ID NO: 39374

SEQ ID NO: 79603 - DNA, 201 bp, Bos taurus; identical to SEQ ID NO: 39375

SEQ ID NO: 79604 - DNA, 201 bp, Bos taurus; identical to SEQ ID NO: 39376

SEQ ID NO: 79605 - DNA, 201 bp, Bos taurus; identical to SEQ ID NO: 39377

SEQ ID NO: 79606 - DNA, 201 bp, Bos taurus; identical to SEQ ID NO: 39378

SEQ ID NO: 79607 - DNA, 201 bp, Bos taurus; identical to SEQ ID NO: 39379

SEQ ID NO: 79608 - DNA, 201 bp, Bos taurus; identical to SEQ ID NO: 39380

SEQ ID NO: 79609 - DNA, 201 bp, Bos taurus; identical to SEQ ID NO: 39381

SEQ ID NO: 79610 - DNA, 201 bp, Bos taurus; identical to SEQ ID NO: 39382

SEQ ID NO: 79611 - DNA, 201 bp, Bos taurus; identical to SEQ ID NO: 39383

SEQ ID NO: 79612 - DNA, 201 bp, Bos taurus; identical to SEQ ID NO: 39384

SEQ ID NO: 79613 - DNA, 201 bp, Bos taurus; identical to SEQ ID NO: 39385

SEQ ID NO: 79614 - DNA, 201 bp, Bos taurus; identical to SEQ ID NO: 39386

SEQ ID NO: 79615 - DNA, 201 bp, Bos taurus; identical to SEQ ID NO: 39387

SEQ ID NO: 79616 - DNA, 201 bp, Bos taurus; identical to SEQ ID NO: 39388

SEQ ID NO: 79617 - DNA, 201 bp, Bos taurus; identical to SEQ ID NO: 39389

SEQ ID NO: 79618 - DNA, 201 bp, Bos taurus; identical to SEQ ID NO: 39390

SEQ ID NO: 79619 - DNA, 201 bp, Bos taurus; identical to SEQ ID NO: 39391

SEQ ID NO: 79620 - DNA, 201 bp, Bos taurus; identical to SEQ ID NO: 39392

SEQ ID NO: 79621 - DNA, 201 bp, Bos taurus; identical to SEQ ID NO: 39393

SEQ ID NO: 79622 - DNA, 201 bp, Bos taurus; identical to SEQ ID NO: 39394

SEQ ID NO: 79623 - DNA, 201 bp, Bos taurus; identical to SEQ ID NO: 39395

SEQ ID NO: 79624 - DNA, 201 bp, Bos taurus; identical to SEQ ID NO: 39396

SEQ ID NO: 79625 - DNA, 201 bp, Bos taurus; identical to SEQ ID NO: 39397

SEQ ID NO: 79626 - DNA, 201 bp, Bos taurus; identical to SEQ ID NO: 39398

SEQ ID NO: 79627 - DNA, 201 bp, Bos taurus; identical to SEQ ID NO: 39399

SEQ ID NO: 79628 - DNA, 201 bp, Bos taurus; identical to SEQ ID NO: 39400

SEQ ID NO: 79629 - DNA, 201 bp, Bos taurus; identical to SEQ ID NO: 39401

SEQ ID NO: 79630 - DNA, 201 bp, Bos taurus; identical to SEQ ID NO: 39402

SEQ ID NO: 79631 - DNA, 201 bp, Bos taurus; identical to SEQ ID NO: 39403

SEQ ID NO: 79632 - DNA, 201 bp, Bos taurus; identical to SEQ ID NO: 39404

SEQ ID NO: 79633 - DNA, 201 bp, Bos taurus; identical to SEQ ID NO: 39405

SEQ ID NO: 79634 - DNA, 201 bp, Bos taurus; identical to SEQ ID NO: 39406

SEQ ID NO: 79635 - DNA, 201 bp, Bos taurus; identical to SEQ ID NO: 39407

SEQ ID NO: 79636 - DNA, 201 bp, Bos taurus; identical to SEQ ID NO: 39408

SEQ ID NO: 79637 - DNA, 201 bp, Bos taurus; identical to SEQ ID NO: 39409

SEQ ID NO: 79638 - DNA, 201 bp, Bos taurus; identical to SEQ ID NO: 39410

SEQ ID NO: 79639 - DNA, 201 bp, Bos taurus; identical to SEQ ID NO: 39412

SEQ ID NO: 79640 - DNA, 201 bp, Bos taurus; identical to SEQ ID NO: 39413

SEQ ID NO: 79641 - DNA, 201 bp, Bos taurus; identical to SEQ ID NO: 39414

SEQ ID NO: 79642 - DNA, 201 bp, Bos taurus; identical to SEQ ID NO: 39415

SEQ ID NO: 79643 - DNA, 201 bp, Bos taurus; identical to SEQ ID NO: 39416

SEQ ID NO: 79644 - DNA, 201 bp, Bos taurus; identical to SEQ ID NO: 39417

SEQ ID NO: 79645 - DNA, 201 bp, Bos taurus; identical to SEQ ID NO: 39418

SEQ ID NO: 79646 - DNA, 201 bp, Bos taurus; identical to SEQ ID NO: 39419

SEQ ID NO: 79647 - DNA, 201 bp, Bos taurus; identical to SEQ ID NO: 39420

SEQ ID NO: 79648 - DNA, 201 bp, Bos taurus; identical to SEQ ID NO: 39421

SEQ ID NO: 79649 - DNA, 201 bp, Bos taurus; identical to SEQ ID NO: 39422

SEQ ID NO: 79650 - DNA, 201 bp, Bos taurus; identical to SEQ ID NO: 39423

SEQ ID NO: 79651 - DNA, 201 bp, Bos taurus; identical to SEQ ID NO: 39424

SEQ ID NO: 79652 - DNA, 201 bp, Bos taurus; identical to SEQ ID NO: 39425

SEQ ID NO: 79653 - DNA, 201 bp, Bos taurus; identical to SEQ ID NO: 39426

SEQ ID NO: 79654 - DNA, 201 bp, Bos taurus; identical to SEQ ID NO: 39427

SEQ ID NO: 79655 - DNA, 201 bp, Bos taurus
agacaaactgctaggtaattagcctataggagtgagaaggatatcagcactgtgagggaatgatgagccagaaggtttgggctaagagaaaacacaggttrgtgctaaaaagtattggtaagccatgttaaagattgggaattttatcttaaatgaaagaaaattctttgaagtattttaagacttgaaatcccagaacta

SEQ ID NO: 79656 - DNA, 201 bp, Bos taurus
tgtggcagatctctcccggaacacagatgtgctccaagctgttcccttgaagaagcaaactgctgtgtactcctccccagggtctgtctgcctgagacatsagtttctgtggtatctcccagtgtgaacacgcactagtgagctgggatgcccccgtcatgtgatctttgagaattagctctggccagcctctgttatgag

SEQ ID NO: 79657 - DNA, 201 bp, Bos taurus
atatcactgacatagcatcacaagttcttactatcttgtaaaggatctgggaatccagcaggctagccaaaattgccctggcagcactcttttgcagcatrcattttactttcaaaatgtcaacatagcgtcactctgagatttgttcatctcacaaatggcagagtcagctccttaaattaatcaacctaacttggaaga

SEQ ID NO: 79658 - DNA, 201 bp, Bos taurus
tggaaaggtcaacatttatgaaatctatcactctcccaatcctcttctttgctgaaaagctctcatacaatcgcccataaacattagctctatacagatcygctccctgtagattaagtttctggaggattttaatgactttcaaccaaatatcacaacatttagacagtgagaggtatgagttaacattcaacaaataat

SEQ ID NO: 79659 - DNA, 201 bp, Bos taurus
actgtaacccagggtggacttattgctgtcaagggggaagtttaggttgatgattcttctgagctgcccagctcagtggtttttctgttgacaatgtcagytctttcttgcagacttagtgttgtaacagagacttcagctatagaaggataatggggatctatttaatagattctctgttgggaaaaaaccctcaatctc

SEQ ID NO: 79660 - DNA, 201 bp, Bos taurus
ctttgataagcaccattagcaaacacagatggcctaacacactgaacaacctcctctgaagtcctccaatacttttccatcagctcagcaaagcgcttaamaatcctctggcctctatttcccaggtttgggttaactctttctaccctgttgcaacagccttgaataacacctttctttcctgtttaactctgtccagca

SEQ ID NO: 79661 - DNA, 201 bp, Bos taurus
ttttgatgcaatccatatcaaaataccaagtgcattttttaccaaactagaacaaataattctaaaatttgtatggttacacaagacttcaaatagctaarataatattgagaaagagaacacagctgaaggtaacatgctcctagatatcagactaaagctatactcatcaaaacagaggcacagaaagagacacagatc

SEQ ID NO: 79662 - DNA, 201 bp, Bos taurus
taagtatgaatggtattaaaagactttgtagacattgtttgatttggaaatcgtggccacttgatcactatacaatctgtcagtttccccaaagggttatrttaacagttttttccttcttttgttcatcagtgattgcagccatgaaattaaaagatgcttgctccttggaaggaaagttatgaccaacctagacagcat

SEQ ID NO: 79663 - DNA, 201 bp, Bos taurus
atatgaaatatatgatataagattgatgaacttcaaaaacatagcgctaaggaaagaagccagactcaagagaccatattttagattatttaatttatatrcaccaaccaggataagcaaatctttggtgacaggaagtagatttgtgattgccttgggctggaggttggaatagcgagtcactgaaaatggacagaaggt

SEQ ID NO: 79664 - DNA, 201 bp, Bos taurus
gctactctttctctgtgtgagaacggtaatagcttttggttatttgttgctttcaagcgtgaggaattagctttctgtatatgtttaagagagcttttaarttttctctggccgtcagatatttgaggccgagaaggaacgttttgttcttgaggggatagtgaactaaatgcaaagttatagttgcaatagttaaacttt

SEQ ID NO: 79665 - DNA, 201 bp, Bos taurus
taaaatacatatttccaggttctatcttcagaaatcctaattctatagatttacagtaaaggtgtgggatgttaaaacactcccagttaaatctgacatayatctttcgttaagaattatttctttaaagcttatttctggggcagatgtaatcattgtttactacccaaggaacaagtaagcaggaaaatgtagaaaaac

SEQ ID NO: 79666 - DNA, 201 bp, Bos taurus
gagagaaagcagtttaaaagttgatcaagttcggccaagtcacccttgctaagcttctgtttcctcagctgtaaaatgatacatatctgatagattgtttyaagaagtgatgagcaggccagtagctctgactttcattttgactctaggataattcttagattgtatctcctggcacatacaacagtgacttacatacat

SEQ ID NO: 79667 - DNA, 201 bp, Bos taurus
tacggtcattgaatggcagtgggaaatgaggctctccattgttcatccttctttaataagaaagggctgttggtggtgttgcaatgcagagaataaaaggkcagtgctttgttttttgttttggagagcagtgaagagccccacatatatctaaatggttttttaccttatttttagttgtgcttataaacacctaacagt

SEQ ID NO: 79668 - DNA, 201 bp, Bos taurus
gactccaggaggctcacaggtgggggcgctgccggccccagagtgagctcacctcctcatgcttgtgtgggcgacttgggcctcgcacagcccccacaggrctcctgacaagctctgtgtaacttgcttgctcccggtaactgcaagctccttactccctgccttcttcccctcaggcccatccacacactcatggtccac

SEQ ID NO: 79669 - DNA, 201 bp, Bos taurus
aattatttctgagcactgtacttaaattgttctatgctttgtacattcagggctctttctcccagatcgtctctagttaaagggtgctagattatgaggtrgaactctgaggggaaagcaaagctgcagaacaatcctgttttccacgaggctctatgatggggactgcagtagctttgatgtatgcggctcccagagcat

SEQ ID NO: 79670 - DNA, 201 bp, Bos taurus
aacattgtggttcctttgactttccctctggattccgtttctaaactcaacaatcctagttgctctcctggagggcacgctgtactcacactgcattctcyttgtaatttggaaactgtagggatggagtatcactttcccagtcctgttactagactgctggtaacacagcctacctaagaccacactagctttacttgg

SEQ ID NO: 79671 - DNA, 201 bp, Bos taurus
aatggggatcgatgggccagggggtgggactggggggtgggctgctgtcttaaacaagagggtcagggaagacctcctggagagggtgcctccttgaagtrgatgcaggagtgaggcctgggctggctgcaggaagagcgtccctgggtgtgacggtggccatcagggagagtagaggcctggcaggcttcagacaagaca

SEQ ID NO: 79672 - DNA, 201 bp, Bos taurus
gatcccctggaggagggcatggcaacccactccagtattcttggagaattccatggacagaggagtctggctggctacagtccatagggttgcaaagtgtsggccacgactgaagcaacttccactttatgttacgtaatctaaccttcaacaccaatcaatgctcaagctttaatggtatacactctgtgaggttcagaa

SEQ ID NO: 79673 - DNA, 201 bp, Bos taurus
ctggcactctggggtggcagtgcagggcgtcaagagcccagggggtttgggcagctgtgagccagaggctaggtaagggagaggggaaaaaaggcaaggartgtggatgaagcgtgtgcttgtgtgcttagacagtgcctgccaacattgtagacacgcagtaaatttttgttgaatgaatgaatgactaacgggtcagga

SEQ ID NO: 79674 - DNA, 201 bp, Bos taurus
tttagttatttctcatctgtctccccttgagggctacctagctcactgctgtatgtccagaagagtgattctaaaccctggccgcacgttcagatcactgrgcacttcatttatttctggttgtgctgagtcttcactggtgggcgtgggctttctttagttgtggagagcagagactactccgtgttgtggtgcccgggc

SEQ ID NO: 79675 - DNA, 201 bp, Bos taurus
atctttagtgtggatctaatcctggggacacaaatccttgtgtgggtcagtctgcaggaaactgatgtggagacctcaaagatggcaatgagaaggaaagytgacctaactctagaacaaaggagatgaagatggtgtgtctaccagatgccatggttggatcctgaatgggaaaaagtatatatttacaaaacatgtttc

SEQ ID NO: 79676 - DNA, 201 bp, Bos taurus
attcagaccctagtgactcttcatcggaaatgtttttgacagaatctaaggatgagaggaagcatagaacttagaattaggcagacttttttgatcttctsagatcttaggaaagagacattgtgtgtctaaattacagctgtctttcagggactgtttagttaagcatctacgatgtgcagcaccctgggaatccatcag

SEQ ID NO: 79677 - DNA, 201 bp, Bos taurus
taatacttttttctttttaggggaatactagatgccacccacttaattgatttcacaatcccatccactaatgggcctcatccaacagttgaaaaaaagcygtagaacaggtcaaatggggcattttctcttagtaaacaattgtgggccttgaggcctgctagctgagtggggccagatcagatgtccaaaccagatgtg

SEQ ID NO: 79678 - DNA, 201 bp, Bos taurus
ccactggaccgctagggaagtcctctgttttgtttttaattatctttttgtgtgtgtgtctgtaagcttgtttcagttattgatactttttgacaattacrcatttggaattttctagaactgtctcagagaaggcaatggcaccccattccagtacttttgcctggaaaatcccatggacggaggagcctggctgcagtc

SEQ ID NO: 79679 - DNA, 201 bp, Bos taurus
gtcttgaatgttcccgttggcatcttcatcttcacctgtagtcagaactccaagctgtcactcactctggcatcagctgctgctccttggcccaagtcttrtggctgccacagtgtggagacacagtcccagtgaccttctctggcttctgctctgctgatgcagctgtcagaagattttccttaaagtcccccagggcct

SEQ ID NO: 79680 - DNA, 201 bp, Bos taurus
agggcccgagagggcctcggttactcaaatcctcccttggctgttagagaaagcaagtttcagagacttaaaggctttggtctctgggcgcattgggggtrgaaccaggagctcaggcctggtcagtaccgtaggggtttgggctttgcctggagtgggaacagacatttgccccgctctgtgctcccgtccttgtatggt

SEQ ID NO: 79681 - DNA, 201 bp, Bos taurus
gaaaagctgggcacacacggctgcctacatggcctggttcctaaaaccaagaaaaaggaaagtgagattttccttggctccacgtctgattcccaaatgcmgtggggcggggcctcccacctcgagaaaactcccaccctgggggtcccatgttctctgcttggagggtggccctaatggctcgccaccagcagaatgccc

SEQ ID NO: 79682 - DNA, 201 bp, Bos taurus
tcctccatgcagccttcttggattccctctgctaacagaaaccatccttcctctaattcccagggcatgatatttgtgcgtgtctttggctggagttccaycgggccatggtatcacctccctgtcagtccctaagtcagctctggagggccgtcccctaatacggcttctccttacctgctcctccagtaaagggggcag

SEQ ID NO: 79683 - DNA, 201 bp, Bos taurus
ggagacacagaggacctggagggtgcagggcaggagtgaaagagggaaaagtattccgtgtatgagaagcgggtcatggccggaggcaggaacgaggatgragggagagcgcgggggagactgacagacaggcacagggctctgaaccaaagcagatggccgggtcctccctgtgtctggatgcagctgctgtgtctccag
